United States Patent 10,858,665 (ISOLATED POLYNUCLEOTIDES, POLYPEPTIDES AND METHODS OF USING SAME FOR INCREASING ABIOTIC STRESS TOLERANCE, BIOMASS AND YIELD OF PLANTS) - sequence listing, part 2

SEQ ID NO: 1359 - DNA, 1022 bp, Elaeis guineensis
ctccaagtcctcttcctcctagaacggaaaaataaaagagcggcgtctccagatccgatcaccgcctctcaacccccgcgccttcgaagatgtctggtttcagcggtgacgagacagcgcccttcttcggcttccttggcgccgcggccgccctcgtcttctcctgtatgggggcggcgtacgggacggcgaagagtggagtgggggtggcctcgatgggggtgatgaggccggagctggtgatgaagtcgatcgtgccggtggtcatggcgggagttctggggatatacggcctcatcatcgcggtcatcatcagcaccggtatcaaccctaaggcgaagtcctactacctcttcgacggatatgcccacctttcatccggcctcgcctgcggtctcgccggcctctccgccggcatggccatcggcatcgtcggcgacgccggcgtcagagccaatgcacagcagcccaaactctttgttggaatgatcctcatcctcatctttgccgaagcactggccctgtatggcctcattgttggtatcattctgtcatctcgtgcaggccaatctagagcagactaggtcatcagtaaaaagaggacagagaatcatgcttggtaggcttgtttgacaagttagatccttatctgcctccgagtcatagaaggtttgcaattcttcatgtgcttgtattctcgtgaaattttgaattggtcatattctatttagtgattagtctttgagcacaatggggatgaatatgtatgccaataaagataacatggctgttactttttgggctgcagcatttgaattagcgcttcagctattgtgaaaactaccaatgtaaacttggtccaatttttttgcttggtgacctaaatttctttattttgtttcatcgtcatgttatctcattttgttagcttcggtgctgattcatggtgttggtgttgtctgctcagaggtagaatggggtctatgatacgcttgttgcattggaatattttttggatttac

SEQ ID NO: 1360 - DNA, 1158 bp, Elaeis guineensis
catccatctcggactattgtgataaaacgtgtaaatcagacaatctccgggtgctccctccgatcaccggaagccattcattctcttccattcgacgccccctctccattctacacccattccccaattgtttcctttcttcttcgccgaaaattctatatattctgagattagggtttcgaagatcctgaataggtgttggattttgacagatatctagggttccactgatatctccgacgatgtcgagcttcagcggcgaccaaaccgcccccttcttcggatttctcggcgccgcggccgccctcgtcttctcctgcatgggggcagcgtatgggacggcgaagagcggggtgggggtggcgtccatgggggtgatgcggccggagctggtgatgaagtcgatcgtgcctgtggtcatggctggagtgcttgggatctacgggttgatcatagccgtgatcattagcaccggtatcaaccctaaggccaagtcgtattacctcttcgatggctacgctcatctttcctccgggctggcttgtggccttgccgggctctctgcgggcatggctatcggcatcgttggcgatgctggagtccgggccaacgcacagcagccaaaactttttgtgggcatgattctcattctcatttttgctgaagcacttgccctttatggtctcattgttggcatcatcctttcctctcgagctggccagtctcgggcggactaagatgcaagtctcgggcggactaagatgcaagcagatgattataaatcatcctgcgggccattgtaataattatattgaatgtgattccattgtgatttgcattgctagatgttacaaaagatccttctgttttgtgatctggcatctatattaaatttatcgattgtcatgcaagcaaacagttgcttgagtctctcagctgtttggctgctgctttgaggtgttggaaacgttcattttgtaatgaatggatacaatgatttggtctgcatgagtcgcctttaaatgttgacattagtgtttttgggtgtgtgcttatgtcccatgcgagagcttcccttgttcatacctacaggtgtaacatgttcacagtttgggatacgggaaatttatgatgttcctggcaaaaaaaaaaaaaaaa

SEQ ID NO: 1361 - DNA, 876 bp, Elaeis guineensis
cggaaaaataaaagagcggcgtctccagatccgatcaccgcctctcaacccccgcgccttcgaagatgtctggtttcagcggtgacgagacagcgcccttcttcggcttccttggcgccgcggccgccctcgtcttctcctgtatgggggcggcgtacgggacggcgaagagtggagtgggggtggcctcgatgggggtgatgaggccggagctggtgatgaagtcgatcgtgccggtggtcatggcgggagttctggggatatacggcctcatcatcgcggtcatcatcagcaccggtatcaaccctaaggcgaagtcctactacctcttcgacggatatgcccacctttcatccggcctcgcctgcggtctcgccggcctctccgccggcatggccatcggcatcgtcggcgacgccggcgtcagagccaatgcacagcagcccaaactctttgttggaatgatcctcatcctcatctttgccgaagcactggccctgtatggcctcattgttggtatcattctgtcatctcgtgcaggccaatctagagcagactaggtcatcagtaaaaagaggacagagaatcatgcttggtaggcttgtttgacaagttagatccttatctgcctccgagtcatagaaggtttgcaattcttcatgtgcttgtattctcgtgaaattttgaattggtcatattctatttagtgattagtctttgagcacaatggggatgaatatgtatgccaataaagataacatggctgttactttttgggctgcagcatttgaattagcgcttcagctattgtgaaaactaccaatgtaaacttggtccaattttttgcttggtgacctaaatttctttattttgttt

SEQ ID NO: 1362 - DNA, 1288 bp, Citrus sinensis
ccagctccgagaccccgatcgatctcatcgtcgcgcatttccacatctctcacgagagacaaagtaatcaaagctaatcgggagcagaattctgtgctatccgggaattacttaaaacttgcgattacgactactcagatcttcgtagcaaacaggcaaaatcatcatcatcatcgccatgtcatcgactttctccggcgacgaaactgctcccttcttcggcttccttggagcagcggccgctctcgtcttctcctgtatgggtgctgcctatgggacagcaaagagtggggttggcgtggcttcaatgggtgtcatgaggccggagcttgttatgaaatcgattgttccagtggttatggctggagttttgggtatttatgggttgattattgctgttattattagtactgggatcaaccctaaagctaagtcttattatttgtttgacgggtatgcacatttgtcttcggggcttgcttgtggtcttgctggactctctgctgggatggctattggaattgttggtgatgcgggagttagggctaacgcacagcagcctaagttgtttgtgggaatgattcttattctcatctttgccgaagctctcgctctttatggtctcatcgtgggaatcatcctctcatctcgagcaggccaatctcgggcagaataaaagaaaaggcttggttttcctttggattagtgaaagcagaatatacatttcaaatgatgtctacacactacacagtgaagcattaagcatagacccacaggtttgtattgaaaaagagcatatcagctgctcagattgcagcttctctgacatcagtaatgtccataaaatgcatttacctcattcttttgttcaaaagggcaattgttcagtcggtatgaagagatatgatgtaatttgagtagctacagagtcaaaaggaatctccattccaatgaagtactgattttgttaataatgatacatggaccatcgacctttttacatgtgaggaatgttaggagtcgccgtgttgttgaaaattgaaagcgcctcaaactcactaatgatttgagtatttgttgcacttggagctttgatgtaaatgatcccggtctgtactgtgtagcctttttaaataagtgccagttgtattaagctttctccgccattctggtaacgatgattgttaattcttaaatctacgacacaaggacataaacttcaaatatgctacatattgtacagttataaattccgaatacagtatcacaatcttacatttgcattcat

SEQ ID NO: 1363 - DNA, 1139 bp, Citrus sinensis
aatctcgatacggaaaagagtcgaggggtaattaatttttagaagtcattagtctcctcttgagagaaagagcacggaacaaataacgaaaacaaaacacacgctcaagtctcagatccagtccgcatctcccaagatgtcttcaacattattcagtggcgatgaaaccgctcctttcttcggctttctcggcgccgctgccgccctagtcttttcctgtatgggagctgcgtacggaacggcgaagagtggcgtcggtgtggcgtcgatgggagtgatgaggccggagcttgtgatgaaatcgatcgtgcccgttgttatggcgggagttttgggtatttacggtttgattattgctgttattattagtaccggaattaaccctaaggccaaatcttattaccttttcgatggctacgcgcatctctcttctggcctcgcttgtggccttgctggtctctccgctggtatggcaattgggatcgtcggtgatgctggtgtcagagccaatgctcaacagccgaagcttttcgttgggatgatcctcattctgatctttgctgaagcgctggcactttatggacttattgttggtatcattctttcttctcgtgctggtcagtcaagagcagactagaagaggatgctttgcttggtggttatttggcctgttgtgttccattaagaagaattcagttcatattgcctgtgacgggaggtggtagtctgcgttgggtagtgtttttctttttcgacttaaaagttattgtctgtggtgtgattgttcaaccagattgattcgatttttaatggtgatggagaatgtagaattaggaattagcttctcccattaataaagtcatgctgtcattgtttagtttaatgttaaaatgctgtattttttgggatccatttataggttgttgataccctaataatcgcttgtaatgttttctgagactctctctacttgatctccagttttgtaaagccaaaattgtgttgtgggtcaataagtcagaatctgatttctgtttggcagtccaggctaaaaaacgagttgtggtgacaaaatgtaagagtgatttataatatttgtattgggaggtttatattaataattaagcctattatttgga

SEQ ID NO: 1364 - DNA, 995 bp, Carica papaya
gcttcttgcttggctggcttgtctgaaacataaccagagagatcaaacaccaaaaaatctctctgcgaaacgtgaacgcgcgagctttcagtttccagatctaaacgacgttgctttagatccaccatcttcaatggcctcttcattcagtggcgatgaaactgcacctttcttcggtttccttggtgcagcggctgcactcgtcttctcctgtatgggagctgcttatggaacagcaaagagtggtgttggtgtggcttccatgggtgtgatgaggcctgagctggtgatgaagtcaattgttccagttgttatggctggtgttttgggtatttatgggctgattattgctgttattatcagtactggaattaacccaaaggctaaatcttattacctttttgatggttatgcacatctctcatctggtcttgcttgtggtcttgctgggctttctgctggcatggccattgggattgttggtgatgctggtgtaagagctaatgcacagcagccaaaactttttgttgggatgattcttatcctcatttttgctgaagctcttgcactttatggccttattgttggcatcatcttatcttctcgagctggtcaatctagggcagactgagaaggaagtgatggctcttgatactcttccatcttgtctatttgtctcactcatgaggaaagagttttagcaattctctgattagtcgatgtggactgcatttgcagggttctcaagatttttcatggaggtaatattcctctgccattcatttggtggttcctctgtcctgtttgtagcattaggattgagtttctttgcttaataaaaggttggaatttgaaaatccatctgttcagattcatcttatagtgtattttgcagaagtaatatctcttggtgggagtttgatacttgaaccattgcatgtatgagatcttattaattgatttgcttgtatcttcaagtttacttatctgttgtt

SEQ ID NO: 1365 - DNA, 1087 bp, Pinus taeda
taatgctctgagattgcatctggatcgggctaggcacttgcaggttccagcttcgaggttcgatctctttggaggctctgaaactctgaaaaaccttcgaagttctagggagaatctcgtcccagatctcagttaaaatggtggacgtattcagcggcgatgagactgctccattcttcggcttccttggggccgccgcagcgctcgtgttctcctgcatgggagctgcatatgggactgcgaagagtggcgtgggcgtggcctccatgggtgtgatgaggccggagcttgtgatgaaatcgattgttccagtcgtcatggctggagtgttgggtatttatggtttgattattgctgtgattatcagcacaggaattaaccccaaggcaaagtcctattatctatttgatggttacgcgcatctgtcatcgggactggcttgcgggctctcgggtcttgctgcgggaatggctattggtattgttggtgatgcaggtgtcagagcaaatgcacagcagccaaagctatttgttggtatgatcctcatattgatctttgcagaagcacttgcactctatggccttatagttggtattatactttcttctcgagctggccagtcacgagcagattaaagaagttgcagttggtcttctgtttacttggttcatttgtaagctttttagcaaagactgctgtcttctgcagtggaaatgtgattgttgtttccagtaggagataatattttgctcaagattcattattattctcttggtttggaattttagacttaagaatttagtgatcaatttgaaagctcattacaatgtggaaattgaaccagttaacaagtgcacgttactgctggtgtcatttggcacgttatgaatttgaaatcagtcgtatgattctacttttttagctacttaatttgctgcagattactatagatacctccccctttttggtctctgctgttgatatattgaaattagaacaaaaataatgaatgaagaaaactgattaaaactccgcttttcattgcgaagatggaaaagcatgggagtatatcttggttaaaaaagaa

SEQ ID NO: 1366 - DNA, 772 bp, Populus trichocarpa
caataacttccttcgccacgaagctctctccagtttctcttattattagaaagtaaataaataagttaattaattaacacaagagctctagattcaattgtcctctccaaatctcgtcaaaatccaaaaacaacatgtcttcaacattcagtggagatgaaactgcgccgttcttcggattccttggcgctgctgccgccctcgttttctcctgcatgggagctgcttacggtaccgcgaagagtggagttggcgttgcatcaatgggtgtgatgcgaccagagctcgtgatgaaatccatagtcccggtcgttatggctggagttttgggtatatacggtctgattattgccgtgattatcagtactggtattaacccgaaggcaaaatcctattatctgttcgatggatatgctcatctttcttctggtctcgcctgtggcctcgctggtctctctgctggtatggctattggcatcgttggtgatgctggtgttagagctaatgcccagcaaccaaagctttttgttggtatgatcctcattctcatctttgctgaagcactggccctttacggtctcattgttggcatcattctctcctcccgagctggtcaatcgagagctgagtaaagagtccctctgcttggtgtctgtatggctgttgtgattcatctttgttagtttaacttaaaaagtgttttgtactaaaaaaattcatgtctgacttcagtgccattgcttatatgataaaaatgtagaattggttattg

SEQ ID NO: 1367 - DNA, 1224 bp, Populus trichocarpa
caataacttccttcgccacgaagctctctccagtttctcttattattagaaaataaataaataagttaattaattaacacaagagctctagattcaattgtcctctccaaaactcgtcaaaatccaaaaacaaaatgtcttcaacattcagtggcgatgaaactgcgccgttcttcggattccttggcgctgctgccgccctcgttttctcctgcatgggagctgcttacggtaccgcgaagagtggagttggcgttgcatcaatgggtgtgatgcgaccagagctcgtgatgaaatccatagtcccggtcgttatggctggagttttgggtatatacggtctgattattgccgtgattatcagtactggtattaacccgaaggcaaaatcctattatctgttcgatggatatgctcatctttcttctggtctcgcctgtggcctcgctggtctctctgctggtatggctattggcatcgttggtgatgctggtgttagagctaatgcccagcaaccaaagctttttgttggtatgatcctcattctcatctttgctgaagcactggccctttacggtctcattgttggcatcattctctcctcccgagctggtcaatcgagagctgagtaaagagtccctctgcttggtgtctgtatggctgttgtgattcatctttgttagtttaacttaaaaagtgttttgtactaaaaaaattcatgtctgacttaagtgccattgcttatatgataaaaatgtagaattggttattagctcttcccttgataaattctcattgtttaattaatcgatgtatgttatggtcacttcaaattcttgttgaaaggatgccatattgcctggtttgctgatcctgcactctcccgctgtggtgaaggatccagattgaccttgccatccatctgtaactgccttgaaatatgtttttctgccgggattaatagtctagtctatacgctggtattttggccccctccatttcatcaaatggtttgcgtgtgtagagctgctggggtcgcaagtttgagcgctggtggggtgggtgcatgtattttctgaattgtgttgatttttttttccaaaaaaaaagaaagatgtatgacatgtcgtttgtccatttaatgaaaataaataaatagagcaaggccaggcatgtgtggcttgctcccgtgggctttacactaggcacgatccttttcttcct

SEQ ID NO: 1368 - DNA, 775 bp, Primula obconica
aaaatgtcaagcttcagcggcgacgaaactgctcctttcttcggcttcctcggcgccgccgccgcccttgtcttctcctgtatgggagcggcgtatggaaccgcaaagagcggtgttggggtggcgtcgatgggtgtgatgaggccggagctggtgatgaagtcgatagtgccggtggttatggctggagtgttgggtatatatggacttatcatagctgtcattattagcactggtattaaccccaaggccaagtcttattacctctttgatggttatgctcacctctcatcgggccttgcttgcggtctggcgggtctctcggctgggatggctattgggatcgtcggagatgctggcgtcagagctaatgcacaacagcctaagctttttgttgggatgattcttatcctcatctttgctgaggcattggctttatatggactaattgttgggattatcctttcatctcgcgctggccagtctagggcagagtagacttaaacatgaccctcgtgaattcatctttaggggcaccgtgctattgagtactaaagctagtttgaacattttcttaaaattcttctgtattgtcaacaattttcttgtcgcgtgtaattgttagtctggtgtttagccatacgaggtgatctaaaataaagctgtgtaaaaagctccttattcggtacatgtggatcgtgttatgctttgtgcaaattttacagctcgttacttgttgtcaagttggtgtggcttaagagttcatatttttctt

SEQ ID NO: 1369 - DNA, 695 bp, Pteridium aquilinum
gagatcaaaaactctctccagcacaacacaaagcactttctgactccttttcctcagatctaaacgacattgtctcagatccactgactccacgatgtcttctactttcagcggcgatgaaacggcaccgttcttcggcttcctcggtgccgctgctgctctcgtcttctcctgtatgggagctgcgtatgggacagctaagagtggtgttggtgtggcatcgatgggtgtgatgaggcctgagttggttatgaaatctattgtaccagttgttatggctggtgttttgggtatttatggattgattattgctgttattattagtactgggatcaatcctaaggccaaatcatattaccttttcgatggttacgctcacctttcctctggtcttgcttgtggccttgctgggctttctgctggaatggcaattggaattgtcggtgatgctggtgtcagagcgaatgcacaacagccaaaactttttgttggaatgatccttatcctcatttttgctgaagctttggctctttatggacttatcgtaggcatcatcttgtcttcacgagctggccaatccagagcagaataggatgctcatcgagctgcttagtattctttgattgcttatctgtagcattgtacgggaaagagtattgattatgctcagggtaaattgtgattggacagcatgt

SEQ ID NO: 1370 - DNA, 1006 bp, Oryza sativa
caagttgaagcattgagccccgtagtctccgccacatatctctttccttcttcctcacccccaccaccacctcttctctttcccccaccaacaccaaccccacgcgaccacccccaatcctcgatcaaacgccctaggatttcatcgcaagcaaggaaggaggagaccaaatccaatccaatcccccatggccggcgcgtcgaccttcagtggcgacgagacggcgcccttcttcggcttcctgggcgccgcggcggcgctcgtcttctcctgcatgggcgccgcctacggcacggccaagagcggcgtcggggtggcgtccatgggcgtcatgcgcccggagctcgtcatgaaatccatcgtgcccgtcgtcatggccggggtgctcgggatctacggcctcatcatcgccgtcatcatcagcaccgggatcaaccccaaggccaagccctacttcctcttcgacggctacgcgcacctctcctccggcctcgcgtgcggcctcgccggcctcgccgccgggatggccatcggcatcgtcggcgacgccggcgtcagggcaaatgctcaacagccaaaactgtttgtgggtatgatcctcatccttatctttgcggaagcgcttgcactctatggtctcattgttggtatcatcttgtcatctcgtgctggtcaatcccgagcggactaatttatcaggctataatgcctgtaacacttgtctgtcatgaatataatggcatgtcaatattcttttgctgtatctttgtggttacgtactgttgttcagactacgttttcttttgcttatttttgagatagtacaaccaacttataattttgactcaccccagagccatggctacatttgttgcatgggaacatggacttatatggtgctagacgatttggtgaataaacaacaaatttttgtactgaatatttatcacttgtgctatggacacatcgcttgccccaatagaggattgcaggactgtttgtgtgt

SEQ ID NO: 1371 - DNA, 722 bp, Rosa hybrid cultivar
caaatctcagagccaatcccaaaaaaatgtcatccaccaccttcagcggagatgaaacggcaccgttcttcggcttcctcggcgccgccgccgccctagttttctcctgtatgggcgcggcttacggaacggcgaagagcggcgtcggagtggcgtcgatgggcgtgatgaggccggagctggtgatgaagtcgattgtgccggtggttatggcgggagtgttgggtatttatggtttgatcattgctgtgatcataagtacggggattaatccaaaggccaagtcttattatctttttgacggctatgcacatctctcttccggtcttgcttgcggcctcgccggcctttctgccggaatggccatcgggatcgttggtgatgccggtgttagagctaatgcacagcagccaaagctttttgttggaatgatcctcattctcatttttgctgaagcgttggctctgtatggtctgatcgttggtatcatcctttcatcccgagctgggcagtccagagcagattagaggtgccattcgggccggcttctgatgcgagtgtgatttgcatcttcggtgactcactggttgaagatgttcattcagtgtgtagtgttcagtgtgcagtcttgtgttatgttattcagtcttgcataggtgggaagaaatatccttgtctttttgtaggattggtgatttgtcttggaaataaagcttttcttc

SEQ ID NO: 1372 - DNA, 1094 bp, Sarracenia psittacina
agataggaacggacacgacatctcttcccggatagaaaaccagaagaatttcaaatcagattgatcttcctgcaaatcaaaatcctcaaatccgaacaagaaatatgtcttcaacgttcagcggcgatgaaacggcgccgttcttcggcttcctcggcgctgcagctgccttggtcttctcctgtatgggtgcggcgtatgggacggcgaagagtggggttggagtggcgtcgatgggcgtgatgaggccggagctggtgatgaagtcgatcgtgccggtggttatggccggagttttgggaatctatggattgattattgctgtgatcatcagcactgggattaaccctaaggccaagtcttattatctttttgacggatacgctcatctgtcgtctggtcttgcttgtggcctcgctggcctttctgctggtatggcaattggcattgtgggcgatgccggtgttagagccaatgctcagcagccaaaactttttgttgggatgatcctcattctcatatttgctgaagcgcttgctctctatggcctcatcgtcggcattatcctctcttctcgagctggtcaatcaagagcagcctaaacaggtgattctgcttggtgctggtggtgattgttactatttattaagaattatcatgatgttctctctggtagaaatggtaattcagctgaggagatgtcttttcctacaaattcttttttatcatttgccattgctcagtctggtgagttgggtggttgctctgtgtgctaatggtagagtgtatattagctgcgacttctctccttgaataacattcgtctgcttctttttacagatgcactgtttcacaaaccagtttgatttttttcccccctggaattattgtttttattgtttctgctgtttcatttacttcctttttcatgtcatccccatccaaagatagatatctggtatgattggttcaaaacttggtaattgctgcatacattgtttggtcattttgggacttttttaacatgttatctacaagattgtcctggtgattgctaatgctgatataagaatgttgtcttttgttgtgtgtgg

SEQ ID NO: 1373 - DNA, 821 bp, Sarracenia psittacina
attcgtcgcaggaaattccatcatgtcttcgacattcagcggagatgaaaccgctcctttcttcgggtttctcggcgctgctgctgccctcgtcttctcctgtatgggagctgcctatgggacggcgaagagtggtgttggtgtggcgtcgatgggtgtgatgaggccagaactggtgatgaagtcaattgttccggttgttatggccggtgtgttgggtatttatggcttgatcattgctgttatcatcagtactgggattaaccccaaagccgagtcatattatttgtttgatggttatgcacatctttcttctggactcgcttgcggtctcgctgggctttctgctggaatggcgattgggattgttggtgatgccggtgttagagctaatgcgcagcagccaaaactttttgttggaatgatactcattctcatctttgctgaagccctggcgctctatggcctcattgtcggtatcatattgtcttctcgagctggtcaatccagagcagactgagaagagggtttgacgaaattgttaaatcttcttacgggcagaacagcactttcgtggttcttcaaattcttcagtcttaaagtaattaccctatccctaatacatttattttgtcgctgctcagtgctgtttttagtttaggcttttaagtatatctggagactaaaaagctcatgatacttcctgtttggttttatctattcattgaatctgacattacaacttcaaaaactgtgtagagattcttatcttggaactagtgtgtgtattattattatttatgaattatggattccactgc

SEQ ID NO: 1374 - DNA, 612 bp, Euphorbia esula
  misc_feature (6)..(7): n is a, c, g, or t
  misc_feature (10)..(11): n is a, c, g, or t
  misc_feature (404)..(404): n is a, c, g, or t
cgcaanntcnnagagagagagagagagagagcgaaaaagcttcagatctgatcggagatcttcatcttctttgtccgaccggtaaaaatgtcgtcaacgttcagcggtgatgaaacggcacccttctttggctttctcggtgccgctgcggcccttgttttctcttgtatgggagccgcttacgggacggcaaagagcggggttggtgtggcgtcaatgggagttatgaggccggaattggtgatgaagtcgattgttccggtggttatggcaggagttttgggtatttatggtttgattattgctgtgattattagtacgggaattaaccctaaggctaaatcttattacctcttcgatggctacgcccatctctcctctggtcttgcttgcggcctcgccgntctctctgctggcatggctattggcatcgtcggcgatgcgggcgttagggccaatgcacaacaacctaagctttttgttgggatgattctcattctaattttcgccgaagcacttgctctttatggacttattgttggtattattctctcttctcgagctggtcagtcaagagctgattaagtgaatgttttgcgcttggaatttgtg

SEQ ID NO: 1375 - DNA, 874 bp, Saccharum officinarum
gtactggctgcgagcaggtaccggtccggaatcccgggcagaaacaagaaagaagaaacgcggaggcacgcacatccaagccaagccaagccaagaagctgcgtcgtggcctgaccctgaccccgtccctcctctccggccggcgagagcaacaagagatcccggcgacgtcctctcctccacctccatctccacccatggcgacctccaccttcagcggcgacgagacggcgcccttcttcggcttcctcggcgccgccgccgcgctcgtcttctcctgcatgggcgccgcctacgggacggccaagagcggcgtcggcgtggcctccatgggcgtcatgcgccccgagctcgtcatgaagtccatcgtccccgtcgtcatggccggagtgctcggcatctacggcctcatcatcgccgtcatcatctccaccgggatcaaccccaaggccaagccctactacctcttcgacggctacgcgcacctctcctccggactcgcatgcggcctcgcggggctcgccgccggcatggccatcggcatcgtcggagacgccggagtcagggcgaatgcacagcagccaaagttgtttgtgggcatgattctgattctcatcttcgcagaagctcttgctctgtatggtctcatcgttggtatcatcctctcatcccgtgctggccaatctcgcgccgattagaaggcttgatatatggcacacgagtcatcagccattgtattcaaagtgttcctttctcggtgaacattggagggatcatgttgagcctgttccacctttgaatattatattactattctgcaaagacaaacctagctagcgcatgtagttgtgctgttgtatttatttgaaataat

SEQ ID NO: 1376 - DNA, 746 bp, Helianthus annuus
taaatcaacaaccgacgatgtcttcgacgttctccggcgacgaaactgctccgtttttcggcttcctcggcgccgctgctgcgttggtcttctcttgtatgggagcagcctatgggacggccaagagtggcgttggagtggcttcaatgggagtgatgaggccagagttagtaatgaagtcaattgtgccggtagttatggctggagtgttgggtatttacggtctgattattgccgtgattattagtactgggattaaccctaaggccaagtcttattatctgtttgacggatacgctcatctttcttctggccttgcttgtggtctggctggtctttctgctggtatggccattggaatcgtcggtgatgctggtgttagggctaatgcacaacaacctaaacttttcgttggaatgatcttgattctcatttttgctgaagctttggccctctacggtcttattgctggcatcattctttcttctcgagctggccaatccagagcggattagaatcgttgatcgtgggtctcacgagtgccttaaattgatcaatattcttcctcaggtatggtttgatttacctttctttggtgtagcttgtagactagattcttgcactcccttcaataaagtcatcttgatgctttttttttttgcaaaaataagtcttgggacatgtcaagatctggaaatcatggattgtgatctatttgtgctgtacaagttataataacatttttt

SEQ ID NO: 1377 - DNA, 1156 bp, Panicum virgatum
cggacgcaggggcaaaatcgtccacatcacaaatctccccatccccccacccctcgcaacgccgtggccctctcgtcttcttccccaccccacccccgagctcctcagatcagatcggcgaaagcccaaatcccaagcagaggagcgaaatctcgagcgctcgtgccggcgaagaccacgagaaggaggccgcggcacgagagctccccaggcatctgtttctcttcgcagcaccagcggcatcggcgtcagcagcggcagcaagagggagatgtctgcgttcagcggcgatgagaccgcccccttcttcggcttcctcggcgccgccgccgcgctcatcttctcatgcatgggggcggcgtacgggacagccaagagtggcgtaggcgtagcgtccatgggtgtcatgcgccctgagctcgtcatgaagtccatcgtgcccgtggtcatggctggtgtgctcggtatctacggcctcatcattgccgtcatcatcagtactgggatcaaccccaaggccaagccatactacctcttcgacggctatgcccacctgtcgtctggcctagcctgtggtcttgctgggcttgccgccggcatggccattggcattgtcggtgatgctggtgtgagggctaacgctcagcaacctaagctgttcgtgggcatgatcctcatcctcatttttgccgaagcacttgccctctacggtcttatcgtcggcatcatcctctcatcccgcgccggccagtcccgtgcagactaggcacgttccagatgtcgataccatgcctggccctggctgggccctgttttatattcatgagacaagaagctggagctctttagagggttattttaattctgtctagttttcgctcttctgtttgggtctgagaaaaaaaacgtgtgcagccaagggaggacttccccttgtggtgccgatgccattctttctccagtctgtggtggtggtggtgggctgtggtcgatgctcattatttatgcacagtttcttctttttgttggggtgtggtatggctggacggcgttgtaatctggtgaataagaataagcaagggcatgcgatgcgactgagtgtcgaggacaccttttgttcatctgtttcgttcttgtgatggtgatgttatgacta

SEQ ID NO: 1378 - DNA, 1006 bp, Panicum virgatum
ccacccccgagctcctcagatcagatcggcgaaagcccaaatcccgagcagaggagcgaaatctcaagcgctcgtgccggcgaagaccacgagaaggaggccgcggcacgagagctccccaggcatctgtttctcttcgcagcaccagcggcatcggcgtcagcagcggcagcaagatggagatgtctgcgttcagcggcgatgagaccgcccccttcttcggcttcctcggcgccgccgccgcgctcatcttctcatgcatgggggcggcgtacgggacagccaagagtggcgtaggcgtagcgtccatgggtgtcatgcgccctgagctcgtcatgaagtccatcgtgcccgtggtcatggctggtgtgctcggtatctacggcctcattattgccgtcatcatcagtactgggatcaaccccaaggccaagccatactacctcttcgacggctatgcccacctgtcgtctggcctagcctgtggtcttgctgggcttgccgccggcatggccattggcattgtcggtgatgctggtgtgagggctaacgctcagcaacctaagctgttcgtgggcatgatcctcatcctcatttttgccgaagcactcgccctctatggtcttatcgtcggcatcatcctctcatcccgcgccggccagtcccgtgcagactaggcgcgttccagatgtcgataccatgcctggccctggccgggccctgttttatattcatgagacaagaagctggagctctttagagggttattttaattctgtctagttttcgctcttctgtttgggtctgagaaaaaaaacgtgtgcagccaagggaggacttccccttgtggtgccgatgccattctttctccagtatgtggtggtggtggtgggctgtggtcgatgctcattattctggactaattatgagttgattaacagggcacatcggtgaactgacgtggctaataaaaagattatgagcatatcatcacgtggggtatggt

SEQ ID NO: 1379 - DNA, 956 bp, Tabernaemontana elegans
ctacatccgtctatacttccacacaagggggagacacgcagctccaggagagatctaattactgccttgtcgcaactccataattctctgtagccttatcattcacgctcaaatctcagatccaattcggaacaatgtcttcaaccttcagcggcgatgaaactgctccctttttcggctttctcggggctgccgctgccctcgtcttctcctgtatgggggccgcgtatggaacggctaagagcggagtaggagtggcatcgatgggagtgatgaggccggagcttgtgatgaagtccattgttccggtggttatggctggtgtgttgggtatttacggtcttattattgctgttattatcagtactggaattaaccccaagacaaaggcgtattacctttttgatggctacgcacatctctcctccggtcttgcttgtggtctcgctgggctttctgctggtatggccattgggatcgtgggtgacgctggtgttagagccaatgcacagcagccaaagctctttgttggaatgatccttattcttatttttgccgaagctttggcgctttatggccttattgtgggaattattttatcttcacgagctggccagtcaagagcagactaagaacgagaaaactagtgatgacattctgttatgttgccccaatggcacggtatcatctgggtaaactgaaggaaatgaaatttggtcttatttgtttagcattgctctttagggtgcgtcggtttcagttgggaagcaaatgttcaaccatattttatttgatggcgcttagtgatctttgtagtagtagtgatgaggttttttctgctcaataaagctttatggagctatttttctcgagtttaaactgttattttcttttgaaattatattgtctatgtagtacttacttggatatggtttatttgtgatataaaatctccc

SEQ ID NO: 1380 - DNA, 881 bp, Tabernaemontana elegans
ggacagtcagcagagaaaaagccacgtccgacgcgaaatctactattctctccgccgagccgtgaaatctctcagatcctttctcttcatccttctctctccgcagatccaatctgaagatgtcctcaaccttcagcggcgatgagacggcaccgtttttcggcttcctcggcgctgccgccgccttagtcttctcctgcatgggagcagcatatgggacagctaagagtggcgtaggggtggcatctatgggtgtgatgaggcccgagctggtgatgaagtcgattgttccagtggttatggctggagttttgggtatttatggattaattattgctgtgattatcagtactggaatcaaccctaagactaaggcttactacctctttgatggttatgctcatctctcttccggtcttgcttgtggtctcgctggtctttctgctggtatggcaattggaattgtcggagatgctggtgttagggccaatgctcaacaacccaagctttttgttggtatgattcttattctcatttttgccgaagctctggcactttatggccttattgtcggcatcatcctctcttctcgagctggacaatcaagagcagattagaaaaggagcatattcagcgctattgtgtcaatgattgagaactattattattttcttcctgattagagatggttgtctattcgcggaagttccttgttccaagctttcatacgcacaacaccatcagttcaaagaattgttctgattttagcatgtagatttaagatttcatttttttccccagaataagatcctctgctggtatttgattaggtgcaccatgtttgagagagaaaaccagattaaaccatgtaaaacttttgt

SEQ ID NO: 1381 - DNA, 997 bp, Tabernaemontana elegans
agcgacccaagctagcaaagagaatagtcaaagatcaaaaaacaccatcgttgcagagagagagagagagaaaatccccaaatatcttcctaatccagagagctatttgacaaatttttggatcggtcgctcaaaatcctcgtaaaagagaatagaaagatcctagagatgtcttcgattttcagcggcgatgaaactgctccgttcttcggcttcctcggagctgctgctgcactcgttttctcctgtatgggagctgcatatgggaccgctaagagtggggtgggagttgcgtcgatgggagtgatgcggccggagctggtgatgaaatcaattgttccagttgttatggctggtgtgttgggtatttacggtttgattattgctgtcattattagtactggaattaaccctaagacgaaagcatattatctctttgatggatatgcacatctctcttctggcttggcttgtggtcttgcggggctttccgctggaatggcgatcgggattgttggtgatgctggtgtcagagcaaatgcacaacagccaaagcttttcgttggtatgattctcatcctcatctttgctgaggcgttggctctatatggactaattgttggcatcatcctttcttcccgtgctggtcaatccagagctgattaaacaagcaaggtcttccctcttcttgtttagaggtaaatcatggtagtcatgaggcacacaagtaacatcttggctatttcttcactctattatttagtggttttatgctgcttgtaaattgggagaaaccttctcccttgaataaggatttgtaatgctggttttgctctttctcattgctgtacttgtcccagggagagagaaactattttatggaattagtgccactgtaataggatttttgtgaatttttaattgtaaaactggaacgaattgtaactaaacttatttatgtgctgtggaagtggaacaatgagttggaacttggaaa

SEQ ID NO: 1382 - DNA, 592 bp, Tamarix hispida
  misc_feature (35)..(35): n is a, c, g, or t
  misc_feature (395)..(395): n is a, c, g, or t
  misc_feature (494)..(494): n is a, c, g, or t
gggggatccatctccagtcaatctcaattctaatnaaaaataagttcttccaccttatttctcctataatgtctaccgtattcaacggcgatgaaactgcgccgttctttggctttctcggtgccgccgctgctctcgtcttctcctgtatgggagcggcctatgggacggcgaagagtggagtaggagtcgcttcgatgggagtgatgaggccagagttggtcatgaaatcaattgttccagttgttatggctggtgtcttgggtatttatggattaattattgctgttattatcagtactggcattaaccctaaggcgaaatcctactatttatttgatgggtatgctcatctctcttctggtctcgcttgtggccttgctggtttagctgcnggtatggccattggtattgttggtgatgccggtgtcagggctaatgcacagcagccaaagcttttcgtgggtatgatcctcattctcatctttgccgangctcttgctctttacggtcttattgttggcatcatcttgtcttcccgtgccggacagtcaagagcggactaagaagcatttcgggaatcaagattatc

SEQ ID NO: 1383 - DNA, 955 bp, Camellia sinensis
acacgaaaaggagaagagaggcatcgaactacaaacccagttctgcggagagagaactagtaacaggaaaattcacagaattctctctcagatccgatcgatttctctgcaaattccaaaccctcgaaaccacaaacaacaacaatggcttcaaccttcagcggcgatgaaacggcaccgttcttcggcttcctcggcgctgcagctgccctagtcttctcctgtatgggggctgcgtatgggacagcgaagagtggcgttggagtggcgtcaatgggtgtgatgaggccagagcttgtgatgaagtcgattgttccagtggttatggctggtgtgttgggtatctatggattgattattgctgtgatcatcagtactggtattaaccctaaggccaagtcttattacctttttgatggctatgctcatctttcttccggtcttgcttgtggcctcgctggtctatctgctggtatggctattggcatcgtcggcgatgccggtgttagagccaatgctcagcagccaaaactttttgttggtatgatcctcattctcatctttgctgaagcgcttgccctctatggccttattgtcggcattatcctctcttctcgtgctggacagtcgagagcagattaacttggggcattcttgttggtgatggtgtggcttgtttaggaattattttgatattctctcctgttacaaatgataattcagcttacaaaggaagtgtcttctgatccaaaattctactatttgggtggccagtgcttggtcaagcggattgggtggctgctatgtgctactagtggtagagtacagattagctcttagtctccccttaaataatgtttctctatttcttttcatggatgatgtgtcacactttgttcggtttgaatttgtctagtattattgctggtattgtctctccagaatactcagtacc

SEQ ID NO: 1384 - DNA, 869 bp, Camellia sinensis
ctcgcgacgaacacgccgatctgaggactggttattgttgaattataatttagataagaagaagagaggaaatctaatggcatcgacgttcagcggagatgaaactgctccgtttttcggcttcctcggcgccgctgctgccctcgttttctcctgtatgggtgctgcctatggaactgcaaagagcggtgtgggcgtggcatcaatgggtgtaatgagaccagagcttgtgatgaagtcgattgtgcccgttgttatggctggtgtgttgggtatttatggtctgattattgctgtgatcattagtacaggtattaacccgaaggccaagtcgtattacctctttgatggatatgcgcacctctcatctggtctagcttgcggcctagcggggctttcagccggaatggctattggtattgttggagatgctggtgttagagctaatgcacaacagcctaagctttttgttggaatgattctcattctcatctttgcggaggcattggcgttgtatggccttattgttggcattatcctctcttctcgtgctggccaatcaagagcagattagagaatggtgtcctccctcttcttgcagttcgtttgcatcaccttattatcaggttagtgaggctagtttggaagttgcaatctcttattattgtgatgcatgcaatttcttcttcacatcattaagtaattctgtgcttgattgtaatattggtgacaattttcctctgggaaataaagctttgtgaagcttgtttcttacatttgcatctttgtattttacataagttccaaggagcatactattcatcttgtgatactagttcgtgtacatgtagagtgttattttagtacag

SEQ ID NO: 1385 - DNA, 918 bp, Eutrema halophilum
cttgtccttgtacgcgtacatctacggagagagatctgagagaagcagcgaagatcagattccgtcttcaacctaagatccagaatcggtcgaaatgtcttcattcagtggcgatgagaccgcacctttctttggtttcctcggcgctgcggcagcgctcgtcttctcctgcatgggagctgcatatggaacagccaagagtggcgtcggtgtggcatctatgggtgtgatgaggccagagttggtgatgaagtctattgtcccagttgttatggctggtgtgttgggtatctatggtttgattattgctgttatcatcagtaccggaatcaaccccaaggctaaatcttactacctctttgacggatatgcccatctctcctctggtctcgcttgtgggcttgctggtctttctgctggaatggccattggtattgttggtgatgctggtgtcagggccaatgctcaacagccaaagcttttcgttggtatgattcttatcctcattttcgctgaagccctggctctgtatggtctcatcgtggggatcattttgtcctcccgagctggtcagtcgagagccgaatgagaagagaatgcggatcctggttccgcgtgattctttctttgctttttcgctggtcgagccgggatcttcttatattatttctcaggttagtagagacgagagtggttttgctcctcgtagcatgtttcttaagaacgtgtctgcgcgaaacaaaaaccacacatgatcgaaatgttgttcgttttcatttcatccttctgttatgtttgtaatattgaccgtgccggattcttgtgctcccagtaagatgtaactgtgagagacaccctatttatccttttttttttatcagtccaataaatcacagaaaactcgatttgatctttgtt

SEQ ID NO: 1386 - DNA, 909 bp, Eutrema parvulum
atcttcatcggccttgcttgtcctgaaacgcgtcgagggagagatctgagagaagcagctaaagatcagattcttaagatccagaatcgtccgaaatgtcttcgttcagtggcgatgagaccgctcctttcttcggcttccttggcgctgcggcagccctcgtcttctcctgcatgggagctgcatatgggacagccaagagtggtgtgggagtggcatctatgggtgtgatgaggccagagttggtgatgaagtctattgtcccagttgttatggctggtgtgttgggtatctatggtttgattattgctgttatcatcagtaccgggattaaccccaaggctaaatcttactacctcttcgacgggtatgcccatctatcttctggtcttgcttgtgggcttgctggtctttctgctggaatggccattggtattgttggtgatgctggtgtcagggctaatgctcaacagccaaagctttttgttggtatgattcttatcctcattttcgctgaagctctggctctatacggtctcatcgttggaatcatcttgtcctcccgagctggtcagtccagagccgaatgaggagagagcgcggtgattctgcgtgattctttctttggtttttctcccgatctcttcatcgagctgggatcttcttatattatttctcaagttagtagtggcacgcagtggttttgctacttgtagcatgtttcttgagaacgtgtctgcacgaatcaaaaaccacacatcatccaagtgttgttcgttttcacccttctgttatgtttgtaatattcgtgacggattttctgttcccagtaagatgtaattgtgagagacaaccctatttatatttttatcagtacaataaatcacagaaaactcgatttgatcttgt

SEQ ID NO: 1387 - DNA, 980 bp, Tripterygium wilfordii
tgttgtgggaatcatcgtcttcttcttcgatccgatctcctactctgcgattcctcagaaccctaagcagtgaaaaatgtcttcgactttcagcggcgatgaaactgcccccttcttcgggttcctcggcgctgctgctgccctcgttttctcctgtatgggagcagcttatggaaccgcgaagagcggagttggtgtagcctcgatgggtgtgatgaggccagaactggtgatgaagtcgattgtgcccgtggttatggctggagttttaggtatatatggtttgattattgcggtgattattagtaccggtatcaaccccaaggccaagtcttattaccttttcgatggttatgcgcatctctcctctggtcttgcttgtggtcttgccgggctgtctgccggtatggctattgggattgttggcgatgccggtgttagagctaatgcacaacagcctaagctctttgtggggatgatccttattctcatttttgccgaagctctggctctttatggcttgattgttggcatcattctctcttctcgtgctggtcagtcaagagctgagtaaaaaagatggctttttgcttggtgtttgttcgtttcaaagaactatatctatatttgctcagttttaagcattggtgtagctgggcaagtgttttgtggttcatattatttttcatgtgtgtgattgtttacccactggacagggtattggctataaccggaagtagaatatagcgatagaaattagtttcttgctgcaataaaattagcttgttatcagatgctgtaacttatggatcgatcggagctcttgtagaataattgagtattatttttggtactctcaacagggttggtttgttattatgatttgcttgggtctttaagctgcttgtagttagaatgcattttcactaagatattgaactacatctgaattgtttgagcttaatatatttggtggttga

SEQ ID NO: 1388 - DNA, 838 bp, Tripterygium wilfordii
ccatctatcttcttattctctccctctctctagctctcgctcccggacaatcaaatccgaattcgcgatctctcactggaacaagaccttatcggaaaatgtcatcaacattcagcggcgatgagactgcccccttcttcggcttcctcggcgctgcagccgcgctcgttttctcatgtatgggagctgcgtatggtacggcgaagagcggtgtaggcgtggcttcaatgggagtgatgaggccggagctggtgatgaaatcgatagtgccagttgttatggcgggagtgttaggtatttacggtttgatcattgctgtcattattagcactggaattaaccctaaggccaagtcgtattacctgttcgatggctacgctcacctttcctctggtctcgcttgtggtcttgctggtctctctgccggtatggctattggaattgtcggcgatgctggcgtcagggctaatgcacagcagccaaagctttttgttggaatgattctcattcttatctttgctgaggcattagctctatatggcctcattgttgggatcatcctgtcttcccgagctggtcaatccagagctgaatagaatgcctcttaattgtgaggttgcctccattggtcatactgagttggtgtggctaatacattgttttctctgttatgtcaagttattagtgatgcatgcgttttcttggatatatctttatcatgctggctgtataatttggacaaaacatttctttgaagtgaagcttgttatttgttccatttctttttgctgtattcttaatattgaacaattgtagtagttttcattgcaaaacaatt

SEQ ID NO: 1389 - DNA, 824 bp, Tripterygium wilfordii
aaaatgtcttccactttcagcggagatgaaactgcccccttcttcggcttccttggcgctgctgctgccctcgttttctcatgcatgggagcagcttatggaaccgcgaagagcggagttggtgtagcctcgatgggtgtgatgaggccagagctggtgatgaaatcgattgtgcccgtggttatggcgggagttttaggtatttatggtttgattattgcggtgattattagtaccggtatcaaccctaaggccaagtcttattaccttttcgatggttatgctcatctctcctctggtcttgcttgtggtcttgccgggctgtctgccggtatggctattgggattgttggcgatgccggtgttagagctaatgcacaacagcctaagctttttgtggggatgatccttattctcatttttgccgaggctctggctctttatggcttgattgttggcatcattctctcttctcgtgctggtcagtcaagagctgagtaaaaagagatggccttttgcttggtgtttgttcttttcttgtgatccatgaacaactatttctatatttgcttaggtcttgagcattaatgtagcctggcaagtgttttctggttcaaattatctgtatgtgtgtgattgtttacctgctgaacagggtattggctatatataactggaggtagaatatagtgataaaatagtttattcctgcaataaaactagcttgttattagattccgtaacttatggatcgatcggagctcttgtagaataattgtgtattatttttggtactctcaacagggtttgtttgttattgtgat

SEQ ID NO: 1390 - DNA, 1009 bp, Tripterygium wilfordii
ttcgacaaggcatcagatccaaacgacacagctccagatctagttgatcggcaatggcctcgactttcagcggcgatgaaacggcaccattcttcggctttctcggagcggctgctgccctcgtcttctcatgcatgggagccgcttatggaacagctaagagtggtgttggtgtggcgtcaatgggggtgatgagacccgagctggtgatgaagtcaattgttcctgttgttatggctggtgtgttgggtatatacggcttaattattgctgtcattatcagtactggaattaaccccaaggccaagtcatactacctttttgatggatatgcacatctctcatctggtcttgcttgtggacttgctgggctctctgctggaatggcaattggaattgttggtgatgcgggtgtcagagctaatgcccagcagccaaaactttttgttggaatgatccttatcctcatctttgctgaggctttggccctttacgggcttattgttggaatcatcttgtcctctagagctggtcaatccagggcagattaaaagggaactgtgacaccttgtattctttaattgcttatctgtgttactccaggaagatttttatctattctcaggttggctgatgacggcccttgctggggccttgaattttattgtgcaactgtctcatcaagcatcacgagggtcgtctgtgctattcgtagaagtatttagtttctctgcgcaataaaaagttgggaagcttttcatgtgcggttctctctatcactgtattttgtagacatttcaaactaccataggtacttaaaatttctggaaccagtatgtctggtccttattatttgtgtatactttactcaattgcttgcatctagcttgcggtaccggtaagcctcaagatgattgctttcattaattttggtttctgaaagctaagcatgatagatcatttacttgaccgtgtgaaatttacaaaaaaaaaaaaaaaacaatactag

SEQ ID NO: 1391 - DNA, 933 bp, Valeriana officinalis
tcatcatcataaaaactacgaaggcacgacgaaggagagcgatagagagatctgattccgaacgatttcgtgatctgagatcatcatacctaaaaatgtctacgactttcagcggcgatgaaactgctccgttcttcggcttcctcggcgctgctgccgccctcgttttttcatgtatgggggctgcttatggtacggctaagagtggtgtaggggttgcatcgatgggagtgatgaggccagagttggtgatgaagtcgattgtgccagttgttatggctggtgtgttgggtatttatggtctgattattgctgttatcattagtacaggtatcaaccccaaggcaaagtcatattacctttttgacggctatgctcatctttcctctggtcttgcttgtggtcttgccggactttctgctggtatggccattggtattgttggtgatgctggtgtcagagccaatgcacaacagccgaagctttttgtcggaatgatccttatccttatttttgctgaagctcttgcactatacggcctaattgttggtatcatcttgtcctcgcgagcgggccagtctagagccgactaaaagaaaggtggttttcacataccgtgattctcttgtctgtatttgcttgcgagaaacaagaacaaatgttggtattgctttttccattttgttttccaggttagaacagcgctagtagctgtgagggtttgcataatattatttactttattgagtgtaattgccacgacgttgtagcgttctgttttgcttgggagtaacaatcgagtttttattcagaataaaaaagctctgcctctctctcagattctttcacttttgtttgtgtaattttattatcaatgttacttttgatatgcgtggaagacatgggagggactacccaattattgcgttgcaa

SEQ ID NO: 1392 - DNA, 763 bp, Vinca minor
agaaataaaaataatctctcagatcccttcgctcaatcatccttctacatccaccacagatccaatctcaaaaaatgtcttcaagcttcagcggcgatgaaacggcaccgttcttcggcttcctcggcgccgccgccgccctagtcttctcctgcatgggagcagcgtacggaacggcaaagagtggagtaggagtggcatctatgggtgtgatgaggcctgaactggtgatgaaatcaattgttccggtggttatggctggagttttggggatttacggtttaattattgctgttatcatcagtactggaattaaccctaagactaaggcttattatctctttgacggttatgctcacctctcttccggtcttgcttgtggtctcgctggtctctctgctggtatggctattggaatcgtcggagatgctggtgttagggccaacgcacaacagccaaagctttttgttggtatgattcttattcttattttcgctgaagctctggcactttatggccttattgttggcatcatcctctcttctcgagctggacaatcaagagcagattagagaagaagcatatttagtgctattttgttaatgattaattgtgttctttgttagagatggtaactgataattttctcattccaaacctttatacgttcagcgccatcaactcaaaagattgttttgattttagcatgtagatctagaatttcttttttcctctgaataagacgcggtgaagcatgttgaga

SEQ ID NO: 1393 - DNA, 833 bp, Vinca minor
acgcaaagaaaaagactcctccccggcgagcagtgaagaaatctatccctctctcagatccttcctcctccatcctccacagatccaaatctcaaaaaatgtcttcaaccttcagcggcgatgaaacggcaccgttcttcggcttcctcggcgctgccgcagccctagtcttctcctgcatgggagcagcatacggaacagcaaagagtggagtaggagtggcatctatgggtgtgatgaggccggagctggtgatgaaatcaattgtaccggttgttatggctggagttttggggatatacggtttaattattgctgttattatcagtactggtattaaccctaagactaaggcttattatctctttgacggttatgctcacctctcttccggtcttgcttgtggtctcgctggtctttctgctggtatggctattggaattgtcggagatgctggtgttagggccaacgcacaacagccaaagctttttgttggtatgattcttattcttatttttgctgaagctctggcactttatggccttattgttggcatcatcctctcttctcgagctggacaatcaagagcagattagagaagaagcatattcagtgctattttgttaaatgattaattgtgttctttgttatagatggttgttcatttgcacaagtttctcattccgaacctttctacgctcagtgccatcaactcaaaagattgttctgatttttagcatgtagatttagaatttcgttttttcctttgaataagattccgtggtgaagcattttgagagaaccgtattaaatcatgtaaaacttgtttaagc

SEQ ID NO: 1394 - DNA, 906 bp, Citrullus lanatus
tttcccgaatcaccggttttgctataacttcatcaaagaagaagaaaacctagaaaagattaccggagcgtcgggaccaggatcggattcggaagctattttggttgttaatccaatggcgtctactttcagcggcgatgaaactgctcctttcttcggcttcctcggggctgctgcagctcttgttttctcatgcatgggtgctgcttatgggactgctaagagtggagttggagtggcttccatgggagtcatgcgaccagagcttgtcatgaaatctatagttcctgttgttatggctggagtgttgggtatctatgggttgatcatcgctgttattatcagtaccggaataaacccaaaagctaagtcttactatttgtttgatgggtatgcacacctgtcttctgggcttgcttgtggacttgctggtctctctgctggaatggcaattgggattgttggtgatgctggtgttcgggccaacgcacaacaacctaagctctttgttggaatgattctcatcctcatctttgctgaggctcttgccctctacggtctcattgttggtatcattctttcatctcgggcaggccaatctcgtgcagattaaagtacgccaagttgatccatcatctttgaatttgtcattcaaatgtcttgaggagattttgttactttgttacttctgtccatgtcaaattgaacctattgtattttattgagttatgataatgagcaggttttatgacaaacctccatgctcgtctcgtcattttgtgtgatattctttctaatttcagtcagtacactggagtagtggactgattttatgtggacattaccttgcggtgcagattcctttgaaaattacctataattcttcaaataaataccatcaaggta

SEQ ID NO: 1395 - DNA, 914 bp, Vaccinium corymbosum
ccatcgaacaacggagacagaaaaccagaacaactttcagatctaatcgaagcaccaaaaccctcaaaatcagatcaagatgtcttcttcggggttcagcggcgacgaaacggcgccattcttcggcttcctcggcgctgccgctgccttagtcttctcctgtatgggggcggcatatgggacagcgaaaagcggtgtaggggtggcgtcgatgggggtgatgagaccggagctagtgatgaagtcgattgtgccggtggttatggctggtgtgttaggtatttatggtttgattattgctgtgatcataagcactggaattaaccccaaggccaagtcttattaccttttttgatggctacgctcatttatcgtctggccttgcttgtggcctcgctgggctttctgctggtatggctattggtattgttggcgatgccggtgttagggccaatgctcaacagcctaaactttttgttgggatgatccttattctcatctttgctgaagctcttgctctctatggcctcattgttggcattatcctctcttctcgagctggtcaatcgagagctgattagaacacggcattgttgttggcggcggcggtgtttcttcccatcgattgaggctatagtgatgctctctctggttagaaatggtaatacagttaaagaagtgttctagtttcgacattgcttggtgttattgggtggttcatgttgcgacgtgtttatggtatattgtagtttcactgttacttcttaagtgctattgttctgtttaccctagatgcttttatcatttggattctaaaaaccctaatatgaatttaccgaactgaaaaccctattatgtgggttttttctttggatgtctgctgctattatgaatttatttgatccttgtgaccc

SEQ ID NO: 1396 - DNA, 1001 bp, Amorphophallus konjac
gatcgcccacgtctctctcgacccacgattcccttcgacggccaccttccattcgtcttcctcttcctccacacaaggggtgaatcctcgaagggtggacgcagaagaaattagggtttccgccatcagagcacggagaaaatgtcctccttcagtggcgatgaaacagctccgttcttcggcttcctcggcgccgcggcggccctcgtcttctcttgcatgggggcggcgtacgggacggcgaagagcggggtcggggtggcgtcgatgggagtgatgcgtccggagctggtgatgaagtccatcgtgcccgtcgtcatggcgggagtgctcgggatctacgggctgatcattgccgtgatcatcagcacggggattaaccccaaagcgaagtcgtactacctgttcgatgggtacgctcacctctcgtccggactcgcctgtggcctcgcggggctctccgcggggatggcgattgggatcgtcggggacgctggagtccgggccaatgcacagcaaccaaagctgttcgtggggatgattctcatcctcattttgctgaagcacttgccctttacggtcttattgttggcatcatcctctcatctcgcgccggtcagtctcgagcagactaaacgcgggatggtagccgttggcatctccgccaagtttcctgttgtaccctacatatatgacgtgaaaccacccaggcttctgcttagttcttgattttcattcataatgttaatccgatcaaagacttgatcacgcatgtggcaagttggtctgcgttttgtaacccagggacctatgagctatccatctcatcacgtgtgctgtggtggcgatgattaactattgtaggcctggagccttaaaaatccgtattaatttacgtgtccttgaacgtcgcgggatcatacggttgaacactcttggatcaccgcatccaccatttgtattgattcagttcaaattagatatcatatgatatgatttga

SEQ ID NO: 1397 - DNA, 946 bp, Flaveria ramosissima
atccatcgttgttgcacgattcaatttctgtggagattggatcgatatctgagaatcaaaatccccaaaatccattccatttctcttcagatcaaatcaaaaccctaaatcaatcaatcaatctatcaatcatgtcttcaacgttctccggcgacgaaactgctccgttcttcggcttcctcggcgccgctgccgctctggtcttctcctgtatgggggcggcgtagtgggacggcgaagagcggtggttggagtggcgtcgatgggagtgatgaggccggagttggtgatgaagtcgattgtgccagtggttatggctggagtgttgggtatttatggattgattatagcggtgattattagtactgggattaaccctaaggctaaatcttattatctgtttgatgggtatgcacatctttcttctggtcttgcttgtggtcttgctggtctttctgctggtatggctattggaattgttggtgatgctggtgttagagccaatgcacaacaaccaaaattatttgttgggatgatcttgattctcatttttgctgaagctctggctctatatggtctaattgtcggcatcatcctttcttctcgcgctggtcagtctagagctgactagatgggcagtggccttggtgaattatcttctctctgtggttgtggtggtggtggtagagctgcaaacatgatcaattctttggtggtgatgatatattggactatggttatgctcctacaataggtttttaaaccaagctctagctctctcttataataatgtttcatcttgtttttgttagataaactttgcacatttgtcccacatttgttggtaactatttattttatggtgaaaattgtagttttgtttatgtactaccaaaccaacaaagtaaaagttgtaaggttggttcgtttttggttctactaatga

SEQ ID NO: 1398 - DNA, 940 bp, Sarracenia psittacina
gggccgtcggaaaataaaaagttcctccctgaatagcgaaaacttgaggaattctcagatccgatcgatttttcttcaattagaaaccctagaaagcagatttcaaaaaatgtcttcgacgttcagcggggatgaaacagcgccgttcttcggtttccttggcgctgcagctgccttagtcttctcctgtatggggctgcgtatgggacggcaaagagtggggttggagtggcgtcgatgggcgtgatgcggccggagttggtgatgaaatcgattgttccggtggttatggccggtgttttggggatctatggattgattattgctgtgatcataagtaccggtattaaccccaaggccaaatcttattacctctttgacggctacgcccatctttcctctggtcttgcttgtggcctcgctggcctatctgctggtatggctattggtattgttggcgatgccggcgttagagccaatgctcagcagccaaaactatttgttgggatgatcctcattctcatctttgctgaagcgcttgctctctatggccttattgtcggcattatcctctcttctcgagccggtcagtcgagagccgattaaaccgagcattctccttggtggtggtgtcacttgttgccattgattaagaattatttcgatgttctctctggtttgaaatggtgattcaactgaggaagaagtgtcttatgctccacgattcttctatacttttggttggtggccggtgcttgcatcaggtggattgttggcttatttatgctaatgttagaatgcagattagctcttagttgtgttctcaaatactcttgtatctgcttctttttaaggatgatgtgcttcataaatttgtctttgaattatggccattattatttattctgatttcttggtactacttttttcatacgtttct

SEQ ID NO: 1399 - DNA, 564 bp, Thalictrum flavum
acgactagaagaagaagaacgagtcaccaaatctcaattagggtttctctttagatctaaaatcaaaatgtcttcaaccttcagtggcgatgaaactgctcccttcttcggtttccttggagccgcagcagctcttgttttctcctgtatgggagcagcatatggaacagcaaagagcggtgttggagttgcatcaatgggtgtgatgagacctgaacttgtgatgaaatcaattgtaccagttgttatggcaggagttttggggatttatgggttgattatagctgtgattataagtactggaattaatcctaaagctaaatcttattatttgtttgatggatatgctcacttgtcttctggtcttgcttgtggtcttgctggtctttctgctggtatggctattggtatcgttggtgatgctggagtaagggccaatgcacagcagccaaagctgttgtgggcatgattctgatcctcatttttgccgaagcgcttgctctatacggtcttatcgtgggtatcattctctcctctcgagctggccagtcgcgagcagactaa

SEQ ID NO: 1400 - DNA, 2013 bp, Zostera marina
accaagcaagttgcaaggtttgcaaccttttagttcgttcttcttccatcagaagagatcccgaaatccaaaaggtaagttaaaaaaaaaatgcatgcaaagacagattcggaagggacaagtctagcaccgtcgtcgccgacgaggtcacctcgtcgaacagtttactacgtccaaagtccatctcgtgattctcatgatggggagaagacgacaaacaactcgttccattcaacacctatcatcagtcccatgggctctcctccacattccggcaaccattcatcgagagagtcttcctcgtcgagattctccgagtctctgaagcatcttcatggaggaagcaggaagatcttacccaacgacccacatgagaaaaagataaagaagaagaagaaagggtttgaggtgattgatgaggaaggacttttggatgatgaggatgagagagacactcttccgaggaagtgttattaccttgcttttgttcttggcttcttcgtccttttcagttttttctcactggttctctggggcgccggtaactcccagaagcccagaatcacaatgaagacgatcaaattcaacaacttcgtaatccaagctggaacggacactaccggggtaccaacggacatggcaacactgaactcaaccgtaaggttcacttttcggaacactgctagcttcttcggtgtccatgtcacttcaactccgctgtctctcacttactccgaccaactcaccctcgccgccggcagaatgaattatttctaccagaggaggaagagtcagaggagcataacggttgttgtggaagggaacaaaatcccactctatggaggtgggtcgagtctcagtagcagcagcagcagcgacaaaactatcgagagagaagaattggtgccattgatgttgagattcaaagtccggtcgagagcatacgttcttggtaaattggtaaaacacaaattctatattaatgtgttatgtaatgtcaaattgaacccaaatgaactcaacactccgatgagactcaagaacagctgcacgttcaactgaagaagcagcagtagcagtgtagtagaactagaatattgctagtagtagcagatgaaaataaaattgtaacgtgttcatggtatgaaataatgaatgattagattttaagcatcatcataaattcataatcattaatcaccatcattattaattattatcattgttgttgcaaataagtacgtacacagaacaatctacaaaaaattcgcgcagattgaaaacaatagatagatgaagcagcagcagaatgggaagacgcgcagtcatttttctcactcgatcaacaaaatcgtggattaattaaaaacaagaacgaacctgaaatctggaaatctctgtcgcagatcaattcaggtttgattgtttaatcagctcgagattgaccagcgcgggatgagaggatgatgccgacaataaggccatagagagctagagcctcagcaaaaataagaatgaggatcattccaacaaagagctttggctgctgtgcatttgctctaacaccggcatcgccaacgatcccgatcgccattccggcggataaaccagcgagaccgcaagccagacctgaagaaagatgtgcatagccgtcaaacaaatagtaggatttggccttgggattgattccggtactgatgatcacagcgatgataagaccgtaaatcccaagcactcccgccatgacaacggggacgatggatttcatcacaagctccggtcgcatcactcccatcgacgccacaccgactccactcttcgccgttccataggctgctcccatacaggagaaaacgagggcagaggcggctccaaggaagccgaagaacggagcagtctcatcgccgctgaaagtagacgacatatttctcttcgatcggagaaaactgtagatctgtggtgattgttaagatcggaggattgaagaatgcgaggaggaaaggtgaatatgat

SEQ ID NO: 1401 - DNA, 1175 bp, Panicum virgatum
gtgctagtaatacgagcagattatatcagaatgtgcacataatttacacttctacccggccagaatggtcgcgtccacgtagccaagacgcaggggcaaaatgggaaacccgcggtgggccccatcgtcgctctcgcgtctggagattttcagatcagatcggggtgggggaagtcgcaacaaaaagaaaccaggcagcctccgctcgagagagatcgcatctgcctgcctgcccaccttcccttcctccccaccccggcgacgcggccgccccgagaccgagcaaccccacggcgagaggaacaggtagggcaagaagatgtcgtcggcgttcagcggcgatgagacggcccccttcttcggcttcctcggcgccgccgccgccctcatcttctcatgcatgggcgcggcgtacgggacggcgaagagcggcgtcggcgtggcgtccatgggcgtgatgcggccggagctcgtgatgaagtccatcgtgcccgtggtcatggctggtgtgctcggtatctacggcctcatcatcgccgtcatcatcagtaccgggatcaaccccaaggccaagccctactacctcttcgatgggtacgcccacctctcgtccgggcttgcctgtggcctcgcggggcttgctgctggcatggccattggcatcgttggtgatgctggtgtcagggcaaatgcacaacagccgaagctctttgtgggcatgatttcattctcatttttgcaaagcgctagctctctacggtctcattgtgggcatcattctctcatcccgtgccggccaatcccgtgcggattaggcgcttgctgctaccattctataattactgctgtgtttattatatgctcttttgagagaaacttgaactcgaggttcttgtctagtttgttcatgttaccatgtatcaatgaaacagttgtagctgaaggaaggtggcacttccagtcatgttcgatttggtggtgtcaagaggttattttttgggttaaggctggatggatgctcctgggctaagtggatttaattttatccatggtgaataaagaacacggaattgtagccaaataataacgtgataattgatatatatatttcttcgccctgatactgcatccctggttttgcaatgtcatctatgctagagcatttctactgttat

SEQ ID NO: 1402 - DNA, 632 bp, Brassica juncea
atggcttcaggtttcagcggcgatgaaactgctcctttcttcggatttctcggcgctgcagccgctctcgttttctcctgtatgggagcagcgtacggaacagcgaagagcggggttggtgtggcgtcgatgggtgtgatgagaccagagcttgtaatgaaatcgattgttcctgtggttatggctggtgtgttaggtatctatggtttgatcattgctgtcatcatcagtactggaatcaaccccaaggctaagtcatactatctattcgatggctatgctcatctctcttcgggtctcgcttgtggtctcgccggtctctccgctggtatggctattggtatcgtcggcgacgctggtgttagagcgaatgcacaacaaccaaagctgtttgtgggaatgattttgattctcatctttgctgaagcacttgcgctgtacggtctcattgttggtatcatcctctcgtctcgtgctggtcagtctagagccgagtgaagtcataaagtcttttcgttatgtgcgaaacccttgtcatgttttttatatatttcacttcttttttttgtggcactgtgagttttttgcttttctcatgaaaaaacaagcagacatatcatttgaatttggtt

SEQ ID NO: 1403 - DNA, 1072 bp, Musa acuminata
tgggccacgagaaaataaaatgatattagaagataaatcgatcgatctcaagaccgcctgccacgatcgaacgtaatcccccacggacgtgtctgcacatctagaagaggaaccggcaaaagttttctttccgaaaatattccaatcgtgtcagcaaaccctcttcccttcagatggtaaatcatgtaaattatactaaagcaaaggctattattatatgataagaatctaccaaagttcttccgatcccgaaaagggaacaatttgtggccgactcccgcatcctctcactcgatcatcttctttccgaaggtctaggacaatcaaatcggcgcgacgatgtcgacattcagcggcgatgagactgcccccttcttcgggttcctcggagccgccgctgcgctcgtattctcgtgcatgggggcggcgtacgggacggcgaagagtggagtcggggtggcgtcgatgggagtgatgcggccggagcttgtgatgaagtccatcgtgcccgttgttatggcgggagtgctcgggatctacggcttgatcatcgcagtgattattagcacaggcattaatcccaaggccaagtcgtattacctcttcgatgggtatgcacacctctcctcggggcttgcttgtggcctcgctggcctttctgccgggatggccattgggatcgttggggatgctggagtcagggcaaacgctcagcagccaaagctttttgtgggcatgattcttattctcattttcgcggaagctcttgcactgtatggtctcatcgttggcataattctgtcttctcgagctggtcaatctcgggcagactaagatacggttggtgccatgttccatgtgatccttcaagttagttttaaatttttgtgaccatactgttatttgtctgacacgttttgatgtcaagtccttatttttaataatgtgttatgttctactaagatgacctagggattttgctggaaataactgggtcatcctccttcaggaacaactgtgaaccacatgaatttgtatgattattcaataaatctgtgtctaataaaattgt

SEQ ID NO: 1404 - DNA, 745 bp, Musa acuminata
tcacatatccacctggcgatgtcaaccttcaccggcgatgagacggcccccttcttcggattcctcggagccgcggcggctcttgttttctcctgcatgggggccgcgtacgggacggcgaagagcggagttggagttgcttcaatgggagtgatgcgaccggagctcgtgatgaagtcgatcgtgcccgttgtcatggcgggagtgctcgggatctatgggttgatcattgctgtgatcatcagcaccgggataaaccctaaggccaagccgtactatctcttcgacggctacgctcacctctcgtccggactggcttgtggtctcgctgggctttctgccgggatggcgatcgggatcgtcggagatgctggcgttagggccaatgcacagcagcccaagctgtttgttgggatgattcttattctcatttttgctgaagctcttgcactctatggtcttattgtcggcatcatcctttcatctcgagctggtcaatctcgggcagattaagaaaacatgaagtctcggatgtcatttcccgttgcttcctatgtttgctacagaacatttgttctaaatatctattatctacttttctgattacactgtgaactatccagataacttgtattaaccagagccctttggcagttccatgtctttttaataatgtaaatgcatcaatctcattgtaatgaagagtgagagtttttttgcattaaatatttatgccttactatga

SEQ ID NO: 1405 - DNA, 881 bp, Musa acuminata
ccctcgtgtctcttccccgtgcgtcgtcgaatcctaccgggcaattagggctcccagaaatcttggttgcgtcccgactccgcgcgacgatgtcgaccttcagcggcgatgagaccgcccccttctttggattcctcggagccgccgcggctctcgtgttctcctgcatgggggcggcgtacgggacggccaagagcggagtcggggtggcgtcgatgggagtgatgcgaccggagcttgtgatgaaatccatcgtgcccgttgttatggccggagtgctcgggatctacgggttgatcattgcggttattattagcaccgggataaaccccaaggcgaagtcgtactacctctttgatgggtacgcgcacctctcctcggggctcgcctgtggtctcgctggcctctctgccggaatggcgattgggatcgtcggtgatgccggagtcagggccaacgctcaacagccgaaactatttgtaggcatgattcttattctcatttttgcggaagcccttgctctctatggtctcattgttggaatcatcttgtcttctcgggctggtcaatctcgggcagattaagaaaacatgattgctatgtcatattccgtgcccctatatgtcactgtggaaacaaacaggtgttccctttaagctttatgatcacacactaatatttgtttggcacgttactggcatgagtcgtcggttgacggctgttgaattcttattcttaataatgtgatgttttgatcgatcttgtaaggtaaggttagggaccttttgctgcaaataacatgaggtcagcaactgcgaagcacaaggatttgtatagttattcaataattctcgtatggatcaaattgctgaatatggtgg

SEQ ID NO: 1406 - DNA, 1183 bp, Musa acuminata
gtttccgatccgtcgccctccgcttcttcttccttccctcctcgaagagcaattagggttcctcaaaatccccgcaaggatgtcgaccttcagtggcgacgaaaccgctcccttcttcggattcctcggcgccgcggcggccctcgttttctcctgcatgggggcggcgtacgggacggcaaagagcggcgtcggggtggcgtcgatgggcgtgatgcggccggaactcgtgatgaaatcgatcgtgcccgtcgtcatggctggagtgcttgggatctatggtctcatcatcgctgttatcataagcaccgggatcaaccctaaggccaagtcatattacctcttcgatgggtacgcgcacctctcgtccggcctggcgtgtggccttgcaggactctcggcggggatggcgatcgggatcgttggtgatgctggagtcagagccaacgcacaacagccaaaactgtttgtaggaatgattctgattctcatctttgcggaagctcttgccctctatggtctcattgttggcatcatcctttcctctcgtgctggtcagtcccgagcagactaaggagtagctggcaccatgttacctgtgcttcctctatatttttcatggaaaatgataacataaattggtcaacttttgtggttataatgtgatctaatacaggacttccacagataagagtcacattgctagactcgtgctacatttcaataatttcccactgtaatcttcttgtactgctgagttatggacaactgcgggcactctatttccatttcggagggaactaactacaaactttgtggatttagattgttactttgtgtagcctggtcagatgaatcaggtttgatcttgttctgaagtaatgtattttatgttcaactcctttggattacatctgtttggtttccaataaagtggttctttgatctattttgggtgaattaaaaaaatagctcctgtaatttaagtgaaatataataaattatgccaagggagatgatgaatgttgatgatgattctattaaatcccgttgagtacatctgtttggtttccagtcaaagctcgcacattgtggttctgagatttattttgggcgtatcaaaagaatgtaaaatttagcaagtgaaatgtaatagactatgttcgactttgttaatgttgag

SEQ ID NO: 1407 - DNA, 1053 bp, Phaseolus coccineus
gacatggaaatcccacgttttcttcacggcaatagaatcatcgagacacgctcagagatcggtctctgccgagaatttgaatttctcagatctatccgacgtcgttgcagatccatcaacggtcatggctggcttcagcggtgatgaaacggcaccgtttttcggcttcctcggagccgcagctgccctcgtcttctcctgcatgggagctgcctatggaacagcaaagagtggtgtgggcgtggcttccatgggtgtaatgagacctgagctagtgatgaagtctattgttccagttgttatggctggagttttgggtatttatggccttattattgctgttattattagtaccggtattaatccaaaggccaaatcttattacctctttgatggttacgcacatctctcctctggtcttgcctgtggcttggctgggctgtctgctggcatggctattggtattgttggtgatgctggtgttagagccaatgcacagcaaccaaaactttttgttggaatgattctcatcctcatttttgctgaagctcttgccctctatggtctcattgttggtattatcctgtcttctcgtgctggccagtctagagccgactaagaaaggagttgtgctaaatattctttgaccacccatctgttttaacctccttttaaagggggtgagggaggtaattactagttgttgcgagattagctatgttcaggcagcattttcaggctttagcaattgtgtgaaagttcaattcgccatttgtggtgtttgtttgtataattagggctatctttacttaataaagcttcttaagcttcctctctttttttctttattgattgtgttatgccatatcatctgaccttatatatattttttgggctgttgaaactggtgcatgtaatgatttggctagcaatgaaaacgtatttcatgggtctttccattttggaattggtaatagctgttttttgtgttaaattttttgtttatggtttggtgaaaaatgaatcatataattgaaagaactgaaatgaaag

SEQ ID NO: 1408 - DNA, 824 bp, Phaseolus coccineus
gaattgaatctaaccatggcaggtttcagtggcgacgaaaccgctcctttcttcggcttccttggcgcggccgcggctctcgttttctcctgtatgggagcagcgtacggaactgcgaagagtggggtgggagtggcgtcgatgggtgtgatgaggccggagcttgtgatgaagtcgattgtgccggtggttatggctggagtgttggggatctatgggttgattattgcggtcatcattagcactgggataaaccccaaggctaagtcttactatctatttgatggctatgcccacttgtcctctggccttgcctgtggccttgctggcctctctgctgggatggccattggaattgttggggatgctggtgttagggctaatgctcagcagccgaagctgtttgttggtatgattcttattttgattttcgctgaagctcttgctctttatggcctcattgtgggtatcatcctttcatctcgggcaggccaatctcgtgctgattaaaacgagccaactcagtgatacttggtagtccagtaatttttattctcaggcttgtatttgaaatgggagatatttgtctttcgtctattgctattatttcatttattttcgtacacaaaccctgtatccaaactccatcagttttatgaagtattttccaatggattacttatttggatggctgcattgttatgtgatatttgtttgttgtgcagaatcacaggaaattattgatacaatatagatgtagaagttaaaactattgatgatttgcctatctttgttgcagtatatgaactttcatgaaattagga

SEQ ID NO: 1409 - DNA, 888 bp, Nicotiana benthamiana
agacaaaattgagatcatccacaagcgaaaggctacaataatctctctctctctttctctctctctctagaagattttgagaagtatctcagatccaaatcaataacacacttctgagatccaatcagaaacaatgtcttcgactttcagcggcgatgaaactgctcccttcttcggctttctcggcgctgctgccgccttagtcttctcctgtatgggagcagcttatggtacagcaaagagtggcgtaggggtggcatcaatgggtgtgatgaggccggagttggtgatgaagtcaattgtgccagttgttatggctggtgttttgggtatttatggattgattatagctgtgattattagtacagggattaacccgaaaaccaagtcttactatctttttgatggatatgctcacctttcttctggtcttgcttgtggtcttgctggcctttctgctggtatggccattggaatcgttggtgacgctggtgtgagagccaatgcacaacagccaaagctttttgtcgggatgattttgattcttatttttgctgaagccctggctttgtatggccttattgttggaatcatcctctcttctcgtgctggtcagtctagggcagagtagaagaagagaatgctgtgcaccattactgtgaattatctttgtgtttttcatgggtgagtctggctgctgaattacattttcctttttctgtgggctccaagattctgtacttgattgcttggttagaagaattggttagattagatctctaaataaagaagtcagttaatctgatgccccaacttttaaggacaatggatttttgtaaaatgccactgtataattttttcttaacttgaattcaagtttttattatt

SEQ ID NO: 1410 - DNA, 944 bp, Nicotiana benthamiana
ggggaaaaaaaatcccaaacccaactgcatcagaacacggaagccacgtgtaagaagcttgactttattatcaaccagatttcaattattaacttgtagagcaaaaaatcagatccatacacaaacactcgataaaactctccttgtatcttaatctaatcaatttctcagatccaaaatccgatcggaacaatgtcgtcgacattcagcggcgatgaaactgctcctttcttcggcttcctcggcgccgctgcggctctcgtcttctcctgcatgggagcagcgtacggaacagcaaagagcggtgtaggagtggcgtctatgggagtgatgagaccggagctggtgatgaaatccattgttccggtggttatggctggtgtgttaggtatttatggtttgattattgctgttattatcagtactggtattaatcccaaaacaaagtcgtattacctgtttgatggatatgctcatctctcctctggtctcgcttgtggtcttgctggactttctgctggaatggctattggtattgttggtgatgccggtgttagggctaatgctcaacagccaaagctttttgttgggatgatcctcattctcatttttgctgaagctttggctctttatgggcttattgttggaattatattgtcttcacgagctgggcagtccagagcagagtgaagttggcttattaatactattcttactatgatgtatgtgagactcagtaaaccctggcaaaacttgatccttgctaaagtcaaaaagttatatctatgtctatgtttgttattcatgatggcacggttgctactggtgctgctatgtactgtttgtagaagtaggagtgagtatttattttaataataacttaagaagctgtcgtatttgatcactatttgtgcatgtaatgattttttgctacaatttgttat

SEQ ID NO: 1411 - DNA, 947 bp, Olea europaea
tacggttcatacatcatacgtctaaacaggcagcagagaggactgagatccattcatccatacccccaaaccatccgtctctgtaactgtaactgttaattcaacgtaatttttcagatccgttagtatatttttgcaatccaaacaaaaatgtcttcaatcttcaacggcgatgaaactgctccctttttcggcttcctcggcgccgcttctgctctcgttttctcctgtatgggtgctgcgtatggaacggcgaagagtggggtaggtgtagcgtcgatgggagttatgaggccggaactggtgatgaagtcgatcgtgccagtggttatggctggagtgttgggtatttatgggttgattattgctgtgattatcagcactgggattaaccccaaggcaaagggttattatctgttcgatggctatgcgcatctctcttcaggcctcgcttgtggccttgctggtctctcagctggaatggcaattgggattgttggcgatgctggcgtcagggctaatgcacagcagccaaagcttttcgttgggatgatccttattctcatctttgctgaagctttagccctttatggtttaatcgttggaattattttgtcttcacgagctggccagtctagagctgactgaggaattggcttttacgtagttcaactgcagtgtttaatgttatggagaaatttgattcttggcaggcttcgtgaactctttcatacgcgccctatttagaagtacctttttcaccctttgctgaataagagcttaaattgctgtggatgttggattaagcgattttatttttggcaattatgaaccctgtagaaatatatttattcgaaactagtgtgcacctatagtttttgttcttattttccccccttagatgtgttttgttttcatgcttatatgatatacccagtattgtcccc

SEQ ID NO: 1412 - DNA, 927 bp, Allium cepa
tacccattgaaacattgatccgtaaatccttggccttctaccagcggacggggttgggtcaacgcgtaactggaattccctaatcaaatcttaaaattctcaataccaggaacttcaaatcagaaattgaattcagtcatggtcggattcagtggagatgaaaccgccccattcttcgggttccttggcgccgccgccgccctcgtcttctcctgtatgggagcagcctatggaacagctaagagtggagtaggagtagcatcaatgggagtaatgagaccagagcttgtaatgaaatcgatcgtgcctgttgttatggctggagttcttggaatttatggattaattattgctgttattattagtacgggaattaatcctaaggctaagccatactacttgtttgatggctatgctcatctttcttctggattggcctgtggtcttgcaggtttgtctgctggtatggcaattgggattgtaggcgatgctggtgtaagggctaatgcacaacagcctaagctctttgttgggatgatattgattcttatctttgctgaagcgctcgctctatatggcctcatcgttgggatcatcttgtcttctcgtgctggacaatcacgtgccgattagttttgtgcctgttctacatctatgtttctctcttttttagatccttacatgaatgaacttgtcgtctacatcatcctcttattcggacagttgtcaaaatttacagcaagacttgttatgaatggaattggttgataagtttcaaagtacctgcttttttacgttgtactaattactgtattaatatctgtaataacgtgaaatactggcagcctttacagtctctagtgtagtggtggccttttctatatgttgtgaatctaatgcctgtattaaattctgttctatgttatg

SEQ ID NO: 1413 - DNA, 951 bp, Allium cepa
tttcaaattaaatcaaacttagggtttcacgaaatccctctctctacgcggaaaatctcaaaactccatggcaggatttagcggtgatgaaaccgcccccttctttggcttccttggcgctgctgccgccctcgtcttttcctgtatgggtgcagcatacggaacggcgaaaagtggcgttggagtagcgagcatgggtgtgatgagacccgagcttgtgatgaagtctatcgttcctgtagttatggcgggagttttgggtatttacggactgattatcgcagttattattagtactggaattaatccgaaggctaaaagttattatttatttgatgggtatgcgcatttgagttccgggttggcttgtggattagctggcctatctgctggcatggctattgggattgttggcgatgctggtgtgagggccaatgctcaacagccaaagctatttgtgggcatgattctcattctcattttcgcagaagcacttgctctttatggcctaattgttggtatcattctttcttcaagagctgggcaatctcgtgctgattaggtgatcaattcgcagtccttggcagtttgtgggtaatgtcatattcataaaaggtcatgcctctcaatcaattcatattgtgatccaattatcatgagcatttttgttctcattttttgttactttgtgatcgctttatgagatttatttgaaaacatgttttatatgggattccccctttgataaacttttattacaaacaattgattatctttgtaatatctctatactttcaaccttttgattgacgatccgtttgtttgtatttgcgaaaacggatgtatggtattatctgtatattttcatatatcgtttgcttttgacaagcaacttatagttctttccaggactacattttgtttgagcagtacatgggatgagttgtatat

SEQ ID NO: 1414 - DNA, 966 bp, Zostera marina
ccatcgatcttacctaacgatcagaggcttctaggaagcggatcccaaattttcaaatccagcgtcctcagatcgcaatagccgcaagcacaagtttctcgtagatcctcacgatcttcgtacagatccgattaatcatgtctacaaccttcagcggcgatgaaacagctcccttcttcggcttcctcggagccgcatcggctctcgttttctcatgcatgggggcagcatatggaacggcgaaaagtggggttggagtggcatcgatgggagtgatgagaccggagcttgtcatgaaatccattgttcctgttgttatggcgggagtgcttgggatctatggtttgatcattgcagttattattagcactgggattaatcccaaggctaagtcatactacctcttcgatggctacgctcatctttcctctggtcttgcttgtggtcttgccggtctttctgccggaatggccatcggaatcgtcggagatgcgggagtcagggctaatgcacagcagccaaaactctttgttggtatgattcttattctcatttttgctgaagctcttgcactttatggtcttattgttggcatcatcctatcatctcgtgccggccaatcccgagcagactaagcagcaaagaaaaacatgcattcaagaagaaacttcatcactcttcaatggttcaaatctttatttccatattcaattagcgagcatgtagtaataataatttccattgaagtgttttttccctctctccgtgtggcttattacgccttatttgacacaacatcaaaacttgtttaaaatgtggtgtggtgtggtgcagtgttgtatcttcttccttcattcccttcttttgttagggttttaaaaccctatattttgatgagtatgggttaccgttggtttattttcctttcataataaatttcatgcgatgcaatacaaatcttatttt

SEQ ID NO: 1415 - DNA, 968 bp, Zostera marina
cttaccctaacgatcagaggcttctaggaagcggatcccaaattttcaaatccagcgtcctcagatcgcaatagccgcaagcacaagtttctcgtagatcctcacgatcttcgtacagatccgattaatcatgtctacaaccttcagcggcgatgaaacagctcccttcttcggcttcctcggagccgcatcggctctcgttttctcatgcatgggggcagcatatggaacggcgaaaagtggggttggagtggcatcgatgggagtgatgagaccggagcttgtcatgaaatccattgttcctgttgttatggcgggagtgcttgggatctatggtttgatcattgcagttattattagcactgggattaatcccaaggctaagtcatactacctcttcgatggctacgctcatctttcctctggtcttgcttgtggtcttgccggtctttctgccggaatggccatcggaatcgtcggagatgcgggagtcagggctaatgcacagcagccaaaactctttgttggtatgattcttattctcatttttgctgaagctcttgcactttatggtcttattgttggcatcatcctatcatctcgtgccggccaatcccgagcagactaagcagcaaagaaaaacatgcattcaagaagaaacttcatcactcttcaatggttcaaatctttatttccatattcaattagcgagcatgtagtaataataatttccattgaagtgttttttccctctctccgtgtggcttattacgccttatttgacacaacatcaaaacttgtttaaaatgtggtgtggtgtggtgcagtgttgtatcttcttccttcattcccttcttttgttagggttttaaaaccctatattttgatgagtatgggttaccgttggtttattttcctttcataataaatttcatgcgatgcaatacaaatcttatttatataaatat

SEQ ID NO: 1416 - DNA, 1012 bp, Zostera marina
atcttaccctaacgatcagaggcttctaggaagcggatcccaaattttcaaatccagcgtcctcagatcgcaatagccgcaagcacaagtttctcgtagatcctcacgatcttcgtacagatccgattaatcatgtctacaaccttcagcggcgatgaaacagctcccttcttcggcttcctcggagccgcatcggctctcgttttctcatgcatgggggcagcatatggaacggcgaaaagtggggttggagtggcatcgatgggagtgatgagaccggagcttgtcatgaaatccattgttcctgttgttatggcgggagtgcttgggatctatggtttgatcattgcagttattattagcactgggattaatcccaaggctaagtcatactacctcttcgatggctacgctcatctttcctctggtcttgcttgtggtcttgccggtctttctgccggtatggccatcggaatcgtcggagatgcgggagtcagggctaatgcacagcagccaaaactctttgttggtatgattcttattctcatttttgctgaagctcttgcactttatggtcttattgttggcatcatcctatcatctcgtgccggccaatcccgagcagactaagcagcaaagaaaaacatgcattcaagaagaaacttcatcactcttcaatggttcaaatctttatttccatattcaattagcgagcatgtagtaataataatttccattgaagtgttttttccctctctccgtgtggcttattacgccttatttgacacaacatcaaaacttgtttaaaatgtggtgtggtgcagtgttgtatcttcttccttcattcccttcttttgttagggttttaaaaccctatattttgatgagtatgggttaccgttggtttattttcctttcataataaatttcatgcgatgcaatacaaatcttattttatataaatatccttttaagatgaaatatttgttataaattatattgtcaccccggt

SEQ ID NO: 1417 - DNA, 1136 bp, Abies balsamea
gacagccacttaactgacaactggcagtggtatgttaccggtaacctgctgagtgggataacgtgcttcatatgcatatgcatacgatttcgtaatcaccacttcttcaatgctctgagattgcatctggatcagccaaggcaatgcaagttcaggttcagttcgattcctccggaggctctgaagctctgaaaaaccctcgaagtcccagcaagaagttcgtcccagatctcggttaaaatggtggaagcattcagcggcgatgagactgctccattcttcggcttcctcggggccgccgcagcgcttgtgttttcctgcatgggagctgcctatgggactgccaagagtggcgtgggcgttgcctccatgggcgtgatgaggccagagcttgtgatgaaatcgattgttccagtcgtcatggctggagtgctgggtatttatggtttaatcattgctgtgattatcagcacaggtattaaccccaaggcaaagtcctattatttatttgatggatatgcgcatctttcatctggattggcttgtgggctttcggggcttgctgcgggtatggctattggtattgttggtgatgccggtgtcagagcaaatgcacagcagccaaagctctttgttggtatgatcctcatattgatctttgcggaagcacttgctctctatggtcttattgttggtattatactttcttctcgagctggccaatcacgagcagattaaagaagttacagttggtcttctgtttacttggttcatttgtgagtttttttgcaagactgctatcttctgcagtggaaatgtgattgttctcagtaggagataatattttgctcaagattcattgttaatctcttggtttgcaattttagacttaagaatttaatggtcaatttgaaggctcattacaatgcagaaattgaaccaggtaacaagtgggcattattgttggtgtcatttggcactatatgaaatcaaagtgtattattctaatttctgagctacttcaattgctgcagattattatagatttctactgatttgtgatttctgccgttgatatattggaattagaacaaaaaaaatgaatgaagaaaactgatcacaactctgcttttcat

SEQ ID NO: 1418 - DNA, 1192 bp, Amborella trichopoda
aattgaagaattttggcaaggatcattttgtatattaaaaatttagggtcattttggatatttcctccttgtagctccgcaccacaattgaagaattttgtgggggcacatataacaacacgcagccgcgacttgctgtgcggccttttccctgggacgaagaagcgaaggcacagagagagcgtgtgtgcgctttctagagagagaaagagacccttcgccattgcagctggtgtcaccagatctcactttctcccactagatctcaacctgcaagccctaaaaatggtttcattcagtggcgatgagactgcccccttctttggcttccttggagcggcggctgccctagttttctcctgcatgggggccgcttatggtactgctaagagtggcgtaggagtggcatccatgggtgtgatgaggcctgagcttgtgatgaaatccattgtaccagtggtcatggctggtgttcttggtatctatggcttgatcatcgcagtgattatcagtacagggatcaatcccaaggctaaaccttactatctgtttgatggttatgctcatctatcttctggtttggcctgtggtcttgctggcctttcggctggtatggccattggtgtagttggtgatgctggagtcagggccaatgctcagcagccaaagctctttgttgggatgattctcattctcatttttgctgaagcacttgccctctatggtctcattgtgggcatcattctctcatcccgagctggccaatccagagctgaataagacttcattgcatgtccttgtgaggttggtatttcacaaattagttaattgtattctgttgtattcatttttatggaccatttatatcttttacctgttctcatcccgtggtgaatgtggatagtagagaagagtcttcaggattggatgaaataaagcttgtgaagctgttcatctctgtattggtattgatcctaatgaatttgaagcttgcgcttgtggtcagcgtaactagtcaaggttcctgtagatttttgtgggaagactgcttaatatgtgttttttttttggttgattctgaacctcaatttacgtggtgggtacaataagaattctcgtatttgaaggtcaaaagagctgaatcaattttatgctatgagatttgccgatgcgatactgaatatctgacccc

SEQ ID NO: 1419 - DNA, 1113 bp, Amorphophallus konjac
cggagataacctgggcattcaccccagatctggtctggtactggagagtgtggacgcacgcagcgccctccacggccacgagaggacgacgtccccctctcccccaccgtcatccagcacgcacctctcgctgttcttcctcgctccctggaatcgaaggggaagaggaaaagagggggggaataccggaagttagggtgtttttccagagatctcgaatcccccgggaagaatgtccaccttcagcggggatgagacggctccgttcttcgggttcctcggcgccgcggccgcccttgtcttctcctgcatgggcgcggcgtacgggacggcgaagagcggggtcggggtggcgtcgatgggcgtgatgcggccggagctggtgatgaagtccatcgtccccgtcgtcatggcgggagtgctagggatctatggtttgatcatagcggtgattataagtacggggataaatcccaaggcgaagtcttattacctgttcgatgggtatgctcacctttcgtctgggctggcctgcggccttgcggggctgtccgccgggatggcgattggaattgtcggggacgctggagtgcgggctaatgctcaacaaccgaagcttttcgtgggtatgattctcatcctcatttttgccgaagcgcttgcactttatggtcttattgtgggcatcatcctctcatcacgtgctggtcaatctcgagccgattgacaatcagtgtagcagctattttcatccccaccatcatcttctcgtatacttacgcaaggcattcgacttagtccttggttttgttctcttgattctatcggtaatggtaaatctgcttgggacttgatgatttatgcgataagtttcagactcgcaaaatccataaatcgagcgatgtaatatgtcaccttttcttgttcttgtcccccttttttttgttaaacctgcggctcaagctgtagaccccctacgaaagctcccttcgcacgtgcatgaagttaaaaccttcatgtagagagatcctaattggtatgtgggagccccgaggaaggtcttttacggcaccggcagggtaggacaactctttttactccttgagggtcgta

SEQ ID NO: 1420 - DNA, 900 bp, Amorphophallus konjac
ctcctttgccttctgcgtcactcgtattaattattattatagcgcgggagggaaggaaggcggggaggagatcggaggagacgcagaactgccgaggcacaggaattagggtttccgagatctggattctggaatccctgacaggatgtcgacgttcagcggcgatgagacagctcccttcttcggcttcctcggcgccgcggcggccctcgtcttctcctgcatgggggcggcatacgggacggcgaagagcggggtcggggtggcgtcgatgggtgtgatgcggccggagctggtgatgaagtcgatcgtgcccgtcgtcatggcgggagtgctcgggatctacggtttgatcatcgcggtgatcattagcaccgggataaacccgaaggcgaagtcgtattacctgttcgacgggtacgctcacctgtcgtctgggctcgcctgcggcctcgcggggctctccgcggggatggccatcgggatcgttggggacgctggagtccgggccaacgcacagcaaccaaagctgtttgtgggtatgattctcatcctcatttttgctgaagcacttgcgctttatgggcttatcgttggcatcatcctctcatcccgtgctggtcaatctcgagctgattgacgcaggtgcagctgttgtcattttctctccattatcttctcatctctctacataggacatgtactgacgttcctgttttatcatcttgattctattcgtaacggagatctcacaatgggcttgatgttcgtgagtttgtgaatctgccccacatttaataagtcctcttctatgatgttctatcatcctataatatcttcggtcgttgtattgcccaagtggttactgtccatggcattgaataagttttgtgacttggg

SEQ ID NO: 1421 - DNA, 770 bp, Amorphophallus konjac
aaggcggggaggagatcggaagagacgcagaactgccgaagcacaggaataagggtttccgagatctggaatccctgacaggatgtcgacgttcagcggcgatgagacagctcccttcttcggcttcctcggcgccgcggcggcccttgtcttctcctgcatgggggcggcatacgggacggcgaagagcggggtcggggtggcgtcgatgggtgtgatgcggccggagctggtgatgaagtcgatcgtgcccgtcgtcatggcgggagtgctcgggatctacggtttgatcatcgcggtgatcattagcaccgggataaacccgaaggcgaagtcgtattacctgttcgacgggtacgctcacctgtcgtctgggctcgcctgcggcctcgcggggctctccgcggggatggccatcgggatcgttggggacgctggagtccgggccaacgcacagcaaccaaagctgtttgtgggtatgattctcatcctcattttcgctgaagcacttgcgctttatgggctcatcgttggcatcatcctctcatcccgtgctggtcaatctcgggctgattgacgcaggtgcagctgttgtcattttctctccattatcttctcatctctctacataggacatgtactgacgttcctgtttaatcatcttgattctattcgtaacggagatctcacaatgggcttgatgttcgtgagtttgtgaatctgccccacatttaataagtccttgtctatgatgttctatcatcctacaa

SEQ ID NO: 1422 - DNA, 933 bp, Amsonia hubrichtii
acgaacgtgtgatccagagcgtcacaagccagcaaagagaagagtcaaagatcaaaaaacaccattgttgcacgaaggagacccaaatatctttctaatccagaggggtctttgatcaatttttcgatcgatcgctcaaaaaccctgatcggaaagagaaaaagaaggatcatacagatgtcaacgactttcagtggtgatgaaactgctccattcttcggcttcctcggcgctgcggccgctctcgttttctcctgtatgggagctgcgtatgggaccgccaagagtggggtgggagttgcgtcgatgggagtgatgcggccggagctggttatgaaatcgattgttccagttgttatggctggtgtgttgggtatttacggtttgattattgctgtcatcatcagtactggaattaatcccaagaccaaagcatattatctctttgatggatatgcgcatctttcttctggcttggcttgtggtcttgcggggctttcagctggaatggctattgggattgttggcgatgctggtgtcagagcaaatgcacaacagccaaagctttttgttggtatgattctcatcctcatcttcgctgaggcgttggctctatatggattaattgttggtatcattctttcttcccgtgctggtcaatccagagctgattaaacaagtaagatcttccatcttcttacttgtttagtgttaagtaatgctagtcatgaggtgcactctctattgtggtttcatatgctacttcttcattctattgtttagtggtttatgctgcttgtaaatctggagaaaccttctccctcgaataaagatttgtaacgctggttttgccctttattcttattactgtacttttccctgggagagaaaggaaactgttttggggaatcactgcctctgtaatagaacttt

SEQ ID NO: 1423 - DNA, 760 bp, Arabidopsis lyrata
ttgtctcttcaccgatcagatctcaacgacgacgagtcatggcttcaagtttcagcggcgatgaaactgctcctttcttcggattccttggcgctgccgccgctctcgttttctcctgtatgggagcagcgtacgggacagcgaagagcggggttggtgtagcgtcgatgggtgtgatgagaccagagcttgtgatgaaatcgattgttccggttgttatggctggagttttaggtatttatggtttgatcattgctgttatcatcagtaccggaattaaccctaaggccaagtcttactatctattcgatggctatgctcatctctcttccggtcttgcttgtggtctcgctggtctctccgccggtatggctattggaattgtcggcgatgccggtgttagagcgaatgcacaacaacccaagttgtttgtgggaatgattctgattctcatctttgctgaagcacttgccctgtacggtctcattgttggtatcatcctttcttctcgagctggtcagtctagagccgagtgaaatccagagtctctctctcatatgggctatatccttgtaatgttttggtatattttacttccagtttttttcttttgtggtattgtgagtttttgagtttctcatgaaaacaagcaacatgggtgaaaattatttgacttttgtttcaaaaccatttctctttttcatttgcacactatatatggatacattaataagtaataaaatatgacgattcaacgatt

SEQ ID NO: 1424 - DNA, 858 bp, Arabidopsis thaliana
atatcattgacaaaaaaattggtttctctctcaaaatctgccaacagtttttgtctcattcccgatcagatctcaacgacgacgagccatggcttcaactttcagcggcgatgaaactgctcctttcttcggattccttggcgctgccgccgctctcgttttctcctgtatgggagcagcgtacgggacagcgaagagcggggttggtgtagcgtcgatgggtgtgatgagaccagagcttgtgatgaaatcgattgttcctgttgttatggctggagttttaggtatttatggtttgatcattgctgttatcatcagtaccggaatcaaccctaaggccaagtcttactatctattcgatggctatgctcatctctcttccggtcttgcttgtggtctcgctggtctctccgccggtatggctattggaattgtcggcgatgccggtgttagagcgaatgcacaacaacctaagttgtttgtgggaatgattctgattctcatctttgctgaagcacttgccctgtacggtctcattgttggtatcatcctctcttctcgagctggtcagtctagagccgagtgaaatccagagtatctctctctcttatcggctacagtccttgtaatgttttggtatattttactctgttttcttttgtggtatgtttttgagtttctcatgaaaacaagcaacatgggtgaaatttatttgacttttgtttcaaaacccatttcttttctttttcatttgcacactatatatggatacatcaataagtaataaaatatgacgattcaatgattctgtagcctttgtaacttctcagaagcaatgatttgagtattgtgttgttg

SEQ ID NO: 1425 - DNA, 720 bp, Persea americana
agtgaccattacggccgggggagatgagtcggagttggactgactagccgaaaataacaaaagaggaatagcttctctccatccacgttcgagatttctccaaaattcagatcgagatccccaaacatggctaatttcagtggagatgaaacggcccctttctttggattcctcggcgctgcagctgccctagttttctcctgcatgggagcggcgtacggaacagcgaagagcggtgtcggcgtggcttccatgggcgtcatgaggccggagctcgtgatgaaatcgatcgtgcccgttgtcatggccggagtactgggaatctatggtctgattatcgccgtcatcatcagcaccgggatcaaccccaaggcgaaatcctattacctgtttgacggttacgctcatctgtcgtccggtctttcttgcggcctcgccggtcttgcagctggaatggcgatcggtatagtcggtgatgctggcgtcagagcaaatgcccagcagcccaaactctttgttggaatgatcctaatcctcatctttgctgaagcgcttgccttgtacggccttattgtcggcatcattctttcttcacgagcgggccaatcaagagcagactaggcgaaaagtagagtggagctgttgtcactcttgattttctcctacgctttgaaagcttgtctccatcctaaaaatgatttgttgtggtgagctgcatgt

SEQ ID NO: 1426 - DNA, 738 bp, Brassica oleracea
  misc_feature (71)..(71): n is a, c, g, or t
  misc_feature (74)..(74): n is a, c, g, or t
  misc_feature (459)..(459): n is a, c, g, or t
  misc_feature (624)..(624): n is a, c, g, or t
ggggggatctctcgcaatcgcaaatcatcaaacggtttttgtctctttgcgatcagatctcatcggagagnagntatggcttcaggtttcagcggcgatgaaactgctcctttcttcggattcctcggcgctgccgccgctctcgttttctcctgtatgggagcagcgtacgggacagcgaagagcggggtcggcgtggcgtcgatgggtgtgatgagaccagagcttgtgatgaaatcgattgttcccgtggttatggctggtgtgttaggtatctatggtctcatcattgctgtcatcatcagtactggaatcaaccctaaggccaagtcttactacctcttcgatggctatgctcatctctcttccggtctcgcttgtggtctcgccggtctctccgccggtatggctattggtatcgtcggcgacgctggtgttagagcgaatgcacaacaaccnaagctgtttgtgggaatgattctgattctcatctttgctgaagcactggcgttgtacggtctcattgttggtatcatcctctcttctcgtgctggtcagtctagagccgagtgaatgcagaaagctttttcataatgggtcaagtccttttgttatgttctgtgntatatttcactttcagttttcttttgtgggattgtgagtttttgagtttctcatcaaaaaacaagcaatttgggtgataaactgataatcatttatgactttggttctaaatag

SEQ ID NO: 1427 - DNA, 617 bp, Brassica oleracea
  misc_feature (342)..(342): n is a, c, g, or t
  misc_feature (363)..(363): n is a, c, g, or t
  misc_feature (378)..(378): n is a, c, g, or t
  misc_feature (381)..(381): n is a, c, g, or t
atggcttcaggtttcagcggcgatgaaactgctcctttcttcggattcctgggcgctgccgccgctctcgttttctcctgtatgggagcagcgtacgggacagcaaagagcggggttggtgtggcgtcgatgggtgtgatgagaccagagcttgtaatgaaatcgattgttccggtcgttatggctggtgtgttaggtatctatggtctgatcatagctgtcatcatcagtactggaatcaacccaaaggccaaatcttactatctcttcgatggctacgctcatctctcttccggtctcgcttgtggtctcgccggtctctccgccggtatggctatcggnatcgtcggcgatgccggtgtnagagcgaatgcacancanccaaagctgtttgtgggaatgattctgattctcatctttgctgaagcacttgcgctgtacggtcttatcgttggtatcatcctctcttctcgtgctgggcagtctagagccgagtgaactctgaaagtctctgttcttatgtgctaaatccttgtaatgtttttagattatatttcactttcaatatttcgtggcattgttgttagtttttgagtttcttatgaataaacaagcaa

SEQ ID NO: 1428 - DNA, 912 bp, Brassica rapa
aaccgccagcaatttactaaatctcattgttgacataagttcggtttccttctctctctctcgcaaaacatcaaaccgttttgtctctttgcgatcagatctcatcggagagcaattatggcttcaggtttcagcggcgatgaaactgctcccttcttcgggttcctcggcgccgccgccgctctcgttttctcatgtatgggagcagcgtacgggacagcgaagagcggggtcggcgtggcgtcgatgggtgtgatgagaccagagcttgtgatgaaatcgattgttcccgtggtcatggctggtgtgttaggtatctatggtctcatcattgctgtcatcatcagtactggaatcaaccctaaggccaagtcttactacctcttcgacggctatgctcatctctcttccggtctcgcttgtggtctcgccggtctctccgccggtatggctattggtatcgtcggcgacgctggtgttagagcgaatgcacaacaaccgaagctgtttgtgggaatgattttgattctcatctttgctgaagcactggcgctgtacggtctcattgttggtatcatcctctcgtctcgtgctggtcagtctagagccgagtgaactcagaaagccttttggtcaagtccttttgtaatgtttatgatatgtttcacttttggttttcttttgtggcattgtgagttttttgagtttctcatgggaacaagcaaaacatgggtgataatcatttgactttctggttctaattatatttttcatttgcacactctatggaatacttcaataattaataaaacaatatgatgatttagtacctttttattgtcaactgatgagttactgacatgaatcctttatctagctcttaaagcactgatgacatgcgtctttctcatt

SEQ ID NO: 1429 - DNA, 705 bp, Musa acuminata
ggcgtcccgactccgcgcgacgatgtcgaccttcagcggcgatgagactgcccccttctttggattcctcggagccgccgcggctctcgtgttctcctgcatgggggcggcgtacgggacggccaagagcggagtcggggtggcgtcgatgggagtgatgcggccggagcttgtgatgaagtccatcgtgcccgttgttatggccggagtgctcgggatctacgggttgatcattgcggtgattattagcaccgggataaaccccaaggcgaagtcatactacctctttgatgggtacgcgcacctctcctcgggactcgcctgtggtctcgctggcctctctgccggaatggcgattgggatcgtcggtgatgccggagtcagggccaacgctcaacagccgaagctatttgtaggcatgattcttattctcatttttgctgaagcccttgctctctatggtctcattgttggaatcatcttgtcttctcgggctggtcaatctcgggcagattaagaaaacatgattgctatgtcatattccgtgcccccatatgtcactatggtaacaaacaggtgttccctttaagctttatgatcacacactaatatttgtttggcacgttactggcatgagttgtcggttgacggctgttgaattcttattcttaataatgtgatgttttgatcgatcttgtaagtaag

SEQ ID NO: 1430 - DNA, 1077 bp, Phaseolus coccineus
gagcgtgagattataaagggaatagacatggaaatcccacgttttcttcacggcaatagaatcatcgagacacgctcagagatcggtctctgccgagaatttgaatttctcagatctatccgacgtcgttgcagatccatcaacggtcatggctggcttcagcggtgatgaaacggcaccgtttttcggcttcctcggagccgcagctgccctcgtcttctcctgcatgggagctgcctatggaacagcaaagagtggtgtgggcgtggcttccatgggtgtaatgagacctgagctagtgatgaagtctattgttccagttgttatggctggagttttgggtatttatggccttattattgctgttattattagtaccggtattaatccaaaggccaaatcttattacctctttgatggttacgcacatctctcctctggtcttgcctgtggcttggctgggctgtctgctggcatggctattggtattgttggtgatgctggtgttagagccaatgcacagcaaccaaaactttttgttggaatgattctcatcctcatttttgctgaagctcttgccctctatggtctcattgttggtattatcctgtcttctcgtgctggccagtctagagccgactaagaaaggagttgtgctaaatattctttgaccacccatctgttttaacctccttttaaagggggtgagggaggtaattactagttgttgcgagattagctatgttcaggcagcattttcaggctttagcaattgtgtgaaagttcaattcgccatttgtggtgtttgtttgtataattagggctatctttacttaataaagcttcttaagcttcctctctttttttctttattgattgtgttatgccatatcatctgaccttatatatattttttgggctgttgaaactggtgcatgtaatgatttggctagcaatgaaaacgtatttcatgggtctttccattttggaattggtaatagctgttttttgtgttaaattttttgtttatggtttggtgaaaaatgaatcatataattgaaagaactgaaatgaaag

SEQ ID NO: 1431 - DNA, 951 bp, Phaseolus coccineus
tttttttcttccaaaattcatttccacattccactttgatctgatctccacaaacccgatcaatttcatcaatcttctatttcttccacaaagaacaaagagagaaagtttcatcatcgtagcagaggaattgaatctaaccatggcaggtttcagtggcgacgaaaccgctcctttcttcggcttccttggcgcggccgcggctctcgttttctcctgtatgggagcagcgtacggaactgcgaagagtggggtgggagtggcgtcgatgggtgtgatgaggccggagcttgtgatgaagtcgattgtgccggtggttatggctggagtgttggggatctatgggttgattattgcggtcatcattagcactgggataaaccccaaggctaagtcttactatctatttgatggctatgcccacttgtcctctggccttgcctgtggccttgctggcctctctgctgggatggccattggaattgttggggatgctggtgttagggctaatgctcagcagccgaagctgtttgttggtatgattcttattttgattttcgctgaagctcttgctctttatggcctcattgtgggtatcatcctttcatctcgggcaggccaatctcgtgctgattaaaacgagccaactcagtgatacttggtagtccagtaatttttattctcaggcttgtatttgaaatgggagatatttgtctttcgtctattgctattatttcatttattttcgtacacaaaccctgtatccaaactccatcagttttatgaagtattttccaatggattacttatttggatggctgcattgttatgtgatatttgtttgttgtgcagaatcacaggaaattattgatacaatatagatgtagaagttaaaactattgatgatttgcctatctttgttgcagtatatgaactttcatgaaattagga

SEQ ID NO: 1432 - DNA, 813 bp, Brassica napus
gaaccgccagcaattactaaaatcattggtttcggtttccttctctctctatctctcgcaatcgcaaatcatcaaacggtttttgtctctttgcgatcagatctcatcggagagtagctatggcttcaggtttcagcggcgatgaaactgctcctttcttcggattcctcggcgctgccgccgctctcgttttctcctgtatgggagcagcgtacgggacagcgaagagcggggtcggcgtggcgtcgatgggtgtgatgagaccagagcttgtgatgaaatcgattgttcccgtggttatggctggtgtgttaggtatctatggtctcatcattgctgtcatcatcagtactggaatcaacccaaaggctaagtcttactacctcttcgatggctatgctcatctctcttccggtctcgcttgtggtctcgctggtctctccgccggtatggctattggtatcgtcggcgacgctggtgttagagcgaatgcacaacaaccgaagctgtttgtgggaatgattctgattctcatctttgctgaagcactggcgttgtacggtctcattgttggtatcatcctctcttctcgtgctggtcagtctagagccgagtgaatgcagaaagctttttcataatgggtcaagtccttttgtaatgttctgtgatatatttcactttcagttttcttttgtgggattgtgagtttttgagtttctcatcaaaaaaacaagcaatttgggtgataaactgataatcatttatgactttggttctaaatattttttttgctatatggatttacatcaataa

SEQ ID NO: 1433 - DNA, 793 bp, Brassica napus
cctgcagtccggtccggaattctgggtcgagggcgcgtccgccgttttgtctctttgcgatcagatctcatcggagagcaattatggcttcaggtttcagcggcgatgaaactgctcctttcttcggattcctcggcgctgccgccgctctcgttttctcatgtatgggagcagcgtacgggacagcgaagagcggggtcggcgtggcgtcgatgggtgtgatgagaccagagcttgtgatgaaatcgattgttcccgtggttatggctggtgtgttaggtatctatggtctcatcattgctgtcatcatcagtactggtatcaatcctaaggccaagtcttactatctcttcgacggctatgctcatctctcttcgggtctcgcttgtggtctcgccggtctctccgccggtatggctattggtatcgtcggcgacgctggtgttagagcgaatgcacaacaaccgaagctgtttgtgggaatgattttgattctcatctttgctgaagcactggcgttgtacggtcttattgttggtatcatcctctcgtctcgtgctggtcagtctagagccgagtgaactcagaaagccttttggtcaagtccttttgtaatgtttatgatatgtttcacttttggttttcttttgtggcattgtgagtttttgagtttctcatgggaacaagcaaaacatgggtgataatcatttgactttctggttctaattatatttttcatttgcacactctatggaatacttcaataattaataaaacaatatgatgatttagt

SEQ ID NO: 1434 - DNA, 768 bp, Brassica napus
gctctaagtttgctctctcaaaatcgtttcttcgcgatcggatctcatcggaagagacacacaatttcacgacgagcgatggcttcaggtttcagcggcgatgaaactgctcctttcttcggattcctgggcgctgccgccgctctcgttttctcctgtatgggagcagcgtacgggacagcaaagagcggggttggtgtggcgtcgatgggtgtgatgagaccagagcttgtaatgaaatcgattgttccggtcgttatggctggtgtgttaggtatctatggtctgatcatagctgtcatcatcagtactggaatcaacccaaaggccaagtcttactatctcttcgatggctacgctcatctctcttccggtctcgcttgtggtctcgccggtctctccgccggtatggctatcggcatcgtcggcgatgccggtgttagagcgaatgcacaacagccaaagctgtttgtgggaatgattttgattctcatctttgctgaagcacttgccctgtacggtctcattgttggtatcatcctctcttctcgtgctggtcagtctagagccgagtgatatcagaagttcgtttcatatgtgcgaaacccttgtcatgtttttgatatatttcacttcctttttgtggcattgtgagtttttgtttttctcatgaaaaaacaagcaaacaatcattgaatttggttttatatattttttgaaaaaaatttgcacactgtaagaaataccccaataagtaataaatatgat

SEQ ID NO: 1435 - DNA, 742 bp, Brassica napus
aaagtttggtttccttctctttaaacagcttttgtctctttggcgatcagatctcaccggagacgagcgatggcttcaggattcagcggcgatgaaactgctcctttcttcgggttcctcggcgcagccgccgctcttgttttctcatgtatgggggcagcgtacgggacagcaaagagcggggtcggtgtggcgtcgatgggggtgatgagaccagagcttgtaatgaaatcgattgttccggtggttatggctggtgtgttaggtatttacggtctgatcatagctgtcatcatcagtactggaatcaacccaaaggccaagtcttactatctcttcgatggctatgctcatctctcttccggtctcgcttgtggtctcgccggtctctccgccggtatggctatcggaatcgtcggcgatgccggtgtcagagcgaatgcacagcaaccaaagctgtttgtgggaatgattctgattctcatctttgctgaagcacttgcgctgtacggtcttatcgttggtatcatcctctcttctcgtgctgggcagtctagagccgagtgaactctgaaagtctctgttcttatgtgctaaatccttgtaatgtttttagattatatttcactttcaatatttcgtggcattgttgttagtttttgagtttctttatgaataaacaagcaaatatcatttgaacttggttttctaattgtgttttctttttaaaaataaataaatt

SEQ ID NO: 1436 - DNA, 734 bp, Brassica napus
gcgatcggatctcatcggaagagacgcacaattcacgacgagcgatggcttcaggtttcagcggcgatgaaactgctcccttcttcggattcctcggcgccgccgccgctctcgttttctcctgcatgggagcagcgtacgggacagcgaagagcggggtcggtgtggcgtcgatgggtgtgatgagaccagagcttgtaatgaaatcgattgttccggtcgttatggctggtgtgttaggtatctacggcctcatcattgctgtcatcatcagtactggaatcaacccaaaggccaagtcttactatctcttcgacggctacgctcatctctcttccggtctcgcttgtggtctcgccggtctctccgccggtatggctattggcatcgtcggcgatgccggtgttagagcgaatgcacaacagccaaagctgtttgtgggaatgattctgattctcatctttgctgaagcacttgcgctgtacggtctcattgttggtatcatcctctcttctcgtgctggtcagtctagagccgagtgaagtcataaagtcttttcgttatgtgcgaaacccttgtcatgtttttgatatatttcacttccttttttttgtggcattgtgagtttttgcttttttcatgaaaaaacaagcaaataatcatttgaatttggttctaaatatttttttttttaatttgcacactgtaagaaatacccccaataagtaataaat

SEQ ID NO: 1437 - DNA, 769 bp, Brassica napus
gggttgacataagttcggtttccttctctctctctcgcaaaacatcaaaccgttttgtctctttgcgatcagatctcatcggagagcaattatggcttcaggtttcagcggcgatgaaactgctcctttcttcggattcctcggcgctgccgccgctctcgttttctcatgtatgggagcagcgtacgggacagcgaagagcggggtcggcgtggcgtcgatgggtgtgatgagaccagagcttgtgatgaaatcgattgttcccgtggtcatggctggtgtgttaggtatctatggtctcatcattgctgtcatcatcagtactggaatcaaccctaaggccaagtcttactacctcttcgacggctatgctcatctctcttccggtctcgcttgtggtctcgccggtctctccgccggtatggctattggtatcgtcggcgacgctggtgttagagcgaatgcacaacaaccgaagctgtttgtgggaatgattttgattctcatctttgctgaagcacttgcgctgtacggtctcattgttggtatcatcctctcgtctcgtgctggacagtctagagccgagtgaactcagaaagctttttcataatgggttaaagtccttttgtaatgttctttacttctatgatatattttcactttcagttttcttttgtgagtttctcatcaaaaaacaagcaacatgggtgataaactgataatctatttgtactttggttctaaatattttacaaaaaaaaaaaaaaaa

SEQ ID NO: 1438 - DNA, 835 bp, Brassica napus
attgttgacataagtttggtttccttgtctctcccaaatcttcaaacagctttgtctctttgcgatcagatctcaccggagacgcacaaattcgcgaagagcgatggcttcaggtttcagcggcgatgaaactgctcccttcttcggattcctcggcgccgccgccgctctcgttttctcctgtatgggagcagcgtacgggacagctaagagcggggttggtgtggcgtcgatgggtgtgatgagaccagagcttgtaatgaaatcgatagttccggtggttatggctggtgtgttaggtatttacggtctgatcatagctgtcatcatcagtactggaatcaacccaaaggccaagtcttactatctcttcgatggctatgctcatctctcttccggtttagcttgtggtctcgccggtctctccgccggtatggctatcggaatcgtcggcgacgccggtgtaagagcgaatgcacaacaaccaaagctgtttgtgggaatgattctgattctcatctttgctgaagcacttgcgctgtacggtcttattgttggtatcatcctctcttctcgtgctggtcagtctagagccgagtgaaaccagaacgtctctgttcttatgtgctaaatccttgtaatgtttttagatatgttttcacttccgatactcatggcattgcgagttttttgattttctcatgaataacaagcaaaaatcatttgcatttggttctaaatgtttatttcatttgctcactttattgaatacatccataagatgattcagtgattttggttagtgttcttgatattgttatgtctaattcgactt

SEQ ID NO: 1439 - DNA, 891 bp, Brassica napus
aaaacttcgaacatgtctacgttcagcggcgacgaaacagctcccttcttcggtttcctcggcgccgcagccgcactcgtcttctcctgtatgggagctgcttatggaacggcaaagagtggtgttggtgtggcttccatgggagtgatgagacccgagcttgtgatgaaatctatcgtccctgttgttatggctggtgtgttgggtatttacggattgattattgctgttatcatcagtaccgggattaaccccaaggctaagtcttacttcctcttcgacggatacgcccatctctcttccggtcttgcttgtggtcttgctggtctttccgctggaatggccattggtattgtcggagatgctggtgtcagggcaaatgctcagcagcctaagctctttgtcgggatgattcttatccttatcttcgcagaagcgcttgcgctttacgggcttattgtaggaatcatcctctcctctagagctggccagtctagagctgaatgagaaagtaccccaaaggtacttcttttactttctgtgtgctttatttagtatgtatcatcgaaaactggaacatttactggattcttggaactttgtttcagaagcaaaaccacctatggtttatttattatttggttctgtaataaagagctcggaggagctttggtatgttttttttttgtattcttgtattgtcctgaggaagtaagttataatacatgtatttgtaaagaagtttgctttctgaaaccatcttgctctctcctctggtgttgtgttcgtgaagttgttgttttgttttcttggtgaagttttatgtcattattttcattcatgtttaaagtttcgtgacaaaagtataaagaaaaagaatttttgattcac

SEQ ID NO: 1440 - DNA, 908 bp, Manihot esculenta
gagctcctttttcacgaccaaaaagtagtactacggcgatcgaaacttcagattctctctgcgatcccagaaccgaacaacatcgtttttagatccgttaatcgaccatgacttctggtttcagcggcgatgaaactgctcctttctttggcttcctcggcgccgctgccgctctcgtcttctcctgtatgggagcagcatatggaacagctaagagtggtgttggtgtggcatcaatgggagtgatgaggcctgaactcgtaatgaagtcaattgtaccagttgttatggctggtgtgttgggtatatatgggttgattattgcagttattatcagtaccggaattaaccctaaggccaagtcatattacctgtttgatgggtatgcacatctctcatctggtcttgcttgtggccttgctgggctttctgctggaatggccattggaattgttggtgatgctggtgtccgagctaatgcccaacagcctaaactttttgttggaatgattcttatcctcatttttgctgaagcgttggcattgtatggactcattgttggcattatcttgtcttcccgagctggccagtctagggcagaataagcagggagattagtacctattgttattcttttatggcttagtggtgagaaagatttaatgattgttcactgattattgatagtagggaatcccttgcactgttttgaaattatggaagtcactgtgttgcctgggcacttggtggtttctttgtgctctttgcagaagtaggactgagtcagtttatatgcagaataaaagctggtgaagctgtaatatttttttatttttctctgaatgtatcaatgtgttttgcggactatcaactgttgcagatgacttcaatttcaggtccaattcatc

SEQ ID NO: 1441 - DNA, 964 bp, Manihot esculenta
ttgtttgattcagattggagattagctagaagcatcaaactccatatttttttgatctaaatcaggaggaaactgaaaatcggagatcaatgccttcgacattcagcggcgatgagactgctcctttctttggcttccttggcgctgctgccgcgcttgttttctcctgcatgggagctgcgtatggaaccgcgaagagcggggttggtgtggcgtccatgggtgtcatgagacccgagctggtgatgaaatcgattgtgcctgtggttatggctggagttttgggtatatacggtttgattattgctgtgattatcagtaccggaatcaatcccaaggccaagtcgtattatctcttcgatggatacgctcacctctcttctggtctcgcctgtggccttgctggtctctctgctggtatggcaattggcatcgtaggggatgcaggtgttagagctaatgcacaacagccaaagctttttgttggaatgatcctcattctcatttttgctgaagcactggccctctatggcctcattgttggcatcatcctctcctcccgagctggtcaatcaagagctgagtaaaagaggaggggtgctcctctcttgaatcttttgattcattaaggaatatcataatattggtgagagtaggaagtgtttttactgaggcctccagtgtgagattctgccaaatggattggttcagcgctattgctgtagattgtagtgaattgcatggttagttgttagttcttctctctaactaaagttgtgattgtttcattgttcgtgttgtattttgtggatttatttaggaagatcttcggaattatcttcctactgcattttgcatgagataaaactatgaagtagagggccttctgtaaactctcaattagttggtggtaagtacagtgcagtctagtattgcctgttaattatttgctggacggttaaat

SEQ ID NO: 1442 - DNA, 1114 bp, Manihot esculenta
atctctgtcccatctcaaaccgacggtacatgtctgttagagtgtgaaagcgaggaaggaagagcgttcccggagtcgaaacccttacctccttctctcttgtgaacgaatctgtgattaaattcccagtttctgatggcctctggatttagtggcgatgaaacagcgcctttcttcggcttccttggcgctgctgctgctcttgttttctcttgtatgggagctgcctatgggactgccaagagcggtgttggagtagcgtcaatgggcgtgatgagaccggaactcgtcatgaaatcaatagttccagttgttatggctggagttctcggtatctatggtttgattattgccgttattattagcactgggattaaccctaaagccaaatcatattacctctttgatggttatgctcacctttcatcgggtctggcttgtggtctcgctggcctttctgctggtatggctattggtattgttggcgatgctggtgttagagctaatgcgcagcagccaaagctttttgttggtatgattctcattctaatctttgctgaggcactggctctgtatggactcattgttggcatcatcctctcttcccgagctggccaatccagagctgaatagaatgcgtggttgttggcatcactggttactccgagtagttcaagattggaaaactactgggcacggtatttggtaacctactccgaaattgtcttcttggtttatggtcatcagctagtatttttggttttcaatatcatcgtggcttcataaaagcacattgtcattgataagaaatgcaaagagtctcaatcccaaatatttaagcgctgcgagttgaataatgatatcactgctgctcgacaataagtattttggaagtgtcttcctagatggatgctcttttttaattaagcaatatttgctgtttgtggatattatttttctctcattatttcctgtatttggtacctgtttaagttgtagtatttcatatgatttggttacacgatgctagaaagtgagagcatatagtctctcaagttcggagtagtatgattatgtttattttactgtccagagcaacacattaccgtgatct

SEQ ID NO: 1443 - DNA, 933 bp, Manihot esculenta
ttcaaattccccaatttctaatggcctctggatttagcggcgatgaaacagcgcctttctttggcttccttggcgctgccgctgcccttgttttctcttgtatgggagctgcctatgggactgccaagagcggtgtcggagtagcgtcaatgggcgtgatgagaccggagctcgtgatgaaatcaatagttcctgtagtcatggctggagtcctcggtatctatggtttgatcattgctgttattattagcactgggattaaccctaaagccaaatcatattacctctttgatggttacgctcacctttcttcgggtctggcttgtggtctcgctggcctttctgctggtatggctattggtattgttggtgatgctggcgttagggctaatgcacaacagccaaaactttttgttggcatgattctcattctaatctttgctgaggcactggctctgtatggactcattgttggcatcatcctttcttcccgagctggccaatccagagctgaataggatgcctggttgttcgcatcacttcaagttattctgagtttggtgatgcgagttgatagtgcatgtgttttatcaagttatttgtcatgcacgtgatttccttcaaatttattagtgggcccttcaaataaagttggcatgattcttgatatctttgttgtattctacataaaaatagttcaaacttgcaaaactagtgtccgcgttttttgagtataaacttgtcttttctttttcttcttcttattttctttttcttcttcttcttattttctaatcatcggcttgtgtggtattacgattgaatagttttacctcactaataggttatgtctttttctttcatgtcccatgtgattttatattttgttgaaacatattgtgaaatgtgacttcgatttggtgatttcatacc

SEQ ID NO: 1444 - DNA, 1241 bp, Manihot esculenta
attagagatagctaaaagcatcaattccagttttttcttttttttttctcccttcaaaatcaggaggaaagtgaaaatcagcgaaaaatggcatcgacgttcagcggcgatgagactgctcctttctttggcttccttggcgctgctgctgcacttgttttctcatgcatgggagctgcgtatggaaccgcgaagagcggggttggtgtggcgtctatgggtgtgatgagacccgagctggttatgaaatcgattgtgcccgtggttatggctggagttttgggtatatatggtttgattattgctgtgattatcagtaccggaattaatcccaaggccaagtcgtattatctcttcgatggatacgctcacctctcttctggcctcgcctgtggcctcgctggtctctctgctggtatggcaattggcatcgtaggggatgcaggtgttagagctaatgcgcaacagccgaagcttttcgttgggatgatcctcattctcatctttgctgaagcattggccctctatggtcttattgttggcatcatcctctcctcccgagcaggtcaatcaagagctgagtaggagagtttactttttgaatcagttgagtcatccaaaaatattctgtattggttaaaatgggaagttttttactgaagaattattgtctccaatctgcagtgtgattttctgcgaaatagattggttcagttccattgctgtagacggtagtgaaatacagggttaggtattagttcttcccttgaagttgtcatcgtttcattattcacattgtattttgtgaatttatttgatgtccttgtagggagattgcccctttgtgcttctagaaaaataaaaataaaaagtaaaagaattatcaagtagtgggtcttttcataaatactgattagtgggtggcttatgcgtgtccactgtctcctatttctattattttggtgtttctttgtgctttctgttttgaaatttttcttcaggcgacttcctttccagcaccggcagctgattggaggcggcagactctacctttgcagtaacgaacttgggtttgggatatggacttggactgtattcgggcttgggttgcgtctaaacctttgttttaaacactttttttttttctcttttcttagaccataagctttgttgctggacttttgtttttatcatgtagttggacttaggcctattatcgatgcagcttctctctctctttc

SEQ ID NO: 1445 - DNA, 800 bp, Chelidonium majus
agaagaacagttcgtagatctcatctgctgcaactgaaacccaaaaaggtttagggcttctcagatctctcttccaacaaccaaaaaaaaaaaaatgtcaacttttagtggcgatgaaactgctccattcttcggcttccttggagccgctgctgctcttgttttctcatgcatgggagctgcttatggaacagcgaagagtggtgtaggagttgcatccatgggtgtcatgcgacctgagctcgtcatgaaatcgatagttccagtggtcatggcaggagttttgggaatttacggtttgattatcgctgttattattagtactggaattaatcctaaggctaaatcttattatttgtttgatggatacgctcacttgtcctctggtcttgcttgtggtcttgctggtctttctgctggaatggccatcgggatcgtcggtgatgctggtgttcgggccaacgcacaacagccaaagctgtttgtgggtatgattctaattctgatctttgcagaagcacttgctctatacggtctcattgtgggtatcattctctcgtcccgggctggtcaatctcgagcagattagaagagggtgaagtaagcttgtgattttataattgtagttttataatagaatcaaggacttgaaaccatgctttgattttcttattttatttttgattcatttaagacttatttgtatacgtgtcgggggctgtctactttagttctctaaacaattttctctcctatgtgaaatgtttctgtcttttgggattttattaaatgcagatttt

SEQ ID NO: 1446 - DNA, 728 bp, Castanea mollissima
gtcttcttcatcagtgttcagcggcgatgaaacagccccattctttggcttcctcggcgctgctgccgccttagtcttctcctgtatgggagcggcgtacggaacggcgaagagcggagttggggtggcgtcgatgggtgtgatgaggccagagctggtgatgaagtcgatcgtgccggtggtcatggctggtgtgttgggtatttatggtctcatcattgctgtgattatcagcacagggattaacccaaaggctaagtcctattacctcttcgatggctacgcccatctctcttctggtctctcttgtggcctcgctggcctctctgccggtatggctattggtatcgtcggtgacgctggtgtcagagccaatgcacaacagccaaagctttttgttgggatgattcttattcttatttttgctgaagcactggctctctatggtctcattgttggcatcatcctttcttcccgagctggccagtccagagctgactgaaactgagagcacattcttctgggtggttgcggttgtggttgtgtggtttattgctattaatttggaagtgtttttttactagagattcttgtggctgtgggtgagtgcaattattctaccaatatatgttttaggaagttgccttgctatggtgataggatatagaattagaaattagttgctactcttaaattttaataaagttttttttcatctttgtgattca

SEQ ID NO: 1447 - DNA, 724 bp, Cichorium intybus
cgggggagttggattctagaaaacaaaatcctcagatccgagcaatttttctgcagatctacactcgaaattcaatcatcatgtgctcaacattctccggcgatgaaacggctccgttcttcggcttcctcggcgccgcggcagccctaatcttctcctgcatgggggcggcatatgggacggcgaaaagcggtgttggtgtggcgtcgatgggagtgatgaggccggagttggtgatgaagtcgattgtgccggtggttatggctggagtgttaggtatttacgggttgattattgcagttattatcagtaccgggattaacccgaaggccaaatcttactatctcttcgatggttacgctcatctctcttccggccttgcttgtggccttgctggtctttctgctggtatggctatcggaattgttggtgatgctggtgttagagcaaatgcacaacaaccaaaactatttgttggaatgattttgattctgattttcgctgaagctttggctttatatggtcttattgttggcatcattctatcttcacgagctggccaatcaagagcagactagattcatggtagcttttagaccaaaaattctagcttttgttataataagatttgtattatttttgtcattggaattattttggagatttgtcccacatttgttggcaactctttttatcttatgctcaaaaattccgttttataatt

SEQ ID NO: 1448 - DNA, 798 bp, Cirsium arvense
tattcccttctccggcgaccaattttccggccatccaaatctcttttccgatctccggcaaatacaatcggaattaatgtcgtcgtctactttcagcggcgatgaaaccgctcccttcttcggcttcctcggtgccgcagcagcccttgttttctcctgtatgggcgctgcgtatgggacggctaagagcggcgttggtgttgcatcgatgggagtgatgaggccggagctggtgatgaagtcgatcgtgccggttgttatggcgggagtgttaggtatttacggattgattattgctgttattattagtaccggaatcaatccaaaggccaaatcctattatctgtttgatggctatgcgcatctctcctctggtcttgcttgtggtcttgctggactttccgccggaatggccatcggaatcgttggcgatgctggtgttagggcaaatgcacagcagccaaagcttttcgttggaatgattcttattctaatctttgctgaagcacttgcgttatacggtctgattgttggcatcatcctgtcctcccgtgctggccaatccagggctgattaagttgtacaatttctcatccatccatccaatcatatcatcttatgaggttagtttcacaagttgagaagatccagattcatcttttcaagatcttgctcctatcttccttcccgttatcaaattatttgttagttattaaactggaagcaacttttgccctcaaataaagacttaaactagcattgtttatttacctattctgtattatatatacatatcat

SEQ ID NO: 1449 - DNA, 820 bp, Cleome gynandra
gggggggtctccatcattttcatttagtcgtttcctttcctggatccgatcaaccttcgaaggatacagagatcttatccaggccgaggataccgttattccgatcatctctccgtgtatcctcacatcctaacgaagagatttcaagcgccatggcttcgggtttcagtggcgacgagactgctcctttcttcggcttcctcggagccgccgctgctctcgtcttctcatgcatgggtgctgcatatggcacagcaaagagtggggtcggtgtggcgtccatgggtgtgatgaggcctgagcttgtcatgaagtcgattgttccggtggttatggctggagtattggggatttacgggttgattatagccgtcatcatcagtaccggaatcaacccaaaagcgaagtcatactatctctttgatggttatgcacacttatcatcaggtcttgcttgtggactcgctggcctttctgctggaatggctattgggatcgttggtgatgctggtgttagggcaaacgctcagcaaccgaagctctttgtgggaatgattctcattctgatctttgccgaggctcttgctctctatggtctcatcgttggcatcatcctctcatcccgagctggacagtctcgtgcggagtgacgtaccaatctgtttgctcctcacattgttttccaatcggaatttgttcatgttccgttcactcatcatagtttgatatcgtgtatcaccatttcagattgagttcaatgaataaacaaaaacaattgtagattatagatcctgataattcactcttcctcatgtttctc

SEQ ID NO: 1450 - DNA, 784 bp, Cleome spinosa
cgcgctgtacattatcacaggtagatcagatcccggtgtctctttgctcagtgaagaacaaaattcttccggcaagcttcgacgaattcgtccttagatccaacaccggcggagatgtctgcattcagcggcgatgagactgcgcctttcttcggcttccttggcgctgcggctgctctcgttttctcctgcatgggagctgcttatgggacagcaaagagtggtgtcggtgtggcatctatgggtgtgatgaggcctgagttggtaatgaagtctattgtcccagtggttatggctggtgttctgggtatctacggattgattattgctgtgatcatcagtactgggatcaaccccaaggctaagtcgtactacctctttgatgggtatgcccatctttcttctggactcgcttgtggccttgctgggctttcagctggaatggccatcgggattgtgggtgatgccggtgtcagggccaacgctcaacagccaaagctctttgtggggatgattcttatcctcattttcgctgaagcactggctctgtacggtctcatcgtgggtatcatcttgtcttcccgagccggccagtccagagcagactgagagaggatgggcggttttgacccccaaaggattgtttcatctatgggtaagacggtggatttgcttgaggtcagccatgtgccttaagaaggtgctggctcgaacccaaaaaaaacagtcttcaggttttgtttgtttccagcattgtgttatgtttgtaatatgatggcgaagg

SEQ ID NO: 1451 - DNA, 1007 bp, Gossypium hirsutum
gcagcttgactcgctggagtcatggatgtctatgtcactgacttgaggaaaacaattccgagagtctcgactgttctcagatctaaacgacaacgtttccagatccacaatggcttctacattcagcggcgatgaaacggctccgttcttcggcttcctcggcgccgccgccgctcttgtcttctcttgtatgggagctgcatacgggaccgctaagagcggtgtcggtgtggcatctatgggtgtgatgaggccagaattggtgatgaaatcgattgtacccgttgttatggctggtgttttgggtatttacgggttgattattgctgtcattattagtaccgggatcaatcctaaggcaaaatcgtattaccttttcgatggttatgcccatctttcatctggtcttgcttgtggccttgccggtctttctgctggaatggctattggaattgttggtgatgccggtgtcagagctaatgcacaacaaccaaaactttttgttggaatgatacttatcctcatctttgccgaagctttggctctttacggccttattgtcggcatcatcttgtcttcccgggctggccaatctagagcagaataagatactggtggaattggttagtattcttttatttgcttatattggtatattaccatatgaaaaaagagtattcgatcgttctcgggttagttccgatttaagcagcaaatccagggttggtactattagtatttaatgaaaagcaactacttttgagggttcatttagtggttgctcttttcactttgtagaagtagaaatgagtttctatgaataaattgacaagaacctttttatccctgtttgaatgttattttcatcagtctatctttgcttctgaaattgaaacttttctctatggaagttcaattttggagataatgccttaatctgttattatttttttaatgatccgtgtttgatacatattcggatatgatttcgaaaatgaatcgaaagt

SEQ ID NO: 1452 - DNA, 1024 bp, Gossypium hirsutum
tacaatttttttttattttccgccttcaattatagctctctccggattagaatttgtacaaaaaaaaagcttaacattttcagatccaactcattactctcttcaaaggaccaaaaagaagatggcttcaacattcagcggcgatgaaactgctcctttcttcggcttcctgggtgctgctgctgccctcgttttctcttgtatgggagcagcttatggtacagcgaaaagtggtgttggtgtagcatcaatgggtgtaatgagaccggagctggtgatgaaatcgatcgtcccggtggtaatggctggggtgctgggtatttatggtttaatcatcgctgttataatcagtactgggattaacccaaaggctaaatcttattaccttttcgatgggtatgctcatttatcttctggtttagcttgtggacttgctggtctttctgctggtatggctattggaattgtaggtgatgctggtgttagagctaacgcacaacagccaaagctttttgttgggatgatcctcattcttatctttgccgaggcattggcactatatggcttgatcgtcggcattattctctcatccagagctggtcagtcacgagccgagtgatagaaaaggcctaattactcagtgtgactctcatatcactggccgtggtttaccgaaagaatttgttccatatattattttgttttgctggttagaattatataatataagttttgctcataaaagtatttgtctacagcctttgagattttctgcagattgaaaaaattcaaaggggctgatgattatagattagagatatataaattagatggtccaataaaaattgtagttttgtttttattaaattatgtacttggggatccaatttggaaccttgtagacttggtgcttgcattagttcttcatttgctggtgttatcttttcattgtttcttagatgctggagtttggattgtatattaaatcttggttggtaaagttgtttatctacttaattcttaa

SEQ ID NO: 1453 - DNA, 1059 bp, Gossypium hirsutum
ttttccaccttcaattatagctctctcctgattagaatttgtacaataaaaagaagtctttttgttttttgttaacattttcagatccaattcattactctcttcaaaggaccaaaaagaagatggcttcaacattcagcggcgatgaaactgctcctttcttcggcttcttgggtgctgctgctgccctcgttttctcttgtatgggagcagcttatggtacagcgaaaagtggtgttggtgtagcatcaatgggtgtaatgagaccggagctggtgatgaaatcgatcgtcccggtggtaatggctggtgtgctgggtatttatggtttaatcatcgctgttataatcagtactgggattaacccaaaggctaaatcttattaccttttcgatgggtatgctcatttatcttctggtttagcttgtggacttgctggtctttctgctggtatggctattggaattgtaggtgatgctggtgttagagctaatgcacaacagccaaagctttttgttgggatgatcctcattcttatctttgcggaggcattggcactatatggcttgatcgtcggcattattctctcatccagagctggtcagtcacgagccgagtgatagaaaaggcctaattactcattgtgactcttatatcactggctgtggtttaccgaaagaatttgttccatatattattttgatttgctggttagaagtatataatataagttttgctcataaaagtacttttctacagcctttgagattttctgcagattgaaaaaattcaaaggggctgatgattatagattagagatatataaattagatggtccaataaaaattgtagctttgtttttattaaattatgtgcttggggatccaatgtggagccttgtagacttggtgcttgcattagttcttcatttgctggtgtttacattgtttcttagatgctggagtttggattgtatattaaatcttggttggtaaagttgtttatctacttaattcttaatcggttcatttaaattggattcgattacttgtctaaaaa

SEQ ID NO: 1454 - DNA, 1010 bp, Gossypium hirsutum
aggctcgatcacgttcacgtgggatccactcagtaatttccaagttccttcttcaattcattatctctcttgtctcttcctttcatttcatcactcacgaaatccagcgatcaaggtttccccaaactcccttcaaatcctcgtctcaacaattttttttaaagcctagtaaaatggcgtccacatttagcggtgatgaaactgctcctttcttcggcttcctcggagccgctgctgccctcgttttctcctgtatgggtgctgcgtacgggacggcgaagagcggtgtcggggtggcatcgatgggagtgatgaggccggagctggtgatgaaatcgatcgtgcccgttgttatggctggagttttaggtatttatgggttgattattgcggttattatcagcactgggattaacccaaaggccaaatcttactacctgttcgatggctatgctcatctttcctctggtctcgcttgtggcctcgccggtctctctgccggtatggccattggaatcgtcggcgatgctggagttagagccaatgcccaacaaccaaagctttttgttggaatgattcttattctcatttttgctgaggctttggctctctatggactcattgtcggtatcattctctcttcccgggctggtcaatcccgagcagaatagagtgcaaagttccgaaacttgggtcattgctagtaggcttcacttggttgtttctccaattcttgccgctagtgcagtatgaaacatttgtcaagttgttcttttgatctcattcatgaattttcttttcaatggttctctgctgtttgtatgattagaagacggattccgtttgaaataaattcttattttacattacattttttttttctagatctagtgttgtaatatgcaagttcaacataatgtaaacaccatttagtttaaaactggtttttcttatatttatatactattcgaacgtttgaataaaaaagaaaaaagtaaccgaactagacg

SEQ ID NO: 1455 - DNA, 1208 bp, Gossypium hirsutum
agaagcttcatagatcgttttccatctctgtctctctttcttctctaattattgaggaaatccaccgatcaaagttgttcaaatcgtgggtgaaagtcttgagaaactaaaatggcgtccacattcagcggcgatgaaactgctccgttctttggcttccttggggccgctgctgctctcgttttctcctgtatgggagcggcgtacggaacggccaagagcggtgtcggagtggcgtcgatgggagtgatgaggccagagctggtaatgaaatcgatcgtccccgttgttatggctggtgttttaggtatttatgggttgattattgcggttattataagcaccgggattaacccaaaggccaaatcttactaccttttcgatggctatgctcatctttcctctggtctcgcttgtggcctagctggtctctctgctggcatggctattggaatcgtcggcgatgctggcgttagagccaatgcccaacaaccaaagctttttgtcggaatgattcttattctcatttttgcggaggctttggctctgtatggactcatcgttggcatcatcctctcttctcgagctggccagtcccgagcagaatagagttcaaggttctgagacttgggttgttgctagttggtgttactcagttgtctcttctccaatagcatgcactgtgaaacatttttccagaagttattttgaatccattgatgaatttcttgaagtggtttatgctgtttgtatgattgagaagataggtgtaagttgaaataaacgttgttttgcattttcttttttaatctatgcctttaggctgtaatttacatgtaagttgaatttaatgtaagattgctccactttgttcagttcatcataagcctaatcagatggttttaacttttttatgtatattagatagactgatagacaatatgtgcatccatttgaaaattggatgactaatgacactttccaccttattttaattgaagacgactttggtggattatgtgttagtgcaattttttcatatcttgattgaattaaaattttccatgtcaaacatattttatatggtgttggtgtggtatctatttttttctattttggtacttgaattctatcttatctcaattgtctcatttcatctaaaaaattattggtgtctaatgagaatgctacgtaataatttagatacc

SEQ ID NO: 1456 - DNA, 977 bp, Gossypium hirsutum
tcgatccacgttcacgtgggatccactcagaaatttcccagttccttcttcagttcattatctctcttgtctctccctttcatttcatcactcacgaaatccagcgatcaaggtttccccaaactcccttcaaatcctcgtctcaacaatttttgtttaaagcctagtaaaatggcgtccacatttagcggtgatgaaactgctcctttcttcggcttcctcggagccgctgctgccctcgttttctcctgtatgggtgctgcgtacgggacggcgaagagcggtgtcggggtggcgtcgatgggagtgatgaggccggagttggtgatgaaatcgatcgtgcccgttgttatggccggagttttaggtatttatgggttgattattgcggttattatcagcactgggattaacccaaaggccaaatcttactaccttttcgatggctatgctcatctttcctctggtctcgcttgtggcctcgccggtctctctgccggtatggctattggaatcgttggcgatgctggagttagagccaatgcccaacaaccaaagctttttgttggaatgattcttattctcatttttgctgaggctttggctctctatggactcattgtcggtatcatcctctcttcccgggctggtcaatcccgggcagaatagagtgcaaagttccgagacttgggtcattgctagtaggcttcacttggttgtttcgtctccaattcttgccgctggagcagtatgaaacatttgtcaagttgttctttcgatctcattcatgaattttcttttcaatggttctctgctgtttgtatgattagaagacggattccgtttgaaataaaatcttgttttacattacattttttttttcagatctagtgttgtaatatgcaagttcaacacaatgtagacaccatttagtttaaaactggtttttcttatatatatacaatttgttatgtgtt

SEQ ID NO: 1457 - DNA, 1014 bp, Gossypium hirsutum
ggccactaagaaacttcatagttcgttttgcatctctgtttctctttcttctctaattattgaggaaatccaccgatcaaagttgttcaaatcgtgggtgaaagttttgagaaactaaaatggcgtccacattcagcggcgatgaaactgctccattctttggcttccttggggccgctgctgctctcgttttctcctgtatgggagcggcgtacggaacggccaagagcggtgtcggagtggcgtcgatgggagtgatgaggccagagctggtaatgaaatcgatcgtccccgttgttatggctggtgttttaggtatttatgggttgattattgcggttattataagcaccgggattaacccaaaggccaaatcttactaccttttcgatggttatgctcatctttcctctggtctcgcttgtggcctagctggtctctctgctggcatggctattggaatcgtcggcgatgctggcgttagagccaatgcccaacaaccaaagctttttgtcggaatgattcttattctcatttttgcggaggctttggctctgtatggactcatcgttggcatcatcctctcttctcgagctggacaatcccgagcagaatagagttcaaggttctaagacttgggctgttgctagttggtgtcactcagctatctcttctccaatagcatgcactgtgaaacatttttccagaagttattttgcatccattgatgaatttcttgaagtggtttatgatgtttgtatgattgagaagataggtgtaagttgaaataaaccttgttttgcattttcttttttaatctatgcctttaggctgtaatttacatgtaagttgaatttaatgtatgattgctccactttgttcagttcatcataagcctaatcagatggttttaactttttatgtatattagatagacaatatgtgcatccgtttgaaaattggatgactaatgacactttccaccttatttcaattgaagacgactttggtgga

SEQ ID NO: 1458 - DNA, 936 bp, Gossypium hirsutum
aaaaaatttctctggaaacaaagcaactatcaactacgtttacctcagatctaaaacacctcgtctcagatccactaaattcaccatgtctactactttcagcggcgatgaaacggctcccttcttcggcttcctcggcgccgccgccgctctcgtcttctcctgtatgggagctgcatacgggacggctaagagcggtgtgggtgtggcttcaatgggtgtgatgaggcctgagttggtgatgaaatccattgttccagttgttatggctggtgttttgggtatttatgggttgattattgctgttattattagtactggcatcaatccaaaggccaaatcgtattatctttttgatggttatgcccatctttcctctggtcttgcttgtggacttgctgggctttcagctggaatggcaatcggaattgttggtgatgctggtgtcagagctaatgcacagcagccaaaactttttgttggaatgatccttatcctcatctttgctgaagctttggctctttacggcctcatcgtgggcatcatcttgtcttctcgggctggccaatctagagcagagtaaagcgctggtagagctgttttagtagtattcttttattacttatcgtgtttattatgattggacatcaagtggtgggtttaatgagcagtgtctctttcctcttggtagaagtagaattgagttctctctctaataaattgtatggttattgtttggtaagtgtatttgcagtgtgtggaacactattaattttggagagataatatatctatgtatttaatccatagcttttagatggttggtggatatatttatttttggtacgtatcaatattgatgtatcaaaacaatatcacactacttgttaaataatgcctgaaatttttaaaaagttcaatttacatttagcatac

SEQ ID NO: 1459 - DNA, 922 bp, Vigna unguiculata
agaatcatcgagaccctcagagatcggtctctcccgagattttgaatttctcagatctatccgacgtcgttgcagatccatcaacgctcatggctggtttcagcggtgatgaaacggcaccgtttttcggcttcctcggagccgcggctgccctcgtcttctcctgtatgggagctgcctatggcacagcaaagagtggtgtgggcgtggcttccatgggtgtgatgagacctgagctagtgatgaagtccattgttcctgttgttatggctggtgttttgggtatttatggccttattatcgctgttattattagtaccggcattaatcccaaggccaaatcttattacctctttgatggttacgcacatctctcctctggtcttgcctgtggcttggctgggctatctgctggcatggctattggtattgttggtgatgctggtgttagagccaatgcacagcagccaaaactttttgttggaatgattctcatcctcatttttgctgaagctcttgccctttatggtctcattgtgggtattatcctgtcttctcgtgctggccagtctagagccgattaagaaaggagttgtgctgctaaatattctttgaccacccatctgttttaacctccttttaaagggggtgagggaggtaattattagttgtttcgagattagctatgttcaggcagcattttcaggcattagcagttgtgtgaaagttcaattcgccattcgtggtgtttgtttgtataattaggtctatctttacttaataaagcttccttaagcttcctttatttttttctttattgattgtattatgccatatcatctgaccttatatatgatttttgagctgttggaactggtgcatgtaatgatttggctagcaatgcaaacgtatttcatgggtc

SEQ ID NO: 1460 - DNA, 954 bp, Vigna unguiculata
cacggcaacagaatcatcgagaccctcagagatcggtctctcccgagattttgaatttctcagatctatccgacgtcgttgcagatccatcaacgctcatggctggtttcagcggtgatgaaacggcaccgtttttcggcttcctcggagccgcggctgccctcgtcttctcctgtatgggagctgcctatggcacagcaaagagtggtgtgggcgtggcttccatgggtgtgatgagacctgagctagtgatgaagtccattgttcctgttgttatggctggtgttttgggtatttatggccttattatcgctgttattattagtaccggcattaatcccaaggccaaatcttattacctctttgatggttacgcacatctctcctctggtcttgcctgtggcttggctgggctatctgctggcatggctattggtattgttggtgatgctggtgttagagccaatgcacagcagccaaaactttttgttggaatgattctcatcctcatttttgctgaagctcttgccctttatggtctcattgtgggtattatcctgtcttctcgtgctggccagtctagagccgattaagaaaggagttgtgctgctaaatattctttgaccacccatctgttttaacctccttttaaagggggtgagggaggtaattattagttgtttcgagattagctatgttcaggcagcattttcaggcattagcagttgtgtgaaagttcaattcgccattcgtggtgtttgtttgtataattaggtctatctttacttaataaagcttccttaagcttcctttatttttttctttattgattgtattatgccatatcatctgaccttatatatgatttttgagctgttggaactggtgcatgtaatgatttggctagcaatgcaaacgtatttcatgggtctttccatttaaaagaaaaaaaaa

SEQ ID NO: 1461 - DNA, 817 bp, Vigna unguiculata
aatttcttcttcaaaattcatttgcacattacactttgatctgatctccacaaacccaatcaatttcatcatccttctacttccacaaagaacaaggagagaaagtttcatcaccgtagcaggggaatcaaatcaaaccatggcaggtttcagtggcgacgaaaccgctcctttcttcggcttcctcggcgctgccgcggctctcgttttctcctgtatgggagcagcgtacggaactgcgaagagtggggtgggagtggcgtcgatgggtgtgatgaggccggagcttgtgatgaagtcgatagtgccggtggttatggcgggagtgttgggtatttatgggttgattattgcggttatcattagcaccgggataaaccccaaggctaagtcttactatctctttgatggttatgcccacttgtcctctggccttgcctgtggccttgctggcctctctgctgggatggccattggaattgttggggatgctggtgttagggctaatgctcagcagccgaagctgtttgttggtatgattcttattttgattttcgctgaagctcttgctctttatggcctcattgtgggtatcatcctctcatctcgggcaggccaatctcgtgctgattaaaacgagccaactcagtgatacttggtagtccagtaatttttattatgaggcctgtatttgaaatgggagatatttgtctttagattgctattatttcatttattttcgtacacaaaccttgtatccaaactccatcagttttatcaagtattttcctatggactacatatttggatggctgca

SEQ ID NO: 1462 - DNA, 820 bp, Vigna unguiculata
  misc_feature (818)..(818): n is a, c, g, or t
aatttcttcttcaaaattcatttgcacattacactttgatctgatctccacaaacccaatcaatttcatcatccttctacttccacaaagaacaaggagagaaagtttcatcaccgtagcaggggaatcaaatcaaaccatggcaggtttcagtggcgacgaaaccgctcctttcttcggcttcctcggcgctgccgcggctctcgttttctcctgtatgggagcagcgtacggaactgcgaagagtggggtgggagtggcgtcgatgggtgtgatgaggccggagcttgtgatgaagtcgatagtgccggtggttatggcgggagtgttgggtatttatgggttgattattgcggttatcattagcaccgggataaaccccaaggctaagtcttactatctctttgatggttatgcccacttgtcctctggccttgcctgtggccttgctggcctctctgctgggatggccattggaattgttggggatgctggtgttagggctaatgctcagcagccgaagctgtttgttggtatgattcttattttgattttcgctgaagctcttgctctttatggcctcattgtgggtatcatcctctcatctcgggcaggccaatctcgtgctgattaaaacgagccaactcagtgatacttggtagtccagtaatttttattatgaggcctgtatttgaaatgggagatatttgtctttagattgctattatttcatttattttcgtacacaaaccttgtatccaaactccatcagttttatcaagtattttcctatggactacatatttggatggctgcanag

SEQ ID NO: 1463 - DNA, 1163 bp, Cycas rumphii
  misc_feature (882)..(882): n is a, c, g, or t
  misc_feature (894)..(894): n is a, c, g, or t
ggtttcttgggggtttcgtcctctctatatattttttggcctggattggactcctcacaggtctgatgcaccctgcaaatatctccgggtaaaattcgaagtcattgacataatatcgtctgcagatttggtggtgtgtgcgagctgcattaaaaaaataaaaaattagcatagaagaaatttcaagatggcggaggttttcagcggggatgagactgctccattcttcggcttccttggtgctgctgcggcccttgtgttttcctgtatgggtgctgcatatggaacagcgaaaagcggtgttggtgtagcatccatgggtgtcatgaggccagagcttgtcatgaaatccatagttccagttgttatggctggtgtgttgggtatctatggcttgattattgctgtgataatcagcacaggaatcaaccccaaagccaagtcatattatttatttgatggctatgcacatctatcctctggactggcttgtggtcttgctggcctttctgcaggcatggctatcggtattgttggcgatgccggtgtaagggcaaatgcacaacaaccaaaactctttgtcggtatgattctcatcttgatctttgctgaagcactggctctctatggtcttattgttggtattattctctcttcgcgtgctggtcaatcgcgatcagattagagagattatgattgttcttaggcttcgtggatcgctggcagaattgaaactgcctagtttggctttggaaaatctgaccataattcagaagtatggatccttttaaacacatggtttagtttcaggatttgcttaaagtgttcttctgagtcttgcatttaagacattcatgaatttaacggaaggctattcaatgncccttttaatgntgcagtgtatgggctatacagcctctttttgttggctattaggcatgatatataatgcgtctatagatagtataatattcaaatctgacctgaatttgactcacgttagtgattatatctgccctctatcttatgctggtggagcaaatgtcttgttgaaggggaagaaagggcaaagcgtctgctgaaattacatgtaaacaaggtataactgtaacttagtttcaaggttcagttgttttatatcccttcttccaacattgcctatg

SEQ ID NO: 1464 - DNA, 1081 bp, Eschscholzia californica
agagagatcgtcatcgaggaagaggaagagaaaaccaaccaccagatccgatcgagttttttttttctgcaaatcaaatcaaatcggtgtgaaagaatgtctacctccttcagtggcgatgaaactgctcctttcttcggtttccttggagctgctgctgctttagttttctcatgtatgggagctgcttatggaacggcaaagagtggagttggtgtagcatcaatgggagttatgagacctgaattggttatgaaatcaattgttccagttgttatggctggagttttgggtatttatggtttgattattgctgttattatcagtactggtatcaaccctaaggctaaatcttactacctatttgatgggtatgctcatctttcatctggtctttcttgtggtcttgctggtctttctgctggtatggccattgggattgttggcgatgctggtgttagagccaatgctcaacaaccaaagctctttgttggtatgatccttatcctcattttcgccgaagccttggccttgtatggtctcatcgtcggtatcatcctgtcttcaagagctggccaatccagagcagactagagtgagagagagaggttctcccttgtgttacttatgtggttaatctgtatcattttggcttttaattccatccacaaggtttcttagtttgtcgatcgtggtgggtggtctgagaaattcttcactctgaaaacaatgacttgttcttccccactccccattcttcattgggggcttattatttattctgtgctggttgtgtagtattagaaaccaattgctacctccttgaataaaaagctttacaagcttccatttaattcctgtattttgaagatacataaactcggtcttgttttaggaactcatggatcactttgtgtctagtgtttttgtactgtattcgagcatgcagtaaattttgtgaatcataggttgcaggaattgtttccatgggactgtttcaaaaattttcgccaatggcaaggattggaatcttattagtattgatccatatataacgtgggagtctactgctttattggag

SEQ ID NO: 1465 - DNA, 904 bp, Eschscholzia californica
aaagaaagagagatccaaatatcgaagcagagagaaaaagataaaaagttctagatccgatcaaattctctgcaaatccttcattaaaacatgtctacacagttcagcggcgatgaaactgctccattcttcggctttcttggagctgcagctgccttagttttctcctgtatgggcgcagcttatggaacagcaaagagtggtgttggtgtggcatcaatgggagttatgaggccagaattggtcatgaaatctattgttccagttgttatggctggagttttgggtatttatggattgattattgctgttattatcagtactggtattaaccctaaggctaaatcttactacctatttgatggttatgcacatctttcatctggtctctcttgtggtcttgctggcctttctgctggaatggctattgggatcgttggtgatgctggtgttagagccaatgcacagcagcccaagctctttgttggtatgattcttatcctcatttttgctgaagccttggccttgtacggacttatcgtcggtattatcttatcctcgcgggctggtcaatccagagcagactagaaagagcccgatcctgatattaattaatttatcaggtttgtcagtaagattttggctttcgattcatctctcatatttgtaatggttattcatcattttaatgctactaggaaatttcttcactctgaacccagttactcccctgccaccttttagtcatgaggtgatttgttcttttgctggttgttgtattgggaaatgattggatcctaaaataaagaagcttgagaagctttctgtttcatctatttaatactttgtatttgcagatataaaaaccctagctgatctagtgactttggatctcgatctaaag

SEQ ID NO: 1466 - DNA, 781 bp, Eschscholzia californica
agaaaaaaaaagtctccaattttttcagatccaatcgaaatctttggaattcattctgaaactcgaagatgtcgacttcattcagtggagatgaaactgctcctttctttggatttctcggagctgccgctgctctagttttctcctgtatgggagctgcttatggaacagcaaagagtggtgttggtgtggcatctatgggtgttatgagaccagaacttgtaatgaaatcaattgttccagttgttatggctggagttttgggtatttatgggttgattattgctgttattattagtactggaattaaccctaaggctaaatcgtattaccttttcgatggatatgctcacctttcatctggtctatcttgtggtctcgctggtctttctgctggtatggctatcgggatcgtcggtgatgccggtgttagagccaatgctcaacagccaaagctctttgtcggaatgatccttatcctcattttcgctgaagctctagccttgtacggtctcattgttggtattatcttgtcatctcgagcgggtcaatccagggcagactagaaaagcgattattttgccaagttaccttgtgtggtttgtgccgattgtttcatcgttatctttttattcatgtagcaaacaatagcttagtacttttgtcgtcttaaattttcgttcctgagctgctatccttattgggtaattgatctgctggttgtaaaattaaatgagattgttctttctgaaataaattttagagaaaatgtttctctaag

SEQ ID NO: 1467 - DNA, 788 bp, Eschscholzia californica
aattcagaaatctgaagaaaaaaaaaaagtctccaattttttcagatccaatcgaaatctttggaattcattctgaaactcgaagatgtcgacttcattcagtggagatgaaactgctcctttctttggatttctcggagctgccgctgctctagttttctcctgtatgggagctgcttatggaacagcaaagagtggtgttggtgtggcatcgatgggtgttatgagaccagaacttgtaatgaaatcaattgttccagttgttatggctggagttttgggtatttatgggttgattattgctgttattattagtactggaattaaccctaaggctaaatcgtattaccttttcgatggttatgctcacctttcatctggtctatcttgtggtctcgctggtctttctgccggtatggccatcgggatcgttggtgatgctggtgttagagccaatgcccaacagccaaagctcttcgttgggatgatccttatcctcattttcgctgaagctctagccttgtacggtctcattgttggtattatcttgtcatctcgagcgggtcaatccagggcagactagaaaagcgattattttgccaagttaccttgtgtggtttgtgccgattgtttcagctttatctttttattcatgtagcaaactatagcttagtacttttgtcgtcttaaatttttccttcctgagttgctatccttattgggtaattgatctgctggttgtaaaattaaacaagattgttctttctgaaataaatcttagagagaca

SEQ ID NO: 1468 - DNA, 1025 bp, Eucalyptus grandis
ggggaggagagggcagaagggagaggtttcctgcagaaagacgccaaaagaaaagagctcgtgaccccaaaaactccaatagaaaaaaaaataaaaaaaataaaaaagcaacaaaagaggagtcgcgaaaagcctctcagatcttccatcccatcttgatctacccaccgcatctcctcctccttcctctcccgctcctcaattccagcgctcgatccatccgtccatccgtcgaagatgtcgaccttcagcggcgacgagaccgcccccttcttcggcttcctcggcgccgccgccgccctcgtcttctcctgcatgggggccgcgtacgggaccgccaagagcggcgtcggcgtggcgtcgatgggggtgatgcggcccgagctcgtgatgaagtcgatcgtccccgtcgtcatggccggtgtgctcggtatctacggcctcatcatcgccgtcatcatcagcaccgggatcaaccccaaggccaagtcctactacctgttcgacggctacgcgcacctctcctccggtctggcctgtggcctcgccgggctctccgccggtatggcgatcggcatcgtcggagatgccggcgtcagagccaatgcacaacaacctaagctgtttgtgggaatgatccttatccttatctttgctgaagcactggccctctatggccttattgtcggcatcattctatcttctcgggcaggtcaatcaagagccgactaaacgagggctagccatgagttctgatggtgtggtttgtgtagtgcttcaggaggctcatcagtattttttttttttgattaaggtggaagttaactccatataattcttgccgtgcttgtctatgctttggtcagatatatgatgtcattaccccttcatattcaattttatgacaatcggacctcgtcttccatcatgtgaactagtaattattgttccttgtcgtgccatgtgccgtatgttgtggatgcaaatcaaaatctttctcgaagtactgcctttttattctgcca

SEQ ID NO: 1469 - DNA, 736 bp, Euphorbia peplus
tatcaatcaattcacatacacctgatctttgcgattccgaccatcaattttcataaataaacaacaatgtctacgggattcagcggcgatgaaactgctccgttctttggcttccttggcgctgctgcagcccttgttttctcctgcatgggagctgcctatggaaccgccaagagcggggttggtgttgcatccatgggtgtgatgagacctgaactggtaatgaaatcgattgtaccagtggttatggctggagttttgggtatatatggtttaattattgctgttatcatcagtaccggaattaaccctaaggccaaatcgtattatctctttgatggatacgctcacctttcttctggtctcgcctgtggccttgctggtctctctgctggtatggccattggcatcgtaggggatgcaggtgtcagagctaatgcacaacagccaaagctttttgttggaatgatcctgattctcatctttgctgaagctttggccctctacggccttattgttggcatcattctttcgtcacgagctggtcaatcgagagccgaataaagggtacttgtgcttgcgattgtgtgggctgttgtgatttaagagttattttgtgtaagataaagagaataaatatcttgtataagacagaatgggaaggtgttcctgctctagagtcattgacttcatctctccattgtatgctatggtcaggatatgctgatgcgggaat

SEQ ID NO: 1470 - DNA, 826 bp, Flaveria ramosissima
atccaaaaggccaggtgttgtacatcactcatacacacacacacaaacagatctcaaactccttttcgttttcaccttaatcatccgatcgatttcaatcgaacaacaatgtcttcagcttcaggattcagcggtgatgaaaccgcccccttcttcggtttccttggtgcagctgccgccctcgtcttctcatgtatgggggctgcatacgggactgctaagagtggcgtaggtgtggcgtcgatgggtgtgatgaggcctgagctggtgatgaagtcgattgttccggtggttatggctggtgtgcttggtatttacggtttgattattgctgtcatcattagtactgggattaaccctaaggcgaaatcgtattatctgtttgatgggtatgcgcatctttcctctggtttggcttgtggtcttgctggtctgtctgctggaatggctattggaatcgttggtgatgctggtgtcagagcaaatgcacagcagccaaagctttttgtgggtatgattcttattctcatctttgccgaagcccttgctctatacgggcttattgttggtatcatcttatcttcccgtgctggccaatcgagagcagattaagaaggcgacccgaactcaacaatgagcatgaacttgtttctatatctatatgttgtttgtcctgaaaagtcaagatcatgttattttttgctttatctatttcccatattataaacttcagttttctggatggaattctttgtgttcttattatcattagtgtttatggtgcttctacagaataaggccatagttttggtcaagacttttgttc

SEQ ID NO: 1471 - DNA, 786 bp, Flaveria ramosissima
atccgatcaaaatcaaaatcatccgatcgatttcaatcgaacaacaatgtcttcagcttcaggattcagcggtgatgaaaccgccccgttcttcggtttcctcggtgcagctgccgccctcgtcttctcctgtatgggggctgcatacgggactgctaagagtggcgtaggtgtggcgtcgatgggtgtgatgaggcctgagctggtgatgaagtcgattgttccggtggttatggctggtgtgcttggtatttatggtttgattattgctgtcattattagtactgggattaaccctaaggcgaaatcttattatctgtttgatgggtatgcgcatctttcctctggtttggcttgtggtcttgctggtctgtctgctggaatggctattggaatcgttggtgatgctggtgtcagagcaaatgcacagcagccaaagctttttgtgggtatgattcttattctcatctttgccgaagcccttgccctatacgggcttattgtcggtatcatcttatcttcccgtgctggccagtcgagagcagattaagaaggcgacctgaactcaacaatgaacatgaacttgtttctatatctcttcattgtttgtcctgaaaaatcaagatcatgttttctttttttgctttatttctatctctataaattaaacttcagttttctggatggaattcttgtgttatcattatcattagtgtttacggtgcaactacataataaggccattgtcttggtcaagacttctgttcatgtgtgtattcttaatag

SEQ ID NO: 1472 - DNA, 957 bp, Fraxinus spp
cggccggggggacccaaaatcccatataccacgtgttcagcgcggattgacacttcatcaataatagctcttcttctccaccatacagcatacatcaaaacagtcagcagtgagaactgagatctgttcatccaaacccccaaatcatccgtctctataactgataattcaacgtaatttttcagatcctttagtaattttttcgcaatcccaacgaatatgtcttcaatcttcaacggcgatgaaactgctccctttttcggcttcctcggtgccgcttctgccctcgtcttctcttgtatgggtgcggcgtatggaacggcgaagagtggagtaggtgtagcgtcgatgggagtgatgaggccggagctggtgatgaagtcgatcgtgccagtggttatggctggagtgttgggtatttatgggttgattattgctgtgattatcagcactgggattaaccccaaggcaaagggttattatctgttcgatggctatgcgcatctctcttcaggcctcgcttgtggccttgctggcctctcagctggaatggcaattgggatcgttggcgatgctggcgtcagggctaatgcacagcagccaaagcttttcgttgggatgatcctcattctcatcttcgctgaagcgttagccctttatggtctaatcgttggaattattttgtcttcacgagctggccagtctagagctgactgaggaattggcttttaactagttagttcaactgcagtgtttaacgttttggagaaatttgattcttggcaggcttcgtaaactctttcatacgcgccctatttatggccaagaatgttatttatatttctcatcgcatttaatgccacggtagcttcgtgatgtttgtagaattatttgaagttaccctttttttctgcagaataagagcttaaatgcctgtggatgttggattaagtgtag

SEQ ID NO: 1473 - DNA, 592 bp, Gerbera hybrid cultivar
gcttcgacgttctccggcgatgaaacggctccgttcttcggctttctcggtgccgctgcggccttggtcttctcctgtatgggggcggcgtatgggacggcgaagagcggtgttggagtggcgtccatgggagtgatgaggccggaattggtgatgaagtctattgtgccagtggttatggctggagtgttgggtatttacggtttgattattgctgtgattattagtaccggtattaaccctaaggctaagtcgtattacctttttgatggctacgctcatctttcttccggtctcgcttgtggcctagctggtctttctgctggtatggctattggaatcgtcggtgatgctggtgtcagagctaatgcacaacagccaaaactctttgtcgggatgatcctaattctcattttcgccgaagctcttgccctctacggtcttattgtcggcatcattctttcttctcgagctggtcagtccagagcagactagaaggtcactagtcggctataaaattaagcattttttaatcctctatgtggttagagtttgttttttgcataattattatgtggtgagggtagtttgt

SEQ ID NO: 1474 - DNA, 1090 bp, Gossypium raimondii
acacatagtgtagggactaatatagtaaaacctgaccattttattccaatatcgcaataaaaaccagatataagatgggagatcaaactgccttgaaggaaaacaattccgagagtctcgactgttctcagatctatacgacaacgtttccagatccacaatggcttctacattcagcggcgatgaaacggctccgttcttcggcttcctcggcgccgccgccgctcttgtcttctcttgtatgggagctgcatacgggaccgctaagagcggtgtcggtgtggcatctatgggtgtgatgaggccagaattggtgatgaaatcgattgtacccgttgttatggctggtgttttgggtatttacgggttgattattgctgtcattattagtaccgggatcaatcctaaggcaaaatcgtattaccttttcgatggttatgcccatctttcatctggtcttgcttgtggccttgccggtctttctgctggaatggctattggaattgttggtgatgccggtgtcagagctaatgcacaacaaccaaaactttttgttggaatgatccttatcctcatctttgccgaagctttggctctttacggccttattgtcggcatcatcttgtcttcccgggctggccaatctagagcagaataagatactggtggaattggttagtattcttttatttgcttatattggtatattaccatatgaaaaaagagtattcgatcgttctcgggttagttccgatttaagcagcaaatccagggttggtactattagtatttaatgaaaagcaactacttttgagggttcatttagtggttgctcttttcactttgtagaagtagaaatgagtttctatgaataaattgacaagaacctttttatccctgtttgaatgttattttcatcagtctatctttgcttctgaaattgaaacttttctttatggaagttcaattttggagataatgcattaatctgttattatttttttaatgatccgtgtttgatacatattcggatatgatttcgaaaatgaatcgaaagtgaacgtccaagcgtatagaaaaatttatacaa

SEQ ID NO: 1475 - DNA, 1158 bp, Gossypium raimondii
gagttcagcccaatagaaaaatgagccttgttaaaggaaaagctctatgatctctccacttatttcagtgatttgaggttgtccttgtttcgctacaattttttttttttattttccaccttcaattatagctctctcctgattagaatttgtacaaaaaaaaaaaaaagcttaacattttcagatccaactcattactctcttcaaaggaccaaaaagaagatggcttcaacattcagcggcgatgaaactgctcctttcttcggcttcttgggtgctgctgctgccctcgttttctcttgtatgggagcagcttatggtacagcgaaaagtggtgttggtgtagcatcaatgggtgtaatgagaccggagctggtgatgaaatcgatcgtcccggtggtaatggctggtgtgctgggtatttatggtttaatcatcgctgttataatcagtactgggattaacccaaaggctaaatcttattaccttttcgatgggtatgctcatttatcttctggtttagcttgtggacttgctggtctttctgctggtatggctattggaattgtaggtgatgctggtgttagagctaatgcacaacagccaaagctttttgttgggatgatcctcattcttatctttgcggaggcattggcactatatggcttgatcgtcggcattattctctcatccagagctggtcagtcacgagccgagtgatagaaaaggcctaattactcagtgtgactctcatatcactggccgtggtttaccgaaagaatttgttccatatattattttgttttgctggttagaagtatataatataagttttgctcataaaagtatttgtctacagcctttgagattttctgcagattgaaaaaattcaaaggggctgatgattatagattagagatatataaattagatggtccaataaaaattgtagttttgtttttattaaattatgtacttggggatccaatttggaaccttgtagacttggtgcttgcattagttcttcatttgctggtgttatcttttcattgtttcttagatgctggagtttggattgtatattaaatcttggttggtaaagttgtttatctacttaattcttaatcggttcatttcaattcgattacttgtctaact

SEQ ID NO: 1476 - DNA, 1046 bp, Gossypium raimondii
tgtatggcgaaggctcgatcacgttcacgtgggatccactcagaaatttcccagttccttcttcaattcattatctctcttgtctctccctttcatttcatcactcacgaaatccagcgatcaaggtttccccaaactcccttcaaatcctcgtctcaacaatttttgtttaaagcctagtaaaatggcgtccacatttagcggtgatgaaactgctcctttcttcggcttcctcggagccgctgctgccctcgttttctcctgtatgggtgctgcgtacgggacggcgaagagcggtgtcggggtggcgtcgatgggagtgatgaggccggagttggtgatgaaatcgatcgtgcccgttgttatggccggagttttaggtatttatgggttgattattgcggttattatcagcactgggattaacccaaaggccaaatcttactaccttttcgatggctatgctcatctttcctctggtctcgcttgtggcctcgccggtctctctgccggtatggctattggaatcgtcggcgatgctggagttagagccaatgcccaacaaccaaagctttttgttggaatgattcttattctcatttttgctgaggctttggctctctatggactcattgtcggtatcatcctctcttcccgggctggtcaatcccgagcagaatagagtgcaaagttccgagacttgggtcattgctagtaggcttcacttggttgtttcgtctccaattcttgccgctagagcagtatgaaacatttgtcaagttgttctttcgatctcattcatgaattttcttttcaatggttctctgctgtttgtatgattagaagacggattccgtttgaaataaaatcttgttttacattacattttttttttcagatctagtgttgtaatatgcaagttcaacataatgtagacaccatttagtttaaaactggtttttcttatatatatatacaatttgttatgtgttttaatgagttaatgataaagaaattacagaaatttcatttcataattaaaataa

SEQ ID NO: 1477 - DNA, 1243 bp, Gossypium raimondii
catgggaattggccactaagaaacttcatagttcgttttccatctctgtttctctttcttctctaattattgaggaaatccaccgatcaaagttgttcaaatcgtgggtgaaagttttgagaaactaaaatggcgtccacattcagcggcgatgaaactgctccattctttggcttccttggggccgctgctgctctcgttttctcctgtatgggagcggcgtacggaacggccaagagcggtgtcggagtggcgtcgatgggagtgatgaggccagagctggtaatgaaatcgatcgtccccgttgttatggctggtgttttaggtatttatgggttgattattgcggttattataagcaccgggattaacccaaaggccaaatcttactaccttttcgatggctatgctcatctttcctctggtctcgcttgtggcctagctggtctctctgctggcatggctattggaatcgtcggcgatgctggcgttagagccaatgcccaacaaccaaagctttttgtcggaatgattcttattctcatttttgcggaggctttggctctgtatggactcatcgttggcatcatcctctcttctcgagctggacaatcccgagcagaatagagttcaaggttctgagacttgggttgttgctagttggtgttactcagttgtctcttctccaatagcatgcactgtgaaacatttttccagaagttattttgaatccattgatgaatttcttgaagtggtttatgctgtttgtatgattgagaagataggtgtaagttgaaataaacgttgttttgcattttcttttttaatctatgcctttaggctgtaatttacatgtaagttgaatttaatgtaagattgctccactttgttcagttcatcataagcctaatcagatggttttaactttttatgtatattagatagacaatatgtgcatccgtttgaaaattggatgactaatgacactttccaccttatttcaattgaagacgactttggtggattatgtgagttggtgcaattttttcatatcttgattgaattaattttttccatgtcaagacatattttatatagtgttggtgtgatatctatttttttctattttggtacttgaattctgtcttatctcaaatgtctcatttcatctaaaaaattattggtgtctaatgagaatgctacataataatttagataccaataatataaaaaggaaaaaagt

SEQ ID NO: 1478 - DNA, 1027 bp, Mesembryanthemum crystallinum
ctcgtgccgaattcggcacgaggattattcatctctctctctctctctctcctctttctctctctgccctgattgcagagaaaaactagacgacaaacgatccgccattgttgatcccttcatctctcagatctaatcccaaattctctgcaacaatgtcttctgctgtcttcaacggcgatgaaaccgcccccttcttcggcttcctcggagccgcttccgccctcgtcttctcctgtatgggagcggcgtacggaacagcgaagagtggcgttggggtggcgtcgatgggagtgatgaggcctgagttggtgatgaaatcgatcgtaccagtggttatggctggtgtgttgggtatttatgggttgattattgctgtcattatcagtactggaattaaccctaaggccaaatcttactacctctttgatggttatgctcatctttcctctggtctcgcttgtggtcttgctggtctctccgccggtatggctatcggtatcgtcggtgatgccggtgtcagagctaacgcccagcagcccaagcttttcgttggaatgatccttatcctcattttcgctgaagctttggccttgtacggtctcattgtcggcatcatcctctcctcccgtgctggacaatcaagagccgactaaaaagagggtttgcctcttgattattgtttgcttttcattgccaccactggagatgtatttttttccccctttcctggcaggaagaagaggtcacttggcattgtgagtgggttcctcttcgaagagtgagtttatggtttatggttcttatggttttgcgtcgtgtcgattggtggttcttctacatgagaaactgttaccataatgtagaattactaggtagtagttatctctccttccaaaataaaagtgatgctgtatcattatttccctctcttggctcctgtgtatggagataattcagacttcctgtaacactatgatagttctttattttggtgctaaatattctttaagcttttaatttttga

SEQ ID NO: 1479 - DNA, 1016 bp, Mesembryanthemum crystallinum
caaaaagctaatcaacaaatttgtctctcccttcaatctctcacctcagacttcttcatcatccgccctttctctctcttctctttctctctcttcattctctctgatccccagatccgatcactactcaatcatgtcaaccgtcttcaacggcgatgaaacggcgccgttcttcggcttcctcggcgccgcttccgctctcgtcttctcctgtatgggagctgcgtatggaacggcgaagagtggtgttggagtggcatcaatgggagtgatgaggcctgagcttgtgatgaagtcaattgtcccagttgttatggctggtgttttgggtatttatgggttgattattgctgtgattatcagtactgggattaaccctaaggctaaatcttactatctatttgatggttatgcccatctctcttctggtcttgcttgtggtcttgctggtttgtctgctggtatggctattggtattgttggtgatgctggtgttagagccaatgctcagcagccaaaacttttcgtgggaatgattcttattctcatctttgctgaagcgcttgctctctacggtctcattgtcggtatcatcttgtcttcccgagctggacagtcaagagcagattaagtacagcagactactgctcagtcatcttgtattcatggatgcggagtgaaacagtaatgccctttctcctcgttttcttctttccatttttcccccaccaggtgaagggcagagaaattctggtttatattcttaggttaagtgtggtgaaacactctattcaaacgttttctcgaagtacattatggtcgatattgctttgccctattcaatttatactttgctgcccatttgtaacactaggatgttgcagaataaatgcttgtgaagtttatctgtctctagtttgtgttatttaatttttctgttggaactggtgctggtaattttgtggaaaaactattgtgagacctagtacctgaataaaatgcttttgcttcgaaac

SEQ ID NO: 1480 - DNA, 803 bp, Ipomoea batatas
gggattcacagtttttccgagactgtgtgaacagccattccccgggaattctcagatccgatcaattacgccgtcgctgcagatccgatcgaatccggattcgaaagcaccagagaaaatgtcgtcagctttcagcggagatgaaacggcaccgttcttcggcttcctcggcgctgctgccgccctagtattctcttgtatgggagccgcttacgggaccgcgaagagtggggttggtgtggcgtcgatgggcgtcatgaggccggagctggtgatgaagtccattgtgccggtggttatggctggtgtgttgggtatttacggcttgattatcgctgtgatcatcagtactgggatcaaccccaagaccaagtcatactatctctttgatggctacgctcacctttcttctggccttgcctgtggcctcgctggcctttctgctggtatggccattggaatcgttggtgatgccggtgttagggccaatgcacaacagcccaaacttttcgtcgggatgattctcattctcattttcgctgaagctcttgctctctatggccttattgttggaatcatcctctcctcccgcgctggtcagtccagagcagaataggggacgagcattgaactttcatcatattcgtgattgcagaggccgtttggctctgaaaaaacttaaattttttgcaacgtgcacgaggcttgaagaataggggtttcatatgcgcagatgttgtgatgtagattagatctcgctgtaataagaatttggagtttaaactctgcttgattattattct

SEQ ID NO: 1481 - DNA, 817 bp, Ipomoea batatas
gaacaatagagtggagagagatccagctattattatatcccaaagctgaagagctctctctctgttcagagttcagaagctaaatctcagatcccaaatccgatcaaaagatccgaacaatgtcttcgtctttcagcggcgatgaaactgctcccttcttcggcttcctcggcgccgctgccgctctcgtcttctcctgtatgggagcagcctatggaacggcgaagagtggggtcggagtggcgtcgatgggagtgatgaggccggagcttgtgatgaaatcgatcgtgccggtggttatggctggtgtgcttggtatttacggattgattattgctgtgatcatcagtactggaattaaccccaaaaccaagtcttactacctattcgatggatatgcacatctctcttccggtctcgcttgtggcctcgccggactctcggccggaatggccatcggaatcgttggtgatgccggtgtcagggctaatgcacagcagcccaagctttttgttggaatgatccttattctcatttttgctgaagctttggccctttatggtctcattgtcggcattatcctgtcttctcgagctggccagtctagagcagagtaaaaaggaggctatgatttatgtccttagaaggctgcacgtgtgttagaaaagaaggtagaagtcatttttatgaagcacgtacgagaagctattgagggttggtggtgttcttcattctggcactattaagagtcataaggaataagcttaattatcaagcccgtcactggtcttttccctttacgagtttttttggttta

SEQ ID NO: 1482 - DNA, 769 bp, Ipomoea batatas
agagttcgactgctaatctcagatcccatatccgctccaaagatcaagcaataatgtcttctgcattcagcggcgatgaaactgctccctttttcggcttcctcggcgccgctgccgctctcgtcttctcctgcatgggggcagcttacggaactgcgaagagcggggtaggagtggcgtccatgggtgtgatgcggccggagctggtgatgaaatcgatcgtgccggttgttatggccggtgtgctcggtatttatggcttgattattgctgtgatcatcagtaccggtattaaccccaaaaccaagtcttattatctattcgatggttatgcacatctctcctccggtctcgcttgtggcctcgccggcctatctgccggaatggccattgggatcgttggcgatgccggtgtcagggctaatgcacaacaacctaagctttttgtcgggatgatccttattcttattttcgctgaagctttggccctttatggcctcattgttggcatcatcttgtcttcacgagctggtcaatccagagcagaataaaaactgcggctttcgactacatccttgtaagctgtgtgttgcactagggaagcaaagacagaaatttgattcttataaggtcagaagcctttgatgttccacaacattcttcattcttggactctcttctctctcaatctctggccatttctcctatttgtaataggaagaacttagtttttctgctaaataaaaactctcgaatgcattcacctcaa

SEQ ID NO: 1483 - DNA, 841 bp, Ipomoea nil
atcattgtacagtcccactgcaccatcgtttcttggcggtataggctctacaccaaacctcattcctccagactggacaggtaaaggaaagagaagctcgactgctaatctcagatcccatatccgttcaaaagatcaagcaatgtcttctacattcagtggcgatgaaactgctccctttttcggattcctcggcgccgctgccgctctcgtcttctcctgcatgggggcagcttacggaactgcgaagagtggggtaggagtggcgtccatgggtgtgatgcggccggagctggtgatgaaatcgatcgtgccggttgttatggccggtgtgctcggtatttatggtttgattattgctgtgatcatcagtaccggtattaaccccaaaaccaagtcttattatctattcgatggttatgcacatctctcctccggtctcgcttgtggcctcgccggcctttctgccggaatggccattgggatcgttggcgatgctggtgtcagggctaatgcacaacaacctaagctttttgtcgggatgatccttattcttattttcgctgaagctttggccctttatggcctcattgttggcatcatcttgtcttcgcgagctggccaatccagagcagaataaaaactgtgggtttcgactacatccttgtaagctgtgtgttgcactagggaagcaaagacagaaatttgattcttataaggtcagaagcctttgatgttccacagcattcttcattcttggactctcttctctctcaatctctcgctatttctcctatttgtaataggaagaacttagtttttctgctaaataaaagctctc

SEQ ID NO: 1484 - DNA, 825 bp, Ipomoea nil
gattctgtgccctctctgcaaagtggaaatcatagaagagagattttcagatccgatcaaatccgcgatcgacaaaagctgagaagatgtcttcaaccttcagcggagatgaaacggcgccgttcttcggcttcctcggcgctgcggccgccctagtcttctcctgtatgggagctgcttacgggaccgcgaagagcggggtaggtgtggcgtcgatgggtgtgatgaggccggagctggtgatgaagtcgattgtgccggtggttatggctggtgtgttaggtatttacggattgattatcgctgtgatcatcagtaccgggatcaaccccaagaccaaatcgtactatctctttgatggctatgctcacctttcctcgggtcttgcttgtggccttgctggcctttctgccggtatggcaatcggcattgtgggggacgccggtgttagagctaatgcacaacagcccaagctctttgttgggatgattctcattctcattttcgctgaagctctggcactttatggccttattgtcggaatcatcctctcttctcgtgctggtcaatctagagccgagtagacgaagaacagatttgaattatcttcaggcacattttattttattttatttttctttattcttttggtccaagattatgtgtgttaattgcttggctagaacaactggttcatatgtgatgatttgcttttgtagattaggtctctcctcaaataaaactcaggtattctgctgttgtatttttctgggaccagaatggattgcctgtattattttactcaaacttttccaaggttaaagt

SEQ ID NO: 1485 - DNA, 760 bp, Actinidia deliciosa
  misc_feature (47)..(48): n is a, c, g, or t
aacgtgtgatcgatatctctctctccctctctatttctctgcaacanncacaccgagcgaaacctcctctcttccctaatctctctctctctctctctctctctgtgaacgaaagaaaatgtctacgttcagcggcgatgaaactgctccgttcttcggcttcctcggcgcagctgctgccctcgtattctcctgtatgggagctgcctatggaacggcaaagagtggtgtaggtgtggcctcaatgggtgtcatgagaccagagcttgtgatgaagtcaattgtgcccgttgttatggctggtgtgttgggtatttacggtttgattatcgctgtgatcatcagtactggaattaaccctaaggccaagtcctattatctcttcgacgggtatgcacacttgtcatctggtcttgcttgtggtctcgctgggctttcagccggaatggctattgggattgttggtgatgctggtgttagagcaaatgcacaacagcctaagctttttgttggaatgattctcattctcatctttgctgaggcactggcattgtatggtctcattgttggcatcatcctctcttcccgtgctggacaatcacgagcagattagagaattctatcctcaatgattcttttgtgtggtttgttggcatcaccttattctcaggtcagtgatgctaggttggaaagtgcaatgcttcttcttgctattacggtgcactcaattctttatggcttgtaatttctgctgattgta

SEQ ID NO: 1486 - DNA, 630 bp, Actinidia deliciosa
  misc_feature (365)..(366): n is a, c, g, or t
  misc_feature (518)..(518): n is a, c, g, or t
aaacagcgtttcgccgcgagaaaatccacaatgtcgtcgacgttcagcggagacgaaaccgctcctttcttcggctttctcggcgctgctgctgccctcgtcttctcctgtatgggagcagcctatgggacggcaaagagtggcgttggtgtggcgtccatgggtgtgatgagaccagagctggtgatgaagtctattgtgccggtcgttatggctggtgtgttgggtatttatggcttgataattgcagttatcatcagtactggcattaaccccaaggccaagtcgtattacctgtttgatggttatgcacatctttcctctggtcttgcttgtggcctcgctgggctctccgctggaatggnnatcgggattgtgggcgatgccggtgtgagagcaaatgcacagcagccaaaactttttgtcggaatgatcctcattctcatctttgctgaagcattggctctctatggtctcattgttggtatcatattgtcttcaagagctggtcaatccanagcagactgagaagaggtatgttttactagcgtccttgtattgctttatggtatcatctttgagaagatgaaaaatgaaaaaaagaaaagattattaggttagaacggagct

SEQ ID NO: 1487 - DNA, 898 bp, Glycyrrhiza uralensis
tagtcccaaaaaataaaacaacagtgaaaaaaaaaaatcaatcgcagagaaggcaaattgaaacaatagatcgatcctcttcttcttcatcctgcatctgattttggtagaaacaaaagagaagagaaaatggctggtttcagcggcgacgaaactgctcctttcttcgggttcctgggcgccgcggctgccctagttttctcctgtatgggagcggcatatgggacagcgaagagtggggtaggggtcgcgtcgatgggagtgatgagaccggagctggtgatgaaatcgatcgtgccggttgtgatggctggtgtgttgggtatttatggtttgatcatcgccgtcatcatcagcaccggcattaaccccaaggccaaatcttactacctctttgatggctacgctcacctttcttctggcctcgcttgtggtctcgctggcctctctgctggtatggccattggcattgttggcgatgctggtgtcagagcgaatgcccaacagccaaagcttttcgttggaatgattctcattctcatctttgctgaggcgttggcgttgtatggtctcattgttggcatcatcctctcttcccgcgctggccaatccagagctgattaatataaattttattgttgcttgtagcacacagagccacggagccatggattgtgaattttaccagagatttgggcttagtaagggtggatctttgtcatgttcttcactcgtcttatgactcttatctactcgttataaaattgtggttatcctgggataaagcctgtcaaactatttccttggcattattgtatttaattgtgttgagtcaaactagattagagagatctctgcaataaactttatatgcctgtgttgatttcaataatgttta

SEQ ID NO: 1488 - DNA, 957 bp, Tropaeolum majus
accaccaaaaacacaaccacagagagatcataataaaactaaatatctctgctataatcaaatcctgttaccactacaaattctcagatccaaatctgtaatatcttgatcaatcatctacaatggtttctggattcagcggagatgaaacggcaccgttcttcggtttcctcggcgcagcagccgctcttgtgttctcctgtatgggagctgcatatggaacagccaagagtggtgttggtgtggcctctatgggtgtgatgaggccagaattggtgatgaagtcaatcgttccggttgttatggctggtgttttgggtatttacgggttgattattgctgttattattagtactgggattaaccccaaggctaaatcatattacctcttcgatggctatgcacatctctcatctggtcttgcttgtggtcttgccgggctttctgctggaatggccattggaattgtcggtgatgctggtgtgagggctaacgcacaacagccaaaactttttgttggaatgattcttatcctcatttttgctgaagctcttgctctctacggtcttattgtcggaatcatcttgtcctccagagctggccagtctagagctgaatagaaggaatccttactgcctggtattcgtttcaactcctatggagaaggattttagtagctctcagtctagttttactgtccacagaaaatttacattattttcaagaaatagtttggtagtgactgctctatcaatcatttggttgttgtttggtcccttaataatttgttgtgaagcttctctttaggctttgttgatcattgtttcatgaagaattacatcttcgttatcgaaggctattttcggaactattatgtggatggtttggtgttcagattcaactcttggaacttgattttcgtaaacactgcctttgcataatatgaagatgatattt

SEQ ID NO: 1489 - DNA, 989 bp, Tropaeolum majus
tgacaaaatcgtgggaggagatacatgatgaatgagatctaatccctttctatgggatctctcggtttaattcataataggccggtctctccgaaacaaggcctatttaacattaaaggaaaaaaacccaacacttgctctcatctctggacaaacaaccaagatagctttagatccgatcattttttccaagaaacatggtttcaaatttcagtggagatgagacagctcctttctttggtttcctcggagctgcagctgcccttgttttctcatgtatgggagctgcttatggaacagccaagagcggcgttggtgtagcgtcaatgggggtgatgaggccagagctggtgatgaagtcaatcgtcccagttgttatggctggtgtgttgggtatatacggcttgattattgcggttatcattagtactggaattaacccgaaggccaaatcctactacctatttgatggctacgcacatctctcttcgggtctggcttgtggtctggctggtctctctgctggtatggctattgggattgttggtgatgctggtgttagggctaatgcacaacaaccaaagctgttcgttggaatgattctcattctcatctttgctgaagcacttgctctgtatgggttgattgttggcatcatcctttcttctcgggctggtcagtcccgagctgaatgatgaagataccattttggaaatgataattgtgtgttgaaccagaaaggaacctggatagttacatcactatgcttcagctctctaatttacggtcaaaaactgtctcatctaatgttcaacatagcccctaactcctacccggctcttatatgggacttatgttaaactagcctttgactttgagtatcatttacaaatttataatttcacatatatgtaattgtgtaattttaaccctataattagtttagggtcataatttagtattggttttggttctctttattcggttcg

SEQ ID NO: 1490 - DNA, 946 bp, Nicotiana benthamiana
aaaattgagatcatccacaagcgaaaggctacaataatctctctctctctttctctctctctctagaagattttgagaagtatctcagatccaaatcaataacacacttctgagatccaatcagaaacaatgtcttcgactttcagcggcgatgaaactgctcccttctttggcttcctcggcgctgctgccgccttagtcttctcctgtatgggagcagcttatggtacagcaaagagtggcgtaggggtggcatcaatgggtgtgatgaggccggagttggtgatgaagtcaattgtgccagttgttatggctggtgttttgggtatttatggattgattatagctgtgattattagtacagggattaacccaaaaaccaagtcttactatctttttgatggatatgctcacctttcctctggtcttgcttgtggtcttgctggcctttctgctggtatggccattggaatcgttggtgacgctggtgttagagccaatgcacaacagccaaagctttttgtcgggatgattttgattcttatttttgctgaagccctggctttgtatggccttattgttggaatcatcctctcttctcgtgctggtcagtctagagcagagtagaagaagagaatgctgtgcaccattactgtgaattatctttgtgtttttcatggatgagctagtctggctgctgaattacatttcccttttttctttgggttccaagattctgtacttgatttcttggttagaagaattggttcatatatgcggttctgctgtagattagatccctaaataaagaagtcagttaatctgatgccccaactttcaaggacaatgggtttttgtaaaatgccactgtatcattttttcttaacttgaattcaagtttttaatattctataccctgttttatctctttgtttgccctttacca

SEQ ID NO: 1491 - DNA, 890 bp, Nicotiana benthamiana
  misc_feature (3)..(3): n is a, c, g, or t
  misc_feature (12)..(12): n is a, c, g, or t
  misc_feature (806)..(806): n is a, c, g, or t
acngccggggancgaaaggctacaataatctctctctttctctcgaagacattgagaagtatctcagatccaaatcaataacacacttctgagatccaatcagaaacaatgtcttcgactttcagcggcgatgaaactgctcccttctttggcttcctcggcgctgctgccgccttagtcttctcctgtatgggagcagcttatggtacagcaaagagtggcgtaggggtggcatcaatgggtgtgatgaggccggagttggtgatgaagtcaattgtgccagttgttatggctggtgttttgggtatttatggattgattatagctgtgattattagtacagggattaacccaaaaaccaagtcttactatctttttgatggatatgctcacctttcctctggtcttgcttgtggtcttgctggcctttctgctggtatggccattggaatcgttggtgacgctggtgttagagccaatgcacaacagccaaagctttttgtcgggatgattttgattcttatttttgctgaagccctggctttgtatggccttattgttggaatcatcctctcttctcgtgctggtcagtctagagcagagtagaagaagagaatgctgtgcaccattactgtgaattatctttgtgtttttcatggatgagctagtctggctgctgaattacatttcccttttttctttgggttccaagattctgtacttgatttcttggttagaagaattggttcatatatgcggttctgctgtagattagatccctaaataaagaagtcagttaatctgangccccaactttcaaggacaatgggtttttgtaaaatgccactgtatcattttttcttaacttgaattcaagtttttaatattcc

SEQ ID NO: 1492 - DNA, 841 bp, Nicotiana benthamiana
  misc_feature (169)..(169): n is a, c, g, or t
  misc_feature (217)..(217): n is a, c, g, or t
  misc_feature (230)..(230): n is a, c, g, or t
  misc_feature (250)..(250): n is a, c, g, or t
  misc_feature (397)..(397): n is a, c, g, or t
  misc_feature (530)..(530): n is a, c, g, or t
  misc_feature (536)..(536): n is a, c, g, or t
  misc_feature (545)..(545): n is a, c, g, or t
  misc_feature (568)..(568): n is a, c, g, or t
  misc_feature (813)..(813): n is a, c, g, or t
gatccaaactccgatcggaacaatgtcctcgactttcagcggcgatgaaactgctcctttcttcggcttcctcggcgccgctgcggctctcgtcttctcctgcatgggagcagcgtacggaacagcaaagagcggtgtaggagtggcgtctatgggagtgatgagaccngagctggtgatgaaatccattgttccggtggttatggctggtgtgttnggtatttatggtntgattattgctgttattatnagtactggtattaatcccaaaacaaagtcgtattacctgtttgatggatatgctcatctctcctctggtctcgcttgtggtcttgctggactttctgctggaatggctattggtattgttggtgatgccggtgttagggctaatgcncaacagccaaagctttttgttgggatgatcctcattctcatttttgctgaagctttggctctttatgggcttattgttggaattatattgtcttcacgagctgggcagtccagagcagagtgaagttggcttnttaatnctattcttnctatgatgtatgtgagactcatnaacgctggcagaccttgatccttgctaaagtcgaaaagctatctatgtctatgtttgttattcatgatggcacggttgctactggtgctgctatgtactgtttgtagaagtaggagtgagtatttattttaataataacttaagaagctgtcgtatttgatcactatttgtgcatgtaatgattttttgctacaatttgttatggccccgtgcaacatgtatgatattccgcttacatatttctntgaataaaaaactctgttgggtgatgct

SEQ ID NO: 1493 - DNA, 865 bp, Elaeis guineensis
ctattcgtctcctcttcatccccaagtcctctccttcgaagatacaacaattagggttgccaagatctagggtttctccaatccctccgcccatgtcggacttcagcggtgaccagactgcccccttctttggcttcctcggagccgcggcagcgctcgtcttctcctgcatgggggcggcgtatgggacggcgaagagtggagtcggggtggcgtcaatgggcgtgatgcggccggagctcgtgatgaagtcgatcgtgcccgttgtcatggctggggtgctcgggatctacgggttgatcatagctgtgatcataagcaccgggattaaccccaaggccaagtcttactacctcttcgatggatatgcgcacctctcgtccgggctcgcttgtggccttgctggcctctctgctggcatggcgatcgggattgtcggtgatgcaggagtcagggccaacgcacagcagccaaagctatttgttggcatgattctaattcttatttttgcagaagctcttgccctctatggtctcattgtcggtatcatcctttcatctcgggctggtcaatcccgtgcagactaagaacacgggcagctggccatgtgctctttgctcttcttattttcatataggacatgatcagagctttctaattatttgtcattatactgtaatttatttaaggactttgttgtgaatggggcctctgattgtttgacttgcctgccgtcttttctatgaggtgaccttttttttatgtgcttttaatgcaagctaatgacattttgccacgcttgtacatgtggcaccctttgcaaaggacatgggtctagattgcttctgttattataaagtctcag

SEQ ID NO: 1494 - DNA, 924 bp, Olea europaea
tcgggggacatacaaatgatacatcacaagaatcagctgagagagaactagatctgttaatcggaaaccaccaaatcatctctctctgtaacaataactgttcgatcaacataaatttccagatccgttagtaatttatttttttgcaatccaaacaaaaatgtcttctatattcaacggcgatgaaactgctccctttttcggcttcctcggcgccgcttctgccctcgtcttctcctgtatgggtgcggcgtatggaacagcgaagagtggagtaggtgtggcttcgatgggagtgatgaggccggagttggtgatgaagtcgatcgtgccagtggttatggctggagtgttgggtatttacgggttgattattgctgtgattatcagcactgggattaaccctaaggcaaagggttattatcttttcgatggctatgcgcatctttcctcgggcctcgcttgtggccttgctggcctctcagctggaatggcaattgggattgttggagatgctggtgtcagggctaatgcacagcagccgaagcttttcgttgggatgatcctcattctcatcttcgctgaagctttagccctttatggtctaattgttggaattattttgtcttcaagggctggccaatctagagctgactgagaaactggcttttatcaagttcaactgcaatgtttaatgtaatggagaaacttgattcttggcaggctttgtaaactctttcgtaccctccctatttatcaccgtgaatgttatcaatgttaccattgcattcattccacggtagcttcgtgatgtttgtagaattattagaagtgcttttatctacccctgctgaataagagcttatatggcttttgcttttggattaagtaaatttgttttctgtttttttgttttgttttgtt

SEQ ID NO: 1495 - DNA, 866 bp, Olea europaea
gagagagaactagatctgttaatcggaaaccaccaaatcatctctctctgtaacaataactgttcgatcaacataaatttccagatccgttagtaatttattttttgcaatccaaacaaaaatgtcttctatattcaacggcgatgaaactgctccctttttcggcttcctcggcgccgcttctgccctcgtcttctcctgtatgggtgcggcgtatggaacagcgaagagtggagtaggtgtggcttcgatgggagtgatgaggccggagttggtgatgaagtcgatcgtgccagtggttatggctggagtgttgggtatttacgggttgattattgctgtgattatcagcactgggattaaccctaaggcaaagggttattatcttttcgatggctatgcgcatctttcctcgggcctcgcttgtggccttgctggcctctcagctggaatggcaattgggattgttggagatgctggtgtcagggctaatgcacagcagccgaagcttttcgttgggatgatcctcattctcatcttcgctgaagctttagccctttatggtctaattgttggaattattttgtcttcaagggctggccaatctagagctgactgagaaactggcttttatcaagttcaactgcaatgtttaatgtaatggagaaacttgattcttggcaggctttgtaaactctttcgtaccctccctatttatcaccgtgaatgttatcaatgttaccattgcattcattccacggtagcttcgtgatgtttgtagaattattagaagtgcttttatctacccctgctgaataagagcttatatggcttttgtcttttggtattaagttaaatttagtttt

SEQ ID NO: 1496 - DNA, 709 bp, Olea europaea
ttggaattctttaaatccgatctccgcagatcccctccagggaaaatgtcatcaaatttcagcggcgaagaaacggcgccgttcttcggcttccttggtgccgcggctgctctagttttctcctgtatgggtgcggcgtgcggcacggcaaagagtggcgttggtgtggcgtcgatgggcgtgatgcgaccggagctggtgatgaagtcgatagttccggtggtcatggctggagttttgggtatttatggattgattattgctgtgatcatcagtactggaatcaaccctaaggcaaagtcatactacttgtttgatggctatgctcacctttcttctggcctcgcttgtggccttgctggcctttctgctggtatggccattggaattgttggggatgctggtgttagagccaatgcacaacagccaaagctctttgttggaatgattcttattcttatttttgctgaagcgctggctctttatggccttattgttggcatcatcctctcttctcgtgctggtcagtctagggcagattagaagacggcattcggctttgcagctgcagtttgttactatctctattgtgttcccagtatgaattattagttcggtcagcaatgtttttaggctcaatctttatctttatgtggttattgcttggcctgaagaagaggagggttgatttctgctgatggtagatagt

SEQ ID NO: 1497 - DNA, 904 bp, Olea europaea
catcatacgtctaaacaggcagcaaagaggactaagatccattcatccatacccccaaaccatccgtctctgtaactgtaactgttaattcaacgtaatttttcagatccgttagtaaatttttgcaatccaaacaaaaatgtcttcaatctttaacggcgatgaaactgctccctttttcggcttcctcggcgccgcttctgccctcgttttctcctgtatgggtgctgcgtatggaacggcgaagagtggggtaggtgtagcgtcgatgggagttatgaggccggaactggtgatgaagtcgatcgtgccagtggttatggctggagtgttgggtatttatgggttgattattgctgtgattatcagcactgggattaaccccaaggcaaagggttattatctgttcgatggctatgcgcatctctcttcaggcctcgcttgtggccttgctggtctctcagctggaatggcaattgggattgttggcgatgctggcgtcagggctaatgcacagcagccaaagctttttgttgggatgatccttattctcatcttcgctgaagctttagccctttatggtttaatcgttggaattattttgtcttcacgagctggccagtctagagctgactgaggagttggcttaagtagttcgactgcaatgtttaatgttatggagaaatttgattcttggcaggcttagttaaatctttcatacgcgccctatttatgaccatgaatgttcttgccatggtagcttcgtgatgattgtagaattgttagaagtacctttttctccctttgctgaataagagcttaaatggatgtggatgttggattaagcgaatttatttttggtcaattatgaaccctgtggaatatatttattcgaattagtgtg

SEQ ID NO: 1498 - DNA, 947 bp, Olea europaea
aagaggactaagatccattcatccatacccccaaaccatccgtctctgtaactgtaactgttaattcaacgtaatttttcagatccgttagtaaatttttgcaatccaaacaaaaatgtcttcaatctttaacggcgatgaaactgctccctttttcggcttcctcggcgccgcttctgccctcgttttctcctgtatgggtgctgcgtatggaacggcgaagagtggggtaggtgtagcgtcgatgggagttatgaggccggagctggtgatgaagtcgatcgtgccagtggttatggctggagtgttgggtatttatgggttgattattgctgtgattatcagcactgggattaaccccaaggcaaagggttattatctgttcgatggctatgcgcatctctcttcaggcctcgcttgtggccttgctggtctctcagctggaatggcaattgggattgttggcgatgctggcgtcagggctaatgcacagcagccaaagctttttgttgggatgatccttattctcatcttcgctgaagctttagccctttatggtttaatcgttggaattattttgtcttcacgagctggccagtctagagctgactgaggagttggcttaagtagttcgactgcaatgtttaatgttatggagaaatttgattcttggcaggcttagttaaatctttcatacgcgccctatttatcaccatgaatgttcttgccacagtagcttcgtgatgattgtagaattgttagaagtacctttttctccctttgctgaataagagcttaaatggctgtggatgttggattaagcgaatttatttttggcaattatgaaccctgtagaaatatatttattcgaaactagtgtgcacctatagttttcgttccctttgttccttagatgtgttttgttttcatgcttatatgatatacct

SEQ ID NO: 1499 - DNA, 799 bp, Allium cepa
  misc_feature (739)..(740): n is a, c, g, or t
  misc_feature (749)..(749): n is a, c, g, or t
tcaaatcttaaaattctcaataccaggaacttcaaatcagaaattgaattcagtcatggtcggattcagtggagatgaaaccgccccattcttcgggttccttggcgccgccgccgccctcgtcttctcctgtatgggagcagcctatggaacagctaagagtggagtaggagtagcatcaatgggagtaatgagaccagagcttgtaatgaaatcgatcgtgcctgttgttatggctggagttcttggaatttatggattaattattgctgttattattagtacgggaattaatcctaaggctaagccatactacttgtttgatggctatgctcatctttcttctggattggcctgtggtcttgcaggtttgtctgctggtatggcaattgggattgtaggcgatgctggtgtaagggctaatgcacaacagcctaagctctttgttgggatgatattgattcttatctttgctgaagcgctcgctctatatggcctcatcgttgggatcatcttgtcttctcgtgctggacaatcacgtgccgattagttttgtgcctgttctacatctatgtttctctcttttttagatccttacatgaatgaacttgtcgtctacatcatcctcttattcggacagttgtcaaaatttacagcaagacttgttatgaatggaattggttgataagtttcaagtacctgcttttttacgttgtactaattactgtattatatctgnnataacgtgnaatactggcagcctttacagtctctagtgtagtggtggccttttctatat

SEQ ID NO: 1500 - DNA, 988 bp, Carica papaya
atgctcgatcattcaccttcttccccgatccgatccccaaatctcattttggttttttgcttcttttcaaaagcactgcaacccagacgaactacaggggtttatccaacccaaggattacctaacgccgttctctccgtggatctcctgtccaaacaaattgaaaaaaagcaccatggcttcgggtttcagcggcgatgaaactgcccccttcttcggcttcctcggagctgccgcggctctcgtattctcttgcatgggtgccgcctatgggaccgcaaaaagtggggtaggagttgcctccatgggagtcatgcggcctgaacttgtcatgaagtctattgtacccgtggttatggctggagttttgggaatttatgggttgatcatagctgttatcatcagtactggtataaacccaaaagcaaaatcgtactatctctttgatgggtatgcacacctgtcctcgggtcttgcttgtgggcttgctggcctctctgctggaatggctattggaattgttggtgatgctggtgttcgcgctaatgctcaacagcctaagctgtttgtgggtatgattctcattcttatctttgcggaagctcttgctctatatggtctcattgtggggatcattctatcatcccgagctggccaatctcgggcagaatgaagagagctaaaaattcttgttcgtgatatcttctatttgatatacaactggctggacttgtatcattgctcatcgagtgtgagttatatggaccattttcttgttattatatttctcaagctccacctgcttgatggatgaactcttgtatggggtggatttatagatagcattatgaaatctgtattattttcttagcggagtttcctgtacccttcttgatgtcttgcgtgatgatggtgtatttactcaaattatctttatgtgcttactcaatacaactggctttaagttgtgcagccgctaacatttact

SEQ ID NO: 1501 - DNA, 936 bp, Carica papaya
gtcctctctctctctgcctctccaaatttctcgatcgatcggattccccgatctaattttcaactccctgcaaattagtgttcggaaaagatgtcaactccattcagcggcgatgaaactgctcccttcttcggcttcctcggcgccgctgctgcactcgttttctcatgcatgggtgccgcgtatggaacggcgaagagtggcgtaggggtggcgtcgatgggtgtgatgaggccagagcttgtaatgaaatcgatcgtgcccgttgttatggcgggagttttgggtatttacggtttgattattgcggttataatcagtactggtattaaccctaaggccaagtcctattacctttttgatggatatgctcacttgtcctcgggtcttgcttgtggccttgcgggtctttctgccggtatggctattggtattgttggcgatgctggtgtgagagctaatgcacagcagcctaagctttttgttggaatgattttgattctcatctttgctgaggcattggctttgtatggcctcattgtgggcatcatcctttcttctcgggctggtcaatccagagcagaataaggtgcaggattctgatctatgggctgttggaacacttttgtattctggttggtgatgctcttgtagagcaggagatgttaaattaaattgtttgtaatttagatggttaccctacttgtggttgggtggttcttgctgatattctgattaggatcaagttttttctccctccttgaaataaatttgttgaagctgtttctttctatattgtgctattttacatgtaggttccaactaatgtgaaagatggtattaccatcaccaatttgaaccctaagataccctctctctctctctctctctctctatgtatatgtatgtttttatgtggctgaattccatattatc

SEQ ID NO: 1502 - DNA, 859 bp, Phalaenopsis aphrodite
atccacccgtcttctttgtgcttcttccttcttctccggcgacgagataaggagggaggtagggggagggattgagaggagaaaattttcctaagaagatccgatcatctcccaatcaaccaaaatggccggattcagtggtgatgaaaccgctcctttcttcggcttcctcggcgccgccgccgcccttgtcttctcttgcatgggagctgcttacggaacggcgaagagtggtgtcggcgtggcttcgatgggggtgatgagacctgagctcgtgatgaagtcaatcgtgccggtggttatggctggagtgctaggtatctatggccttattattgctgttattatcagcacggggataaaccccaaggcgaagtcttactacctctttgatggctatgcgcatctgtcatctggtttggcatgcggactcgctggtctttctgccggtatggctatcgggatcgtgggtgatgctggggttagagccaatgcacagcagccgaagctgttcgtggggatgatactgatactgatatttgctgaggcgttggcgctctatggattgatagttggcataattctgtcgtctagggctggccaatctagggctgattaaaattcttgctctcctttggtgatctctatagcttccagcatttgaaccgggccttgtgcttctatttaggaaccacttttatattcagaacgttttaataagatcttctgctagtcgattgctacagactctatttattacatacatatatatatttattaaccattttgagtgcttatatcgtgcagttttttccattatttatttaccttgatgtcgagatttttccgtcgtttagtg

SEQ ID NO: 1503 - DNA, 1613 bp, Phalaenopsis aphrodite
ggtttgttgctgagaggtcgcctgaatggatggcattattgcgggagttctttgcaatgacaccttccgctgctgttggtgagattggcctggataagggttcacatgggaggaatattgacttctctcaacaggttgaagtcttccggcaacaacttgaacttgctaaggaattagaaagaccagtatccattcattgcgtgagagcattcggggaacttcttgagataatgcaaagtagcggacctttcccagctggtgttattctgcattctttcatgggttctgctgagatggtgccagctttcactaagcttggttcttatttctccttctctggttttttaacatcaatgaaatctgagaaagctaagaaaatgctcaaatcggtgccaattgaaaggattctatttgaatcagatgcaccagatgcattgcccaagtcaaacatagattattcaccacttctggtggaaaactctatagcacacggtcatcaaagccatcgtccaaaggaggaactgaatcatccagctaatattcaaattgtgttgaatcatgttgcccaattgcttgacgtttccaaggaagaacttgcagcagcaagctgtcagaatgcccttcacctgttctcttacccaggttccaagctcctcggagaaatttaaaacctcctacctctgtccttcatcccacatgtttcacaacaaatatccagcggagccttgtggtcagacttaatctgaagatctgacggtcatgatcaaatgatcactttatcctattgtagtccacggagcatccaaacactatccttcgctccatctatcatccacccgtcttctttgtgcttgttccgtcttctccggcgacgagataaggagggaggtagggggagggatagagaggagaaaattttcctaagaagatccgatcatctcccaatcaaccgaaatggccggattcagtggtgatgaaaccgctcctttcttcggcttcctcggcgccgccgctgcccttgtcttctcttgcatgggagctgcttacggaacggcgaagagtggtgtcggcgtggcttcgatgggggtgatgagacctgagctcgtgatgaagtcaatcgtgccggtggttatggctggagtgctaggtatctatggccttattattgctgttattatcagtacggggataaaccccaaggcgaagtcttactacctctttgatggctatgcgcatctgtcatctggtttggcatgcggcctcgctggtctttctgccggtatggctatcgggatcgtgggtgatgccggggttagagccaatgcacagcagccgaagctgttcgtggggatgatactgatactgatatttgctgaggcgttggcgctctatggattgatagttggcataattctgtcgtctagggctggccaatctagggctgattaaaattcttgctcttctttggtgatcactatagcttccagcatttgaatcgggccttgtgtttttatttaggaaccacttttatattcagaacgttttaataagatctgctagtcgattgctacagactgtatttattacatacatatatatatatatatatattt

SEQ ID NO: 1504 - DNA, 929 bp, Phalaenopsis aphrodite
atccagcggagccttctggtctagacttatctgaagatctgacggtcatgatcaaatgatcactttatcctatttagtccacgagcatccaaacactatccttcgatccatctatcatccacccgtcttctttgtgcttcttccttcttctccggcgacgagataaggagggaggtagggggagggatagagaggagaaaattttcctaagaagatccgatcatcttccaatcaaccgaaatggccggattcagtggtgatgaaaccgctcctttcttcggcttcctcggcgccgccgctgcccttgtcttctcttgcatgggagctgcttacggaacggcgaagagtggtgtcggcgtggcttcgatgggggtgatgagacctgagctcgtgatgaagtcaatcgtgccggtggttatggctggagtgctaggtatctatggccttattattgctgttattatcagcacggggataaaccccaaggcgaagtcttactacctctttgatggctatgcgcatctgtcatctggtttggcatgcggcctcgctggtctttctgccggtatggctatcgggatcgtgggtgatgccggggttagagccaatgcacagcagccgaagctgttcgtggggatgatactgatactgatatttgccgaggcgttggcgctctatggattgatagttggcataattctgtcgtctagggctggccaatctagggctgattaaaattcttgctcttctttggtaatcactatagcttccagcattttgaaccgggccttgtgtttctatttaggaaccacttttatattcagaacgttttaataagatctgctagtcgattgctacagactgtatttattacatacatatatatatatatattttaacgattttgagtgcttatgtcgtgcagtttt

SEQ ID NO: 1505 - DNA, 923 bp, Cajanus cajan
agaaaaagggcattatggtaaaatgacgcaacacgatccttctctctcacactgcaacctgtctccttctgtaccaatccaaataatttaatttttttttccatttccacatttcgctttgatctgatctcacaacaacccaatcaattccattctctttgctccgcgagaacaaagaagagagagagagaaaaaaaaaaaatctcatcaacgatggcaggcttcagtggcgacgaaaccgctcctttcttcggcttcctcggtgccgcggcggcgctggtcttctcctgtatgggagcagcgtacggaacagcgaagagtggggtgggagtggcgtcgatgggtgtgatgaggccggagcttgtgatgaagtcgattgtgccggtggttatggctggcgtgcttggaatctatgggttgattattgcggttatcatcagcactgggataaaccccaaggctaagtcttactatctctttgatggatatgctcacttgtcctctggccttgcctgtggccttgctggtctttctgctggaatggccattggaattgttggtgatgctggtgtcagagctaatgcccagcaaccgaagctgtttgttggtatgattcttatcttgattttcgccgaagctcttgctctgtatggcctcattgtgggtatcatcctctcatctcgggcaggccaatctcgtgctgattgaaatgaagccaacttggcgatacttggtagtccagtatattttaatatcacgcttgtatttgaaatgggggatacttgtccttagtttattactattatttcatttgttttcgtacacagatccctgtctcagaattctatatgttctatgaagcattttccttcggattacttatttgaatgactgcataatgatatgggtcatgtttagataaa

SEQ ID NO: 1506 - DNA, 1053 bp, Cajanus cajan
gtggtgtgagggatgaagacagagttggcggggtccattgtccatcgaagaaacttccctttggttgaaattgaaaagccagggaagaggcagtaacagatctgattcccgttttcacaatccatggctggttttagcggcgatgaaactgcccccttcttcggcttcctcggtgcggccgccgccctcgtcttctcctgcatgggggcggcgtacggcactgccaagagcggagttggcgtcgcgtccatgggcgtcatgaggccggagctcgtcatgaaatccatcgtgccggttgtcatggccggagtcttaggtatctacggcctgatcatcgccgtcattatcagcaccggcattaaccctaaggccaaatcctattacctcttcgacggctacgctcacctctcttctggcctcgcttgcggtctcgccggtctctccgctggcatggccattggcattgtcggcgacgccggtgttagagcaaatgcccaacagccaaagcttttcgttgggatgattctcattctcatctttgctgaggcattggcgttgtatggtctcattgttggcatcatcctctcttcccgcgctggccaatccagagctgattaatgtagacttccctgtttcttatagcgcacagaaccatggatggtgaatgtcgccatggactagggcttggtaagagtgtagctttgtgatgctcttcattcgcctcgtgactcttatctacttgtcatgaagttgaggttatcccgaaataaagcgtctcaaacgatttctttagccatttattgtatttaattatgttgagtccagactagattagagttctctataataaaacatgctgtatgtttgtgattatttatttcaataatgtctagtattgtgtcgtgtacaattcaacacttcaccctccccaagacctcctttttttttgttatatttaggtgccaaatgtcaatctgatttcttttataacgattttcaacatcatggaccatttcatttcttactgatgagtgactcaataattcgtgtaag

SEQ ID NO: 1507 - DNA, 872 bp, Platanus occidentalis
acaatcctttccgatccaataatatattcccaacggaaaacaagaagaagaagaagaggaggagaagagctaaacagcggagctgcaaaactgaacctagggttagggattagcagagatctctgcaaaaatgtcaactttcagcggcgacgaaactgctcccttcttcggcttcctcggagctgcagcagctctcgtgttctcctgcatgggtgccgcgtatgggactgcgaagagtggcgtcggtgttgcttccatgggtgtgatgcgacctgagcttgtcatgaaatcgatcgttccagttgtcatggctggagtgttgggaatttacggtttgattattgctgttattatcagtacgggaataaaccctaaggcaaaatcttattatctgtttgatggatatgctcacttgtcgtccggtctggcatgtggcctcgccggactgtctgctggaatggcgatcgggatcgtaggtgacgctggagttcgggccaatgcacagcagcccaagctttttgtgggtatgattcttatcctcatctttgccgaagcgctcgctctctatggtctcattgttggtatcatcctctcctcccgagcaggccaatctcgggcagactaaagaatgcagagccgaggctatcttgaagcccccttgatcttataatctgaaaatagaaacaaaagaacaacaactggattaaggttttgtttgatttcttgttctatttgtgatctaattaaagacctgttgcttttgggagtaattgaagttgtctaaaattttcatagccgtaatgatgtttctgtatgattgttcagatgtcctttttggactgaaattgcatcctctcccatatttaaataac

SEQ ID NO: 1508 - DNA, 967 bp, Platanus occidentalis
atgattctactctagagcataagaacgtgagagatctaaatccatctgcagaggaaagagtttttagatcggatcgtaattagtgcaaacccagactcgaaatgtctacgttcagcggcgatgaaactgctccgttcttcggcttccttggtgctgcagctgctttagttttctcttgtatgggagccgcttatggaacggcaaagagcggtgttggtgtggcctctatgggtgtcatgaggccagagctagtgatgaaatcgattgttcccgtcgttatggctggagtgttaggtatttatgggcttattattgctgttatcatcagtactgggataaaccctaaggccaaatcgtattaccttttcgatggttacgcgcacctttcttctggtcttgcttgtggtctcgctgggctctctgctggaatggcgattgggatcgttggtgatgccggtgtcagagccaatgcacagcagccaaaactctttgttggaatgattctaattctcatctttgctgaagcactggccctttatggcctaattgttggcattatcctctcctcccgagctggccaatccagagcagactaaaaaatagaggcatcctgccagtgtttctgtgtggttattattatttcaaaactcagttcttctcaggctcgtgagtatgttcattgccctcaaaatttcttaagtcaaaatgtgattgcttcacccacatcattcggtggttgctttgtaatggttgtagaattaggattgagtttctccctgaaataaagctggtgaagctgtttctgtttgtttaactattgttgtattttgcagataacaaaatcctatctggtgtagaaactatcattctgaaattagggctgtttgactttgttatttgccacctcccggttatacgttttcttcctttctctttcattcttttgcaagcagtgaattttttactt

SEQ ID NO: 1509 - DNA, 1026 bp, Platanus occidentalis
aatctcttttcggagcgaagaaatctcagatctggtcgtggtctctgcaaatcccgactcgaaaatgtctacgttcagcggtgatgaaactgctccgttcttcggcttcctcggcgctgcagctgccctggttttctcttgtatgggagctgcttatggaacggcgaagagcggtgttggtgtggcatccatgggtgttatgaggccagagcttgtgatgaaatcaatcgttcccgttgttatggctggagttttaggtatttatggattgattattgccgttattatcagtactggaataaaccctaaggccaaatcgtattaccttttcgatggttacgcgcacctttcttctggtcttgcttgtggtctcgctgggctctctgctggaatggcgatcgggatcgttggtgatgctggtgttagagctaatgcacagcagccaaaactcttcgttgggatgatcctaatcctcatctttgctgaagcactggccctatatggcctcattgttggcatcatcctctcctctcgagctggccagtccagagcagactaagaaaaatagaggctgtcttatgtttctttgtttattggtatcattttaaaactcagttattctcaggctagtaacggtagttgtagttaggcgcgttcattgttctctaaaattcttcattcagagcatgactgcttcaccgtcatcgccattcggtggttgctttgtgttggttatagatttggaagtctccccaaaataatgcttgctaggcttttctgtccgtttcattaacttctgtattttgcagatacaagtcctagctggtgtagaaaccgtctttctggacatgactgttatatgccattactcggttcctcattttcttccctttcttttccagtcgttggcatgttaaggtagccaaagtttatgattgcatgtgatagagcttggcaacacaaggccagtaggctttttttttttgttaataatttacttggtactgtggaccttgttatcaattt

SEQ ID NO: 1510 - DNA, 977 bp, Platanus occidentalis
gtcaccaaccatccttaccgatccaatcttctccttttctttacttcttctcatagcggggaaaggtaaaccagaagaaaaagcgcagaaaaataccttagggttaaggttagggttcctagatctctgcaaaaaaatgtctactttcagcggcgatgaaactgctcccttcttcggcttcctcggagccgcggcagctctcgttttctcttgtatgggtgctgcgtatgggacagcgaaaagtggcgtcggtgttgcgtcaatgggtgttatgcgacctgagctcgtcatgaaatcgatcgttccggttgttatggctggggtgttgggtatttacggcttgattattgctgttattatcagtacgggaataaaccctaaggccaaatcttattatctgtttgatggatatgctcacttgtcgtccggtttggcttgtggtctcgctgggctgtccgccggaatggcgatcgggatcgtaggtgacgctggagttcgggccaatgcacagcagcccaagctttttgtgggtatgattctcatcctcatctttgcggaagcacttgctctctatggtctcattgtgggtatcattctctcctcccgagctggtcaatctcgagcagactaaagaaagcagagtcgtggctatcttggagcccttcatgctatgatctgaagttgaaacgaaagaatttcaactggatcagggttatttgatttcttattccgtttgtcatcaaattaaattagaagacttcttgtatatgcagagtctaattgaactgttcgaaataatttctttacctttgtgatgtcttgatattctctgtattgctaagatgttcacccttttgactgaacttgtcggccatgtagtcgcctgctcctggacttggacacgtgtctggcaaacaggcaattgtcaccacatggggcaatatataatcaaaattagtgtttattttatttattat

SEQ ID NO: 1511 - DNA, 955 bp, Populus trichocarpa
ccagtcttccttctcgacacacgtgcaaccataatcaatcatcgtcaccatcccgatccgatcctcttactccaccttccctctcaaaaccagtgagaaattaaaacaagggaataacagaaaacaagcacagagctccatctaatccaaggatcagcataatccatcctcgtcgcgaaacaaggaaacaaaagaacgatgtcttcgactttcagcggcgatgagactgctcctttcttcggcttcctcggggccgctgctgccctcgtcttctcatgcatgggtgctgcctatgggacagcaaagagtggcgtgggtgtggcttcaatgggagtcatgagacccgaactcgttatgaagtcaattgtcccagttgtcatggctggagtgttgggaatttatgggttaattatagctgttattattagtactggaatcaatccaaaggctaaatcttattatcttttcgatggatatgcacacttgtcttctggtctttcttgtgggcttgctggtttatctgctggaatggctattggtattgttggcgatgctggtgtccgagctaatgcacagcagccgaagctgttcgtgggcatgattctcattctcatctttgctgaagcacttgctctctatggtctcatcgtggggatcattctatcatcccgggctggtcagtctcgtgcagaatgaagagtgccaaagcttatggtttcttgatgtcctttatcgtggtttatagaatgggaactgagactatgtttacattgttcgattcaatttgctataattgccaaactcttgtatacgtgggattctcagcatccctgtaatattactatatgataaacctcccttcttgcgctcaatttatgagttcagaacaattcccatctatcgttgatgcctttagaacgatcctgtttataaagcaaggttgattttctaacac

SEQ ID NO: 1512 - DNA, 1010 bp, Populus trichocarpa
agttgatcgagctgtcaatcagggtattctcgtcaaaccatccttccagtcttccttctcgacacacgtgcaaccataatcaatcatcgtcaccatcccgatccgatcctcttactccaccttccctctcaaaaccagtgagaaattaaaacaaaggaataacagaaaacaagcacagagctccatctaatccaaggatcagcataatccatcctcgtcgcgaaacaaggaaacaaaagaacgatggcttcgacttttagcggcgatgagactgctcctttcttcggcttcctcggggccgctgctgccctcgtcttctcatgcatgggtgctgcctatgggacagcaaagagtggcgtgggtgtggcttcaatgggagtcatgagacccgaactcgttatgaagtcaattgtcccagttgtcatggctggagtgttgggaatttatgggttaattatagctgttattattagtactggaatcaatccaaaggctaaatcttattatcttttcgatggatatgcacacttgtcttctggtcttgcttgcgggcttgctggtttatctgctggaatggctattggtattgttggcgatgctggtgtccgagctaatgcacagcagccgaagctgttcgtgggcatgattctcattctcatctttgctgaagcacttgctctctatggtctcatcgtggggatcattctatcatcccgggctggtcagtctcgtgcagaatgaagagtgccaaagcttatggtttcttgatgttctttatcataatttagaatgggaactgagactatgtttacattgttcgattcaatttgctataattgccaaactcttgtatacgtgggattctcagcatccctgtaatattactatatgataaacctcccttcttgcgctcaatttatgagttcaaaacaattcccatctatcgttgatgcttttagaacgatcctgttaataaagcaaggttgattttctaacacatcatgcttatt

SEQ ID NO: 1513 - DNA, 938 bp, Populus trichocarpa
ccttacctgtctaaaaaaatcaatctccaaatctcacttccctctccgtttcaatcaatcaaaaatggtttctacattcagcggcgatgaaacagcaccgttcttcggcttcctcggcgccgctgccgctctcgtcttttcatgtatgggagcagcgtatgggacagcgaagagcggagtaggagtagcttcgatgggagtgatgagaccggaactagtaatgaaatcaatagttccggttgtgatggctggtgtgcttgggatttacggtttgattattgcagttataattagtactggaattaatcctaaagccaaatcttattatttgtttgatggttacgctcatttatcttctggtcttgcttgtggccttgctggtctttctgctggtatggctattggtattgttggcgatgctggtgttagagctaacgcacaacagccaaaactatttgttggaatgattctgattctcatcttcgccgaggcgttggctctatatggacttattgtcggcatcatcctctcttctcgtgctggccaatccagagcagagtagaaaactggtttttggcatggctttgctgtattcaggttggtgatgctagtgaagagtgcgctggtgttaaatcaacattttgtcatgcatgtgatttctccaaatgtatttccgggtgctaacatactggttttgaatctgagggcaagtttccccttgaaataagctgtctttatgtttcattacccttcttcttttttttgtattcttcgtctgttagttcaatgtaatattcaaaacctagcttgcacatggttatctattgcaaagttgtccgtttgttttttatcatcaactggtgtactagtatgtttaattaattgaaccccgctaatcccccccctccccaccaccaccctcttttaaatgtttttat

SEQ ID NO: 1514 - DNA, 1074 bp, Populus trichocarpa
gtgataactgaactctatctccagcccaagagtccaataaaaggtttttgttccaaataaggcccattacatacaatgtgggccacgcaacgaagcttccttccagatcgcatgctgtcaccatcaacggtggttcccttacctgtctaaaaaaatcaatctccaaatctcacttccctctccgtttcaatcaatcaaaaatggtttctacattcagcggcgatgaaacagcaccgttcttcggcttcctcggcgccgctgccgctctcgtcttttcatgtatgggagcagcgtatgggacagcgaagagcggagtaggagtagcttcgatgggagtgatgagaccggaactagtaatgaaatcaatagttccggttgtgatggctggtgtgcttgggatttacggtttgattattgcagttataattagtactggaattaatcctaaagccaaatcttattatttgtttgatggttacgctcatttatcttctggtcttgcttgtggccttgctggtctttctgctggtatggctattggtattgttggcgatgctggtgttagagctaacgcacaacagccaaaactatttgttggaatgattctgattctcatcttcgccgaggcgttggctctatatggacttattgtcggcatcatcctctcttctcgtgctggccaatccagagcagagtagaaaactggtttttggcatggctttgctgttttcaggttggtgatgctagtgaagagtgcgctggtgttaaatcaacattttgtcatgcatgtgatttctccaaatgtatttccgggtgctaacatactggttttgaatctgagggcaagtttccccttgaaataagctgtctttatgtttcattacccttcttcttttttttgtattcttcgtctgttagttcaatgtaatattcaaaacctagcttgcacatggttatctattgcaaagttgtccgtttgttttttatcatcaactggtgtactagtatgtttaattaattgaaccccgctaatcccccccctccccaccaccaccctcttttaaatgtttttat

SEQ ID NO: 1515 - DNA, 1212 bp, Populus trichocarpa
gacttccttggctctaaaaatctgttaatcgcgaagcatcgccaagaagctctctccagatttttttttttaaaaaaaaaaaaaacacaaaagagctctcaaattcaatcatcttctccgatctcgtcaaaatccaataacaaaatggcttcgacattcagtggcgatgaaaccgctccgttcttcggattcctcggcgccgctgccgcccttgttttctcctgcatgggagctgcgtacggtaccgcgaagagtggagttggcgttgcatcgatgggtgtgatgcgaccagaactcgtgatgaaatccatagttccggttgttatggctggagttttgggtatatacggtctgatcattgctgtgattatcagtaccggtattaaccctaaagcaaaatcctattatctttttgatggatatgctcatctctcttctggccttgcttgtggcctcgctggtctctctgctggtatggctattggcatcgttggtgatgctggtgttagagctaatgcccagcagccaaagctttttgttgggatgatcctcattctcatctttgctgaagcacttgccctctacggtctcattgttggtatcattctttcctcccgagctggtcaatcgagagctgagtaaagagtccctctacttggtgtttggatggccgttgtgatttatctataattagttatgagctagcaaggatagccagattatttttgccaagattccttgattctgcaccttcccgctctgtggggaacgaaccagattgaccttgccatccatcaatgggtgtctcaatggctgatgtgtacactgaatggaatgatgaacgatgcacttgaaacatggtttctgctaaaattgggattagtagtctgtggtctacggttgctgtggctataagaagggagctgtatgtcaacgatgacgtcggggggagtgggcggcggccgcgggggccatgctcgttcttaaagccactcattttgtaatttcttaaacaagttatatgaattggtccctcctaaaagttgaaattagattttagcccctgcatggcaacaagtctgaatccgtcgctgtttggataggagttgcttaccagtaactaatggcagcttggagcaatatagcctttaatttaatttaatacaaacagtaaattgaattcaattttggctaaccggagttttagttcct

SEQ ID NO: 1516 - DNA, 1320 bp, Populus trichocarpa
gacttccttggctctaaaaatctgttaatcgcgaagcatcgccaagaagctctctccagatttttttttttaaaaaaaaaaaaaacacaaaagagctctcaaattcaatcatcttctccgatctcgtcaaaatccaataacaaaatggcttcgacattcagtggcgatgaaaccgctccgttcttcggattcctcggcgccgctgccgcccttgttttctcctgcatgggagctgcgtacggtaccgcgaagagtggagttggcgttgcatcgatgggtgtgatgcgaccagaactcgtgatgaaatccatagttccggttgttatggctggagttttgggtatatacggtctgatcattgctgtgattatcagtaccggtattaaccctaaagcaaaatcctattatctttttgatggatatgctcatctctcttctggccttgcttgtggcctcgctggtctctctgctggtatggctattggcatcgttggtgatgctggtgttagagctaatgcccagcagccaaagctttttgttgggatgatcctcattctcatctttgctgaagcacttgccctctacggtctcattgttggtatcattctttcctcccgagctggtcaatcgagagctgagtaaagagtccctctacttggtgtttggatggccgttgtgatttatctatgtatgttactggagcttaattgttttgtgctgaaaaattcttgtaagagttgtgtttttttaccaaatgatctcattaagtgccattgcttatatgataaaatgcagaattagttatgagctagcaaggatagccagattatttttgccaagattccttgattctgcaccttcccgctctgtggggaacgaaccagattgaccttgccatccatcaatgggtgtctcaatggctgatgtgtacactgaatggaatgatgaacgatgcacttgaaacatggtttctgctaaaattgggattagtagtctgtggtctacggttgctgtggctataagaagggagctgtatgtcaacgatgacgtcggggggagtgggcggcggccgcgggggccatgctcgttcttaaagccactcattttgtaatttcttaaacaagttatatgaattggtccctcctaaaagttgaaattagattttagcccctgcatggcaacaagtctgaaaccgtcactgtttggataggagttgcttaccagtaactaatggcagctcggagcaatatagcctttaatttaatttaatacaaacagtaaattgaattcaattttggctaaccggagttttagttcctt

SEQ ID NO: 1517 - DNA, 781 bp, Primula obconica
aaactcaaacacaaactcatcggagagagaaaagatgtcaagcttcagtggcgatgaaactgctcccttcttcggcttccttggcgccgctgccgccctcgtcttctcctgtatgggagcggcatatgggacagcaaaaagtggcgtaggggtggcgtcaatgggtgtgatgaggcctgagctggttatgaagtcgattgtgccggtggttatggcgggtgtgttgggtatatatggactcatcatagctgtcatcataagtactggaattaatcccaaggccaagtcatattaccttttcgatggttatgctcacctctcctccggactttcttgcggccttgcgggtctctctgctggtatggccattgggatcgtcggtgatgctggcgtcagagctaatgctcaacagcctaaactttttgttggaatgattcttatcctcatctttgctgaggcgttggctttatacggactcattgttgggatcatcctctcgtctcgcgctggtcaatctagagccgagtagactttaaatttcttttttgggttcatcttactagtactgaagctagtttgattatttgtatctttattcttctgtattgtccacaattttattttcgtgtgcaagttttgaactggttagctaatactgggagcaaactcgtccctgtaataaagctgtataaaaagcttgtttggttcatttcgatcttattttgctataggcaactttattacactatacttgtcttgggttggtgtggttaaagcattg

SEQ ID NO: 1518 - DNA, 796 bp, Primula obconica
ctctcatcggatctgtctgcaacacaaactcaaaatcaaactcaaaatcaaactcaaacacaaactcatcggagagagaaaagatgtcaagcttcagtggcgatgaaactgctcccttcttcggcttccttggcgccgctgccgccctcgtcttctcctgtatgggagcggcatatgggacagcaaaaagtggcgtaggggtggcgtcaatgggtgtgatgaggcctgagctggttatgaagtcgattgtgccggtggttatggcgggtgtgttgggtatatatggactcatcatagctgtcatcataagtactggaattaatcccaaggccaagtcatattaccttttcgatggttatgctcacctctcctccggactttcttgcggccttgcgggtctctctgctggtatggccattgggatcgtcggtgatgctggcgtcagagctaatgctcaacagcctaaactttttgttggaatgattcttatcctcatctttgctgaggcgttggctttatacggactcattgttgggatcatcctctcgtctcgcgctggtcaatctagagccgagtagactttaaatttcttttttgggttcatcttactagtactgaagctagtttgattatttgtatctttattcttctgtattgtccacaattttattttcgtgtgcaagttttgaactggttagctaatactgggagcaaactcgtccctgtaataaagctgtataaaaagcttgtttggttcatttcgatcttattttgctataggcaactttattacgct

SEQ ID NO: 1519 - DNA, 997 bp, Pseudotsuga menziesii
ggatcagccaaggcactcgcaggttctggttttgattcctctggagtctctgaagttctgaaaaacttgcgaagtcctagcgagaagcttgtcccagatctcggttaaaatggtggaggcattcagcggcgatgagactgctccattttttggcttcctcggggccgcagcagcgctcgtgttttcctgcatgggagctgcgtatgggactgccaagagtggcgtgggcgtggcctccatgggtgtgatgaggccggagcttgtgatgaaatcgattgttccagtcgtcatggctggagtgctgggtatttatggtttgattattgctgtgattatcagcacaggaattaaccccaaggcaaagtcctattatttgtttgatggctatgcgcatctttcatctggactggcttgtgggctttcgggtcttgccgcgggtatggctattggcattgtcggtgatgccggtgtcagagcgaatgcacaacagccaaagctctttgttggtatgatcctcatattgatctttgcggaagcacttgcactctatggtcttatagttggtattatactttcttctcgagctggccagtcacgagcagattaaagaagttgcagttgggattctgtttactaggttcatttatcagattttgtgcaagactgctgtcttctgcagtggaaatgtgattgttctcaataggagataatattttgctcaagattcattattattctcttagtttgcaatttgagacttaagaattgaatggtcaattagaaggctcattacatgtggaaattgaacagggtaacaagtgtgcattattgttggtctcatttggcactctatgaagtcaaatgtatgattctaatatttgacctacttcaattgccgcattttgctatagatccctcctcctttctggtttctgctgttgatatgttcaaattcaaacagaaaattattaatgaagaagactgattaaaactgtgc

SEQ ID NO: 1520 - DNA, 802 bp, Raphanus sativus
  misc_feature (350)..(350): n is a, c, g, or t
  misc_feature (510)..(510): n is a, c, g, or t
ctctctctctctctctcgctcgcaaatcatcaaacagtttcgtctctttgcgatcagatctcataggagagctaatggcttcaggtttcagcggcgatgaaactgctcctttcttcggattcctcggcgctgccgccgctctcgttttctcctgtatgggagcagcgtacgggacagcaaagagcggggtcggtgtggcgtcgatgggtgtgatgagaccagagcttgtgatgaaatcgattgttcccgtggttatggctggtgttttaggtatctatggtctgatcattgctgtcatcatcagtaccggaatcaaccccaaggccaagtcttactatctattcgatggntatgctcatctatcttccggtctcgcttgtggtctcgccggtctttcagctggtatggctattggtatcgtcggtgacgctggtgttagagcgaatgcacaacaaccgaagctgtttgtgggaatgattttgattctcatttttgctgaagcacttgcgntgtacggtctcattgttggtatcatcctctcttctcgtgctggtcagtctagagccgagtgaaaaaatcagaaagccttttggtttaagtcctctttgtaatgtttatgatatgttttcttttgtggcattgtgagttcttttggtgtttctcatgaaaaacaacaagtaacatgagtgataatcatttgacttttggttctgaatatttttttttcttttgcacactatatggaatacatcaataatttaataaaacaatatgatgattctataaattttgtcagttgacg

SEQ ID NO: 1521 - DNA, 825 bp, Raphanus sativus
ataagtttggttgctctctctctctctctctcactcaaatcgtcaaacagtttgtttcttcgcgatcagatctcatcggaagaagagacacacagttcacgacgaggcgatggcttcaggtttcagcggcgatgaaactgctccgttcttcggattcctcggcgctgccgccgctctcgtcttctcctgtatgggagcagcgtacgggacagcgaagagcggggttggtgtagcgtcgatgggtgtgatgagaccagagcttgtaatgaaatcgattgttcctgtcgttatggctggtgtgttaggtatctatggtctcatcattgctgtcatcatcagtactggtatcaaccctaaggccaagtcttactatctcttcgatggctatgctcatctctcttccggtctcgcttgtggtctcgctggtctctctgccggtatggctattggcatcgtcggagatgccggtgttagagcgaatgcacaacaaccaaagctgtttgttgggatgatattgattctcatctttgctgaagcacttgcgctgtacggtctcattgttggtatcatcctctcttctcgtgctggtcagtctagagccgagtgatatcggaaagtcttttcatatgttctaaattcttgtcatgttttttttatatatttcacttccttttgtggcattgtgagttttttttttgcttttctcatgataaacaaccaaacaatcatttgaatttggttctaaatatttattttaaaatttgaacactgtaagaaatacgccaataagtataatataataaaatgattcaatggttttactca

SEQ ID NO: 1522 - DNA, 756 bp, Raphanus sativus
  misc_feature (387)..(387): n is a, c, g, or t
  misc_feature (390)..(390): n is a, c, g, or t
  misc_feature (393)..(393): n is a, c, g, or t
  misc_feature (483)..(483): n is a, c, g, or t
ctctcgttcgttcgcaaatcatcaaacagtttcgtctctttgcgatcagatctcattggagagctaatggcttcaggtttcagcggagatgaaactgctcctttcttcggattcctcggcgctgccgccgctctcgtcttctcctgtatgggagcagcgtacgggacagcgaagagcggggtcggtgtggcgtcgatgggtgtgatgagaccagagcttgtgatgaaatcgattgttcccgtggttatggctggtgtgttaggtatttacggtctgatcattgctgtcatcatcagtaccggaatcaaccctaaggccaagtcttactatctattcgatggctatgctcatctatcttccggtctcgcttgtggtctcgccggtctntcngcnggtatggctattggtatcgtcggcgacgctggtgttagagcgaatgcacaacaaccgaagctgtttgtgggaatgattttgattctcatntttgctgaagcacttgcgttgtacggtctcattgttggtatcatcctctcttctcgtgctggtcagtctagagccgagtgaaaaatcagaaagccttttggtttaagtcctctttgtaatgtttatgatatgttttcttttgtggcattgtgagtttttttggtgtttctcatgaaaaacaacaagcaacatgagtgataatatcatttgacttttggttctgaatattttttttcttttgcacactatatggaatgcatcaataatttaata

SEQ ID NO: 1523 - DNA, 761 bp, Rosa hybrid cultivar
gaaaaatccctcagaattcagatcttgtccgtaacatcgagaagaatggcttcttcaacgttcagcggcgatgaaacggcaccgttcttcggctttctcggcgccgccgcggccctcgtcttctcctgtatgggagctgcgtacggaacggcgaagagtggagtaggagtggcgtcgatgggagtgatgcggccggagctggtcatgaagtcgatcgttccggtggtcatggccggagtgttgggaatttacggccttattatcgccgtcatcattagtaccggtatcaaccctaaggccaaatcctattacctgtttgatggttatgctcatctctcgtctggtctggcctgtggccttgctgggctctcagctggtatggctattggcattgttggtgatgctggtgttagagctaatgcccaacagccaaagctttttgttgggatgatcctcattctcatttttgctgaagcccttgctctgtatggtctcattgttggcatcattctttcctcccgagcaggtcagtcaagagccgactagaaagctgtgctgggtggatttctcgattgctgctattaaacaagctctatgttttggtataagttctagtttcgttttggaagtgtactgcagattcttgtttgttgtgatcgatgtctgccagatggattggtagtatttatgtgccaaaggtagaaaatagaattagcaattagttttacttctgaataaatttgcatcctttttcaattttc

SEQ ID NO: 1524 - DNA, 931 bp, Rosa hybrid cultivar
aatatcaaccattctcctcctccgatccaaactccctattctctcacctaaaaaaccagagagagagagagagagagagagcttcttcttcatcgaaaccccagattcgattcacacacccaatcaatcagaccagagatggcttcttctactttcagcggcgacgagaccgctcccttcttcggcttcctcggcgccgccgcagctctcgtcttctcctgcatgggcgcggcgtacgggaccgccaagagtggcgtgggcgtggcctccatgggagtgatgcggccggagctggtcatgaaatcgatcgttccggtggtcatggctggagtgcttgggatctacgggctcatcatagctgtgattatcagcaccgggataaacccaaaggccaaatcttattacctgtttgatggatatgcacacttgtcctctggccttgcttgtggcctcgctggactttccgccggaatggccatcgggatcgtcggtgatgccggtgtccgggctaatgcacagcagccaaagctctttgttggcatgatccttatcctcatctttgctgaagctcttgctttgtacggtctcattgttgggattatcctctcatcccgagcagggcaatctcgcgcagactgaggaagtcaacttggttattgctcctctaggttctttgaagagcattcacattcactgcctcgacaagttgtctctataaagttcgattaagtttagttagagttattatatcggtatttgagcggccctatgcttgtagttatgaagaaacatttgttctgaatgtcatttttttctttctcttgctccaaaataaggacagattagtcaatgagaacttcaccctagtgatgggttttggtggttttgttatataatagctgtaagtagctaattgaatgaggtaagaaga

SEQ ID NO: 1525 - DNA, 607 bp, Salvia sclarea
ctactagaccttggctgtcactcaacacttggacagagatcgacagatctaaactcccaaccctagtgaaagagttctcccagattcttcgatttcaggagcaaatccgatctgcaattatgtcgtcgacattcagtggcgatgaaactgctcccttctttggattcctcggcgccgctgctgcgctcgtcttctcatgtatgggtgcggcctatggtacagctaagagtggtgttggtgtggcatcaatgggagttatgaggccggagctggttatgaaatcgattgtgccagtggtcatggctggtgtgttgggtatctacggtttgattattgctgtcattatcagcactggtattaaccctaaagccaagtcctactacctttttgatggttatgcccatctctcttctggtcttgcctgtggccttgctgggcttgctgctggaatggccatcgggattgttggagatgctggtgttagggctaatgcacaacaaccaaagttgtttgttggaatgatccttattctcattttcgctgaagctttggctctctatggtcttatcgtcggaattattttgtcttcacgagctggccagtctag

SEQ ID NO: 1526 - DNA, 893 bp, Glycine max
ggtgtgagtggtgatgagagacttggcggggtccactcaagaaacttccctttggtttggtccaaaaaaacgaagcctgagacggaagaggcaaagcaaataagcagtaatagatctgactctgattttcagaaagcaaaatgcctggtttcagcggcgatgaaactgctccgttcttcggcttcctgggcgcggcggccgccctagtattctcctgtatgggagcggcgtacggcacggccaagagcggggtcggcgttgcgtcgatgggcgtcatgagaccggagctggtcatgaaatccatcgtcccggttgttatggccggagtgttgggaatctacggcttgatcatcgccgtcatcatcagcaccggtattaaccctaaggccaaatcctattacctcttcgacggctacgctcacctctcctccggcctcgcttgcggcctcgctggcctctccgctggcatggccattggcattgttggcgatgccggtgttagagcaaatgcccaacagccaaagctttttgttgggatgattctcattctcatctttgctgaggcgttggcattgtatggactcattgttggcatcatcctctcttcacgtgctggccaatccagagctgattagtataaaatttcctgtttgctgcgcacagaaccatgaattggatggtgaatgtcgccggggactaggtcatgttaagagtgtagctttgtgatgctctgcatccgtcttatgataaaattgaggttatcctgaaataaagtgtctcaaacgatttattttccatttattgtatttaatttgagtccaaactagattagagatctctgtaataaaacatgtttgtgtttatttcaataacatttagtattgtgtcgtata

SEQ ID NO: 1527 - DNA, 1021 bp, Glycine max
aattttgatgacatgttatgtggtgtgagtggtgatgagagacttggcggggtccactcaagaaacttccctttggtttggtccaaaaaaacgaagcctgagacggaagaggcaaagcaaataagcagtaatagatctgactctgattttcagaaagcaaaatgcctggtttcagcggcgatgaaactgctccgttcttcggcttcctgggcgcggcggccgccctagtattctcctgtatgggagcggcgtacggcacggccaagagcggggtcggcgttgcgtcgatgggcgtcatgagaccggagctggtcatgaaatccatcgtcccggttgttatggccggagtgttgggaatctacggcttgatcatcgccgtcatcatcagcaccggtattaaccctaaggccaaatcctattacctcttcgacggctacgctcacctctcctccggcctcgcttgcggcctcgctggcctctccgctggcatggccattggcattgttggcgatgccggtgttagagcaaatgcccaacagccaaagctttttgttgggatgattctcattctcatctttgctgaggcgttggcattgtatggactcattgttggcatcatcctctcttcacgtgctggccaatccagagctgattagtataaaatttcctgtttgctgcgcacagaaccatgaattggatggtgaatgtcgccggggactaggtcatgttaagagtgtagctttgtgatgctctgcatccgtcttatgataaaattgaggttatcctgaaataaagtgtctcaaacgatttattttccatttattgtatttaatttgagtccaaactagattagagatctctgtaataaaacatgtttgtgtttatttcaataacatttagtattgtgtcgtataccattcaacacttcagctctctccccacaacctaaagaccccttttttatggttttatcgagatgtaaaatgttaatccgatttcttctataacgattttcaacatt

SEQ ID NO: 1528 - DNA, 913 bp, Glycine max
ccgaaatcgaaattcattcccacatttcactttgatctgatctcatttccattcattcattcgttgttcttctttccaccaacaagaaagaaaacagagagaaactttcatttcatagattttcatcatctcagcaaaggaatcaatcaatcaagccatggcaggcttcagtggcgacgaaaccgctcctttcttcggcttcctcggtgccgctgcggccctcgtcttctcctgtatgggagcggcgtatggaacggcgaagagtggggtgggggtggcgtcgatgggagtgatgaggccggagctggtgatgaagtcgatcgtgccggtggttatggcgggagtgttggggatttacgggttgattattgcggttattatcagcactgggataaacccaaaggctaagtcttactatctctttgatggatatgctcatttgtcctctggccttgcctgtggcctagctggcctctctgctggaatggccattgggattgttggtgatgctggtgtcagagctaatgcccagcaaccgaagctgtttgttggcatgattcttatcttgattttcgctgaagctcttgctctgtatggcctcattgtgggtatcatcctctcatctcgggcaggccaatctcgtgccgattaaaagcagtcaactcaatcatacttggtagtccagtaaattccaatatcaggcttgtatttgaaatgggagatacttgtctttagtatattattactattatttcatttgttttcgtacacaaaccctgtatccaaactccatcagttttatgaagtattttcctatggattacatatttggatggcttgttttaatgtttgttgtgcagaaactcttgataaaacttatacaatctaaaagttaacactattggtgacttgc

SEQ ID NO: 1529 - DNA, 1329 bp, Glycine max
ctgaaatctccccaatcctgtgcaatcctggaaggtgaagacgaagacgatggatggcagtggcgatgattgacagcacgaatggcgactgcgcgaggagaagaagaagagaaatgggcaacacgttgggacatgaagagggagaggagaactttttaaaatttgaagtgaaagataattttccggcttcacttaaaatattggtgcatctagcaaatacccaagccttcctagcaacaactgcattattgcattacaaaaagggaaaaaaactacggtagaggaaaagggtattatagtaaaatcaaagaacacgatctgatctctcacactgcaatctgtctctatctgtgaccaatccaaataataataatttttcttttttaccgaaatcgaaattcattcccacatttcactttgatctgatctcatttccattcattcattcgttgttcttctttccaccaacaagaaagaaaacagagagaaactttcatttcatagattttcatcatctcagcaaaggaatcaatcaatcaagccatggcaggcttcagtggcgacgaaaccgctcctttcttcggcttcctcggtgccgctgcggccctcgtcttctcctgtatgggagcggcgtatggaacggcgaagagtggggtgggggtggcgtcgatgggagtgatgaggccggagctggtgatgaagtcgatcgtgccggtggttatggcgggagtgttggggatttacgggttgattattgcggttattatcagcactgggataaacccaaaggctaagtcttactatctctttgatggatatgctcatttgtcctctggccttgcctgtggcctagctggcctctctgctggaatggccattgggattgttggtgatgctggtgtcagagctaatgcccagcaaccgaagctgtttgttggcatgattcttatcttgattttcgctgaagctcttgctctgtatggcctcattgtgggtatcatcctctcatctcgggcaggccaatctcgtgccgattaaaagcagtcaactcaatcatacttggtagtccagtaaattccaatatcaggcttgtatttgaaatgggagatacttgtctttagtatattattactattatttcatttgttttcgtacacaaaccctgtatccaaactccatcagttttatgaagtattttcctatggattacatatttggatggcttgttttaatgtttgttgtgcagaaactcttgataaaacttatacaatctaaaagttaacactattggtgacttgcgtatctttgttgcaatatgaacttttaact

SEQ ID NO: 1530 - DNA, 886 bp, Glycine max
tctgatcccaattccattcattcattcattcgttcttcttctttcaccaacaacaaagaaaacagagaaactttcatttcatatattttcatcatcgcagcaaaggaatcaatcaatcaaaaaccatggcaggcttcagtggcgacgaaaccgctcctttcttcggcttcctcggtgccgctgcggccctcgtcttctcctgtatgggagcggcgtacggaacggcaaagagtggggtgggggtggcgtcgatgggcgtgatgaggccggagctggtgatgaagtcgatcgtgccggtggttatggcgggagtgttggggatttacggtttgattattgcggttattatcagcactgggataaacccaaaggctaagtcttactatctctttgatggctatgcccacttgtcctctggcctcgcctgtggcctcgctggcctctctgctggaatggccattgggattgttggtgatgctggtgtcagggctaatgcccagcagccgaagctgtttgttggtatgattcttatcttgattttcgctgaagctcttgctctgtatggcctcattgtgggtatcatcctctcatctcgggcaggccaatctcgtgctgattaaaaggagtcaacttggtggtacttcgtagttccgtaaattttatatcaggcttgtatttgaaatgggagatacttgtcttttatatattactattatttcatttgttttcgtacacaaaccctgtatccaaactgcatcagttttatgaagcattttcctttggattacatatttggatggcttgtttgaatgtttgttatgcagaaactcttgaaattcttgataaactaatacaagctaaaagttaacactattggtgacctgca

SEQ ID NO: 1531 - DNA, 1050 bp, Glycine max
atccttcactctcacacttcaatctgtctccatctgtaccaatccaaataactaataactttttccccaaatatcaaaattcattccctcatttcactttgatctgatcccaattccattcattcattcattcgttcttcttctttcaccaacaacaaagaaaacagagaaactttcatttcatatattttcatcatcgcagcaaaggaatcaatcaatcaaaaaccatggcaggcttcagtggcgacgaaaccgctcctttcttcggcttcctcggtgccgctgcggccctcgtcttctcctgtatgggagcggcgtacggaacggcaaagagtggggtgggggtggcgtcgatgggcgtgatgaggccggagctggtgatgaagtcgatcgtgccggtggttatggcgggagtgttggggatttacggtttgattattgcggttattatcagcactgggataaacccaaaggctaagtcttactatctctttgatggctatgcccacttgtcctctggcctcgcctgtggcctcgctggcctctctgctggaatggccattgggattgttggtgatgctggtgtcagggctaatgcccagcagccgaagctgtttgttggtatgattcttatcttgattttcgctgaagctcttgctctgtatggcctcattgtgggtatcatcctctcatctcgggcaggccaatctcgtgctgattaaaaggagtcaacttggtggtacttcgtagttccgtaaattttatatcaggcttgtatttgaaatgggagatacttgtcttttatatattactattatttcatttgttttcgtacacaaaccctgtatccaaactgcatcagttttatgaagcattttcctttggattacatatttggatggcttgtttgaatgtttgttatgcagaaactcttgaaattcttgataaactaatacaagctaaaagttaacactattggtgacctgcatatctttgttgcaatatgaacttttaacttactgatacaagcacatgcattcatgaaactag

SEQ ID NO: 1532 - DNA, 927 bp, Fragaria vesca
aatcaaatatccaatcattctcctcctccgatccaacttccccattctctcaccaaaatccagaaagagagagaaacacagaccccagattccaatcacagatggcttcctcttctttcagcggcgacgagaccgctcccttcttcggcttcctcggcgccgccgcagctctcgtcttctcctgcatgggcgccgcgtacggcaccgcgaagagcggagtcggcgtggcctcgatgggagtgatgcggccggagctggtcatgaaatcgatcgttccggtggttatggctggagtgcttgggatctacgggctcatcattgctgtgattatcagcaccgggattaatcccaaggccaagtcttattacctgtttgatggatatgctcacttgtcctctggccttgcttgtggcctcgccgggctctccgccggaatggccatcgggatcgtcggtgacgccggtgtccgggccaatgcacagcagccaaagctctttgttggcatgatccttatcctcatctttgctgaagctcttgctttgtacggtctcattgtggggattattctctcatcccgagcagggcaatctcgtgcagactaaggatatcagcttggttattgatcctctcagtcctttgtagaggatgcacattcactgcctcgacaattctgttatctctataaagttcgattaagtttagttagaattattatattgttatttgagcggcactatgtttgtagttatgaagaaacatttgttctgaatgccattttcccttgcttcaaaataaggacagattagtcgatgagaactgggttttggtggttttgttatataattgatataagtagctaattgaatgatataagaggctgtttgtttctaaatacgagttacttgcttgaagcgtagtgtattcaag

SEQ ID NO: 1533 - DNA, 948 bp, Panicum virgatum
ctgccggttgccggagtccacagaaagggcgagagagagaagggcgagcgagtcagatcgagctccaggctccagcaaccagcaggggttggatcatcgtggcctgagcctgaccccgtccatcctctcctctcttccccggccggcgagatcccatggcgggctccaccttcagcggcgatgagaccgcccccttcttcggcttcctcggcgccgccgccgcgctcatcttctcctgcatgggcgccgcctacgggacggccaagagcggtgtcggggtcgcctccatgggggtcatgcgcccggagctcgtcatgaagtccatcgtccccgtcgtcatggccggagtcctcggcatctacggcctcatcatcgccgtcatcatctccaccgggatcaaccccaaggccaagccctactacctcttcgacggctacgcgcacctctcctccggactcgcctgcggcctcgccggcctcgccgccgggatggccatcggcatcgtcggagacgccggcgtcagggcgaacgcacagcagccgaagttgtttgtgggcatgatcctcatcctcatcttcgcggaagctcttgctctgtacggtctgatcgtcggtatcatcctctcctctcgcgctggccaatctcgtgccgattagagggggtcagagaaatgcacacgactcatggatgattgtattcaaagtgttccttttctcggtgaacattgtacagggtcatgttgaacctgttccaccctttgtaatattattatcattgctctgccaagacaaacctagctagcgcttgtagttcgtgctgttgtatttatttgaaataataggcagcaagccccgggtgtgatgaataaataagcaaagctggactaatttttgttcgttcaatgctgtttgatttcattatgcttgtagtgtttgcactgatctgttt

SEQ ID NO: 1534 - DNA, 936 bp, Panicum virgatum
ctgccggttgccggagtccacagaaagggcgagagagagaagggcgagcgagtcagatcgagctccaggctccagcaaccagcaggggttggatcatcgtggcctgagcctgaccccgtccatcctctcctctcttccccggccggcgagatcccatggcgggctccaccttcagcggcgatgagaccgcccccttcttcggcttcctcggcgccgccgccgcgctcatcttctcctgcatgggcgccgcctacgggacggccaagagcggcgtcggggtcgcctccatgggggtcatgcgcccggagctcgtcatgaagtccatcgtccccgtcgtcatggccggagtcctcggcatctacggcctcatcatcgccgtcatcatctccaccgggatcaaccccaaggccaagccctactacctcttcgacggctacgcgcacctctcctccggactcgcctgcggcctcgccggcctcgccgccgggatggccatcggcatcgtcggagacgccggcgtcagggcgaacgcacagcagccgaagttgtttgtgggcatgatcctcatcctcatcttcgcggaagctcttgctctgtacggtctgatcgtcggtatcatcctctcctctcgcgctggccaatctcgtgccgattagagggggtcagagaaatgcacacgactcatggatgattgtattcaaagtgttccttttctcggtgaacattgtacagggtcatgttgaacctgttccaccctttgtaatattattatcattgctctgccaagacaaacctagctagcgcttgtagttcgtgctgttgtatttatttgaaataataggcagcaagccccgggtgtgatgaataaataagcaaagctggactaatttttgttcgttcaatgctgtttgatttcattatgcttgtagtgtttta

SEQ ID NO: 1535 - DNA, 1038 bp, Panicum virgatum
acaaatgattgaaggcataggcatggagatgcccttattcaccaatctcagcccaggaactaagaggcagcccacgagccgagccgaaagaaggatcaaaatcccagcccatgagcccatgaagaaatagtattgtttttctccggagtccacagaaaaggagagagatcgtgctccagcacgcaggatcgtcgtggcctgaccctgatcccgtccatcctctctctctctctgttccccggcgagacgagatcccatggcgggctccaccttcagcggcgatgagacggcgcccttcttcggcttcctcggcgccgccgccgcgctcatcttctcatgcatgggcgccgcctacggcacggccaagagcggcgtcggggtcgcctccatgggggtcatgcgcccggagctcgtcatgaagtccatcgtccccgtcgtcatggccggagtcctcggcatctacggcctcatcatcgccgtcatcatctccaccgggatcaaccccaaggccaagccatactacctcttcgacggctacgcgcacctctcctccggactcgcctgcggcctcgccggcctcgccgccgggatggccatcggcatcgtcggagacgctggagtcagggcgaacgcacagcagccaaagttgtttgtgggcatgatcctcatcctcatcttcgcggaagctcttgctctgtacggtctcatcgtcggtatcatcctctcctctcgtgctggccaatctcgtgccgattagagggggtcagagaaatacacacgactcatggatcattgtattcaaagtgttccttttctcggtgaatattgtgcaggatcatgttgagcctgttccacaccctttgtaatattattatcattgttctgtcatgacaaacctagctagcgcttgtagttcgtgctgttgtatttatttgaaataataggcagcaagccccggatgtgatgaataaataagcaagctggaccagtttttgttcgttcaatgctgtttgatctcattatgcttgtagtgcttgc

SEQ ID NO: 1536 - DNA, 809 bp, Panicum virgatum
tcgtggcctgaccctgatcccgtccatcctctctctctctgttccccggcgagacgagatcccatggcgggctccaccttcagcggcgatgagacggcgcccttcttcggcttcctcggcgccgccgccgcgctcatcttctcatgcatgggcgccgcctacggcacggccaagagcggcgtcggggtcgcctccatgggggtcatgcgcccggagctcgtcatgaagtccatcgtccccgtcgtcatggccggagtcctcggcatctacggcctcatcatcgccgtcatcatctccaccgggatcaaccccaaggccaagccatactacctcttcgacggctacgcgcacctctcctccggactcgcctgcggcctcgccggcctcgccgccgggatggccatcggcatcgtcggagacgctggagtcagggcgaacgcacagcagccaaagttgtttgtgggcatgatcctcatcctcatcttcgcggaagctcttgctctgtacggtctcatcgtcggtatcatcctctcctctcgtgctggccaatctcgtgccgattagagggggtcagagaaatacacacgactcatggatcattgtattcaaagtgttccttttctcggtgaatattgtgcaggatcatgttgagcctgttccacaccctttgtaatattattatcattgttctgtcatgacaaacctagctagcgcttgtagttcgtgctgttgtatttatttgaaataataggcagcaagccccggatgtgatgaataaataagcaagctggaccagtttttgttcgttc

SEQ ID NO: 1537 - DNA, 1024 bp, Taxus baccata
gggctctcgctgcaacctgacggtccggtacgccagtgggataagcgggtcacggcaaatatatttcacacctacaccaataagccaagagatcgagtccagccaaagatcgtttcatcttgtaaccgcgttcgacaaggattatcgcctggaagatcaccagatccgtttaaaaatggcggacgtattcagcggagatgaaactgctcctttcttcggatttctgggagccgcagcagcccttgttttctcatgcatgggagcagcctacggtacagcgaagagtggagtaggagttgcatcaatgggcgttatgaggccagaacttgtcatgaaatctatagtaccagttgttatggctggtgtgctgggtatatatggcttgatcattgcagttatcataagcacaggaatcaaccccaaagctaaatcctattatctatttgatggatatgcccacttatcatcaggtctggcttgtggtctatctggattgtctgcaggaatggcaattggaattgtaggtgatgctggtgtcagagcaaatgcacagcaacctaagctttttgtgggtatgatactcatcctcatttttgcagaggcgcttgctctttatggtttgatcgttggtattattttatcatcaagagctggtcagtcaagagctgactgaattatatgatcctactgcaaacctatcactagggtgttcatttaaaaatgaggaccacgtgaaggattcatgatggtggctcaatatctttgtatatttttctaattgtttgaagtcattacaaacttaattatgctcatagctctagcttcttaggtgagtacaatattatttagtgtgccttgatgggcattttctgtactcattcactcatggttttggatacaattgtctcccttcatagcttcaaggctgactcctttttcaatgtttaatcagacatgcaactatgaatgttattactttccttgtcggacaatataggcaaattcctcctttgaaggtcaataa

SEQ ID NO: 1538 - DNA, 927 bp, Eutrema halophilum
taatttaagtccggtttaattattagacgccgactcacggccggcaattactaatcaatcaaatcattgttgacacaaaattgttttccttctctctttctctcgaaaatctcaactgttttcgcctctttgcgatcagatctcatcggagacgcacaatccacgacgagccatggcttcaggtttcagcggcgatgaaactgctcctttcttcgggttccttggcgctgccgccgctctcgttttctcctgtatgggagcagcgtacgggacagcgaagagcggggttggtgtggcgtcgatgggtgtgatgagaccagagcttgtgatgaaatcgattgttccggtggtcatggctggtgttttaggtatttatggtctgatcattgctgttatcatcagtactggaatcaacccaaaggccaagtcttactatctcttcgatggctatgctcatctctcttctggtctggcttgtggtctcgccggtctctccgccggtatggctattggaatcgtcggcgatgccggtgttagagcgaatgcgcaacaaccaaagctgtttgtgggaatgattctgattctcatcttcgctgaagctcttgcgctttacggacttattgttggtatcatcctctcttctcgagctggccagtctagagccgagtgaaatcattcaagtcttttctcatatgggcgcacgtccttgtaatgtttttgatatattttcagttttttcttttgtggtattgtgagttttcgattttctcatgaaaacaatgaacatgggtgaaaatcattcgactctggttctaaaccatatatattttttttctgtttatttgcacacttatggaacacatcagtaaagcaataaaatgtatgatgatccaatgattttgaagtctttgtagctcctaaaagtaa

SEQ ID NO: 1539 - DNA, 896 bp, Eutrema parvulum
taatttaagtccggtttaattcttcacgtcgactcgcggccggcaattactaatcaatcaaatcattgtttcagattagtttgatttccttctctctctctctctctcgcatatcttcaaatagtttttgtctctttgcgatcagatctcatcggagacacacaattcacgacgagcgatggcttcaggtttcagcggcgatgaaactgctcctttcttcggattccttggcgctgccgccgctctcgttttctcctgtatgggagcagcgtacggtacagcgaagagcggggttggtgtggcgtcgatgggtgtgatgagaccagagcttgtgatgaaatcgattgttccggtggttatggctggtgttttgggtatttatggtctgatcattgctgtcatcatcagtactggaatcaacccaaaggccaagtcttactatctcttcgatggctatgctcatctctcctccggtctcgcctgtggtcttgccggtctctccgccggtatggctattggaatcgtcggcgatgccggtgttagagcgaatgcccaacaaccaaaactgtttgtgggaatgattctgattctcatctttgctgaagcacttgcgctgtacggtctcattgttggtatcatcctctcttctcgtgctggtcaatctagagccgagtaaaatcagaaagtcttttcatgtggtgttaaatctttgtaatgttttgatatattttcactttcagttttcttttgtggcattgtgagtttttgagtgagtttctcatgaaaacaagcaacatgggtgaaaatcattcgactttggttctaaatatttgttcatttgcacactatatggaatacatcaataagcaataaaatatgatgattcaattattttg

SEQ ID NO: 1540 - DNA, 760 bp, Eutrema parvulum
aattattaatcgattggaacaaatctctgccaacagatctctgccaagaaccatggcttcaggtttcagcggcgatgaaactgctcctttcttcggattccttggcgccgccgccgcgcttgttttctcctgtatgggagcagcgtacgggacggcaaagagcggcgtcggagttgcgtcgatgggtgtgatgaggcctgaacttgttatgaaatcgattgtgcctgtggttatggctggtgttttaggtatctatggcctgatcatcgccgtcataatcagcaccgggattaaccccaaggccaagtcttactacctatttgatggctatgcccatctctcttccggtctagcttgtggtctcgccggtctctccgctggtatggctatcggaatcgtcggcgatgccggtgttagagcgaatgcccaacaaccaaagctgtttgttggaatgatcttgattcttatctttgcggaagcgcttgcattgtatggtctcattgtcggtatcatcctctcatctcgagctggtcagtctagagccgagtgaaagaaaacgtatcaagcagggatttattattatcattatctctcatatgtgaaatgccatgtaatgtttggcttctcctttctgttgctttttgtgcgtttgagttcagttttctcattataaacaagtaacttgggcgatatcttttgacttggttatcaaaagcatgcttttttcatttgcatcagaaaatctctcagttaagcagta

SEQ ID NO: 1541 - DNA, 938 bp, Nicotiana tabacum
  misc_feature (871)..(871): n is a, c, g, or t
  misc_feature (875)..(875): n is a, c, g, or t
gccggggagagcataaaatcagatccatacacaaatactcgataaaactctcctcgtatctaaatctaatcaatttctcagatccaaaatccgatcggaacaatgtcgtcgactttcagcggcgatgaaactgctcctttcttcggctttctcggcgccgctgcggctctcgtcttctcctgcatgggagcagcgtacggaacagcaaagagcggtgtaggagtggcgtctatgggagtgatgagaccggagctggtgatgaaatccattgttccggtggttatggctggtgtgttgggtatttatggtttgattattgctgttattatcagtactggtattaatcccaaaacgaagtcgtattacctgtttgatggatatgctcatctctcgtctggtcttgcttgtggtcttgctggactttctgctggaatggctattggtattgttggtgatgccggtgttagggctaatgcacaacagccaaagctttttgttgggatgatcctcattctcatttttgctgaagctttggctctttatgggcttattgttggaattatattgtcttcacgagctgggcagtccagagcagagtgaacttgtcttattaatgctattcttactatgatgtatgtgagactcggtaaactttggcaaaggttgatccttgctaaagtcgaaaagctatatctatgcctacgcttgttattcatgatggcacggttgctactggtgctgctatgtgctgtttgtagaagtaggagtgagtatttattttaataataacttgagaagctgtcctatttgatcactatttgttgtatcttgcaattttctatttttgaacagctttgtgcatgtaatgatntttnttctataatttgttatgaccccgtgcaacatgtatgacattcccgcttaaatatttctctgac

SEQ ID NO: 1542 - DNA, 1011 bp, Nicotiana tabacum
  misc_feature (88)..(88): n is a, c, g, or t
  misc_feature (93)..(96): n is a, c, g, or t
  misc_feature (98)..(99): n is a, c, g, or t
  misc_feature (101)..(101): n is a, c, g, or t
gggggggaaaaaaaatcccaaacccaactgcatcagaacacggaagccacgtgtatgaagcttgactttatttatcaaccagatttcnattannnncnngnagagcataaaatcagatccatacacaaatactcgataaaactctccttgtatctaaatctaatcaacttgtcagatccaaaatccgatcggaacaatgtcgtcgacattcagcggcgatgaaactgctcctttcttcggcttcctcggcgccgctgcggctctggtcttctcctgcatgggagcagcgtacggaacagcaaagagcggtgtaggagtggcgtctatgggagtgatgagaccagagctggtgatgaaatccattgttccggtggttatggctggtgtgttgggtatttatggtttgattattgctgttattatcagtactggtattaatcccaaaacaaagtcgtattacctgtttgatggatatgctcatctctcctctggtctcgcttgtggtcttgctggactttctgctggaatggctattggtattgttggtgatgccggtgttagggctaatgcacaacagccaaagctttttgttgggatgatcctcattctcatttttgctgaagctttggctctttatgggcttattgttggaattatattgtcttcacgagctgggcagtccagagcagagtgaagttggcttattaatgctattcttactatgatgtatgtgagactcagtaaacgccggcaaaacttgatccttgctaaagtcgaaaagctatctatgtctatgtttgttattcatgatggcactgctatgtgctgtttgtagaagtaggattgagtatttatttaataataacttaagaagtttttgtatttgatcactatttgttgtatcttgcagttttctatttttgaacggcgttgtgcatgtaatgattttttgctataatttgttatggccccgtgcaacatgtatgacattccgcttaaatatttctctga

SEQ ID NO: 1543 - DNA, 902 bp, Tripterygium wilfordii
cagagagagatcaaaaaaatctctggaagattaaacaattcacgaagacactactaccggatctaaacgacaccgctccagatctacttgatcgaccatggcctcgactttcagcggtgatgaaactgcacctttcttcggcttccttggggcggcggcggccctcgttttctcctgtatgggagccgcatatggaacagctaagagtggtgttggtgttgcctcaatgggagtgatgagacccgagctggtgatgaagtcaattgttcctgttgttatggctggtgtcttgggtatctatggcttaattattgctgttattatcagtaccggaattaaccccaaggccaagtcatactacctttttgatggatatgcacatctctcatctggtcttgcttgtgggcttgctgggctctctgctggaatggcaattggaattgttggtgatgcaggtgtcagagctaatgcccagcagccaaaactttttgttggaatgatccttatcctcatctttgctgaggcgttggccctttacgggcttattgttggaatcatcttgtcctctagagctggccaatccagggcagaataaaagggaactgtggcaccttgtattctttaattgcttatcccgtgttactcgcaggaagatttccttttattctcaggttggctgatgtttgacagcccttgcaggggcctcagaattttattgttcaaccgtttgtcaagcatcacgatggttgtctgcgctattagtacaagtatttagtttctcggcacaataaaaagttttgaagctgttcatgtatggttttccctatcaatgtattttgcagacatttcaaactgtcataggtacttaaatttctggaaccagcatgtctggtccttattat

SEQ ID NO: 1544 - DNA, 975 bp, Tripterygium wilfordii
cggatagagattatcagagagatcaaagaactctctggaacaaccaaaattcacgaagacacttactatcagatccaaacgacacagctccagatctacttgatcgacaatggcctcgactttcagcggcgacgaaactgcacccttcttcggcttccttggagcggctgcggccctcgttttctcctgtatgggagccgcatacggaacagctaagagtggtgttggtgttgcctcaatgggagtgatgagaccagagctggtgatgaagtcaattgttcctgttgttatggctggtgtcttgggtatctatggcttaattattgctgttattatcagtaccggaattaaccccaaggccaagtcatactatctttttgatggatatgcacatctctcatctggtcttgcttgtgggcttgctgggctctctgctggaatggcaattggaattgttggtgatgcaggtgtcagagctaatgcccagcagccaaaactttttgttggaatgatcctcatcctcatctttgctgaggcattggccctctatgggcttattgttggaatcatcttgtcctctagagctggccaatccagggcagaataaaagggaactgtggcaccttgtattctttaattgcttttccgtgttactccaggaagatttttatttattctctctcaggttggctgatgtttgacagcccttgccggggtcttagaatttaactgtgtaactggctttgtcggggcattacgatggttgtctgtgctattagtagaattattgagtttatccgcgtaataaaaagttgtgaatcagttattgagtttatccgtgtaataaaaagttgtgaatctgtccttgtttggtcttctccatcaatgtatttttcagaacttaaaaaagttcaaacgatgataggtatttaaatttctggaaccagcatttctggtcattattaaaaaaaaaaa

SEQ ID NO: 1545 - DNA, 1031 bp, Tripterygium wilfordii
ataatcagaatttctctgcgcggataagcggaagatcgaaatcgaacttgaaataccaaatcgtttaccttctttgatccgatctcttgctctgcacttcgtcagtagtgaaaatgtcttcgactttcagcggtgatgaaagtgcccccttcttcggattcctcggcgctgctgctgccctcgttttctcatgcatgggagcagcttatggaaccgcgaagagcggagttggtgtagcatcgatgggtgtgatgaggccagagctggtgatgaaatcgattgtgcccgtggttatggcgggagttttaggtatttatggtttgattattgcggtgattattagtaccggtatcaaccctaaggccaagtcttattaccttttcgatggttatgcacatctctcctctggtcttgcttgtggtcttgccgggctgtctgccggtatggctattgggattgttggcgatgccggtgttagagctaatgcacaacagcctaagctctttgtggggatgatcctgattctcatttttgccgaagctctggctctctatggattgattgttggcatcattctctcttctcgtgctggtcaatcaagagccgagtaaaaaagatggcctttggcttggtgtttgttcttttattgtgatccatgaagaactatttctatatttgctcaggacttgagcattggtgtatcctggcaagtgttttccgtttcaaattattttgtacttgtgtaattgtttacccgctggacagggtattggctataactggaggtagaatatagcgatagaaattagtatttccctgcaataaaattagcttgtcatccggtactgtaacctgtggatcgattgaagctcttgtagaataattgagtactatttaggccattttaggccaagaaaacgttttggttgtgtgagaggaactacatctttgtttatactggtcggttggttgggttatatgccacaataagtaaacaatttcggagaagagtccggtatgcattatataaa

SEQ ID NO: 1546 - DNA, 996 bp, Vinca minor
acgatcacttatagggagcactgaaccgtgaatgattagcacatctatcttcttccacagaacgcagagatccaatttcacaacaatgccttcaaccttcagtggcgatgaaacggctccgttcttcggcttcctcggcgccgctgctgctctcgtcttctcatgtatgggagcggcgtatggaacggcaaagagcggcgtaggagtggcgtccatgggagtaatgaggccggaacttgtgatgaagtctattgttccggtggttatggctggtgttttgggtatttacggtcttattattgctgttattatcagtaccggaattaaccccaagactaaggcttattacctctttgatggctacgcacatctctcctccggtttagcttgtggtctcgctgggctttctgctggtatggccattggtatcgttggtgacgccggtgtcagggccaacgctcagcagccaaagctttttgttgggatgatccttattcttatttttgccgaggctttggccttatatggccttatcgtgggtattattttgtcttcacgagctggccagtcaagagcagactaagaaagagaaaaaatgctgatgatgttatattgtgttgccaccagtggtactgtatcactttggttgaaggaattgaaatttggtcctactatttgtttagcatggctctctgggttctgcctcggtgtgcacttggagagcaattgcttagccatatttaattttgatcgcatttattcctgtttgtagaagacgaggtctttttctgcacaataaagccttctatagagctaattttctcttagtttaagctgtttctactttgaaattatattgagcgactatattgtagtcattgttactagttggtgcatttgtggcataagttggttttgttgacattctattccagaaaaccagttgtgactaaatatatatgtattaattcaatgcacttctccctttgatctgct

SEQ ID NO: 1547 - DNA, 954 bp, Juglans hindsii x Juglans regia
  misc_feature (66)..(66): n is a, c, g, or t
  misc_feature (68)..(68): n is a, c, g, or t
  misc_feature (298)..(298): n is a, c, g, or t
  misc_feature (655)..(655): n is a, c, g, or t
  misc_feature (687)..(687): n is a, c, g, or t
  misc_feature (712)..(712): n is a, c, g, or t
ggaggagagaccgaagctccaactctctgaaactaaccacgagagtttcagatccccgaacgacgncnttgcagatccacgatcgagaatgtctaatttcagcggcgatgaaacggcaccgttcttcggcttcctcggcgcagcagcggcccttgttttctcctgtatgggagctgcctatgggacagcaaagagtggcgttggtgtggcttctatgggtgtaatgaggcctgaactggtgatgaagtccattgttccagttgttatggctggagttttgggtatctatggccttatnattgctgttatcatcagtactgggattaacccaaaggccaagtcatattacctgtttgatggttatgcacacctctcttctgggcttgcctgtggtcttgctgggctctctgctggtatggcaattggtattgttggcgatgctggtgttagagctaatgcacagcagccaaaactttttgttggaatgattctcattctcatcttcgctgaagcacttgccctatatggtcttattgttggcattatcttgtcttcacgagctggacaatccagagcagaataagaatgctgccatgttgccgcagattcttgttactacttattagttttattctgaggggggatgtgaattgtnagagaggttagtaattgccaggtagcacctgngcagctctggaagaatgaattattngaagtaggtgctctgcttctgcttaaagtttggtggtactgtgcttgtagaagtaggattgagtttctgtggctaataaaagcttgcgaagctgtactctcgtttggtttcatctattgttgtatttttccataagaacttagaactgttatagaatttatggtcatggactggtgcgtgcatgtatggttttgttatccctatcaaatgttggtacatccgagtcaatatcccacttttac

SEQ ID NO: 1548 - DNA, 1079 bp, Zostera marina
gggggagaaggcaggagagagagagagagagagagagagagagccatcgatcttaccctaacgatcagaggcttctaggaagcggatcccaaattttcaaatccagcgtcctcagatcgcaatagccgcaagcacaagtttctcgtagatcctcacgatcttcgtacagatccgattaatcatgtctacaaccttcagcggcgatgaaacagctcccttcttcggcttcctcggagccgcatcggctctcgttttctcatgcatgggggcagcatatggaacggcgaaaagtggggttggagtggcatcgatgggagtgatgagaccggagcttgtcatgaaatccattgttcctgttgttatggcgggagtgcttgggatctatggtttgatcattgcagttattattagcactgggattaatcccaaggctaagtcatactacctcttcgatggctacgctcatctttcctctggtcttgcttgtggtcttgccggtctttctgccggaatggccatcggaatcgtcggagatgcgggagtcagggctaatgcacagcagccaaaactctttgttggtatgattcttattctcatttttgctgaagctcttgcactttatggtcttattgttggcatcatcctatcatctcgtgccggccaatcccgagcagactaagcagcaaagaaaaacatgcattcaagaagaaacttcatcactcttcaatggttcaaatctttatttccatattcaattagcgagcatgtagtaataataatttccattgaagtgttttttccctctctccgtgtggcttattacgccttatttgacacaacatcaaaacttgtttaaaatgtggtgtggtgtggtgcagtgttgtatcttcttccttcattcccttcttttgttagggttttaaaaccctatattttgatgagtatgggttaccgttggtttattttcctttcataataaatttcatgcgatgcaatacaaatcttattttatataaaatatccttttaagatgaaatatttgttataaattatattgtcaccccggtgatttttagtac

SEQ ID NO: 1549 - DNA, 894 bp, Nicotiana benthamiana
aaggacacacaagtaaatatctctcaccgatcagaaaaattgtcatcaaaattccgatcggtcactggcgaaatctctgataaactgaaaaaaatgtcatcaactttcagcggcgatgaaacggcgcccttcttcggtttcctcggagcagctgcagctctcgttttctcctgtatgggagctgcttatggaacggcgaagagtggggtgggggtagcctcaatgggagtaatgaggccagagcttgtgatgaagtcaattgtgccggttgttatggccggagtgttaggtatttatggtttgattattgcggtaattatcagtacgggaattaaccctaagaccaaatcatattacctttttgatggatatgcgcatctttcttctggtttggcttgtggtctggctggcctttccgctggaatggctattggaattgttggtgatgctggtgttagagcaaatgcacaacaaccaaaactgtttgttggtatgatcctgattctcatctttgccgaggcattggctttatacggactgattgtcggcatcatcctttcttcccgtgctggtcaatctagagcagaatagaaattaatgatttccaggttcatgatggaatcattttgcatcattgtgctggcagtttggtaactgatactggtttagatgcatcttttccttttccgtcacactgtgtagatttggaagctgctttttccctgcatgcaatctagagaacgttctcttaatttttcaattgctatattttgcaataatgaggagcatcttgttggttgaatgctgatacaattgtataatttttgttggaatgcatttattacctcggtatatgaaatccaccttgattattgctataactgcttgagcagt

SEQ ID NO: 1550 - DNA, 903 bp, Fraxinus spp
ctgtaacaggaactgttaattcaacgtaaatttacaggtccattagaatttttttgcaatcccacaaaaatgtcttctatcttcaacggcgatgagactgctcccttttttcggcttcctcggcgccgcttctgccctcgtcttctcctgtatgggtgcggcgtatggaacggcgaagagtggtgtaggtgtcgcttcgatgggagtgatgaggccggagctggtgatgaagtcgatcgtgccggtggttatggctggagtgttgggtatttacgggttgattattgctgtgattatcagcactgggattaaccctaaggcaaagggttattatctattcgatggttatgcgcatctctcctcgggcctcgcttgtggccttgctggcctctcagctggaatggcaattgggattgttggcgatgctggcgtcagggctaatgcacagcagccgaagcttttcgttgggatgatcctcattctcatcttcgctgaagctttagccctttatggtctaatcgttggaattattttatcttcacgagctggccaatctagagctgactgagaattggcttttaacaagttcgactgcaacgttagatgttatgttgaaatttgatttttggcaggcttcgtaaactctttcatacgctccctatttatcaccatgaatgttatccatgtttccatcgcatccattccatgttagctgcgtggtgtttgtagaactatgagaagtgttcttttctactgaataaaagcttatatggctgtcgctgatggattaagtgaatttcgttcctcataccgtgctttatatattagatatgcagagatatcgtagcttctatgaaatgttattttattgtattaataaaagtcatcttgtaccgaaaaaac

SEQ ID NO: 1551 - DNA, 795 bp, Lippia dulcis
tatagtttcatacatcaatccgaagatcatctcagatccgatctctgcactaatccaaaccgatcgatcatgtcgtctaccttcagcggcgatgaaacggcaccgtttttcggcttcctcggcgccgccgccgctctagtcttctcctgtatgggagctgcgtacggaactgccaagagcggcgtcggggtgcgtcgatgggggtgatgaggccggagctggtgatgaagtctattgttccggtggtcatggctggtgttttggggatttacggtttgattattgctgtcatcattagcaccggtattaaccctaaggccaggtcttactacttgtttgatggctacgctcacctctcttctggactgcttgcggtctcgccggtctcgccgccggtatggccatcggaatcgttggcgatgctggtgttagagccaatgcacaacaacccaagctcttcgtcggcatgattctcatcctcatttttgctgaagccctggctctctatggtctcattgttggcatcattctctcatctcgcgctggtcagtctagagcggattagacgactaaatctcgatcccggcttatgggagttgctattctttccttaatttaagaattataaatatgttatttggccatggctactgagtctcaaattttctttcgtgcacgtgggaagtgcttggccattgaattcgagggttggcatgttaagttagtaggatgtagatgagttgatttttctgggaataaagttgttcaatactttgatgttggtgtattttggaa

SEQ ID NO: 1552 - DNA, 729 bp, Pteridium aquilinum
agttccttctccatctctctcttcctctgctcactgaagaaatccaccgatcaaagtttcccaaatcccttcaattcgttggtggaatttttttggcgaacgaaaatgtcgtccacgtcagcggcgatgaaactgcacccttcttcggcttcctcggcgctgctgctgccctcgttttctcctgtatgggagctgcgtacgggacggcgaagagcggtgttggagtggcgtcgatgggagtgatgaggccagagctggtaatgaaatcgatcgtccccgttgttatggctggagttttaggtatttatgggttgattattgcggttattataagcactgggattaacccgaaggccaaatcttactaccttttcgatggctatgctcatctttcctctggtctcgcttgtggcctcgctggtctctctgcgggcatggccatcggaatcgtcggcgatgctggcgtcagggccaacgcccaacagccaaagcttttcgtaggaatgattctaattctcatttttgccgaggctttggctctgtatggactcattgtcggtatcatcctctcttcccgagctggtcagtcccgagcagaatagagtgcgaggttctgagactaagggttgttgctagttggcatcacttggttgtctccgattcatgccacgagcatattcagtgtgaaacaatttgtcaagttgttatcttgaactcattcatgaattt

SEQ ID NO: 1553 - DNA, 681 bp, Salvia sclarea
gaagtattatattttggcataaaatagaactcattattatctctctcgctcacagacgagcagatccaaaatccaaaccccagcagaaattactcgtgatttctgacgctaaattcgatctgaaaccaagatgtcttcgaccttcagcggcgatgaaactgctcctttcttcggctttctcggcgccgccgcggcgctcgtcttctcctgtatgggtgcggcttacgggacagcgaagagtggagttggcgtggcgtcgatgggggttatgcggccggagctggtgatgaaatccattgtgcctgttgttatggctggtgtgttgggtatatatggattgattattgctgtgattatcagcaccgggattaaccctaaggccaagtcttactacctcttcgacggctatgcgcatctctcttcgggcctggcttgtggcctcgctggacttgctgctgggatggctattggcattgtcggagatgccggtgttagggctaacgcgcagcagcctatgcttttttgttggaatgatcctcattctcattttcactgaagcgttggcgctctatggtcttattgttggaattatattgtcttcgcgagcaagccagtcccgggctgactagggcagacgatagtgatttaagtttattatttttggaggaattcatggtactt

SEQ ID NO: 1554 - DNA, 827 bp, Brassica juncea
gagaacgatatatccacacctctctctccatctctctctcgccagatttcaatcatcgacctctgatctcatctcagatccaaaatcacaagcttcgacatcatgtctaccttcagcggcgatgaaacagctcctttcttcggtttcctcggcgctgcagccgcactcgtcttctcctgtatgggagctgcttatggaacggcaaagagtggtgttggtgtggcttccatgggagtcatgaggccagagttggtgatgaagtccattgtccctgtggttatggctggtgtgttgggtatctacggtttgattattgctgttatcatcagtaccgggattaaccccaaggctaagtcttactacctcttcgatggatacgctcacctctcctccggtcttgcttgtggtcttgctggtctttccgctggtatggccattgggatcgtcggtgatgccggtgtcagggcaaatgctcagcagcctaagctctttgttgggatgatccttatccttatcttcgcagaagcgcttgctctttacgggcttatcgtaggtatcatcctctcctctagagctggccagtctagagctgaatgagaatgtgacgacccacaagatttgccatcgttctgagagaatgtacttccttttcgttctgtgtgcttttttgttctttccttctttagtatttatcatcggtaaacctacagatttactggattcttggaactttgttccggaagcaaactacctattcgtcatccccttttctctttcggtggtttgctttcgggtttgtagggggttctcttatcgttcggttctgt

SEQ ID NO: 1555 - DNA, 634 bp, Brassica juncea
tctctctctcgccagatatcaatcaatcatcgactcgctcctcagatttcagatccaaatctacacaccaaagcttcaacatgtctaccttcagcggcgatgaaacagctcctttcttcggcttcctcggcgccgccgccgctctcgtcttctcctgtatgggagctgcttatggaacggcgaagagtggtgttggtgtggcttccatgggagtcatgaggcccgagctggtgatgaaatccatcgtaccagttgttatggctggtgtgttgggtatctacggtttgattattgctgttatcatcagtactggtattaaccccaaggctaagtcttactacctcttcgatggttacgctcacctctcctccggccttgcttgtggtcttgctggtctctccgctggtatggccattggtatcgtcggtgatgccggtgtcagggcaaatgctcagcagcctaagctctttgttgggatgattcttatccttattttcgcagaagcgctcgctctttacgggcttattgttggaatcatcctctcctctagagctggccagtctagagctgaatgagaatgattttgccatcgttctgaggatgagagaatgtacttccttttcgttctgtgtgc

SEQ ID NO: 1556 - DNA, 596 bp, Brassica juncea
cagatttcaatcatcgacctctgatctcatctcagatccaaaatcacaagcttcgacatcatgtctaccttcagcggcgatgaaacagctcctttcttcggcttcctcggagctgcagccgccctcgtcttctcctgtatgggagctgcttatggaacagcaaagagtggagttggtgtggcttctatgggagtgatgaggcccgagctggtcatgaagtccattgtccctgttgtcatggctggtgtgttgggtatttacggtttgattattgctgttatcatcagtaccgggattaaccccaaggccaagtcttactacctcttcgatggatacgctcacctctcctccggtcttgcttgtggtcttgctggtctctcagctggtatggccattggtattgtcggtgatgccggtgtcagggcaaatgctcagcagcctaagctctttgtcgggatgattcttatccttatcttcgcagaagcgcttgctctttacggccttattgtaggaatcatcctctcctcaagagctggccagtctagagcagaatgagaatgtaacccacaagatttgctccgaaggtacttccttta

SEQ ID NO: 1557 - DNA, 754 bp, Brassica juncea
acaaagcttcgacatgtctaccttcagcggcgatgaaacagctcctttcttcggcttcctcggcgctgcagccgcactcgtcttctcctgtatgggagctgcatatggaacagcaaagagtggagttggtgtggcttctatgggagtgatgaggccagagttggtcatgaagtccattgtccccgttgttatggctggtgtcttgggtatttacggtttgattattgctgttatcatcagtaccgggattaaccccaaggctaagtcttactacctcttcgatggttacgctcacctctcctccggtcttgcttgtggtcttgctggtctttctgctggtatggccattggtattgtcggtgatgccggtgtcagagcaaatgctcagcagcctaagctctttgttgggatgattcttatccttatcttcgcagaagcgctcgctctttacgggcttattgttggaatcatcctctcctctagagctggccagtctagagctgaatgagaatgtgaccaccaccaccacaagatttgccatcgttctgagaattgagagaatgtacttcctttttcgttctgtgtgcttttttgttctttccttctttagtatttatcatcggtaaacctacagatttactggattcttggaactttgtttcagaagcaaaaccagctatggttatttattgtttggttatgtaataaagagctcagaggagcttgataagttttttttttgtattcttgtatt

SEQ ID NO: 1558 - DNA, 666 bp, Brassica juncea
gatcgttattcaatctgagagaagaggaggaagatcagattctcctgggcgtcatcattaagatcgaggatcgtcggaaatgtcaacgttcagtggcgatgaaaccgctcctttcttcggcttccttggcgctgccgcagccctcgtcttctcctgcatgggagctgcatatggaacagccaagagtggtgttggagtggcgtctatgggtgtgatgagaccagagttggtgatgaagtctattgtccctgttgttatggctggtgttttgggtatttacggtttgattattgctgttatcatcagtaccgggattaaccccaaggctaaatcttactacctcttcgacggatatgcacatctctcttctggtctcgcttgtggacttgctggtctttctgctggaatggccattggtattgttggtgatgctggtgtcagggccaatgctcagcagccaaagcttttcgttggtatgattcttatcctcattttcgctgaagctctggctctttacggtctcatcgtcgggatcatcttgtcctcccgagctggtcagtccagagccgaatgaggaagagaatgcgcttcttcttcttggattctgcgtgattctttcttttgctttgccacctgtctcttcttcatcagagccgggatcttctt

SEQ ID NO: 1559 - DNA, 628 bp, Brassica juncea
ttcaggtttcagcggcgatgaaactgctcctttcttcggattcctcggcgccgccgccgctctcgttttctcatgtatgggagcagcgtacgggacagcgaagagcggggtcggcgtggcgtcgatgggtgtgatgagaccagagcttgtgatgaaatcgattgttcccgtggtcatggctggtgtgttaggtatctatggtctcatcattgctgtcatcatcagtactggtatcaaccctaaggccaagtcttactacctcttcgacggctatgctcatctctcttccggtcttgcctgtggtctcgccggtctctccgccggtatggctattggtatcgtcggcgacgctggtgttagagcgaatgcacaacaaccgaagctgtttgtgggaatgattttgattctcatctttgctgaagcactggcgctgtacggtctcattgttggtatcatcctctcgtctcgtgctggtcagtctagagccgagtgaactcagaaagccttttggtcaagtccttttgtaatgtttatgatatgtttcacttttggttttcttttgtggcattgtgagtttttgagtttctcatgggaacaagcaaaacatgggtgataatcatttgacttt

SEQ ID NO: 1560 - DNA, 697 bp, Brassica juncea
gaagtacgtaaataaataaataaaatcagaacgatatatctactacgtctctccctctcgccagagttcaatcagcgactcgatttcagatccgagataaaaacttcgaacatgtctacgttcagcggcgacgaaacagctcccttcttcggtttcctcggcgccgcagccgcactcgtcttctcctgtatgggagctgcttatggaaccgcaaagagtggtgttggtgtggcttccatgggagtgatgagacccgagcttgtgatgaaatccatcgtccctgttgttatggctggagtgttgggtatttacggattgattattgctgttatcatcagtaccgggattaacccaaaagctaagtcttactacctcttcgatggatacgcacatctctcctccggtcttgcttgtggtcttgctggtctttccgctggaatggccattgggattgtgggtgatgctggtgtcagggcaaatgctcagcagcctaagctctttgttgggatgattcttatccttattttcgcggaagcgcttgctctttacgggcttattgtaggaatcatcctctcctctagagctggtcagtctagagctgaatgagaaagtaatcacaagatttaccccaatggtactacgtcctttactttctgtgtgcgttctttagtatgtatcatcgaaactgaaaatttta

SEQ ID NO: 1561 - DNA, 674 bp, Brassica juncea
agaaaatccaaaataaaatatcagagaggtcgctgcgaaatccaaatctatctcccccagatttaagaagatgtctacgttcagcggcgatgagactgctcccttcttcggcttcctcggcgctgccgccgccctcgtcttctcctgtatgggagctgcttatggaactgcaaagagtggtgttggtgtggcttccatgggagtgatgagacctgaattggtgatgaaatccattgtacccgtggttatggctggtgtgttgggtatttatggactcatcatcgctgttattatcagtaccggtatcaacccaaaggctaagtcttactacctctttgatggatacgcacacctctcctctggtcttgcatgtggtcttgctggtctctctgctggaatggccattgggattgtgggtgatgctggtgtcagggcaaatgctcagcagcctaagctctttgtcgggatgattcttatccttatttttgcggaagcgcttgctctttacgggcttattgtaggtatcatcctttcctctagagctggtcagtctagagctgaatgagaaagtaatcacaagatttaccccaatggtactacttcctttacttttgtatgcgttctttagtatgtatcatcgaaactgaaaattttactggattcttggaactttg

SEQ ID NO: 1562 - DNA, 879 bp, Brassica juncea
gagagaggtcgctgcgaaatccaaatctctctctcttctccccagttttagatccgagaagatgtctacgttcagcggcgatgagactgctcccttcttcggcttcctcggcgctgccgccgccctcgtcttctcctgtatgggagctgcttacggaactgcaaagagtggtgttggtgtggcttccatgggagtgatgagacctgagttggtgatgaagtccattgtccctgtggttatggctggtgtgttgggtatctacggtttgattattgctgttatcatcagtaccgggattaaccccaaggctaagtcttactacctcttcgatggatacgctcacctctcctccggtcttgcttgtggtcttgctggtctttccgctggtatggccattgggatcgtcggtgatgccggtgtcagggcaaatgctcagcagcctaagctctttgtcgggatgatccttatccttatcttcgccgaagcgcttgctctttacgggcttatcgtaggaatcatcctctcctctagagctggccagtctagagctgaatgagaatgtgacgacccacaagatttgccatcgttctgagagaatgagagaatgtacttcctttttcgttctgtgtgcttttttgttctttccttctttagtatttatcatcggtaaacctacagatttactggattcttggaactttgttccggaagcaaacctacctattcgtcatccccttttctctttcggtggtttgctttcaggtttgtagggtgttctcttatcgttcggttctgtaataaagagctctcaggagcttggtatgtttctgtattcttgtattgtcctgaggaagtttaaatacatttatttgttttgat

SEQ ID NO: 1563 - DNA, 691 bp, Brassica juncea
agcgggaatcatcatcagccttgtccttaaacgcgtaaatttcaatctgagaggagaaagatcagattcagaggcatcatcttaagatccagaatcgtcggaaaatgtctacgttcagtggcgatgaaaccgctcctttcttcggcttcctcggcgctgccgcagccctcgtcttctcctgtatgggagctgcatatgggacagccaagagtggtgtgggagtggcatcgatgggtgtgatgaggcctgagttggtgatgaagtctattgtccctgttgttatggctggtgttttgggtatctatggtttgattattgctgttatcatcagtaccgggattaacccaaaggctaaatcttactacctcttcgacggatatgcacatctctcttctggtctcgcttgtggtcttgctggtctctctgctggaatggccattggtattgttggtgatgctggtgtcagggccaatgctcagcagccaaagcttttcgttggtatgattcttatcctcattttcgctgaagctctggctctgtacggtctcatcgtggggatcatcttgtcctcccgagctggtcagtccagagccgaatgaggaagagaatgattctttcttcttggattcggcgtgattctttcttttggtttttgccaccggtctcattcttcaacgagccgggatctttt

SEQ ID NO: 1564 - DNA, 524 bp, Brassica juncea
atgtctaccttcagcggcgatgaaacagctcctttcttcggcttcctcggcgctgcagccgcactcgtcttctcctgcatgggagctgcatatggaacagcaaagagtggagttggtgtggcttctatgggagtgatgaggccagagttggtcatgaagtccattgtccccgttgttatggctggtgtcttgggtatttacggtttgattattgctgttatcatcagtaccgggattaaccccaaggctaaatcttactacctctttgatggatatgctcatctctcttctggtcttgcttgtggacttgctggtctttctgctggaatggccattggtattgttggtgatgctggtgtcagggccaatgctcagcagccaaagcttttcgttggtatgattctaatcctcattttcgctgaagctctggctctatatggtctcatcgtggggatcatcttgtcctcccgagctggtcagtccagagccgaatgaggaagagaatgcggttcttcttcttggat

SEQ ID NO: 1565 - DNA, 828 bp, Brassica juncea
aatcgtcggaaatgtctactttcagtggcgatgaaaccgctcctttcttcggcttccttggcgctgccgcagctctcgtcttctcatgtatgggagctgcatatgggacagccaagagtggtgtgggagtggcatcgatgggtgtgatgaggcctgagttggtgatgaagtctattgtccctgttgttatggctggtgtcttgggtatctatggtttgattattgctgttatcatcagtaccggtattaacccaaaggctaagtcttactacctcttcgatggttacgctcacctctcctccggccttgcttgtggtcttgctggtctctccgctggtatggccattgggatcgtcggtgatgccggtgtcagggcaaatgctcagcagcctaagctctttgttgggatgattcttatccttattttcgcagaagcgctcgctctttacgggcttattgttggaatcatcctctcctctagagctggccagtctagagctgaatgagaatgatttgccatcgttctgaggatgagagaatgtacttccttttcgttctgtgtgcgtttttgttctttcgttcttttagtatttatcatcgggaaccaacagatttactggattcttgggactttgtttcggaagcaaactcacctattcgtcatcccctttttctctttcggtggtttgcatccgggttgtaggggttctcttattgttcggttctgtaataaaaagctttgaggagcttggtatgtttctatattcttgtgttgtcctgaggaagtttaaatacatttatttgttttgatttgaaaaaaatacagtt

SEQ ID NO: 1566 - DNA, 962 bp, Musa acuminata
atcaaagggcttttccggaaccttggcgatcactataaaccattcgtcgtcggcttccttcctcctccattgacaccaataaaacgaagtcgacgaaggaatcgagatctgaagcttagggtttcgtaggatctcttggggcttcttcgatctccggggcacgatgtctaccttcagcggcgacgaaaccgcccccttctttggcttcctcggcgccgcggccgccctcgtcttctcctgcatgggagcggcgtacgggacggcaaagagcggcgtcggggtggcctccatgggcgtgatgcggccggagctggtgatgaagtcgatcgtgcctgtggtcatggccggagtgctcgggatctacgggctgatcattgctgtgatcataagcaccgggatcaaccccaaggcgaagtcctattatctgtttgatgggtatgctcacctctcctctgggcttgcttgtggtcttgccggtttatctgctggcatggcaatcgggatagtcggtgatgctggtgtcagggccaacgcacagcagccaaagctctttgtcggcatgattctgattctcattttcgctgaagcacttgcgctatatggtctcattgtcggcatcattctctcctctcgagctggtcaatctagggcagagtaagaaacacgagccaccatattttgcgcccaatatgatcctttcatgttcgtatggaacatgcactcgatgtcttttgttgatttcgcactgcccaagtggttggtatgcttggactgagaagttttctcatactatattttctttgattcttaaatttgaagttatcagttgcttgtctgactttccggcagctgtttccatgtttaagcatctttgtggactaagatatatgcatctattagttgctcttttcagcgttggtccactaaactgcttgataattgttatggatggcccacattgg

SEQ ID NO: 1567 - DNA, 1002 bp, Musa acuminata
cacgtgtcctccgtgccaaagaaggcgaaactatgtaatgcttaatgaccaaaagacccataagaatgatcgtgctctgtctcacggtctaaattgtaattttgaccaaatcgaagggtgtattgtttcacaagcctctatcgatcgccgacccaagaaagacctcttccgatcaccgcaatgatagaagccagccattcatctctttcctctcctccgccttctccacctcgcctccttccacgaaactagggtttcccaattccgccgcaaagatgtcgacgttcagcggcgacgaaactgcccccttcttcgggttcctcggcgctgccgcggccctcgttttttcctgcatgggggcggcgtacgggacggcgaagagcggcgtcggtgtggcgtccatgggtgtgatgcgcccggagctggtgatgaagtcgatcgtgcccgtcgtcatggctggagtgcttgggatctatggtctcatcattgcggtgatcatcagtaccgggatcaaccccaaggccaagtcgtactatctctttgacgggtacgcgcacctctcgtctgggttggcttgtggccttgcaggactttcggctgggatggcgatcggcatcgtgggcgatgctggagtaagggccaacgctcagcagccaaagctcttcgtaggtatgattcttattctcatctttgcggaagctctcgcgctctatggtcttatcgttggcattattctttcctctcgggctggtcaatctcgagcggagtaagaaacacatgacgagtgtgctcgccgtagtatatttctgcaacttttttgttatcataatgtaatttattcaatgactctcctcggatgagagtctgttgtttgttaactcactcacactacatcctcaataatttgtcactgcacttttatttgtacgaatgattataaacgtgcaaccttcatataattttggtccactctgccgtctcgtttccttctgtaccgccctg

SEQ ID NO: 1568 - DNA, 959 bp, Musa acuminata
gtttctctttgtttgtcctccgattcctgacccaaaaataatagcgtttccgatcaccagaagccatcatctcattcttcttcttcatctcctcctctcgagaaactagggttcctcaaatcccccaattccccggaaacgatgtcgaccttcagcggcgacgaaaccgcccccttcttcggattcctcggagccgccgcggcccttgtcttctcctgcatgggggcggcgtacgggacggcaaagagcggcgtcggggtggcatccatgggcgtgatgcggccggagctcgtgatgaagtcgatcgtgcctgtcgtcatggctggagtgctcgggatctacggtctcattattgcggtgatcattagcaccgggatcaaccccaaggccaagtcgtactacctattcgatgggtatgctcatctctcttccgggctggcctgtggccttgcaggactttcggctgggatggcgattggcatcgtgggcgatgctggagtcagggccaatgctcagcagccaaagctctttgtgggaatgatccttattctcatctttgcggaagctcttgccctctacggtctcatcgttggcatcatcctttcctctcgggctggtcaatctcgagcagagtaagattggaccatacacttttatggaaaattactgcatatttttgtcgacctttgtgatcgtcacgtaatttattccagaacttcctacggataagagtcattacaggactcacgctatatcctcaataagttggcactgtaatcttgttgtactgcaagttgtagatgacggcatacgccacgccgtgcctccattccgtgaggactttgaagtaaatttaaatgatttacgttgcctccttatagataattcagctgatttcaagtttattattgtttttgcctgtttggttgctaatagaaatgacctcccaatttgatgga

SEQ ID NO: 1569 - DNA, 552 bp, Musa acuminata
gtgtacggaccggtagcatcgcatcgatcgatctcgtcgacggcgagatgtctaccttcagcggagacgagaccgcccccttcttcggcttcctcggcgccgcggccgcgctcgtcttctcctgcatgggagctgcgtacgggacggccaagagcggggtcggtgtggcgtcgatgggggttatgcggccggagctcgtgatgaagtcgatcgtgcccgtggtgatggctggagtgctcgggatctacggattgatcattgctgtgatcataagcaccgggatcaaccccaaggctaagtcgtattacctcttcgatgggtatgcgcatctatcgtccggcctggcttgtggcctcgcgggcttgtccgccggcatggctatcgggatcgtcggtgatgccggagtccgggccaacgctcagcagccaaagctatttgtaggcatgattctcatcctcatttttgccgaagcccttgcgctatatggccttatcgtcggcatcatcctctcctctcgtgctggccaatctcgagccgagtgagaaacaaaag

SEQ ID NO: 1570 - DNA, 940 bp, Phaseolus coccineus
aaaattgaaattgttttcttaatctttaatttgaaaaataatttatttgaaagcagagaagaaagtaaaataaagaaacgaaacagagaagaggtagcgatcaaagaacgaacaaccgcaacggaatcgctttctctccgaacaaaaacaaaatggctgccttcagcggtgacgaaaccgctcctttctttggcttcctcggagccgccgccgctctcgttttttcctgcatgggtgcggcgtacggcaccgcgaagagcggcgtgggtgtagcgtcgatgggagtgatgagaccggagctggtgatgaaatcgatcgtgccggtcgtgatggctggtgtgttggggatctacggtttgatcattgcggttatcataagtacgggcattaaccctaaggccaaatcctattacctcttcgacggttacgctcacctatcttcgggtctcgcttgtggcctcgccggcctctccgccggcatggccatcggcatcgtcggcgacgctggtgtcagagcaaatgctcagcagccaaagctttttgttggaatgattctcatcctcatttttgctgaggctttggccttgtatggtcttattgttggcatcatcctctcttcccgtgccggccaatccagggctgattgatataaaatttgctgttggatgtgatacacagccacagattttgatgggtaatgactgtacactgactcctgctttggcttgctcatgtgagtctacttatgttcgcattataaaattgaggctgtccaggaataatgtcaatcaatctcttcctaggccgtaattatttctttaattatatgctcaatccaaactagaatagagatctccataataagacagatgtatgttttgattccatttactttcactgttttttctactcttcaaaatgcctccccctaaatttattc

SEQ ID NO: 1571 - DNA, 1070 bp, Lactuca sativa
aaaataacttcatattaactaaatttccaatagttctaaaataattaaaaaaaaaattaaaacttatccagaaaattgttgcatttaataattaatcgttccgaaaaaaatttatagatccaatcgacgtgatctcaatgtaaagacaagtgttggaacgtgagaggaacaacgcataaaacgatctaacacgttgagattagagatcgaggcaaagagattcaactctgtctgcacttctctgatccaaattcgatcaatttcactcccaattccgatcaacaatgggttccgattcattcagtggtgatgaaaccgcccctttctttggatttctcggcgccgctgctgccctcgtcttctcctgtatgggggctgcgtatgggacagcgaagagtggtgtaggtgtggcatcgatgggagtgatgaggcctgagctggtgatgaagtctattgttccagttgttatggctggtgtgctcggtatctatggtttgattatcgctgtcattatcagtaccggaatcaaccctaaggccaagtcttattatctttttgatggctatgcacacctttcctctggtttggcttgtggtcttgctggtctttcagccggaatggccattggaattgttggtgatgccggtgttagagcaaatgcacagcagccaaagctttttgtggggatgattcttattctgatctttgctgaagccctggctttatatggtctgattgtgggtatcatattgtcttcacgtgctggtcaatccagagcagattaagatttcaggaatcaagaaccacacggtatgtagttattctgagaaatgaagattcatgatgaacaaacaaattctctaaaattttctgattcgtagcatttctggcgttatttgcattcttttatggtgttttttatatattgcggctttggaataagaccatggtttggttataaacatgtgtcgcttttgtactccttttattcatgttttgttcatttcttttgaaataatatatgatgaaatgaaacaattgtcgtattcgattacaagtttagtaaatat

SEQ ID NO: 1572 - DNA, 901 bp, Allium cepa
tactgtaacaaaataagcgcaatcttcacttttagatctgaccagtcataataaatcacccattttatttaagatccccaaatcaaaatccaatctgcgtcagtaatataacttgttaattcttccaaacgaactctaggtttcaaatctcaatttcaatcatggtgggatttagcggagatgaaactgcccctttcttcggatttcttggcgccgctgccgcccttgttttttcatgcatgggagcagcttacggaacagcaaagagtggtgtaggagtagcatcgatgggagttatgagacccgagcttgtaatgaaatcgattgtgcctgttgtcatggctggagttctcggaatttatggattgattattgctgttattatcagtactggaataaatcctaaggcaaagtcatactatttgtttgatgggtatgctcatctttcttctggattggcttgtggtcttgcgggattgtctgctggtatggcaatcgggattgttggtgatgctggtgttagagccaacgcacaacagccaaagctctttgttggtatgatcctgattctcatctttgctgaggcacttgctctttatggtctcatcgtcggcatcatcttatcttcccgtgctggccaatcccgtgctgactaattctctgtacaagtttcaatttgtggaatatcactgcacaagtgtgaccttgtgtctacatttttctattttcttttttggtaaatcgttgattcttactcgaatactgcttatgagtagagttactcttgagttgagagaattctgatacttgcatgtattattattgatgttgtaatggttatttaaatatttgtaatctggggtgctggcggctattttgctgcctttttcatagcagttgt

SEQ ID NO: 1573 - DNA, 794 bp, Allium cepa
atatcatctcattttcatcatcatcgtcatccaaataatcaaatctctcctccttcaatagaaaatctctaatcaaattacaaccgcacaaatattaataatggtgggttttagtggagatgaaactgctcctttctttggattccttggcgccgccgccgctctggtattttcatgcatgggagcagcatatggaacagcaaagagtggggtaggtgtagcatcaatgggagtgatgaggcctgagctcgtaatgaaatcaattgttcctgttgtcatggctggagttcttggaatttacggattgattattgctgttattatcagcactggaattaatcccaaggcaaaatcatattatttatttgatgggtatgctcatctttcttctggattggcttgtggtcttgctggtttgtctgctggaatggctattgggattgttggtgatgctggtgttagggccaatgcgcaacaaccaaagctttttgttggtatgattttgatcctcatctttgctgaagctcttgctctgtatggtctcatcgtcggcatcatcttgtcttctcgtgctggacaatcgcgtgccgattgatttcgcccaattgctttgttttctcggtgtttctctgtattattttattgcatggcttgttatacaaatagaagtcaggttcaataaaaattcaagtacttgcatcatttaaaatgttgtaatggttgatttaaaactctgtaatgtgagatactggctgatattattttgttttgtaaatgttttttaagactgatta

SEQ ID NO: 1574 - DNA, 799 bp, Allium cepa
tcaaatagataagttataaacaatctctcattcaggcatcagggttcggatttcagtcatggtgggttttagtggagacgaaacagcccctttcttcggattcctaggcgccgcggccgctctcgtcttctcttgcatgggagcagcatatggaacggccaagagtggagtaggagtggcatcaatgggagtaatgaggcctgagctcgtaatgaaatcaatagtgcctgttgttatggctggagttcttggaatttatggattgatcattgctgttattatcagtaccggaatcaatcctaaggcgaagtcgtactacttgtttgatggctatgctcatctgtcttctggattggcttgtggtctggcaggtttgtctgctggaatggcaattggaattgttggtgatgctggtgttagggcgaatgcacagcagccaaagctgtttgttggtatgatactgattctcatatttgctgaggcgcttgctctatatggcctcattgtaggcatcattctgtcttctcgtgctggccagtcacgtgctgattagttttccagttgcacctgctatgtctgagcttcttcgacctgaccatgtctttacattgttcctgctgttgaaattatttgtatttagctccaaaggcaaagacttgttcttcaattgattttcagttacttgtgttcattgaagtcgtagtgattgtacgaatctctgtaatgcgagatgtgggctgctactgcatattccgccggtaaatcaaataaataaacgcttttgtgcagccttgctatt

SEQ ID NO: 1575 - DNA, 937 bp, Capsicum annuum
acgaaaccagagccgaagacaaatacaacaaggacaaaataaaaaaagttcgtcttcgaaattccgatcgatcaccggcgaaatctttgagtcaattccgccgataaaacaatggcatcagctttcagcggcgatgaaactgcccccttcttcggtttcctcggcgccgctgcagcgctcgttttctcatgcatgggagctgcttatggaacggcgaagagcggtgtaggagtggcgtcgatgggtgtaatgaggccagagcttgtgatgaagtcaattgtgcctgttgttatggctggtgtgttaggtatttatggtttgattattgctgtcattattagtacagggattaaccctaagaccaaatcgtattacctttttgatggatatgcgcacctctcatctggtctcgcttgtggtctcgctggcctttccgctggtatggctattggaattgttggtgatgctggtgttagagcaaatgcacaacaaccgaaactctttgttggtatgatcctgattcttatttttgccgaggcgttagctttatatggactgattgtcggcatcatcctttcttcccgtgctggccaatctagagcagaatagaaaatgatgtatttccatatttatgatggaatctttttgcatcactgtgctggcagtttcataaccgatgctagttgttaggtgcatcttctcctttccttttcctttcctttttcgtcacacattgtgtgttccactggtgattgtagattttgaagctgtcttttccctgtatgcgaccaagagaacgttctctcaatttttccattactgtaagtgcaatgatgaggagcatcttgttgcttgaatgctgatacagttgtattattgttggaatgtattgatacacccgaatatatgaaatccactttgatcattgccctcgtgc

SEQ ID NO: 1576 - DNA, 1100 bp, Prunus mume
ctctaacagcaggggtaaaatcgtaataacgtgacctacctacttctttgaggctgagagcggaacacatacgctcaaaggcatctgcggagaggagagaaaaaaagaatacaatcactccagaggtcagatccgatcaagaatatcttgtccgtaaatcgagaagaatgtcttcttcaacgttcagcggcgatgaaacggcaccattctttgggttccttggcgccgccgcggccctcgtcttctcatgtatgggagcagcatacggaacagcgaagagcggagtaggtgtggcgtcgatgggagtgatgaggccggagctggtgatgaagtcgatcgtgccggtggttatggctggtgtgctgggtatctacggccttatcatcgccgtcatcatcagtacgggcatcaaccccaaggccaaatcctattacctcttcgatggctacgcccatctctcctctggtctcgcttgtggccttgctggcctctctgctggtatggctattggcattgtcggtgatgctggtgttagagccaacgcccagcagccaaagctttttgttgggatgatcctcattctcatttttgctgaagcacttgccctgtatggtctcattgttggcatcattctctcttcccgatcgggtcagtcaagggccgactagaaggtgtgctaggtggttttgttgggttgctgctatttattaagagctactttactgttttgtttgaagttgtagtttctttttgggaggtgcattacagattcttgtatggtgtgagtgatccgtcgatgtctaccgggtggattggtagtagttatgcgccaaaggtagatatagggctagcaattagttgtacttctgaataagtttgagatgtgtttcatgagtccatgcctgtattgagaaatcgaattgacattaatttgttgggaattatatataccgcctgtatcattgtgttaatttcatttcttcgtattctacctctctagatttgttgggattatgctgaatctaaagttccatatgatgtaactaacctgattagtaaaatctgaaacagaattttgaaaatgagagggaacttttaag

SEQ ID NO: 1577 - DNA, 982 bp, Prunus mume
tccagaagccacagaatttcttacattaaacaacaacagagctttatcttcttcatccaaaccccagattcgcgcacacaaccaatccccgcaaccaaacacaaacagacatggcttcttctaccttcagcggcgacgaaaccgctcctttcttcggcttcctcggagccgccgcagctctcgtcttctcctgcatgggtgcggcttacggcacagcgaagagtggggtgggtgtggcctccatgggagtgatgcggcctgagctggtgatgaaatcgatcgtgccggtggttatggctggagtgcttgggatctatggcctcatcatagctgttattattagcaccgggattaacccaaaggccaaatcttattacctctttgatgggtacgcgcacttgtcctctggccttgcttgtggtctcgccggactctccgccggaatggccattgggatcgtcggtgacgccggtgtccgggctaatgcacagcagccaaagctcttcgttggtatgattcttatccttatcttcgctgaagctcttgccttgtatggcctcattgtggggatcatcctctcatcccgatcagggcaatctcgcgcagattaaggaagtcaagtttgttgctcctctagattatttgaagaggatattattattatgcctttacaatggtgttgtctctataaagcttggttaattttagttagagttatattatttgagctgcacgatgcctgtagttatgaagaaacaattgttttgaatgtcaattttctcatgctccaaaataaggacggattagtcaatgaaaacttcaccttgttgaagaggattggtgtttttaagatttattgtgttgtgagtggctaattgaggtgagaagctgtgcctgtgtgtttctaaacgttagttatttgcgtaaggatctgagtagcaatgctctgatgaagttgaatgctgttttgtaagttaagcaa

SEQ ID NO: 1578 - DNA, 1189 bp, Prunus mume
tgaagcttcagagaaagaggcaccacacgctgtcgtgactcgtaagcgacaaaacgctcgtgtgaatccaaatcaatccgtctctaatctccgcgatcaaaatttcccaaatctgagagaggctgaagcaaatcgctaatcggaaaccaaaagcaaagaaaatggcgtcatccacgttcagcggcgacgaaacggctccattcttcggcttcctcggcgcggcggccgccctagttttctcctgtatgggagcggcgtacgggacggcgaagagcggcgtgggcgtggcgtcgatgggggtaatgaggccggagctagtcatgaaatcgattgttccggtggttatggcgggagtgttgggtatctatggtttgatcattgctgtgattatcagcacggggattaacccaaaggccaaatcttattaccttttcgatggctatgcccacctctcctcaggcctcgcttgcggcctcgccggactttccgccggcatggccatcggaatcgtcggcgatgccggtgttagggcgaatgcgcaacagccaaagctttttgttggaatgattctcattctcatctttgctgaagctttggctttgtacggtctcattgtcggcatcatcctttcatcccgatccggacaatccagagcagattagagatggcattcttgccagcttcgaatgtgaatgttgttggcatctcagttactcacaggttggtgatgctcattcgcagtgtgcagtgttgtgtcaagttattggtcttgcataggaagatcctttttccgattgtagaatttgaagtgaattgtctttgaaataaagtttttttagctggttgttcacctgctcctttttctacatattagttttgacataatggggaaatcatcattctggaatattccactccacagaatttgttttatgtttctgatcatcgtatttgatggtattaccatcatttgagagattattgtactgggaaatgcataaaacattgatgacctctagaaacataatcttacagttatactaagccgctgaacctgaactctcacctctgaaccaagatgagtccctccctccacggacagcctccgactcagcaaaacaccttgttaaaagaaaaaggccatgaaatcattgacgcattccttcgataagtttaaactaaagactgc

SEQ ID NO: 1579 - DNA, 1070 bp, Prunus mume
ccttataaagcagttggactattcccttcgacgactttggcttgcgtaagcacgagaaacacaaccactgagggagagcagagagaccagagatccaaaattctgagatccagacgacgtcgtcccagatccacgctccataatgtcatcttcaaccttcagcggcgatgaaacggcgccgttcttcggcttcctcggcgctgctgcagccctcgtcttctcatgtatgggagctgcctatggaacggcaaagagtggtgttggtgtggcatctatgggggtgatgaggcctgagctggtgatgaagtccattgttcctgttgttatggctggagttttgggtatttatggccttattattgctgttatcattagtactggaattaaccctaaggccaagtcatactatctttttgatggttatgcacatctctcttctggtcttgcttgtggtctcgctgggctatctgctggaatggcaattggtatagttggtgatgctggtgtaagagctaatgcacagcagccaaaactctttgttgggatgatcctcattctcatctttgctgaagcactggccctctatggcctcattgttggcatcatcttgtcttcccgatcaggccaatccagagcagactaggaagtgaccatgcagtctaatattctttattgcttgttaatggcacttgaaggggaaaacttttggctgatctctggttggtcgttgggctgtgcttgctggttcgtacagattatgtttgtgaaagtaacgactgtgccttgtagtggtaggattgagtttatcaacagaataaaatcttcctaagcaggtttttaaatatgtttatgtattcttccaccagaactatgaactgctatattttttatgattctaaaactagcgcatgtatgatcttattcatccaccaatgatctataggaggctggttgtgatacatctcaattacttgttagtcataatgtgttcatcgaattaagaaaaacaaaataaacaaaaataaaaaggagattatagtgctacggttaaaggtaataaaccttttatt

SEQ ID NO: 1580 - DNA, 933 bp, Glycine max
acggcaacagaagaataatcgagacacaaagatcatagtgatcattttttaatttctcagatttatccgacgtccttgcagatccaccaaccgttatggctgccttcagcggtgatgaaacggcaccgtttttcggcttccttggcgccgcagctgccctcgtcttctcctgtatgggagctgcctatggcacagcgaagagtggcgtgggcgtggcttccatgggtgtaatgagacctgagctggtgatgaagtcgattgttcctgttgtcatggctggagttttgggtatttatggccttattattgctgttattatcagtaccggtattaatccaaaggccaaatcctattacctctttgatggttatgcacatctctcttctggtcttgcctgtggcttggctggcctttctgctggcatggctattggtattgttggtgatgccggtgttagagccaatgcacaacaaccaaaactttttgttggaatgattctcatcctcatttttgctgaagcacttgccctttatggtctcattgttggtattatcctgtcttctcgtgctggccagtctagagccgactaagaaaggagttgtgctgcaaaatattctttgaccacccatctgttttaacctccttttaaaggggatgagggaggtaattattagttgttccgagcttagcgatgttcaggcagcattttcaggctttagcaatggtgtgaaagttcaattcgccatttgtggtgtttgtttgtataattaggtttatgtttacttaataaagcttcttaagcttcctcttttttatactttattgattgtattttgccatatcatccgacttttatatgtattttttgggctgctgaaactggtgcatgtaatgatttggctagcaatgcagtgtatttcatgggtctttcca

SEQ ID NO: 1581 - DNA, 873 bp, Zostera marina
aataatttttctcccaaaccaaataagtccaaacccccctcccaaacgctagatctctgcacgatctcaaatcagaagaagacccgaccttctcctccttcgatctaagttttccgatccgatcaaaatatgtccaccttcagcggcgatgagactgctccttttttcggtttccttggagccgcctctgctctcgtcttctcctgtatgggggcggcgtacgggacggcaaagagtggtgtaggagtggcttctatgggagtgatgaggccagagctggtcatgaaatcgatcgttcccgttgtcatggcgggagttcttgggatttatggacttattattgctgttattattagcactgggattaatcccaaggctaagtcttactatctattcgacggttatgcacatctctcgtccggtttggcttgtgggcttgccggattatctgctgggatggccattgggatcgtcggtgacgctggcgtcagggccaacgcacaacaacccaaactctttgtgggaatgatcctcattctcatttttgctgaagcacttgctttatacggtcttattgttggcatcatcttgtcatctcgtgccggtcaatctcgagcggactagataaaaccccaaatctgatctgagaggggggaggaaggagagagcaaacgtgtgctgagatttttcctttaaaattcgccttttcttctatgggttgttgatgatacaatgcatgcttgtttgtttgttgtaagtttcaactttgcttttcttcttctatatgcattccaccatcattatgagattttgtattgcttctttattttgtaatatttgttgcctatcgaataatcataacaattattatta

SEQ ID NO: 1582 - DNA, 696 bp, Acacia harpophylla
atcctcaccagaaagaaagatcccgcggcctcttcgacagtgatcaacgatggcaggtttcagcggtgacgaaactgctcctttcttcggcttccttggagccgctgctgcccttgtcttctcctgtatgggagcggcctatggaacggcaaagagtggagtaggcgtggcctctatgggagttatgagaccagagctcgtcatgaaatccattgttccggtggtaatggctggagtgctgggtatttatggattaatcatagctgttattatcagtacaggaattaacccaaaagcaaaatcttactatctcttcgatggctatgcccacttatcgtccggccttgcctgtggccttgccggactttctgctggaatggcaattggaattgttggtgatgctggagttcgggctaacgcgcagcagccaaagctgttcgtgggaatgattctgatcctgatctttgctgaagctcttgctctgtatggcctcatcgtgggtatcattctctcatcccgggcaggccaatcccgtgctgagtgagagtgagccggatgggtcatagttgatagtcaccactcaccagtaaagctttataatgtaccataattgtgcattcctagtgactcgacttcacaactattttttcaggagacatgccctgtatcgtatacgcggattccaatagtttttcc

SEQ ID NO: 1583 - DNA, 886 bp, Ambrosia trifida
ccacgagatcttcacaagtgttgaaacgtgataggaacaacacataaaaacaatcgaagcatctcgagattaggcatcgaaacacacacactcacatctccgatcataattattcgatcaattcaactccagatctccattaacaatggcagattcgaccttcagcggtgatgaaactgctcctttcttcggattcctcggtgccgctgctgctctcgtattctcatgtatgggagctgcgtatgggacggcgaagagtggtgtgggtgtggcatctatgggagttatgaggcctgagctggtgatgaaatctattgttccagttgttatggctggtgtgcttggtatttatggtttgattattgctgttattatcagtacagggattaaccctaaggcgaaatcttattatctgtttgatggatatgcacacctttcctctggtttggcttgtggtcttgctggtctttccgctggaatggccatcggaattgttggtgatgctggtgtgagagcaaatgcgcagcagccaaaactttttgtgggcatgattcttattctcatcttcgctgaagccttggccttatacggtctcattgtgggtatcatcttgtcttcccgtgcgggtcagtccagagcagattaagaagtgacagcacctttgccatatatcggtatgtagttattctagaaaaaatgaagattggatccatttttatgctcatctggcagcttttgaacaacgattattgcttgctattcttttgtggttgtttattattgtggaataagagtttgaaacactcgcgtccgttgtgtacttttgacctatgctttgagcactgtagagactgttcctgtttcatttatggtgtttatatattca

SEQ ID NO: 1584 - DNA, 688 bp, Ambrosia trifida
tccacgagatcttcacaagtgttgaaacgtgacaggaacaacaacataaaaacaatcgaagcatctcgagattaggcatcgaaacacatagactcacatctccgatcataattattcgatcaattcaactccagatctccattaacaatggcagattcgaccttcagtggtgatgaaactgctcctttcttcggattcctcggtgccgctgctgctctcgtattctcatgtatgggagctgcgtatgggacggcgaagagtggtgtaggtgtggcatctatgggagttatgaggcctgagctggtgatgaaatccattgttccagttgttatggctggtgtgcttggtatttatggtttgattattgctgttattatcagtacagggattaaccccaaggcgaaatcgtattatctatttgatggatatgcacacctttcctctggtttggcttgtggtcttgctggtctttccgctggaatggccatcggaattgttggtgatgctggtgtgagagcaaatgcgcagcagccaaaactttttgtgggcatgattcttattctcatctttgctgaagccttggccttatacggtctcattgtgggtatcatcttgtcttcccgtgctggtcagtccagagcagattaagaagtgacagcgcctttgccatatatcggtatgtagttat

SEQ ID NO: 1585 - DNA, 578 bp, Ambrosia trifida
acaaacacaaacacaaacacaaagatctattaaaatccttccctttaaactttatccgaccaacaatgtcttcaagttcaggatttagcggtgatgaaacagcccccttcttcggtttcctcggtgcagctgccgcccttgtcttctcctgtatgggggcagcatatgggactgcaaagagtggtgtaggtgtggcttcaatgggtgtgatgagaccagagctggtgatgaagtcgattgttcccgttgttatggcgggtgtgcttggtatttatggtttgattattgctgttattattagcactgggattaacccgaaagcgaaatcttattatctgtttgatgggtatgcgcatctttcgtcgggtttggcttgtgggcttgctggtttgtcggctggaatggcgattgggattgttggtgatgctggtgttagagcgaatgcacagcaaccaaagctttttgtgggtatgattcttattctcatctttgccgaagctcttgccctatacgggcttatcgttggtatcatcttatcttcgcgtgctgggcaatcgagagcagattaagaaggtaac

SEQ ID NO: 1586 - DNA, 1051 bp, Malus domestica
gagatcgaaacacgcataaacgcttaaaggggttttggcggagaggagaggagaggagaaaacaaatccatcaaaagccagatccgatcaaagaatatctgtccataaatcgaggagaatgtcttcttcaaccttcagtggcgatgaaacggcaccgttcttcgggttcctcggcgccgccgcggccctcgtcttctcctgtatgggagctgcatatgggacggcgaagagcggagtaggagtggcgtcgatgggagtgatgaggccggagctggtgatgaagtcgatcgtgccggtagttatggcgggagtgttgggtatttacgggctcattatcgccgtcatcatcagtaccggtatcaaccccaaggctaagtcctattaccttttcgatggctatgctcatctttcctctggtctagcttgcggccttgccggtctatctgccggtatggctattggcattgtcggtgatgccggtgttagagccaatgcacaacagccaaagcttttcgttgggatgatcctcattctcatttttgctgaagcactggcactgtacggtctgattgttggtatcattctctcttcccgatcgggtcagtcaagagctgactagaaggtgtgcttggtggcgttttcagttgctgctatttatcaagaactactttactgttttggttagaagttatagttttgtttcgaaggtgcgatgcagcagattcatgtatgatgtgattgatgttgtgttctaccaggtggattgtggtagtatttatgtgccaaaggtgttagaaatagaattagctattagttttacttccgaataagtttgcgttgtgtttcacgatcccatatgctgtattgagaaatcgaattaaacatttatttgttcaagtttatatagcctgtatcattgtgtttggtgcattcgttcttattttgcttctggatttgttagtagttatgtgttgcgataccgatttattggcatggtccgtcgagtatttgtagtttggtttatgaaggtgaaatcatttgagaaatccaa

SEQ ID NO: 1587 - DNA, 1084 bp, Malus domestica
ttgcctggggacaccttgggaaacctaaaaatcaaccgtcctcctacaattcaactctttctctctccctctctaaaatccccaagacagaattcgattcattgtcgaacgactaaaaccagagcttcgtcgtcttcatccaaacctcatattcgcacgcgcaacccaatccccgcaaccaagcacccccactcacacaaagccagggatacatggcttcttctaccttcagcggcgacgaaaccgctcccttcttcggcttcctcggcgccgccgcagccctcgtcttctcctgcatgggcgccgcctatgggacggcgaagagcggcgtgggcgtggcctccatgggagtgatgcggccggagctcgtgatgaaatcgatcgttccggtggttatggctggagtgctcgggatctatgggcttatcatagctgtgattattagtaccgggatcaacccaaaggccaaatcctattatctgtttgatgggtatgctcacttgtcatctggccttgcttgcggtctggccggcctctccgccggaatggcgattgggatcgtcggtgacgccggtgtccgggctaatgcacagcagccaaagctctttgttggtatgattcttatcctcatctttgcagaagctcttgccttgtacggtctgatcgtggggatcatcctctcatcccgatcaggccaatctcgtgcggattaaggaaggcaagtttgttgctcctctatattatttgaagatcgtattattttgattcctttaagatggtgctatcactataaaacttggttaatttttagttagaagtacattatttaaactgcaccatgcttgtagttatgaagaaacaattgttccgaatgttaattttctccttcctcatataaggacagattagttaatgaaaacttcaccctgctgaagacgtttggtgtttttcaatattttgcttttgtaagtggctaattgaatagttgtttgctcaaggatccttggcaaaagttttattatgctccagtatatgatattcctggagcaatggatgcagtcagtagggctgggttcggttcgaa

SEQ ID NO: 1588 - DNA, 900 bp, Malus domestica
tcaaaatcaaccgtcctccccgattcaactctctctctctctcaaatccccaaagacagaattcgattcattattgaactactaaaaacagagcttcttcgtcttcatccaaacccccagattcgctcacgccacccaatccccgcaaccatacacccccactcacacacacagcgatacatggcttcttctaccttcagcggcgacgaaaccgctcccttcttcggcttcctcggcgccgccgcagccctcgtcttctcctgcatgggcgccgcctatgggacggccaagagcggtgtgggcgtggcctccatgggagtgatgcggccggagctcgtgatgaaatcgatcgttccggtggttatggcgggagtgctcgggatctatgggcttattatagctgttattattagtaccgggattaacccgaaggccaaatcttattatctgtttgatgggtatgctcacttgtcatctggccttgcttgcggtctggccggactctccgccggaatggcgattgggattgtcggtgacgccggtgtccgagctaatgcacagcagcccaagctctttgttggtatgattcttatcctcatctttgctgaagctcttgccttgtatggtctcatcgtggggatcatcctctcatcccgatcagggcaatctcgtgcagattaagggagtcaagtatgttgtttctctagattatttgaaggtcgtattattttgatttctttatgatggtgctatcactataaaacttggttaatttttcgttagaagtatattatttgaagtttaaactgcaccatgcttgtagttatgaagaaacaattggtttgaatgttatttttctcccccgaataagaacagattatgaaaacttcaccctgcgta

SEQ ID NO: 1589 - DNA, 1089 bp, Malus domestica
aaagtcgcgtgtgtgaatccaaatctctgtgtctccattctccgcgatcagaatttcccaaatctgagaaacttcacccaatcgctaatcagaacacccaaaagatggcgtcatccaccttcagcggcgatgaaacggcaccgttcttcggctttctcggcgcggcggccgccctcgtcttttcctgcatgggagcggcgtacgggacggcgaagagcggcgtgggagtggcgtcgatgggggtgatgaggccggagctggtgatgaagtcgattgttccggttgttatggcgggagtgttgggtatctacggtttgatcattgctgtgattatcagcactgggattaacccaaaggccaaatcttactacctcttcgatgggtacgcccacctctcctccggtctcgcttgtggacttgccggactttccgccggaatggccatcggcatcgtcggcgatgccggtgttagggcaaacgcacaacagcccaagctttttgttgggatgattctcattctcatctttgctgaagctttggctttgtacggtcttattgtcggtatcatcctttcatcccgatctggacagtccagagcagattagagataacatttctgtcggctccctatgtgaatgttgtggttactcacatgtttgtgatgctcattcacagtgtgcagtgtcgcgtcgagttactcgtcttgcataggtgggaagaaagatcctttttccgattgtagaattccgagcgaattgtctctgaataaagcttttaattagctgcttcttcttcttctaccttttttctttcttttacatattagtttggtatcatgtagaaatcgtcattgtggaattgtccacagaaggtcgtttatgtttctgatcatcacattcaatggtattactatcatttgattatttgtactaggaaatgcataatacttcaataaccttaaatgggttgaattgttggttgtaagggggaggggatggttgaatccgcaccgaggtgcatagacatgattgctttccgccattgcagtcaagcaccatctgcttatttagaaacataatctaacttttc

SEQ ID NO: 1590 - DNA, 946 bp, Arabidopsis lyrata
aaaaaaatccaattctctcttcctccctccagattcaaacgatccgatccaaagttcttagatccgagaagatgtctacgttcagcggcgatgaaactgctcccttcttcggcttcctcggcgccgccgccgctctcgtcttctcctgtatgggagctgcttatgggactgcgaagagtggtgttggtgtggcttcaatgggagtgatgagacctgagttggtgatgaagtctattgttcctgttgttatggctggtgttttgggtatttatggacttattattgctgttatcatcagtaccggtatcaatcctaaggctaagtcttattacctatttgacggatacgctcacctttcgtctggtcttgcttgtggtcttgctgggctatcagctggtatggctattggaattgtcggcgatgcgggtgttagggcaaatgcgcagcagcctaagctctttgttgggatgattcttattcttatctttgcggaagcacttgctctttacggccttattgtaggcatcattttatcttctcgagctggtcagtcgagagcagaatgagagcacaaacaaatgttagagttccaggtacttacttatcgatcaacttttgtgtgcggtatgtagtatctggagtcgatattttgtggattcttggatcttgatttgggaagcagatctgccacctactttcctaggttggtggttacttgagtgtaggatgttattttgtttggttcggtaataaaaaaagagcttggcatttgttttgtattcttgtattgtctgcatttgtcttgatgaacttgataatattttgtttgtaaagaagtttgcttctgataccatctttgaatgttatgagattaatctttgatagcttttccactgaacaaaacattatataaggaggtggttaagcaaagtaagcaaaatattaa

SEQ ID NO: 1591 - DNA, 850 bp, Arabidopsis lyrata
agagagatcagattccggcgtcccaaggaagcacaaatcttaagatccagaatcgcctgagatgtctaccttcagtggcgatgagaccgctcctttcttcggcttccttggcgctgccgcagcgcttgtcttctcctgtatgggagctgcgtacgggacagccaagagtggtgtgggagtggcatccatgggtgtgatgaggccggagttggtgatgaagtctattgtcccagttgttatggctggtgtcttgggtatctatggtttgattattgctgttatcatcagtaccgggattaaccccaaggctaaatcttactacctcttcgatggatatgcccatctctcttctggtcttgcttgtggcctagctggtctttcagctggaatggccattggtatagttggtgatgctggtgtcagggccaatgctcaacagccaaagcttttcgttggtatgattcttatcctcattttcgctgaagctctggctctatacggtctcatcgttgggatcattttgtcctcccgagctggtcagtccagagccgaatgagaaaagaatgcggttcttgaagtctgcatgattctttcttccccttttcgctggtctcttcatcgagccgggatcttcttatattatttgtcaggttagtagagacacagtggttttgttccttgtggcaacgtgtctgctcggaacaaaaaccacacatcatcatcaaaaatgttcgttttcacccttctgtcatgtttgtaatgagacggttcccagtaagataactgtgggagacaccctatttatatcgtttatcattttcctaataaatccccgaaaactcgatttgat

SEQ ID NO: 1592 - DNA, 901 bp, Arabidopsis lyrata
ctctctctctctctctctctctctcgccagatttcatcgactcgatttcagatttgagatcttagatacaaaacttcgacatgtctacgttcagcggcgatgaaacagctcccttcttcggcttcctcggcgccgcagccgcactcgtcttctcctgtatgggagctgcttatggaaccgcaaagagtggtgttggtgtggcttctatgggagttatgaggcctgagttggtcatgaaatcgattgtccctgttgttatggctggtgttttgggtatctatggattgatcattgctgttatcatcagtaccgggattaaccccaaggctaagtcttactacctctttgatggatatgctcatctttcgtctggtcttgcttgtggtcttgctggtctttcagctgggatggccattgggattgtgggtgatgccggtgtcagggcaaatgctcagcagcctaagctctttgtcgggatgattcttatccttatcttcgcagaagcgctcgctctttacgggcttattgtgggaatcatcctttcctcacgagctggccagtctagagcggaatgagaaagtaaaccacaagattgctcaaaggtacttcctttacttttgtgtgtgttttgtttaatcgtgcttagtatgtatcatcgggaaccaaaaaatttactggatacttggaaatttgtttcggaagcaaaaccgcctatcgtcatctcctttccttttcttttccggtggttactctccgatgtagaatttttattgtttgattctgtaataaaaagctttgaggagcttggtatgtttttgtattcttgtatttgtcctgaggaagttaaatacatttatttgtaaagaagtttgctttttctgaaaccgtcttgagtcttctt

SEQ ID NO: 1593 - DNA, 716 bp, Arabidopsis thaliana
aaatactacaatttggtaacagatctcatcggagcaacagtcatcaaagagccaatggcttcttcaggtttcagcggcgatgaaactgcgcctttcttcggattcctcggcgccgccgctgcgctcgttttctcctgtatgggagcagcgtacgggacggcgaagagtggagttggagttgcgtcgatgggagtgatgagacctgaacttgttatgaaatcgattgttcctgttgtcatggctggtgtgttaggtatttatggtttgatcatcgctgttatcatcagtactgggattaaccccaaggccaagtcttattacctattcgatggctatgctcatctctcttctgggctagcttgtggtcttgctggtctctctgctggtatggctattggaatcgtcggtgatgctggtgttagagcgaatgcgcaacaaccgaagctgtttgtgggaatgattctgattctcatctttgcggaagcgcttgcactgtatggtctcattgttggtatcatcctctcatctcgagctggtcagtctagagctgagtgaaagaagtggagacttattgttattatcatcatgtctcatatgagaagtttcatgtgatgtgtagcttctcctttcagttctttttcgtgagtttgagttctgttattattagacacacttgtgtaacttgggtgaaattatatgactcggtaccaaaagca

SEQ ID NO: 1594 - DNA, 955 bp, Arabidopsis thaliana
actcatctgaaaacaaaatccaattctctctctctccctccagattcaaacgatccgatccaaaactttgagatccgagaagatgtctacgttcagcggcgatgaaactgctccgttcttcggcttccttggcgccgccgccgctctcgtcttctcctgtatgggagctgcttatggaacagcaaagagtggtgttggtgtggcttcaatgggagtgatgagacctgagttggttatgaagtctattgtccctgtggttatggctggtgttttgggtatttatggacttattattgctgttatcattagtaccggcatcaatcctaaggctaagtcttactacctatttgacggatacgctcacctttcgtctggtcttgcttgtggtcttgctggactctcagctggtatggctattggaattgttggtgatgcgggtgttagggcaaatgctcagcagcctaagctatttgttgggatgattcttatccttatctttgcggaagcgctcgctctatacggcctaattgtaggcatcattttatcttctcgagctggtcagtccagagcagaatgagagcacaaacaaatgttaaaatttccaggtacttccttatcgatcaacttataagtgcggtatgtagtatcgggagccgatattttgtggattcttggtttgggaagcagatgttgccacctcgctttccttggttggtggttacttgagtgtaggatgttatttggttggtacggtaataaaaaaaagagcttggcatttgttttgtattcttgtattgtctgcatctgtcttgatgaacttgataatattttgtttgtaaagaagtttgcttctgataccatctttgaatgttatgagattaatgctagcttttctactgaacaaaacattatattttcggagggtgttaagcaaagtaatgaaaatattaatcgt

SEQ ID NO: 1595 - DNA, 1024 bp, Arabidopsis thaliana
actcatctgaaaacaaaaacaacaaacaaaataaataaattcaacagcgatatatcttcatctctctctctctcgccagattttcatcgactcgatttcagatttaagatctcagatacaaaactccgacatgtctacgttcagcggcgatgaaacagctcccttcttcggcttcctcggcgctgcagccgcactcgttttctcctgtatgggagctgcttatggaaccgcaaagagtggtgttggtgtggcttctatgggagttatgagacctgagttggtgatgaaatctattgtccctgttgttatggctggagtgttgggtatctatggattgatcattgctgttatcatcagtaccgggattaaccccaaggctaagtcttactacctctttgatggatacgcacatctctcgtctggtcttgcttgtggtcttgctggtctctcagctggaatggccattgggattgttggtgatgccggtgtcagggcaaatgctcagcagcctaagctctttgttgggatgattcttatccttattttcgcagaagcgcttgctctttacgggcttattgtaggaatcattctttcctcacgagctggccagtctagagctgaatgagaatctaaaccacaagactgctcaaaggtacttcctttacttctgtgtgcgttttgttttatcgtgattagtatgatgtatcatcgggaaccaaaaattttactggattcttggaaatttgtttcggaaacaaaaccgcctatcttcattctccttttcttttccggtggttactctccgatgtagaattttattgtttgattctgtaataaagaagctctgaggagtttggtatgtttttgtattcttgtatttgtcctgaggaagttaaatacatttatttgtaaagaagtttgcttttctgataccatttcttttgaaattatcctgcgatgtatattgcttttgtgtgtcttttatatgatttactagaaaattcatgttgaacgtttttgtgac

SEQ ID NO: 1596 - DNA, 982 bp, Arabidopsis thaliana
gtgcgcttcgctgttgtagtagtagtatatctcatcatcaatcaggcttttgagcctcggaaactcaatccttgtatattcaacggagagagatctgcgagagaaagagagatcagattccggtgttccaaggaagcacatattttaagatccagaatcgcctgagagatgtctaccttcagtggcgatgagaccgctcctttcttcggcttccttggcgctgccgctgcgctcgtcttctcatgtatgggagctgcgtacgggacagcaaagagtggtgtgggagtggcatctatgggtgtgatgaggccggagttggtgatgaagtctattgtcccagttgttatggctggtgtgttgggtatctatggtttgattattgctgttatcatcagtaccgggattaaccccaaggctaaatcctactacctcttcgacggatatgctcatctctcttctggtcttgcttgtgggctagctggtctttcagctggaatggccataggtatcgttggcgatgctggtgtcagggccaatgctcaacagccaaagcttttcgttggtatgattcttatcctcattttcgctgaagctcttgctctatacggtctcatcgtcgggatcattttgtcctcccgagctggtcagtccagagccgaatgagaaaagagtgcggttcttgaagtccgcatgattctttcttccccttttcaccggtctcttcatagagccgggatcttcttatattgtttgtcaggttagtagagagacacagtggttttgttccttgtggcatgtcttctcgaaacaaaaaccacacatcatcatcaaaagcgttgttccgttttcacccttctgttatgtttgtaatgagaccgttgcggattcttctgttcccagtaagataactgtgggagacaccctatttatatcgtttatcattttcctaataaaattccagaaaaactcgatttgatcttgt

SEQ ID NO: 1597 - DNA, 717 bp, Arnica chamissonis
ttctccggcgatgaaacggcaccgttctttggatttctcggagccgctgccgcactagtcttctcctgtatgggggcggcgtatgggacggcgaagagtggtgttggagtggcgtcaatgggagtgatgaggccggagttggtgatgaagtctattgtaccggttgttatggctggagtgttgggtatttatggtttgattattgctgtgattatcagtaccgggattaaccctaaggctaaatcctattatctgtttgatggatacgctcatctttcttctggtcttgcttgtggtcttgctggtctttctgctggtatggctattggaattgttggtgatgctggtgttagagccaatgcacaacaaccaaaactttttgtggggatgattctgatcctcattttcgcagaagctcttgctctctatggtcttattgttggcatcatcctttcttctcgagctggtcagtcgagagcagactagaagtttggcaattgatggatgatccgatacctgctcgtgtgttttacggggtaacttgaagcatttttggttgtcagtttgggtgaagttgaaactgtgttgttttttttccataatttgtgaagttgaagctgtgttgagggtcggttgtaggctagagtgtagttttctgcgataataagcctcaggatatctgtggtattatttgttgctatatttatttgtttattt

SEQ ID NO: 1598 - DNA, 935 bp, Arnica chamissonis
tcaatttcactccagatttccaacaacaatggcagattcgacgttcagtggcgatgaaactgcgcctttctttggattccttggtgccgctgctgcactcgtattctcatgtatgggggctgcgtatgggacggcgaagagtggcgtaggtgtggcatcgatgggagttatgaggcctgagctggtgatgaaatccattgttccggttgttatggctggtgtgctcggtatttatggtttgattattgctgtcattattagtaccggtattaaccctaaggcgaaatcttattatctatttgatggctatgcacacctttcctctggtttggcttgtggtcttgccggtctctccgccggaatggccatcggaatagttggtgatgctggtgttagagcaaatgcacagcagccaaaactttttgtgggcatgattcttattctcatcttcgccgaggcattggccctatacggtctcattgtgggtatcatcttgtcttcccgtgctggtcagtccagagcagattaagaagtgacagcatagcacccttcgccgtatatcagtatgtagttattctggaaaatgaagattgtttccatttttatgctcatctggcagctttcgaacatcacttattgctttacctggaaattctctttggtagcatttgcattcttttgtggtgtttatgattgtggaataagagttaaaacactcgtgtcggttgtgtgtacttttgacccgtgttttaagccctgcagactcttgcagttgcattatggtgtttatgtatttatctgtgatggtaccgttttggtctggtctggtctgctttaagctgaaattgtgaacagacctcacagtatctgttttctcaaccctctgatacaaaaacttcgacgggttgggacggtgttaacgcttggttatcttt

SEQ ID NO: 1599 - DNA, 709 bp, Arnica chamissonis
atcaatttcactcccaatttacaacaacaatggcggattccacattcagtggtgatgaaactgcgcctttctttggattcctcggcgccgctgctgcactcgtattctcatgtatgggggctgcgtatggaacggcgaagagtggtgtaggtgtggcatcgatgggagtgatgaggcctgagcttgtgatgaagtccattgttccggttgttatggctggtgtgctcggtatttatggtttgattattgctgtcattatcagtactgggattaaccctaaggccaaatcttattatctttttgatggctatgcacacctttcctctggtttggcttgtggtcttgctggtctttctgctggaatggccattggaatagttggtgatgctggtgttagagcgaatgcacagcagccaaaacttttcgtgggaatgattcttattctcatctttgctgaagccttggccctatacggtctaattgtgggtatcatcttgtcttcccgtgccggtcagtccagagcagattaagatgacaagaccttgccaagtattcgtatgtagttattctgaaatatcgaagatttattccattttcgtgctcagttccgacttaatctggcagcttttggacaacatttattgcttttctcgaaagtttcttcttggtagcatttctggtctctctgtatggtttttgtgactggaat

SEQ ID NO: 1600 - DNA, 738 bp, Persea americana
caagccctttcctgttcccaccacttgaatttccgatctgatctgattctctctctcgtttctctctctctaatctcctctttcgttctcctctgcgcagctctgaaacaacacaaaaccaacacatacaatacaatacaagatcccaaatcgaatcacagagagatagaaagagagattcataataaaaagatgactgatttcagcggcgatgtgactgctcccttctttggcttccttggcgctgctgctgccctagtcttctcctgtatgggcgcggcctatgggacggcgaagagcggcgtgggggtggcgtcgatgggagtgatgcggccggagctcgtgatgaagtcgatcgtgcccgttgttatggccggagtgcttgggatttacggtttgattatcgccgtcatcatcagcacgggaattaatcccaaggcgaaatcttattacttgtttgatggatacgctcatctctcgtctggtctttcctgtggccttgctggattggccgccgggatggctatcggcatcgtcggcgacgctggcgtcagggccaatgctcagcagccaaagctttttgtgggcatgattctcatcctcatctttgcagaagctcttgcactttacggactaattgttggcattattctctcatctcgagctggccaatctcgagcagattaagaaatcaagcaacagttttctggaggttcttcagatgtttaaatataaaca

SEQ ID NO: 1601 - DNA, 804 bp, Persea americana
ctctccagatccaaatcccagccatggttgctttcagcggcgatgaaactgctcccttcttcggcttcctcggtgctgcagcagccctcgttttctcatgcatgggagcggcgtacgggacggcgaagagcggcgtcggcgtggcgtcgatgggagtcatgaggccggagctcgtgatgaaatcgatcgtccctgtcgtcatggcaggagttttgggaatttacggtctgatcatcgccgtcatcatcagtactggtattaaccctaaggcgaaatcatattatctctttgacggctatgctcatctctcctctggtctctcctgcggcctcgccggacttgccgctggaatggcgatcggaatcgtcggcgacgccggtgtcagagccaatgcacagcagccaaaactctttgttggaatgatcctcatcctcatttttgctgaagctctggccctgtacggcctcattgttggtattattctttcttctcgagcgggccaatcaagagcagactaagtaaaagggtttcgttgttactgttgtgtggtttgttggtaacgatcaagcttcatttcctactgcttcctctattctcataaattctttgttgtggacaacaatcaccccatttttatgtagttgtaatgagctgcttgtaggagtgggtcgtcttggaaataaggcttcctaagctggtggtagtctttgacttgtattttgcagatgtaagtttagatgttgttgaactgttaatttgaatgaacgttggactttattttattctaaaaaaaaaaaaaaaaaa

SEQ ID NO: 1602 - DNA, 858 bp, Brassica juncea
tgatccaaatccaaaaaaaaaattcagcatgtctaccttcagcggcgatgaaacagctcctttcttcggtttcctcggcgctgcagccgcactcgtcttctcctgtatgggagctgcttatggaacggcaaagagtggtgttggtgtggcttccatgggagtcatgaggccagagttggtgatgaagtccattgtccctgtggttatggctggtgtgttgggtatctacggtttgattattgctgttatcatcagtaccgggattaaccccaaggctaagtcttactacctcttcgatggatacgctcacctctcctccggtcttgcttgtggtcttgctggtctttccgctggtatggccattgggatcgtcggtgatgccggtgtcagggcaaatgctcagcagcctaagctctttgttgggatgatccttatccttatcttcgcagaagcgcttgctctttacgggcttatcgtaggtatcatcctctcctctagagctggccagtctagagctgaatgagaatgtgacgacccacaagatttgccatcgttctgagagaatgtacttccttttcgttctgtgtgcttttttgttctttccttctttagtatttatcatcggtaaacctacagatttactggattcttggaactttgttccggaagcaaacctacctattcgtcatccccttttctctttcggtggtttgctttcgggtttgtagggtgttctcttatcgttcggttctgtaataaagagctctcaggagcttggtatgtttctgtattcttgtattgtcctgaggaagtttaaatacatttatttgttttgagaagtttgctttctgaaaccat

SEQ ID NO: 1603 - DNA, 880 bp, Brassica juncea
tctctctctcgccagatatcaatcaatcatcgactcgctcctcagatttcagatccaaatctacacaccaaagcttcaacatgtctaccttcagcggcgatgaaacagctcctttcttcggcttcctcggcgccgccgccgctctcgtcttctcctgtatgggagctgcttatggaacggcgaagagtggtgttggtgtggcttccatgggagtcatgaggcccgagctggtgatgaaatccatcgtaccagttgttatggctggtgtgttgggtatctacggtttgattattgctgttatcatcagtactggtattaaccccaaggctaagtcttactacctcttcgatggttacgctcacctctcctccggccttgcttgtggtcttgctggtctctccgctggtatggccattgggatcgtcggtgatgccggtgtcagggcaaatgctcagcagcctaagctctttgttgggatgattcttatccttattttcgcagaagcgctcgctctttacgggcttattgttggaatcatcctctcctctagagctggccagtctagagctgaatgagaatgattttgccatcgttctgaggatgagagaatgtacttccttttcgttctgtgtgcgtttttgttctttcgttcttttagtatttatcatcgggaaccaacagatttactggattcttgggactttgtttcggaagcaaactcacctattcgtcatcccctttttctctttcggtggtttgcatccgggttgtaggggttctcttattgttcggttctgtaataaaaagctttgaggagcttggtatgtttctatattcttgtgttgtcctgaggaagtttaaatacatttatttgttttga

SEQ ID NO: 1604 - DNA, 601 bp, Brassica juncea
gagaacgatatatccacacctctctctccatctctctctcgccagatttcaatcatcgacctctgatctcatctcagatccaaaatcacaagcttcgacatcatgtctaccttcagcggcgatgaaacagctcctttcttcggcttcctcggagctgcagccgccctcgtcttctcctgtatgggagctgcttatggaacagcaaagagtggagttggtgtggcttctatgggagtgatgaggcccgagctggtcatgaagtccattgtccctgttgtcatggctggtgtgttgggtatttacggtttgattattgctgttatcatcagtaccgggattaaccccaaggccaagtcttactacctcttcgatggatacgctcacctctcctccggtcttgcttgtggtcttgctggtctctcagctggtatggccattggtattgtcggtgatgccggtgtcagggcaaatgctcagcagcctaagctctttgtcgggatgattcttatccttatcttcgcagaagcgcttgctctttacggccttattgtaggaatcatcctctcctcaagagctggccagtctagagctgaatgagata

SEQ ID NO: 1605 - DNA, 1261 bp, Brassica juncea
gaaaatgtctacgttcagtggcgatgagaccgctcctttcttcggcttccttggcgctgccgcagccctcgtcttctcctgcatgggagctgcatatgggacagccaagagtggtgtcggagtggcatctatgggtgttatgagacctgagttggtgatgaagtctattgtccctgttgttatggctggtgtcttgggtatctatggtttgattattgctgttatcatcagtaccggtattaaccccaaggctaaatcttactacctcttcgacggatatgcacatctctcttctggtctcgcttgtggccttgctggtctttctgctggaatggccattggtattgttggtgatgctggtgtcagggccaatgctcagcagccaaagcttttcgttggtatgattcttatcctcattttcgctgaagctctggctctatacggtcttatcgtcgggatcatcttgtcctctcgagctggtcaatccagagccgaatgagaagagaatgctgttcgttcctagattctgcgtgattctttctttggttttttttcgctctcgtcttatattatttctcaggttagtagagggacagtggttttgctacttgtagcatgtttcttaataacgtactgtccgcacgaaacaaaaaccacagagtcaccaaagtgttgttcgttttccacccttgtgttatgatgtttgtaatattcttctcttcccagttaagagagacaacctcttatttatatattttttttttccaatgattcaacacttgcatgaggtttgtacattacattacttcaaaggaaggaagaaatacactcgcaccagaaacagtaaggattatacttaacttacataatggaatcacagaaacttggtaacaaaatggaaacagaggaggctgagatttgataatttagtctcacttgccaagtccaagttctttctctacctctctggttaggctgaactgtaaagtgttctgccatgggaacagagttcttgtcactggtagtttcctcctcagatccttgaaagtgttatccggtaatttagaatatgctacctctagagctccaagatactctgtttcatggtgtcttatgatattggctatggcaatcgcgcagtcatcagcagactgaaatattgtcgaatcctggaactctttctttgcatctaactctacattcccctcttcgaaataatgtgctcctacctgcactttcccttttatgtcaagcacctgcg

SEQ ID NO: 1606 - DNA, 835 bp, Brassica juncea
tcatcttaagatccagaatcgtcggaaaatgtctacgttcagtggcgatgaaaccgctcctttcttcggcttccttggcgctgccgcagccctcgtcttctcctgtatgggagctgcatatgggacagccaagagtggtgtgggagtggcatcgatgggtgtgatgaggcctgagttggtgatgaagtctattgtccctgttgttatggctggtgttttgggtatctatggtttgattattgctgttatcatcagtaccgggattaacccaaaagctaaatcttactacctcttcgacggatatgcacatctctcttctggtctcgcttgtggccttgctggtctttctgctggaatggccattggtattgttggtgatgctggtgtcagggccaatgctcagcagccaaagcttttcgttggtatgattcttatcctcattttcgctgaagctctggctctgtacggtctcatcgtggggatcatcttgtcctcccgagctggtcagtccagagccgaatgaggaagagaatgctgctcttcttggattctgcgtgattctttttttttggttttccaccggtctcttcttcatcagagccgggatcttcttataatatttatcaggttagtagaggcacactgtggttttgctacgtgtaaacaaaaaccacacctcatcaaactgttgttcgttttctctcttctgttatgtttttgtaattttcgaccgtgacggtcagtaagatgtaactgtgagagacgcactctctcatccactctgttatgtttgtattactccaataaatcacagaaaactcgatttaatcctgtt

SEQ ID NO: 1607 - DNA, 769 bp, Brassica juncea
agaagatgtctacgttcagcggcgatgagactgctcccttcttcggcttcctcggcgctgccgccgccctcgtcttctcctgtatgggagctgcttatggaactgcaaagagtggtgttggtgtggcttccatgggagtgatgagacctgaattggtgatgaaatccattgtacccgtggttatggctggtgtgttgggtatttatggactcatcatcgctgttattatcagtaccggtatcaacccaaaggctaagtcttactacctctttgatggatacgcacacctctcctctggtcttgcatgtggtcttgctggtctctcagctggaatggccattggaatcgtcggagatgctggtgtcagggcaaatgctcagcagcctaagcttttcgtgggaatgattcttatcctcatctttgcggaagcacttgctctctatggtctcattgtaggcatcatcttatcttctcgagctggtcagtccagagcagaatgagaaacaaagcaatcgtccaggtaatgattatttttgtgtgtgtgtggaatgtcacttgctctgccatctctgctccttccttctggtgggtgctgcttgagtgtaggatgttgttatttgtttggttgggtaataaaaaagacaagtgtgcatgttttgtattctttgtattttgtcttgaggaacttgatgatatattttgtttgtaaagaagtttgcttctgaaaccatgtttgagtgttgttatgatactcatcttttgaatcttc

SEQ ID NO: 1608 - DNA, 842 bp, Brassica juncea
agcgacctgatctcagatccaaatcgcaaacgtcgacatgtctaccttcagcggcgatgaaacagctcctttcttcggcttcctcggcgctgcagccgcactcgtcttctcctgtatgggagctgcttatggaaccgcaaagagtggtgttggtgtggcgtctatgggagtgatgaggcccgagctggtcatgaagtccattgtccccgttgttatggctggtgtgttgggtatttacggcttgattattgctgttatcatcagtaccggtattaacccaaaggccaagtcttactacctcttcgatggatacgctcacctctcctccggtcttgcttgtggtcttgctggtctttccgctggtatggccattgggatcgtcggtgatgccggtgtcagggcaaatgctcagcagcctaagctctttgtcgggatgatccttatccttatcttcgccgaagcgcttgctctttacgggcttatcgtaggaatcatcctctcctctagagctggccagtctagagctgaatgagaatgtgacgacccacaagatttgccatcgttctgagagaatgagagaatgtacttcctttttcgttctgtgtgcttttttgttctttccttctttagtatttatcatcggtaaacctacagatttactggattcttggaactttgttccggaagcaaacctacctattcgtcatccccttttctctttcggtggtttgctttcaggtttgtagggtgttctcttatcgttcggttctgtaataaagagctctcaggagcttggtatgtttctgtattcttgtattgtcctgaggaagtttaaatacatt

SEQ ID NO: 1609 - DNA, 653 bp, Brassica juncea
atcagaacgatatatctactacgtctctccctctcgccagagttcaatcatcgactcgatttcagatccgagataaaaacttcgaacatgtctacgttcagcggcgacgaaacagctcccttcttcggtttcctcggcgccgcagccgcactcgtcttctcctgtatgggagctgcttatggaacggcaaagagtggtgttggtgtggcttccatgggagtgatgagacccgagcttgtgatgaaatccatcgtccctgttgttatggctggtgtgttgggtatttacggtttgattattgctgttatcatcagtaccgggattaaccccaaggctaagtcttactacctcttcgacggatacgcccatctctcttccggtcttgcttgtggtcttgctggtctttccgctggaatggccattggtattgtcggagatgctggtgtcagggcaaatgctcagcagcctaagctctttgtcgggatgattcttatccttatcttcgcagaagcgcttgcgctttacgggcttattgtaggaatcatcctctcctctagagctggccagtctagagctgaatgagaatgtgacgacccacaagatttgccatcgttctgagagaatgtacttccttttcgttctgtgtgcttttt

SEQ ID NO: 1610 - DNA, 897 bp, Brassica oleracea
cgggacgcgtggggcaaaaaaaaaaactaaataaataaaataagaaaaaacgcagcgatatccacgctgctccatctctctctcgccagatatcaatcatcgactcgttcctcagatttcagatccaaatctacacacaaaaagcttcaacatgtctaccttcagcggcgatgaaacagctcctttcttcggcttcctcggcgccgccgccgcactcgtcttctcctgtatgggagctgcttatggaacggcgaagagtggtgttggtgtggcttccatgggagtcatgaggccagagctggtgatgaagtccatcgtacccgttgttatggctggtgtgttgggtatttacggtttgattattgctgttatcatcagtactggtattaaccccaaggctaagtcttactacctcttcgatggttacgctcacctctcctccggtcttgcttgtggtcttgctggtctctccgctggtatggccattgggatcgtcggtgatgccggtgtcagggcaaatgctcagcagcctaagctctttgttgggatgattcttatccttattttcgcagaagcccttgctctttacgggcttattgttggaatcatcctctcctctagagctggccagtctagagcagaatgagaatgatttgccatcgttctcaggatgagagaatgtacttccttttcgttctgtgtgcctttttttcttctttcgttcttttagtattcatcatcgggaaccaaacagattaattggattcttggaactttgtttcggaagcaaactcacctattcgtcatccccttttcgctttcggtggtttgctttcgggttgtagggggttctcttattgttcggttctgtaataaagagctctgaggagcttggta

SEQ ID NO: 1611 - DNA, 678 bp, Brassica oleracea
  misc_feature (254)..(254): n is a, c, g, or t
  misc_feature (272)..(272): n is a, c, g, or t
  misc_feature (281)..(281): n is a, c, g, or t
  misc_feature (284)..(284): n is a, c, g, or t
  misc_feature (317)..(317): n is a, c, g, or t
  misc_feature (443)..(443): n is a, c, g, or t
  misc_feature (458)..(458): n is a, c, g, or t
  misc_feature (536)..(536): n is a, c, g, or t
ggagagaagaggaggaagatcagattccagattccagattccagattcctgagcgtcatcactaagatcgagaatcgtcggaaatgtcaacgttcagtggcgatgagacagctcctttcttcggcttccttggcgctgccgcagccctcgtcttctcctgcatgggagctgcatatgggactgccaagagtggtgtcggagtggcatctatgggtgttatgagaccagagttggtgatgaagtctattgtcccngttgttatggctggtgtnttgggtatntanggtttgattattgctgttatcatcagtaccggnattaaccccaaggctaaatcttactacctcttcgacggatatgcacatctctcttctggtctcgcttgtggacttgctggtctttctgctggaatggccattggtattgttggtgatgctggtgtnagggccaatgctcancagccaaagcttttcgttggtatgattcttatcctcattttcgctgaagctctggctctctacggtctcatcgtcggnatcatcttgtcctctcgagctggtcaatccagagccgagtgagaaaagatactgcggttcttcttggattctgcgttgattctttctttgcttttttcgctcgtcttatattatttctcaggttagtagagggccccccagt

SEQ ID NO: 1612 - DNA, 1128 bp, Brassica oleracea
  misc_feature (748)..(748): n is a, c, g, or t
tctctctctctcgccagatttcaatcatcgtcctgatctcatcctcagatccaaatcgcaagcttcgacatgtctaccttcagcggcgatgaaacagctcccttcttcggcttcctcggcgctgcagccgcactcgtcttctcctgtatgggagctgcttatggaaccgcaaagagtggtgttggtgtggcgtccatgggagtcatgaggcccgagctcgtgatgaagtccattgtccccgttgttatggctggtgtgttgggtatttacggtttgattattgctgttatcatcagtaccgggattaaccccaaggccaagtcttactacctctttgatggatacgctcacctctcctccggtcttgcttgtggtcttgctggtctttctgctggtatggccattgggattgtcggtgatgccggtgtcagggcaaatgctcagcagcctaagctctttgtcgggatgattcttatccttatcttcgctgaagcgcttgctctttacgggcttatcgtaggaatcatcctctcctcaagagctggccagtctagagctgaatgagaaatgtaacccacaagattttcccccaaggtactttattttctgtgtgttttgttctatcgttctttagtatgtatcatcgggaaactaaaaaaattattggacgctctcccatttctctctcggtggttgctctccgatgtagggatctttattatttggttctgtaataaagagctctganggagcttggtatgttttttgtattcttgtattgtcctggggaagttaaatacatttatttgtaaagaagtttgctttctgaaaccctgacgagtctctgattgctttacatttatttgtaaagaagtttgctttgctgttgtgttttctttgaagaagttccatttgactttgattttatttatagtttctatacaatgaacattcatttatgctaaaagtttttgtgaccgaagttgaaagagaagttaagctttgatgtttgacccttgacatagttttgatttccttatcgttttcttttacacaaaagtatttctctgtgattttgttttttatatcttgaacttcaagctttgatgtttgaatataagctaggag

SEQ ID NO: 1613 - DNA, 1384 bp, Brassica rapa
actcatccgagagaaaaaaacaaaacaataacaaataaataaataaaaaaatcagagcgatatatccatccacatctctctctctctctctctcgccagattccaatcatccagcgacctgatctcagatccaaatcgcaaacgtcgacatgtctaccttcagcggcgatgaaacagctcctttcttcggcttcctcggcgctgcagccgcactcgtcttctcctgtatgggagctgcttatggaaccgcaaagagtggtgttggtgtggcgtctatgggagtgatgaggcccgagctggtcatgaagtccattgtccccgttgttatggctggtgtgttgggtatttacggcttgattattgctgttatcatcagtaccggtattaacccaaaggccaagtcttactacctcttcgatggatacgctcacctctcctccggtcttgcttgtggtcttgctggtctttctgctggtatggccattggtattgtcggtgatgccggtgtcagggcaaatgctcagcagcctaagctctttgttgggatgattcttatccttatcttcgcagaagcacttgctctttacgggcttattgtaggaatcatcctctcctcaagagctggccagtctagagctgaatgagatatgtaacccacaagattttcccccgaaggtactttattttctctgtgtgttttgttctatcgttcattagtatgtatcctctcgggaactgaaaaaaattattggacgctctcctatttctctctcggtggttgctctccgatgtagggatttttattattttgttctgtaataaagagctctgatggagcttggtatgtttttgtattcttgtattgtcctgaggaaagttaaatacatttatttgtaaagaagtttgctttctgaaaccatcacgagtctctctgattgcttttctctggtgtttgtttatcaactttgttgttgtgttttctttgaacaagttccatttgactttgattttatttatagtttctatactatgaacattcatttatgctaaaagtttttgtgaccgaagctgaaagagaagttaagcgttgatgtttgacccttgacatagtcttgatttccttatcgttttcttttacacaaaactatttctctgtgattttgtttttttatatcttgaacttcaagctttgatgtttaataataagctaggagcacaaaagcttaacatatcattttacgcgagtgaaaatttatcaaggctgcaacctttatcgttaggtcacaccactaattaaacatattatattgttaccactccaaatcttgtaccactcaattccaaatagcaccttaaacgtaatgagtttatccttcagaccaaa

SEQ ID NO: 1614 - DNA, 961 bp, Brassica rapa
ccactcatctgaaaatccaaaaaagaaaatatctgctgaatccaaatctctctctccccagttgtagacccgagaagatgtctacgttcagcggagatgagactgctcctttctttggcttcctcggcgctgccgccgccctcgtcttctcctgtatgggagctgcttacggaactgcaaagagtggtgttggtgtggcttccatgggagtgatgagacctgagttggtgatgaagtcgattgtccccgtggttatggctggtgtgttgggtatctatggactcatcatcgctgttatcatcagtaccggtatcaacccaaaggctaagtcttactacctctttgatggatacgcacacctttcctctggtcttgcttgtggtcttgctggtctctcagctggtatggccattggaatcgtgggagatgctggagtcagggcaaatgctcagcagcctaagcttttcgtcgggatgattcttatcctcatctttgcggaggcgcttgctctctatggtctcattgtaggcatcatcttatcctctcgagctggtcagtccagagcagaatgagaaacaaaacaagtgtcagatgatgactttttttttttttttgtggaaccttgtttggggctgccatatattctgcttccttttggtgggtgcttgagtttaggatgtttttatttgtctgggtcggtaataaaagagaagttgacattttctgtattcttgtattttgtcttgatattttgtttgtaaagaagtttgcttctgaaaccatatttgagtgttattatgatactcatcttttgtgtcttccaattttgatatgaagctgaagataagctttttaaacgaacaaaccatgaattaacagaagtggtttaaccaatgtcttgtaaataagtttttgaagatgacctatgtacacaaccaaatgatataatcaaatttctttc

SEQ ID NO: 1615 - DNA, 2584 bp, Brassica rapa
gcccatcttcagatcccgacgtgtgcgcttcttcttcgctgggttttgtaatatatcatcgtcaccaatctcattcaacttcatcgttattcaatctgagagaagaggaggaagatcagattctcctgggcgtcatcattaagatcgaggatcgtcggaaatgtcaacgttcagtggcgatgagaccgctcctttcttcggcttccttggcgctgccgcagccctcgtcttctcctgcatgggagctgcatacgggacagccaagagtggtgtcggagtggcatctatgggtgttatgagacctgagttggtcatgaagtctattgtccccgttgttatggctggtgtcttgggtatctacggtttgattattgctgtgatcatcagtaccgggattaatcccaaggctaaatcttactacctcttcgacggatacgcccatctctcttctggtctcgcttgtggtcttgctggtctttccgctggaatggccattggtatcgttggtgatgctggtgtcagggccaatgctcagcagccaaagcttttcgttggaatgattcttatcctcattttcgctgaagctctggctctctatggtctcatcgtcggtatcatcttgtcctctcgagccggtcaatccagagccgaatgagaagagaatgcggttcttcttcttggattctgcgttgattctttctttgctttttttcgcgcgtcttatattatttctcaggttagtagagaccgccagtggttttgctacttcttaaaaacgtactgtctgcacgaaacaaaaaccacacatcaccaaagtgttgttcgttttccacccttgtgttatgtttgtaatattcttctcttcccagtaagagagacaccctcttttttatatatatttttgtcattctaataaaatcacataaaactcaatttgatttgtttacgaaactcttctctttgtttaacttattatcaaactacgatccgaactctcatccagaaatgatacgagccatacgcacacacagcttaattggtgtctgagcagatgtacaacaattgaaatcaggagcccaggcccatattatttagtccacgacaccgaccgtatagagtgatgacaagcgtcgtaaccgtctatctgagaaactgaatcgaaaagcgtttcagaaactctcgagatttccttcccgtacaagtccgatcacgcgtataaataaagagatagatacatgatcagcttcctgaaaaagctagggttttattcgagattgtatgatcaatcgagtatcaatcgagagatgtcttcctccgaaactagggcacagaagaagcagccgccgtctccgatctcttccctccccgaagaaatcttcgtcgacatcgtagcgcgcgtctctcgatcctattacccgactctctcccaagtctccaggcgtttccgatccctcgtcgcttccccggagctttacgccagacgatccgtcttgcggcgcacggagcaatgcatctacgtcgccatctccaaggatcagacctctgacatccactggttcactctctgcatcaaacccaacggcggcggcggcaccagtgatcatcgattggtgcatatcccctcgctccctcccatgcctctacaaggcagctacgtcgccgtcggttctagcatcttcgtgatgggcggatttcaagattggagcatcacgtcgagtgtttcgctcatcgactgtcgatctcacacggcgcagcctctcgccgacatgcccaaggcggtcgctggctccgtcgcgcaggtcatcgacggcaagatttatgtaatcggaggagcaaatggtcactcgccgatgaaatcaaggtcgagaacgatgatggagtttgatatagagacggaggtttggaagctgaagtcgaggctagattgggagcaaggcaaagtgtggtttagtagtgtggccatgggaggtaagatttacatgcggacttgctacaatagcttcgtttgcgatcccgttaccagtccagatcatttcgtgaaagacgaggttctgcactccaaggagtggttgggttcctgtgtcgttgaggatgtcttgttttactatgacgttcgtggcaagtgtttgagagcttatgatcctaagctcagatcttggggagtcgtgaatggtttggaaggtctattgcctcggggctgttcatggtcgaaagccgctagttatggaggtgggaaaatggttctcttcatgcagacggaagagatctggtgtgccgagattgccgtggagagacgacaaggaggagatatttggggtacagttgagtggtgtgaggttgtgcttggtgggaactttcgcattatggattgtgtacctgtagctgttctgctctgatgttcttgtgtatacaaaaaaggatactagtatagtctcttggtgcttttatgaatgtgtgcttttaaaacctcccttgggatgtgtttctcagacgtgtcaatctttgtgtttggtgggcctattttacatttgtgaattgactgaatcttataccgagtgattcaatacttatttggggtttattt

SEQ ID NO: 1616 - DNA, 914 bp, Brassica rapa
taagttaagtccggtttaatttcacatgccgactaaccgccagcaattactgaatcgatcaaaccattgttgacataagtttggtttccttgtctctcccaaatcttcaaacagctttgtctctttgcgatcagatctcaccggagacgcacaaattcgcgaagagcgatggcttcaggtttcagcggcgatgaaactgcacccttcttcggattcctcggcgccgccgccgctcccgttttctcctgtatgggagcagcgtacgggacagctaagagcggggttggtgtggcgtcgatgggtgtgatgagaccagagcttgtaatgaaatcgatagttccggtggttatggctggtgtgttaggtatttacggtctgatcatagctgtcatcatcagtactggaatcaacccaaaggccaagtcttactatctcttcgatggctatgctcatctctcttccggtttagcttgtggtctcgccggtctctccgccggtatggctatcggcatcgtcggcgacgccggtgtcagagcgaatgcacaacaaccaaagctgtttgtgggaatgattctgattctcatctttgctgaagcacttgcgctgtacggtcttatcgttggtatcatcctctcttctcgtgctggtcagtctagagccgagtgaaaccagaacgtctctgttcttatgtgctaaatccttgtaatgtttttagatatgttttcacttccgatactcatggcattgcgagtttttttattttctcatgaataacaagcaaaaaatcagttgcatttggttctaaatgtttattttatttgctcactatattgaatacatccataagtaataaaataagatgattcagtgatttttggttagtgttcttgatattgttgtgtctaattcgactt

SEQ ID NO: 1617 - DNA, 1072 bp, Brassica rapa
gtacaatgacattgttatcccgacaagcaacgttgttcccttccactcatctgaaaagaaaaaaagacaaaacaaaaataagtacgtaaataaataaataaataaaatcagaacgatatatatctactacgtctctcctccctctcgccagatttcaatcatcgactcgatttcagatccgagataaaaacttcgaacatgtctacgttcagcggcgacgaaacagctcccttcttcggtttcctcggcgccgcagccgcactcgtcttctcctgtatgggagctgcttatggaacggcaaagagtggtgttggtgtggcttccatgggagtgatgagacccgagcttgtgatgaaatccattgtccctgttgttatggctggtgtgttgggtatttacggattgattattgctgttatcatcagtaccgggattaaccccaaggctaagtcttactacctcttcgacggatacgcccatctctcttctggtcttgcttgtggtcttgctggtctttccgctggaatggccattggtattgtcggagatgctggtgtcagggcaaatgctcagcagcctaagctctttgtcgggatgattcttatccttatcttcgcagaagcgcttgctctttacgggcttattgtaggaattatcctctcctctagagctggccagtctagagctgaatgagaaagtaccccaaaggtacttcttttactttctgtgtgctttatttagtatgtatcatcgaaaactggaacatttactggattcttggaactttgtttcgaaagcaaaaccacctatggtttatttattgtttggttctgtaataaagagctcggaggagctttggtatgtttttatttttgtattcttgtattgtcctgaggaagtaagttataatacatgtatttgtaaagaagtttgctttctgaaaccatcttgctctctcctctggtgttgtgttcgtgaagttgttgttttgttttcttggtgaagtttttatgtcattattttcattcatgtttaaagtttcgtgacaaaagtataaagaaaaagaattttt

SEQ ID NO: 1618 - DNA, 1109 bp, Brassica rapa
aagtaggcccaggcccaatgacgtggtcgtctctgttgttaaaaagaacaagctacgttgctcccttccaccattcatctgaaagaaacaaaaaaaattaaataaaataaaaaaagaaaaaacgcagcgatatccacgctgctccatctctctctcgccagatatcaatcaatcatcgactcgctcctcagatttcagatccaaatctacacacaaaaagcttcaacatgtctaccttcagcggcgatgaaacagctcctttcttcggcttcctcggcgccgccgccgctctcgtcttctcctgtatgggagcagcttatggaacggcgaagagtggtgttggtgtggcttccatgggagtgatgaggcccgagctggtgatgaagtccatcgtaccagttgttatggctggtgtgttgggtatctacggtttgattattgctgttatcatcagtactggtattaaccccaaggctaagtcttactacctcttcgatggttacgctcacctctcctccggtcttgcttgtggtcttgctggtctctccgctggtatggccattgggatcgtcggtgatgccggtgtcagggcaaatgctcagcagcctaagctctttgttgggatgattcttatccttattttcgcagaagcgctcgctctttacgggcttattgttggaatcatcctctcctctagagctggccagtctagagctgaatgagaatgatttgccatcgttctgaggatgagagaatgtacttccttttcgttctgtgtgcgtttttgttctttcgttcttttagtatttatcatcgggaaccaacagatttactggattcttgggactttgtttcggaagcaaactcacctattcgtcatcccctttttctctttcggtggtttgcatccgggttgtaggggttctcttattgttcggttctgtaataaaaagctttgaggagcttggtatgtttctatattcttgtgttgtcctgaggaagtttaaatacatttatttgttttgatttgaaaaaaatacagttattttgtaaagaagtttgatttctcaaaccatcttgatctcttattgtgtgtttcgtagaaaatc

SEQ ID NO: 1619 - DNA, 1541 bp, Musa acuminata
ggccgaaaacatgctacattatatgtcccatgatgcagaggaaataggaaaaagtcggacataacattgttaaccatacgacttcggaaacacacacatcagttgcaaagtatacacacacgcatgtgccagacaaaagtactgaaacacacaacaccctagcactcttaaccgagactcgtcataggcaggcaaatgctgggtgtgtactactttttacctcgaagcttcactccaagcaccctttctagtttggtaattatctgtcgatttggaagagcctttcctgactcatattcttggatcacttggggcttctcattaattagctgtccaagttgagcctgggttaacttcttacccagtcgagcttgcataatgttcttcttcagttcgcttgacactcgctcatgagtaagattctcagtctcctcgtcgagcttcctcgtattcagagaagtgctgctagaagcggccttgttcgtaccagcggtagacttcttgacggtttcgatctcggctccactgcgtcgggcggcgttgacggccttctcgtccttcttggcagcggcggtgggcgccttcttgcggatcacaatgggctcccagtcttgcgtgatgggaccgttccctgccatcgagatcgacgatttctgcttcggattagggtttcagaggcgaaaaacagaaccgggaggaaatgatctttctgggaggaaacgacgaaggaatcgagatctgaagcttagggtttcgtaggatctcttggggcttcttcgatctccggggcacgatgtctaccttcagcggcgacgaaaccgcccccttctttggcttcctcggcgccgcggccgccctcgtcttctcctgcatgggagcggcgtacgggacggcaaagagcggcgtcggggtggcctccatgggcgtgatgcggccggagctggtgatgaagtcgatcgtgcctgtggtcatggccggagtgctcgggatctacgggctgatcattgctgtgatcataagcaccgggatcaaccccaaggcgaagtcctattatctgtttgatgggtatgctcacctctcctctgggcttgcttgtggtcttgccggtttatctgctggcatggcaatcgggatagtcggtgatgctggtgtcagggccaacgcacagcagccaaagctctttgtcggcatgattctgattctcattttcgctgaagcacttgcgctatatggtctcattgtcggcatcattctctcctctcgagctggtcaatctagggcagagtaagaaacacgagccaccatattttgcgcccaatatgatcctttcatgttcgtatggaacatgcactcgaggtcttttgttgatttcgcactgcccaagtggttggtatgcttggactgagaagttttctcatactatattttctttgattcttaaatttgaagttatcagttgcttgtctgactttccggcatctgtttccatgtttaagcatctttgtggactaagatatatgcatctattagttgctcgttcc

SEQ ID NO: 1620 - DNA, 703 bp, Musa acuminata
ggaagccggccattcgtctctttcctctcctccgccttctccacctcgcctccttccacgaaactagggtttcccaagtccgccgcaaagatgtcgacgttcagcggcgacgaaactgcccccttcttcgggttcctcggcgctgccgcggccctcgttttctcctgcatgggggcggcgtacgggacggcgaagagcggcgtcggtgtggcgtccatgggtgtgatgcgcccggagctggtgatgaagtcgatcgtgcccgtcgtcatggctggagtgcttgggatctatggtctcatcattgcggtgatcatcagtaccgggatcaaccccaaggccaagtcgtactatctctttgacgggtacgcgcacctctcgtctgggttggcttgtggccttgcaggactttcggctgggatggcgatcggcatcgtgggcgatgctggagtaagggccaacgcgcagcagccaaagctcttcgtaggtatgattcttattctcatctttgcggaagctctcgcgctctatggtcttatcgttggcattattctttcttctcgggctggtcaatctcgagcggagtaagaaacacatgacaagtgtgctcgccgtagtatatttctgcaacttttttgttatcataatgtaatttattcaaatgactctcctcggatgagagtcttgttgtttgttaactcacact

SEQ ID NO: 1621 - DNA, 2322 bp, Brassica napus
ttttttttttcgagaaaaagtttaattcattccggccaaaactctaataacataactgcagaccaaaaactctaataaatctttgagataaactgaactgcgatagtttagaaacaggtcttaacaaagtctgcctaaaaccaaaactcatgttttgttgattgcaaacacaaacagtaaacaaaatcgtctaacaaaaggaaatgcaacaaacccaaaaaaacaaccaagtaatcaatcccaagtggcttgattgttacttcactcgtcttcttggctacggagcctagcaagcctgttggtaactacaatatccaactgagaagctctctccacaatagccttcctcttcttggtcgaaacgttgtgagcaatctcagcgcagtaggtcctgttgtgcatcatcaacaactcgaggtcactcgtgttgtgcacaacgaacttcttgaatccattggggagatagtgacgagtcttcttgtctgatccgtaacccacattgggcatcaatgtcacacccttgaactttcttctaacccttgagtcaataccctttggcctcctccagctctccttgacggtgattctacggtcgctctggggtctgatgaacttggcagacctcttcttcacaaccttcttcgtaagcaacgggaccgccatttttttattttttttgctgcttcactaagattgatctcaatgcgacaaaataaataccaaaacaaagcttcgaatccaacgataaagcacaacagagatattatcttttctaacaaaactgatactaagacaagaagtctgtttttaactccaaaagtaaaatgatagagctcagatgataataaattaataacttagatgattcctattttgttagccacatccagagcatcataatcaggagtcaatctcacgtacgccttcttcgttccatcaggcctgatgagggtattgactttcttggtctgaatgtcatacatcttcttgacagcatctttgatcttcttcttgtcagcacggatgtcaacaatgaagaccaaggtgttgttgtcttcgatcttcttcattgcagactcggtggtgagtgggtacttgaggattccgtagtggtccaacttgttccttggagttgcactgatgcgtgggtacttagggtccctagcctttgtcaatgtctttggcctgtggaacgtcaccttcgttctgatcttcttcgccttcttcttgatgacttgccctgatttcacagctttcgcagctttcaaggccttggcctttgggtcagccttcttagtgacatcaactttagctggagccattactcaaaagtaagatcctttcctacaaaaactgagcggcgcagcgatatccacgctgctccatctctctctcgccagatatcaatcaatcatcgactcgctcctcagatttcagatccaaatctacacacaaaaagcttcaacatgtctaccttcagcggcgatgaaacagctcctttcttcggcttcctcggcgccgccgccgctctcgtcttctcctgtatgggagctgcttatggaacggcgaagagtggtgttggtgtggcttccatgggagtcatgaggcccgagctggtgatgaaatccatcgtaccagttgttatggctggtgtgttgggtatctacggtttgattattgctgttatcatcagtactggtattaaccccaaggctaagtcttactacctcttcgatggttacgctcacctctcctccggccttgcttgtggtcttgctggtctctccgctggtatggccattgggatcgtcggtgatgccggtgtcagggcaaatgctcagcagcctaagctctttgttgggatgattcttatccttattttcgcagaagcgctcgctctttacgggcttattgttggaatcatcctctcctctagagctggccagtctagagctgaatgagaatgatttgccatcgttctgaggatgagagaatgtacttccttttcgttctgtgtgcgtttttgttctttcgttcttttagtatttatcatcgggaaccaacagatttactggattcttgggactttgtttcggaagcaaactcacctattcgtcatcccctttttctctttcggtggtttgcatccgggttgtaggggctcttattgttcggttctgtaataaaaagctttgaggagcttggtatgtttctgtattcttgtgttgtcctgaggaagtttaaatacatttatttgttttgatttgaaaaaaatacagttattttgtaaagaagtttgatttctcaaaccatcttgatctc

SEQ ID NO: 1622 - DNA, 657 bp, Brassica napus
aaatccaaaaaaaaaaatatctgctgaatccaaatctctctctctctctctctccccagtcttggatccgagaagatgtctacgttcagcggagatgagactgctcctttctttggcttcctcggcgctgccgccgccctcgtcttctcctgtatgggagctgcttacggaactgcaaagagtggtgttggtgtggcttccatgggagtgatgagacctgagttggtgatgaagtcgattgtccccgtggttatggctggtgtgttgggtatctatggactcatcatcgctgttatcatcagtaccggtatcaacccaaaggctaagtcttactacctctttgatggatacgcacacctttcctctggtcttgcttgtggtcttgctggtctctcagctggtatggccattggaatcgtgggagatgctggagtcagggcaaatgctcagcagcctaagcttttcgtcgggatgattcttatcctcatctttgcggaggcgcttgctctctatggtctcattgtaggcatcatcttatcctctcgagctggtcagtccagagcagaatgagaaacaaaacaagtgtcagatgatgtccttttttttttttgtggaaccttgtttggggctgccatatattctgcttccttttggtgg

SEQ ID NO: 1623 - DNA, 784 bp, Brassica napus
gagaagaggaggaagatcagattccagattccagattccagattcctgagcgtcatcactaagatcgagaatcgtcggaaatgtcaacgttcagtggcgatgagacagctcctttcttcggcttccttggcgctgccgcagccctcgtcttctcctgcatgggagctgcatatgggactgccaagagtggtgtcggagtggcatctatgggtgttatgagaccagagttggtgatgaagtctattgtccccgttgttatggctggtgtcttgggtatctatggtttgattattgctgttatcatcagtaccggtattaaccccaaggctaaatcttactacctcttcgacggatatgcccatctctcttctggtctcgcttgtggacttgctggtctttctgctggaatggccattggtattgttggtgatgctggtgttagggccaatgctcaacagccaaagcttttcgttggtatgattcttatcctcattttcgctgaagctctggctctctacggtctcatcgtcggtatcatcttgtcctctcgagctggtcaatccagagccgagtgagaaaagatactgcggttcttcttggattctgcgttgattctttctttgcttttttcgctcgtcttatattatttctcaggttagtagagggccccccagtggttttgctacttgttaaaaacgtactgtctgcacgaaacaaaaaccacttgtgttatgtttgtaatattcactcttatttatatatttttgtcagtctaataaaatca

SEQ ID NO: 1624 - DNA, 830 bp, Brassica napus
ctctctctctctcgccagatttcaatcatccagcgacctgatctcagatccaaatcgcaaacgtcgacatgtctaccttcagcggcgatgaaacagctcctttcttcggcttcctcggcgctgcagccgcactcgtcttctcctgtatgggagctgcttatggaacagcaaagagtggtgttggtgtggcgtccatgggagtgatgaggcctgagctcgtgatgaagtccattgtccctgttgttatggctggtgtgttgggtatttacggtttgattattgctgttatcatcagtaccgggattaaccccaaggccaagtcttactacctcttcgatggatacgctcacctctcctccggtcttgcttgtggtcttgctggtctttctgctggtatggccattggtattgtcggtgatgccggtgtcagggcaaatgctcagcagcctaagctctttgttgggatgattcttatccttatcttcgcagaagcacttgctctttacgggcttattgtgggaatcatcctctcctcaagagctggccagtctagagctgaatgagaatgtaaccccacaagattttcccccgaagatactttattttctgtgtgtgttttgttctatcgttcattagtatgtatcctctcgggaactgaaaaaaattattggacgctctcctatttctctctcggtggttgctctccgatgtagggatttttattattttgttctgtaataaagagctctgatggagcttggtatgtttttgtattcttgtattgttctgaggaagttaaatacatttatttgtaaagaagtttgctttct

SEQ ID NO: 1625 - DNA, 911 bp, Brassica napus
gccagatttcaatcatcgtcctgatctcatcctcagatccaaatcgcaagcttcgacatgtctaccttcagcggcgatgaaacagctcccttcttcggcttcctcggcgctgcagccgcactcgtcttctcctgtatgggagctgcttatggaaccgcaaagagtggtgttggtgtggcgtccatgggagtcatgaggcccgagctggtgatgaagtccattgtccccgttgttatggctggtgtgttgggtatttacggtttgattattgctgttatcatcagtaccgggattaaccccaaggccaagtcttactacctctttgatggatacgctcacctctcctccggtcttgcttgtggtcttgctggtctttctgctggtatggccattggtattgtcggtgatgccggtgtcagggcaaatgctcagcagcctaagctctttgtcgggatgattcttatccttatcttcgcagaagcgcttgctctttacgggcttattgttggaatcatcctctcctcaagagctggccagtctagagctgaatgagaatgtaaccccacaagattttcccccgaaggtactttattttctgtgtgtgttttgttatatcgttctttagtatgtatcattgggaaactaaaaaaattattggacgctctcccatttctctctcggtggttgctctccgatgtagggatctttattatttggttctgtaataaagagctctgatggagcttggtatgttttttgtattcttgtattgtcctggggaagttaaatacatttatttgtaaagaagtttgctttctgaaaccctgacgagtctctgattgcttttccctggtgtttgtttatcaactttgctgttgtgttttctttgaagaagttccatttgactttga

SEQ ID NO: 1626 - DNA, 895 bp, Brassica napus
accaccatttccccgtttcatcactgctactcttcacagatactgtaaagaaacaaaaaatcgaattagaaattgtataatgagatgaagacaaaaaaagaatatcagagtgggtagctgccaaaaaatccaaatctctctcttcccagtttttttgagatccgagaagatgtctacgttcagcggagatgagactgctcctttctttggcttcctcggcgctgccgccgccctcgtcttctcctgtatgggagctgcctatggaactgcaaagagtggtgttggtgtggcttccatgggagttatgagacctgagttggtgatgaagtccattgtccctgtggttatggctggtgtgttgggtatctatggactcatcatcgctgttatcatcagtaccggtatcaacccaaaggctaagtcttactacctctttgatggatacgcccacctctcctccggtcttgcttgtggtcttgctggtctctcagctggaatggccatcgggatcgtcggagatgctggagtcagggcaaatgcgcagcagcctaagcttttcgtgggcatgattcttatcctcatcttcgcggaggcgcttgctctctatggtctcattgtaggcatcatcttatcctctcgagctggtcagtccagagcagaatgagaaacaaaacaaatgtcagatgatgattttttttttttttttttttgtggaaccttgtgtggggctgccatatattctgcttccttttggtgggtgcttgagtttaggatgtttttatttgtctgggtcggtaataaaagagaagttgacattttctgtattcttgtattttgtcttgatattttgtttgtaaagaagtttgcttctgaaaccatatttgagtgttattat

SEQ ID NO: 1627 - DNA, 784 bp, Brassica napus
aaaaatcagagcgatatatccatccacatctctctctctctctctctcgccagattccaatcatccagcgacctgatctcagatccaaatcgcaaacgtcgacatgtctaccttcagcggcgatgaaacagctcctttcttcggcttcctcggcgctgcagccgcactcgtcttctcctgtatgggagctgcttatggaaccgcaaagagtggtgttggtgtggcgtctatgggagtgatgaggcccgagctggtcatgaagtccattgtccccgttgttatggctggtgtgttgggtatttacggcttgattattgctgttatcatcagtaccggtattaacccaaaggccaagtcttactacctcttcgatggatacgctcacctctcctccggtcttgcttgtggtcttgctggtctttctgctggtatggccattggtattgtcggtgatgccggtgtcagggcaaatgctcagcagcctaagctctttgttgggatgattcttatccttatcttcgcagaagcacttgctctttacgggcttattgtaggaatcatcctctcctcaagagctggccagtctagagctgaatgagatatgtaacccacaagattttcccccgaaggtactttattttctctgtgtgttttgttctatcgttcattagtatgtatcctctcgggaactgaaaaaaattattggacgctctcctatttctctctcggtggttgctctccgatgtagggatttttattattttgttctgtaataaagagctct

SEQ ID NO: 1628 - DNA, 823 bp, Brassica napus
gtccttaaacgcgtcaggagaggagaaagatcagattcaatcggcgtcatcatcttaagatccagaactcgtcggaaaatgtctacgttcagtggcgatgaaaccgctcctttcttcggcttccttggcgctgccgcagccctcgtcttctcctgcatgggagctgcatatgggacagccaagagtggtgttggagtggcgtctatgggtgtgatgaggcctgagttggtgatgaagtctattgtccctgttgttatggctggtgtgttgggtatttacggtttgattattgctgttatcatcagtaccgggattaaccccaaggctaaatcttactacctcttcgacgggtatgcacatctctcttctggtctcgcttgtggacttgctggtctctctgctggaatggccattggtattgttggtgatgctggtgtcagggccaatgctcagcagccaaagcttttcgttggtatgattcttatcctcattttcgctgaagctctggctctatacggtctcatcgtggggatcatcttgtcctcccgagctggtcagtccagagccgaatgaggatgagaatgattctttcttcttggattcggcgtgattctttcttttggtttttgccaccggtctcattcttcatcgagccgggatctttcttatattattatttatcaggttagtagaggcacaatgtggttttgctacgtgtagacaaaaaccacacctcatcaaactgttgtttgttttctctcttctgttacgtgtagacaagatgtaactgatttatgtttttatcactccaataaatcacaga

SEQ ID NO: 1629 - DNA, 959 bp, Brassica napus
ggaagtcgagaaagatctcacgctcgggagagagattggtttgtgtctctgtaggaggtgggcaaagtgtaagaagaagaagagctcgacgacacttatcagtcattgacaattatatcctctttccatttcagtgcacaaacgtttctgttcgactctctttaaagaaaaaggagaggagaaagatcagattcaatcggcgtctgacatcttaagatccagaactcgtcggaaaatgtctacgttcagtggcgatgaaaccgctcctttcttcggcttccttggcgctgccgcagccctcgtcttctcctgcatgggagctgcatatggaacagccaagagtggtgtgggagtggcatcgatgggtgtgatgagacctgagttggtgatgaagtctattgtccctgttgttatggctggtgttttgggtatctacggtttgattattgctgttatcatcagtaccgggattaaccccaaggctaaatcttactacctcttcgacggatatgcacatctctcttctggtctcgcttgtggacttgctggtctctctgctggaatggccattggtattgttggtgatgctggtgtcagggccaatgctcagcagccaaagcttttcgttggtatgattcttatcctcattttcgctgaagctctggctctgtacggtctcatcgtggggatcatcttgtcctcccgagctggtcagtccagagccgaatgaggaagagaatgattctttcttcttggattcggcgtgattctttcttttggtttttgccaccggtctcactcttcatcgagccgggatctttttttatgttattttttatcaggttagtagaggcacaatgtggttttgctacgtgtagacaaaaaccacacctcatcaaactgttgtttgttttctctcttctgttacgtgtagacaagatgtaactgatttatgtttt

SEQ ID NO: 1630 - DNA, 929 bp, Brassica napus
gaatctgagaggagggaaggggagatcgagaatcgttggaaatgtcaacgttcagtggagatgagacagcacctttcttcggcttccttggcgctgccgcagccctcgtcttctcctgcatgggagctgcatatgggaccgccaagagtggtgtcggagtggcatctatgggtgttatgagaccagagttggtgatgaagtctattgtccccgttgttatggctggtgtcttgggtatctatggtttgatcattgccgttatcatcagtaccggtattaaccccaaggctaaatcttactacctctttgacggatatgcacatctctcttctggtctagcttgtggccttgctggtctttctgctggaatggccattggtatcgttggcgatgctggtgtcagggccaatgctcagcagccaaagctgttcgttggaatgatccttatcctcatttttgctgaagctctagctctatacggtctcatcgtcgggatcatcttgtcctcccgagctggtcagtccagagccgaatgaggaggaagagcttgtcttcttcttcttcttctgcgtcataatcattctttcttttgctggtctcttcatccgcccagatcttcttatattattttatcaggttagttgagacacagcagtggttccgctactctgctctgcttcatactcttgttgttcgttttcaccctttgtgtgaaccttgtacgactgatttttctttttctcttcccagcaagatgctactgtctgtgagagacaccccatctattattctatgttttgttatctgtccaaggaaaactctatttgatctttgtttatcaaacctatgctgctttatttgaattattctgggaattggaagtgttgtcttcatatgttatttgttgagagaactgatcacatatacac

SEQ ID NO: 1631 - DNA, 815 bp, Brassica napus
ggaaaatccaaaaaaaagaaatatctgcggaatccaaatctctctctctctctctccccagtctggatccgagaagatgtctacgttcagcggagatgagactgctcctttcttcggcttcctcggcgctgccgccgccctcgtcttctcctgtatgggagctgcttatggaactgcaaagagtggtgttggtgtggcttccatgggagtgatgagacctgagttggtgatgaagtccattgtacccgtggttatggctggtgtgttgggtatctatggactcatcatcgctgttatcatcagtaccggtatcaacccaaaggctaagtcttactacctctttgatggatacgcccacctctcctccggtcttgcttgtggtcttgctggtctctcagctggaatggccatcgggatcgtcggagatgctggagtcagggcaaatgcgcagcagcctaagcttttcgtgggcatgattcttatcctcatcttcgcggaggcgcttgctctctatggtctcattgtaggcatcatcttatcctctcgagctggtcagtccagagcagaatgagaaacaaaacaaatgtcagatgatgatattttttttttttttttttggaaccttgtgtggggctgccatatattctgcttcgttttggtgggtgcttgagtttaggatgtttttttttgtctgggtcggtaataaaagagaagttgacattttctgtattcttgtatttttcttgaggaacttgatgatattttgtttgtaaagaagttttgcttctgaaaccatgtttgagtgttttatgata

SEQ ID NO: 1632 - DNA, 843 bp, Brassica napus
acgtaaataaataaaatcagaacgatatatctacgtctctccctctcgccagatttcaatcatcgactcgatttcagatccgagataaaaacttcgaacatgtctacgttcagcggcgacgaaacagctcccttcttcggtttcctcggcgccgcagccgcactcgtcttctcctgtatgggagctgcttatggaacggcaaagagtggtgttggtgtggcttcaatgggagtgatgagacccgagcttgtgatgaaatccattgtccctgttgttatggctggtgtgttgggtatttacggtttgattattgctgttatcatcagtaccgggattaaccccaaggctaagtcttactacctcttcgacggatacgcccatctctcctccggtcttgcgtgtggtcttgctggtctttccgctggaatggccattggtattgtcggagatgctggtgtcagggcaaatgctcagcagcctaagctctttgtcgggatgattcttatccttatcttcgcagaagcgcttgctctttacgggcttattgtaggaatcatcctctcctctagagctggccagtctagagctgaatgagaaagtaccccaaaggtacttcttttactttctgtgtgctttatttagtatgtatcatcgaaaactggaacatttactggattcttggaacttggtttcagaaacaaaaccatctatggtttatttattgtttggttatgtaataaagagctcggaggagcttgatatgttttttttctgtattcttgtattgtcctgaggaagttaaaatacatttatttgtaaagaagtttgctttctgaaaccatc

SEQ ID NO: 1633 - DNA, 653 bp, Brassica napus
tctgctgaatccaaatctctctctctctctctctccccagtcttggatccgagaagatgtctacgttcagcggagatgagactgctcctttctttggcttcctcggcgctgccgccgccctcgtcttctcctgtatgggagctgcttacggaactgcaaagagtggtgttggtgtggcttccatgggagtgatgagacctgagttggtgatgaagtccattgtacccgtggttatggctggtgtgttgggtatctatggactcatcatcgctgttatcatcagtaccggtatcaacccaaaggctaagtcttactacctctttgatggatacgcacacctttcctctggtcttgcttgtggtcttgctggtctctcagctggtatggccattggaatcgtgggagatgctggagtcagggcaaatgctcagcagcctaagctttttgtggggatgattcttatcctcatctttgcggaagcacttgctctctatggtctcattgtaggcatcatcttgtcctctcgagctggtcagtccagagcagaatgagaaacaaaacaaatgtcagatgatgattttttctttttgtggaaccttgtgtggggctgccatatattctgcttcgttttggtgggtgcttgagcataggat

SEQ ID NO: 1634 - DNA, 994 bp, Catharanthus roseus
cagacgcagagagaagagtcaaacatctttgcgcgaaggattggattgtttgattgagagaattccccaaataaaaatatcttcctaatccaaacagagacttcttcgatcaatttttcgatcgatccagcgattgatcaaaatccgaattgaaaagagagaagattagatcctgaagatcagaaaatgtcggcttttagtggcgatgaaactgctccgttctttggattccttggcgctgctgctgctcttgttttctcctgtatgggagctgcatatggtaccgctaagagtggggttggagttgcttcgatgggagtgatgcggccggaattggtcatgaaatctattgttccagttgttatggctggtgttttgggtatttacggtttgattattgctgtgattattagtactggaattaatcccaagaccaaagcatattatctatttgatggatatgcacatctttcttctggcttggcttgcggtcttgcggggctttcagctggaatggctattggaattgttggggatgccggtgtcagagcaaatgcacaacagccaaagctttttgttggtatgattctcatcctcatctttgctgaggctctggctctctatggactaattgtcggcatcatcctttcttcccgtgctggtcagtccagagctgattaatcaagtaagatattcgggtcttcttacttgtttagaggtaattcatgctagtcatgaggtgtactctctcgcttgtgattacacattctatttatcactctattatttagtggttttatttagaaaccttctccctcgaataaatatttgtaacgaatgcttcttttgctctttagtttctttggctgtacttttcctggtgaaagaggaaactgttgtttggtcattacggccaatgttataggattttttgtttgttgtaaactgggaagaattgttactgaaacttatgtgctgtggaacaacgagttgg

SEQ ID NO: 1635 - DNA, 753 bp, Centaurea maculosa
cgggggacagtgtgtagaaatcaaacacagagagaaatcatctgaaagaaaaacttccgatttccacttctctgctctaaatccgatcgatttcagtcgaaaatccgtcatcaatggcagattcaggattcagcggtgatgaaactgctcctttcttcggtttccttggcgcagctgctgctctcgtcttctcatgtatgggggcggcttatggaacagctaagagtggtgtaggtgtggcctcgatgggtgtgatgaggcctgagctagtgatgaagtctattgttcctgtggttatggctggtgtgcttggtatctatggtttgattattgccgttatcatcagtactgggattaacccaaaggcgaaatcgtattacctttttgatggctatgcacatctttcttctggtctggcttgtggtcttgctggtctttctgcaggaatggcgatcggaattgttggtgatgccggtgtcagagccaacgcccaacagccaaaactattcgtggggatgattcttattctcattttcgcggaagctctagcactatacggtctcatcgttggtatcattttatcttcccgtgccggtcaatccagagcagattaaacgatgataaagagaacgaaaatgtttttttttctttttttccttttttcttctatatctgttgttgtttgtcatacttaatcaatcaaaatcatgtttttttcttctccatggtttttttgtaatgttttttttacag

SEQ ID NO: 1636 - DNA, 762 bp, Centaurea maculosa
  misc_feature (708)..(708): n is a, c, g, or t
aaaggacaagtgtagaaatcaaacacagagagattgatcgatcatctgagaaaaaaaaaacttccgatttccacttctccgatcgatttcagtcatcaatggcagattcaggattcagcggtgatgaaactgctcctttcttcggtttccttggcgcagctgctgctctcgtcttctcatgtatgggggcggcgtatggaacagctaagagtggtgtaggtgtggcctcgatgggtgtgatgaggcctgagctagtgatgaagtcaattgtccctgtggttatggctggtgtgcttggtatttacggtttgattattgctgttatcatcagtactgggattaacccaaaggcgaaatcctattatctctttgatggctatgcacatctttcttctggtttggcttgtggtcttgctggtctctctgcaggaatggcgatcggaattgttggtgatgccggtgtcagagccaatgcccagcagccaaaactattcgtggggatgattcttattctcattttcgcggaagctctagcactatacggtctcatcgttggtatcattttgtcttcccgtgccggtcaatccagagcagattaaacgacgataacaagaacaagaatgttttttttttcttttttcctttttcttttatatctgttgttgtttgtcttccttgatcaatcaaaatgatgttttcttcttctcnatgtattttgaatttgttctcatcattcattagtgaatatgttgtttctgcaaa

SEQ ID NO: 1637 - DNA, 1012 bp, Centaurea maculosa
  misc_feature (12)..(12): n is a, c, g, or t
  misc_feature (91)..(91): n is a, c, g, or t
  misc_feature (94)..(94): n is a, c, g, or t
  misc_feature (135)..(135): n is a, c, g, or t
  misc_feature (137)..(137): n is a, c, g, or t
  misc_feature (187)..(187): n is a, c, g, or t
  misc_feature (235)..(235): n is a, c, g, or t
  misc_feature (322)..(322): n is a, c, g, or t
  misc_feature (388)..(388): n is a, c, g, or t
  misc_feature (409)..(409): n is a, c, g, or t
  misc_feature (412)..(412): n is a, c, g, or t
  misc_feature (481)..(481): n is a, c, g, or t
  misc_feature (490)..(490): n is a, c, g, or t
  misc_feature (514)..(514): n is a, c, g, or t
  misc_feature (526)..(526): n is a, c, g, or t
  misc_feature (553)..(553): n is a, c, g, or t
  misc_feature (568)..(568): n is a, c, g, or t
  misc_feature (595)..(595): n is a, c, g, or t
  misc_feature (604)..(604): n is a, c, g, or t
  misc_feature (622)..(622): n is a, c, g, or t
  misc_feature (658)..(658): n is a, c, g, or t
  misc_feature (700)..(700): n is a, c, g, or t
  misc_feature (752)..(752): n is a, c, g, or t
ggcgggggatcngaagccaggtgtcgaacaaacacacacacacacacacacaaagatctaaaaaactttctggtttccacttctccgcttnaantccgatcgatttcaatttcaatcggaaatctgtaattaatnancaacaatggcggattcaggattcagcggtgatgaaaccgctcctttcttnggtttccttggcgcagctgctgctctcgtcttctcatgtatgggggcngcatatggaacagcaaagagtggtgtaggtgtggcatcgatgggtgtgatgaggcctgagctagtgatgaagtctattgtccccgtngttatggctggtgtgctcggtatttatggtttgattattgccgttatcatcagtactgggattaanccaaaggcgaaatcgtattanctntttgatggctatgcacatctttcttctggtttggcttgtggtcttgctggtctctctgcaggaatggcnattggaatngttggtgatgccggtgtcagagcnaacgcccagcanccaaagcttttcgtggggatgattctnatcctcatctttgcngaagctctggccctatacggtctcatngttggtatnatcttgtcttcacgtgcnggtcagtcccgagcagattaagaagatgatttaacnaaaagagaatgaaaatggagttttcttttattctatatctgnttgttgtttgttctcattaatcaaatcaagatcatgtttttatttgaatttngcagttttttacatcctttttttatttaaaaaaaacaataaaacaaacataaaaaagggggccgcttattacctcagatgtcctaatggagcgtaataagctagcctggcgtcgtttacacgcttgactgaactgcactgatcttgagactactcttgtgtgatatgcaactcccacaatagctaggataataagttatgtaaccgctaactcgctgaatgctcgtagtataaaataaccgacgaggctatttgtgggta

SEQ ID NO: 1638 - DNA, 1073 bp, Cephalotaxus harringtonia
cggatttttcactggcaccgcaacttgacgggccggttcaccggtcactgcaaaactatttcgcatctcattgccctgcacattaatagatcaagagatcgagcccagcccgaggtcgttaatcttctaagtgcgctcgagaagtaatatcatcccaaagatcagcagatctgttaaaaaatggcggactcatttagcggagatgaaactgctcctttctttgggtttctgggagctgcagcagccctcgttttctcatgcatgggagcagcctatggtacagcaaagagtggagttggagttgcatcaatgggtgtaatgaggccagaacttgtgatgaaatctatagtaccagttgttatggctggtgtgttgggtatatatggtttgatcattgcagtcatcataagcacgggaatcaatcccaaggctaaatcatattatctgtttgatggatatgcccacttatcatcaggtctggcttgtggtctatctggattgtctgcaggaatggctattggcattgtaggtgatgctggtgtcagagcaaatgcacagcaacctaagctttttgtggggatgatactcatcctcatttttgcagaggcacttgctctttatggtttgatcgttggtattattttatcatcaagagctggtcagtcaagagctgactgaattatatgaatctactcagtccattcaccggcgagtttagttaaaaaggaggaccacatgaaggattcatgatggtggctcaatatctttgtatattttctaattgtttgaagtcattaggattttaatcatgctaatagctctggcttcgttagtagaatatttttcagtgtgcctttatgggcatttgttgtactctcattcactcatggttttggattcaatgccttccttcatagcttcgaggtgacttcttgtttaatgtttagagacgtccaactttaaatgttatttatttccttgtcagacaatatgggctagttcttcctcctttgaagtcaataaattactaaatttgttccaggatgttttcttgccattaaatttgtttggtc

SEQ ID NO: 1639 - DNA, 1027 bp, Cicer arietinum
aaacaaataaataaacaaataaattcgagcgagaaagagcataacagatctatctatctaatatctatcaccttcttcattttctacttcttctaattttcgtaaattcgtgaaataataataataaaaaatggctggtttcagcggcgatgaaactgctcccttcttcggcttcctcggcgccgcggctgccctagttttctcatgtatgggagcggcatatggaactgcgaagagcggtgttggtgttgcatcgatgggtgtgatgagaccggagttagttatgaaatcgatcgtacccgttgttatggctggtgtgttgggtatttacggtttgattatcgccgtcattatcagcactggtattaatccaaaggctaaatcttattatctctttgatggttacgctcatctttcttctggtctcgcttgtggtctcgctggtctctctgctggcatggctattggcattgttggtgatgctggtgttagagcaaatgcccaacaacccaagcttttcgttggaatgattctaattctcatctttgctgaggctttggcgttgtatggtctcattgttggcatcatcctctcttcccgtgccggccaatccagagctgagtaatataaattttattcctgcttgtagtgcacagagccacagattcatggattgtaaactttatcggagacttaggcatggtaagggtggagctttgcgtgctcttctttcgtcttatgactcttatctactagttataaaattgaggttatcatggaataaagcctatcgaactattttcagggcattaccgtatttaattatgtttagtcaaactagattagagatttctgtaataaactttttgtttgtttgtgttgatttcaataatatttagttattgtgttctataccgttcaaagcttcattacgcgatccaagttctctttttacaattgtattgagatgtaatatggttttttgtatcatttctgaacatggatcattttcacatgtaagcgtggg

SEQ ID NO: 1640 - DNA, 1238 bp, Cicer arietinum
agaaacttccttttggtccaaaacaaataaaaataaaaacaaaaataaaaattcgagcgagaaagagcataacagatctatctatctaatatctatcaccttcttcattttctacttcttctaattttcgtaaattcgtgaaataataataataaaaaatggctggtttcagcggcgatgaaactgctcccttcttcggcttcctcggcgccgcggctgccctagttttctcatgtatgggagcggcatatggaactgcgaagagcggtgttggtgttgcatcgatgggtgtgatgagaccggagttagttatgaaatcgatcgtacccgttgttatggctggtgtgttgggtatttacggtttgattatcgccgtcattatcagcactggtattaatccaaaggctaaatcttattatctctttgatggttacgctcatctttcttctggtctcgcttgtggtctcgctggtctctctgctggcatggctattggcattgttggtgatgctggtgttagagcaaatgcccaacaacccaagcttttcgttggaatgattctaattctcatctttgctgaggctttggcgttgtatggtctcattgttggcatcatcctctcttcccgtgccggccaatccagagctgagtaatataaattttattcctgcttgtagtgcacagagccacagattcatggattgtaaactttatcggagacttaggcatggtaagggtggagctttgcgtgctcttctttcgtcttatgactcttatctactagttataaaattgaggttatcatggaataaagcctatcgaactattttcagggcattaccgtatttaattatgtttagtcaaactagattagagatttctgtaataaactttttgtttgtttgtgttgatttcaataatatttagttattgtgttctataccgttcaaagcttcattacgcgatccaagttctctttttacaattgtattgagatgtaatatggtttttttgtatcatttctgaacatggatcattttcacatgtaagcgtgggtattatagtttgtgtaggttatgatttttgatgttgcaacagcactgtgtaggttatgatttatgaatagagctgtaaatgaatcacgcattttgtgttattcttgtatggttggcttggtagttgctaccataactataggatccgaacgttgcattggcttgtgtatgaagtactccgac

SEQ ID NO: 1641 - DNA, 789 bp, Cichorium intybus
aacgatatcacgttgagattatagatcgaggcacacagattctactctgtttgcacatctccgatccaaattcgatcaaattcactcccaattccgatcaacaatggcttcagattcgttcagtggtgatgaaaccgcgcctttctttggatttctcggcgccgctgctgccctcgtcttctcctgtatgggggctgcgtacgggacagcgaagagcggtgttggcgtggcatcgatgggagtgatgagacctgagctggtgatgaagtccatcgtcccagttgttatggctggtgtgctcggtatttacggtttgattattgctgtcatcatcagtaccggaatcaaccctaaggcaaagtcttattaccttttcgatggctatgcacacctttcctctggtttggcttgtggtctagctggtctttcagctggaatggccattggaattgttggtgatgctggtgttagagcaaatgcacagcagccaaagctttttgtgggaatgattcttattttgatctttgctgaagccctggctttatacggtcttattgtgggtatcattttgtcttcacgcgcgggtcaatccagagcagattaagaagcacacacgatataattggtatgtagttattctgagaaatgaagatccattcccatttgatttgccagcttatgaacaaacaaacttcaaattttctcattggtagcatttgtggctctatttgcattcttttatggggtttttatgactatgggaataagagtttggagcagtccatggtt

SEQ ID NO: 1642 - DNA, 752 bp, Cirsium arvense
ttttatttccattaaaaataattctcaaaagctgtccgcttgtgatccagaagcacaggtgtcgaacaaaaacacacacacacacacacacaaagatctaaaactttctggtttccacttctcaaaatccgatcgatttcaatttcaatcggaaatctgtaatcgttaacaatggcggattcaggattcagcggtgatgaaaccgctcctttcttcggtttcctcggtgcagctgctgctctcgtcttctcatgtatgggggcagcatatggaacagcaaagagtggtgtaggtgtggcatcgatgggtgtgatgaggcctgagctagtgatgaagtctattgtccccgtggttatggctggtgtgctcggtatttatggtttgattattgccgttatcatcagtactgggattaacccaaaggcgaaatcgtattacctctttgatggctatgcacatctttcttctggtttggcttgtggtcttgctggtctctctgcaggaatggcaattggaattgttggtgatgccggtgtcagagcgaacgcccagcagccgaagcttttcgtgggaatgattctcatcctcatctttgcggaagctctggccctatacggtctcatcgttggtattatcttgtcttcgcgtgccggtcagtcccgagcagattaagaagatgatttaaaaaaagagaatgaaaatggagttttcttttattctatatctgtttgttgtttgttctcattaatcaa

SEQ ID NO: 1643 - DNA, 646 bp, Cirsium arvense
ggttcaaaaagttgtcctctcgtgatccaaaaggacaaaagtgtagaacatcaaacacagagagatcgatcatctgaagaaagaaaaaaaacttccgatttccacttctccgatcgatttcagtcatcaatggcagattcaggattcagcggtgatgaaactgctcctttcttcggttttctaggcgcagctgctgctctcgtcttctcatgtatgggggcggcgtatggaacagcaaagagtggtgtaggtgtggcctcgatgggtgtgatgaggcctgagctagtgatgaagtctattgttcctgtggttatggctggtgtgcttggtatttacggtttgattattgctgttatcatcagtactgggattaacccaaaggcgaaatcgtattatctctttgatggctatgcacatctttcttctggtttggcttgtggtcttgctggtctctctgcaggaatggcgatcggaattgttggtgatgccggtgtcagagccaacgcccagcagccaaaactattcgtggggatgattcttattctcattttcgcggaagctctagcactatacggtctcatcgttggtatcattttgtcttcccgtgccggtcaatccagagcagattaaacgacgataacaagaa

SEQ ID NO: 1644 - DNA, 709 bp, Cirsium arvense
gttctccggcgatgaaactgctcccttcttcggctttcttggcgccgctgctgccctagtcttctcctgtatgggagcggcgtatgggacggcgaagagcggcgtcggagtggcgtcgatgggagtgatgaggccggagttggtgatgaagtcgattgtacccgttgttatggccggagtgttggggatttacggtttgattattgctgtcatcatcagtaccggaattaaccctaaggctaagtcttattaccttttcgatggctacgctcatctctcttccggccttgcttgtggtcttgctggtctttctgctggtatggctattggtatcgtcggtgatgctggtgtcagagccaatgcacaacaaccaaaactttttgttggcatgatcctcatcctcattttcgctgaagctcttgccctctacggtctaattgttggcatcatcctttcttctcgagctggtcagtccagagcagactagaatgtcagcattcaatccagtactcggtgtgttttacaggtataagttaagcattttttgatggttgttttgggtagagttgaaactggtgtgggtgtgtcgtttttttccataatttgtgaatggtggggtggagtatttgtgctgaggcatgagggtaggttgtagattaggttgtagttgtccactataataaagttgtcattgttgctcgtattattt

SEQ ID NO: 1645 - DNA, 733 bp, Cirsium arvense
ctctcaaaaactgtccgttcgtgatccagaaggacaagttttgaaaacagcaaaacacagcgaagatatctaaaaagctttctgtttccacttctcagctctaaaatccgatcgatttcaatcgaaaatctgttaacaatggcggattcaggattcagcggtgatgaaactgctcctttctttggtttcctcggcgcagctgctgctcttgtcttctcctgtatgggagcggcatatggaacagcgaagagtggtgtaggtgtggcatcgatgggtgtgatgaggcctgagcttgtgatgaagtcgattgttcctgtggttatggctggtgtgcttggtatttatggtttgattattgctgttatcatcagtactggaattaaccctaaggcgaaatcgtattatctgtttgatggttatgcacatctttcttctggtttggcttgtggtcttgctggtctctctgcaggaatggctattgggattgttggtgatgctggtgtcagagccaacgcccagcagccaaagctattcgtggggatgattcttatccttatttttgcggaagctctggctctatacggtctcatcgttggtatcattttgtcttcgcgtgccggtcaatccagagcagattaagaagatatgaataaaaaaatatgaaatggtagttttttttaattatctgttgttgtttgtcctccttaattaatcaaaatcatgtttatttttt

SEQ ID NO: 1646 - DNA, 954 bp, Vigna unguiculata
aggcgaaaaaacaataataacagtaatagcaacagatctaagtgtcgtttggccgaagccaaaatccagagaaagaaagaaagaatggttgatttcagcggcgatgaaacggctcccttcttcggcttcctgggtgccgcggcggctctcgttttctcctgcatgggggcggcgtacggcacggcgaagagcggtgtcggtgttgcatcgatgggcgtgatgaggccggagctggtgatgaaatcgattgtgccggttgtcatggcgggagtgctgggcatctacggcttgatcatcgcggtgatcatcagcacgggaattaaccctaaggccaaatcgtactatctcttcgacggctacgctcatctctcttctggtctcgcttgcggtctcgctggtctctccgctggcatggccattggcatcgttggcgacgccggtgttagagcaaatgcccaacagccaaagctttttgttggtatgattctgattctcatctttgctgaggcattggcgttgtatggtctcattgttggcatcatcctctcttcccgcgctggccaatccagggctgattaggacggaatctcacgctgcttagagcgtatagaaccatggatttggatggcgaatgtcgtgaagatctaggtattggtaagattgttgctttgtgatgctcttcattcaggttattcagaaataaaacgtccaaacgattttctttggccatttattgtatttaattatgctatccagactaaattagagatctctgaaataaaacatgtttgagtttattttgaaaacggtgagtattgtgtcgtgtgccattcgacacttcagctctctccacaagccccaaaacctcattttatggctgtaatgagatattaaatgtcaaccttatttcttttataatgatcttgaaaattacggacaaaaaaaaaaaaaaaa

SEQ ID NO: 1647 - DNA, 981 bp, Vigna unguiculata
  misc_feature (23)..(23): n is a, c, g, or t
agagagggtgggttcaagaaacntcgcagagggaagaagagaaggcgaaaaaacaataataacagtaatagcaacagatctaagtgtcgtttggccgaagccaaaatccagagaaagaaagaaagaatggttgatttcagcggcgatgaaacggctcccttcttcggcttcctgggtgccgcggcggctctcgttttctcctgcatgggggcggcgtacggcacggcgaagagcggtgtcggtgttgcatcgatgggcgtgatgaggccggagctggtgatgaaatcgattgtgccggttgtcatggcgggagtgctgggcatctacggcttgatcatcgcggtgatcatcagcacgggaattaaccctaaggccaaatcgtactatctcttcgacggctacgctcatctctcttctggtctcgcttgcggtctcgctggtctctccgctggcatggccattggcatcgttggcgacgccggtgttagagcaaatgcccaacagccaaagctttttgttggtatgattctgattctcatctttgctgaggcattggcgttgtatggtctcattgttggcatcatcctctcttcccgcgctggccaatccagggctgattaggacggaatctcacgctgcttagagcgtatagaaccatggatttggatggcgaatgtcgtgaagatctaggtattggtaagattgttgctttgtgatgctcttcattcaggttattcagaaataaaacgtccaaacgattttctttggccatttattgtatttaattatgctatccagactaaattagagatctctgaaataaaacatgtttgagtttattttgaaaacggtgagtattgtgtcgtgtgccattcgacacttcagctctctccacaagccccaaaacctcattttatggctgtaatgagatattaaatgtcaaccttatttcttttataatgatcttgaaaattacggaca

SEQ ID NO: 1648 - DNA, 841 bp, Vigna unguiculata
gataacagctcccgataaaagaacgatcaaccgcaacagatatcgttttctctccgaacagaaccagtatggctgccttcagcggcgacgaaaccgctcctttctttggcttcctcggagccgccgccgctctcgttttttcctgcatgggtgcggcgtacggcaccgcgaagagcggcgtgggggtggcgtcgatgggagtgatgagaccggagctggtaatgaaatcgatcgtgcctgtcgtgatggctggtgtgttggggatctacggtttgattattgcggttatcataagtacgggcattaaccctaaggccaaatcctattatctcttcgacggttacgcgcacctctcttctggtctcgcttgtggcctcgctggcctctccgccggtatggccatcggcatcgtcggcgacgccggtgtcagagcaaatgctcagcagccaaagctttttgttggaatgattctcatcctcatttttgctgaggctttggcgttatacggtctcattgttggcatcattctctcttcccgtgccggccaatccagggctgattgatataaaagttcctgttggatggggtacacactcacagattgtgaatgttacagtgtagtccggctgggtaatgtttgtacactaactgctgctttggcttgctcatgtgagtctatttatgttcgcatcataaaattaaggctgtccagtaataatgtcagtcaaacttttcctaggccgaaatttttgaataattttcttaaaccaaactagaatagagatctccataataagacagatgtatgtttcgattccatttactttcagtttttcttcca

SEQ ID NO: 1649 - DNA, 865 bp, Vigna unguiculata
aaaagagataacagctcccgataaaagaacgatcaaccgcaacagatatcgttttctctccgaacagaaccagtatggctgccttcagcggcgacgaaaccgctcctttctttggcttcctcggagccgccgccgctctcgttttttcctgcatgggtgcggcgtacggcaccgcgaagagcggcgtgggggtggcgtcgatgggagtgatgagaccggagctggtaatgaaatcgatcgtgcctgtcgtgatggctggtgtgttggggatctacggtttgattattgcggttatcataagtacgggcattaaccctaaggccaaatcctattatctcttcgacggttacgcgcacctctcttctggtctcgcttgtggcctcgctggcctctccgccggtatggccatcggcatcgtcggcgacgccggtgtcagagcaaatgctcagcagccaaagctttttgttggaatgattctcatcctcatttttgctgaggctttggcgttatacggtctcattgttggcatcattctctcttcccgtgccggccaatccagggctgattgatataaaagttcctgttggatggggtacacactcacagattgtgaatgttacagtgtagtccggctgggtaatgtttgtacactaactgctgctttggcttgctcatgtgagtctatttatgttcgcatcataaaattaaggctgtccagtaataatgtcagtcaaacttttcctaggccgaaatttttgaataattttcttaaaccaaactagaatagagatctccataataagacagatgtatgtttcgattccatttactttcagtttttcttccactcttcaaaaaaaaaaaa

SEQ ID NO: 1650 - DNA, 764 bp, Cyamopsis tetragonoloba
  misc_feature (607)..(608): n is a, c, g, or t
  misc_feature (672)..(672): n is a, c, g, or t
  misc_feature (709)..(709): n is a, c, g, or t
  misc_feature (712)..(712): n is a, c, g, or t
  misc_feature (718)..(718): n is a, c, g, or t
  misc_feature (720)..(720): n is a, c, g, or t
  misc_feature (724)..(724): n is a, c, g, or t
  misc_feature (732)..(733): n is a, c, g, or t
  misc_feature (737)..(737): n is a, c, g, or t
  misc_feature (747)..(747): n is a, c, g, or t
cacgaggaaacagagaaacagaacaaccagtcagagagcaaccgcaacaacagatctccatctccctccctttctcaccaaaaaatcaaatccatggctcccttcagcggcgacgaaactgctcctttcttcggcttcctcggagccgccgcggccctcgttttctcctgtatgggagcggcatatggaacggcgaagagcggtgtcggtgtggcatcgatgggtgtgatgagaccggagctggtgatgaaatcgatcgtaccagttgtgatggctggtgttttaggtatctacggtttgatcattgcggttatcatcagtaccggaattaaccctaaggccaaatcgtattatctctttgacggttacgctcacctttcttccggtcttgcttgtggcctcgctggtctctccgctggaatggccatcggcatcgttggcgatgccggtgttagagcaaatgctcaacagccaaagctttttgttggaatgattctcatcctcattttcgctgaggcgttggcgttatatggtctcattgttggcatcattctctcttcccgtgctggacaatccagggctgattaatatgaaatttccattgaanngtggtacatagagccacagactaaatgttaccgtgaagttagagtggttaattttagttcgcanactctgctttgtcttatgtgattcgatttatgtactngtnataaantngagnctatctanngaanaaagcctctngaacacttctttgccca

SEQ ID NO: 1651 - DNA, 1152 bp, Cyamopsis tetragonoloba
cacgaggggagcatctcgtttctctcagatcagatctattcgtgattcgacgtcgttgcagtaccaatggctccgttcagcggcgatgagacggcaccgtttttcggcttcctcggagccgcagctgcacttgtcttctcctgtatgggagctgcatatggcacagctaagagtggtgttggtgtggcttcaatgggtgtgatgagaccggagttggtgatgaaatctattgtccctgttgttatggctggtgttttgggtatttatggccttattattgctgttataatcagtactggcattaatcccaaggccaaatcttattacctctttgatggttatgcacatctctcttctggtcttgcctgtggtttggctgggctctctgctggcatggctattggtattgttggtgatgctggtgtcagagccaatgcacagcaaccaaaactttttgttggaatgattctcatcctcatctttgctgaagctcttgctctatatggtctcattgtgggtattattctgtcttctcgtgctggccagtctagagctgattaagaaaggagctatgctgcaaaatattctttagccatccgtctgttttaaccttcttagttcttattaagagggtgaaggagtaaatttttagttgcgaggttagtgatatgctcggacaccacctgcaggattcaacaaatacttatctgaaaaacaatagctccaccagccattttgtggtgtttgtatcagtagtctttctttggttaataaatcttcttaaaacttcatcatttttccttatgaaatgtattgtgccatatgatctgagtccacattttttttgctgcttaaactggtgcatgtattaatttggttgccaatgtatcttttatgcatttatgagtctattcgtattggatgctgttgtgcggctaaaagttgcttgtgttcgcgcattggtttaatcaaccttctcgaatctcgcaagagaagcgcatttggagttgtgatcaaattctgataacatatcattctgaatcatttgattgttgaagtaagctgggaatatgaaatgaacttattaaacttttgtattgagatagagaagtcatggtatagtgaaatttcatgcctgctttctacctcgtg

SEQ ID NO: 1652 - DNA, 806 bp, Cynara scolymus
gcggggattcatcgatggtttgatcgtgattcagaaggacaagtctttgaacacaaacacacacagatctaaaactttctggttccacttctccgatcgatttcgatccaaaatctgttaacaatggcggattcaggattcagcggtgatgaaactgctcctttctttggtttccttggcgcagctgctgctcttgtcttctcatgtatgggggcggcatatggaacagcgaagagtggtgtaggtgtggcatcgatgggtgtgatgaggcctgagctggtgatgaagtctattgttcctgtggttatggctggtgtgctcggtatttatggtttgattattgctgttatcatcagtactggaattaaccctaaggcgaaatcgtattatctgtttgatggctatgcacatctttcctctggtttggcttgtggtcttgctggtctttctgcaggaatggcaattggaattgtcggtgatgccggtgtcagagccaatgcccagcagccgaagctattcgtggggatgattcttatcctcatttttgcggaagctctggctctatacggtctcatcgtcggtatcatcttgtcttcacgtgccggtcaatcccgagcagattaagatgttacagagaatgaaaatggaggtttttttcttctttatctgtttgttgtctgttcttattaatcaatcaagatcatgttttatttgtttatttaaatttggcaggttttgaacgtcctttttttaaaattttatggtctatttatttgtatctcagtatcataatggtgttgctgcag

SEQ ID NO: 1653 - DNA, 920 bp, Taraxacum officinale
cggcggggaagacagtgttggaacgtgaaaggaacaacgcataaaacgatcaacacgttgagattagagatcgaggttcagagattaactctgtctgcacttctccgatccaaattcgatcaatttcactcccaattccgatcaacaatgggttcagattcattcagtggtgatgaaaccgcgcctttctttggatttctcggcgccgctgctgccctcgtcttctcctgtatgggagctgcgtatgggacagcgaagagtggtgttggagtggcatcgatgggagtgatgaggcctgagctggtgatgaaatccatcgttccagtggttatggctggtgtgcttggtatttacggtttgattattgccgtcatcatcagtaccggaatcaaccctaaggccaagtcatactatctattcgatggctatgcacacctttcctccggtttggcttgtggtcttgctggtctatccgccggaatggccatcggaatagttggtgatgccggtgttagagcaaatgcacagcagccaaagctttttgtgggaatgattcttattttgatctttgccgaagccttggctttatacggtctgattgtgggcatcattttgtcttcacgtgctggtcaatccagagcagattaagaaccgatttgtaggtattctcagaaatgaagatcaattcccatttcatcaagaaacaaatactcttgaaattctctcattggtagcattttgcattctttttgaataaggccatggtttcgttataaacatgtgtcacttctgtactcgttttaattattttgtgcgtttttatctccaacttaaatcggtattgattctattttgtaataatgatgagacagttacaggatctgattaccagtttagtaaatattattagaaagttaacg

SEQ ID NO: 1654 - DNA, 863 bp, Solanum melongena
aatcccaattccaataaacactcagatcgcgaatcactccaattcccaattcgaagaagaaaaaaaaatggcttctacgtttagcggcgatgaaacggcaccgtttttcggcttcctcggcgctgcagctgccttagtcttctcctgcatgggtgcagcttatggtacagcgaagagtggggtaggagtagcgtcgatgggtgtaatgaggccggaattggtgatgaagtctattgttccggtcgttatggctggagttttgggtatttatggattaattattgctgtgattattagtactgggattaatcctaaaaccaagtcgtattatctatttgatggatatgctcatctttcatctggtcttgcttgtggtcttgctggtctttctgctggtatggctatcggaatcgttggtgatgctggtgttagagctaatgcacagcagccaaagctttttgttggaatgattctaatccttatttttgctgaagccctggctctttacggccttattgttggtatcatcctttcttctcgtgctggtcaatctagagcagagtagagaaaagattgtcatatgtttcataattgtgaagtatttgtgttcttcctcgttggatgagctagactggctcatgaattacatcttgtttagttttggccttcgatattattatgtatttgattgcttggctagaagaattccctcaataaagatatcaacttttctgatactccatttttgaaagacaacaattggattgttgtaaaatgttccctgtatttatttatctcgactcaacttttaagctttcatttgtttctggatctcctctctgctttggatgatatttttactc

SEQ ID NO: 1655 - DNA, 958 bp, Euphorbia peplus
agagaatccaattacagagctacacctctatccgacaccgttttcttctcatctccgtctccaaacaatgtcttctgcttctgtttttagcggcgatgaaactgctcccttcttcggcttcctcggagctgccgctgccctcgtcttttcctgcatgggcgccgcttatgggacggcaaagagtggggttggagtggcttcgatgggagtgatgcgaccggagctcgtcatgaagtcaatagttccggtggttatggctggagtgttggggatttacgggttaattatagcggttattattagtactggtattaatcccaaggctaaatcttattatctttttgatggctatgctcacttgtcctctggtcttgcttgcgggcttgctggtttatctgctggaatggcaattgggattgttggtgatgctggagtccgggctaatgctcaacagccaaaactgttcgtaggaatgattcttatcctcatttttgctgaagcacttgctctatatggccttattgttggaatcattctctcatctcgagcgggccagtctcgtgcagactaaaaagggccaacttgtaactcttgatgccctttatttttcagatcaaagattaaagtgtatggtgtatccagaagctgctcaaaaactttcataaattatttgaatccatccattccggaaactcttgtatatgtaggatcctggccatccaggagttgtaatcattgtgaagagtttatttatcctcaattaagttggttgtgagcttcggtttatttgtatcctgaaagtctatcagatctttttcacaaatgataaactcttatgggtgagatattaaactacttgagcaatgaaaaattgctcgattttaactttgtgagttgaattcatcaagttcttgattatgcagcatataatgacaaataggggaaaatttgtggcttc

SEQ ID NO: 1656 - DNA, 797 bp, Euphorbia peplus
acgacaacaacaacaaataatctgagagagatcgaaactccagaaggtgtgtgtgaagctctgctatctgatctcagatctaaacaatcaatcatgtcttctggtggattcagcggcgatgaaaccgctcctttcttcggcttcctcggcgccgctgctgctctcgtcttctcctgtatgggagcggcatatggaacggccaagagtggtgttggggtagcatctatgggtgttatgagacctgagcttgtgatgaagtcgattgtaccagttgttatggctggtgtgttgggtatatatggcttgattattgcggttattatcagtactgggatcaacccgaaagctaagtcatattatctttttgatggatacgcccatctttcgtctggtctttcttgtggccttgctggcctctctgctggtatggccattggaatcgttggtgatgctggtgtcagagctaatgcacaacaaccaaagcttttcgtgggaatgatccttatcctcatctttgctgaagcattggcattgtacggacttattgttggcatcatcttgtcttcccgagctggccaatctagggcagaataaggagagaggtcgttatgtttatattctttttaatggattagtgttgcgtctctgaaggggaagattggatgattgttggcagataattgaatggtttgaattcaaacagttgcagggttttgaaattattcttatggaagttgtctgcctgccctgccagacattcagtggtttctttgtggtgtttgcggaagtaggatcag

SEQ ID NO: 1657 - DNA, 771 bp, Euphorbia peplus
agtaaagatccatttaagagatcacgagcatcaatcaattcacctcctatcttctccgattcgcagcctcaatttttaacaaataaacaacaacaatgtccacgggattcagcggcgatgagactgctccgttcttcggattccttggcgctgctgcggccctcgtcttctcctgtatgggagctgcgtatggaaccgcgaagagcggggttggtgttgcatccatgggtgtgatgagacctgaattggtcatgaaatcgattgttccagtggttatggctggagttttgggtatttacggtttgattattgctgttatcatcagtactggaattaaccctaaggctaaatcttattatcttttcgatggatacgctcatctttcatctggtctctcttgtggccttgctggtctatcggctggtatggctattggcatcgtcggggatgctggtgtcagagctaatgcacaacagccaaagctttttgttggaatgattctaattctcatctttgctgaagctttggctctctatgggcttattgtgggtatcattctttcatctcgagctggtcaatcgagagccgaataaaagattggtccttgtttgaatttgtggttaatgtgggggtgttgtgatttaagagtttatttttgtgtaagataagaataataattattatttttgtataagatagaatgggaaaagtgttttcctactctagaattcaatctctccatttgtatggttcagtggtatttgctgatac

SEQ ID NO: 1658 - DNA, 1115 bp, Flaveria ramosissima
cacataaaaactaccgatgcatcgagattgaagatccaacacacacaaattcatctcttttttcatctccgatccccaaatctcatcaatttcactcccaattcacgacgacaatggcagattccacattcagtggtgatgaaaccgcacctttctttggattcctcggtgccgctgctgcactcgtcttctcatgtatgggggctgcgtatgggacggctaagagtggtgtaggtgtggcttcgatgggagtgatgaggcctgagctggtgatgaagtctattgttccggttgttatggctggtgtgcttggtatttatggtttgattattgctgttattatcagtactgggattaaccctaaggcgaaatcgtattatctgtttgatggatatgcacacctttcctctggtttggcttgtggtcttgctggtctttcggctggaatggccatcgggattgttggtgatgctggtgttagagcaaatgcacagcagccaaaacttttcgtgggaatgattcttattcttatctttgctgaagccttggccctgtacggtctaattgtgggtatcatcttgtcttcccgtgcgggtcaatccagagcagattaagatgacgaaaccttgccatgtatcggtatgtagttattctgaaaaaaatgaagatttattccattttcgtctcggtccccacttaaatctggcagctttcgaacaacacttattgctttcctcaaatttttcttcttggtagcatttctggtctcatttgccatcttgtatggtttttatgcctgtggaataagagttgagaacttgtgtggttctgtacttttgagtcgtactttaagccatgtagaaaccattgctatggcataatgtgtttatgtattgtcgtattgatgttttgttggacggcacgcactctagtttgggttagtcaaggttaggctgggttgggttgggttgggttggttctagtttatgtaggaattttcgaactttctaaaccaaaaatatcattagtcaagttaggttcttaattattatcttttagttgtatgatagttttggttgtaatattgtacatacaatgaaactgtagaaaacaag

SEQ ID NO: 1659 - DNA, 880 bp, Flaveria ramosissima
ccaacacacacaaattcacctctgttttcgtctccgatccccaaatcccttcaatctctctcccaattcacaacgacaatggcagattccaccttcagtggtgatgaaaccgcacctttctttggattcctcggtgccgctgctgcactcgtcttctcatgtatgggggctgcgtatggaacggcgaagagtggtgtaggtgtggcatctatgggagtgatgaggcctgagctggtgatgaagtccattgttccggttgttatggctggtgtgcttggtatttatggtttgattattgctgttattatcagtactgggattaaccctaaggcgaaatcgtattatctgtttgatggatatgcacacctttcctctggtttggcttgtggtcttgctggtctttcggctggaatggctattggaattgttggtgatgctggtgttagagcaaatgcgcagcagccaaaacttttcgtgggaatgattcttattcttatctttgctgaagccttggccctgtatggtctaattgtgggtatcatcttgtcttcccgtgcgggtcaatccagagcagattaagatgacgaaaccttgccatgtatcggtatgtagttattctgaaaaaatgaagatttattccattttcgtctcggtccccacttaaatctggcagctttcgaacaacacttattgctttcctcaaaattttcttcttggtagcatttctggtctcatttgccatcttgtatggtttttatgcctgtggaataagagttgagaacttgtgtggttctgtactttgagttcgtactttaagccctgtagaaaccattgctatggcataatgtgtttatgtattgtcgtattgaatagttaaacg

SEQ ID NO: 1660 - DNA, 946 bp, Flaveria ramosissima
ttcatctcttttttcatctccgatccccaaatctcatcaatttcactcccaattcacgacgacaatggcagattccacattcagtggtgatgaaaccgcacctttctttggattcctcggtgccgctgctgcactcgtcttctcatgtatgggggctgcgtatgggacggctaagagtggtgtaggtgtggcttcgatgggagtgatgaggcctgagctggtgatgaagtctattgttccggttgttatggctggtgtgcttggtatttatggtttgattattgctgttattatcagtactgggattaaccctaaggcgaaatcgtattatctgtttgatggatatgcacacctttcctctggtttggcttgtggtcttgctggtctttcggctggaatggctattggaattgttggtgatgctggtgttagagcaaatgcgcagcagccaaaactttttgtgggaatgattcttattcttatctttgctgaagccttggccctgtacggtctaattgtgggtatcatcttgtcttcccgtgcgggtcagtccagagcagattaagatgacgaaaccttgccatgtatcggtatgtagctattctgaaaaaatgaagatttattccattttcatctcagtccccacttaaatctggcagctttcgaacaacacttattgctttcctcaaaattttcttcttggtagcatttctggtctcatttgccatcttgtatggtttttatgcctgtggaataagagttgagaacttgtgtggttctgtacttttgagtcgtgctttaagccatgtagaaaccattgctatggcataatatgtttatgtattgtcgtattgatgttttgttggacggcacacgctctagtttgggttagtcagggttgttgggttgggttggtctagtttatgtaggaattccgaactatatt

SEQ ID NO: 1661 - DNA, 771 bp, Flaveria ramosissima
acacaaattcaactctgttttcatctccgatccccaaatctcatcaatttcactcccaattcacgacgacaatggcagattccacattcagtggtgatgaaaccgcacctttctttggattcctcggtgccgctgctgcactcgtcttctcatgtatgggggctgcgtatgggacggctaagagtggtgtaggtgtggcttcgatgggagtgatgaggcctgagctggtgatgaagtctattgttccggttgttatggctggtgtgcttggtatttatggtttgattattgctgttattatcagtactgggattaaccctaaggcgaaatcgtattatctgtttgatggatatgcacacctttcctctggtttggcttgtggtcttgctggtctttcggctggaatggccatcggaatagttggtgatgctggtgttagagcaaatgcacagcagccaaaacttttcgtgggaatgattcttattctcatctttgctgaagccttggccctgtacggtctaattgtgggtatcatcttgtcttcccgtgcgggtcagtccagagcagattaagatgacgaaatcttgccatgtatcggtatgtagttattctgaaaaaatgaagtttattccattttcgtgctcagtccccacttaaatctggcagctttcgaacaacacttattcgctttcctctaaaattttctcttggtagtcatttcttgtctcatttgcctttcttttatggtttttatcgtcctgttggaataag

SEQ ID NO: 1662 - DNA, 818 bp, Flaveria ramosissima
gatccccaaatctcatcaatttcactcccgattcacaacgcaatggcagattccacattcagtggtgatgaaaccgcacctttctttggattcctcggtgccgctgctgcactcgtgttctcatgtatgggggctgcgtatggaacggctaagagtggtgtaggtgtggcatctatgggagtgatgaggcctgagctggtgatgaagtccattgttccggttgttatggctggtgtgcttggtatttatggtttgattattgctgttattattagtactgggattaaccctaaggcgaaatcatattatctgtttgatggctatgcacacctttcatctggtttggcttgtggtcttgctggtctttccgctggaatggctattggaattgttggtgatgctggtgttagagcaaatgcacagcagccaaaacttttcgtgggaatgattcttattctcatctttgctgaagccttggcattgtacggtctaattgtgggtatcatcttgtcttctcgtgcgggtcaatccagagcagattaagatgacgaaaccttgccatgtatcggatgtagttattctgaaaaaatgaagatttattccattttcatgctcagtccccactaaaatctggcagctttcgaacaacacttattgctttcttcaaaattttcttcttggtagcatttctggtctcatttgcaatcttgtatggtttttatgactgtggaataagagttgagaacttgtgtggttctgtacttttgagtcatgctttaagccatgtagaaaccattgctatggcattatgtgtttat

SEQ ID NO: 1663 - DNA, 810 bp, Flaveria ramosissima
ccccaaatcccttcaatctctctcccaattcacaacgacaatggcagattccaccttcagtggtgatgaaaccgcacctttctttggattcctcggtgccgctgctgcactcgtcttctcatgtatgggggctgcgtatggaacggcgaagagtggtgtaggtgtggcatctatgggagtgatgaggcctgagctggtgatgaagtccattgttccggttgttatggctggtgtgcttggtatttatggtttgattattgctgttattatcagtactgggattaaccctaaggcgaaatcgtattatctgtttgatggatatgcacacctttcctctggtttggcttgtggtcttgctggtctttcggctggaatggccatcggaatagttggtgatgctggtgttagagcaaatgcacagcagccaaaacttttcgtgggaatgattcttattctcatctttgctgaagccttggccctgtacggtctaattgtgggtatcatcttgtcttcccgtgcgggtcagtccagagcagattaagatgacgaaatcttgccatgtatcggtatgtagttattctgaaaaaatgaagtttattccattttcgtgctcagtccccacttaaatctggcagctttcgaacaacacttattgctttcctcaaaattttcttcttggtagcatttcttgtctcatttgccatcttgtatggtttttatgcctgtggaataagagttgagaacttgtgtggttctgtacttttgagtcatgctttaagccatgtagaaaccattgctatagcataatgt

SEQ ID NO: 1664 - DNA, 1092 bp, Vitis vinifera
cacagaaggagaaaccagtaggcagtaaccacatcattatgtcagttattctgatgctctagtaattccgagtagcaatggagggccttattggaatttcacgttgaataatcatagtcgtccatggtcattattcactctccctcaatcatcatcatcatctccgatccgatctgctaatccgcgttttatctcagaagagagggcttccgatatccctgtaatcaaacatgtctaccttcagcggcgacgaaaccgctcccttcttcggcttccttggcgccgctgccgcccttgttttctcatgcatgggcgcggcctatgggactgcaaagagcggggtgggtgtggcctccatgggagtgatgcgaccggagctcgtcatgaaatcgattgtcccagttgttatggctggagttttgggtatctatgggttgattatagccgttattattagtaccggcataaaccctaaggccaaatcttactatcttttcgatggttatgcccacttatcatctggtcttgcttgtggccttgctggcctctccgccggtatggcaattgggattgtgggagatgctggagttcgggctaatgcacagcagccaaagctgtttgtgggtatgattctcatcctcatctttgctgaagcgcttgctctttatggcctgattgtcggcatcattctttcatcccgagcaggccaatctcgggcagagtaaaggagttgaagactggcatttttcttggagtacttaaattatttttaaaacgtggatcacatactcctactggatggttatatgagacttcataggtccacctgatgtcactgttggaccttttgtatattgagttttattcaaaattccccagaattgcactctatgctgataaattactttgccctttatggagcattaaagaaaacctgactgatgattgtgttgaatctcgttatggatgatttcacagagatttcttcttttagcagctagccttgtcatatgcatttgacaacatgtggcatatgatactatagaacatgcatgtttattaaggcattatgataatttgttatagttcttt

SEQ ID NO: 1665 - DNA, 1896 bp, Vitis vinifera
gcgtaatacaggcccaataggcccacatcaggcccaatagcagacgtgtgactattaaacacttgcaatcatcttccgctgcgctgatcttcaaggagagaatcagagagacagagagaccaagctgattcaagcgacgtcgtttcagatccactatctaaaatgtctacattcagcggcgatgaaacggcaccgtttttcggattcctcggcgccgctgctgccctcgtcttctcctgtatgggagctgcgtatggaacggcgaagagtggcgtcggagtggcgtcgatgggagtgatgaggccggagctggtgatgaagtcgattgtaccagttgttatggctggagttttaggtatttacgggcttatcattgctgttatcatcagtactgggattaaccctaaggccaaatcgtactaccttttcgatggctatgcgcatctctcgtcgggtttggcgtgtggtctggccgggctctcggccggaatggcaatcgggattgttggcgatgccggtgtcagggctaatgcgcagcagcctaaactttttgttggtatgatcctcattctcatctttgctgaagcactggccctatatggccttattgttggcattatcttgtcatcccgagctggccagtccagagcagaataagaaagggactgtactacccagtattcttgtatcgttcattggtaacattttgggaagaaaataacttaattcttctgagatcagcagtggttggtgagcacttgcagggttcaccaatgttttcataatggaagttagtgctccaaaacaatctttctgttctgttatttgtagaagtaggattgagtttatctgcaagaataaaatgcttgtgaaggctgtatttgtttggtatagaaactaggaactctggacctagtgcatgtatgatttttgttttctgcggccttgtgctcatttaactttggcaagtttatacatataatttgaacaatttcttggttcttgtgtttaaattgtttgtgcagtggacaccttaaatggaaattatttatgcagtgcgagagattgtgttggcatcgtgggttccaaacataccggtaacctggtttattgcctaaaatgttgttatgggctgggattggattggattggattgaacgggatgaaagtcatgctttgagcatggacactcccagcttccttccatttccttcttgtaaccccacggtgtgagactcaagggaaaagagggtcggatggatttgttcataataagctaacgagcttggtgtcacagatttgggagtttgttaggtaatcttcctcctcgtcaatcatggcatttaagggttttcttcttgtgatgtcccgcacccagtgtgatctgtcacatagaaaacaatgggtgtcgcctgcgccttgcctgtgtcttccttgccactaggtgtcatgtttgatccctctttagcaacagtgaggcctcttgaccctttaggcaaggtgtgacattggtctgtcttcatccttagaaggcagatgaagttgtgaccctttagcaacagcttagatgaagcttgtttctttttgggtgtgaggttgttggattaaaatgttattgtgtgcccgttttggattcttggatgaaagctgtgccctcagggatgttgatcccttcagtgtgtgccatggagctttggagaaaggccacaacttgacccataataggtttttaaatgtacactagttttgggttggatttcatttctcattgatgcgtttaccctttttgtgcaaggcatgaatctgacctagattttgagtttgggctttggcaaagggaattggcgagagaacccaattcagaaacaacctatatgatcataggtcataacttat

SEQ ID NO: 1666 - DNA, 949 bp, Guizotia abyssinica
gttcacaaaaaaagcttatagaaccaatcgacgtgatctccatattaacatgacacgtgttgaaaggtgagaggaacaatacatcgagattagagatcaaaacacagaaattcaactccgatcaccaaattcgatcaatttcactcccaatttacatcatcaatggcagattccacattcagtggtgatgaaactgcacctttctttggattcctcggcgccgctgctgcactcgtattctcatgtatgggggcagcgtatggaacggcgaagagtggggtaggtgtggcatcaatgggagtgatgaggcctgagctggtgatgaagtctattgttccagttgttatggctggtgtgcttggtatttatgggttgattattgctgttattattagtactgggattaaccctaaggctaaatcttattatctgtttgatggctatgcacacctttcatctggtttggcttgtggtcttgctggtctgtctgctggcatggccattggaattgttggtgatgctggtgttagagcaaatgcacagcagccaaaacttttcgtgggaatgattcttattctcatctttgctgaagccttggccttatatggtttaattgtgggcatcattctttcttcccgtgcgggtcaatccagagcagattaagatgacaaaaccttggcatgtatcggtatgtagttattctgataaatgaagatctattccattttcgtgctcagtccccacttaatctggcagcttttatatttgcttgaaaatttctttttggtagcatttctggtcttgtttgcaatcgtttatggtttttatgactgtggaataagagttgaaaatttgtttagttttgtgcttttgagtcacgctttaagcgctgtacaaaccattgctatggcattttggtgtttatatattaaagttttatgggatggtg

SEQ ID NO: 1667 - DNA, 761 bp, Guizotia abyssinica
tacgggccggggtcctttcacatctcggatcagaattcgatcaatttcacttcagatctccaacaacaatggcgggttcgactttcagtggcgatgaaaccgcgcctttctttggattccttggcgccgctgctgcactcgttttctcatgtatgggggcagcgtatgggacggcgaagagtggtgttggtgtggcgtcgatgggagttatgaggcctgagctggtgatgaaatctattgttccggttgttatggctggtgtgctcggtatttatgggttgattattgctgttattatcagtaccgggattaaccctaaggcgaagtcatattatctgtttgatggctatgcacacctttcctctggtttggcttgtggtcttgctggtctttcagccggaatggccattggaatagttggtgatgctggtgttagggcaaatgcacagcaaccaaaactttttgtgggcatgattcttattctcatttttgctgaagccttggctctatacggtcttattgtgggtattatcttgtcttcccgtgctggtcagtccagagcagattaagaagtgacggcaccctttgccatatatcagtatgtagttattctgaaaacttatgattgaatccatttttatgctcatctggctacttttgaacagcacttatcgctttaccaaaatcctttatttattgcattcttttgcgggttatcctggaataagagtaaaacatcgtgtctgtttgtactttgacca

SEQ ID NO: 1668 - DNA, 715 bp, Hevea brasiliensis
caagtctgcttcaaagcccgattgctttctgacctctaaatatttttagtttcaacctgactcctcttgtttgattccgattagaaatagctataactattatcaactccagaatttttttgatcctaggaaactgaaaatcagagaaaaatggctacggcattcagcggcgatgagactgctcctttctttggcttccttggcgctgctgctgcacttgttttctcctgcatgggagctgcgtatggaaccgcgaagagcggggttggtgtggcgtccatgggtgtgatgagacccgagctggtgatgaaatcgattgtgcccgtggttatggctggagttttgggtatatacggtttaattattgctgtgattatcagtactggaattaatcccaaggccaagtcttattatctcttcgatggatacgctcacctctcttctggtctcgcttgtggccttgctggtctctctgctggtatggcaattggcatcgtaggggatgcaggtgttagagctaatgcacaacagccgaagctttttgttgggatgatcctcattctcatctttgctgaagcattggccctctatggcctcattgttggcatcatcctctcctcccgagctggtcaatcaagagttgactaaaagaggtccttttggtagttgtgtctgttttgaatctcttgattcattaagaaatattctatattag

SEQ ID NO: 1669 - DNA, 915 bp, Ipomoea batatas
ggccggggctgccttctttgcaatcatagaagagagatttttcagatccgatcaaatccgcgatagagaaaagctgagaagatgtctacaaccttcagcggagatgaaacggcgccgttcttcggcttcctcggcgctgcggccgccctagtcttctcctgtatgggagctgcttacgggaccgcgaagagcggggtaggtgtggcgtcgatgggggtgatgagaccggagctggtgatgaagtcgattgtgccggtggttatggctggtgtgttaggtatttacggattgattatcgctgtgatcatcagtaccgggatcaatcccaagaccaaatcgtattatctctttgatggctatgctcacctttcctctggtcttgcttgtggccttgctggcctttctgccggtatggcaatcggcattgtgggagacgccggtgttagagccaatgcacaacagcccaagctctttgttgggatgattctcattcttattttcgctgaagctctggcactttatggccttattgtcggaatcatcctctcttctcgtgctggtcaatctagagccgagtagacgaagaacaaatttgaattattttcaggcacattttattttattttattttgtttatctttattcttttggtccaagattatgtgtgttaattgcttggctagaacaactggttcatatgtgatgatttgcatttgtagattaggtctctcaaataaaactcaggtattctactgttgtatttttctgggaccagaatggattgcctgtattatttattcaaactttttccaaggttaaagctattctcataaaattttctggtcattctaatcttattgtggcaaaataatcttgtgtagaattttttgctaattttatatttcatttattatt

SEQ ID NO: 1670 - DNA, 961 bp, Ipomoea nil
gttcgcacgaacaatatcgtggagagagatccatctattattatatcccaaaactcaagacctctctctctgttcagagttcagacgctaaatctcagatcccaaatcccatcaaaagatccgaacaatgtcttcgactttcagcgacgatgaaactgctcccttcttcggcttcctcggcgccgctgccgctctcgtcttctcctgtatgggagcagcctatggaacggcgaagagtggcgtcggagtggcgtcgatgggagtgatgaggccggagcttgtgatgaagtcgatcgtgccggtggttatggctggtgtgcttggtatttacggattgattattgctgtgatcatcagtactgggattaaccccaaaaccaagtcttactacctattcgatggatatgcacatctctcttccggtctcgcttgtggcctcgccggactctctgccggaatggccatcggaatcgttggcgatgccggtgtcagggctaatgcacagcagccaaaactttttgttggaatgatccttattctcatttttgctgaagctttggccctttatggtctcatcgtcggcattatcttgtcttctcgagctgggcagtctagagcagagtaaaaaggaggatatgatttatgtccttagaaggctgtggtagaaagtcaatttttatgaagcacgtacgagaagctattgaggtttgttgtcgttcttcattctggcactattaagagtcataaggaataagcttaattatgaagccagtcactggtcttttccctttagcgagtacttttgggttattatatatcgtttctgaattatgtacaaccctttttccccccttttgagctctgatctgtacacctatgatatttatttgattcctactttattttactcattgcatgaatgcatggtggtgtatgaacctgttcagtgttactataacca

SEQ ID NO: 1671 - DNA, 945 bp, Jatropha curcas
attccttgtctcatcccaatcgacggtacatgtctctgtaacgccgagaaacttcttctctcgcaatcgattcaccgatccaattctccaaaatttctaatggcaactggttttagcggcgatgaaaccgctcctttcttcggcttccttggcgccgcggcggccctcgttttctcatgtatgggagctgcctatgggacagccaagagcggtgttggtgtagcatcaatgggcgttatgagaccagagctcgtgatgaaatctatagttcctgttgttatggctggagtgcttggtatttatggtttgattattgctgttattattagtactggaattaaccctaaagccaaatcatattacctcttcgatggttatgctcatctttcttccggtctggcctgtggtcttgctggcctttctgctggtatggctattggtattgttggagatgctggcgtcagagctaatgcacagcagccaaagctttttgttggcatgattctcattctcatttttgctgaggcactggctctttatggactcattgttggcatcatcctttcttctcgagctgggcaatctcgagcagaatagaatagctggctgttggcatcactggttattctcaggtcggtgatgccggtgaagattgtgcaggtgttttatgaagtcatttatcatgcatgttagttgaccatcgaaataaagcttgtcatgctctacatttttgttgtattcttcatatattagttgaaccttgaaaactagtgtgcacattatttggttatttgttatacacttgtctttttgttttgatcatcagctaatgtgctactgtaatggaataattgcacgccgctaatagcccgtttctctgtctctttcatgcctcgtgtgattatgtattgatatgtttgtaaaatgtaactacttagtctgcaa

SEQ ID NO: 1672 - DNA, 914 bp, Lactuca sativa
gcgggggagtgatctcaatgtaagacagtgttggaacgtgagaggaacaacgcataaaacgatctaacacgttgagattagagatcgaggcaaagagattcaactctgtctgcacttctctgatccaaattcgatcaatttcactcccaattccgatcaacaatgggttccgattcattcagtggtgatgaaaccgcccctttctttggatttctcggcgccgctgctgccctcgtcttctcctgtatgggggctgcgtatgggacagcgaagagtggtgtaggtgtggcatcgatgggagtgatgaggcctgagctggtgatgaagtccattgttccagttgttatggctggtgtgctcggtatctatggtttgattatcgctgtcattatcagtaccggaatcaaccctaaggccaagtcttattatctttttgatggctatgcacacctttcctctggtttggcttgtggtcttgctggtctttcagccggaatggccattggaattgttggtgatgccggtgttagagcaaatgcacagcagccaaagctttttgtggggatgattcttattctgatctttgctgaagccctggctttatatggtctgattgtgggtatcatattgtcttcacgtgctggtcaatccagagcagattaagatttcaggaatcaagaaccacacggtatgtagttattctgagaaatgaagattcatgatgaacaaacaaattctctaaaattttctgattcgtagcatttctggcgttatttgcattcttttatggtgtttttatatatggcgactttggaataagaccatggtttggttataaacatgtgtcgcttttgtactccttttattcatgttttgttcatttcttttgaaataatatatgatgaaatgaaaca

SEQ ID NO: 1673 - DNA, 866 bp, Glycyrrhiza uralensis
gcaaaccaaaccaaaccaaatagccaatcaatctatctagatctatatcatcatcgatcgacattacttcacacttccattcattcatctcccaaagagaaagaagaaagaggagaatctaaatccaattaggccttaataataacaacagccatggcaggcttcagcggcgacgaaactgctcccttcttcggcttcctcggtgccgctgcggccctcgtcttctcctgtatgggagctgcatatggaacagcgaagagtggagtgggggtggcttcaatgggtgtgatgaggcctgagcttgtgatgaagtccattgtcccagtggttatggctggagtgctgggaatttatggcctcatcattgctgtcatcatcagtactggaattaaccccaaggctaagtcttactatctctttgatggctatgctcacttgtcctctggtcttgcttgtggccttgctggtctttctgctggaatggccattggaattgttggtgatgctggagtcagggctaatgcccagcagccgaagctgtttgttggtatgattcttatcttgatttttgctgaagctcttgctctctatggcctcattgttggtatcatcctctcatcccgagcaggtcaatcccgtgctgaataaaatgaaaccaagtcagtgatagctggtagtccatccattataattacagtacctgtcttgcatttgaaatgggacatgttttactttagtagattattactattatttcatttattctcgtacacaaactatgtatctgaactctgtcagttttgtgaagtgttttccaatggattattcattttggatgactgcataatgatatgatatattgatac

SEQ ID NO: 1674 - DNA, 1070 bp, Lotus japonicus
agacgggtagtacgggattgggcatagaaaatccacgtcttcttcttattctctccactccttctgcaacacaacagattacagatctctctctctctcccgattccaatttgaatttctcagatctattcgacgtcgttgcaccgtgatggctggcttcagcggtgatgaaactgcaccgtttttcggcttccttggagccgcagctgcccttgtcttctcctgtatgggagctgcgtatggcacagcaaagagtggtgtgggagtggcttccatgggtgtgatgagaccggagttggtgatgaagtctattgttcctgttgtcatggctggagttttgggtatttatggccttattattgcggtcatcattagtaccggtattaacccaaaggccaaatcttattatctctttgatggctatgcacatctctcctctggtcttgcctgtggcttggctggactctccgctggcatggctattggtatagttggcgatgctggtgttagagccaatgcacaacagccaaaactttttgttggaatgatcctcattctcatctttgctgaagctcttgccctttatggtctcattgttggtattatcttgtcttctcgtgctggccagtctagagctgagtaagaaaggagctctgccgcaaaatattctttcaccacccatctgttcaatcttccttataaaggtgatgcagtaaattattagtggatgcgatgttagtgatgttcgagcagcatttgcaggctataacagttacttgtgtgaaagttcaatccaccatttctggtgtttctttgtacaagtaggtcgatctttgcttaataaagcttcattaagcttcctcttttgttctttattaattaaatgtattatgtcacaacatctcggagattatatatatttttggatgctggaactagtgcatgtatgttttggctagaaatggaacatattttgtgagtccttccatattggatgtttttaacagctgctatgttgtatgtatagcctatgtttatggaaaattaatctttttgttgtttgtgagagc

SEQ ID NO: 1675 - DNA, 1115 bp, Lotus japonicus
cccagagaagagaaagcgatactattaaataataatctttaataatgtccaacaataataaataaaattatagatctccttcttcttcttcttcatcagaaattctcatctcctcgcgattctcagaatggctggtttcagcggcgatgaaactgctccgttcttcggctttctcggcgccgccgctgcccttgttttctcctgtatgggagcggcttatggcacggcgaaaagtggtgttggtgtggcgtcgatgggtgtgatgagaccggagcttgttatgaaatccatcgtccccgtcgtcatggctggtgtgttgggtatttacggcttgatcatcgctgtgattatcagcaccgggattaaccctaaggcgaaatcttactatctatttgatggatatgctcacctttcttctggtctcgcttgtggtctcgctggcctctccgctggcatggccattggtattgttggcgacgctggtgttagagcaaatgctcagcagccaaagctttttgttgggatgattctcattctcatctttgccgaagcgttggcgttgtatggtctcattgttggcatcatcctctcttcccgagctggccaatccagagctgagtaatataaaatttcatgttgctagtagcgtgcaggaccatggattgtggcttttggctgggactttggcttagtacaagtggaggtttgtcatgctctttattcgttttatgactcttttctactcgttatgaaattcaggttatcctggaataaagcctgtcaaactatttctttggagtaattgtatttaattatgttgaattcaatctaggttagctatctatgtaataaaacagatgtctgtgttgattcaataatgtttagtattgtgttctgtactgttaaacaccttagcccctcccccgaccccatatctctttatataaatggtatcagttctgaacattatggatcattttcacttgcaagtctggctaatgattcgtgtaggtcatggatagaagattcatgaacatcgctgtatgtgttattttctactcgtgaacattctgaaaagtaacggctgaaattgccaatacacttatcctactaca

SEQ ID NO: 1676 - DNA, 811 bp, Lotus japonicus
tttttctgatctgatctctgcaaaaaccaatcgatcaaatcttcctcaacacgctccttcattcactttccttcatcaaacactctccgcttagcgacggaaacaacaaccatggcaggcttcagcggcgacgaaactgctcccttcttcggcttcctcggcgccgccgccgcactcgtcttctcctgtatgggagctgcatatggaactgcgaagagtggagtgggagtggcatcgatgggagtgatgagacctgagcttgtcatgaaatcgattgtgcctgtggttatggctggtgtgcttggaatttatgggttgattattgctgtgattatcagtactggaattaaccctaaggctaagtcttactatctctttgatggatatgctcacttgtcttctggtcttgcttgtggccttgctggtctctctgctggtatggctattggaattgttggtgatgctggagtcagggccaatgcccagcagccgaagctgtttgttggtatgattcttatcttgatttttgccgaagctcttgctctgtatggtctcattgtgggtatcatcctctcatcccgagctggccaatctcgtgctgagtaaaatgaagccaaatcagtgatagctgggtagtacgttataattttactatctgtcttgcatttgaaatcagaatacttgactttggtatattactattaattcatttattttcgcagacaagtcctgtatctctaaactctgttagtttcatggattattcattttggttggctgataatgatattatacttgtttgtcgaaaaaa

SEQ ID NO: 1677 - DNA, 923 bp, Tropaeolum majus
ttatcaccactaccatattctccctcttcccccgatccgatctcctaatctctctgattcttcttcttctctcgtggaaaaaaaaaaaccccatttgaatcaaaacgtaaagaagaacttgttaccgatctcaattcaatcgaaggattgacctaattgcagcttctttaagttcataaacaaggaaaatcatcatcatggctggtttcagcggcgacgagactgctcctttcttcggcttccttggagcggccgctgctcttgttttctcttgcatgggtgctgcctatgggacagcaaagagtggagttggtgtggcatcaatgggagtcatgcggccagaacttgtcatgaagtctattgttcctgtggttatggctggagtgttggggatttacgggttgatcatagctgttatcatcagtactggtatcaacccaaaagcaaagtcatactatctctttgatgggtatgcacacttgtcatcaggtctcgcttgtgggcttgctggtctctccgctggaatggctattggtattgttggtgatgctggtgtcagggctaatgctcagcagcctaagctgtttgttggtatgattcttatcctcatctttgctgaagctcttgctctctatggtctcattgtggggatcattctctcatcacgagcaggacaatctcgagcagagtaaagaatgcatcttgtacaatttatgatggtggggatctgcaccatcggaagttgaacttgttatgtgaaaaattgttttttcgttattattttgcccttctcaagtgtcaccaccttgattcataaaaagaaagttttgtgccctggattgacaatcagttgtttgaaattgtgttgctgaatgacttgagtttttcttcttaagcctaatttattgaagaacatatttatt

SEQ ID NO: 1678 - DNA, 1018 bp, Tropaeolum majus
cgtccgaagacacggtagttctaacgaccgaacgaagtagggtccgactttaacggtcccggggaacggacgagtggtagtcaacgcacagtgccattacgccgggacgacacggatcattttaaaaggtccatccaccaacaccaaacctgtaaacgcaacggttttcagatccgaatttatcatatagtcttcctagatccgtcatctacaatggttgctggattcagtggagatgaaacagcacctttcttcggcttcctgggcgccgcagccgcgcttgtattctcctgtatgggagctgcatatggaacagcaaagagtggtgttggtgtggcctctatgggtgtgatgaggcctgagttggtgatgaagtcaattgttccagttgttatggctggtgttttgggtatttatgggttgattattgctgttattattagtactgggattaacccaaaggcaaaatcttattatctctttgatggttatgcacatctctcatctggtctcgcttgtggtcttgctggcctttctgccggaatggccattgggattgttggtgatgccggtgtcagggctaatgcacagcagccaaagctttttgttggaatgattcttattcttatctttgccgaagcacttgctctctatggtcttattgttggaatcatcttgtcatctagagctggccagtcccgagcagaatgagatgagggacccttgctggttagtaatctttttctctaggtctcactctgtggaaaaagattattcgatgttgtgtctagtaaacagcgaaaatcatttacaggattttcaccccataatttgttattgactgctccgctagtcatttgttggttgctcggtctggtcctatttgtagctgtagtaccgagtgtctaataaaaaaactgtgaaagctccctgcttagctttgttttatcatggtttattgtagaactaaaaattcgttatgaacatcggattttggaactaatttgtagatgatttt

SEQ ID NO: 1679 - DNA, 1115 bp, Tropaeolum majus
ggttctctcacttcatctccttcctcccccctccaccctctgcaacaatccttctctttcttctttcttgaagaagttctaagaaaacgtgtgaatttcatccaaatcaaggtccacaccacaactgtagatattcattctctccagatctctgcatccaaacgagaaaagcaacagacatggctggtttcagcggcgatgagactgctccctttttcggcttccttggagccgctgctgctctcgtcttctcttgtatgggtgctgcatatggaactgcaaagagtggggttggtgtggcctcaatgggggtcatgcgtcctgaacttgtcatgaagtctattgttcccgtggttatggctggagtgttgggaatttacgggttgatcatagctgttattatcagtaccggtatcaacccaaaagccaagtcatattatctctttgatgggtatgcacacttatcatcaggtcttgcttgtgggcttgctggcttgtctgctggaatggctattgggattgttggtgatgctggtgttcgggctaatgctcagcagcctaagctctttgtgggtatgattcttatcctgattttcgctgaagctcttgctctctatggcctcattgtgggtatcattctgtcatcacgagctggtcaatctcgagccgagtaaaagaaggccaagcaaaactcatattttgtgagatcgtcttgtataattatgacatgggatctgcaccaaattgttttatttacatttgttatttttcattattgtgtcttttaccatgattggcaactagttcagtacattatggatttgatgtatttgccttgtgacttgaatttttttgtgcttctccggattacatgaactacatgttttaagcctggcttgtattgactattcattcaattacttaaactctgctcaccagttgcccctaatgcaaccttaagggctcggttagaaacatgaagtttaagcttccattttagttaggcgttaacgtgattttaatgtggatggtagtcgaagctattttgtatatcactatcgttcatattttgtttcctcctataaaaaatgtgttactgactaaaaaaaaaaagg

SEQ ID NO: 1680 - DNA, 919 bp, Nicotiana benthamiana
agatcaatcgtaaagtaaggaccagacattctcagattatattctcagattacgatcaataagctttttcccctctcagatcgcgaatcgcttcaactccaattcgaagaaaaaatggcatcgacttttagcggcgatgaaacggcaccgttcttcgggttcctcggcgctgcagctgccttagtcttctcctgtatgggagctgcttatggaacagcgaaaagtggggtaggggtggcatcgatgggagtaatgaggccggaattggtgatgaagtcaattgtgccagttgttatggctggagttttgggtatttatgggttaattatagctgtgattattagtactgggattaacccgaaaacaaagtcgtattatttatttgatggatatgctcacctttcatctggacttgcttgtggtctcgctggcctttctgctggtatggctattggaatcgttggcgatgctggtgttagagctaatgcacagcagccaaagcttttcgttgggatgattctgattcttattttcgctgaagcgttggctctttacggccttattgtcggcatcatcctctcttctcgcgctggccaatctagagcagagtagagaaagatcctctcgtgttccatatttgtgtagtatctttgtgttcttcctcgttggacgagtgagtttggctgttaaatcacattttgttttgatttgggctccaagattatgtatttgtttgcgtggctagagaattggttacgtgcagatcagctgtagattagatctctcaataaggatatcagtttttctgatgctccatttttgagtgacaacaatggatttttgtaaaatgttgcatgtattattcgatctcaactttaatttaagcatttgtaattgtttctggtccttgcattctcta

SEQ ID NO: 1681 - DNA, 855 bp, Nicotiana benthamiana
gagacattctcagattatattctcagattacgatcaataagctttttcccctctcagatcgcgaatcgcttcaactccaattcgaagaaaaaatggcatcgacctttagcggcgatgaaacggcaccgttcttcgggttcctcggcgctgcagctgccttagtcttctcctgtatgggagctgcttatggaacagcgaaaagtggggtaggggtggcatcgatgggagtaatgaggccggaattggtgatgaagtcaattgtgccagttgttatggctggagttttgggtatttatgggttaattatagctgtgattattagtactgggattaacccgaaaacaaagtcgtattatttatttgatggatatgctcacctttcatctggacttgcttgtggtctcgctggcctttctgctggtatggctattggaatcgttggcgatgctggtgttagagctaatgcacagcagccaaagcttttcgttgggatgattctgattcttattttcgctgaagcgttggctctttacggccttattgtcggcatcatcctctcttctcgcgctggccaatctagagcagagtagagaaagatcttctcttgttccatatttgtgtagtatctttgtgttcttcctcgttggacgagtgagtttggctgttaaatcacattttgttttgttttgggctccaaggttatgtatttgtttgcgtggctggaagaattggttacgtgcagatcagctgtagattagatctctcaataaagatatcagtttttctgatgctccatttttcagtgacaacaatggattttgtaaaatgttgcatgtattatttgatctcaactac

SEQ ID NO: 1682 - DNA, 1157 bp, Quercus alba
tccttccacccaattcgagttcgacaaccaaaacaaaacaaaacaaaacacacaatttcccaaactctctctctttctaaaagcgaacaatttccgatcaatttcccaaactttcccaaatcaaaaacaaatcctagaattcagaaaaaaaaaaatgtcttcttcttcagtattcagcggcgatgaaaccgctccattcttcggcttcctcggagctgcggctgccctagttttctcatgtatgggagctgcttatgggacagctaagagtggagttggggtggcatcgatgggtgtgatgcgaccagaactggtgatgaaatcgatcgtgccggttgttatggctggagtcttaggtatttacggtttgatcattgcggttattattagtaccgggattaaccctaaagccaaatcgtattacctttttgacggttatgcccatctctcctcgggtctatcttgtggtctcgctggcctctccgctggtatggctatcggtatcgttggcgatgccggtgttagagctaatgctcaacagccaaagctttttgtcggaatgattcttattctcatctttgctgaggccttggccttgtatggtctcattgttggtatcatcctttcttctcgagctggccaatccagagcagattagagaaaggttttctgcaagctgctgatgttggtgttgtaggtgttgctcaaggtttgtgatgcatactaagtgggcaatcttgtgtcgagttattcattctgtatgtggactttccattacattttatagaggttctctgctaatttggaggtgagtttcaaaataaagcttgctgggccgttgctttacctgttgctgtattgtagatgttagcttaaactagtctagaaactgtctttgaggcagatccctgtcaaacattcactttacatttctgatcgtcattattgtacttaaagttgtgtttctagactttctgtatgtctgtgtgtgtgtacttgaagaaatgtttctagtatggtctattctttaactctgtgagagagagattaagattcctgtactgtagccatttgttgcttgttggggtgtacttgatggagcctgaattctagctttggactggtaacaaaaaatatgagagtatatgttgtgtctc

SEQ ID NO: 1683 - DNA, 767 bp, Elaeis guineensis
gtttggccgtaagcccactggtctcctcctctccaaccgaagaaatagaaactaggatttccaagatctagggtatctccaatctctccaaacatgacggactttagcggcgacgaggtcgcccccttctttggattcctcggagccgcggcggcgctcgttttctcctgcatgggggcggcgtatggtacggcgaagagtggtgtcggggtggcttcgatgggcgtgatgcggccggagctcgtgatgaagtcgatcgtgcctgtggtcatggccggagtcctcgggatctacgggttgatcatagccgtgatcataagtaccgggattaaccccaaggccaagtcttactacctcttcgatggatatgcgcatctctcgtcggggctcgcttgcggccttgctggcctttctgcaggcatggcgatcgggattgtcggtgatgcaggtgtcagggccaatgcgcagcagccaaagctatttgttgggatgattctcattctcatttttgcagaagctcttgcactctatggtctcattgttggtatcatcctttcatcccgggctggtcaatcccgtgcagactaagaacgtgagcagctggccatgtattctctgttctccctatgttcatataggacatgagctaagcgttataattgttttgttattatactgtgattcatttaaggactttgttatgaatgggggcctcattgttcgacttgtctgttatcagtcttttctataacgtgtcatttttatct

SEQ ID NO: 1684 - DNA, 590 bp, Parthenium argentatum
caaccctaatttcacacctccgatcgtaatccgatcaattcactccagatctccattaacaatggcaggttcaacattcagcggtgatgaaactgctcctttctttggattcctcggcgccgctgctgcactcgtattctcatgtatgggggctgcttatgggacggcgaagagtggtgtaggtgtggcatctatgggagttatgaggcctgagctggtgatgaaatctattgttccggttgttatggctggtgtgcttggtatttatggtttgattattgctgttattatcagtaccgggattaaccctaaggcgaagtcttattatctgtttgatggatatgcacacctttcttctggtttggcttgtggtcttgctggtctttccgctggaatggccatcggaatagttggcgatgctggtgttagagcaaatgcccagcagccaaaactttttgtgggcatgattcttatcctcatctttgctgaagccttggccttatacggtctcattgtgggtatcatcttgtcttcccgtgcgggtcagtctagagcagattaagaagtgacagcacctttgccatatatcg

SEQ ID NO: 1685 - DNA, 1049 bp, Arachis hypogaea
aaggaaccgcctcgccgggggactcaatcaaacaaaaactaaaatcgcagcatacgaacacacagttaatagatctcctccttctcctcctccctctcctcgatccattctttcttctcacgatcgccggatcccaactttaatcaacaaagcatggctggtttcagcggcgatgaaactgctcctttcttcggattcctcggcgctgccgctgccctagttttctcctgtatgggtgcggcttatggcactgcaaaaagtggggttggggttgcatcgatgggtgtgatgagacccgagcttgtgatgaaatcaattgtgccagttgtcatggctggtgtgttgggtatctatggtttgatcattgcggttatcatcagtactgggattaaccctaaggccaaatcttactatctctttgatggctacgctcacctttcttctggtttggcttgtggccttgctggtctctctgctggcatggctattggcattgttggggatgctggtgttagagcaaatgcccaacagccaaagcttttcgttggaatgattctcattctcatctttgctgaggcgttagcgttgtatggactcattgttggcatcatcctttcttcccgtgccggccaatccagagctgaatgattaatagagagttccctgttggttgtggtgcacagacgcgtagattgtgaatgttaccagggattttgtattggcaagctttttagctttgtcatgctcctcattcgtcttttgcaggttatccaggaataaaacccgtcaaactatttatttggtcatcactgtgtttagtatgctcgattcgatctagattggatttctctgtaataaaacagatgtttgtgttggttactatattgtttaattagtattatttcatactcttcagtcaagtctctctttatgattttggaactataaatgttgatatgacttcgtgtagtgtcttaattcttgtatgaaggtggattgctatgtcaaattaaagatttcatagtgccttagccgtgtttgtgaagtac

SEQ ID NO: 1686 - DNA, 901 bp, Arachis hypogaea
tttagttttagatctgatctctccatctctccagacaccaccgagattatgttcttacttcttagcactctaacatcatccactacaatctttcccatctcatctttcaaaaccaaaagagaagacaagacgggtgccactgtaagtaagtgatcgaaatcaaagatggcaggcttcagcggcgacgaaactgctcctttcttcggcttcctcggtgctgctgctgccctcgtcttctcctgtatgggagcggcgtacggaacggcgaagagtggagtgggagtggcgtcgatgggagtgatgaggcctgagcttgtgatgaagtcgatagtgccagttgtgatggctggcgtgcttggtatttatggcctcatcattgccgttatcatcagcactggcattaaccctaaggctaagtcttactatctcttcgacggttacgcccacctgtcctccggcctcgcctgtggcctcgccggtctctccgctggcatggccatcggaattgttggtgatgctggcgtcagggctaatgctcagcagccgaagttgtttgtcggaatgattctgatattgatttttgctgaagctcttgctctctatggccttatcgtcggtatcatcctctcatccagagcaggccaatcccgtgctgagtgaaacatcataaaccaaattagtcattgctgctagtagtcacttaaaattttagagtctggcttctttttggattggaagttggaacagtttcatttgagtagagttctattatttcattttatttagaaccccaaatattgtatcagaaatattagttttgtgatgatgtattctcctgcggatgattcatttggatgtttgcttaattaatgatatgatactttattttttgttttgcaaa

SEQ ID NO: 1687 - DNA, 703 bp, Petunia hybrida
actccaaactaaaaatatttcagtagtataatttagaattgttcagatccaaaatccgatcaacaaaatgtcttcgagtttcgccggagatgaaactgctccctttttcggtttccttggcgctgctgccgccctcgtcttctcctgtatgggagcagcttatggaacagcgaagagtggtgttggagtggcatcaatgggagtgatgagaccggaattagtgatgaagtcgattgttccggtggttatggctggtgtgttaggtatttatggtttgattattgctgtcatcatcagtactggaattaaccccaaaacaaagtcgtattacctatttgatggctatgctcatctctcgtccggtcttgcttgtggtcttgctggcctttctgctggaatggctattggtattgttggtgatgctggtgttagggcaaatgcacaacagcctaagctctttgtggggatgatcctcattctcatttttgctgaagctttggctctttatgggcttattgttgggattattttgtcttcccgagctgggcagtctagagctgagtgaaattaactctatacttaccgcctgcatgagagacttcagaagaacaaggcagctaaattcagaaagtatctatttcgtgtaccaatatccatatgatgccactgctgccacttcataatgtggtgctatgtgctgttt

SEQ ID NO: 1688 - DNA, 957 bp, Phalaenopsis aphrodite
caccatctcacctcatccgcaacaacgctggcagtttattaaccaaacaaccgtcggctaagaaactgaccattccttccgaataaatctcgtctttgttcttaggttacttccatcctcttcgtcgcgcaaaggaatcagaaggaataatcaggaagagttcaatttgaagttaaaaggatttccaggttcgagaatttctgaaagaatggttggctttagcggcgatgaaacggctcccttcttcgggttccttggcgccgcagcggcgcttgttttctcctgtatgggggcggcctacgggactgcaaagagcggcgtaggcgtggcctcgatgggggtcatgcggccggagcttgttatgaagtcaattgtgcccgtggtcatggctggtgttcttggtatctatggattgattattgcggttattattagcacgggaattaatcccaaggccaagtcttattatctatttgatggatacgctcacctctcttcgggtcttgcatgtggtcttgctgggctatcagccggcatggctattgggatcgttggtgatgctggcgtgagggctaatgctcagcagccaaaactctttgtaggcatgatacttattcttatttttgctgaagcactcgccctctacggtctcattgttggcatcatcctctcatctcgagctggtcaatctcgtgcggattaagataaaacaagtttgtaggctgtatccttgctttgtatctgttgagtgattctagctttgtgatctatatcatctgtatttattaattgttaccgagagcttcttgtctgcttgttgtttatagatttgttgtgtctttttgggagtatcattatcaaatgaagcctttcatgatgcatttgacaatcttatcagtaagagggttgtggcattggttaccaaaactattgactgttatggtttggatctctgtt

SEQ ID NO: 1689 - DNA, 808 bp, Phalaenopsis aphrodite
aggtctccggttgcgatcgatatcaaatatggtgggcttcagcggcgacgaaactgcccccttctttggattcttgggcgccgcggctgcccttgttttctcctgcatgggggcggcgtacggcacggcgaagagcggcgtgggcgtggcttccatgggggttatgaggcccgagttagtgatgaagtcgatcgtgccggtagttatggccggtgtgctcggcatctacggactcatcatagccgtcattatcagtactggtataaaccctaaggccaagtcttactacctctttgatggatacgcccatctttcctcgggcttggcttgtggtcttgcgggcctctcggcgggcatggcaattgggatagtcggtgatgcgggtgtcagagcaaatgcacagcagccaaaactattcgtgggaatgattctcattctaatttttgctgaagccttggccctatacggcctcattgtgggcatcatcctttcatctcgtgcaggtcagtctagagccgactgaggggaaaaatatgaatctctgttcctctgcggctcggtgcctaatctggctatcgaacaatcatgtgcttttatttacgtctactttggttctttgaacttggtggttcaaatatctgtaaactagatgcttaaatggagctttattctgttttatgcaaacacggcccataaattacatgcctgtagaagattgatatggaatttgtgaaattaagcccagtgcctgtccatttaatacgagaaatggtttctgattgtggtctttattttatatgggtagtca

SEQ ID NO: 1690 - DNA, 980 bp, Phalaenopsis aphrodite
ggcaccatctcacctcatccgcaacaacgctggcagtttattaaccaaacaaccgtcggctaagaaactgaccattccttccgaataaatctcgtctttgttcttaggttacttccatcctcttcgtcgcgcaaaggaatcagaaggaataatcaggaagggttcaaatttgaagttaaaaggatttcaaggttcgagtatttctgaaagaatggttggctttagcggcgatgaaactgctcccttcttcgggttccttggcgccgcagcggcgcttgttttctcctgtatgggggcggcctacggaactgcaaagagcggcgtaggcgtggcctcgatgggggtcatgcggccggagcttgttatgaagtcaattgtacccgtggtcatggctggtgttcttggtatctatggattgattattgcggttattattagcacgggaattaatcccaaggccaagtcttattatctatttgatggatacgctcacctctcttcgggtcttgcatgtggtcttgctgggctatcagccggcatggctattgggatcgttggtgatgctggcgtgagggctaatgctcagcagccaaaactctttgtaggcatgatacttattcttatttttgctgaagcactcgccctctacggtctcattgttggcatcattctctcatctcgggctggtcaatctcgtgcggattaagataaaacaagtttgtaggctgtatccttgctttgtatctgttgagtgattccagctttgtgatctatatcatctgtatttattaattgttaccgagagcttcttgtctgcttgatgtttatagatttgttgtgtctttttgggagtatcattatcaaatgaaacctttcataatgcatttgacaatcttatcagtaagagggttgtggcattggctaccaaaactattgactgttatggtttggatctctgttcaaattattgttcaatttcg

SEQ ID NO: 1691 - DNA, 796 bp, Phalaenopsis aphrodite
cataagatccattagacacgtctggatagggtttcattttcgataatggcgggttttgctggcgatgaaactgctcctttcttcggcttcctcggcgctgcggcggcgctcgtattctcctgcatgggggcggcatatgggacggcgaagagcggcgtcggcgtggcctcgatgggagtgatgcggccggaacttgtcatgaagtcgatcgtcccagttgttatggccggagttctcgggatctacggtttgatcattgcggttattatcagcacgggaataaatcctaaggcaaaatcgtattacctttttgatggatatgctcacctctcttccggacttgcctgcggtctcgctggattgtccgctggaatggccattgggatcgttggtgatgctggtgtgcgggccaatgctcagcaaccaaagctgtttgtgggaatgattctgattcttatttttgctgaagcgctcgctctttacggtctaattgtcggcatcattctctcttctcgagcaggtcaatctcgcgcagactaagattaactcctgctcttccttcttcatggctctttgtaacgttaatcatggttggagtttttaatttaactttaggattcctttatgattgtatttaagacattaatgatcatactcattaatgtctaatggtttgtcccatggattgcttacctttggcattattatttcatgagtgaatatagttggttggcatgtttttttctagggaaatttatatatgcaactcacaattctttatttatttacatttctc

SEQ ID NO: 1692 - DNA, 1034 bp, Cajanus cajan
caggaagtgaggaacgcgagattataaagggaatggacgtggaaaccccacgtctcttcacggcaacagaatcatcgagacacagagagatcgggcttgtccgtagaatttgaatttctcagatctatccgacgtcgttgcagatccatcaacggtcatggctgccttcagcggtgatgaaacggcaccgtttttcggcttcctgggagccgcagctgcactcgttttctcctgtatgggagctgcctatggcacagcgaagagtggcgtgggcgtggcttccatgggtgtgatgagacctgagctagtgatgaagtccattgttcctgttgtcatggctggagttttgggtatttatggtcttattattgcggttattatcagtactggtattaatcctaaggccaaatcttactacctctttgatggttatgcacatctttcctctggtcttgcctgtggcttggctggcctctctgctggcatggctattggtattgttggtgatgctggtgttagagccaatgcacagcagccaaaactttttgttggaatgattctcatactcatctttgctgaagctcttgcgctttatggtctcattgttggtattatcctgtcttctcgtgctggccagtctagagccgactaagaaaggagttgtgctgcaaaatattctttgaccacccatcgtttttaaccgccttataaagggggtgagggaggtaattattagttcttgcgaggttagtgatgttcaggcagcatttgcagactttagcagttgtgtgaaagttcaattcgccatttgtggtgtttgtttgtataattaggtctaccttttcttaataaagcttcttaagcttcctcttttttcctttattgattgtattatgccatatcatctctgaccatatatatattttttgggctgctgaaaactggtgcatgtaacgatttgatttggctaccaatgaatcatatttcatgggtcttttcatgttggatattggtaacagctgttttttgtgtta

SEQ ID NO: 1693 - DNA, 1058 bp, Cajanus cajan
tgggcaaaaggcgaaaaggcagagaagaagaaagaagtaaaaaagaaaagagagagagagagagaggaagtagcgatcagagagcaaccgccacagatctccgtttcccaccaaccaaacaaacgaaaaatggctgccttcagcggcgacgaaaccgctcctttcttcgggttcctgggagccgcggcggccctggtgttctcctgcatgggagcggcgtacggcacggcgaagagcggcgtcggggtggcgtcgatgggcgtgatgaggccggagctggtgatgaagtcgatcgtgccggttgtgatggctggtgtgttgggtatctacggtttgatcattgcggttatcatcagcactgggattaaccctaaggccaaatcgtattacctcttcgacggttacgcgcacctctcttcgggcctcgcctgtggcctcgctggcctctccgctggcatggccatcggcatcgtcggcgatgccggtgttagagcaaatgctcagcagccaaagctttttgttggaatgattctcattctcatttttgctgaggcattggcattatacggtctcattgttggcatcatcctttcttcccgtgctggtcaatccagggctgattaatataaagtttcctgtcggatgtggtggtacacggccacagattgtgaatgttactgcagagtcgaggtggttaatgttagctcacagactgctgctttggcttgctcatgtgattctatttatgttcgtgttataaaattgaggctatccagaaataaagtccgtcaaactcttcttagcccctcattattttaattatttgctcagtccatactagagtagagatctgcataataaggcagatgtatgtttagattccatttctttagtattgttctctactcttcaaaacactccccacctacccctaaatctattcttatttgatttcatggagatatgatttgtcgatatgacttcctttatatcattttaatcaacaagatagtattcttgctcctatttgatgtgaagtaaataagataagtattgcg

SEQ ID NO: 1694 - DNA, 1035 bp, Cajanus cajan
cctccacagtgtacggtaacagagatcgggaagtggaacccctctgtgcggaaatcggaatatctcagttctccgatcagatctatacgacgtcgttgcagcgataatggctccgttcagcggcgatgagacggcaccatttttcggcttccttggagccgcggctgcactcgtcttctcctgtatgggagctgcctatggcacagcaaagagtggggtgggcgtggcttcgatgggtgtgatgagaccggagctggtgatgaagtctattgttcctgttgttatggctggagttttgggtatttatggtctgattattgctgttattatcagtactggtattaatcccaaggccaaatcttattacctctttgatggttatgctcatctctcctctggtcttgcctgtgggttggccggtctctctgctggcatggctattggtattgttggtgatgctggtgttagggccaatgcgcagcagccaaaactttttgttggaatgattctcatcctcatttttgctgaagctcttgccctgtatggtctcattgttggtattattctctcttctcgtgctggtcagtctagagctgattaagaaagatgtgctgcaaaatattctttaaatctcccaatctgttttaaccttattgtgaggacgatgggggtaaattgttagttgtgaggttagtgatgtccacttggaggatttaacaaatacttgtgtgaaagcagtagctgcaccagtcatttttgtgtttgtataagtagtctttgcttaataaagcttcttaagcttctttttccccctttgtgccatatgatcttagtcttcaatttttttgctgctgccataagcctttgtaatttatatgtagtaacgggtcttttaatattggatgctggtgtagctaaaccttgccttgtgttttggtcagttgtataatcctaatcgacatggatcttctcaataaaagagcattttgagtattctaatattatgttgaaccatttgatgattgttgaagcagg

SEQ ID NO: 1695 - DNA, 1127 bp, Populus trichocarpa
cctctcgctcgtttttttctctagcaaagcacagaacagagagatccaagaaattttcaactccaagaatctctgttcagttcagatctaaagacaccgtctcagattcagtgatcaatcatgtctactttcagcggtgacgaaactgctccgttcttcggcttccttggcgccgctgctgccctcgtcttctcatgtatgggagcagcgtatggaacagctaagagtggagttggtgtggcgtcgatgggagtgatgaggcctgagttggtgatgaagtcgattgttccagttgttatggctggtgtgttgggtatttatgggttgattattgcggttattattagtactggaattaacccaaaggccaagtcttactacctttttgatgggtatgcacatctctcgtctggtcttgcttgtggccttgcggggctttctgctgggatggccattggcattgttggtgatgccggtgtcagagctaatgctcaacagcctaaactttttgttggaatgatccttatcctcatctttgctgaagcgttggcgctgtatggccttattgttggcatcatcttgtcatcccgtgctggccagtccagggcagaataagaagggtgattgctaactactgctattcttttatagcttgtcagtgtcgcttaggagaaaaaactgtggtttgcagattattgagggttgggcagcactttcagcatcctcaaatatcttctcatggaagtgtctgctctgccaagcatttggtggtttcgttgtgctgtttgcaggagtaggattgcgatttatccgcaaaataaaagcttttcaagctcgccatgttgggttctgtctatgattgtattttgcagaccataaaactgttatacaaacttcaaatcttgacttttgcacctgtgatcatattatttattgaagtcttatttcacaacttaaaagtttggttgcctgctaacctagtgtgtgcttacataacttcactcctttctccacggaatgagaggctcgaggcagtatttttccctacaatcattctcattattgacaggttttgagataggatgtttctcgatatgatttaacatgctaatggcttaatgctgagt

SEQ ID NO: 1696 - DNA, 1144 bp, Populus trichocarpa
tattcatttattgccttcctctcgctcgtttttttctctagcaaagcacagaacagagagatccaagaaattttcaactccaagaatctctgttcagttcagatctaaagacaccgtctcagattcagtgatcaatcatgtctactttcagcggtgacgaaactgctccgttcttcggcttccttggcgccgctgctgccctcgtcttctcatgtatgggagcagcgtatggaacagctaagagtggagttggtgtggcgtcgatgggagtgatgaggcctgagttggtgatgaagtcgattgttccagttgttatggctggtgtgttgggtatttatgggttgattattgcggttattattagtactggaattaacccaaaggccaagtcttactacctttttgatgggtatgcacatctctcgtctggtcttgcttgtggccttgctgggctttctgctgggatggccattggcattgttggtgatgccggtgtcagagctaatgctcaacagcctaaactttttgttggaatgatccttatcctcatctttgctgaagcgttggcgctgtatggccttattgttggcatcatcttgtcatcccgtgctggccagtccagggcagaataagaagggtgattgctaactactgctattcttttatagcttgtcagtgtcgcttaggagaaaaaactgtggtttgcagattattgagggttgggcagcactttcagcatcctcaaatatcttctcatggaagtgtctgctctgccaagcatttggtggtttcgttgtgctgtttgcaggagtaggattgcgatttatccgcaaaataaaagcttttcaagctcgccatgttgggttctgtctatgattgtattttgcagaccataaaactgttatacaaacttcaaatcttgacttttgcacctgtgatcatattatttattgaagtcttatttcacaacttaaaagtttggttgcctgctaacctagtgtgtgcttacataacttcactcctttctccacggaatgagaggctcgaggcagtatttttccctacaatcattctcattattgacaggttttgagataggatgtttctcgatatgatttaacatgctaatggcttaatgctgagt

SEQ ID NO: 1697 - DNA, 1072 bp, Populus trichocarpa
acgtgcgacgttttatatccatggatgattgtcttccacccgtttcttctctaaacagggagagagagcaaaggaattctaatttctcaaaaagctatctgcaaacttcagatctaaaacgacactgtctcagatccagtttatcaatcatgtctactttcagtggcgatgaaactgcaccgttcttcggcttccttggggctgctgctgccctcgtcttctcatgtatgggagcagcttatggaaccgctaagagtggagttggtgtggcatcgatgggagtgatgaggcccgagttggtgatgaagtcgattgttccagttgttatggctggtgtgttgggtatttatgggttgattattgctgttattattagtaccggaattaaccctaaggctaagtcttattaccttttcgacgggtatgcacatctctcgtccggtctcgcttgtggccttgccgggctatctgctggaatggccattggcattgttggtgatgctggtgtcagagctaatgctcaacagcctaaactttttgttggaatgattcttatcctcatctttgccgaagcgttggctctttatggccttattgttggcatcatcttgtcttcccgtgctggccagtccagggcagaataagaagggagattgctacctactattattcttttatagcttgtcagtgtcacttcggaggaaaatttatgtttgcttgcagattagtgcgggttgggcagcccttgcagcgttctcaaactatcttctcacggaagtgtctgctctgccaagcgtgcgtttggggggtttctttgtactgtttgcgggagtaggattgagttatattcgcaaaataaaagcttttcaagctgtccttgttgggctctgtctatcgttgtattttaaagaacaaaaaaaaaaagctgctgtagaaacttcaaatcttgactgatgcacctgtgatcgtattatttattgaacttgtaattttacaatttcaaattttggttgcctgcacgtctgggctccaattttttttcctgctatattctaacagaaacaattatttt

SEQ ID NO: 1698 - DNA, 1140 bp, Populus trichocarpa
actatacaacaaacaagcccaatttaacacgtgcgacgttttatatccatggatgattgtcttccacccgtttcttctctaaacagggagagagagcaaaggaattctaatttctcaaaaagctatctgcaaacttcagatctaaaacgacactgtctcagatccagtttatcaatcatgtctactttcagtggcgatgaaactgcaccgttcttcggcttccttggggctgctgctgccctcgtcttctcatgtatgggagcagcttatggaaccgctaagagtggagttggtgtggcatcgatgggagtgatgaggcccgagttggtgatgaagtcgattgttccagttgttatggctggtgtgttgggtatttatgggttgattattgctgttattattagtaccggaattaaccctaaggccaagtcttattaccttttcgacgggtatgcacatctctcgtccggtctcgcttgtggccttgccgggctatctgctggaatggccattggcattgttggtgatgctggtgtgagagctaatgctcaacagcctaaactttttgttggaatgattcttatcctcatctttgccgaagcgttggctctttatggccttattgttggcatcatcttgtcttcccgtgccggccagtccagggcagaataagaagggagattgctacctactattattcttttatagcttgacggtgtcacttcggaggaaaatttatgtttgtttgcagattagtgagggttggtcagcccttgcagcgttctcaaaatatcttctcacggaagtgtctgctctgccaagcgtgcgtttggggggtttctttgtactgtttgcgggagtaggattgagttataatcgcaaaataaaagcttttcaagctgtccttgttgggctctgtcgatcgttgtattttaaagaacaaaaaaaaaaaactgctgtagaaacttcaaatcttgactgatgcacctgtgatcgtattatttattgaacttgtaattttacaatttcaaattttggttgcctgcacgtctgggctccaatttgttttcctgctatattctaacagaaacaattattctagtttaaaatgtatatgttattatggaagtttcatgaaaa

SEQ ID NO: 1699 - DNA, 937 bp, Solanum tuberosum
gatgcgactacaaagaaccagacaatccaaaaacaataattctctctcgccaatcagaaagttgttcttccaaattccgatcggttaccgctgaaatctgtgtgggagtaaacaatggcgtcaactttcagtggcgatgaaactgcgcctttcttcggtttccttggcgccgctgcagcgctagttttctcatgtatgggagctgcttatggaacggcgaagagcggtgtgggagtggcgtccatgggagtaatgaggccagagcttgtgatgaagtcaattgtgccggttgttatggctggtgtgttaggtatttatggattgattattgcagtcattatcagtactgggattaaccccaagaccaaatcgtattacctttttgatggatatgcgcacctttcttccggtctggcttgtggtctcgctggcctttccgctggaatggctattggaattgttggtgatgctggtgttagagcaaatgcacaacaaccaaaactctttgttggtatgatcttgattcttatttttgctgaggcgttggctttgtatggactgattgtcggcatcatcctttcttcccgtgctggccaatctagagcagaatagaagaaaataatgtgttttcaggtttatgatggaatctttttcatcactgtgcttgcagcttgataaccgatgctagttgttaggtgcatcttctctttttccttttccttttccatcacacattgtgtgttccactggtgtttgtagatttgggagctgccttttccctgtatgtgaccaagagaacgttctctcaatttttccattactgtattttgcaataatgaggagcatcttgttgcttgaatgctgatacaattgtattattattggtggaatgtattgatactcctgaatatatgaaatccaccttgatcattggtgt

SEQ ID NO: 1700 - DNA, 859 bp, Primula obconica
ccgtccttaattctttcattcgctctctctctctgtctaaaaaagcataatttattctctgcaaatcaaaactcgagaagaagaaaaagatgtcaacattcagtggcgatgaaactgcgccgttcttcggattcctcggcgcagcagctgcccttgttttctcctgcatgggtgcggcgtacggaacggcgaaaagcggggtaggagtggcgtcaatgggagtgatgagaccagagctggtgatgaagtcgattgtgcctgtggttatggctggtgtgctcggtatctacggattgattattgctgtgattattagcacaggaattaaccctaaagccaagtcttattacctctttgatggatatgctcatctctcctctgggcttgcttgtggccttgccggattatcagcgggtatggctattggcatcgtaggtgatgctggtgttagagccaatgctcagcagccaaaactatttgttgggatgatcctcattcttatctttgctgaagcacttgctctctatggtctcattgtcggcattattctctcttcacgtgctggtcagtcgagagctgaataaatagtattattcgctcttgatcgtggcagtctgcagtttatattgttattgatgggaggtttttttttttttgacatctaagaggaggaaatgtttttcgtcctaaatttgtttctgtgcttggtaggtggattaggtactttgtgttcacggggactgtagatggcctcttttttccttcttcaaataatggtatctgttcttttgacaaatgatccgtttttaatttattacatcatatcaaaggtgtcattatagacatgtctcctgtatta

SEQ ID NO: 1701 - DNA, 960 bp, Prunus persica
atgacacatgtcaagcaaaaaatagagaaggtccaaaagagaacgaaacacatacgcttaaaggcatatgcggagaggagagaaaaaaagaataccatcactccagaggtcagatccgatcaagaatatcttgtccgtaaatcgagaagaatgtcttcttcaacgttcagcggcgatgaaacggcaccgttctttgggtttctcggcgccgccgcggccctcgtcttctcatgtatgggagcagcatacggaacagcgaagagcggagtaggtgtggcgtcgatgggagtgatgaggccggagctggtgatgaagtcgatcgtgccggtggttatggctggtgtgctgggtatctacggccttatcatcgccgtcatcatcagtacgggcatcaatcccaaggccaaatcctattacctcttcgatggctacgcccatctctcctctggtctcgcttgtggccttgctggcctctctgctggtatggctattggcattgtcggtgatgctggtgttagagccaacgcccagcagccaaagctttttgttgggatgatcctcattctcatttttgctgaagcacttgccctgtacggtctcattgttggcatcattctctcttcccgatcgggtcagtcaagagccgactagaaggtgtgctaggtggttttgttgggttgctgctatttattaagagctactttactgttttgtttgaagttgtagtttctttttgggaggtgcattacagattcttgtatggtgtgagtgatccgtcgatgtctaccaggtggattggtagtggttatgcgccaaaggtagatatagggctagcaattagttggtacttctgaataagtttgagttgtgtttcatgagtccatgcctgtattgagaaatcgaattgacattaatttgttggaaattatatataccgcctgtatcattgtgttaatttca

SEQ ID NO: 1702 - DNA, 897 bp, Prunus persica
ctctctctctcataaaaatccagaagccacagaatttcatacattaaacaacaatagagctttatcttcttcatccaaaccccagattcgcgcacacaaccaatccccgcaaccaaacacacacagacatggcttcttctaccttcagcggcgacgaaaccgctcctttcttcggcttcctcggagccgccgcagctctcgtcttctcctgcatgggtgcggcttacggcacagcaaagagtggggtgggtgtggcctccatgggagtgatgcggcctgagctggtgatgaaatcgatcgtgccggtggttatggctggagtgcttgggatctatgggctcatcatagctgttattattagcaccgggattaacccaaaggccaaatcttattacctctttgatgggtacgcgcacttgtcctctggccttgcttgtggtctcgccggactgtccgccggaatggccattgggatagtcggtgacgccggtgtccgggctaatgcacagcagccaaagctcttcgttggtatgattcttatccttatcttcgccgaagctcttgccttgtatggcctcattgtggggatcatcctctcatcccgatcagggcaatctcgcgcagattaaggaagtcaagtttgttgctcctctagattatttgaagaggatattattattatgcctttacaatggtgttgtctctatatagcttggttaattttagttagagttatattatttgagctgcacgatgcctgtagttatgaagaaacaattgttttgaatgtcagttttctcatgctccaaaataaggacagattagttaatgaaaacttaaccttgttgaagaggattggtgtttttaagatttgttgtgttgtgagtggctaattga

SEQ ID NO: 1703 - DNA, 815 bp, Prunus persica
aaacgctcgtgtgaatccaaatctatcagtctctaatctccgcgatcaaaatttcccaaatctgagagaggctgaagccaatcgctaatcggaaaaccaaaagcaaagaaaatggcgtcatccacgttcagcggcgacgaaacggcgccgttcttcggcttcctcggcgccgcggccgccctagttttctcctgtatgggagcggcgtacgggacggcgaagagcggcgtgggcgtggcgtcgatgggggtaatgaggccagagctggtcatgaaatcgattgttccggtggttatggcgggagtgttgggtatctatggtttgatcattgctgtgattatcagcactgggattaacccgaaggccaaatcttattaccttttcgatggctatgcccacctctcctccggcctcgcttgcggcctcgccggactttccgccggaatggccatcggaatcgtcggcgatgccggtgttagggcgaatgcgcaacagccaaagctttttgttggaatgattctcattctcatctttgctgaagctttggctttgtacggtctcattgtcggcatcatcctttcatcccgatccggacaatccagagcagattagagatggcattcctgccagctttgaatgtgtatgttgttggcgtctcggttactcacaggtttgtgatgctcattcgcagtgtgcagtgttgtgccaagttattggtcttgcataggaagatcctttttctgattgtagaatttgaagtgaattgtctttgaaataaagcttttttagctggttgttcacctgctcctttttct

SEQ ID NO: 1704 - DNA, 935 bp, Prunus persica
ccttataaagcagttggactattcctttcgacgactttggcttgcggaagcacgagaaacacaaccactggggagagaagagagaccagagatccaaaattctgagatccagacgacgtcgtcccagatccacgctccataatgtcatcttcaaccttcagcggtgatgaaacggcgccgttcttcggcttcctcggcgctgctgcagccctcgtcttctcctgtatgggagctgcctatggaacggcaaagagtggtgttggtgtggcatctatgggggtgatgaggcctgagctggtgatgaagtccattgttcctgttgttatggctggagttttgggtatttatggccttattattgctgttatcattagtactggaattaaccctaaggccaagtcatactatctttttgatggttatgcacatctctcttctggtcttgcttgtggtctcgctgggctctctgctggaatggcaattggtatagttggtgatgctggtgtaagagctaatgcacagcagccaaaactctttgttgggatgatcctcattctcatctttgctgaagcactggccctctatggcctcattgtcggcatcatcttgtcttcccgatcaggccaatccagagcagactaaaccatgcagtctaatattctttattgcttattaatggcacttgaaagggaaaacttttggctgatctctggttggtcgttgggccgtgcttgctggttcgtacagattatgtttgtgaaagtaacgactgtgccttgtagtagtaggattgagtttatcaacagaataaaatctttctaagcaggtttttaaatacgtttatgtattcttccaccagaactatgaactgctatattttttatgattctaaatctagtgcatgtatgatcttattcatccaccaattatccata

SEQ ID NO: 1705 - DNA, 847 bp, Raphanus sativus
  misc_feature (220)..(220): n is a, c, g, or t
actcatcagaaaatccaaaataaaaaaatatcagagagaggtcgctgcaaaaatccaaatcaaatctccccagatttaaaggaagatgtctaccttcagcggcgatgagactgctcccttcttcggcttcctcggcgctgccgccgccctcgtcttctcctgtatgggagctgcttatggaactgcgaagagtggtgttggtgtggcttccatgggagtnatgagacctgagttggtgatgaagtccattgtccccgtggttatggctggtgtgttgggtatttatggactcatcatcgctgttatcatcagtaccggtatcaacccaaaggctaagtcttactacctctttgatggatacgcgcacctctcctctggtcttgcttgtggtctcgctggtctctcagctggaatggccattggaatcgtcggagatgctggagtcagggcaaatgctcagcagcctaagcttttcgtggggatgattcttatcctcatctttgcggaagcacttgctctctatggtctcattgtaggcattatcttgtcctctcgagctggtcagtccagagcagaatgagaaacaaaacaaacgtcaggtgatgattaattttttttccgtgtgtgtaatgtctcacttactctcatctgtttgtttggggttgtcaccttccttccgatgggtgcttgagtgtaggatgttgttatttgtttggttggctaataaaaagacaagtgtgcatgttttgtattctttgtatttgtcttgaggaacttgatgatattttgtttgtaaagaagtttgcttctgaaaccgtcttcgagtgttgttatgatattcatctat

SEQ ID NO: 1706 - DNA, 921 bp, Raphanus sativus
ggaaaaacaaaaataagtaaataaataaataaaactaaaaaaacaaatcagagcgatatatatctctccatctctctttctcacgccagatttcaatcatcgactcgatttcagatccgagatacaaactccgaacatgtctaccttcagcggcgatgaaacagctcccttcttcggtttcctcggcgccgcagccgcactcgtcttctcctgtatgggagctgcatacggaacagcaaagagtggtgtaggtgtggcttcgatgggagtgatgagacccgagcttgtgatgaaatccatcgtccctgtcgttatggctggtgtgttgggtatctacggtttgattattgctgttatcatcagtaccgggattaaccccaaggctaagtcttactacctcttcgacggatacgcacatctctcctccggtctcgcttgtggtcttgctggtctttccgctggaatggccattggtattgtgggtgatgctggtgtcagggcaaatgctcagcagcctaagctctttgtcgggatgattcttatccttattttcgctgaagcgcttgctctttatgggcttattgtaggtatcatcctttcctctagagctggtcagtctagagctgaatgagaaagttatctcaagatttaccaccccaattgtactacttgctttactttctgtgtgcgttctttagtatgtatcgtcgacactgaaacatttactggattcttggagctttgtttcagaaacaaaaccagctatgggttatttattgtttggttatgtaataaagagctcagagcagctttgattttttttttgtattcttgtattgtcctgaggaatttaaaatacatttatttgtaaagaagtatgctttctgaaaccatcttgaatcgtatgaaatgtctgcaata

SEQ ID NO: 1707 - DNA, 925 bp, Raphanus sativus
  misc_feature (34)..(34): n is a, c, g, or t
  misc_feature (68)..(68): n is a, c, g, or t
  misc_feature (284)..(284): n is a, c, g, or t
gggtccttaaacgcgtaaattcaatctgagaggnggagaaagatcagattcaaacggcgggcgtctancttaagatccagaaagaatcgtcggaaatgtctacgttcagtggagatgaaaccgctcctttcttcggcttcctcggcgctgccgctgccctcgtcttctcctgcatgggagctgcatacgggacagccaagagtggcgtgggagtggcatcgatgggtgtgatgaggccagagttggtgatgaagtctatcgtccctgttgtcatggctggtgtnttgggtatctatggtttgattattgctgttatcatcagtaccgggatcaaccccaaggccaaatcttactacctcttcgacggatatgcgcatctctcttctggtctcgcttgtggtcttgctggtctttctgctggaatggccattggtattgttggtgatgctggtgtcagggccaatgctcaacagccaaagcttttcgttggtatgattcttatcctcattttcgctgaagctctggctctgtacggtctcatcgtggggatcatcttgtcctcccgagctggtcagtccagagccgaatgaggaagagtatgctgcttcttcttggattctgcgtgattctttcttttgctttccaccgggatgttcttatattatttatcaggttagtaggcacaacagtggttttgctacgtgtagacaaaaaccacacctcatcaaactgttgttctttttcaactcttctgttatgttttttgtaatattcgaccgtgacgggttcttctgttcccactaagatgtaactgtgagacactattatcactccaataaatcacagaaaactcgatttgatcttgttttgtaagcttcttttggttataacttctataacaatattatctcgagggattgaatga

SEQ ID NO: 1708 - DNA, 968 bp, Raphanus sativus
ggactcatctgaaagaaagaaaaaaacaaaaaattaaataaataaaaacacgcagcgatatccacgctgccccatctctctctcgccagatttcaatcgtcgactcgattctcagatttcagatccaaatccaaaaaaaaaaaaattcagcatgtcaaccttcagcggcgatgaaacagctcctttcttcggcttcctcggcgctgcagccgcactcgtcttctcctgtatgggagctgcttatggaacagcaaagagtggtgttggtgtggcttctatgggagtgatgaggccagagttggtcatgaagtccattgtccctgtggttatggctggtgtgttgggtatttacggtttgattattgctgttatcatcagtaccggaatcaaccccaaggctaagtcttactacctcttcgatgggtacgctcacctctcctccggtcttgcttgtggtcttgctggtctctccgccggaatggccattgggatcgtcggtgatgccggtgtcagggcaaatgctcagcagcctaagctctttgttgggatgattcttatccttatcttcgcagaagcgctcgctctttacgggcttattgtaggaatcatcctctcctctagagctggccagtctagagctgaatgagaatgtgacccacaagatttgccgtcgttctgagaatgagagaatgttacttccttttcgttctgtgtgcttttttttgttctttccttctttagtatttatcatcggtaaacctacagatttactggattcttggaactttgtttcggaagcaaactcacctattcgtcatccccttttctctttcggtggtttgctttcaggtttgtaggggttctcttatcgttcggttctgtaataaagagctctcaggagcttggtatgtttctgtatttttgtattgtcctgaggaagtttaaataacatttatttgttttgattt

SEQ ID NO: 1709 - DNA, 863 bp, Raphanus sativus
catcagaaaatccaaaaataaaaaatatcagagagaggtcgctgcaaaaaaatccaaatcaaatctccccagatttaaagaagatgtctaccttcagcggcgatgagactgctcccttctttggcttcctcggcgctgccgccgccctagtcttctcctgtatgggagctgcttatggaactgcgaagagtggtgttggtgtggcttccatgggagtgatgagacctgagttggtgatgaagtctattgtccccgtggttatggctggtgtgttgggtatctatgggctcatcatcgctgttatcatcagtaccggtatcaacccaaaggctaagtcttactacctctttgatggatacgcgcacctctcctctggtcttgcttgtggtctcgctggtctctcggctggaatggccattggaatcgtcggagatgctggagtcagggcaaatgctcagcagcctaagcttttcgtggggatgattcttatcctcatctttgcggaagcacttgctctctatggtctcattgtaggcattatcttatcctctcgagctggtcagtccagagcagaatgagaaacagaacaaacgtcagctgatgattaatttttttttcgtgtgtggaatgtctcaattgctctcatctgtttgtttggggttgccacctctgctccttccttccgatgggtgcttgagtgtaggatgttgttatttgtttggttgggtaataataagacaagtgtgcatgttttgtattctttgtatttgtcttgaggaacttgatgatattttgtttgtaaagaagtttgcttctgaaaccatcttcgagtgttgttatgatattcatctatatttggtgtc

SEQ ID NO: 1710 - DNA, 834 bp, Raphanus sativus
ggattcaccctctcaacttgatcgttattcaatcagattcatcggccggcgtcttcttaaagttcagatcgtcgaagatgtctacgttcagtggcgatgagaccgctcctttcttcggcttccttggcgctgccgcagccctcgtcttctcctgcatgggagctgcatatgggactgccaagagtggtgtcggtgtggcatctatgggtgtcatgagacctgagttggtcatgaagtctattgtccctgttgttatggctggtgtcttgggtatctatggtttgattattgctgttatcatcagtaccggtattaaccccaaggctaaatcttactacctcttcgacggttatgcccatctctcctctggtctcgcttgtggtcttgctggtctttctgctggaatggccattggtattgttggtgatgctggtgtcagggccaatgctcagcaaccaaagcttttcgttggtatgattcttatcctcattttcgctgaagctctggctctatacggtctcatcgtcggcatcatcttgtcttcccgagctggtcagtccagagccgaatgagaagacaatgcgcttcttcttggattctttgctttgctttttccgctctcgtcttatattatttctcaggttagtagagggagtcccccagtggttttgctacttgtgtagcatgtttgttaaaaacgtactcgtctgcacgaaacaaaaaccacacaatcaccaaagtgttgttcgttttccacccttgtgttatgtttgtaatattcttctcttcccagttaagagaaacaccttcttatttatattttttctgtcagtc

SEQ ID NO: 1711 - DNA, 833 bp, Raphanus sativus
  misc_feature (747)..(747): n is a, c, g, or t
  misc_feature (750)..(750): n is a, c, g, or t
tcattcaccctctgatctcaacttcagattcatcggccggcgtcttcttaaaattcagatcgtcgaagatgtctacgttcagtggcgatgagaccgctcctttcttcggcttccttggcgctgccgcagccctcgtcttctcctgcatgggagctgcatatgggactgccaagagtggtgtcggtgtggcatctatgggtgttatgagacctgagttggtcatgaagtctattgtccctgttgttatggctggtgtcttgggtatctatggtttgattattgctgttatcatcagtaccggtattaaccccaaggctaaatcttactacctcttcgacggttatgctcatctctcttctggtctcgcttgtggccttgctggtctttctgctggaatggccattggtattgttggtgatgctggtgtcagggccaatgctcagcagccaaagcttttcgttggtatgattcttatcctcattttcgctgaagctctggctctatacggtctcatcgtcgggatcatcttgtcttcccgagctggtcagtccagagccgaatgagaagagaatgcgcttcttcttggattctttgctttgctttctcgctctcgtcttatattatttctcaggttagtagagggagtcccccagtggttttgctactttatgtagcacgtttcttaaaaaccacacaatcaccaaagtgttgttcgttttccacccttgtgttatgtttgtaatattnttntcttcccagttaagagagacaccctcttatttatacttgttttttgtcattctaataaaatcacagaaaactcaatttgatct

SEQ ID NO: 1712 - DNA, 1031 bp, Raphanus sativus
atctgaaaggaaaaaaaaagacaaaaattaaataaataaaaacacgcagcgatatccacgctgctccatctctctctccgccagatttcaatcgtcgactcgattctcagatttcagatccaaatccaaaaaaaaaaattcaacatgtctaccttcagcggcgatgaaacagctcctttcttcggcttcctcggcgctgcagccgcactcgtcttctcctgtatgggagctgcttatggaacagcaaagagtggtgttggtgtggcttccatgggagtgatgaggccagagttggtcatgaagtccatcgtccccgttgttatggctggtgtgttgggtatttacggtttgattattgctgttatcatcagtaccggtattaaccccaaggctaagtcttactacctctttgatggatacgctcacctctcctccggtcttgcttgtggtcttgctggtctctccgctggaatggccattggtattgtcggtgatgccggtgtcagggcaaatgctcagcagcctaagctctttgttgggatgattcttatccttatcttcgcagaagcgcttgctctttacgggcttattgtaggaatcatcctctcctccagagctggccagtctagagctgaatgagaatgtgacccacaagatttgctatcgttctgagaatgagagaatgttacttccttttcgttctgtgtgcgtttttgttctttccttctttagtatttatcatcggtaaacctacagatttactggattcttggaactttgttccggaaacaaacccacctattcgtcgtccccttttctcttacggtggtttggtttgctttcgggtttgtaggggttctcttatcgtttcggttctgtaataaagagctcttaggagcttggtatgtttctgtatttttgtattgtcctgaggaagtttaaatacatttatttgttttgattttaaaaatatacatttatctgtaaagaagtctgctttctcaatccatctcgtagaaaacgttacgtta

SEQ ID NO: 1713 - DNA, 928 bp, Raphanus sativus
ggagaaatgggtgtttatgcggcccattaatgcaacgtgttcccaactcttaactataggtacacgatcttcctcttccactcatcagaaaatccaaaataaaaaatatcagagagaggtcgctgcaaaaatccaaatcaaatctccccagatttaaaggaagatgtctaccttcagcggcgatgagactgctcccttcttcggcttcctcggcgctgccgccgccctcgtcttctcctgtatgggagctgcttatggaactgcgaagagtggtgttggtgtggcttccatgggagttatgagacctgagttggtgatgaagtccattgtccccgtggttatggctggtgtgttgggtatctatggactcatcatcgctgttatcatcagcaccggtatcaacccgaaggctaagtcttactacctctttgatggatacgcgcacctctcgtctggtcttgcttgtggtcttgctggtctctcagctggaatggccattggaatcgttggagatgctggagtcagggcaaatgctcagcagcctaagcttttcgtggggatgattcttatcctcatctttgcggaagcacttgctctctatggtctcattgtaggcattatcttgtcctctcgagctggtcagtccagagcagaatgagaaacaaaacaaacgtcaggtgatgattattatttttttcgtgtgtggaatgtctcacttgctctcatctgtttgtttggggttgcgatctctgctccttccttccgatgggtgcttgagtgtaggatgttgttatttgtttggttggctaataataagacaagtgtgcatgttttgtattctttgtatttgtcttgaggaacttgatgatattttgtttgtaaagaagtttgcttctgaaaccatcttcgagtgttgttatgatattca

SEQ ID NO: 1714 - DNA, 793 bp, Raphanus sativus
  misc_feature (569)..(569): n is a, c, g, or t
agatttcaatcatcgactcgatttcagatccgagatacaaacttggaacatgtctaccttcagcggcgatgaaacagctcccttcttcggcttcctcggcgccgcagccgcactcgtcttctcctgtatgggagctgcatacggaacagcaaagagtggtgtaggtgtggcttcgatgggagtgatgagacccgagcttgtgatgaaatccatcgtccctgtcgttatggctggtgtgttgggtatctacggtttgattattgctgttatcatcagtaccgggattaaccccaaggccaagtcttactacctcttcgacggatacgcacatctctcctccggtctcgcttgtggtcttgctggtctctccgctggaatggccattggtattgtcggcgatgctggtgtcagggcaaatgctcagcagcctaagctctttgtcgggatgattcttatccttattttcgcagaagcgcttgctctttatgggcttattgtaggtatcattctttcctctagagctggtcagtctagagctgaatgagaaagttatctcaagatttaccccnattgtactgcttcctttactttctgtgtgcgttcttttagtatgtatcatcgaaactgaaacatttactggattcttggagctttgtttcagaaacaaaaccagatatgggttatttattgtttggttatgtaataaagagctcagaggagctttgatatttttttttgtattcttgtattgtcctgaggaatttaaaatacatttatttgtaaagaagtatgc

SEQ ID NO: 1715 - DNA, 889 bp, Raphanus sativus
atccacacctctctctctctctctctctctctcgccagatttgaatcatcgacctgatctcagatccaaatcacaagccttcgacatgtctaccttcagcggcgatgaaacagctcctttcttcggcttcctcggcgctgcagccgcactcgtcttctcctgtatgggagctgcttatggaacagcaaagagtggagttggtgtggcttctatgggagtcatgaggccagagttggtcatgaagtccattgtccccgttgtcatggctggtgtcttgggtatttacggtttgattattgctgttatcatcagtaccgggattaaccccaaggctaagtcttactacctcttcgatggatacgcacatctctcctccggtcttgcttgtggtcttgctggtctctctgctggtatggccattggtattgtcggagatgccggtgtcagggcaaatgctcagcagcctaagctctttgtcgggatgattcttatccttatcttcgcagaggcgcttgctctttacggccttattgtgggaatcatcctctcttctagagctggccagtctagagctgaatgagaatgtaacccaccacaagattttcccccgaaggtacttttattttctgtgtgtgttttgttgttctatcgttctttagcatatgtatcatcgggaactgaagaaaaaaattattggacacttgggaactttgtttcggaagctctcctatttctctctctctcggtggttgatctccgatgtagggattttttttattatttggttctgtaataaagagagctctgatggagcttggtatgtttttgtattcttgtattgtcctgaggaagttaaatacatttatttgtaaagaagtttgctttctga

SEQ ID NO: 1716 - DNA, 948 bp, Raphanus sativus
ggatctgagaaaaaaaaaaaccaaaaataaataaacaaataaaaatcagaaacgatatatccatccacacctctctctctctgtctcgccagatttgaatcatcgacctgatctcagatccaaatcacaagccttcgacatgtctaccttcagcggcgatgaaacagctcctttcttcggcttcctcggcgctgcagccgcactcgtcttctcctgtatgggagctgcttatggaacagcaaagagtggagttggtgtggcttctatgggagtcatgaggcctgagttggtcatgaagtccattgtccccgttgtcatggctggtgtgttgggtatttacggtttgattattgctgttatcatcagtaccgggattaaccccaaggctaagtcctactacctcttcgacggatacgcacatctctcctccggtcttgcttgtggtctcgctggtctttctgctggtatggccattggtattgtcggagacgccggtgtcagggcaaatgctcagcagcctaagctctttgtcgggatgattcttatccttatcttcgcagaagctcttgctctttacggccttattgtgggaatcatcctctcctcacgagctggccagtctagagctgaatgagaatgtaaccccccaccacaagattttcccccgaaggtactttatttttctgtgtgtgttttgttgttctatcgttctttagcatatgtatcatcgggaactgaaaaaaaagaaatttattggacacttggaactttgtttcggaagctctcctatttctctctctcggaggttgctctccgatgtagggatttttttattattattttgttctgtaataaagagagctctgatggagcttggtatgtttttgtattcttgtattgtcctgaggaagttaaatacatttatttgtaaagaagtttgctttctga

SEQ ID NO: 1717 - DNA, 1022 bp, Raphanus sativus
  misc_feature (135)..(135): n is a, c, g, or t
ggactcatctgaaagagaaaaaaaaaaacaaaaattaaataaataaaaacacgcagcgatatccacgctgctccatctctctctcgccagatttcaatcgtcgactcgattctcagatttcagatccaaatccanaaaaataaaaaaattcaacatgtctaccttcagcggcgatgaaacagctcctttcttcggcttcctcggcgctgcagccgcactcgtcttctcctgtatgggagctgcttatggaacggcaaagagtggtgttggtgtggcgtctatgggagtgatgaggccagagttggtcatgaagtccattgtccctgtggttatggctggtgtcttgggtatttacggtttgattattgctgttatcatcagtaccggtattaaccccaaggctaagtcttactacctcttcgatggatacgctcacctctcctctggtcttgcttgtggtcttgctggtctttccgctggaatggccattgggatcgtcggtgatgccggtgtcagggcaaatgctcagcagcctaagctctttgttgggatgattcttatccttatcttcgcagaagcgcttgctctttacgggcttattgtaggaatcatcctctcctctagagctggccagtctagagctgaatgagaatgtgacccacaagatttgccatcgttctgagaatgagagattgttacttccttttcgttctgtgtgcgtttttgttctttccttctttagtatttatcatcggtaaacctacagatttactgtattcttgaaactttgttccggaaacaaacccacctattcgtcgtccccttttctctttcggtggtttgctttcgggtttgtaggggttctcttatcgttcggttctgtaataaagagctctcaggagcttggtatgtttctgtatttttgtattgtcccgagtaagtttaaataacatttatttgttttgatttacaaaaaaatacatttgtctgtaaagaagtttgctttctcaatccatttcgca

SEQ ID NO: 1718 - DNA, 767 bp, Raphanus sativus
  misc_feature (607)..(607): n is a, c, g, or t
gatcgtcattcatcagattcatcggccggcgtcttcttaaaattcagatcatcgaagatgtctacgttcagtggcgatgagaccgctcctttcttcggcttccttggcgctgccgcagccctcgtcttctcctgcatgggagctgcatatgggactgccaagagtggtgtcggtgtggcatctatgggtgttatgagacctgagttggtcatgaagtctattgtccctgttgttatggctggtgtcttgggtatctatggtttgattattgctgttatcatcagtaccggtattaaccccaaggctaaatcttactacctcttcgacggttatgcccatctctcttctggtctcgcttgtggccttgctggtctttctgctggaatggccattggtattgttggtgatgctggtgtcagggccaatgctcagcagccaaagcttttcgttggtatgattcttatcctcattttcgctgaagctttggctctatacggtctcatcgtcggcatcatcttgtcctcccgagctggtcagtccagagccgaatgagaagagaatgcgcttcttcttggattctttctttgctttttcgctctcgtcttanattatttctcaggttagtagggagtccccctgtggtttgctacttgtagcatgtttcttaaaaaaccacacactcaccaaagtgttttcgttttctaccctcgtgttatgtttgtaatattcttctcttcccagttaagagagacaccctcttatttata

SEQ ID NO: 1719 - DNA, 517 bp, Rhizophora mangle
tgtcttctgtcttcagcggcgatgaaacggcaccgttcttcggctttctcggcgcagcctccgcgctcgtcttctcctgtatgggagctgcatatggaacagccaaaagtggtgtgggtgttgcatcaatgggtgtgatgagacctgagctggtgatgaagttaattgtgccagttgttatggctggtgtgttgggtatatatggattgatcattgctgttattatcagtactgggattaaccccaaagcaaagtcatattacctttttgatggttatgcacatctctcttctggtcttgcttgtggccttgctgggctttctgcagggatggccattggtattgttggtgatgctggtgtcagagctaatgcccaacagccaaaattgtttgttgggatgatccttattctcatttttgctgaagcgttggccctgtacgggcttattgtgggcatcatcttgtcttctcgagctggccagtcaagggctggctaagaaaggaaattgctaccgca

SEQ ID NO: 1720 - DNA, 815 bp, Silene vulgaris
tttcctatcaaacccagatcatcatgtcttctgtattcaacggtgatgaaactgcgccgtttttcggctttcttggagctgctgccgctcttattttctcctgtatgggagcagcatatggaacagcaaaaagtggagtaggagttgcatcaatgggagtgatgagaccagaattggttatgaaatcgattgttccggttgttatggctggagttttgggtatttatggtcttattattgctgtcattatttctactggaattaatccaaaggctaagtcttattatctatttgatgggtatgctcatctttcgtctggtattgcttgtggtctttctggtttggctgctggtatggctattggtgttgttggtgatgctggtgtcagagccaacgcacaacaacctaagctttttgtcgggatgattcttatcctcattttcgctgaagctcttgctctctacggtctcattgtcggcatcatcttgtcctctcgggcaggtcagtcgagagccgattaagttcactcgagtattgatcactcctcttgtattgatgcacactctattcttggcttcttgttttcttcttcgattttgggcaaatacaactcatattcgacagttactcatagagctaggctctagccgaataaatgcttgtgaagtttcttcggttttgtttcataaatttttttgtatcaccagctgtgaaaatgactcaattgaggatggatttttcagctattctgtttgatgcaatttttcattttttcaattaattggtttcttcacatcagcggaaatctgaaaaag

SEQ ID NO: 1721 - DNA, 999 bp, Solanum phureja
acgacgtgtccagtgaattgagaaattagaacgtgtgatcgagagcgactacaaagaaccagacaatccaaaaacattaattctctctcgccaatcagaaagttgttcttccaaattccgatcggttaccgctgaaatctgtgtgggagtaaacaatggcgtcaactttcagtggcgatgaaacagcgcctttcttcggtttccttggcgccgctgcagcgctagttttctcatgtatgggagctgcttatggaacggcgaagagcggtgtgggagtggcgtccatgggagtaatgaggccagagcttgtgatgaagtcaattgtgccggttgttatggctggtgtgttaggtatttatggattgattattgcagtcattatcagtaccgggattaaccccaagaccaaatcgtattacctttttgatggatatgcgcacctttcttccggtctggcttgtggtctcgctggcctttccgctggaatggctattggaattgttggtgatgctggtgttagagcaaatgcacaacaaccaaaactctttgttggtatgatcttgattcttatttttgctgaggcgttggctttgtatggactgattgtcggcatcatcctttcttcccgtgctggccaatctagagcagaatagaagaaaataatgtgttttcaggtttatgatggaatctttttcatcactgtgcttgcagcttgataaccgatgctagttgttaggtgcatcttctctttttccttttccttttccttttccatcacacattgtgtgttccactggtgtttgtagatttgggagctgccttttccctgtatgtgaccaagagaacgttctctcaatttttccattactgtattttgcaataatgagaagcatcttgttgcttgaatgctgatacaattgtattattattggtggaatgtattgatactcctgaatatatgaaatccaccttgatcattggtataactgcctgagcagt

SEQ ID NO: 1722 - DNA, 770 bp, Solanum phureja
atcaatcaatcaattccaataaacactcagatcgcaaattacttcaatttcccaattcgaagaagataaaaatggcttctacgtttagtggagatgaaacggcaccgttttttggcttcctcggcgctgcagctgccttagtcttctcctgtatgggtgcagcttatggtacagcgaagagtggggtaggagtagcgtcgatgggtgtaatgaggccggaattggtaatgaagtcaattgttccggttgttatggctggagttttgggtatttatgggttaattattgctgtgattattagtactgggattaacccgaaaactaagtcgtattatctatttgatggatatgctcacctttcatctggtcttgcttgtggtcttgctggtctttctgctggtatggctatcggaatcgttggtgatgctggtgttagagctaatgcacagcagccaaagctttttgttggaatgattctgatccttatttttgctgaagccttggctctttacggccttattgtcggtatcatcctttcttctcgcgctggtcaatctagagcagagtagagaaaaagtgtcacctgttccataattgtgaagtatctttgtgttcttcctcgttcgatgagctagtttggctgttgaattacattttgtttagttttggcctccgtgattatgtatttgattgcttggctagaagaattccctcaataaagatatcaaacttttccgatatttttgaaagacaataattggattgctgta

SEQ ID NO: 1723 - DNA, 849 bp, Glycine max
atacttggcgggtccattgaagaaacttcccttggctcagggaagaaagaatagaagagacggaagaggcaaaagcaaataatagaatagatctgactctcattttcagaaagcaaaatggctggtttcagcggcgatgaaactgctccgttcttcggcttcctgggcgcggcggccgccttagtattctcctgtatgggagcggcgtacggcacggccaagagcggtgtcggcgttgcttcgatgggcgtcatgagaccggagctggtcatgaaatccatcgttccggttgttatggccggagtgttgggaatctacggcttgatcatcgccgtcatcatcagcaccggcattaaccctaaagccaaatcctattacctcttcgacggctacgctcacctctcctccggcctctcttgcggtcttgctggcctctccgctggcatggccattggcattgttggcgacgccggtgttagagcaaatgcccaacagccaaagctttttgttgggatgattctcattctcatctttgctgaggcgttggcattgtatggactcattgttggcatcatcctctcttcccgtgctggccaatccagagctgattagtataaaatttcctgttgcttgtagcgcactgaaccacggattggatggtgaatgtcgccggggaccaggtcctgttaagagtttagctttgtgatgctctgcattcgtcttatgataaaattgaggttgtcctgaaataaagcgtctcaaacgatttctttccatttattgtatttaattatgttgagtccaaactagattagagatctatgtaataaagcatgtttgtgtttattt

SEQ ID NO: 1724 - DNA, 1155 bp, Glycine max
tatcaatccaaaaatgaaataattatgtctgtgccgtggcatacttggcgggtccattgaagaaacttcccttggctcagggaagaaagaatagaagagacggaagaggcaaaagcaaataatagaatagatctgactctcattttcagaaagcaaaatggctggtttcagcggcgatgaaactgctccgttcttcggcttcctgggcgcggcggccgccttagtattctcctgtatgggagcggcgtacggcacggccaagagcggtgtcggcgttgcttcgatgggcgtcatgagaccggagctggtcatgaaatccatcgttccggttgttatggccggagtgttgggaatctacggcttgatcatcgccgtcatcatcagcaccggcattaaccctaaagccaaatcctattacctcttcgacggctacgctcacctctcctccggcctctcttgcggtcttgctggcctctccgctggcatggccattggcattgttggcgacgccggtgttagagcaaatgcccaacagccaaagctttttgttgggatgattctcattctcatctttgctgaggcgttggcattgtatggactcattgttggcatcatcctctcttcccgtgctggccaatccagagctgattagtataaaatttcctgttgcttgtagcgcactgaaccacggattggatggtgaatgtcgccggggaccaggtcctgttaagagtttagctttgtgatgctctgcattcgtcttatgataaaattgaggttgtcctgaaataaagcgtctcaaacgatttctttccatttattgtatttaattatgttgagtccaaactagattagagatctatgtaataaagcatgtttgtgtttatttcaatagcatttagtattgtgtcgtataccattcaacacttcggccttctccccacaagccacaacctcaagacctctttttatggtcgtattgagatgtaaaatggctatctgatttcttttatgacgattttcaacataatggataatttcttacccaagagtgacttaataattcgtgtaagtaatgggtaaagctataaataatgatgctgtttgtatcgttgtgtataagggttgcttgttacgtaaaaaatacatttaggg

SEQ ID NO: 1725 - DNA, 978 bp, Glycine max
aaggcagaaaaaggaagaaaaagtaaaacacagagagcaaccaccaatcgaagaagaaacaaccgtaacagatctccgtttctcgccaaacaaaaaacaaaaaaatggctgccttcagcggtgacgaaaccgctcctttctttggcttcctcggagccgccgctgccctcgttttttcctgtatgggcgcggcgtacggcaccgcgaagagcggcgtcggggttgcgtcgatgggcgtgatgaggccggagctggtgatgaaatcgatcgtgccggttgtgatggcgggtgtgttgggtatctacggtttgatcattgcggttatcataagtacgggaattaaccctaaggccaaatcgtactatctctttgacggttacgcgcacctctcttcgggtctcgcttgtggcctcgctggcctctccgctggcatggccatcggcatcgttggcgatgccggtgttagagcaaatgctcagcagcctaaactttttgttggaatgattctcatcctcatttttgctgaggcattggcattatatggtctcatcgttggcatcatcctctcttcccgtgctggccaatccagggctgactaataaactttccagttggatgtggtacacagccacagattgtgaatgttactgtggagtccgggtgggtaatgttagtacacagactgctgctttggcttgctcatgtgattctatttatgtccgcattataaaattgaggttatccaggaagagagtcagtcgaactttccttagccattcattatttttagttatatgctcaaatccaaactagaatagagatatgcacaataagactgatgtatgttttgattccatttactttcaatattgttttctactcttcaaaacgcctcccacctccccttaaatctattcttatttgatttctttgagatgtgatatgtggaaatgggtttctttataatcaacatgatag

SEQ ID NO: 1726 - DNA, 1023 bp, Glycine max
caaaaggcaaggcagaaaaaggaagaaaaagtaaaacacagagagcaaccaccaatcgaagaagaaacaaccgtaacagatctccgtttctcgccaaacaaaaaacaaaaaaatggctgccttcagcggtgacgaaaccgctcctttctttggcttcctcggagccgccgctgccctcgttttttcctgtatgggcgcggcgtacggcaccgcgaagagcggcgtcggggttgcgtcgatgggcgtgatgaggccggagctggtgatgaaatcgatcgtgccggttgtgatggcgggtgtgttgggtatctacggtttgatcattgcggttatcataagtacgggaattaaccctaaggccaaatcgtactatctctttgacggttacgcgcacctctcttcgggtctcgcttgtggcctcgctggcctctccgctggcatggccatcggcatcgttggcgatgccggtgttagagcaaatgctcagcagcctaaactttttgttggaatgattctcatcctcatttttgctgaggcattggcattatatggtctcatcgttggcatcatcctctcttcccgtgctggccaatccagggctgactaataaactttccagttggatgtggtacacagccacagattgtgaatgttactgtggagtccgggtgggtaatgttagtacacagactgctgctttggcttgctcatgtgattctatttatgtccgcattataaaattgaggctatccaggaagagagtcagtcgaactttccttagccattcattatttttagttatatgctcaaatccaaactagaatagagatatgcacaataagactgatgtatgttttgattccatttactttcaatattgttttctactcttcaaaacgcctcccacctccccttaaatctattcttatttgatttctttgagatgtgatatgtggaaatgggtttctttataatcaacatgatagtatccttgctcctatttggtgcatagtaaataggata

SEQ ID NO: 1727 - DNA, 1231 bp, Glycine max
accaactgaaacactctataccgaatccaagttctgtatttccttctcttttccaattgtttgagcgtgaatttttgcgttaatgaagtctgaaacctatgataaggggatatctgttgatgactggaaaatactggtaaagtggtaataggcaaagaagtgaagaatcacaattggtttggaggcccatcgcattgaggcaagtagaaaattgacccgcccaagtggagattcaagtcgggtaccgaacgtgcgactataaagggaatgaacgtggacaccccacgctttcttcacggcaacagaagaataatcaaatttctcagatctatccgacgtcgtcgcagatccaccaaccgttatggctgccttcagcggtgatgaaacggctccgtttttcggcttccttggagccgcagctgccctcgtcttctcctgtatgggagctgcctatggcacagcaaagagtggtgtgggcgtggcttccatgggtgtgatgagacctgagctggtgatgaagtctattgtccctgttgtcatggctggagttttgggtatttatggccttattattgctgttattatcagtaccggtattaatccaaaggccaaatcttattacctctttgatggttatgcacatctctcctctggtcttgcctgtggcttggctggcctttctgctggcatggctattggtattgtcggtgatgctggtgttagagccaatgcacagcagccaaaactttttgttggaatgattctcatcctcatttttgctgaagctcttgccctttatggtctaatcgttggtattatcctgtcttctcgtgctggccagtctagagctgactaagaaaggagttgtgctgcaaaatattctttgaccacccatctgttttaacctctttttagagggggtgagggaggtaattattagtttttccgagcttagcaatgttcaggcagcattttcaggctttagcaattgtgtgaaagttcaatttaccatttgtggtgtttgtttgtgtaattaggtttatgtttacttaataaagcttcttaagcttcctctttttgtttttttactttattgattgtattttgccatatcttctgacctttatatatattttttgggctgctgaaactggtgcatgtaatgatttgatttggctagcaatgcaacgtatttcatgggtctttccatgttggatgttggtaacagctg

SEQ ID NO: 1728 - DNA, 1371 bp, Glycine max
ttttgccaaaggtgataaacaatccaaaaatttttaagaaaaaaaaggagagaaaatttgtaaagaaaaattcatatgtagagaaaaaacattttaatgacataaaccaactgaaacactctataccgaatccaagttctgtatttccttctcttttccaattgtttgagcgtgaatttttgcgttaatgaagtctgaaacctatgataaggggatatctgttgatgactggaaaatactggtaaagtggtaataggcaaagaagtgaagaatcacaattggtttggaggcccatcgcattgaggcaagtagaaaattgacccgcccaagtggagattcaagtcgggtaccgaacgtgcgactataaagggaatgaacgtggacaccccacgctttcttcacggcaacagaagaataatcaaatttctcagatctatccgacgtcgtcgcagatccaccaaccgttatggctgccttcagcggtgatgaaacggctccgtttttcggcttccttggagccgcagctgccctcgtcttctcctgtatgggagctgcctatggcacagcaaagagtggtgtgggcgtggcttccatgggtgtgatgagacctgagctggtgatgaagtctattgtccctgttgtcatggctggagttttgggtatttatggccttattattgctgttattatcagtaccggtattaatccaaaggccaaatcttattacctctttgatggttatgcacatctctcctctggtcttgcctgtggcttggctggcctttctgctggcatggctattggtattgtcggtgatgctggtgttagagccaatgcacagcagccaaaactttttgttggaatgattctcatcctcatttttgctgaagctcttgccctttatggtctaatcgttggtattatcctgtcttctcgtgctggccagtctagagctgactaagaaaggagttgtgctgcaaaatattctttgaccacccatctgttttaacctctttttagagggggtgagggaggtaattattagtttttccgagcttagcaatgttcaggcagcattttcaggctttagcaattgtgtgaaagttcaatttaccatttgtggtgtttgtttgtgtaattaggtttatgtttacttaataaagcttcttaagcttcctctttttgtttttttactttattgattgtattttgccatatcttctgacctttatatatattttttgggctgctgaaactggtgcatgtaatgatttgatttggctagcaatgcaacgtatttcatgggtctttccatgttggatgttggtaacagctgctttttgtgttatattctcgtagtttatggttagg

SEQ ID NO: 1729 - DNA, 992 bp, Glycine max
gacgtggagaccccacgttttcttcacggcaacagaagaataatcgagacacaaagatcatagtgatcattttttaatttctcagatttatccgacgtccttgcagatccaccaaccgttatggctgccttcagcggtgatgaaacggcaccgtttttcggcttccttggcgccgcagctgccctcgtcttctcctgtatgggagctgcctatggcacagcgaagagtggcgtgggcgtggcttccatgggtgtaatgagacctgagctggtgatgaagtcgattgttcctgttgtcatggctggagttttgggtatttatggccttattattgctgttattatcagtaccggtattaatccaaaggccaaatcctattacctctttgatggttatgcacatctctcttctggtcttgcctgtggcttggctggcctttctgctggcatggctattggtattgttggtgatgccggtgttagagccaatgcacaacaaccaaaactttttgttggaatgattctcatcctcatttttgctgaagcacttgccctttatggtctcattgttggtattatcctgtcttctcgtgctggccagtctagagccgactaagaaaggagttgtgctgcaaaatattctttgaccacccatctgttttaacctccttttaaaggggatgagggaggtaattattagttgttccgagcttagcgatgttcaggcagcattttcaggctttagcaatggtgtgaaagttcaattcgccatttgtggtgtttgtttgtataattaggtttatgtttacttaataaagcttcttaagcttcctcttttttatactttattgattgtattttgccatatcatccgacttttatatgtattttttgggctgctgaaactggtgcatgtaatgatttggctagcaatgcagtgtatttcatgggtctttccatgttggatattggtaacagctgctttttgtgtta

SEQ ID NO: 1730 - DNA, 1065 bp, Glycine max
aagtaaagaatgtgagattataaagggaatggacgtggagaccccacgttttcttcacggcaacagaagaataatcgagacacaaagatcatagtgatcattttttaatttctcagatttatccgacgtccttgcagatccaccaaccgttatggctgccttcagcggtgatgaaacggcaccgtttttcggcttccttggcgccgcagctgccctcgtcttctcctgtatgggagctgcctatggcacagcgaagagtggcgtgggcgtggcttccatgggtgtaatgagacctgagctggtgatgaagtcgattgttcctgttgtcatggctggagttttgggtatttatggccttattattgctgttattatcagtaccggtattaatccaaaggccaaatcctattacctctttgatggttatgcacatctctcttctggtcttgcctgtggcttggctggcctttctgctggcatggctattggtattgttggtgatgccggtgttagagccaatgcacaacaaccaaaactttttgttggaatgattctcatcctcatttttgctgaagcacttgccctttatggtctcattgttggtattatcctgtcttctcgtgctggccagtctagagccgactaagaaaggagttgtgctgcaaaatattctttgaccacccatctgttttaacctccttttaaaggggatgagggaggtaattattagttgttccgagcttagcgatgttcaggcagcattttcaggctttagcaatggtgtgaaagttcaattcgccatttgtggtgtttgtttgtataattaggtttatgtttacttaataaagcttcttaagcttcctcttttttatactttattgattgtattttgccatatcatccgacttttatatgtattttttgggctgctgaaactggtgcatgtaatgatttggctagcaatgcagtgtatttcatgggtctttccatgttggatattggtaacagctgctttttgtgttatattctcgtagtttatggttaggttacgtgaaaaatgaatca

SEQ ID NO: 1731 - DNA, 971 bp, Glycine max
cacactgtacggtaacagagatcggagcgtggaacctctctctctctctctctctctgcggaaaccggaatatctcagttctctgatcagatccatccgacgtcgtttcagtgataatggctccgttcagcggcgatgagacggcaccgtttttcggcttccttggagccgcagctgccctcgtcttctcctgtatgggagctgcctatggcacagcgaagagtggcgttggcgtggcttcgatgggtgtgatgagaccagagctggtgatgaagtctattgtccctgttgttatggctggagttttgggtatttatggccttattattgctgttattatcagtactggcattaatcccaaggccaaatcttattacctctttgatggttatgcacatctctcctctggtcttgcctgtgggctggctggcctctctgctggcatggctattggtattgttggtgatgctggtgttagagccaatgcacagcagccaaagctttttgttggaatgattcttattctcatttttgctgaagctcttgctctctatggtctcattgttggtattatcctgtcttcacgtgctggtcagtctagagctgattaagaaagatgtggctgcaaaatattctttgatctaccatctgttttaaccttcttattgtgaaggcaaggggggtaaattgttagttgtgaggttaatgatgttgggataccacttgcaaggtttaacaaatgtgaaagcagttgctgcatcagtcatttttgtgtttgtataagtagtctttctttgcttaataaagctttttaagcttctttttccctatgtgccatataattcttaatcttcccttttttggctgctgccattgtaatttatatgtattaatgggtcttttagtattggatgctggtgtagcttaaacgttgccttgtgttctcaataaaagagcattttgagtattct

SEQ ID NO: 1732 - DNA, 1065 bp, Glycine max
gagtaattaactaactacagtataaaataatggaaatggttccttcccctccacactgtacggtaacagagatcggagcgtggaacctctctctctctctctctctctgcggaaaccggaatatctcagttctctgatcagatccatccgacgtcgtttcagtgataatggctccgttcagcggcgatgagacggcaccgtttttcggcttccttggagccgcagctgccctcgtcttctcctgtatgggagctgcctatggcacagcgaagagtggcgttggcgtggcttcgatgggtgtgatgagaccagagctggtgatgaagtctattgtccctgttgttatggctggagttttgggtatttatggccttattattgctgttattatcagtactggcattaatcccaaggccaaatcttattacctctttgatggttatgcacatctctcctctggtcttgcctgtgggctggctggcctctctgctggcatggctattggtattgttggtgatgctggtgttagagccaatgcacagcagccaaagctttttgttggaatgattcttattctcatttttgctgaagctcttgctctctatggtctcattgttggtattatcctgtcttcacgtgctggtcagtctagagctgattaagaaagatgtggctgcaaaatattctttgatctaccatctgttttaaccttcttattgtgaaggcaaggggggtaaattgttagttgtgaggttaatgatgttgggataccacttgcaaggtttaacaaatgtgaaagcagttgctgcatcagtcatttttgtgtttgtataagtagtctttctttgcttaataaagctttttaagcttctttttccctatgtgccatataattcttaatcttcccttttttggctgctgccattgtaatttatatgtattaatgggtcttttagtattggatgctggtgtagcttaaacgttgccttgtgttctcaataaaagagcattttgagtattctaatattattttgaatgatgactaatgagattgttgaagcaagc

SEQ ID NO: 1733 - DNA, 1011 bp, Glycine max
cacactgtacggtaacagagatcggaacgtggaactgcggaaaccggaatatctcacttctcagatcagatcaatccgacgtcgttgcagttataatggctccattcagcggcgatgagacggcaccgtttttcggcttccttggagccgcagctgccctcgtcttctcctgtatgggagctgcctatggcacagcgaagagtggcgtgggcgtggcttcgatgggtgtgatgagaccggagctggtgatgaagtctattgtccctgttgttatggctggagttttgggtatttatggccttattattgctgttattatcagtactggcattaatcccaaggccaaatcttattacctctttgatggttatgcacatctctcctctggtcttgcctgtgggctggctggtctctctgctggcatggctattggtattgttggtgatgctggtgttagagccaatgcacagcagccaaagctttttgttggaatgattctcattctcatctttgctgaggctcttgccctgtatggactcattgttggtattatcctgtcttctcgtgctggtcagtctagagctgattaagaaagatgtgctgcaaaatattctttgatctcccacctgttttaaaaccttcttattgtgagggcaaggggggtaaattgttagttgtgaggttagtgatgttgggatggcacttgcaaggtttaacaaatacatgtgaaagcagtagctgcaccagtcatttttgtgtttgtttaactagtctttctttgcttaataaagcttcttaagcttttttttccctatgtgccatataatcttagactttatttttgcctgctgccattgtaatttatatgtattaatgggtcttttagtattggatgctggtgtagctaaacgttgccttgtgttttgatcagttgtataatccgaatcgacatggatgttctcaataaaagagcatttattttttatcaataataaaagagcattttgagta

SEQ ID NO: 1734 - DNA, 1076 bp, Glycine max
taatggaaatggttccttcccctccacactgtacggtaacagagatcggaacgtggaactgcggaaaccggaatatctcacttctcagatcagatcaatccgacgtcgttgcagttataatggctccattcagcggcgatgagacggcaccgtttttcggcttccttggagccgcagctgccctcgtcttctcctgtatgggagctgcctatggcacagcgaagagtggcgtgggcgtggcttcgatgggtgtgatgagaccggagctggtgatgaagtctattgtccctgttgttatggctggagttttgggtatttatggccttattattgctgttattatcagtactggcattaatcccaaggccaaatcttattacctctttgatggttatgcacatctctcctctggtcttgcctgtgggctggctggtctctctgctggcatggctattggtattgttggtgatgctggtgttagagccaatgcacagcagccaaagctttttgttggaatgattctcattctcatctttgctgaggctcttgccctgtatggactcattgttggtattatcctgtcttctcgtgctggtcagtctagagctgattaagaaagatgtgctgcaaaatattctttgatctcccacctgttttaaaaccttcttattgtgagggcaaggggggtaaattgttagttgtgaggttagtgatgttgggatggcacttgcaaggtttaacaaatacatgtgaaagcagtagctgcaccagtcatttttgtgtttgtttaactagtctttctttgcttaataaagcttcttaagcttttttttccctatgtgccatataatcttagactttatttttgcctgctgccattgtaatttatatgtattaatgggtcttttagtattggatgctggtgtagctaaacgttgccttgtgttttgatcagttgtataatccgaatcgacatggatgttctcaataaaagagcatttattttttatcaataataaaagagcattttgagtattctaatagtattttgaatgatgagattgttgaagcaagca

SEQ ID NO: 1735 - DNA, 952 bp, Glycine max
ctaccaaaaggccaaaaaggcagacaaagggagaagtaaaaaacacagagcaaccaccgatcaaagaagaaacaaccgcaacagatctccgtttctcgccaaacaaacacaaaatggctgccttcagcggcgacgaaaccgcacctttctttggcttcctcggagccgccgctgccctcgttttttcctgtatgggagcggcgtacggaaccgcgaagagcggcgtcggggttgcgtcgatgggcgtgatgaggccggagctggtgatgaaatcgatcgtgccggttgtgatggctggtgtgttgggtatctacggtttgatcattgcggttatcataagtacgggcattaaccctaaggccaaatcgtactatctttttgacggctacgcccacctctcttcaggtctcgcttgtggcctcgctggcctctccgctggcatggccatcggcatcgttggcgatgccggtgttagagcaaatgctcagcagccaaagctttttgttggaatgatactcatcctcatttttgctgaggcgttggcattatacggtctcattgttggcatcatcctctcttctcgtgctggccaatccagggctgactaataaattttcctgttggatgccacagattgtgaatgttactgtgaagtccgggtgggtaatgttagtacacagctgccgctttggcttgctcaagtgattctatttatgtttacattataaaattgaggctatccaggaagaaagtcagttgaactttccttagcccttcattatttttagttatatgctcaatccagactagaatagagatctccataataagacagatgtatgttttgattccatttactttcaatattgttttccactcttcaaaatgcctcccacctccccctatatctattcttatttgatttcattgagatgtgatctgtcaaaatggg

SEQ ID NO: 1736 - DNA, 1104 bp, Glycine max
tccaaatatttaattaaaaaataattaataattttatttatttatttattaaaaaaaaaaacattgcctaccaaaaggccaaaaaggcagacaaagggagaagtaaaaaacacagagcaaccaccgatcaaagaagaaacaaccgcaacagatctccgtttctcgccaaacaaacacaaaatggctgccttcagcggcgacgaaaccgcacctttctttggcttcctcggagccgccgctgccctcgttttttcctgtatgggagcggcgtacggaaccgcgaagagcggcgtcggggttgcgtcgatgggcgtgatgaggccggagctggtgatgaaatcgatcgtgccggttgtgatggctggtgtgttgggtatctacggtttgatcattgcggttatcataagtacgggcattaaccctaaggccaaatcgtactatctttttgacggctacgcccacctctcttcaggtctcgcttgtggcctcgctggcctctccgctggcatggccatcggcatcgttggcgatgccggtgttagagcaaatgctcagcagccaaagctttttgttggaatgatactcatcctcatttttgctgaggcgttggcattatacggtctcattgttggcatcatcctctcttctcgtgctggccaatccagggctgactaataaattttcctgttggatgccacagattgtgaatgttactgtgaagtccgggtgggtaatgttagtacacagctgccgctttggcttgctcaagtgattctatttatgtttacattataaaattgaggctatccaggaagaaagtcagttgaactttccttagcccttcattatttttagttatatgctcaatccagactagaatagagatctccataataagacagatgtatgttttgattccatttactttcaatattgttttccactcttcaaaatgcctcccacctccccctatatctattcttatttgatttcattgagatgtgatctgtcaaaatgggtgtttttatatcattttaatcaacatgatagcattcttgctcctatttggtgcaaagtaaatatgataagtatttggatttggga

SEQ ID NO: 1737 - DNA, 958 bp, Picea glauca
gatcacctcttctttaatgctctgagattgcatctggatcggccaaaggcactcgcagattccaggttcgaggtttgatctctctgcaggttctgaagctctgaaaaccgtcgaagtcctagcgagaagcctgtcccagatctcggttaaaatggtggaggcattcagcggcgatgagactgctccattcttcggcttcctcggggccgccgcagcgctcgtgttctcctgtatgggagctgcgtatgggactgcgaaaagtggcgtgggcgtggcctccatgggtgtgatgaggccggagcttgtgatgaaatcgattgttccagtcgtcatggctggagtgctgggtatttatggtttgattattgctgtgattatcagcacaggaattaaccccaaggcaaagtcctattatttattcgatggctatgcgcatctttcatcgggactggcttgtgggctctcgggtcttgctgcgggtatggctattggtattgtcggtgatgccggtgtcagagcaaatgcacagcagccaaagctctttgttggtatgatcctcatattgatctttgcggaagcacttgcactctatggccttatagttggtattatactttcttctcgagctggccagtcacgatcagattaaagaagttgcagttggttttctgtttacatggttcatttgtcagtttttctgcaagactgctgtcttctgcagtggaaatgtggttgttctccctaggagataatatttagctcaagattcattattattcccttggtttgcaattttagacttaagaatttaatggtcaatttgaaggctcattacaatgaggaaattgaaacaggtaacaagtgcacattattgctggtcatttggcattctatgaatttgaaatcaaagtgtatgattcgaattttcgagctacttccattgctgcagattactata

SEQ ID NO: 1738 - DNA, 919 bp, Euphorbia esula
  misc_feature (27)..(27): n is a, c, g, or t
  misc_feature (39)..(39): n is a, c, g, or t
tctctcatcccttatttaaatcggatngcagagtaaagntccatttaagagatcacgagcatcaatcaattcacctcctatcttctccgattcgcagcctcaatttttaacaaataaacaacaacaatgtccacgggattcagcggcgatgagactgctccgttcttcggattccttggcgctgctgcggccctcgtcttctcctgtatgggagctgcgtatggaaccgcgaagagcggggttggtgttgcatccatgggtgtgatgagacctgaattggtcatgaaatcgattgttccagtggttatggctggagttttgggtatttacggtttgattattgctgttatcatcagtactggaattaaccctaaggctaaatcttattatcttttcgatggatacgctcatctttcatctggtctctcttgtggccttgctggtctatcggctggtatggctattggcatcgtcggggatgctggtgtcagagctaatgcacaacagccaaagctttttgttggaatgattctaattctcatctttgctgaagctttggctctctatgggcttattgtgggtatcattctttcatctcgagctggtcaatcgagagccgaataaaagattggtccttgtttgaatttgtggttaatgtgggggtgttgtgatttaagagtttatttttgtgtaagataagaataataattattatttttgtataagatagaatgggaaaagtgttttcctactctagaattcaatctctccatttgtatggttcagattcaatctctccatttgtatggttcagtggtatttgctgatactttgaaattttagacgcacatgttttcccctatattaattaatgttctagttgtttgttatggatggattatattatttgctaaagatg

SEQ ID NO: 1739 - DNA, 899 bp, Fragaria vesca
acaaaagacgcgtgtgtgactccaattctcgatcaaaaatctattcccaaatctgagagccaatcccaaatcggagctcccacaaaaatggcatccaccaccttcagcggagacgaaactgcccccttcttcggcttcctcggcgccgccgccgccctcgttttctcctgtatgggagcagcgtacgggacggcgaagagcggcgtcggcgtggcgtcgatgggagtgatgaggccggagctggtcatgaagtcgattgtgccggtggttatggcgggagtgttggggatttatggtctgatcattgctgtgatcatcagtactgggattaatcctaaggctaagtcttattatcttttcgacggctatgcgcatctctcttccggtcttgcttgcggcctcgccggtctttctgccggaatggctatcggaatcgttggtgatgccggtgttagagctaatgcccagcagccaaagctttttgttggaatgattctcattctcatctttgctgaagcgttggctttgtatggtttaattgttggtatcatcctttcatcccgagctgggcaatccagagcagattagaggtaccattcgcgatagcgtctgatgtgagtgtgtgttgcatctttggttactcactggttgaagatgctccattcagtgtgcagtgtgcagtcttgtgttatgttatcagttgcataggtgcaaaaaatatccatttctttttgttggatttggtgatttctcggaataaagcccttcactgattcttcacttccttttgctttgacaattatactgcagaatcaatgcaccgatcttttgttgttgttttgaagattttgcgtaagataggtcgattgttgtagtaaagtaagctaaaaattagaatc

SEQ ID NO: 1740 - DNA, 1192 bp, Fragaria vesca
gagcttcctgcgtgaggctgagatttccgacgctttaaagctctttaacagtgagagagaaatatcgagagagtcagaaacatccagaatccagatccgatccgatcatatcatcttgtccgtaaaatcgacaagagaatggcttccacaaccttcagcggcgatgaaacggcaccgttcttcggcttcctcggcgccgccgcggccctcgtcttctcctgtatgggagctgcgtacggaacggcgaagagtggagtaggagtggcgtcgatgggagtgatgaggccggagcttgttatgaagtcgatcgtgccggtggtcatggctggagtgttgggtatttacgggcttattatcgctgttattatcagtactggtatcaaccctaaggcgaaatcgtattacctgtttgatggttatgctcatctctcatctggtctcgcttgtggccttgctggcctctcagctggtatggctattggcattgttggtgatgctggtgttagagccaatgctcaacagccaaagctttttgttgggatgatcctcattctcatttttgctgaagcccttgctctgtatggtctcattgttggcatcattctttcctcccgagcaggtcagtcaagagctgactaaaaggctatgctgggtggattcctcgaatgctgcttttaaacaagctctatgttctggtataagattttctttcgttttggaagtgtactgcagattcttgtttgttgtgattgacgtctaccggatatttatgtgccaaagctagaaattagagttagcaattagtttctcttctaaataagtttaaaattgcatccttttccaattttcatgagaccggtctgtattgagaattcaaattaatttggccaatattatttcttgtagcattatgttagttatattcttcatattctgtcttttgattggttggctggccatagatgaaatattgttatgccaattatgttccatattctccattataattccaagtcatggtggcttgatgagattgaatatctgagttctgtaaatggaagaagacacagactcgaacaataaaataatctggtgcttggcatgttctggtttttgtactgttgggatccagtgttatagcagacctatgggaaatagatgtactggtacatgaggtctcagaaaccccaat

SEQ ID NO: 1741 - DNA, 1039 bp, Helianthus annuus
agtgttggaacgtgagaggaacacgcataaaacaaccaatacatcgagattgtagatcaaaacgttcaatccaactctgttttcacctccgatccccaaatccgatcaatttcactcccaatttacaacaacaatggccgattcaacattcagtggtgatgaaacggcaccgttctttggattcctcggtgccgctgctgcactcgtattctcatgtatgggggctgcgtatgggacggcgaagagtggtgttggtgtggcatcgatgggagtgatgaggccggagctggtgatgaagtcaattgtgccggttgttatggctggtgtgctcggtatttatggtttgattatcgctgtcattatcagtactgggattaaccctaaggcgaaatcgtattatttgtttgatggatatgcacacctttcatctggtttggcttgtggtcttgctggtctttctgctggaatggccattggaatcgttggtgatgctggtgttagagcaaacgcacagcagccaaaacttttcgtgggaatgattcttattctcatctttgctgaagccttggccctatacggactaattgtgggtatcatcttgtcttcccgtgcgggccagtccagagcagattaagatgacaaaaccttgccatgtatgggtacgtagttattttgaaaaaaaaatgaagatttattctatttcatgctcagtgtccacttaatctggcagcttttgaacaacacttattgctttcctcgaagttttcttcttggtagcgtttctggtctcatttgcagtcttttctggctgtggaataagagttgaaaacttgtgtagttctgtacttttcagtcatgctataagccttgtaggaactattgctatggcatcacggtgtttatatattatgttttatacaaaaaaaaaacaaacaacaaacaatatatcttggttggcccctctcggccccacccgactctagtacttaagcaagcttatgcatgccgccgccaccccagcacactggactggccgtcg

SEQ ID NO: 1742 - DNA, 847 bp, Helianthus annuus
agtgttggaacgtgagaggaacaacgcataaaacaaccaatacatcgagattgtagatcaaaacgttcaatccaactctgttttcacctccgatccccaaatccgatcaatttcactcccaatttacaacaacaatggccgattcaacattcagtggtgatgaaacggcaccgttctttggattcctcggtgccgctgctgcactcgtattctcatgtatgggggctgcgtatgggacggcgaagagtggtgttggtgtggcatcgatgggagtgatgaggccggagctggtgatgaagtcaattgtgccggttgttatggctggtgtgctcggtatttatggtttgattatcgctgtcattatcagtactgggattaaccctaaggcgaaatcgtattatttgtttgatggatatgcacacctttcatctggtttggcttgtggtcttgctggtctttctgctggaatggccattggaatcgttggtgatgctggtgttagagcgaacgcacagcagccaaaacttttcgtgggaatgattcttattctcatctttgctgaagccttggccctatatggtctaattgtgggtatcatcttgtcttcccgtgcgggccagtccagagcagattaagatgacaaaaccttgccatgtatggcttttgaacaacacttattgctttcctcgaagttttcttcttggtagcgtttctggtctcatttgcagtcttttctggctgtggaataagagttgaaaacttgtgtagttctgtacttttcagtcatgctataagccttgtaggaactattgctatggcatcacggtgtttatatattatgttttat

SEQ ID NO: 1743 - DNA, 861 bp, Camellia sinensis
gatttacctgcaaatcacaaccagaaaaactaaaaatgtcttcaacgttcagcggcgatgaaactgcacccttcttcggcttcctcggcgctgcagctgccttagtcttctcctgcatggacgctgcgtatgggacggcgaagagcggagttggagtggcgtcgatgggtgtgatgaggccggagctggtcatgaagtcgatcgtgcccgtggttatggctggtgtgttgggtatctatggattgaacattgctgtcattatcagcactgggattaaccctaaagccaaatcttattacctttttgatggatacgctcatctttcgtctggtcttgcttgtggcctcgctggcctctctgctggtatggctattggtatcgtcggcgatgccggtgttagagccaatgctcagcagccaaaactttttgttgggatgatcctcattctcatctttgctgaagcgcctgctctttatggcctcattgttggcattattctatcttctcgagctggtcaatcgagggcggactaaaatagggcattctggttggtggtggtggtgatggtggtttggtttgttgctattgataaagaattattttgatgttctctccagtcaaaattgaaattcagtcgagggagtgtcttctgattcaaaaattttcgatttggttctgcattgcttgctgagatggactgggtagttggcatgtgctaatggtagaatgtagattagctttttgttctctctttaaatatattgtactgcttcggtttatggatactctgtttcacaatcagtttgaatttggctagaaaacaaaaacaacatgtcggccgctcggcctatgtgcggcgca

SEQ ID NO: 1744 - DNA, 726 bp, Thalictrum flavum
caacattcagtggagatgaaactgctccattctttggtttccttggtgcagcagcagctttagttttctcctgtatgggagcagcttatggaacagcaaagagtggtgttggtgtagcatcaatgggtgtgatgagacccgaacttgtaatgaaatcgattgttccagttgttatggctggagttttgggtatttatggattgattattgctgttattattagtactggaatcaatccaaaagccaaatcttattaccttttcgatggttatgcccatctttcatctggtcttgcttgtggtcttgctggtctttctgctggtatggctattggtatcgttggtgatgctggagtaagagccaatgcgcagcagccaaagttgtttgtgggcatgattctaatcctcattttcgctgaagcgcttgctctatatggtcttatcgtgggtatcattctctcctctcgagctggccagtcacgagcagactaagcggtaaagcggaggttgtttttacgagcagactaagcgaagattatttgggagcttcttttgtcttaatactagagtcaagaactgcaagtgaatttattgttcagtttaatttctcggattattcttttgtggtgttaagagattgtatatttcgaatgtttcccaattgaaactaaaacaactttgcactttctctattgatatttattgatcaatgtatgtgatttattgc

SEQ ID NO: 1745 - DNA, 969 bp, Eutrema halophilum
atgacaaaatacttcacttttcgaagtttacaagaaaacatcaaattttgcggttcgtcgttctcctccactcatctgaaaatccccaaaaaaaaaaaaaaacaaaaaaatcacagaggtcgctacaaaatccaaatctctctcccaagatttgaacgatccggtctaagatccgagaagatgtctacgttcagcggcgatgaaactgctccgttcttcggcttccttggcgcggcggctgccctggtcttctcctgtatgggagctgcttatgggactgcaaagagtggtgttggtgtagcttcaatgggagtgatgagacctgagttggtgatgaagtctattgtccctgtggttatggctggtgttttgggtatttatggactgattattgctgttataatcagtaccggtattaaccccaaggctaagtcttactacctctttgatggatacgcacacctctcgtctggtcttgcttgtggtcttgctggtctctcggctggaatggctattggaatcgtcggagatgctggagtcagggcaaatgctcagcagcctaagctctttgttgggatgattcttatccttatcttcgcggaagcacttgctctctacggtcttattgtaggcattatcttatcctctcgagctggtcagtccagagcagaatgagatacacaatataagatgttgaaatccaggtacttccttatggtatgtcgtatcgggagccaatattttgtggattcttggaattttttctgggaagcagatcggctgccatctccgttttccttggttggtggttgcttgatgtcattgtttggttcggtaataaacgagattggcaatgttttatactgtttgcatatgtcttgaggaacttgatgatattttgtttgtaaagaagtttacttctgaaaccatctttgagtgttaagatgagattattaaatcttttgtgcc

SEQ ID NO: 1746 - DNA, 1102 bp, Eutrema halophilum
gtaagaggcccaaaatgacatggtcgtttctgttaaagaacaagctacacgttgttcccttccactcatctgaaaaaaaaaaaaacaaataaataattaaacgatatccacatttctccatctctctctcgccagatttcaatcatcgacccgatttcagatttcagatttcagatttcagatttcagatcccagatccaagcttcaaccatgtctacgttcagcggagatgaaacagctcccttcttcggtttcctcggcgctgcagccgcactcgtcttctcctgtatgggagctgcttatggaaccgcaaagagtggtgttggtgtggcttctatgggagtgatgaggccagagttggtgatgaaatcgattgtccctgttgttatggctggagttttgggtatttacggattgattattgctgttatcatcagtaccgggattaaccccaaggccaagtcttattacctctttgatggatacgcacatctctcctctggtcttgcttgtggtcttgctggtctttcagctggaatggccattgggattgttggtgatgctggtgtcagggcaaatgctcagcagcctaagctctttgtcggcatgattcttatccttatcttcgccgaagcgctcgctctttacggtcttattgtaggaattatcctttcctcaagagctggccaatctagagcagaatgagaaagtagccacaagatttgcttcaaaggtactttctttacttctgtgtgcattttgttttatcgttcttagtatgtatcatcgggaacagtaaatttactggattcttggaactttgtttcggaagcaaaaaccgactatcgtcatccccttttctctcccggtggttgctctccgatgtaggaatttttattgtttggttctgtaataaagagctctgatgagcttggtttgtttttgtattcttgtattgtcctgaggaagttaaatacatttatttgtaaagaagtttgctttctgaaaccaacttgagttcttatgaaattagtctgcaatgtggcttgctctactctgctgtttgttccaactttttgttgtgttttcgtcgaaaaaagtt

SEQ ID NO: 1747 - DNA, 1059 bp, Eutrema parvulum
aactaggcccaggcccaaaatgacgtggtcgtccttgttaaagaacaagctacgttgttcccttccactcatctgaaaaacaaaaaataaataaataaatttagagcgatatccacatctctccatccctctctcgccagatttcaatcatcgacccgatttcagattttcagatttcagatctcagatacaacttcttcgacatgtcaacgttcagcggcgatgaaacagctcccttcttcggcttcctcggcgccgcagccgcactcgttttctcctgtatgggagctgcttatggaaccgcaaagagtggtgttggtgtggcttctatgggagtgatgaggcccgagctggtgatgaaatcgattgtccctgttgttatggctggagtgttgggtatttacggattgattattgctgttatcatcagtaccgggattaaccccaaggctaagtcttactacctcttcgacggatacgcacacctctcatccggtcttgcttgtggtcttgctggtctttcagctggaatggccattgggattgttggagatgccggtgtcagggcaaatgctcagcagcctaagctctttgtcgggatgattcttatccttatcttcgcagaagcgctcgctctttacgggctcattgtaggaatcatcctctcctcaagagctggccagtctagagcagaatgagaaagtatccacaagatttgccccaaggtacttcctttactttctgtgtgcgtttttattttattgttcttagtatgtatcatcgagaaccgaacaatttactggattcttgaaactttgtttcggaagcaagaccacctttcctcatcccctttttctgtcccggtggttgctctccgatgtagggatttttattgtttggttctgtaataaagagctctgaggagcttggtatgtttttgtattcttgtattgtcctgaggaagtttaatacatttatttgtaaagaagtttgctttctgaaaccatctcgagtcttacgaagttagtctgcgatgtgtcttgctttcctctgatgtgt

SEQ ID NO: 1748 - DNA, 896 bp, Nicotiana tabacum
  misc_feature (47)..(47): n is a, c, g, or t
  misc_feature (497)..(497): n is a, c, g, or t
  misc_feature (524)..(524): n is a, c, g, or t
  misc_feature (539)..(539): n is a, c, g, or t
  misc_feature (542)..(542): n is a, c, g, or t
  misc_feature (574)..(574): n is a, c, g, or t
  misc_feature (818)..(818): n is a, c, g, or t
ggcgggagcagggtatacgcagttacggccggggccgatcagaaaanctgccttcaaaattccgatcgatcaccggcgatatctctgagcaaactgaaaaaatgtcttcaactttcagcggcgatgaaactgcgcccttcttcggtttcctcggagcagctgcagcgctcgttttctcctgtatgggagctgcttatggaacggcgaagagcggtgtgggagtagcgtcgatgggagtaatgaggccagagcttgtgatgaagtcaattgtgccggttgttatggctggagtgttaggtatatatggtttgattattgcggtaatcatcagtaccggaattaaccctaagaccaaatcgtattacctttttgatggatatgcgcatctttcttctggtttggcttgtggtctcgctggcctttccgctggaatggctattggaattgttggtgatgctggtgttagagcaaatgcacaacaaccaaaactgtttgtnggtatgatcctgattctcatctttgcngaggcattggctttntanggactgattgtcggcatcatcctttcttcccntgctggtcaatctagagcagaatagaaattaatgatttccaggttcatgatggaatcattttgcatcattgtgctggcagtttggtaactgatgctcgtttagatgccttcttttccttttccgtcacactttgtcacttgtagtagatttggaagctgctttttccctgcatgcaatctagagaacgttctcttaatttttcagttgctatatcttgcaataatgaggagcatcttgttggtngaatgctgatacagttgtatatttttgttggaatgcatttataacctcagtatatgaaatccaccttgatcattgcta

SEQ ID NO: 1749 - DNA, 872 bp, Nicotiana tabacum
agatcaatcgtaaagtaaggaccagacattctcagattccgatcaataaacttttttttttctctcagatcgcgaatcgcttcaattccaattcgaagaaaaaatggcatcgacttttagcggcgatgaaacggcaccgttcttcgggttcctcggcgctgcagctgccttagtcttctcctgtatgggagcagcttatggaacagcgaaaagtggggtaggggtagcatcgatgggagtaatgaggccggaattggtgatgaagtcaattgtgccagttgttatggctggagttttgggtatttatgggttaattatagctgtgattattagtactgggattaacccgaaaacaaagtcgtattatttatttgatggatatgctcacctttcatctggacttgcttgtggtctcgctggcctttctgctggtatggctattggaatcgttggcgatgctggtgttagagctaatgcacagcagccaaagcttttcgttgggatgattctgattcttattttcgctgaagctttggctctttacggccttattgtcggcatcatcctttcttctcgcgctggtcaatctagagcagagtagagaaagatcctctcttgttccatatttgtgtagtatctttgtgttcttccttgttggacgagtgagtttggctgttaaatcatattttgttttgttttgggctccaagattatgtatttgtttgcgtggctagaagaattggttacgtgcagatcagctgtagattagatctctcaataaagatatcagtttttctgatgctccatttttcagtgacgacaatggatttttgtaaaatgttgcgtgtattatttgctctcaactctgaaaa

SEQ ID NO: 1750 - DNA, 905 bp, Nicotiana tabacum
tctctctctctttttctctctctcagaagacattgagaagtatctcagatccaaatcaatagcacacttctgagatccaatcagaaacaatgccttcgactttcagcggcgatgaaactgctcccttcttcggcttcctcggcgctgctgctgccttagtcttctcctgtatgggagcagcttatggtacagcgaagagtggggtaggggtggcgtcaatgggtgtgatgaggccggagttggtgatgaagtcaattgtgccagttgttatggctggtgttttgggtatttatggattgattatagctgtgattattagtacagggattaacccgaaaaccaagtcttactatctttttgatggatatgctcacctttcttctggtcttgcttgtggtcttgctggcctttctgctggtatggccattggaatcgttggtgacgctggtgttagagccaatgcacaacagccaaagctttttgtcgggatgattttgattcttatttttgctgaagccctggctttgtatggccttattgttggaatcatcctctcttctcgtgctggtcagtctagagcagagtagaagaagagaatgttgtgcaccattactgtgaattatctttgtgtttttcatggataagctagtctggctgctgaattacatttcccttttatctttgggttccaagattctgtacttgattgcttggttagaagaattggttcatatatgcagttctgctgtagattagatctctaaataaagaagccagttaatctgacgccccaactttcaaggacaacgggtttttgtaaaatgccactgtatcattttttcttaacttgaattcaagtttttgatattctataccctgttttatctctttgtttgccctttacc

SEQ ID NO: 1751 - DNA, 1036 bp, Nicotiana tabacum
cgggggacggcgccacacaaacaaaaaaaaaaacacgtattttctctctcacgagacgcgaagaaatacaggaacttctcagatccgatcattcacactttttcttctctctccaaaaacaacttcgcagaaacaatggcgtcgactttcagcggcgatgaaacggctcccttcttcggcttcctcggcgctgccgctgccttagtcttctcctgtatgggggcagcttatggtactgctaagagtggggtaggagtggcatctatgggtgtgatgaggccagagctagtgatgaagtctattgtgcccgtggttatggctggagttttgggtatttacggattgattatagctgtgattatcagtactggcattaacccaaaaaccaagtcttattatctttttgatggctatgctcacctttcttctggtcttgcttgtggccttgctggcctttctgctggtatggccatcggaatcgttggtgatgctggtgttagagctaatgcgcaacagccaaagctctttgttgggatgattctgattcttattttcgctgaagccctggctctttatggccttattgttggcatcattctctcttctcgtgctggccagtcgagagcagagtagaagacgagcatgttatgctctgtaactgtgaattatctttttattcttctgcattggatgagatagtctggctgaattatgttactttgtgttttgggctccatgtagttgattgtttggcttgcagaattggttcacatctgctgatcggctgtagattcgatctcttatcaataaagatatcagtttacctgatgctcaaggacaacaaaggatttatgtgagaggttcctgtgttatttcatgtcaccttcaaatttagtatttataactctttagctctgtatctcttgtttttcctccccatatatgtttccattttagttttggatttgttctgtctctactcctgcttcgaatacttagtgctttcaattgaaaatgaattgatccagtgttttgc

SEQ ID NO: 1752 - DNA, 980 bp, Solanum lycopersicum
gaattgagaaattagaacgtgtgatcgagagcgactacaaagaaccagacaatccaaatacaataattctctctcgccaatcagaaagttgttcttccaaattccgatcggttaccgctgaaatctgtgtgagagtgaacaatggcgtcaactttcagtggcgatgaaactgcgcctttcttcggtttcctcggcgccgctgcagcgctcgttttctcatgtatgggagctgcttatggaacggcgaagagcggtgtgggagtggcgtccatgggagtaatgaggccagagcttgtgatgaagtcaattgtgccggttgttatggctggtgtgttaggtatttatggattgattattgcagtcattatcagtaccgggattaaccccaagaccaaatcgtattacctttttgatggatatgcccacctttcttccggtttggcttgtggtctcgctggcctttccgctggaatggctattggaattgttggtgatgctggtgttagagcaaatgcacaacaaccaaaactctttgttggtatgatcttgattcttatttttgctgaggcgttggctttgtatggactgattgtcggcatcatcctttcttcccgtgctggccaatctagagcagaatagatgaaaataatgtattttcaggtttatgatggaatctttttcatcattgtgcttgcagcttgataaccgatgctagtcgttaggtgcatcttctcttttcctttttcttctccttttccttttccttcacacattgtgtgttcccccggtgtttgtagatttgggagctgccttttccctgtatgtgtgaccaagagaacgttctctcgattttacctttactgtattttccaataatgagtcgcatcttgttgcttgaatgctgatacgattgtattattattggtggaatgtattggtacacctgaatatatgaaatccaccttgatcattgctataac

SEQ ID NO: 1753 - DNA, 846 bp, Solanum lycopersicum
gtattatttaacagaagcattttagatcaatcaatcaatcgattccaataaacactcagatcgcaaatcacttcaatttcccaattcgaagaagataaaaatggcttctacgtttagcggcgatgaaacggcaccgttttttggcttcctcggcgctgcagctgccttagtcttctcctgtatgggtgcagcttatggtacagcgaagagtggggtaggagtagcgtcgatgggtgtaatgaggccggaattggtaatgaagtcaattgttccagttgttatggctggagttttgggtatttatgggttaattattgctgtgattattagtactgggattaacccgaaaactaagtcgtattatctatttgatggatatgctcacctttcatctggtcttgcttgtggacttgctggtctttctgctggtatggctatcggaatcgttggtgatgctggtgttagagctaatgcacagcagccaaagctttttgttggaatgattctgatccttatttttgctgaagccttggctctttacggccttattgtcggtatcatcctttcttctcgcgctggtcaatctagagcagagtagagaaagagtgtcacctgttccataattgtgaagtatctttgtgttcttcctcgttcgatgagctagtttggctgttaaattacattttgtttagttttggccttcgtgattatgtatttgattgcttggcaaagaagattccctcaataaagatatcaaacttttcggatatttttgaaagacaaataattggattgctgtaaaatgttccttgtattaatttactttaagctttcatttgtttctgt

SEQ ID NO: 1754 - DNA, 900 bp, Tragopogon dubius
gacgacaagtgttggaaggtgaaaggaacaacgcataaaacgatcaacacattcagatcagaaattagagattagagatcgagacacagagattcaactctgtttgcccttctccgatccaaatttcattcaatttcactctcaatttcgatcaacaatgggttcagattccttcagtggtgatgaaaccgcgcctttctttggattcctcggcgccgctgctgccctcgttttctcatgtatgggggcggcgtatggaaccgcgaagagcggtgttggcgtggcgtcgatgggagttatgaggcctgagctggtgatgaagtccattgttccagtcgttatggctggtgtgctcggtatttacggtttgattatcgctgtcatcatcagtaccggaatcaaccctaaggcaaagtcttattaccttttcgatggctatgcacatctttcctccggtttggcttgtggtcttgccggtctttccgccggaatggccatcggaatagtcggagacgccggtgtcagagcaaatgcacagcagccaaagctttttgtgggaatgattcttattctgatctttgctgaagctctggctctatacggtctgattgtgggtatcatattgtcttcccgtgctggtcaatccagagcagattaagaagctctcgccattatcatcggtatgtagttattctgagaaattgaacaagcaaatactcattgagctactctaaattttctccttggtagcatttgtggcttcatttgcattcttttatggtgtttatgattactctatggaataagagtttggaacagtccatggttttgttaaaaacatgtgtcacttttgttctgtactcctttattgctgtttatttatttcatctttcttttcgt

SEQ ID NO: 1755 - DNA, 870 bp, Zostera marina
ctagatctctgcacgatctcaaatcagaagaagacccgaccttctcctccttcgatctaagttttccgatccgatcaaaatatgtccaccttcagcggcgatgagactgctccttttttcggtttccttggagccgcctctgctctcgtcttctcctgtatgggggcggcgtacgggacggcaaagagtggtgtaggagtggcttctatgggagtgatgaggccagagctggtcatgaaatcgatcgttcccgttgtcatggcgggagttcttgggatttatggacttattattgctgttattattagcactgggattaatcccaaggctaagtcttactatctattcgacggttatgcacatctctcgtccggtttggcttgtgggcttgccggattatctgctgggatggccattgggatcgtcggtgacgctggcgtcagggccaacgcacaacaacccaaactctttgtgggaatgatcctcattctcatttttgctgaagcacttgctttatacggtcttattgttggcatcatcttgtcatctcgtgccggtcaatctcgagcggactagataaaaccccaaatctgatctgagaggggggaggaaggagagagcaaacgtgtgctgagatttttcctttaaaattcgccttttcttctatgggttgttgatgatacaatgcatgcttgtttgtttgttgtaagtttcaactttgcttttcttcttctatatgcattccaccatcattatgagattttgtattgcttctttattttgtaatatttgttgcctatcgaataatcataacaattattattaatttaataaatcctattcatttcttaatatttattttcatcttaa

SEQ ID NO: 1756 - DNA, 759 bp, Ambrosia trifida
ataaccgatcatgtcttcaacgttctccggcgatgaaacagcgccgttttcggactccttggagccgctgccgctctagtcttctcctgtatgggggcggcgtatgggacggcaaagagtggtgtcggagtggcgtcaatgggagtgatgaggccggagttggtgatgaagtcaattgtgccagttgttatggctggagtgttggaatttacggtttgattattgctgtgattattagtactggtataaaccctaaggctaaatcgtattacttgtttgatggatatgcgcatctttcgtccggtctggcttgtggtcttgctggtctttctgctggtatggctattggaattgttggtgacgctggtgttagagccaatgcacaacaaccaaaactttttgtggggatgatcctcatcctcattttcgctgaagctcttgctctttacggtcttatcgtcggcatcatcctttcttctcgagctgggcagtcgagagctgactaggagagtggcagttgatggatgatcccgtacttgatcgtgtgttttgcagctataacatgaagcatttttcttggttgcgagtttgggtggagttgaagctgtgtggtgttttgttttattatctgtggttggcaaatggtggtcatgatcatatgtgttgagggttggttgtagactagttttctgctataataagggcgtccctgttactggtattatttgttgctatatttatttgtttattattattatt

SEQ ID NO: 1757 - DNA, 1189 bp, Gossypium raimondii
aaacaaaaaatacaacctgagtaactaatggtaggtttggatgggtgattgggtgcggtgtgtagtgtttagcttattttttgtctcacgctataatatcattacagtatctaatctcactgccactgctatttttatactaactgcaagtaggcaccgcccatccaaacgcagctaagcacgttgcgagttgggactataaaaaatcggtgtctgatatttttattttctcaaaccagagagtgaaaaaaaaatttctctggaagcaaagcaactatcaactacgtttacctcagatctaaaacccctcgtctcagatccactaaattcaccatgtctactactttcagcggcgatgaaacggctcccttcttcggcttcctcggcgccgccgccgctctcgtcttctcctgtatgggagctgcatacgggacggctaagagcggtgtgggtgtggcttcaatgggtgtgatgaggcctgagttggtgatgaaatccattgttccagttgttatggctggtgttttgggtatttatgggttgattattgctgttattattagtactggcatcaatccaaaggccaaatcgtattatctttttgatggttatgcccatctttcctctggtcttgcttgtggacttgctgggctttcagctggaatggcaatcggaattgttggtgatgctggtgtcgagctaatgcacagcagccaaaactttttgttggaatgatccttatcctcatctttgctgaagctttggctctttacggccttatcgtgggcatcatcttgtcttctcgggctggccaatctagagcagagtaaggcgctggtagagctgttttagtagtattcttttattacttatcgtgtttattatgattggacgtcaagtggtgggtttgatgagcagtgtctctttcctctttgtagaagtagaattgagttctctctctaataaattgtatggttattgtttgataagtgtatttgcagtgtgtggaacacttttaattttggagagataatatatgtatgtatttaatccatagcttttagatggttggtggatgtatttatttttggtacgtatcaatattgatgtatcaaaacaatatcacactacttgttaaataatgcctgaaaattttaattatagcatacactacatttttcaaaatcca

SEQ ID NO: 1758 - DNA, 775 bp, Allium cepa
  misc_feature (635)..(635): n is a, c, g, or t
tcacgatccccatatcatctcattttcatcatcatcgtcatccaaataatcaaatctctcctccttcaatagaaaatctctaatcaaattacaaccgcacaaatattaataatggtgggttttagtggagatgaaactgctcctttctttggattccttggcgccgccgccgctctggtattttcatgcatgggagcagcatatggaacagcaaagagtggggtaggtgtagcatcaatgggagtgatgaggcctgagctcgtaatgaaatcaattgttcctgttgtcatggctggagttcttggaatttacggattgattattgctgttattatcagcactggaattaatcccaaggcaaaatcatattatttatttgatgggtatgctcatctttcttctggattggcttgtggtcttgctggtttgtctgctggaatggctatttgggattgttggtgatgctggtgttagggccaatgcgcaacaaccaaagctttttgttggtatgattttgatcctcatctttgctgaagctcttgctctgtatggtctcatcgtcggcatcatcttgtcttctcgtgctggacaatcgcgtgccgattgatttcgcccaattgctttgttttctcggngtttctctgtattattttattgcatggcttgttatacaaatagaagtcaggttcaataaaaattcaagtacttgcatcatttaaaatgttgtaatggttgatttaaaactctgtaatgtgagatactggctgatattaaa

SEQ ID NO: 1759 - DNA, 899 bp, Platanus occidentalis
ctctctctgcagatcacagaattctcagatccgatcgtagtatcggcaaatccagactcgaaaatgtcgacgttcagtggcgatgagactgctccgttcttcggcttcctcggcgctgcagctgccctagttttctcctgtatgggagctgcttatggaacggcgaagagcggtgttggtgtggcctccatgggtgttatgaggccagagctagtgatgaaatcgatcgttccggtcgttatggctggggtgttaggtatttatggactgattattgccgttatcatcagtactggaataaatcctaaggccaaatcgtattaccttttcgtatggttatgcgcacctttcttctggtcttgcttgtggtctggctggtctctctgctggaatggccattgggattgttggtgatgctggtgtcagagccaatgcacaacagccaaaactctttgttgggatgatcctaatcctcatctttgctgaagcactggccctttatggcctcattgttggcatcatcctctcctcccgagctggccaatccagagcagactaggaaatagaggtgtcctgccctatgttcctgcatggtttgttggtattaagtcacaactcaattcttctcaatctagttatagtagttcagcatgttcattatcccctaagattctccactcggaacatgatttctttaccgcttgcatttggtggttgcattgtagtggtcctagaattaggtatgagtttttccccgaaataaagcttgcaaagctgtttatgtccaatatatctattgctgtattttgcggatataagttttagctggtatgaaaactgccattcgggtatttgtgcctgtgttactttgttatgtgccatcccttggttttaaaatt

SEQ ID NO: 1760 - DNA, 496 bp, Brassica juncea
atgtctacgttcagcggagatgagactgctcctttctttggcttcctcggcgctgccgccgccctcgtcttctcctgtatgggagctgcttatggaactgcaaagagtggtgttggtgtggtgtctatgggagtgatgaggcccgagctggtcatgaagtccattgtccccgttgttatggctggtgtgttgggtatttacggcttgattattgctgttatcatcagtaccggtattaacccaaaggccaagtcttactacctcttcgatggatacgctcacctctcctccggtcttgcttgtggtcttgctggtctctctgctggaatggccattgggattgtcggtgatgctggtgttagggcaaatgctcagcagcctaagctctttgtggggatgattcttatccttatcttcgcagaagcgcttgctctttacgggcttattgtaggaatcatcctctcctcaagagctggccagtctagagcagaatgag

SEQ ID NO: 1761 - DNA, 684 bp, Brassica juncea
gaaaatgtctacgttcagtggcgatgaaaccgctccttccttcggcttccttggcgctgccgcagccctcgtcttctcctgcatgggagctgcatatgggactgccaagagtggtgtgggtgtggcatctatgggtgttatgagacctgagttggtcatgaagtctattgtccccgttgttatggctggtgtcttgggtatctatggtttgatcattgctgttatcatcagtaccggtattaaccccaaggctaaatcttactacctcttcgacggatatgcacatctctcttctggtctcgcttgtggtcttgctggtctctctgctggaatggccattggtattgttggtgatgctggtgtcagggccaatgctcagcagccaaagcttttcgttggtatgattcttatcctcattttcgctgaagctctggctctatacggtcttatcgtcgggatcatcttgtcctctcgagctggtcaatccagagccgaatgagaagagaatgctgttcgttcctagattctgcgtgattctttctttggttttttttcgctctcgtcttatattatttctcaggttagtagagggacagtggttttgctacttgtagcatgtttcttaataacgtactgtccgcacgaaacaaaaaccacagagtcaccaaagtgttgttcgttttc

SEQ ID NO: 1762 - DNA, 925 bp, Vaccinium corymbosum
aagcggggggatttggtgtcattcctgattcttcgtctttcccaatctgaattttggatcagacgcaaaaagcagagccatcgaacaacggagacagaaaaccagaacaactttcagatctaatcgaagcaccaaaaccctcaaaatcagatcaagatgtcttctgcggggttcagcggcgacgaaacggcaccattcttcggcttcctcggcgctgccgctgcgttagtcttctcctgtatgggagcggcatatgggacagcgaaaagcggtgtaggggtggcgtcgatgggggtgatgagaccggagctagtgatgaagtcgattgtgcctgtggttatggctggtgtgttaggtatttacggtttgattattgctgtgattataagcactggaattaaccccaaggccaagtcttattatggctacgctcatttatcgtctggccttgcttgtggcctcgctgggctttctgctggtatggctattggtattgttggcgatgccggtgttagggccaatgctcaacagcctaaactttttgtaggcatgatccttattctcatctttgctgaagctcttgctctgtatggcctcattgtgggcattatcctctcttctcgagctggtcaatcgagagctgattagaacagggcattgttgttggcggcggtggtgtttcttcctattgattgaggctatagtgatgctctctctggttagaaatggtaatacagttaaagaagtgttctagttgcgacattgcttggtattattgggtggttcttgttgcgacgtgtttatggtatattgtagtttcactgttacttcttaagtgctattgttctgtttaccctagatgcttttatcatttggattctaaaaaccctaatatgaatttaccgaactgaaaaccctattatgt

SEQ ID NO: 1763 - DNA, 952 bp, Lactuca sativa
aaaaatgtgtgattaacccaaataaatttacaacgaaacggtatttaacttttccatagatccgattccaatcaataatttgaagatttttcttcgataaaatcctccaaaaaagctgtccgtcctctcggtatccaaaaggacaggtgttcatcaacatacacacatacacagatctaaaactctttccatttccacttttccgatcgattttaatccaaaatcgattaacaatgtcttcaggttcagcattcagtggtgatgaaactgcccctttctttggtttcctcggcgcagctgctgccctcgtcttctcctgcatgggagcggcgtatggaacagcgaagagtggtgttggtgtggcgtcgatgggtgtgatgaggcctgagctagtgatgaagtcgattgttcctgtggttatggctggtgtgcttggtatttatgggttgattatcgctgttatcatcagtactgggattaaccctaaagcaaaatcgtattatctgtttgatggctatgcacatctttcctctggtttggcttgtggtcttgctggtttgtctgcaggaatggcgattgggattgttggtgatgctggtgttagagcgaatgcacagcaaccaaagctttttgtgggtatgattcttatcctcatctttgctgaagctcttgccttatacgggctcattgttggcatcattttgtcttcacgtgctggacaatcaagagcggattaagaagattgatttttttttttttttttgaaatatctgtttgttgtttgttttgttttcataaatcaagatcatttttttatttcataattttccagcttttggacacatgttattgcattaccttaaattttcgtgatattattgggattctttgtggactcattatcactagcgtttatgtttgtgcagaataagagtttttgttaattttttgt

SEQ ID NO: 1764 - DNA, 864 bp, Capsicum annuum
ctctcgttctctctctttggacattgagaacaacaatctcagatccaatcaaattgttacttagtacactctttgtcttcacagatccaatcggaactaaaaaaaacatgtcgacttttagcggcgatgaaactgctcccttctttggcttccttggcgctgctgccgccttagttttctcttgtatgggagcagcctatggtacagcgaagagtggggtaggagtggcgtcaatgggtgtgatgaggccagagttggtgatgaagtcaattgtgccagttgtcatggctggagttttgggtatttacggtttgattatagctgtgattattagtacagggattaaccccaaaaccaagtcttactatctttttgatggatatgctcacctttcctccggtcttgcttgtggtcttgctggcctctctgctggtatggccattggaatcgttggtgacgctggtgttagagccaacgcgcaacagccaaagcttttcgtcgggatgattttgattcttatttttgctgaagccctggctttatatggccttattgtcggtatcatcctctcttctcgtgctggtcagtctagagcagagtagaagaagagcatgcttcacacctttactgtgaattactcatattcttgatggattattacattttctttcattcttcacttccactattctgtacttgattgtttttggctagaagaattggttcatgtgtgctgttcttctgttgattatatctctaaataaagatgtcagttaatctgatgcccgattttcaaggactacgggcttttgtaaaatgcccggtgtacattttatctcgacttcaattcaaatattaatttac

SEQ ID NO: 1765 - DNA, 987 bp, Capsicum annuum
gggaaattgtgcataaccaaaatgacgtcgaaagcccaaacccattataacatgtgaaatcatcaattattccatttgcttcaacaccaatcgatactagagggaggagaaagagatctctccattcaactccaaaactcaaaattgtcagatccaaatagtaaagacaatgtcgaccttttccggagatgaaactgctcccttcttcggcttccttggcgccgctgctgcccttgtcttctcttgtatgggggcagcttatggaacagcgaagagtggtgttggagtggcgtcaatgggagtgatgagaccggagttggtgatgaaatcaattgtgccagtggttatggctggtgtattaggtatttatggcttgattattgctgtgatcatcagtaccgggattaaccccaaaacaaagtcgtattacctatttgatggctatgctcatctctcatctggacttgcttgtggtcttgctggcctttctgctggaatggctattggtattgttggagatgctggtgttagggctaatgcacaacaacccaagctttttgttgggatgatcctcattctcatttttgctgaagccttagctctttatgggcttattgttggcattatcttgtcttctcgagctgggcagtctagagctgagtgaagttaaccccattcctaccgcactgtatgtgagacttttagaagaccaaggctgcaaaagcctaaagttgaaaagtatctattacgggtattgttattcatgacgccacaactgccactttaatccattggtgctgtcctgtttgtagaagtaggagtccaattttttctacttaataatagcttaaagagctatgcaatttggtcagtatttattgtgtgttttgtactcattatttgtgaacagtccgaggactatttcttttctaagattcgtgcatgtctgatcttttcatttagtatatcatatttactgtgcggtta

SEQ ID NO: 1766 - DNA, 1052 bp, Capsicum annuum
gtttccaaattcgaagaagaagaagaataaaaatgggatcttcgaggtttagcggcgatgaaacggcaccgtttttcggcttcctcggcgctgcagctgccttagtcttctcatgtatgggtgcagcttacggtacagcgaaaagtggtgtaggagtagcgtcgatgggtgtaatgcgtccagaattggtaatgaagtctattgttccagttgttatggctggagttttgggtatttatgggttaattattgctgttattattagtactgggattaatcctaaaacgaagtcctattatttatttgatggatatgctcatctttcatctggtcttgcctgtggtcttgctggtctttctgccggtatggctattggaatcgttggtgatgccggtgttagagctaatgcacagcagccaaagctttttgttggaatgattctgatccttatttttgctgaagccttggctctttacggccttattgttggtatcatcctttcttctcgcgctggtcaatctagagcagagtagagaaagagtgcacctgttttatatttgtgaagtatctttgtttttcttacacgtcggacaagctagtctggctgttgaaatcacttttttgttagtgttggcctctgacattatgtatttttgattgctttggctagaagaattggttcgtttgtgccaatcagctgtagattagatctctcaataaagatactatcaactttttttttttttttttttttttttttttttttactcaacaagtgtacggtcaccttccatttgcatattagcacaaagtaaataattatcaatgtcatcaaagaaaggtataatattcactcaaatcactatcaagttcatttgaagtaactagagcatagaattagcttttttaccttgacgagcacttaaagaaccttctttactttggctatctaatattaagctcacttgttcatttgaagaattagtcccaacttgacttgcttctttcaattcttgaatttccttccatgttgagtcgtcttgtttgttctc

SEQ ID NO: 1767 - DNA, 907 bp, Capsicum annuum
aaaaagagatcgaaatccttcgaagtttatcagatccaaaatccgatcgatcgaacaatgtcgactttcagtggtgatgaaactgctcccttcttcggtttcctcggggctgctgcggccctcgtattctcatgcatgggagcagcgtatggaacagcaaagagtggtgtaggagtggcgtctatgggagtgatgagaccggaattggtgatgaaatcaattgttccagtggttatggctggtgtgttgggtatttatggattgattattgctgttattatcagtactggtattaatcccaaaacgaagtcgtattacctgtttgatggatatgctcatctctcttctggtcttgcttgtggtcttgctggtctttctgctggaatggctattggcattgttggtgatgccggtgttagggctaatgctcaacagcctaagcttttcgttgggatgatcctcattctcatttttgctgaagctttggctctttatgggcttattgttggcattatattgtcttcccgagctgggcaatccagagcagagtgaagttggcttatcaactctattcttactatggtgtacgtgcaactttcagaaaactctgcttaggcttgatccttgctaaagtcgaaaagctacatatttctacgtttgttatgatggctgctatgtgctgtttgtagaagtagggagtatttatctacttaataatagcttaagaagctgtcttatttgattttgatcaccatttgttgtattttgcaatttgctctgattgaacagtgttgtgcatgtattattttttgctataatttaacattgacgatatgcaacatatatgacactccccttcaatatatctgagaaaattcttttgggtgctgccacttggaagtgcaga

SEQ ID NO: 1768 - DNA, 697 bp, Acacia harpophylla
gcttctgcggcacaccatagtcgtacggagagagatcggtactggaagatctctctgtggaagaaattgaaactatcagatttcagatctattcactgccttgtagatcaactgtcaattcatggctccgttcagcggcgatgagacagcaccgtttttcggcttcctcggagccgcagctgccctcgttttctcctgtatgggagctgcctatggcacagcaaagagtggtgtaggtgtggcctcaatgggtgtcatgagacctgagctggttatgaagtccattgttcctgttgttatggctggagttttgggtatttatggccttattattgctgttataatcagtaccgggattaatcctaaggcaaaatcttattacctgtttgatggttatgcacatctctcctctggtcttgcctgtgggctggctggtctttctgctggcatggcaattggtattgttggtgatgctggtgttagagcgaatgcccaacagcccaaactgtttgttggaatgattctcatcctcatctttgctgaagctcttgctctctatggtctcattgttggtattatcttgtcttctcgtgctggtcagtccagagcagaatagaaaaggagtcatgctgccaaatattcttttgctgcctgtttattccaatcttctttgtggttcgacgttgtgaatcttggt

SEQ ID NO: 1769 - DNA, 1614 bp, Amborella trichopoda
acacgtgtccctcaccaaaaccgtgtccatttatttttattgcaataacttcagcattttatcgcaatttccatttctttatctcccctttcattggcatctctacctatctttcactcttccccctccccccttctctcgtctcatttgtattctctctctctgtcaattgtcatctcttattttgtttcacgacttttcagatctctctctgctaaaatggttgcattcagcggtgacgaaaccgctccattcttcggcttccttggagccgctgctgccctggtcttctcctgcatgggagcagcttatggaacagccaagagtggggttggtgtggcatccatgggtgtgatgaggcctgaacttgtgatgaaatctattgtaccagtggttatggctggtgttttgggtatctatggcctaattattgcagtgattataagtacaggtataaaccctaaggcaaagccctactatttgtttgatggctatgcccatctctcctctggtcttgcttgtggccttgctggtctctctgctggtatggcaattggagttgttggtgatgccggtgtcagggccaatgcacaacagccaaagctttttgtgggtatgatcctcattcttatctttgctgaagcgcttgccctatatggtctcattgttggcatcattctttcctctcgtgccggtcaatctcgagcagaatgaggagagggaaagccatggctttcgttgcaccatatttatcaatattagaacatctgattcctttgggggagaaaaaaaatgaaatgttcactgggacatttagcttgaattttccgatttttgtttgttgaattaattgagaaccattattcatgcaactctgggacctttgatctgtgtaatttactgtctcgtccctttcaatcctacttaactcacttggttctcgaggaccagtgctatttgtgggcattcagttgtcgaggatgatgtgtggtcatataagcgttggaactatcatcgatgaggaaatgaaacattgggtaccatggaatttttgtgggttttatttattctagctcctgtattattacgatttttatagccatatgctttcattgaatattgtgtgttatatggctggatttctcttttttgggaaaatatctctgcagaccttattttcagatttattttttcatggacttaggttccaaaacctatctatttttaggttttatttatttataaacttcgagatttcaaattctatctgattgcataaaaattctatttattatatcttttaatctcggatcaattttacttatttttatttccaaataaatttaaaaaatacattatttctaaaccatctttcttaacaaaccctcttttcatgtgtttctctttcattctttccgtgaatctcccaaacccatctttctctttacgtacttccctcaactctctgactacactctccttcacatctgctctctccaaccgcttggactccgtctctctctatacacttcctctcttctcctttctcccaaaaaaaaaaaaaaagaattgtaaatgctaaatgcttccgctctcaccaagcggaagtgaggg

SEQ ID NO: 1770 - DNA, 922 bp, Malus domestica
tctctctctctctctctccaatctccgcgatcagaatttcccaaatctgagaaactcccaccccaatcgctaatcggaacaccgaaaagatggcgccatccaccttcagcggcgacgaaacggcaccgttcttcggcttcctcggcgcggcggcagccctcgtcttctcctgtatgggagcggcgtacgggacggcgaagagcggcgtgggcgtggcgtcgatgggggtgatgaggccggagctggtgatgaagtcgattgttccggttgttatggcgggagtgttgggtatctacggtttgatcattgctgtgattatcagcactgggattaacccaaaggccaaatcttactacctcttcgatgggtacgcccacctctcctccggtctggcttgtggactcgccggactttccgccggaatggccatcggcatcgttggcgatgccggtgttagggcgaacgcacaacagccaaagctttttgttggcatgattctgattctcatctttgccgaagctttggctttgtatggcctgattgtcggtatcatcctttcatcgcgatctggacagtccagagcagattagagataccattgccgtcagcttccaatgtgaatgttgttggcaccttggttgctcgcaggtttgtgacgctcatccacagcgtgtagagttattcgtcttccgtaggcgggaagaaagatccttttccgattgtagaattccgagtgaagtgtctctgaaataaagctttttgttagctgttttttcaccttctattttttcttcttttacatattagttcggtatcatgtagaaatcgtccacggaacgtcgtatatgtatctgatcatcacattcaatggtattaccatcatttgatcatttgtactaggaaatgcataatacttcaataa

SEQ ID NO: 1771 - DNA, 1088 bp, Aristolochia fimbriata
agagagagagagagagagcgagagcgagatcttccccaacccatcgtctctccctgcgttaccaaccccttcctcagatcttcagatccgatcttcttccacgccgaacttcggagcacagaagatgtctactccttttgccggagatgtcgtcgggcccttctttggcttcctgggggccgctgctgccctagttttctcctgcatgggagcggcctacgggaccgccaagagtggcgtcggcgttgcgtcgatgggtgtgatgcgcccggagctcgtgatgaagtccatcgtccctgtggttatggctggtgttctgggtatctacggtttgatcattgcggtcattattagtacgggaataaaccccaaggcgaagccgtactatctcttcgatgggtatgctcacctctcttctggtcttgcttgtggtctcgctgggcttgcggctggtatggctattggcatcgtcggagatgctggtgtcagagccaatgctcagcagccaaagctcttcgttggaatgattctcatcctcatctttgctgaggctctggctctctatgggctcattgttggcatcattttgtcttctcgagctggtcaatcaagagcagagtagagagcaaagaaaaggaggttccatcggtaatttttcatgtcatttgccagttctcttccaatctctgtttcttccttcccaggtgagtaagtagtcgatagcacttgtttgtacgctcttgttttaaattcatgaccgtgggcaggatgcacaccatttttattcagctgtcttgctaagctgcttgtagaagtagaagggttgtacgaaaaataaaagcttattcagctgctaagtcttgtctaattttgcatatcattttgcaagtggtttaagacttcgatgtctgaactaccggactacgaatattacttgtcttacagttctggccaatgtgtacgctttgttgtaaacatgtgattgtctaaacatgttgcgttatatataattttctactccacatcaatctctagttttgccggcttgagtgtgcctctacttcgtactgctgcttgctgataataaa

SEQ ID NO: 1772 - DNA, 799 bp, Arnica chamissonis
acaaacacatagagatctaaaactctttctgtttccgatcaaaatccgatcgacttcaatcaactaacgatgtcttcggcttcagcattcagcggtgatgaaactgcccctttctttggtttcctcggcgcagctgctgcccttgtcttctcctgtatgggggctgcatacggaactgcgaagagcggtgtaggagtggcgtctatgggtgtgatgagacctgagctggtgatgaagtcaattgttcctgtggttatggctggtgtgcttggtatttatggtttgattatcgccgtcatcatcagtacagggattaaccctaaggcaaaatcatattacctgtttgatggctatgcacatctttcatctggtttggcttgtggtcttgctggtctgtctgcgggaatggctatcggaattgttggtgatgccggtgttagagccaatgcacagcagccaaagcttttcgtgggtatgattcttattctcatctttgctgaagctctggccctatacggtctgattgttggtatcatcttatcttcccgtgcgggtcagtccagagcagattaagaaggtgagtgaacaatgaacatggcgtcggttagttgtttgtcctgttcatgtttttgctctaatcccattttgaacattaatttttcgtgatgaagtttgtcgtggtctcataataattattagtggttatgatgttacttcatgacttgtgttcatctaactactttagttttgctgtagtcatcgcttctcatgaaagatagctaaacttgtaagaaacaga

SEQ ID NO: 1773 - DNA, 816 bp, Arnica chamissonis
gaacaacaaacacacagaagaaaaactccgtttcttttcactttctccgatcgatttcaatcgagaaccggtcaataatgtcttcaggttcagcattcagcggtgatgaaacagccccgttctttggtttcctcggcgcagctgctgccctcgtcttctcctgtatgggagcagcatacgggactgctaagagcggtgtaggtgtggcgtcgatgggtgtgatgcgacctgagctggtgatgaagtcgattgttccagttgttatggctggtgtgcttggtatttatggtttgattattgctgtcatcattagtaccgggattaaccctaaggcaaaatcatattatctgtttgacggctatgcacatctttcctctggtttggcttgtggtcttgctggtctgtctgctggaatggcgatcggaattgttggtgatgctggtgttagagcgaatgcacaacaaccaaagctttttgtgggtatgattcttattctcatctttgctgaagctctggccctatacgggcttattgttggtatcatcttatcgtcccgtgctggccaatcgagagcagattaaggtgacccggcaacgaacttggacttgcttctatatatgtttgttgtttgtcctgataaatcaagatcatgtttttttttcttttgctttatttctatttcccatatcttgaactttgtggtcatattattattagtgtttgtgatgttactgcagcataaggccatagtcttggtcaagattcttgttcatttgtgtacttgtttcagtcatgatttaatagccctttgcatga

SEQ ID NO: 1774 - DNA, 957 bp, Brassica rapa
accaatcatcatcgtccttgtccttaaacgcgtcaggagaggagaaatatcagattcaatcggcgtctgacatcttaagatccagaactcgtcggaaaatgtctacgttcagtggcgatgaaaccgctcctttcttcggcttccttggcgctgccgcagccctcgtcttctcctgcatgggagctgcatatggaacagccaagagtggtgtgggagtggcatcgatgggtgtgatgagacctgagttggtgatgaagtctattgtccctgttgttatggctggtgtgttgggtatttacggtttgattattgctgttatcatccgtaccgggattaaccccaaggctaaatcttactacctcttcgacgggtatgcacatctctcttctggtctcgcttgtggacttgctggtctctctgctggaatggccattggtattgttggtgatgctggtgtcagggccaatgctcagcagccaaagcttttcgttggtatgattcttatcctcattttcgccgaagctctggctctgtacggtctcatcgtggggatcatcttgtcctcccgagctggtcagtccagagccgaatgaggaagagaatgattctttcttcttggattctgcgtgattctttcttttggtttttgccaccggtctcattcttcaacgagccgggatctttttttatgttatttttttatcaggttagtagaggcacaatgtggttttgctacgtgtagacaaaaaccacacctcatcaaactgttgtttgttttctctcttctgttacgtgtagacaagatgtaactgatttatgtttttatcactccaataaatcacagaaaactcgatttgatctttttttaaagcttcttttggttataacttctcttataaatattctcttgagggattgattgaaaaaaatctggaactgatctctcaactcttgtct

SEQ ID NO: 1775 - DNA, 833 bp, Brassica rapa
gccggcaatttactaaaccaatcattgtcgacataagtttgatctctctctctcaaatcgtttcttcgcgatcggatctcatcggaagagacgcacaattcacgacgagcgatggcttcaggtttcagcggcgatgaaactgctcccttcttcggattcctcggcgccgccgccgctctcgttttctcctgcatgggagcagcgtacgggacagcgaagagcggggtcggtgtggcgtcgatgggtgtgatgagaccagagcttgtaatgaaatcgattgttccggtcgttatggctggtgtgttaggtatctacggtctcatcattgctgtcatcatcagtactggagtcaacccaaaggccaagtcttactatctcttcgacggctacgctcatctctcttccggtctcgcttggggtctcgccggtctctccgccggtatggctattggcatcgtcggcgatgccggtgttagagcgaatgcacaacagccaaagctgtttgtgggaatgattctgattctcatctttgctgaagcacttgcgctgtacggtctcattgttggtatcatcctctcttctcgtgctggtcagtctagagccgagtgaagtcataaagtcttttcgttatgtgcgaaacccttgtcatgtttttgatatatttcacttccttttttttgtggcattgtgagtttttgcttttttcatgaaaaaacaagcaaataatcatttgaatttggttctaaatatttttttttttaatttgcacactgtaagaaatacccccaataagtaataaatatgatgattcagtgattttattcttttagact

SEQ ID NO: 1776 - DNA, 941 bp, Brassica napus
gagagaagaggaggagaagatcagattcgtcgtcggcgtcatcttaagatcgagaatcattggaaatgtctacattcagtggcgatgaggccgctcctttcttcggcttccttggcgctgccgcagccctcgtcttctcctgcatgggagctgcatacgggacagccaagagtggtgtcggagtggcatctatgggtgttatgagacctgagttggtcatgaagtctattgtccccgttgttatggctggtgtcttgggtatctacggtttgattattgctgtgatcatcagtaccgggattaatcccaaggctaaatcttactacctcttcgacggatacgcccatctctcttctggtctcgcttgtggtcttgctggtctttccgctggaatggccattggtatcgttggtgatgctggtgtcagggccaatgctcagcagccaaagcttttcgttggaatgattcttatcctcattttcgctgaagctctggctctctatggtctcatcgtcggtatcatcttgtcctctcgagccggtcaatccagagccgaatgagaagagaatgcggttcttcttcttggattctgcgttgattctttctttgctttttttcgcgcgtcttatattatttctcaggttagtagagaccgccagtggttttgctacttcttaaaaacgtactgtctgcacgaaacaaaaaccacacatcaccaaagtgttgttcgttttccacccttgtgttatgtttgtaatattcttctcttcccagtaagagagacaccctcttttttatatatatttttgtcattctaataaaaccaaatgaaaatgaggataagaatcattccaacgaaaagctttggctgctgagcattggccctgacaccagcatcaccaacgataccaatggccattccagcggaaagaccagcaaga

SEQ ID NO: 1777 - DNA, 683 bp, Brassica napus
aaaaaaaataaaatactgctgaataccaactactctctctctctctctctccccagtcttggatccgagaagatgtctacgttcagcggagatgagactgctcctttctttggcttcctcggcgctgccgccgccctcgtcttctcctgtatgggagctgcttacggaactgcaaagagtggtgttggtgtggattccatgggagtgatgagacctgagttggtgatgaagtcgattgtccccgtggttatggctggtgtgttgggtatctatggactcatcatcgctgttatcatcagtaccggtatcaacccaaaggctaagtcttactacctctttgatggatacgcacacctttcctctggtcttgcttgtggtcttgctggtctctcagctggtatggccattggaatcgtgggagatgctggagtcagggcaaatgctcagcagcctaagctttttgtggggatgattcttatcctcatctttgcggaagcacttgctctctatggtctcattgtaggcatcatcttgtcctctcgagctggtcagtccagagcagaatgagaaacaaaacaaatgtcagatgatgattttttcttttgtggaaccttgtgtggggctgccatatattctgcttcgttttggtgggtgcttgagcataggatgtttgtttttttttt

SEQ ID NO: 1778 - DNA, 1509 bp, Ricinus communis
gtaatctaaatccatttatgattgcatcactctatttgtagagctgataatatgaataacagatccatttatgatgtaacttctattatgtttgtgttttgtccatgatacatgtgtatgaaaataatataaaataccatatttaatattttctttacttgttaatataaaattatttattttataagtaaaaatcttcaatatgtatttgtattatttagcgttatataacttaatatatttaactcactggactaataatattgcttttggaaataaagtttcaatttgatgtttatattaagggttaaatatattatcagctaatagtaatttatcgaatatttaatgttggtcagctaatagcttaattaaatagatttttttatttaataatttaaatggtattagattttaaattcattgttgtgagaaaaatttctaaatgaacgaatagaggcccattatccctgagggtcaaagcccagagatcttttctgacctgtgaatgttttaagctaacagacacttacttcttctgttccctaattcggattagagggaagggggcgtcattcattaataactaatacactccagattttttggggaaagcgaaggagaaagtgggaaatcatggctccggcatttagcggcgatgagactgctcctttctttgggttccttggcgctgctgctgctctcgttttctcctgcatgggagctgcttatggaacagccaagagcggggttggtgtggcatcaatgggtgtgatgagaccggagctagtgatgaaatctattgttccggtggttatggcaggagttttaggtatatacggtttgattattgctgtgatcattagtacaggaattaatcccaaggctaaatcctattatctcttcgacggatacgctcacctctcttctggtctcgcttgtggtctcgctggtctttctgctggtatggccattggcgtcgttggggatgctggtgttagagctaatgcacagcagccaaagctttttgttgggatgatcctcattctcatctttgccgaagccttggctctctatggccttattgttgggatcatactttcgtcccgagctggtcagtcaagagctgagtaacagaggtttttctgctcaagtggttgtgtgatccgttctgattcattaacataagtttaagttgccagtgttttcatttcaagaatcacgtctccagtctccagtgagatttttctgcctaattggactggtttagtgctactgctgatgcagtaaaatgtagattcagatgtctcattgttttattattcatgatgtgttctggatttatttgaagtcttttgtaggaatatgttatccctttgggcttttgtcatgagagagaattgtgcagtaaagggcttggtagtataggcttcgttgtatcccatggtaacctcgtggatgtgtttgtttataatatagccagaattttttttttctttttaccagaaa

SEQ ID NO: 1779 - DNA, 985 bp, Cedrus atlantica
cgctggaatgctctgagattgcatctggatcggccaaggcactagcaggttccgggttcgattcttctggagcctctgaagctctgaaaaaccttcgaagtcctagggagaagctcgtcccagatctcggttaaaatggtggcggtgacattcagcggcgatgagactgctccattcttcggattcctcggggccgccgcagcgctcgtgttctcctgcatgggagctgcgtatgggactgccaaaagtggcgtgggcgtggcctccatgggcgtgatgaggccagaacttgtgatgaaatcgattgttccagttgtcatggccggagtgttgggtatttatggtttgattattgctgtgattatcagcacaggaattaaccccaaggcaaagtcctattatttatttgatggctacgcgcatctttcatctggactggcttgtgggctatcgggccttgctgcgggtatggctatcggtattgttggcgatgcaggtgttagagcaaatgcacagcagccaaagctctttgttggtatgatcctcatattgatctttgcggaagcacttgctctctatggtcttattgttggtattatactttcttctcgagctggccagtcacgagcagattaaagaagttgtagttgatcttctgtttacttggttcacttgtcagtgtttgtgcaagactgctatcttctgcagtggaaacgtgattgttgttctcagtaggagataatattttgctcaagattcattattattctcttggcttacaattttagactcaacaacttaatggtcaatttgaaggctcattacaatgaggaaattgaaccaggtaacaagtgcgcattattgttggtgtcgtttggcactttatgaaatcaaagtgtatgattctaatttttgagctacttcaattgctgcagattactgtagattcctcccgctttatgatttatattgttgatttattgaa

SEQ ID NO: 1780 - DNA, 981 bp, Centaurea maculosa
  misc_feature (782)..(782): n is a, c, g, or t
  misc_feature (895)..(895): n is a, c, g, or t
tcttggtttgagacgacagtgttggaaggtgagaggaacacaacacacacatcaaaccatcagattacacagatccaattctctgaattcattcacccttttcttcatcttccatccaaaaattcaatcgattttcctcccaattttgttaaacaacaatgggttcaggttccacattcagtggtgatgaaaccgcaccgttcttcggattcctcggtgccgctgccgccctcgtcttctcctgtatgggggctgcgtatgggacggccaagagtggtgtaggtgtggcatccatgggagtcatgaggcctgagctcgtcatgaagtcgattgttcctgttgttatggctggtgtgcttggtatttatggtttgattattgctgttattatcagtaccggaattaaccctaaggccaagtcttattacctttttgatggttatgcacacctttcctctggtttggcttgtggtcttgctggtctttccgccggaatggccatcggcattgttggtgatgctggtgttagagcaaacgcacaacaaccaaagcttttcgtgggaatgattcttattctcatctttgctgaagctctggccctatacggtctcatcgtgggtatcatcttgtcttcccgtgccggtcaatccagagcagattaaaaagatgaagaaaccatgcgatatatttggtaagtatgtagtttattctgataaacgaagaccaatttctgagtatcgtgttgggtccctgtttaatttgccagatttctagcaaacacntactcttgaattattatttttgttctcttcagtagaagcatttctgcctcatttgcattcttttgtgatgtttatgactgaagaataaaagtttatgcaatccatggtttggntcatatctttttacagtttctgtactctaaaagttatgcttttaagccctgtagaaacactttatgaggcattaattattgtgttt

SEQ ID NO: 1781 - DNA, 979 bp, Cephalotaxus harringtonia
tagagtagaaacgttgaataagatctgtggactgataagatcagatctggcttaaaatggcggaggcattcagtggcgatgagacagcacctttcttcggcttcctgggcgcagctgcagcacttgtattttcatgcatgggagcagcatatgggacggcaaagagcggcgtgggcgtggcgtccatgggagtgatgaggccagagcttgtgatgaaatcgattgttccagtggtcatggctggtgttttgggtatatatggcttgattattgccgtcattattagcacgggaattaaccctaaggccaagtcctattatctattcgacggatatgcgcatttctcatctggtcttgcttgtggcctatccggcctttcagcagggatggccattggtattgtaggcgatgcgggtgtcagagcaaatgcacagcagccaaagctgtttgttggtatgatactcatattgatctttgctgaagctcttgcactttatggtcttatcgttggtattatactttcttctcgagcgggccagtcacgagcagactaggaaacattgtggttagccttatgtttagtgtttacacattttatttgtcagttttgatttaacgacttctgtcttctgcagtgaaaacatgtcatccctgatctcagtagcagttaatatttctattaagtttaattgttattttacccattgcaatttacgatatgaatttcaaatttgaagcatctacagtgatgctattgacacaaggattgaatgagtattattatctcagtcggagttcaacatttcagtaaggtttatttgtcattttattgattgaaatttaagatgtgaatgtaatggtcaaatttgaagttgtctgcggtgatgatattgctgcaggggacggatagtgttatcatctcagtagtactcgatatttgcataaagttcaattgttgatctcttgattacaatttaaa

SEQ ID NO: 1782 - DNA, 974 bp, Cicer arietinum
tcacccacgttcactaaccttcttcctctaccgcaaaaaagagatcggaacctctctttctcaatcagaataccgttctccgtagatcagatctattcgacttcgttacagtaaaaatggctccatttagcggcgatgaaacggcaccgttttttggcttccttggagccgcagctgccctcgtcttctcatgtatgggagctgcctatggcacagcaaagagtggtgtgggagtggcttccatgggtgtgatgagaccggagctggtgatgaagtctattgtacctgttgttatggctggtgttttgggtatttatggtcttattattgctgttattatcagtactgggattaaccccaaggctaaatcttattacctttttgacggttatgcacatctctcctctggtcttgcctgtgggcttgctgggctctctgctggcatggctattggtattgttggtgatgccggtgttagagccaatgcacagcagccaaaactttttgttggaatgattcttatcctcatctttgctgaagctcttgccctttatggtctcattgttggtattatcttgtcgtcacgtgctggccagtctagagccgaataagaaaacagctgtgttgcaaaatattctttgaccaccaaccttcttattaagaaagtgtggggtgaatttttagttgtgcggttagtgatgtgtttggacaccacttgcgatatttaacaaatacttgtgaaagcaatagctccacctgtcatttgatggtgtttgtataagtagtctatcttttgcttaataaagctttttaagcttgttcctttttattttgaaatgtgtcatgccatattatatgagcctactttgtttttgctaccgctgaaactagtgcttgtaatgatttagttgcaaatagaacttgtatgcatttgttgatcttttcatattggatgcaggattactgctagatgt

SEQ ID NO: 1783 - DNA, 1804 bp, Cicer arietinum
aagcaatcaatcacccacgttcactaaccttcttcctctaccgcaaaaaagagatcggaacctctctttctcaatcagaataccgttctccgtagatcagatctattcgacttcgttacagtaaaaatggctccatttagcggcgatgaaacggcaccgttttttggcttccttggagccgcagctgccctcgtcttctcatgtatgggagctgcctatggcacagcaaagagtggtgtgggagtggcttccatgggtgtgatgagaccggagctggtgatgaagtctattgtacctgttgttatggctggtgttttgggtatttatggtcttattattgctgttattatcagtactgggattaaccccaaggctaaatcttattacctttttgacggttatgcacatctctcctctggtcttgcctgtgggcttgctgggctctctgctggcatggctattggtattgttggtgatgccggtgttagagccaatgcacagcagccaaaactttttgttggaatgattcttatcctcatctttgctgaagctcttgccctttatggtctcattgttggtattatcttgtcgtcacgtgctggccagtctagagccgaataagaaaacagctgtgttgcaaaatattctttgaccaccaaccttcttattaagaaagtgtggggtgaatttttagttgtgcggttagtgatgtgtttggacaccacttgcgatatttaacaaatacttgtgaaagcaatagctccacctgtcatttgatggtgtttgtataagtagtctatcttttgcttaataaagctttttaagcttgttccttttttattttgaaatgtgtcatgccatattatatgagcctactttgtttttgctaccgctgaaactagtgcttgtaatgatttagttgcaaatagaacttgtatgcatttgttgatcttttcatattggatgcaggattactgctagatgtggcttttacagtattattatgatcttttcacaatagaaaagcatttattgttgaggtcatattctaaattcataagattttgaaccatttgattgttagtgagatgaaaaatatgaaatgaacttgactagaattttagtcagcaagcaaacttttgtatgaaggtgctatatagtagtatttctaagttttccctccatgaaagaaatacaaagaaattgcttggcaaaccagattatgaatggcaagaagaactgtcagagggtcgaactaagatctaaggggggaagatgagaagtttaactagattgatgcctgtcttcatcatgctattatgcctcttttaaaaaccctcgttattcttgtgtaatgcttcaattttctgaacctcttcatgtctatgtgatatacgtggtgttacctaatccattaggtagatagtgtttttttgtggtcacgtgctataaataagtctgagtgaggatgttttattcacttctgaacctttggtcacgagctctgtatgacagggtgtgtgtgcttcgttttaccctaatagtcgctgtctttatttgcaatgccttttaatgtttgtgttgaacaatgacagaaaaagggatgctggttttcattctaatattttgaatttactgctatagtggttgttctcgcgaacattagttatgtatttttggtatgacattttttgtcccagtcctttctatgttattaataaatgtattttttgtctttgctaaaatcaaaaagaaataattatacggtcggaaattgattatacaagtttattatggtttcgag

SEQ ID NO: 1784 - DNA, 958 bp, Cicer arietinum
atgatataggggagtgtgattatagaagaagcaaaatcaaaggcagaaaagggtagaccgacgagtgagagaaagaattagcgatcagagatcaacagatcggaaaaatggctccattcagtggcgacgaaactgctcctttcttcggctttctcggagccgccgcggctctcgttttctcctgtatgggtgcggcttacggaacagcgaagagtggcgtcggtgttgcatcgatgggagtgatgagacctgaactcgttatgaaatcgatcgtacccgttgttatggctggtgtcttaggtatctacggtttgattattgcggttatcataagtactggaattaatccaaaggctaaatcttattatctatttgatggttacgcacatctttcttctggtctcgcttgtggtcttgctggtctctccgctggtatggccatcggcatcgtcggtgatgccggcgttagagcaaatgctcaacagccaaagctttttgttggaatgattctcatcctcatttttgctgaggcgttggcattatacggactcattgtcggcatcatcttatcttcccgtgctggccaatccagggctgaataaatgttatctttctcattggtggtggtttacatagccacatattgtgaatgtcactgcggagttggctttggtaatgtcagtagactgattgctgctttttattattcatgttattctatttatttatgtacttataaagttgaggttatctaggaccatgaataaagcttttctctgggcatcattagtttttaattatatatgctcaatagatcagaggtctatatacttagacagatgtttgttttgatttgttttgattccataacttattatatcgttttgtgctcttcaaaatgtatctcccaaacaacccagacctttcatttatattattttattcaatatgatctctc

SEQ ID NO: 1785 - DNA, 1037 bp, Cicer arietinum
taataatattggtgtttttgataaaataataattttgcaaataagtaaagatgagaatgatatgatataggggagtgtgattatagaagaagcaaaatcaaaggcagaaaagggtagaccgacgagtgagagaaagaattagcgatcagagatcaacagatcggaaaaatggctccattcagtggcgacgaaactgctcctttcttcggctttctcggagccgccgcggctctcgttttctcctgtatgggtgcggcttacggaacagcgaagagtggcgtcggtgttgcatcgatgggagtgatgagacctgaactcgttatgaaatcgatcgtacccgttgttatggctggtgtcttaggtatctacggtttgattattgcggttatcataagtactggaattaatccaaaggctaaatcttattatctatttgatggttacgcacatctttcttctggtctcgcttgtggtcttgctggtctctccgctggtatggccatcggcatcgtcggtgatgccggcgttagagcaaatgctcaacagccaaagctttttgttggaatgattctcatcctcatttttgctgaggcgttggcattatacggactcattgtcggcatcatcttatcttcccgtgctggccaatccagggctgaataaatgttatctttctcattggtggtggtttacatagccacatattgtgaatgtcactgcggagttggctttggtaatgtcagtagactgattgctgctttttattattcatgttattctatttatttatgtacttataaagttgaggttatctaggaccatgaataaagcttttctctgggcatcattagtttttaattatatatgctcaatagatcagaggtctatatacttagacagatgtttgttttgatttgttttgattccataacttattatatcgttttgtgctcttcaaaatgtatctcccaaacaacccagacctttcatttatattattttattcaatatgatctctctttatgtcttcctttatt

SEQ ID NO: 1786 - DNA, 959 bp, Cirsium arvense
ggaaggtgagaggaacaacgcatcaaaccatcgaaaaacatccagatccaactctctcaattctcaccctttctcttcttctccaatccaaaattcaatcgattttcctcccaattttccctaaatcaacaatgagttcaggttcaacattcagcggtgatgaaactgcaccattcttcggattcctcggtgccgctgccgccctcgtcttctcctgtatgggggctgcgtatgggacggccaagagtggtgtaggtgtggcatccatgggagtcatgaggcctgagctcgtcatgaagtccattgttcctgttgttatggctggtgtgcttggtatctatggtttgattattgctgttattatcagtaccggaattaaccctaaggccaagtcttattacctttttgatggatatgcacacctttcctctggtttggcttgtggtcttgctggtctttctgccggaatggcaatcggcatagttggtgatgctggtgttagagcaaacgcacaacaaccaaagcttttcgtgggaatgattcttattctcatctttgctgaagctctggccctatacggtctcatcgtgggtatcatcttgtcttcccgtgccggtcaatccagagcagattaacaagatgaagaaaccatgcgatatatttggtaagtatgtagtttattctgataaacgaagaccgatttctgagtatcgtgttgggtccctgtttaatttgccagatttctagcaaacacttactcttgaattattatttttgttctcttcagtagaagcatttctgcctcattcgcattcttttgtggtgtttatgactgaagaataaaagtttatgcaatccatggtttggttcatatctttttacagtttctgtagaaacactttgaggctattaattattgtgtttatttatgtacaaaaaaagaaagagtaccgactgcg

SEQ ID NO: 1787 - DNA, 718 bp, Cirsium arvense
tttttctattgatccaatcgatattttgattgataaattacgataaaatacttctaaaaaaagttagtcctctcgtgatctccaggaggacaggtgttggacaacaaacacacacacacacagagatctaaaaaactttctgattccacttctccgctcaaaatccgatcgatttcaatccaaaatctgttaacaatggcggattcaggattcagcggtgatgaaactgctcctttctttggtttccttggtgcagctgctgctcttgtcttctcatgtatgggggcggcatatggaacagcgaagagtggtgtaggtgtggcatcaatgggtgtgatgaggcctgagcttgtgatgaagtcaattgttcctgtggttatggctggtgtgcttggtatttatggtttgattattgctgttatcatcagtactggaattaaccctaaggcgaaatcatattatctgtttgatggttatgcacatctttcttctggtttggcttgtggtcttgctggtctttctgcaggaatggcgattggaattgttggtgatgccggtgtcagagccaatgcccaacagccgaagctatttgtggggatgattcttatccttatttttgcggaagctctggctctatatggtctcatcgttggtatcattttgtcttcgcgtgccggtcaatccaatgcagattaagaaaatatgataaaaaaaaaga

SEQ ID NO: 1788 - DNA, 916 bp, Trifolium pratense
  misc_feature (318)..(318): n is a, c, g, or t
  misc_feature (772)..(772): n is a, c, g, or t
tttctacggaaacagagatcggaactaagaacctctctttctttctctccgtcacaaaaatcggatcggaaaaccgttgttcttagatcagatctattctacgtcgttgcagtaggaatggctccattcagcggcgatgaaacggcaccgttttttggcttccttggagccgcagctgctctcgttttctcctgtatgggagctgcctatggaacagcaaagagtggtgttggtgtagcttcgatgggtgtgatgagaccggagctggtgatgaagtctattgtacctgttgttatggctggtgttttgggtatttangggcttattattgctgttattatcagtactggaattaacccaaaggccaaatcttattacctttttgatggttatgcacatctctcctctggtcttgcttgtggacttgccggcctatctgccggtatggctattggtattgttggtgatgctggtgttagagccaatgcacaacagccaaaacttttcgttggaatgattcttatcctcatctttgctgaagctcttgccctttacggtctcattgttggtattatcttgtcttcacgtgccggtcagtctagagccgaatgagaaaggagctgtgttgcaaaatattctttgaccgcaaaccttcttattaagagggtgagaggtgaatttttagttgcgctgttattagtgaaaacaatagctccacttgtcattgatggtgtttgtataagtagtctatctttgcttaataaagcttttnaagcttcgtccttttttccttatgatgaaatgtgtcatgccatattatatgagcctattttgtttttgctgctgctgaaactagtgcttgtaatgatttagttgagaatataacttgtatgcatttgtggattttttcaaaaaa

SEQ ID NO: 1789 - DNA, 916 bp, Cryptomeria japonica
  misc_feature (19)..(20): n is a, c, g, or t
  misc_feature (181)..(181): n is a, c, g, or t
gatagagattgcatgccanncaggtgcatgtaatttggatttcggttgtgcttaatcagatcttacatcaaaaaccatttttcattgaggaaaattcgaattagtgtggcagttggttgcttctccttgtttgtgcaaggaaaaccacaaagcgagcttgtgcggagggagagagaagatnaaaaaatgggggatctgttcagcggcgatgagacagcaccatttttcggtttccttggcgctgcagcagctctcgtgttctcctgtatgggtgctgcatatggaacagcgaaaagtggtgttggtgtagcatcgatgggtgtcatgaggccagagcttgtcatgaaatcaatcgtgccagttgttatggctggtgttctaggtatctatggcctaattattgctgtcatcattagcacgggaatcaatcccaaagccaagtcatattatttatttgacggctatgcgcatctatcttctggactggcttgtggtctttctggtctttctgcgggcatggctattggtattgttggtgatgctggagtaagggcaaacgcacaacagccaaagctctttgtgggcatgattctcatcttgatctttgctgaagccctggccctttatggtcttattgttggcattattctctcttcacgtgctggtcagtcaagggcagaataaagggaggatagaaatgctattaattcacatggttaattttgccatctttagtctaagatcaccgtgcttgtaaaatctgtctgaaaaatgatttattttttgactgtagtgctatactcaaatatctttaatgattgttttcttctagttctagaatttggatatttttcaattgaagaattttatttggagcatcgttattggtacagtataaaaaggtttgtgttaaatt

SEQ ID NO: 1790 - DNA, 1075 bp, Cryptomeria japonica
tgggggttctcagtattttccacgggccaagtaacctgacgagccggtacaccggtgagataagccggtatcttcaaaactcgttcacgcctagcagtccatcagtataatatatttgaagagatcgaatcccattcggagctcgtttatccttggttttgctctgtaaaagtgatattgcttgaaagagcaacagatccggtaaaacatggcggttggtttcagcggagatgaaactgctcctttcttcggatttctgggcgctgcggcagccctcgttttctcatgtatgggagcagcatatggtacagcaaagagtggagttggagttgcatcaatgggtgttatgagaccagaacttgtgatgaaatctatagtaccagttgttatggctggagtgcttggtatatatggtctgatcattgcagtcatcataagcacaggaatcaaccccaaggctaaatcatattatctttttgatggatatgcccacttatcatcaggtctggcttgtggtctatctggattgtctgcaggaatggcaattggcattgtaggtgatgctggtgtcagagcaaatgcacagcaacctaagttatttgtgggtatgatactcatcctcatttttgctgaggcacttgcattatatggtttgatcgttggtattattttatcatcaagagctggtcagtcaagagctgagtgaaacttgtgatcctactgcaatctgttcgctgggagctttatttaagggagaccatgtaagagattcatgatggttgctatctttgtatattttcaatttttaagtcattataaacttaattacgctcataggtctgacttctaagtgagtagaatattcttttactgcgccttagtgggcatttattgtacccattaactcatggttttggatacagttaccctcatatgtttaacgtaaatctggtttatgcttaatcagacatgcaactctgaatgttatttctttttcttgtcagacaatattggcaaatttctcctctgaaggtcaataaattactaaacttatgccagcatttttcttgctttt

SEQ ID NO: 1791 - DNA, 739 bp, Curcuma longa
taaattgaccgcaccgttcacaacgaagaaagcaaatgttcaatgaccaaagaccccattacgaaatcgaaaatgctgatgcggtccgaccgtagtttgttacaaatcagaagggtatttttggtataataatgtcatttgtggccgagaaataaatctcgatcaccacgaccctttggatctcatcagaccgcctctctctccgcccttctcttcctcgtccgaagaaactagggtttcgtcgactccgctgccccgatgtctagcttcagtggcgatgaaactgcccccttcttcggattcctcggcgcggccgcggcgctcgtcttctcttgcatgggggcggcgtacggaactgcgaagagcggcgtcggtgttgcttccatgggtgtgatgcggccggagctcgtgatgaagtcgatagttcccgttgtcatggccggagttttggggatctacggtctcatcattgcggtgataataagcaccgggatcaaccccaaggccaagtcgtactacctcttcgatgggtacgcgcacctctcttccgggctggcttgtggcctcgcaggactttcagctggcatggcgattggaatcgtaggagatgctggagtcagggccaacgcccagcagccaaagctctttgtgggaatgattctgatactcatcttcgctgaagctcttgctctctatggccttattgtcggcatcatcctttcctctcgtgctggccaat

SEQ ID NO: 1792 - DNA, 847 bp, Cynara scolymus
  misc_feature (3)..(3): n is a, c, g, or t
acnacacatgagattatcgaagcatccagactagagatccagactcttacctctccgatccaaatccaatcgatttcgcttccaattttcatcaacaatgagttcaggttcgacattcagtggtgatgaaactgcaccgttctttggattcctcggcgccgctgccgcccttgtcttctcctgcatgggggctgcgtatggaacggcgaagagtggtgtgggtgtggcatcgatgggagtgatgaggcctgagctggtgatgaagtccattgttcctgttgtcatggctggtgtgcttggtatttatggtttgattattgctgtcattatcagtaccgggattaacccgaaggccaagtcttattatctttttgatggctatgcacacctttcttctggtttggcttgtggtcttgctggtctttctgccggaatggccatcggcatagttggtgatgctggtgttagagcaaacgcacaacaaccaaaactttttgtgggaatgattcttattctcatcttcgctgaagctctagccctatacggtctcatcgtgggtatcatcttgtcttcccgtgccggtcaatccagagcagactaagaagatgaagaagaaaccacgcaatatatccggtacgtacgtagttttattccgataaatgaagaccaatttgagtttcgtgttcggtccccatttactttggcagatttctagcaacacttgtattgcgttactcttaattttttttctcttcagtagaagcatttctgcctcatttgcattctttttatggtgtttatgaccgaagaataaaatgttatgcaatccatggtttggtcaattctt

SEQ ID NO: 1793 - DNA, 967 bp, Taraxacum officinale
cgggatattttggtaaataaacctcccgttatggcatttttgtgattaactcaaataaatttacaaccaaaccggatttaacttcggtttaacttttctacagatccatcgaatgatttgaaagagttttcttcgatataatcctccaacaagctgtctcggtatccaaagggacaggtgttcaacaacacacacagagacagatctaatactctttccgtttccacttttccgatcgatttcaatcgtaaatcgattaacaatgtctacaggttcaggattcagtggtgatgaaactgcccctttctttggtttcctcggcgcagctgctgcccttgtcttttcctgtatgggagcggcatatggaacagcgaagagtggtgtcggtgtggcttcgatgggtgtgatgaggcctgagcttgtgatgaagtcgattgttcctgtggttatggctggtgtgcttggtatctatgggttgattattgctgttatcatcagtacggggattaaccccaaggcaaaatcgtattatctgtttgatgggtacgcacatctttcctctggtttggcttgtggtcttgctggtctgtctgcaggaatggcaattggaattgttggtgatgccggtgttagagcaaatgcacagcagccaaagctttttgtgggtatgattcttatcctcatctttgctgaagctcttgccttatacggcctcattgttggcatcattttatcttcccgtgcgggtcaatcaagagcagattaagaagtttggagctctctttttttaatatttgtttgttgtttgcctttcataaatcaagatcatgttttttttttctttatttcataatttaccagcttttggacgtcgactattgcattaccctaaattttcttgaggaattcttgttatcactagtgtttgtagttttgttacataataagagttttgttattttgtgta

SEQ ID NO: 1794 - DNA, 951 bp, Distylium racemosum
cgcggagtctatttataggtcaagagatccagtcctccccagcccaaataatcgtcaaagtgcaacaggagaactgatcttaatcgaaacaacgctttgcagtagatcagatcagatctgtggaaaatggcggtagatggtttcagcggagatgaaacagctccgttctttggatttctgggagctgcggcggccctcgttttctcttgcatgggagcagcctatggaacggcaaagagtggagttggagttgcatcaatgggtgttatgaggccagaacttgtgatgaaatctatagtaccagttgttatggctggtgtgcttggtatatatggtttgattattgcggttatcataagcacaggaatcaaccccaaggctaaatcatattatctgtttgatgggtatgcccacttatcatcggggctggcttgtggtctatctggtttgtctgcaggaatggcaattggcatcgttggtgacgctggtgtcagggcaaatgctcagcaacctaagctttttgtgggaatgattcttatactcatttttgcggaggcacttgcactttatggtttgatcgtgggtattattttatcatcaagagctgggcagtcaagagctgactaaagtataaaaatatcactgcattttgattacagggttcttcctttcatatggagggaccatctaaagggtttggtggtgactcaatatctttgtatattttttcattgtcttattataaactcagttgtgctcaaagttggggtatctttgccttgatgggcagttattgtactcttattcacgtatggtttagagtataatagcctttcttcgaatttcaaagtaactattggtctaatgcttattgagacgtacagcaacaaatgttatttttgccatttcagactgtatgggtaaatatttctttcaaaggttaataaaatg

SEQ ID NO: 1795 - DNA, 894 bp, Solanum melongena
acaataaacgaaacccgagccacagacaaaaattctctctcgcccatcagaaagttggtcttccaaattccgatcggtcaccggtaaattttgtcggaggaaacaatgtcaactttcagcggcgatgaaactgcgcccttcttcggttttctcggggcagctgcagcgctcgttttctcatgtatgggagctgcttatggaacggcgaagagcggtgtgggagtggcgtccatgggagtaatgaggccagagcttgtgatgaagtcaattgtgcccgttgttatggctggtgtgttaggtatttatggattgattattgcagtcattatcagtaccgggattaaccctaagaccaaatcgtattacctttttgatggatatgcacacctttcttctggtctggcttgtggtctcgctggcctttccgctggaatggctattggaattgttggtgatgctggtgttagagcaaatgcacaacaaccaaaactctttgttggtatgatcctgattcttatttttgccgaggcattggctttgtatggactgattgtgggaatcatcctttcttcccgtgctggccaatctagagcagaatagaaaatactgtattttcaggtttatgatggaatctttttgcatcactatactgacatttgatagccgatgctagttgttaggtacatcttctctgcttccttttccatttccatcacacgttgtctgttccagtggtgattgtttgaagttgtcttttccttgtatgtgaccaagagaatgttctctcattttttctgtcactgtattttgcaataatgaggagcatcttgttgcttgaatgctgatacaattgtattattatttttggaatgcattgatacacctgaccatatg

SEQ ID NO: 1796 - DNA, 959 bp, Solanum melongena
cttccacacgaatcgacacagtgcgagggaagaaataaagagatctgttgaactccaaagctcaaatttctcagatccaaatcctaacgacaatgtcgaacttcgccggagatgaaactgctcccttctttggcttccttggcgccgccgctgccctcgtcttctcatgtatgggggcggcttatggaacagcaaagagtggtgttggagtggcttcaatgggagtgatgaggccggagttggtgatgaaatcaattgtgccagtggttatggctggtgtgttaggtatttatggcttgattattgctgtgatcatcagtactgggattaaccccaaaacaaagtcgtattacctatttgatggctatgctcatctatcatccggacttgcttgtggtcttgctggcctttctgctggaatggctattggtattgttggagatgccggtgttagggctaatgcacaacaacccaagctttttgttgggatgatcctcattcttatttttgctgaagccttggctctgtatgggcttattgttggcattatcttgtcttcccgagctgggcagtcgagagctgagtgaagttaacttcattcgtacctcactgtatgtgagacttgagaagaccaaaacagctgaagccaaactccagaaagtatctattacgtgtattgttattcaagacaccacagctgccactttagttcattggtgttatgcgctgtttgtagaagtagtaattcatttttttctacttaataatagcttaaagagctgcgcaatttggtctttattgtgtattttgcgctcattatttgtaaacagtttgacaactgtttattttctaagcttcgtgcttgtatgaactacttttcatctcgtatatcatgtttattctgcatctatacgattgaatttggatatttatttgatcggcaagtattttgtggtact

SEQ ID NO: 1797 - DNA, 907 bp, Solanum melongena
atccacgagatttcaatgatttgcttctctgaggcagaagaaactagatcaaaaagagcttctcctttgtaactgaatctttcaatttctcagatccaaaatccgatcaacaatgtcgactttcagcggagatgaaactgctccgttcttcggcttcctcggcgccgcggcggccttggtattctcctgcatgggggcagcgtacggaacagccaaaagtggcgtcggagtggcgtctatgggtgtgatgagaccggagttggtgatgaaatccattgttccggtggttatggctggtgtgttgggtatttatggattgattattgccgttatcatcagtactggtattaatcccaaaacgaagtcatattacctgtttgatggatatgctcacctctcttctggtctcgcttgtggtcttgctggtctttctgctggaatggccattggtattgttggtgatgccggtgttagggctaatgctcaacagcctaagcttttcgttgggatgatcctcattctcatttttgctgaagctttggctctttatgggcttattgttggaattatattgtcttcccgagctgggcagtccagagcagagtgaagctggcttatcaacacttctcttactatgatgtacgtgcaacttttagaaaactctgccaaaacttgatccttgttaaagtcgaaaagccatatatgtctatgtttgttatgacggctaccatgtgctgtttgtagaagtaggagtgagtatttatctacttaataatagcttaagaagctgtcttatttgatcaccatttgttgtattttgcaatttgctatcactgaacagcgttgtgcatgtatgattttttgctataatttgttatatgacaattcttcctttaatatttctgag

SEQ ID NO: 1798 - DNA, 753 bp, Euphorbia peplus
tcaaaattccaacaatgtcctcatcgggcttcagcggcgatgaaactgctccattcttcggcttcctcggcgccgcggcggccctcgtgttctcctgtatgggagctgcgtacgggaccgcgaagagcggggtaggggttgcgtcgatgggtgtgatgagacctgaattggtgatgaaatctattgttcctgttgttatggctggtgttttgggtatttatggcttgattattgctgttattattagtactggcattaaccctaaggctaaatcttattatttgtttgatggctatgctcatctttcctccggcttatcctgtggtcttgctggtttgtccgccggtatggctattggcattgttggagatgctggtgtcagagctaatgcacaacagccaaaacttttcgttggaatgatcctaattctcatctttgctgaagctttggccctctacggccttatcgtcggcatcattctttcgtcccgagctggtcaatcgagagccgaataaaagcttggtccttggtttgtgcttgtggttaatgtgggggtgttgtgatttaagagtttatttttgtgtaagataagaataattattattttgtataagatagaatgggaaagtgttttcctactctagaattcaatctctccatttgtattgttcagtgatatttgctgatactttgaaattttagacagatattttcctagatcaattttctagttgtttattatggatggattat

SEQ ID NO: 1799 - DNA, 776 bp, Gerbera hybrid cultivar
ttccacttctccgatccaaatccgatcaatttcgacccaaattcgaccgatctgaaccaaaatcgccaacaatgccttcaggttcaacattcagtggtgatgaaactgcacctttctttggattcctcggcgcagctgcagccctcgtcttctcctgtatgggggcggcatatggaactgcaaagagtggcgtaggtgtggcgtccatgggagtgatgaggcctgagctggtgatgaagtcgattgttccggttgttatggctggggtgcttggtatttatggtttgattattgctgttattatcagtactggaattaaccccaaggcgaaatcatattatctctttgatggctatgcacatctttcctctggtttggcttgtggtcttgctggtctttctgctggaatggcaattggaattgttggcgatgccggtgttagagctaatgcacaacagccgaaacttttcgtggggatgattcttattctgattttcgctgaagctctggctttatatggtttaattgttgggatcatattgtcttctcgtgctggtcagtccagagcagattaaaacaaaacaaagtttgtttcctatcctgagaatgcaaattatttccattttcgaccctaaactttcttaattgttagtatgtctggtctcgttttcattcattccagagtttatactgttcttgaattttgactgcagaataagagccaaatcatagtccatagtttggtcaagatttttgataaaaaaaaaaaaaaaaaa

SEQ ID NO: 1800 - DNA, 723 bp, Gerbera hybrid cultivar
ccgatttcgattgatttcatcaacaatggcttctggttcgacattcagtggtgatgaaactgcgcctttttttggatttctcggcgccgctgcggccctcgtcttctcctgtatgggggctgcgtatggaacagcgaagagtggtgtgggtgtggcatcgatgggagtgatgaggcctgagctggtgatgaagtcgattgttcctgtggttatggctggtgtgcttggtatttatggtttgattattgctgttatcatcagtactgggattaatcctaaggcgaaatcatactatctatttgatggctatgcacacctttcatctggtttggcttgtggtcttgctggactttctgctggaatggcgatcggaatcgttggtgatgctggtgttagggctaacgcacagcagccgaaactttttgttggaatgatccttattctcatctttgccgaagctcttgccctatacggactcatcgtgggtatcatcttgtcttctcgtgccggccagtcgagagcagattaagaaattcttctccaagtcttggtatgtagttttatgaatttcgtgttcgtgttttgaaacaacacttattgtattactctaaaattttctccaagatggcattcttttctcgtgtttatgactgcggttgtgtacttttgtgtttaagtttgattataaacttgtgtcaattgtgtaaaaaaaaaaaaaaaaaa

SEQ ID NO: 1801 - DNA, 1077 bp, Vitis vinifera
agacaaataagagagggatcgagaagggaaaaggaaactacgctgcagagaaaagggaagagaaaattttctcagatccggtccgtttctctgcaaaatcgaacacgagaagatgactaccttcagcggcgatgagactgctccattcttcggcttcctcggcgctgctgccgcccttgttttctcctgtatgggagctgcatatggaaccgcaaagagcggggttggtgtggcctccatgggtgtgatgagaccggagcttgttatgaagtcgatcgttccagttgttatggccggagtgttgggtatttatggtttgattattgctgttatcattagtactggtattaaccctaaggccaaatcctattatctttttgatggttacgcacacctttcttctggtctggcttgcggcctcgctggcctttctgctggaatggccattgggatagtcggtgatgctggtgtgagagccaatgctcagcagccaaagcttttcgttggaatgatcctcattctcatctttgctgaagctcttgccctgtatggacttattgttggcatcatcctatcttctcgagctggtcaatcaagagctgaatagaggaaggcgctctggtcggtggttgtggggttgttgctgccctttaagaattatttttgtgttctctctggttacagatggtggttctgctcaggatgaagtgctgttttcttcaaaattcttatatgcgagtgtgattgtggatcgagcagtagaatgtggaattaggaattagtttctcgctgggctctgaataagtttttaagttgtttctttttcatttatccaatgatgtattttgcagataccagttcggatttgtttagaaacactcgcatgtactattttatgagattcctgctgcctacatttttcattgttttttcttctgcaaagtctttgccattggtaaggtaacctagctggtgctgcctacaatgacggttggacaattcaacgtttcactctttaagattctattaaaatggaatgaccatggaggtgttataaaaagaattaaaattttgata

SEQ ID NO: 1802 - DNA, 958 bp, Ipomoea nil
gagggccaataaaaatcttttgtgcagtgccattcgcaactcgcaagagccaagggcttctcagatctgatcaattacacagtttttctgcagatccgacgtatacgaattcgctgaaaagctgaaaagatgtcaaccttcagcggcgatgagacggcacccttctttggcttcctgggcgctgctgctgccctcgtcttctcctgtatgggagctgcctatgggaccgcaaagagtggggtaggggtggcgtcgatgggtgtgatgaggccggagctggtcatgaagtcgattgtcccagtggttatggctggtgttttgggtatttacggcttgattattgccgtgatcataagtaccggtattaaccctaagaccaagtcctactacctctttgatggctacgctcacctttcctctggtcttgcttgtggcctcgctggcctttctgctggcatggccattggaattgttggtgatgcaggtgtaagagcgaacgcacaacagcccaagctttttgtagggatgattcttatcctcatttttgccgaagctctggctctctatggacttattgttggaatcatcctctcttctcgcgctggccaatctagagcagaatagaggaagagcagagcacatttgtctctacgcatatttatgttgttttcaggctatttggttgtggaattttttcttctctttcaccaaagattacttatggggttggttggctaatagattcgctaatttatgtgttgatgttttgttgtagattagatctcccctcggccctcaataaaactgtcatcagttatcataaaagaccataagggaattgtgtaatacttgtttgtgtcgtcttgtcgaatttgttcgtgttgagtttcaaagttagattagctcgatttactttttcattggcacaaagaaagacagatttatggagtctagaata

SEQ ID NO: 1803 - DNA, 939 bp, Ipomoea nil
ggattaaatctgaaagctctggaataaagacaaagttgattgatatcggtaccagaactttttgagattcagagcaaaaggattcacagtttttccgagactgtgagcacagccatacgccgggaattctcagatccggtcaattacgccgtcgctgcagatccgatcgaatccggattcgaaagcaccagagaaaatgtcaactttcagcggagatgaaacggcaccgttcttcggcttcctcggcgctgctgccgccctagtattctcctgtatgggagccgcttacgggactgcgaagagtggggttggtgtggcgtcgatgggagtcatgaggccggagctggtgatgaagtccattgtgccggtggttatggctggtgtgttgggtatttacggtttgattatcgctgttatcatcagtactggaatcaaccccaagaccaagtcctactatctctttgatggctacgctcacctttcttctggccttgcttgtggcctcgctggcctttctgctggtatggccattggaattgttggtgatgccggtgttagggccaatgcacaacagcccaaacttttcgtcgggatgattctcattctcatttttgctgaagctcttgctctctatggccttattgttggaatcatcctctcctcccgcgctggtcagtccagagcagaataggggacaagcattgaactttcatcatattcgtgattgcagaggccgtttggctctgaaaaaacttaatttttgcttgaagatcacatgcacgaggcttgaacaatatgggtttcatatgcgcagatgttgtgatgtagattagatctcgctgtaataagaatttggagttttaaaactctgcttgtattattattcttaccagagctgacttcaacttttgtcctctcccagttagatcgtcacataat

SEQ ID NO: 1804 - DNA, 868 bp, Lactuca sativa
cgggggatttgaagattttttcttcgataaaatcctccaaaaaagctgtccgtcctctcggtatccaaaaggacaggtgttcatcaacatacacacatacacagatctaaaactctttccatttccacttttccgatcgattttaatccaaaatcgattaacaatgtcttcaggttcagcattcagtggtgatgaaactgcccctttctttggtttcctcggcgcagctgctgccctcgtcttctcctgcatgggagcggcgtatggaacagcgaagagtggtgttggtgtggcgtcgatgggtgtgatgaggcctgagctagtgatgaagtcgattgttcctgtggttatggctggtgtgcttggtatttatgggttgattatcgctgttatcatcagtactgggattaaccctaaagcaaaatcgtattatctgtttgatggctatgcacatctttcctctggtttggcttgtggtcttgctggtttgtctgcaggaatggcgattgggattgttggtgatgctggtgttagagcgaatgcacagcaaccaaagctttttgtgggtatgattcttatcctcatctttgctgaagctcttgccttatacggactcattgttggcatcattttgtcttcacgtgctggacaatcaagagcggattaagaagattgaattttttttttttttttgaaatatctgtttgttgtttgttttgttttcataaatcaagatcatttttttatttcataattttccagcttttggacacatgttattgcattaccttaaattttcgtgatattattgggattctttgtggactcattatcactagcgtttaggtttatgcagaataagagtttt

SEQ ID NO: 1805 - DNA, 726 bp, Glycyrrhiza uralensis
aaaaacctccccgtacaccaacagagatcggaacttgaaaggaacttatctctctccgtgtgaggaaaatcggaataccgtaattctcaggtcagatctattcgacgtcgttttagtacagatggctccgttcagcggcgatgagacggcaccgttttttggcttccttggagccgcagctgccctcgtcttctcctgtatgggagctgcctatggcacggcaaagagtggtgtcggcgtggcttcgatgggtgtgatgagaccggagctggtgatgaagtctattgtccctgttgttatggctggagttttgggtatttatggccttattattgctgttattatcagtaccggcattaaccccaaggccaaatcttattaccttttcgacggttatgcacatctctcctctggtcttgcctgtgggctggctggtctctctgctggcatggctattggtattgttggtgatgctggtgttagagccaatgcacagcagccaaaactttttgttggaatgattctcatcctcatttttgctgaagctcttgccctttatggtctcattgttggtattatcttgtcttctcgtgctggccagtctagagccgagtaggagaggagctgtgctgctgcaaaatattctttgaccaccaaccttcttattaagagggcgagggggtgaatttttagttgttgggttagtgatgtttggacaccgcctgc

SEQ ID NO: 1806 - DNA, 903 bp, Lotus japonicus
acacaccccacgtttcacaaccgctccctccgtgtgcttcgatcttctttctctgcgatcaccgtaattcttagatcggatctatctattcgacgtcgtcgtttcaccatcaatggctccgttcagcggcgatgaaacggcaccgtttttcggcttcctcggcgccgcagctgcactcgttttctcatgtatgggagcggcgtatggaacggcaaagagtggtgtcggtgtggcttcaatgggagtgatgagaccggagctggtgatgaagtcgattgttcctgttgttatggctggagttttgggtatttatggacttattattgctgttattatcagtactggaattaaccctaaggccaaatcttactacctctttgatggttatgcgcatctctcctctggtcttgcctgcgggcttgctgggctctctgccggcatggctattggtattgttggtgatgctggtgtcagagccaatgcacagcagccaaaactttttgttggaatgattcttatcctcatcttcgctgaggctcttgccttgtatggtctcatcgtcggtatcatcctctcttctcgtgctggtcagtccagagctgagtaagaaaggagctgtgctgcaaaatattctttgacagccttcttattaagagggccacagggggttaattttttagttgtgaggttagtgattcggacaccatttgcaggatttaacaaatacttatgtgaaagcagtggctccacctgccatttggtatgtttgtataagtagtttttctttgcttaataaagcttctttagcttcatcttttattccttatgaaatgtgttatatcatctaagtttacatttttgtttgctgctgctgttgcttaaagtgatgctgcatgtaatgat

SEQ ID NO: 1807 - DNA, 780 bp, Marchantia polymorpha
atcctctctcgacctcctcgccgatcgagatcctcttctctctcccgagagctggctggatcttgcttttttgtatcatagaagagctcagaatcccagtcttcgatcgtcgagcttttcttgtctgatctgcgggaggaagaagaggtttagtcaagatgtcgaccgacgtaggattctctggagatgaaaccgctccctttttcggcttcatcggagctgctgctgcgctcgtcttttcatgcatgggagcggcgtatggaacagccaagagtggagtgggagttgcaagcatgggtgtgatgaggcccgagttagtgatgaaatctattgtgccagtggtcatggctggagtgttgggtatttacggattgattattgctgtcatcatttccactggaatcaaccctaaggccaaaccctactacttgttcgacgggtatgcccatctgtcctccggattggcttgtggattggcaggactgtcagctggtatggccatcggaatcgtcggagatgctggagtgagggccaacgctcagcagcccaagctgttcgtcggaatgattcttatccttattttcgctgaggcgcttgctttgtacggtcttatcgttggaatcattctctcatctcgcgctggtcaatctcgaggagagtagggacctagttttgccgatctgcatgcctccctcggctggcttgagtgcagagcatgattggttagatatgcgttgttttggttgatgaatattggatagatcttgaagctggaaagaa

SEQ ID NO: 1808 - DNA, 1441 bp, Marchantia polymorpha
  misc_feature (1434)..(1434): n is a, c, g, or t
cgctcattctcgtcgtgtcgatctctcgctctcactgtcgcccgtcccgagctcgagccgaatcgcagcgcgggctatattgtgctggccgtgcgcaagttcgtcaagtcgtcgagctcgtcgaggagagaggggcaggcgcagcgggagatagagatcgagagtgagaagagagattcacaggagaggagaaggagagatcgattggttgattgattgattgatcgattgattgatttgagagcgagaagggaaaggaaggaacgagaaggaaagatgtcgaccgatgtgggattctccggtgatgagaccgcgcccttcttcggcttcatcggagctgcggcagcgctcgtgttctcgtgcatgggagcggcctatggaaccgccaagagtggagtgggagtggccagcatgggagtcatgagacccgagctggtgatgaaatccatcgtgccagtggtcatggcgggagtgttgggtatttacgggctgattatcgctgttattatctccaccgggatcaaccctaaggccaaaccctactacctgttcgatgggtatgcacatctgtcctcgggattggcttgtggactggcaggactctcagctggtatggcgatcggtatcgtcggagatgccggagtcagggccaacgcccaacagcccaagctcttcgtgggaatgatccttatcctcattttcgccgaggcgctggctttgtacggtcttattgtgggtatcatcctgtcttcccgcgccggacaatcacgaggagaatagaagactgcactccgatctgtagatgaagccacattgggctggcttgcgtgcagagcatgatggctatgctttgccttgtgttgattgaggactagtgggcagatcaagtgggcaaaagttcggtccatcactgcaggtgtggcctccagcccttttacaagcttccttgggaccgagcgggacgcacggacatagagttggaactttttgtgaaaattgtaataacagtggttgctcatgtatgttttcctggtggttacatctttctggaggtgaagatctattgattcataagtcacgtgtgacgtaactgcatcggtcgaggactggatcactcccatgagccaatcggagcagattattgtcttggtaatttgtcaattgtttagatctgaacattaatggagaatattgaccttggagcttacactttgcaccgcagatgcaagcgtccctgcaatttttgtttctgtgtgcctttattagttcatatttatttagccaatctgttagaggttgcataggagtattaatagagaaaatctcgtgccaaaggttgtccatgtacggaagttgaagacctgccttagactttctacgtcagtccgcttgtaacagcacatctgttgtaaatctttcattcaaatgcctaanaaaaaaa

SEQ ID NO: 1809 - DNA, 1120 bp, Pinus pinaster
cttctttctcccttcgtctccaagggatagtaaagatcgacggatttagtgttctcttttttctgttctctccgcgaggaattccattccgtttgtgccctgggtacgtctctatataccttctttctcccttcgtctccaagggatagtaaagatcgacggattgagtgttctcttttttcaccttaatactctgcttccatcttcccgcgagatcatttaatccacgaattgcatttaaaaggttgatttcatttgaaagatcggcagatcatcagcgtagacgaaatggcggacccattcagcggagacgagctagcaccttttttcggattccttggagctgcggcagcccttgttttctcatgcatgggggcagcttatgggacggcaaagagtggagttggagttgcatccatgggtgttatgaggccagaacttgtgatgaaatctatagtaccagttgttatggccggagtgttgggtatatatggtttgatcattgcagttattataagtaccggaatcaacccgaaggctaaatcctattatttatttgatggatatgcccacttatcatcagggctagcttgtggtctttctggtttgtctgcaggaatggcaattggcatcgtgggtgatgctggtgtcagagcaaatgcccagcagcctaagctttttgtgggcatgatcctcatactcatttttgcagaggcgcttgccctgtacggtttgattgtgggtattattttatcatcccgagctggtcagtcaagagctgactgatagaagtttataatgccaggtcacttgattgattgggggttcatttaaaagaaccctatgtttcagaaatttcatcgcagtgactggatatcttttgtataatttttagtcctttaaaatttctgtcaacttagtacgaagcattttttcattgtagctttgttgttgaatatcataagttattgatggttgtgaatatagtcaccttcataaatccaaggcgatgcttggtttaatgttcattcagaaatgtggatgttgcaagtccattccattttatagtacatgttcaaattccgccctacgaggttaataagatcaactgcactgaatt

SEQ ID NO: 1810 - DNA, 1040 bp, Medicago truncatula
acgttcactaaccatcaaccatcatcatcttcctctaccacaacacaacagagatcgaaacttctctctccgagaaaaatcacaatcccgtaaatcttagatcagatctatacgtcgtcgtttcagtatcaatggctccattcagcggcgatgaaactgcacccttctttggcttccttggagccgcagctgctctcgtcttctcatgtatgggagctgcatacggaacagcgaagagtggcgttggtgtggcttccatgggtgtgatgagaccggaactcgtgatgaagtcgattgtaccagttgttatggctggtgttttgggtatttatggtcttattattgctgttattatcagtactggaattaacccaaaggccaaatcttattacctttttgatggctatgcacatctttcatccggtcttgcttgtgggcttgctgggctttctgctggtatggctattgggattgttggtgatgctggtgttagagccaatgcacagcagccaaaacttttcgttggaatgatccttatcctcatctttgctgaagctcttgccctttacggtctcattgttggtattatcttgtcttcacgtgccggccagtctagagccgagtaagtaaggagctgtgttgcaaaatattctttgaccaccaaccttcttattaagaaggcgagggggtgaattttagttgtgcggatagtgatgtttggacccagttgcagtattttttaacaaatactttgaaagtaatagctccacctgtcatttgatggtgtttgtataagtagtttatctttggttaataaagctttttaagcttcgtccctttttccttatgaaacgtattatgccatattatttgagcctactttgtttttgctgctgctgaaactagtgcgtgtaatgatttagttgcgaatataaattgtatgcatttgtggatcttttcatattagatgcagctataatgttggcttagacagtagtacaaaattacaacgaccttttcacaatagaataacacataaa

SEQ ID NO: 1811 - DNA, 1008 bp, Medicago truncatula
aaggatgtgagtgatataaaaaaataaaagacagaaaaaagaagaggaagaaatccatcccgatcacagatcagaaatcaaacagatcgatccacaaaaatggctccattcagcggcgacgaaactgctcctttcttcggcttcctcggtgccgcagcggcactcgttttctcatgtatgggagcggcatacggaacagcgaagagtggtgtaggagtagcatcgatgggagtgatgagacctgaacttgttatgaaatctattgttcctgttgttatggctggtgttttgggtatttatggtttgattattgctgttattattagtactgggattaatcctaaggctaaatcttattatctctttgatggttacgctcatctttcttctggtcttgcttgtggtcttgctggtctttctgctggtatggctattggaatcgtcggtgatgccggtgttagagcaaatgctcaacagccaaagctttttgttggaatgattctcatcctcattttcgccgaggcgttggcgttgtacggacttattgttggcatcatcctctcttcccgcgctggccaatccagggctgagtaaagtcatatttcatgttggtcgtggtttacagagccacagattgtgaatgtcactgtggagctggctttgctaatgttcgtacactggttgctgtttttcattattcatgttattctatttatttatgcactctttataaagttgaggttatctaggaccaataataaagcttttctctgcgcgtcattagttttgaattatatatgctcaattaatagatcagagatctatatacttagacagatgtttgttttgattccaataacttattaagtatggttttgtacttgccaaaatgtatctcccaaacaacccagacttttcattaatattattttattcaatatgatctctctgcatgtctttaaatctgtttttatgaagatgatagcatcttgctctggtttgggcagg

SEQ ID NO: 1812 - DNA, 880 bp, Tropaeolum majus
cggccggggactttcttgatttttattctctctttcctacagcattcatcttcaaaatcccccaattgattcccgagttctgaatcgaatttcccaacttctctcaaatcggttcttcgaaggatggctgcattcagcggagatgaaacggctccttttttcggcttccttggtgcagccgctgcactcgttttctcctgtatgggagctgcatacgggaccgcaaagagtggtgtaggtgtggcgtcgatgggggttatgaggccggagcttgtaatgaaatcaattgtcccagttgttatggcgggagtgttaggtatctatggattgattattgcggttatcatcagtactgggattaaccctaaggctaaatcctactacctcttcgatggatacgctcacttgtcatccggtctggcttgcgggctcgctggtctatcggcgggtatggcaattggcattgttggtgatgctggtgttagagcaaatgcacaacagcctaagctgtttgtaggaatgatattgattctcattttcgctgaggcgttggctttgtatggtctcatcgttggcatcattttgtcatcaagggctggccaatccagagcagagtagaagttcaaggttctgatgctatgattcttaattcattttttttttgttattgctgtctgaaattgcttgtttagagttctgagttcgtcctgaaattgtttgttatgtactacaatgctccattacattaaatccacagtatgtgaaattgttttagaggaccgtcgacaataaagttcatttggagttcttgcttcaagtatattaaatctacagttagttaccgcaaatgaaatatatttaatatttttaaaaaaaaaaa

SEQ ID NO: 1813 - DNA, 1029 bp, Nicotiana benthamiana
aagaccacacaaacgaaaaaaaacacttattttctctctcacgagacgcgaagaagtacaggaacttttcagatccgatcattcacacttcttctctctccaaaaacaacttcgcagaaacaatggcgtcgactttcagcggcgatgaaacagctcccttcttcggcttcctcggcgctgccgctgccttagtcttctcctgtatgggggcagcttatggtactgctaagagtggggtaggagtggcatctatgggtgtgatgaggccagagctagtgatgaagtctattgtgcccgtggttatggctggagttttgggtatttatggattgattatagctgtgataatcagtactggcattaacccaaaaaccaagtcttattatctttttgatggctatgctcacctttcttctggtattgcttgtggccttgctggactttctgctggtatggccatcggaatcgttggtgatgctggtgttagagctaatgcgcaacagccaaagctctttgttgggatgattctgattcttattttcgctgaagccctggctctttatggccttattgttggcatcattctctcttctcgtgctggccagtccagagcagagtagaagatgagcatgttatgctccgtaactgtgaattatctttttgttcttccgcattggatgagatagtctggctgctgaattatgttactttgtgttttgggctccatgtagttgattgtttggcttgcagaactggttcacatctgctgatcagctgtagattgaatcaatctcttatcaataaagatattagttttacctgatgctcaaggacaacaaaggatttatgtgaaaggttcctgtgttatttcatgtcaacttcaaatttagtatttataattctttagctctgtatctcttgtttttcctccccattttagttttggattggttctctgtctctactcctgtcttcgaaaaatgaattgatccagtattttgcactttgacaagctatgactttatatag

SEQ ID NO: 1814 - DNA, 986 bp, Nicotiana benthamiana
gcacgaggaagaagtacaggaacttttcagatccgatcattcacacttcttctctctccaaaaacaacttcgcagaaacaatggcgtcgactttcagcggcgatgaaacagctcccttcttcggcttcctcggcgctgccgctgccttagtcttctcctgtatgggggcagcttatggtactgctaagagtggggtaggagtggcatctatgggtgtgatgaggccagagctagtgatgaagtctattgtgcccgtggttatggctggagttttgggtatttatggattgattatagctgtgataatcagtactggcattaacccaaaaaccaagtcttattatctttttgatggctatgctcacctttcttctggtattgcttgtggccttgctggactttctgctggtatggccatcggaatcgttggtgatgctggtgttagagctaatgcgcaacagccaaagctctttgttgggatgattctgattcttattttcgctgaagccctggctctttatggccttattgttggcatcattctctcttctcgtgctggccagtccagagcagagtagaagatgagcatgttatgctccgtaactgtgaattatctttttgttcttccgcattggatgagatagtctggctgctgaattatgttactttgtgttttgggctccatgtagttgattgtttggcttgcagaactggttcacatctgctgatcagctgtagattgaatcaatctcttatcaataaagatattagttttacctgatgctcaaggacaacaaaggatttatgtgaaaggatcctagttatttcatgtcaacttcaaatttagtatttataattctttagctctgtatctcttgtttttcctccccattttagttttggattggttctctgtctctactcctgtcttcgaaaaatgaattgatccagtattttgcactttgacaagctatgaatttatatag

SEQ ID NO: 1815 - DNA, 1037 bp, Quercus alba
cccataggaggaaggggtctgaaactctgatccacaaaccacaattatcaacaaacaaacaaaacaaacaaacccagagcatcttgtagagaataaaagccattcaaaaagagaactaaacaaaaaaagagaaagcaaaaattcagtctcttctcatctcagatctgatcgggaaataaaaaatgtcttcttcatcaactttcagcggcgatgaaacagccccattctttggcttcctcggcgctgctgccgccttagtcttctcctgtatgggagcggcgtacggaacggcgaagagcggagttggggtggcgtcgatgggtgtgatgaggccagagctggtgatgaagtcgatcgtgccggtggtcatggctggtgtgttgggtatatacggtctcatcattgctgtgattatcagcacagggattaacccaaaggctaaatcctattacctcttcgatggctatgcccatctctcttctggtctctcttgtggcctcgctggcctttctgctggtatggctattggtatcgtcggtgacgctggtgtcagagccaatgcacaacagccaaagctttttgttgggatgattcttattcttatttttgccgaagcactggctctctatggtctcattgttggcatcatcctttcttcccgagctggtcagtccagagctgactgaatctgagagagcacattctgcttggtggttgtggttgtgcggtttattgctattaattgggaagtgtttttttttttactagagattcttgtgggtgagtgcaattgttttaccaatatatgttttaggaagtttccttgctatggtgataggatatagaattagaaattagtttctactcttaaattttaaaaaagtcttttctcatctttctgattcagcattgtgcggatttaaatttaaagttgtgtagaattattgtattatcatttttggaaggatttgtcgtcatgcttttgttatctttatcatgatggataagctaagtgtgtgtatggttgtggtcatttg

SEQ ID NO: 1816 - DNA, 1015 bp, Quercus alba
cattttttcatttaccagaggagttcccataggaggaaggggtctgaaactctgatccacaaaccacaattatcaacaaacaaacccagagcatcttatagagaataaaagtcattcaaaaagagaactaaacaaaaaaggagaaagcaaaaattcattctcttctcatctcagatctgatcggaaaataaaaaatgtcttcttcatcaactttcagcggcgatgaaacagccccattctttggcttcctcggcgctgctgccgccttagtcttctcctgtatgggagcggcgtacggaacggcgaagagcggagttggggtggcgtcgatgggtgtgatgaggccagagctggtgatgaagtcgatcgtgccggtggtcatggctggtgtgttgggtatatacggtctcatcattgctgtgattatcagcacagggattaacccaaaggctaaatcctattacctcttcgatggctatgcccatctctcttctggtctctcttgtggcctcgctggcctctctgctggtatggctattggtatcgtcggtgacgctggtgtcagagccaatgcacaacagccaaagctttttgttgggatgattcttattcttatttttgccgaagcactggctctctatggtctcattgttggcatcatcctttcttcccgagctggtcagtccagagctgactgaatctgagagagcacattctgcttggtggttgtggttgtggttgtgcggtttattgctattaattgggaagtgtttttttttactagagattcttgtgggtgagtgcaattgttttaccaatatatgttttaggaagtttccttgctatggtgataggatatagaattagaaattagtttctactcttaaattttaaaaaagtcttttctcatctttctgattcagcattgtgcggatttaaatttaaagttgtgtagaattattgtattatcatttttggaaggatttgtcgtcatgcttttgttatctttatcatg

SEQ ID NO: 1817 - DNA, 691 bp, Parthenium argentatum
gtgatccaaaaggccagtccttcatcttcaacatcaaacacatacacagagatctaaaactcctttcaatcgacaagaatgtcttccggttcaggattcagcggtgatgaaaccgcccccttcttcggtttcctcggtgccgctgccgccctcgtcttctcctgtatgggggcagcatacgggactgctaagagcggtgtaggtgtggcgtcgatgggtgtgatgagaccggagctggtgatgaagtcgattgtaccggttgttatggctggagtgcttggtatttatggtttgattattgctgttattattagtactgggattaaccccaaggcgaaatcgtattatttgtttgatgggtatgcgcatctttcgtctggtttggcttgtggtcttgctggtttatcggctggaatggcgatcgggattgttggtgatgctggtgttagagcgaatgcgcagcaaccaaagcttttcgtgggaatgatccttattctcatctttgccgaagctcttgccctatatggacttattgttggtatcatcttatcttcgcgtgctggccaatcgagagcagattaagaaggtaacacgaaaataaacgcgaacttgtttctacaatctatatatgtttattgtttgtccttataaatcacgatcgtttgtttttacccttttttatttcccatgt

SEQ ID NO: 1818 - DNA, 1044 bp, Arachis hypogaea
tatcaacgcagaggtacggggctcttcagatcggagcctggaagccgtgagtttctctgtgtgatcacaccttcgttcagatcacaagaacatcagatccgaaatcgaaagacaaagagaaagtgtaatcaatggctccgttcagcggcgatgagacggcaccgttttttggcttccttggagccgcagctgcacttgttttctcctgtatgggagctgcctatggcacggcaaagagtggcgtcggcgtggcctcgatgggcgtgatgagacctgagctggtgatgaagtctattgtacctgttgttatggctggagttttgggtatttatggccttattattgctgttattatcagtacaggaattaaccctaaggccaaatcctattatctctttgatggttatgcacatctctcctctggtcttgcctgtggcctcgccgggctttctgccggcatggctattggcattgttggtgatgctggtgttagagccaatgcacagcagccaaaacttttcgttggaatgattctcatcctcatcttcgctgaagctcttgctctatacggtctcattgttggtattatcctgtcatctcgtgccggccaatctagagctgagtaagaaaggagctatgccatagaatattcgttgccaccccacatcatgttttaaccctcttattaagagggagagagggggcaaatttttttagtcggaggttagtgatgctcggacagcacttgtaggctaaaaaggaaaacaaagactttggtgaaagcaattgctccacctgccgtttgttggtgtttgtttgtataagtagctttgctcaataaagcttctcaagcttcatgttttttcttttttcttttttttttcccctccttgtgacattgtattgtgccatataatcttgagttctaaatttttcaacccttttgcttctcttttggctgctgaaagcggtgcatatgagtcattttggttgcgaaggtaactaagaacattaacggatcgtttcgtatgaagcgctgctttc

SEQ ID NO: 1819 - DNA, 876 bp, Capsicum annuum
ctctcgttctctctctttggacattgagaacaacaatctcagatccaatcaaattgttacttattacactctttgtcttcacagatccaatcggaactaaaaaaaacatgtcgacttttagcggcgatgaaactgctcccttctttggcttccttggcgctgctgccgccttagttttctcttgtatgggagcagcctatggtacagcgaagagtggggtaggagtggcgtcaatgggtgtgatgaggccagagttggtgatgaagtcaattgtgccagttgtcatggctggagttttgggtatttacggtttgattatagctgtgattattagtacagggattaaccccaaaaccaagtcttactatctttttgatggatatgctcacctttcctccggtcttgcttgtggtcttgctggcctctctgctggtatggccattggaatcgttggtgacgctggtgttagagccaacgcgcaacagccaaagcttttcgtcgggatgattttgattcttatttttgctgaagccctggctttatatggccttattgtcggtatcatcctctcttctcgtgctggtcagtctagagcagagtagaagaagagcatgcttcacacctttactgtgaattactcatattcttgatggattattacattttctttcattcttcacttccactattctgtacttgattgtttttggctagaagaattggttcatgtgtgctgttcttctgttgattatatctctaaataaagatgtcagttaatctgatgcccgattttcaaggactacgggcttttgtaaaatgcccggtgtacattttatctcgacttcaattcaaatattaatttacttcaagatttcc

SEQ ID NO: 1820 - DNA, 990 bp, Capsicum annuum
gggaaattgtgcataaccaaaatgacgtcgaaagcccaaacccattataacatgtgaaatcatcaattattccatttgcttcaacaccaatcgatactagagggaggagaaagagatctctccattcaactccaaaactcaaaattgtcagatccaaatagtaaagacaatgtcgaccttttccggagatgaaactgctcccttcttcggcttccttggcgccgctgctgcccttgtcttctcttgtatgggggcagcttatggaacagcgaagagtggtgttggagtggcgtcaatgggagtgatgagaccggagttggtgatgaaatcaattgtgccagtggttatggctggtgtattaggtatttatggcttgattattgctgtgatcatcagtaccgggattaaccccaaaacaaagtcgtattacctatttgatggctatgctcatctctcatctggacttgcttgtggtcttgctggcctttctgctggaatggctattggtattgttggagatgctggtgttagggctaatgcacaacaacccaagctttttgttgggatgatcctcattctcatttttgctgaagccttagctctttatgggcttattgttggcattatcttgtcttctcgagctgggcagtctagagctgagtgaagttaaccccattcctaccgcactgtatgtgagacttttagaagaccaaggctgcaaaagcctaaagttgaaaagtatctattacgggtattgttattcatgacgccacaactgccactttaatccattggtgctgtcctgtttgtagaagtaggagtccaattttttctacttaataatagcttaaagagctatgcaatttggtcagtatttattgtgtgttttgtactcattatttgtgaacagtccgaggactatttcttttctaagattcgtgcatgtctgatcttttcatttagtatatcatatttactgtgccctcgtgc

SEQ ID NO: 1821 - DNA, 906 bp, Capsicum annuum
gctaatcactttgtttccaaattcgaagaagaagaagaataaaaatgggatcttcgaggtttagcggcgatgaaacggcaccgtttttcggcttcctcggcgctgcagctgccttagtcttctcatgtatgggtgcagcttacggtacagcgaaaagtggtgtaggagtagcgtcgatgggtgtaatgcgtccagaattggtaatgaagtctattgttccagttgttatggctggagttttgggtatttatgggttaattattgctgttattattagtactgggattaatcctaaaacgaagtcctattatttatttgatggatatgctcatctttcatctggtcttgcctgtggtcttgctggtctttctgccggtatggctattggaatcgttggtgatgccggtgttagagctaatgcacagcagccaaagctttttgttggaatgattctgatccttatttttgctgaagccttggctctttacggccttattgttggtatcatcctttcttctcgcgctggtcaatctagagcagagtagagaaagagtgcacctgttttatatttgtgaagtatctttgtttttcttacacgtcggacaagctagtctggctgttgaaatcacttttttgttagtgttggcctctgacattatgtatttttgattgctttggctagaagaattggttcgtttgtgccaatcagctgtagattagatctctcaataaagatactatcaacttttctgatgctccatttttcaaatacaataattggattgctgtaaaatgttccctgtagtgtagatttgcatggccaatcagctgtagattagaacagttctatatatgttttgtacttgaagtttctacttttaacttcaaatattcttctttgttggt

SEQ ID NO: 1822 - DNA, 924 bp, Capsicum annuum
gcacgaggaacagatcaaaaaagagatcgaaatccttcgaagtttatcagatccaaaatccgatcgatcgaacaatgtcgactttcagtggtgatgaaactgctcccttcttcggtttcctcggggctgctgcggccctcgtattctcatgcatgggagcagcgtatggaacagcaaagagtggtgtaggagtggcgtctatgggagtgatgagaccggaattggtgatgaaatcaattgttccagtggttatggctggtgtgttgggtatttatggattgattattgctgttattatcagtactggtattaatcccaaaacgaagtcgtattacctgtttgatggatatgctcatctctcttctggtcttgcttgtggtcttgctggtctttctgctggaatggctattggcattgttggtgatgccggtgttagggctaatgctcaacagcctaagcttttcgttgggatgatcctcattctcatttttgctgaagctttggctctttatgggcttattgttggcattatattgtcttcccgagctgggcaatccagagcagagtgaagttggcttatcaactctattcttactatggtgtacgtgcaactttcagaaaactctgcttaggcttgatccttgctaaagtcgaaaagctacatatttctacgtttgttatgatggctgctatgtgctgtttgtagaagtagggagtatttatctacttaataatagcttaagaagctgtcttatttgattttgatcaccatttgttgtattttgcaatttgctctgattgaacagtgttgtgcatgtattattttttgctataatttaacattgacgatatgcaacatatatgacactccccttcaatatatctgagaaaattcttttgggtgctgccacttggaagtgcaga

SEQ ID NO: 1823 - DNA, 773 bp, Petunia hybrida
tgtcgactttcagtggtgatgaaacagctcctttctttggttttcttggtgctgctgctgccttagtcttttcttgtatgggggcagcgtatggtacagcgaagagtggggtaggggtagcatcaatgggtgtaatgagacctgagttggtgatgaagtcaattgtgccggttgtcatggctggtgttttgggtatctatggattgattattgctgtgattattagtaccgggatcaaccccaaaaccaagtcttactatctttttgatggatatgctcacctttcctctggtcttgcttgtggtcttgctggtctttctgctggtatggccattggcatcgttggtgacgctggtgttagagccaacgcacaacagccaaagctttttgtcgggatgattttgattctcatttttgctgaagccctggctctatatggccttattgtcggcatcatcctctcttctcgtgctggtcagtctagagcagagtagaagaagagcacattcacgcaattcctgtgaattatatccttcatggatggagctagtttggctgctgaattatatttccttttttctttgggttccaagattctgtacttgattgcttggatagaagaattggttagattagagctctaaataaagatgtcagttaatctgatgccccaattttcaaggacaatgggtttttgttaaacgcgcactgtatcattttatcttaacttcaatttatctttataatttcatttcaagacatcgccgtaatat

SEQ ID NO: 1824 - DNA, 1283 bp, Petunia hybrida
gcgggggtaaaagtaaaggaccagaaactcacccagattccgatcaattatttgctctcagatcacaaattaaaaatgtcaacatttagcggcgatgaaacggcaccgtttttcggtttcctcggtgcagcagctgctttagtcttctcctgtatgggagcagcatacggaacagcaaaaagtggggtaggagtagcatcaatgggagtaatgagaccagaattagtaatgaaatcaatagtaccagttgttatggctggtgttttgggtatttatgggttaattattgctgttattattagtaccggaattaaccctaaaactaagtcttattatttatttgatggatatgctcacctttcttctggtcttgcttgtggtcttgctggtctttctgctggtatggctatcggtatcgttggcgatgctggtgttagagctaatgcacagcagccaaagctttttgttggtatgattctgattcttatttttgctgaagccttggctctttacggccttattgtcggcatcatcctctcatctcgcgctggccagtcaagagcagagtagagaagactgaagagtgtcctgtgttccaaaattgtgaaatatctttgtgttcttcctcgttgggcgagtgtgtgctgttgaatttcatttttgttttgattcggctccatgattatgtatttgattgtttggctagagaattggtttgtatgtgctgatcagctgtagattagatctctcaataaagaactcagtatttccgaaaaaaaaaaaaaaaaaaagtacaactctcttctctacattcatccccccccttttcttccattaattccatatttacccctcaaagtttcaatctccatcatttcctctctcgatccatgtaatttttagatcccaaaactttttagttaagtatgatttgaccccaaaagtttttgttttgatcaattaattaatttagctatgaagatagtggaacttgatgattcgttaattgaaagtgataacaagtgtgttgtgaatagtgaaagacttgatgctaaaagagctttagttggagccggggctcggatcctgttttacccgaccctactttacaatgttttccgtaacaaaattcaatctgaatttagatggtgggatcaaattgatcagtttctcctccttggagcagttccctttccgtcggatgtccctcggttgaagcagcttggcgttggtggtgtaataacgctgaatgaaccttatgaaactttggttccatcatcatt

SEQ ID NO: 1825 - DNA, 877 bp, Petunia hybrida
gcgggggaccagcacgtgcatcacctgaattaatttatccaccactcctcaataacgtgcttccacatccacaccccaacatccatacacacctctgagaggaaggagaaaaaaagaaaaaacagatccaaattaattctctctcagatccaaaatccgatccaaaaaatgtcaacattcagcggagatgaaactgctccatttttcgggttcctcggggcggctgctgctctagtattttcatgtatgggagcagcttatggaacagcaaagagtggggtaggggtagcctcaatgggagtaatgagacctgaactggttatgaaatcaattgtaccagttgttatggctggagtgttgggtatttatgggttaattatagctgtgattattagtactggaattaaccctaaaacgaagtcgtattacttgtttgatgggtatgctcatctttcatcgggtcttgcttgtggtcttgctggtctttctgctggtatggctattggtattgttggtgatgccggtgttagggctaatgcacagcagcctaagcttttcgttgggatgatcctcattctcatttttgccgaagctttggctctttatggtctgattgttggcattatcttgtcttcacgagctggacagtccagggctgagtgaagttggttcatgagctgtatccgtcctgtatgtcagacttcagaaacaaaagcaaaagtttgatccttgctttagtaaaggagatatttatcatctgcattattgttcatgatggcacagtttggcttcatttatggtttgtgctatttctagcaaagtggatggagtttttttttcctgcttaataagagcttcaaagagctgtcgaatcaac

SEQ ID NO: 1826 - DNA, 834 bp, Petunia hybrida
ggtccggaattcctcgagcactgtatggcctactggattaacttccttacacatctctccctctaatcaaatttctcagatctaaaatctgatcggaaaaataatgtcaacattcagcggagatgaaactgctccttttttcgggttcctcggtgccgctgccgcactcgtcttctcctgcatgggagcagcttacggaacagcaaagagcggtgtaggagttgcatcaatgggagtaatgagacctgaattggttatgaaatctattgttcctgttgttatggctggtgttttgggtatttatggattgattattgctgttattattagtactggtattaatcctaagacgaagtcgtattacttgtttgatggatatgctcatttatcctctggtcttgcttgtggtcttgctggtctttctgctggtatggctattggtattgtcggtgatgccggtgttagggccaatgctcaacaacctaagctttttgttgggatgatcctcattctcattttcgctgaagctttggctctttatgggcttattgttggcattatattgtcttcacgagctgggcaatccagagcagagtgaagttggcttattgatgctgttcttactatgatgtacctgagactttcagaaaactctggcaaggggtgttccttgctaatgtcgaaaagctatctatgtgtacgttcgttattcattgtgggacggttgccactttattgctgctgctatgtgctgttagtagaagtaggagtgagtatttatctacttaataatagcttaacaagctgtcctattcgatcactatttgtcgtatt

SEQ ID NO: 1827 - DNA, 853 bp, Solanum tuberosum
gcgtgagggaggagaaaaagatctattcaactccaaaactcgaagttctcagatccaaatcctaacgaaaatgtcgaactttgccggagatgaaactgctcccttcttcggcttccttggcgccgccgctgccctcgtcttctcatgtatgggggcagcttatggaacagcaaagagtggtgttggagtggcgtcaatgggagtgatgaggccggagttggtgatgaaatccattgtgccagtggttatggctggtgtgttaggtatttatggattgattattgctgtgatcatcagtactgggattaaccccaaaacaaagtcgtattacctatttgatggctatgctcatctctcatctggacttgcttgtggtcttgctggtctttctgctggaatggctattggtattgttggagatgctggtgttagggctaatgcacaacaacccaagctttttgttggaatgatcctcattctcattttcgctgaagccttggctctttatgggcttattgttggcattatcttgtcttcccgagctgggcagtctagagctgagtgaagttaactccattcttaccgcactgtatgtgaggcttctgaagaccaagacagctaaagcctaaagatctactacgtgtattgttattcatgacaccacagctgccacttttggtgttatgttctgtttgtagaagtaggaattcattttttttttctacttaataatagcttaaagagctgtgcaatttggtctgtattttttgtgtattttgcactcattatttgtgaacagtctgagaactatttattttctaagatttgtgcacgtatgaactacttttcatct

SEQ ID NO: 1828 - DNA, 874 bp, Primula obconica
agagagagagagataaccagatctaatccaagcaacttcgccggaaaattaaaaataaaataaatcagaaataataaaaaaggatgacggcgttcagcggagacgaaacagctccattcttcggcttccttggagccgctgctgccctcgtattctcctgcatgggagctgcctatggtacagctaagagcggtgttggagttgcgtcgatgggtgtgatgagacccgagctggtgatgaagtccattgtaccagttgttatggctggtgtgttgggtatttatggtttgattattgcggttatcattagtactgggatcaaccctaaagcaaaatcatattatttatttgatgggtatgcccacctttcttctggccttgcttgtggccttgctgggctctctgctgggatggctattggtattgttggcgatgctggtgtcagagctaatgcacaacagcccaagcttttcgttgggatgatccttattctcattttcgctgaagcactggccctctatggcctcattgtgggcatcatattgtcttctcgagctggtcaatccagagcagaatgagagacaagttacttgtctccatcgtaaacagagctctagagtttccagagttgccatttttaatgtcctttgaaatcgattataagaatttattcattactatgctcagtgccggtatatgttagaagaaaagctcatgaagctgcctgttgttggtttaattttattgttcacttttgttatcacaaattatattggtgaaaaactactattttggaacctatgttttgagctattttgtggctgtttgtttggagatagaattattgtgcaatatgatgtttctactttcttca

SEQ ID NO: 1829 - DNA, 759 bp, Carthamus tinctorius
aggacagtgtagaacatcaaacacagagagagatcatctggaaaaaagcttccgatttccatttttcagctctaattccgatcgatttcagtcgaaaatccgtcatcaacaatggcagattcaggattcagcggtgatgaaactgctcctttcttcggtttcctcggcgcagctgctgctctcgtcttctcatgtatgggagcggcgtatggaacagctaagagtggtgtaggtgtggcgtcgatgggtgtgataaggcctgagctagtgatgaagtctattgttcctgtggttatggctggtgtgcttggtatttatggtttgattattgctgttatcatcagtactgggattaaccctaaggcgaaatcgtattatctgtttgatggctatgcacatctttcctctggtttggcttgtggtcttgctggtctgtctgcaggaatggcgatcggaattgttggtgatgccggtgtcagagccaacgcccaacagccaaaactattcgtcgggatgattcttattctcattttcgcggaagctctagccctatacggtctcatcgtcggtatcattttgtcttcccgtgccggtcagtccagagcggattaaacgatgataaaaagaacgaagatggagttttttttctttttttttccttctatattgttgtttgtcttccttaatcaatcaaaatcatgtttccttttttcctcattttcttttgaaattgtcctctcatcatcattattcattaat

SEQ ID NO: 1830 - DNA, 838 bp, Sciadopitys verticillata
aaaatcttcactaaagaactgatttcatctgaaagatcgtcagatctctttgaaaaatgaaggaaacattcagcggcgacgaagttgctcctttcttcggttttctgggagctgcggcagcccttgttttctcatgcatgggagcagcttatggtacagcaaagagtggagttggcgttgcatcaatgggtgttatgaggccagaacttgtgatgaaatctatagtaccagttgttatggctggtgtgcttggtatatatggtttaatcattgcagtcatcataagcacgggaatcaaccccaaggcaaaatcatactatctgtttgatggatatgcccacttatcatctggcctggcttgtggtttatctggactgtctgcaggaatggcaattggcattgtaggtgatgctggtgttagagccaatgctcagcagcctaaacttttcgtgggtatgatcctcatactcatttttgcagaggcacttgccctctatggtttgattgttggtattattctatcatcaagagctggtcagtcaagagctgactgaattacatgatcctagcactgaggaatttgtttaaaaggaccatgtaaaggattcatgatggtgactcaatagatttgtatatttttttaatcatttgaagtcattatgaacttaaattatgctcatagttgtggcttctcaagaaagtagactgattttgactgtgccttgatgtgcatttattgtacttcgatccacttacggttttggatacaattgcctccgtagcttcaaggtgacactggatatagcgcttcttcagacatgaaactatggatgttatt

SEQ ID NO: 1831 - DNA, 957 bp, Sciadopitys verticillata
ggctctgcagatcctaaaacccttgaaaacaaaatctaaagagaagatcatctttacagatctcagttaaaaatgacggaaggattcagcggcgatgaagttgctccattcttcggcttcctcggcgccgctgcagcgcttgtcttctcatgtatgggggctgcatatgggaccgccaagagtggcgtgggcgtagcttccatgggtgtcatgcggccagagcttgtgatgaaatcgattgttccagtcgtcatggctggtgttttgggtatttatggcttgattattgccgtcattattagcactggaataaatcctaaggccaagtcctattatttgttcgatggttatgcacatctctcctctggcctcgcttgtggactttccggtctttccgctgggatggccattggtattgtcggcgatgccggtgtcagggcaaatgcacagcagccaaagctgtttgttggtatgatcctcatattgatctttgctgaagctctcgcactttatggccttattgttggtattattctttcttctagagctggccagtcacgagcagactagaaaaattggtcttgtattttccatttatcagttttgatttagtggactgctatcttctgcagtaaaaaaatttgatccctagtctcactaggagttaatatttccataaaggttaattgttgttctatcaattgcactttaagatgttaatttaatgctcaaatttaaagcatctcaatgatgcaattgcttcagggaaggaatgggtattatcatctcaataggagttaatatttccataaattttaattagtatttagctgattgcatttgaagacttgaattgaacgatcaagtgtgaagcatctgaaatgatgccattgatccagggaaatgaacgagtgttattttctcttcctttgacatcatatataaatgatatactgt

SEQ ID NO: 1832 - DNA, 908 bp, Senecio madagascariensis
aagcagtggtatcaacgcagagtacgcgggaaacagacaggtgttcaccatcaaacacacacaaaacacacacacaccgatctcaatctctccgatccaattccgatcaattcaccatccgataacaatgtcttccggttcaacattcagcggtgatgaaaccgctcctttcttcggtttcctcggtgcagcagccgccctcgtcttctcctgtatgggagcggcttacgggacggcgaaaagtggtgtaggtgtggcttctatgggtgttatgagacctgagcttgttatgaagtcgattgttcccgttgttatggctggtgtgcttgggatttatggtttgattattgctgttattatcagtactggaattaaccctaaggctaagtcgtattatttgtttgacggatatgcacatctttcttctggtttggcttgtggtcttgctggtttgtctgcaggaatggcgattggtattgttggtgatgctggtgttagggccaacgcccagcagccaaagctttttgttggtatgattcttattctcatctttgctgaagctttggccctatacggtttgattgttggtatcatcttatcttcccgtgccggtcagtccagagcagattaagaagacggacttggacttctttctttctatatgtgtttgttgtttgtcctgataaaatcaagatcgtgtttttgctttgttttaatttatgagctgcttttgaacatcgattattgcattactctaaatttttcttgatgaaattttttgttgtttcattgttattactcattagtgtatatgatgttactgcagaataaggccatagtcttggtcaaatacttttattaatttgtgtacttatgttgtagtcatgattgaataaaaccagattatc

SEQ ID NO: 1833 - DNA, 906 bp, Sequoia sempervirens
gatcttggatttgcactgataaattgatattgcttgaaagagcaacagatccggtaaatcatggcggttgatttcagcggagatgaaactgctcctttctttggattcctgggagctgcggcagcccttgttttctcatgcatgggagcagcatatggtacagcaaagagtggagttggagttgcatcaatgggtgttatgagaccagaacttgtgatgaaatctatagtaccagttgttatggctggagtccttggtatatatggtctgatcattgcagtcatcataagcacgggaatcaaccccaaggctaaatcatattatctgttcgatggatatgcccacttgtcatcaggtctggcttgtggtctatctggtttgtctgcaggaatggcaattggcattgtaggtgatgctggtgtcagagcaaatgcacagcaacctaagttatttgtgggtatgatactcatcctcattttcgctgaggcacttgccttgtatggtttgattgttggtattattttgtcgtcaagagctggtcagtcaagagctgagtgaaactcgtgatcctactgcaatcaattcactgggagctttatttaaggaggaccatgtaagggattcatgatggttgctatctttgtatatttttcaatttttaaatcataaacttaattacgctcataggtctgactttttaatgagtagaatattcttttatgtgccttggtgggcatttattgtacccattagctcatgattttggatacagttaccctcgtatcttcaacgtgaatctggtttatgcttaatcagacatgcaattatgaatgttatttctttcttgtcagacagtattgtcaatttcctcctctgaagatcaataaattactaaatttatgccag

SEQ ID NO: 1834 - DNA, 1094 bp, Sequoia sempervirens
ggaattgggatttctgggttgtgtttaatcagatctcacatcaaaaaccattttacattgaggaaaatccgaattagtgtggcagttggttgcttctctacatttatgtaaaggaaggccaaaaagtgagcgtgtgtagagggagagagaagataaaataatggcgggtgggttcagcggcgatgagacagctccattcttcggcttccttggcgctgcagcagctctcgtgttctcctgtatgggtgctgcatatggaacagcgaaaagtggcgttggtgtagcttcaatgggtgtcatgaggccagagcttgtcatgaaatcaattgtgccagttgttatggctggtgttctaggtatctatggcctaattattgctgtcatcattagcacaggaatcaatcccaaagccaagtcatattatttatttgatggctatgcacatctatcttctggactggcttgtggcctttctggtctttctgcgggcatggctattggtatcgttggtgatgctggagtaagggcaaatgcacaacagccgaagctctttgtgggcatgattctcatcttgatctttgctgaagcgctggctctttatggtcttattgttggtattattctctcttcacgtgctggtcagtcaagagcagaataaagggatagaaatgcttttaacgtgcatggctattttgccatctttagtctaagatcaacttgcttgtaaaaatctgtctgaataatgatttgtttttgaccttactgctatactttgaaaatcttttatgattattttcttcttattctagaatttgaatatttttcaattaaagaattttatttggagcatctctagtggtacagtataaacaggtaagggaccctccattatggctgttttcatgacatttatgaagctggattttgatgttaaattgattgaacaatacacacgtaatttaattaatagtgaataatagttccattttgtggtttaagacctccacaaaatattaatccatatactaaagaaaaccataatggtcaaacatagaattgtgttatatgtcaaatgccatgaaaggacaaggaag

SEQ ID NO: 1835 - DNA, 853 bp, Silene vulgaris
atcatgtctaccgtcttcaatggtgatgaaacggcgccgtttttcggcttcttgggtgctgctgccgcccttatcttctcctgtatgggagcagcatatggaacagcaaagagtggggtgggagttgcatcaatgggagtgatgagacctgaattggtgatgaagtcgatagtgccagttgttatggctggagttttgggtatttacggacttattattgctgtcatcatatctactggaattaatcccaaggctaagtcatactacctctttgatggatatgcccacctttcgtctggtattgcttgtggtctttctgggttggctgctggtatggctatcggtgttgttggtgatgctggtgtcagagccaacgcacaacagccaaaacttttcgttgggatgatccttatcctcatttttgctgaagcccttgcgctctacggtctcattgttggcatcatcttgtcttctcgcgctggacagtcaagagctgattaagtacagttaactactgctcagccatcttgtaattgtgcaatcaaatgacttttgttcttgctatcttcttcggaaatgccctccccaggtgaagggcagagaaaccgtggtttatattgttagatttagtgtgcctgagattttgtcaattgttttatgtttaaatacattgttgttgagaaatcatcttaaacactgctgctacttgtatcattaggcagtctcctactgaataaatgcttgtcaagtttgtcctgtttgactctacatgaagagtagcttttatttacttcagaatttagaaagaaaaaaacttacctcggtcatagcggtataattgtttacacttggc

SEQ ID NO: 1836 - DNA, 878 bp, Solanum phureja
acagcgtgagggaggagaaaaagatctattcagctccaaaactcaaaattctcagatccaaatcttaaccaaaatgtcgaactttgccggagatgaaactgctcccttcttcggcttccttggcgccgccgctgccctcgtcttctcatgtatgggagcagcttatggaacagcaaagagtggtgttggagtggcgtcaatgggagtgatgaggccggagttggtgatgaaatcaattgttccagtggttatggctggtgtgttaggtatttatggcttgattattgctgtgatcattagtaccgggattaaccccaaaacaaagtcgtactacctatttgatggctatgctcatctctcatctggacttgcttgtggtcttgctggtctttctgctggaatggctattggtattgttggagatgctggtgttagggctaatgcacaacaacccaagctttttgttgggatgatcctcattctcattttcgctgaagccttggctctttatgggcttattgttggcattatcttgtcttcccgagctgggcagtctagagctgagtgaagttgactccgttcttgccgcactgtatgcgagacttcagaagatcaagacagctgtagcctaaagtcaaaaagtatctattacgtgacaccacagctgccacttcaattagttggtgttatgtgctgtttgtagaagtaggaattcttttatttctacttaataatagcttacagagctgtgcaatttggtctgtatttattgtgtatttttgcactcattatttgtgaacagtctgagaactatttcttttctaaaattcgtgcatgtatgtactacttttcatctagtatatcatgtttactctatt

SEQ ID NO: 1837 - DNA, 947 bp, Solanum phureja
gcttcaacaccaatcgacactgcgtgagggaggagaaaaagatctattcaactccaaaactcgaagttctcagatccaaatcctaacgaaaatgtcgaactttgccggagatgaaactgctcccttcttcggcttccttggcgccgccgctgccctcgtcttctcatgtatgggggcagcttatggaacagcaaagagtggtgttggagtggcgtcaatgggagtgatgaggccggagttggtgatgaaatccattgtgccagtggttatggctggtgtgttaggtatttatggattgattattgctgtgatcatcagtactgggattaaccccaaaacaaagtcgtattacctatttgatggctatgctcatctctcatctggacttgcttgtggtcttgctggtctttctgctggaatggctattggtattgttggagatgctggtgttagggctaatgcacaacaacccaagctttttgttgggatgatcctcattctcattttcgctgaagccttggctctttatgggcttattgttggcattatcttgtcttcccgagctgggcagtctagagctgagtgaagttaactccattcttaccgcactgtatgtgaggcttctgaagaccaagacagctaaagcctaaagatctactacgtgtattgttattcatgacaccacagctgccacttttggtgttatgttctgtttgtagaagtaggaattcattttttttttctacttaataatagcttaaagagctgtgcaatttggtctgtattttttgtgtattttgcactcattatttgtgaacagtctgagaactatttattttctaagatttgtgcacgtatgaactacttttcatctatataccatgtttattttgcatctatgggattgaatttgaatattctttgatcaacaaagttatatttggtgg

SEQ ID NO: 1838 - DNA, 830 bp, Solanum phureja
ggacactgtgtgagggaggagaaaaaaaataatattcagctccaaaactcaatattctcagatccaaatcttaaccacaatgtcgaactttgccggagatgaaactgctcccttcttcggcttccttggcgccgccgctgccctcgtcttctcatgtatgggggcagcttatggaacagcaaagagtggtgttggagtggcgtcaatgggagtgatgaggccggagttggtgatgaaatcaattgttccagtggttatggctggtgtgttaggtatttatggcttgattattgctgtgatcatcagtactgggattaaccccaaaacaaagtcgtattacctatttgatggctatgctcatctctcatctggacttgcttgtggtcttgctggactttctgctggaatggctattggtattgttggagatgctggtgttagggctaatgcacaacaacccaagctttttgttgggatgatcctcattctcattttcgctgaagccttggctctttatgggcttattgttggcattatcttgtcttcccgagctgggcagtctagagctgagtgaagttgacgcactgtatgtgagacttcagaagatcaagacagctaaagccgaaagtcaaaaagtatctattacgtgtattgttattcatgacaccaccactgtcacttcaatttgttggtgttatgtgctgtttgtagaaataggaattcatttttttccatttaataatagcttaaagagctgtgcaatttggtctgtatttaatgtgtattttgcactcattatttgtgaacagtctgagaactatttcttttct

SEQ ID NO: 1839 - DNA, 849 bp, Helianthus annuus
accctaatttcacatctccctccgatccgaattccatcaatttcactcccgatctccttctacaatggccgattcgacattcagcggtgatgaaactgcacctttcttcggattcctcggtgccgcttttgcactcgtcttctcatgtatgggggctgcatacggtacggcgaagagtggtgtaggtgtggcatctatgggagttatgaggcctgagctggtgatgaaatctattgttccggttgttatggctggtgtgctcggtatttatggtttgattattgctgttattatcagtaccggaatcaaccccaaggcgaaatcttattatctatttgatggctatgcacacctttcatctggtttggcttgtggtcttgctggtctttctgctggaatggccattggaatcgttggtgatgctggtgttagggcaaacgcacagcagccaaaacttttcgtgggaatgattcttattctcatctttgctgaagccttggccctatatggactaattgtgggtatcatcttgtcttcccgtgcgggccagtccagagcagattaagatgacaaaatcttgccatgtatgggtacgtagttattttgaaaaaaaaaatgaagatttattctatttcatgctcagtgtccacttaatctggcagcttttgaacaacacttattgctttcctcgaagttttcttcttggtagcgtttctggtctcatttgcagtcttttctggctgtggaataagagttgaaaacttgtgtagttctgtacttttcagtcatgctataagccttgtaggaactattgatatggcatcacggtgtttatatattatgttttat

SEQ ID NO: 1840 - DNA, 814 bp, Helianthus annuus
ggtgttcaacaacacacacagatctaaacacaaacacatctttccttttcactttctccgatcgcaacaatgtcttcaggttcaggattcagcggtgatgaaaccgcccccttcttcggtttcctcggcgctgctgccgccctcgtcttctcctgtatgggggctgcatatgggactgctaagagtggtgtaggtgtggcgtcgatgggggtgatgaggccggagctggtgatgaagtcgattgtgccggttgttatggctggtgtgcttggtatttatggtttgattattgctgttattattagcactgggattaaccctaaggcgaaatcgtattatctgtttgatggctatgcgcatctttcgtctggtttggcttgtggtcttgctggtttgtctgctggaatggcgatcgggattgttggtgatgctggtgttagagcgaatgcacagcaaccaaagctttttgtgggtatgattcttattctcatctttgctgaagctcttgccctatacgggcttattgtcggtatcatcttatcttcgcgtgctggccaatcgagagcagattaagaaggtaacccgacaatgatcgcggacttgtttctatattctctatctgtttattgtttgttatcataaatgacgaccatttttttatttcccatgttttgaacttaagttattgcattatttttcataatttcttgatggaactcctagtgatcttattattagtgtttatgatgttactgtagaataaggccataattttggtcaagacttttgttcatcggtgtaattgttacaatca

SEQ ID NO: 1841 - DNA, 863 bp, Helianthus annuus
cgggggtaggaggtgagaggaaaacacataaaaatatccaacacatccagattactgattagggatcgaaacacagagatctaaccctaatttcacatctccctccgatccgaattccatcaatttcactcccgatctccttctacaatggccgattcgacattcagcggtgatgaaactgcacctttcttcggattcctcggtgccgcttttgcactcgtcttctcatgtatgggggctgcatacggtacggcgaagagtggtgtaggcgtggcatctatgggagttatgaggcctgagctggtgatgaaatctattgttccggttgttatggctggtgtgctcggtatttatggtttgattattgctgttattatcagtaccggaatcaaccccaaggcgaaatcttattatctgtttgatggctatgcacacctttcctctggtttggcttgtggtctggctggtctttccgctggaatggctatcggaattgttggtgatgcaggtgttagagcaaacgctcagcagccaaagctctttgtgggcatgattcttatcctcatcttcgctgaagccttggccttatacggtcttattgtgggtatcatcttgtcttcccgagcgggtcagtccagagcagattaagaagtgacagcacctttgcatttctcggtatgtagttattctgaaaaaaatgaagattggttccatttttatgcttgtctggcagcttttgaacaacgattattgcttgcattcttttgtggtgtttatgattgtggaataagagttaaattgctcgtgtccgttgtgtacttttgacctatgttttgagcactgtagagactattactgtttca

SEQ ID NO: 1842 - DNA, 874 bp, Helianthus annuus
aaacacatctttccttttcactttctccgatcgcaacaatgtcttcaggttcaggattcagcggtgatgaaaccgcccccttcttcggtttcctcggcgctgctgccgccctcgtcttctcctgtatgggggctgcatatgggactgctaagagtggtgtaggtgtggcgtcgatgggggtgatgaggccggagctggtgatgaagtcgattgtgccagttgttatggctggtgtgcttggtatttatggtttgattattgctgttattattagcactgggattaaccctaaggcgaagtcgtattatctgtttgatggctatgcgcatctttcgtctggtttggcttgtggtcttgctggtttgtctgctggaatggccatcgggattgttggtgatgctggtgttagagcgaatgcacagcaaccaaagctttttgtgggtatgattcttattctcatctttgccgaagctcttgccctgtacgggcttattgttggtatcatcttatcttcgcgtgctggccaatcgagagccgattaagaaggtaacccggcaatgagcgcggacttgtttctatattctatatctgtttattgtttgttctcataaatcacggtcattttttttatttcccatgttttgaacttaagttattgcattagttttcataatttcttgatggaactcctagtggtcttattattattagtgtttatgatgttactgcagaataaggccatagttttggtcaagacttttgttcatcggtgtaattgttattcaatagccctttgcactcacaaattgtatatctaattctgtaaaaaatgttgggatctaatcaggttttcgttcctgcatttggttgatcc

SEQ ID NO: 1843 - DNA, 883 bp, Helianthus annuus
atcgatcacacaaaaacgacaagtgtaggaaggtgagaggaaaaacacataaaaatatccaacacatccagattactgattagggatcgaaacacagagatctaaccctaatttcacatctccctccgatccgaattccatcaatttcactcccgatctccttctacaatggccgattcgacattcagcggtgatgaaactgcacctttcttcggattcctcggtgccgcttttgcactcgtcttctcatgtatgggggctgcatacggtacggcgaagagtggtgtaggtgtggcatctatgggagttatgaggcctgagctggtgatgaaatctattgttccggttgttatggctggtgtgctcggtatttatggtttgattattgctgttattatcagtaccggaatcaaccccaaggcgaaatcttattatctgtttgatggctatgcacacctttcctctggtttggcttgtggtctggctggtctttctgctggaatggctatcggaattgttggtgatgctggtgttagagcaaacgctcagcagccaaaactctttgtgggcatgattcttatcctcatcttcgctgaagccttggccttatacggtcttattgtgggtatcatcttgtcttcccgagcgggtcagtccagagcagattaagaagtgacagcacctttgcatttctcggtatgtagttattctgaaaaaaatgaagattggttccatttttatgcttgtctggcagcttttgaacaacgattattgcttgcattcttttgtggtgtttatgattgtggaataagagttaaattgctcgtgtccgttgtgtacttttgacctatgttttgagcactgtagagactattactgtttc

SEQ ID NO: 1844 - DNA, 931 bp, Nicotiana tabacum
aaaataaaaaacactttattttctctctcacgagacgcgaagaaatacaggaacttttcagatccgatcattcacacttttcaattccataaacaacttcgcaaaacaatggcgtcgactttcagcggcgatgaaacggctcccttcttcggcttcctcggcgctgccgctgccttagtcttctcctgtatgggggcagcttatggtactgctaagagtgggctaggagtggcatctatgggtgtgatgaggccagagctagtgatgaagtctattgtgcccgtggttatggctggagttttgggtatttacggattgattatagctgtgataatcagtactggcattaacccaaaaaccaagtcttattatctttttgatggctatgctcacctttcttctggtcttgcttgtggccttgctggcctttctgctggtatggccatcggaatcgttggtgatgctggtgttagagctaatgcgcaacagccaaagctctttgttgggatgattctgattcttattttcgctgaagccctggctctttatggccttattgttggcatcattctctcttctcgtgctggccagtccagagcagagtagaagacgagcatgttatgctccgtaactgtgaattatctttttgttcttccgcattggatgagatagtctggctgctgaatgatgttttgggctccatgtagttgattgtttggcttgcagaattggttcacatctactgatcggctgtagattggatctcttatcaataaagataacagtttatctgatgctcaaggacaacaaaggatttatgtaataggttcctgtgttatttcatgtcaacttcaaatttagtatttataattctttagctctgtatctcttgatttttctccccatatctgtttccattttagttttggat

SEQ ID NO: 1845 - DNA, 828 bp, Solanum lycopersicum
aagggactatttatatcattttgtcgcttacaccaattgacacacatcgtgacttgtgagggaggagaaaaaaaatctattcatctacaaaactcaaaattctcagatccaaatcttaaccacaatgtcgaactttgccggagatgaaactgctcctttcttcggcttccttggtgccgccgctgccctcgtcttctcatgtatgggggcagcttatggaacagcaaagagtggtgttggagtagcgtcaatgggagtgatgagaccggagttggtgatgaaatcaattgttccagtggttatggctggtgtgttaggtatttatggcttgattattgctgtgatcatcagtactgggattaaccccaaaacaaagtcatattacctatttgatggctatgctcatctctcatctggacttgcttgtggtcttgctggtctttctgctggaatggctattggtattgttggagatgctggtgttagggctaatgcacaacaacccaagctttttgttgggatgatcctcattctcattttcgctgaagccttggctctttatggtcttattgttggcattatcttgtcttcccgagctgggcagtctagagctgagtgaagttgactccattcttgccgcactgtatgtgagacttcagaagatcaagacagctaaagcctaaattcaaaaagtatctattacatgtattgttattcatgacaccacagttgccacttcaatttgttggtgttatgtgctgtttgtagaaataggaattcatttttttctacttaataatagctaaaagagctgtgcaatttggtctg

SEQ ID NO: 1846 - DNA, 1014 bp, Solanum lycopersicum
ccaaaatactatcgacagcccaaacccattatgactgagtaatcaattatttcatttgcttccacaccaatcaacactgcgtgagggaggagaaagagatctattcaactccaaaactcaaaattctcagatccaaatcctaacgaaaatgtcgaactttgccggagatgaaactgctcccttcttcggcttccttggcgccgccgctgccctcgtcttctcatgtatgggggcagcttatggaacagcaaagagtggtgttggagtggcgtcaatgggagtgatgaggccagagttggtgatgaagtccattgtgccagtggttatggctggtgtgttaggtatttatggcttgattattgctgtgatcatcagtactgggattaaccccaaaacaaagtcgtattacctatttgatggctatgctcatctctcatctggacttgcttgtggtcttgctggtctttctgctggaatggctattggtattgttggagatgctggtgttagggctaatgcacaacaacccaagctttttgtcggaatgatcctcattctcattttcgctgaagccttggctctttatgggcttattgttggcattatcttgtcttcccgagctgggcagtctagagccgagtgaagttaactccattcttaccgcactgtgtgtggtttctgaagaccaagacagctaaagcctaaagtcagagatctaatatgtgtattgttattcatgacaccacagctgccacttttggtgttatgatctgtttgtagaagtaggaattcttttttttctacttaataatagcttaaagagctgtgcaatttggtctgtattttttgtgtattttgcactcattatttgtgaacagtctgagaactatttattttctaagatttgtgcacgtatgaaccacttttcatctatataccaccatgtttattctgcatctatgggattgaatttgaatattcgttgatcaacaaagttatatttggtggatacta

SEQ ID NO: 1847 - DNA, 937 bp, Tragopogon dubius
atcgaagtattacattttaccttcggtttaaccttttccatagatcctatcgatgattacaaaaacttttctttgataaaatcctacaataagcttgtcctctcgtgatccaaacggacaggtgttgaagagcaaacagagatctaaatctccttctggttacactttctccgatcgagattaatcagaaatcgttcagcaatgtcttcaggttcgggattcagtggtgatgaaactgcccctttctttggtttcctcggcgcagctgctgcccttgtcttctcatgtatgggggcggcatatggaacagcgaagagtggtgttggtgtggcgtcgatgggtgtgatgaggcctgaactagtgatgaaatcgatcgttccggtggttatggctggtgtgcttggtatatatgggttgattattgctgttattatcagtactgggattaaccctaaggcgaaatcctattatctgtttgatggctatgcacatctttcctctggtttggcttgtggtcttgctggtctgtctgcaggaatggctattggaattgttggcgatgctggtgttagagcaaatgcacagcagccaaaactttttgtgggtatgattcttatcctcatctttgctgaagctttggctttatacggtctcattgttggcatcatcttgtcttcgcgtgcgggtcaatccagagcagattaacaacatttataatactctccgtttgttgtttgtcctcataaatcaagatcatgtttttttggacaccaattaaatttttcttgatggaattctttgtgaattcattatcactagtgtttattctgttgttgaataataagagtttctttatttgtatccaaaagagtaaaataggaacatacttctttactctgtattttatcttttactcataataccaacgtacattgct

SEQ ID NO: 1848 - DNA, 1228 bp, Trigonella foenum-graecum
aacaataatagatctatcttctcatttctatcatcaacttcttcattctccccttcatctcattttcgtaaaaaaaaaaatggctggtttcagcggcgatgaaactgctccattcttcggcttcctcggcgccgccgctgctctaatcttctcctgtatgggagcggcatatggaacagcgaagagtggtgttggagtagcatcaatgggtgtgatgagacctgaacttgttatgaaatcgattgttcctgttgttatggctggtgttttgggtatttatgggttgattattgcggttattattagtactgggattaatcctaaggctaaaccttattatctttttgatggttatgctcatctttcttctggtcttgcgtgtggtcttgctggtttgtctgctggtatggctattggtgttgttggtgatgctggtgttagagcaaatgcccaacagccgaagctttttgttggaatgattctcattctcatctttgctgaagcattggcgttgtacggtctcattgttggcatcatcctctcttcccgtgctggccaatccagagctgagtaatataaattttattgttgcttgtagtgcacagagccacagattcatggattgtgaactttataagagacttggtcatggtaagggtggagctttatcatgctcttcttttgtcttatgactcttatctactcgttataatactgaggttatcgtggaataaagcctatcaaactatttccttggcattaccatatttaattatgtcgaatcaaactagattagagatttatgtaataaactttttgcttgtgttgatttcaatattatttagttattgtgttctatactgttcaacacttcgcccccaatccaatatctctttttacaattgtactgagatgtagtaatactacagtagtatggttattgtgtatcagttctctacatcatcgatcattttcaggagtgtgaccaataatttgtgtgggtcatgatttatgaatagagctgtaaatgactgatgctgttcgtgttatccatgtatataaaaggtcgggttcgtagatggtacattgaatacaagatctactgatctaaacattgcattggcttccttgtgaagtactcaaacaacttactgttatagaagatgacttgtatgctacccccaaatagtaagttgtttgaagtacttcacaataatgggttattggt

SEQ ID NO: 1849 - DNA, 982 bp, Trigonella foenum-graecum
gaattaataatattttgcaataagtattgatcaggcaaaaagatcactcacgagaaagaaatcgcgatcacagatcagaagaagcacgcacgacgcaacagatcatcgatccaaaaatggctccattcagtggcgatgaaactgctcccttcttcggcttcctcggcgccgccgcggcactcgttttctcctgtatgggagcggcatacggaacagcgaagagtggtgtaggagtagcatcgatgggagtaatgagacctgaacttgttatgaaatcgattgttcctgttgttatggctggtgttttgggtatttatggtttgattattgcggttattatcagtactggtattaatcctaaggctaaatcttattatctctttgatggttacgctcatctttcttctggtcttgcttgtggtcttgctggtctttctgctggtatggctattgggatcgttggtgatgccggtgttagagcaaatgctcaacaaccaaagctttttgtcggaatgattctcatcctcattttcgctgaggcgttggcactatacgggctcattgttggcatcatcctctcttcccgtgctggccaatccagggctgagtaatgtcatatttcccgctggtcgtgttttacagaaccacagattgtgaatgtcactgtggagctggctttgctaatgtcagtacactgattgctgattttcatcattctgttattttatttatttatgtactcgttataaaattgaggttatctaggaccaagaataaagcttttctctgtgcatcattagttttgaattatatatgctcgattaatagatcagagatctatatacttagacagatgtttgttgttttgattccaataacttattaagtatcgttttgtactcttcaaaatgtatctcccaaacaacccagacctttcatttatattattttattcaatgtgatctctctgtatgccttcctt

SEQ ID NO: 1850 - DNA, 1084 bp, Trigonella foenum-graecum
cggccgggggaactataaataatgggcaaaccaatcatccacgttcactaaccatcttcctctactatcacaacagaaatcgatatctctttctctctctctgagaaaaaaaatcatcaaaccgtaaatcttagatcagatccaaaccacgtcgttgcagtagtaatggctccattcagtggcgatgaaacggcaccattttttggcttccttggcgccgcagctgctctcgttttctcatgtatgggagctgcgtacggaacagcgaagagtggcgttggtgtggcatccatgggtgtgatgagaccggagctggtgatgaagtcgattgtacctgttgttatggctggtgttttgggtatctatggtcttattattgctgttattatcagtaccggaattaacccaaaggccaaatcttattacctttttgatggttatgcacatctttcctctggccttgcttgtggtcttgccgggctttctgctggtatggctattggtattgttggtgatgctggtgttagagccaatgcacagcagccaaaacttttcgttggaatgatccttatcctcatctttgctgaagctcttgccctttacggtctcattgttggtattatcttgtcttcgcgtgctggccagtctagagccgagtaagtaaggagctgtgttgcaaaatattctttgaccaccaaccttcttattaagagggcgagggggtgaatttttagttgtgcggttagtgatgtttggacaccagttgcagtatttaacaaatacttttgaaagctatagctccacctgtcatttgatggtgtttgtataagtagtttatctttggttaataaagctttttaagcttcgtcccttttttcttatgaaatgtgtcatgccatattatttgagcttactttgtttttgctgctgctgaaactagtgcgtgtaatgatttagttgcgaatataaattgtatgcatttgtggatcttttcatattagatgcagctataacgttggcttagacagtagtacaaattacaacgaccttttcactatagaataacatatatgtgttgtggtca

SEQ ID NO: 1851 - DNA, 774 bp, Vinca minor
cttcagtggcgatgaaactgctcctttcttcggcttcctcggcgctgctgctgctctcgtcttctcctgtatgggagcggcatatggaaccgctaagagtggagtaggagtggcgtcaatgggagtgatgaggccagagctggtgatgaagtcaatcgttccagtggttatggctggtgttttgggtatttacggtcttattatagctgttattatcagtaccggaattaaccccaaaacaaaggcctattacctctttgatggctacgcgcatctctcctccggtctagcgtgcggtctcgctgggctttctgctggtatggctattggcatcgttggcgatgctggtgttagggctaacgctcagcagccaaagctttttgttggaatgatccttattcttatttttgccgaggctttggccttatatggtcttatcgtgggtattattttgtcttcacgagctggccagtcgagagcagactaagaaagagaaaaatactgatgatgttatattgcgttgccctcagtggcgccgtaatcacttggggtgaaggaaatgaaatttggtcctatttgtttagcatggctctatctaggttatgcctcggtgtgtacttggaaagcaatcgctcagccatatttaatttgattgcacttactgctgtttgttgaagtagttatgaggtatttttctgtacaataaagcttttagagagctaattttcacggagtttaagctgtttctactttgaaattatattgtagtaatta

SEQ ID NO: 1852 - DNA, 737 bp, Vinca minor
cttcagcggcgatgaaacggctcctttcttcggcttcctcggcgctgccgccgccctagtcttctcctgcatgggagcagcatacggaacagcaaagagtggtgtaggagtggcatctatgggtgtgatgaggccggagctggtcatgaaatcaattgttccggtagttatggctggagttttggggatttacggtttaattattgctgttattatcagtactggtattaaccctaagactaaggcttattatctctttgacggttatgctcacctctcttccggtcttgcttgtggcctcgctggtctctctgctggtatggctattggaatcgtcggagatgctggtgttagggctaacgcacaacaaccaaagctttttgttggtatgattcttattcttattttcgctgaagctctggcactttatggccttattgttggcatcatcctctcttctcgagctggacaatcaagagctgattagagaagaagcattttagtgctattttgtcaatgatcaattgtgttctttgttagagatggttgtcagaacaatcatttgtagaagtttctcattccaatacctttctacgctcagcgacatcaactcaaatgattgttctgattttagcatgtagatttagaatttcttttttcctctgaataagattccgcggttcagcatgttgagagaaccatattattaaaccatgtaaaacttttgtctaaactgg

SEQ ID NO: 1853 - DNA, 962 bp, Zostera marina
cctaacgatcagaggcttctaggaagcggatcccaaattttcaaatccagcgtcctcagatcgcaatagccgcaagcacaagttttctcgtagatcctcacgatcttcgtacagatccgattaatcatgtctacaaccttcagcggcgatgaaacagctcccttcttcggcttcctcggagccgcatcggctctcgttttctcatgcagtggggcagcatatggaacggcgaaaagtggggttggagtggcatcgagtgggagtgatgagaccggagcttgtcatgaaatccattgttcctgttgttatggcgggagtgcttgggatctatggtttgatcattgcagttattattagcactgggattaatcccaaggctaagtcatactacctcttcgatggctacgctcatctttcctctcggtcttcgcttgtggccttgccggtctttctgccggaatggccatcggaatcgtcggagatgcgggagtcagggctaatgcacagcagccaaaactctttgttggtatgattcttattctcatttttgctgaagctcttgcactttatggtcttattgttggcatcatcctatcatctcgtgccggccaatcccgagcagactaagcagcaaagaaaaacatgcattcaagaagaaacttcatcactcttcaatggttcaaatctttattccatattcaattagcgagcatgtagtaataataatttccattgaagttgttttttccctctctccgtgtggcttattacgccttatttgacacaacatcaaaacttgtttaaaatgtggtgtggtgtggtgcagtgttgtatcttcttccttcattcccttcttttgttaggtttaaacctatatttgatgagtatgggttaccgttggtttattttcctttcataataaatttcatgcgatgcaatacaaatcttatttatataaatat

SEQ ID NO: 1854 - DNA, 2126 bp, Cirsium arvense
ttctccggcgatgaaacggctcccttcttcggctttctcggtgccgcggccgccctagtcttctcctgtagtgggggcggcgtatgggacggcgaagagcggtgttggagtggcgtcgatgggagtgatgaggccggagttggtgatgaagtcgattgtgccggtggttatggctggagtgttaggtatttacggattgattattgcggttattatcagtaccggtattaaccctaaggcaaaatcttattatctctttgatggatacgctcatctttcttctggtcttgcttgtggccttgctggtctttctgctggtatggctatcggaatcgttggtgatgccggtgttagagccaatgcacaacaaccaaaactctttgttgggatgatcctgatcctcattttcgctgaagcacttgctctgtatggtcttattgttggcatcattctttcttctcgagctggtcagtcgagagcagactagaaggagacgaggtggtgtatcttactgctattaagtaagcgtatgattattattctctctgtggttgctgttgttgttggttgagttgcagatatgatcaattctttggtgggtgataataccttggcctgatggattggctggctgatgactatgcttctacagtaggttgtagaccaaatttctatctctttacaataataaagttcatacttcaacatcttgatcacctttctctgacaaactcagcttcttcagcaacttcatggttcccttgctgcgtaggaacattgttcctctggtccatctgtgaaaatgtcggattttctccatattgtgatgaactccgattgctgccagatccaactccttgcccataacctccttgtccatactgtccacccgtaggttgcccataaattccaccgctgtgttgcccatactgtccacctgtcggttgtccatattgaccaccagcgccttgcccaaaacctcctccgccaccttgtccatattgtccacctgtgccttgaccaaaatttcctccccctccctgaccgtattgtccacctcttccttgcccataatttcctccacctccttgtccatattgtccgcctgcacctggcccataacttccaccacctggttgaccatattgtcccccagtcccttgccggtaattaccaccgcctccttggctgtagtttcctgcagggggactaaaatccctctgctctggatgtgcatagttcccttggccccttgggggaaaatccgtttggctaccaggattaggacttcttcctgcattgtagtttgcttgataggtagggttggggcccctcctgtctccctgatagttcccctgtcctccaggagtattgttcattggattagggttaccataattctgttgtgctggaggattctgatccattcggcctctaggcggtctgttgtaatctctattgcgatcgttataccttccaccttgccttccatattgtactggaggtggtctgggaattatcgttccatttatgtacttgtctcctccatattctttgtttacaggatcgatataggaatcaggcaatacaaatacaaccccaggtatacctttaaactgctctgaaacttcttcagacacctcaacctgaaatccattgtaagtagttgtgctacaagcataaattttcttctttgcctcttccacacttccaagaactttagcagcagtttggacgtatgtttccaccatttcctccggagatggtttaggatctttagggaaatccatggtaatcagccagtgattgtaatcgcaaccttcgaacagtatagcatcggggctaatctgatcgccatccatatcatcattgttgtatctagctcgcgaagaaaacgcccttgatgatacgaattgaaacgaagaacaactggattttggacgagtgacgtcaaattggctagggttttgttgaatggtggaggtggaggaggaggacggcggtgcagcgaccgccgtgaaacatctcgaatggttaaggtccttgagtaccgcagctgtgagagaaagtgatcgccggagacggagaacgttggccgccattagtggtggtgctgaagcagatag

SEQ ID NO: 1855 - DNA, 724 bp, Gossypium raimondii
agaatagattgagataaaagatcaacaaagctatccacccctttttctcagatccgaaacgccgtcgtcttagtcggaaccgcttcgatccacaatgtcttctactttcagcggcgatgaaacggcaccgttcttcggcttcctcggcgccgctgctgctctcgtcttctcctgtatgggagctgcatatgggacggctaagagtggtgttggtgtggcttcaatgggtgtgatgaggcctgaattggtgatgaaatctattgtaccagttgttacggctggtgtttgggtatttatggcttgattatcgctgtcattattagtactggaatcaatcctaaggccaaatcgtattaccttttcgatggttacgcccatctttcttctggtcttgcttgtggccttgctgggctttctgctggaatggcaactggaattgtcggcgatgctggtgtcagagctaacgcacagcagccaaagctttttgttggaatgatccttatcctcatctttgctgaagctttggctctttatggtcttattgtcggcattatcttgtcatctcgggctggacaatcccgagcagaataagataactcaagtgctgcatagtattctcttattgattttatctgtagcactagaccgaaaaccatttcgatcaatatcaggttagttatggttggacagcaagtgccgcgttcgcacataaatattgatgaac

SEQ ID NO: 1856 - DNA, 796 bp, Tropaeolum majus
cggccggggggtgctgatttcatatcacactccgggattaaattctcgagttccgaacctaattaatttctaatcatctgcagatcgattccgaaaagaaatggcgtctgcatttagcggcgatgaaactgctcccttcttcggatttctcggtgctgctgcggcactcgttttctcctgtatgggagctgcgtatggtacagcgaagagcggcgttggtgtggcgtccatgggggtgatgagaccggaactcgtaatgaaatcgattgtaccagttgttatggcgggagtgttgggaatatacggtttaatcattgcggttatatcagtactggtattaaccctaggcgaaatcgtattacctcttcgatggatacgctcacttgtcatccggtctggcttgcgggctcgctggtctatcggcgggtatggcaattggcattgttggtgatgctggtgttagagcaaatgcacaacagcctaagctgtttgtaggaatgatattgattctcatttttcgctgaggcgttggctttgtatggtctcatcgttggcatcattttgtcatcaagggctggccaatccagagcagagtagaagttcaaggttctgatgctatgattcttaattcattttatttttttttgttattgctgtctgaaattgcttgtttaggtttctgagttcgtcctgaaattgtttgttatgtactacaatgctccattacattaaatccacagtatctgaaattgttttagaggaccgtcgacaataaagttcatttggagttcttgct

SEQ ID NO: 1857 - DNA, 965 bp, Phalaenopsis aphrodite
ccaatcaaccaaaatggccggattcagtggtgatgaaactgctcctttcttcggcttcctcggcgccgccgctgcccttgtcttctcttgcatgggagctgcttacggaacggcgaagagtggtgtcggcgtggcttcgatgggggtgatgagacctgagctcgtgatgaagtcaatcgtgccggtggttatggctggagtgctaggtatctatggccttattattgctgttattatcagcacggggataaccccaaggcgaagtcttactacctctttgatggctatgcgcatctgtcatctggtttggcatgcggcctcgctggtctttctgccggtatggctatcgggatcgtgggtgatgccggggttagagccaatgcacagcagccgaagctgttcgtggggatgatactgatactgatatttgctgaggcgttggcgctctatggattgatagttggcataattctgtcgtctagggctggccaatctagggctgattaaaattcttgctcttctttggtaatcactatagcttccagcattttgaaccgggccttgtgtttttatttaggaaccacttttatattcagaacgttttaattaagatctgctagtcgattgctacagactgtatttattacatacatatatatatatatatatattttaacgattttgagtgcttatatcgtgcagttttttcctattatttatttaccttgatgtcaagatttttctgtcgtttagtgtttaaaattatatcaaatcggtttgaatcaaatgtttgtaattatttcatagaagaataacatgaaacagcctcccattggtttttaggtatctttatgtcaatactcgtcttgcattaagggggcctattttatttttatttgataaggaagatttgattgtttgaaatgtaaaaacaaagttggattcgtaaattcttatgaattgtt

SEQ ID NO: 1858 - DNA, 778 bp, Lippia dulcis
gactttcagcggagatgaaactgctcccttcttcggattcctcggcgccgctgctgcactcgtcttctcctgtatgggtgccgcttatggaactgcaaagagtggagttggtgtggcgtcgatgggagtgatgcgtcccgagcttgtgatgaaatccatcgtaccagttgtcatggctggtgttttgggtatttacggattgattattgctgtgattatcagcactggtattaatccgaaggcaaagtcttattacctttcgatggctatgcacatctctcttcgggcttggcctgtggccttgctgggcttgctgctggaatggctattgggattgtgggtgatgctggtgttagggcgaatgcgcaacagcctaagctttttgtcggtatgatccttattctcatttttgctgaagctttggccctttatggtcttattgttggaattatattgtcttctcgggccggtcagtccagaactgactagaatacaatcccgcaattcagtcatactactatgtgactgaatcttattgcatctctgggaaaatggagtgtgtgagaagctgagttgtggccgattatgtttattgttttcgactcccattatttattcttcatcataaacttgcctgtgtcctattcgcattcattccatggtagcattgtcacatattgggacctccaaggggaactatatagcgttgtaccatttttagcacgttttctacttcggtttgtgaagtttcaattagtgaaataagaatttatgcgtg

SEQ ID NO: 1859 - DNA, 807 bp, Primula obconica
gtgtcctcctattagatgagtacataattctcgtgatctacatctctctctctctcatcggatctgtctgcaacacaaactcaaaatcaaactcaaaatcaaactcaaacacaaactcatcggagagagaaaagatgtcaagcttcagtggcgatgaaactgctcccttcttcggcttccttggcgccgctgccgccctcgtcttctcctgtatgggagcggcatatgggacagacaaaaagtggcgtaggggtggcgtcaatgggtgtgatgaggcctgagctggttatgaagtcgattgtgccggtggttatgggcgggtgtgttgggtatatatggactcatcatagctgtcatcataagtactggaataatcccaaggccaagtcatattaccttttcgatggttatgctcacctctcctccggactttctttgcggccttgcgggtctctctgctggtatggccattgggatcgtcggtgatgctggcgtcagagctaatgctcaacagcctaaactttttgtttggaatgattcttatcctcatctttgctgaggccgttggctttatacggactcattgttgggatcatcctctcgtctcgcgctggtcaatctagagccgagtagactttaaattcttttttgggttcatcttactagtactgaagctagtttgattatttgtatctttattcttctgtattgtccacaatttattttcgtgtgcaagttttgaactggttagctaatactgggagcaaactcgtccctgtaataaagctgtataaaaagcttgtttgg

SEQ ID NO: 1860 - DNA, 810 bp, Thalictrum flavum
cagtggagatgaaacagctcctttcttcggtttccttggtgcagcagcagctttagttttctcctgtatgggagcagcttatggaacagcgaagagtggtgttggagtagcatcaatgggtgtgatgagacccgaacttgtaatgaagtcgatcgttccagttgttatggctggagtttttgggtatttatggattgattattgctgttattattagtactggaatcaatccaaaagccaaatcgtattaccttttcgatggttatgcccatctttcatctggtcttgcttgtggtcttgctggtctttctgctggtatggctattgggattgttggtgatgctggtgtcagggctaacgctcagcagcctaagctttttgttggtatgattctcatcctcatttttgctgaagctctggccttgtatggccttattgttggtatcatcctttcttcccgagctggacaatctagagcagactgaaggaatttctccagtgttgatattctactgtgctgtcttggaatcaccttccatacatttgggactagaataggattgtagttcagaacttgcagtgttatcgaaattgtttattctggccgtggtatctctccctccctcattgggtatgtgttgtgtgcttataaaaatgcataattagtttccttctgaaataaagctcctagagctgggtttatttgctgtaattcttttatatgactggtacttgtattccctggttagaaatttagaccaatgctggagtccagcagtcttattaaatattaatctgcccaaaagaaaa

SEQ ID NO: 1861 - DNA, 988 bp, Castanea mollissima
ctcttccacatctttttttctgtacggaatcaaaacagagagagagagatagagatagagatccgaaactctgagatccgaacgacgtcgttgcagatccaccaccgatcaagaaccaaaaaacaatgtcttcgggttcatcattcagcggcgatgaaacggcaccgttcttcggcttcctcggtgcagccgcagcactcgttttctcttgtatgggagcagcttatgggacagcgaagagtggtgttggtgtggcatcaatgggtgtgatgaggcccgagctggtgatgaagtccattgttccagttgttatggctggagtgttgggtatttacgggcttattattgccgttatcattagtactgggattaacccaaaggccaagtcatattacctttttgatggttacgctcatctctcgtctggtctttcttgtggtcttgctggtctctctgccggtatggcaattggtattgttggcgatgctggtgttagagctaatgcacagcagccaaaactctttgttggaatgatccttattctcatcttcgctgaagcacttgccctctacgggcttattgtcggcattatcttgtcttctcgagctggccagtccagagctgactaagaatattgctgtgttgccaaatattcttttactacttgtgtaattttgggggggaaagtttaatcgttcacaggttagtaatggctggataggacttgagggtttcttgaaaactatcgatgttgaagtaactgctctaccagccattttaggtggtattgtgtttgtagtagtaggattgagtttcgctacctaataaaagcttgtaaagctgtaccagtacttgcgattgcttttatatgttgatgtattttgccatcagaacttcaaactgttataggatttgtgatcatggaattaatgaatgtatgatttttttttaaaaaaaaaaaactaaaaggacacgcaacagggagtag

SEQ ID NO: 1862 - DNA, 667 bp, Cirsium arvense
ggtgggaagacgacaagtgttggaaggtgagaggaaccaacacatcgaaacatccacactaattcaactctctcctctttcgatccaaaatccaatccattttgctcccaattttaatcaacaatggcttccggtggttcgacgttcagtggtgatgaaactgcacctttttttggattcctcggtgccgctgccgcccttgtcttctcatgcatgggggctgcatatggaacggcgaagagtggtgtgggtgtggcatcgatgggagtgatgaggcctgagctggtgatgaagtccattgttcctgttgttatggctggtgtgcttggtatttatggtttgattattgctgttattatcagtaccgggattaacccaaaggccaagtcttattatctttttgatggctatgcacacctttcatctggtttggcttgtggtcttgctggtctttctgccggaatggccatcggcatagttggtgatgctggtgttagagcaaatgcacaacaaccaaaacttttcgtgggaatgattcttattctcatcttcgctgaagctctggccctatacggtctcattgtgggtatcatcttgtcttcacgtgccggtcaatccagagcagattaagaagatgaagaaggaaagaaaccacgccatatattcg

SEQ ID NO: 1863 - DNA, 884 bp, Euphorbia peplus
atcttcaccacacttttctcccttgaattaattaaacacagagccacacctcacctcaatccgacaccgtttccaacttgcctccgtcgccaaaactatgtcttcctcatctggctttagcggcgatgaaaccgctcccttcttcggcttcctaggcgccgccgctgccctcgtcttctcctgtatgggagcggcctacggcaccgcgaagagtggggtaggagtggcgtcgatgggagtgatgaggcccgagctggttatgaaatcgatagtgcctgtggttatggctggagtgttggggatttacgggttgattatagcggttattattagtaccggtattaatcctaaggctaaatcttactatctctttgatggctatgctcatttgtcatctggtctttcttgtggtcttgccggcttatctgctggtatggctattggaattgttggtgatgccggagttcgggctaatgcacaacaaccaaagctgtttgtaggaatgattcttatcctcatttttgctgaagcacttgccctgtacggtcttattgttggaatcatcctctcatcccgagcaggccagtctcgtgcagagtaaaaacagtcgaggtgtaactcttaatgccctttatttctcggatcaacaattaaagtgtatggtgtatccagaagttgctcaaattcccataaattatttgattacatccttgccggcactgcgactcttgtatatgtaggatgctggccagctaggagttgtactcattatgaagagtttatttatcctctctatttgtgagcttcggtttatttgcgtcctctaaagtttatcacacatgactgttctttttcataaatgatgaacttttatgggtgagata

SEQ ID NO: 1864 - DNA, 663 bp, Gerbera hybrid cultivar
gaaacgttgtcccccgtgatccaaaaggacaagtgttgaagaacaaacacagggggagatccaactccaaacatctttccgtttccacttctccgatcgatttcaatccaaactccactaacaatgtcttcaggttctacattcagcggtgatgaaactgcccctttctttggattcctcggcgcagctgctgccctcgtcttctcctgtatgggggcggcatatggaaccgctaagagtggtgtaggtgtggcatcgatgggtgtgatgaggccggagcttgtgatgaagtcgattgttccacttgttatggctggtgtgcttggtatttatggtttgattattgctgttatcatcagtaccgggattaaccctaaggcgaaatcgtattatctttttgatggctatgcacatctttcctctggtttggcttgtggtcttgctggtctctctgcaggaatggcgatcggaattgttggtgatgccggtgttagagcgaacgcacagcagccaaagcttttcgtgggaatgattcttatcctcatctttgcggaagctcttgctttatacggtctcatcgtcggtattatcttgtcttcccgtgccggtcagtccagagcggattaagaacatccaatggaaggtcatactaatatctgtttg

SEQ ID NO: 1865 - DNA, 818 bp, Guizotia abyssinica
tcgacgggtccggagatatgcccgggaattcggccactatagacggggagatctaaaactccctcttttcactttctccgatcaaatccggccaacaatgtcttcaggttcaggattcagcggtgatgaaaccgccccgttcttcggcttcctcggtgcagctgccgccctcgtcttctcctgtatgggggctgcatatgggactgctaagagtggtgttggtgtggcgtcgatgggtgtgatgaggccggagctggtgatgaagtcgattgttccggttgttatggctggtgtgcttggtatttatggtttgattattgctgttatcattagtactggaattaaccctaaggcaaagtcgtattatctgtttgatggctatgcacatctttcctctggtttggcttgtggtcttgctggtctgtcggctggaatggcgattgggattgttggtgatgctggtgttagagcaaatgcacaacagccaaagctttttgtgggtatgattcttattctcatctttgccgaagctctggccctatatggtctcattgttggtattatcttatcttcccacgctggccaatcaagagcggattaaaaaggtgacttgacaataaatgttggctcgtttctatatctgtttgtttgtcctgaaaaatcaagatcatgtttttttggtgttacttttatttctcatatattgaacttcatttattgtattaccataaaatttcttgatggaattctttgtggtcttctactagtgatggtgtaaatgcagaataaggccatagtcttggtcaagacttttgttc

SEQ ID NO: 1866 - DNA, 860 bp, Eragrostis curvula
  misc_feature (51)..(51): n is a, c, g, or t
  misc_feature (53)..(53): n is a, c, g, or t
  misc_feature (56)..(57): n is a, c, g, or t
  misc_feature (63)..(63): n is a, c, g, or t
  misc_feature (79)..(79): n is a, c, g, or t
  misc_feature (81)..(81): n is a, c, g, or t
  misc_feature (106)..(113): n is a, c, g, or t
  misc_feature (117)..(118): n is a, c, g, or t
  misc_feature (120)..(120): n is a, c, g, or t
  misc_feature (123)..(127): n is a, c, g, or t
  misc_feature (129)..(129): n is a, c, g, or t
  misc_feature (137)..(138): n is a, c, g, or t
  misc_feature (140)..(140): n is a, c, g, or t
  misc_feature (144)..(144): n is a, c, g, or t
  misc_feature (193)..(193): n is a, c, g, or t
  misc_feature (226)..(226): n is a, c, g, or t
  misc_feature (238)..(238): n is a, c, g, or t
  misc_feature (244)..(244): n is a, c, g, or t
  misc_feature (250)..(250): n is a, c, g, or t
  misc_feature (259)..(260): n is a, c, g, or t
  misc_feature (326)..(326): n is a, c, g, or t
  misc_feature (328)..(328): n is a, c, g, or t
  misc_feature (402)..(402): n is a, c, g, or t
  misc_feature (415)..(415): n is a, c, g, or t
  misc_feature (427)..(427): n is a, c, g, or t
  misc_feature (430)..(430): n is a, c, g, or t
  misc_feature (442)..(442): n is a, c, g, or t
gcggcgcggggaagaggggaagtcatcggatcagatttaatcaaaggcttntnctnnctcgancagcgtcgtcgtgtcntncccccacccacgtctcctcctctcnnnnnnnntccnnanacnnnnngncatggccnncnccancttcagcggcgatgagaccgcccccttcttcggcttcctcggcgccgcngccgcgctcgtcttctcatgcatgggcgccgcntacgggaccgcnaagagnggcgtnggcgtcgcnnccatgggagtcatgcgccccgagctcgtcatgaagtccatcgtccccgtcgtcatggctggagtcntnggtatctacggcctcatcatcgccgtcatcatctccaccgggatcaaccccaaggccaagccctactacctctncgacggctacgcncacctctcctcnggnctcgcctgtggnctcgccggtcttgccgctggcatggccatcggcatcgtcggggacgccggagtcagggcgaatgcacaacaacccaagttgtttgtgggaatgattctgatcctcattttcgcggaagctcttgctctgtacggcctcatcgtcggaatcatcctgtcttctcgtgctggccagtctcgtgctgattagagaggccattggaaacttcacacgatgcatccatcattgtattcaagtgtcactttctccctggatgaacattgcataggttcatgttgagcctgttcaaccctttgtaatattatttctgccaacacagactgctagcgcttgtagttgtgctgttgtatttatttgaaataataggcagcaaagccctcattgtgatgaataaataagcgagctggaccagttttac

SEQ ID NO: 1867 - DNA, 959 bp, Marchantia polymorpha
gatcagcagaagcagcactaccagcagccagttcgtcccaataagaaggtctctctcctccgtcttcctcagcatcaatcattcaaccattcctctcttccgctcgatagttctacatcttctgcgccggaagagcaatctcggacctcgaagtacaacctctttccaccctcgctcgagagtcggcgaatcagtgaacgaatcgatcgatcgatcgaaggaagggcgagagagaagagaagatgtcgacggacgtgggattcagcggagacgagacggcgccgttcttcggcttcatcggggcatcggcggcgctcgtgttctcatgcatgggggcggcgtacgggacggctaagagcggggtcggagtggcgagcatgggagtcatgaggccggagctagtgatgaagtccatcgtgcccgtggtcatggccggagtgctgggaatttacgggctcatcatcgctgtcatcatcagcacgggcatcaaccccaaggccaagccctactacctcttcgacggatacgcgcatctctcgtccggtctggcctgtggactggcagggctctcggccggcatggccatcggcatcgtcggagacgctggagtgagggctaacgcccagcagcccaagctcttcgtcggaatgatcctcatcctcatcttcgccgaggcgctcgctctctacggcctcatcgtcggtatcatcctctcgtcccgtgccggccagtccaggggcgagtaggaacctttcctcgcgcgcgtctattttttgaccggggtttctcgtccggccgccgccttcttcttcttctgtgaaaagcgcgcggggcagaccgtgacttttgtgtctcggtttatttgatcatttgtagatctgaggaaaaaaccatcaacttccagccacatgtgtcgaccctctcttgttgtgcaaaaataaagctcggagtcctttctc

SEQ ID NO: 1868 - DNA, 946 bp, Quercus alba
aaactcgtccacaccttttttttctgtacggaatcaaaacacagagagagaaagagagagagagatccgaaactctgagatctgaacgacgtcgttgcagatccaccaccgatcaagaaccaaaaaacaatgtcttcgggttcatcattcagcggcgatgaaacggcaccgttcttcggcttcctcggcgcagccgcagcactcgttttctcttgtatgggagcagcttatgggacagcgaagagtggtgttggtgtggcatcaatgggtgtgatgaggcctgagctggtgatgaagtccattgttccagttgttatggctggagtgttgggtatttacggacttattattgccgttatcattagtactgggattaacccaaaggccaagtcatattacctttttgatggttatgctcatctctcgtctggtctttcttgtggtcttgctgggctctctgccggtatggcgattggtattgttggtgatgctggtgttagagctaatgcacagcagccaaaactttttgttggaatgatccttattctcatctttgctgaagcacttgccctctacgggcttattgtcggcattatcttgtcttctcgagctggccagtccagagctgactaagaatattgctgtgttgccaaatattcttttactacttgtgtaattttgggggggaaattttaattgttcacaggttagtaatggctggataggacttgagggtttcttgaaaactatcgatgttgaagtaactgctctagcagccattttaggtggtattgtgtttgtagtagtaggattgagtttcgcggcctaataaaagcttgtaaagctgtatcagtacttgcgattgcttttatatgttgatgtattttgccatcagaaacttcaaactgttataggatttatgatcatggaattaatgaatgtatga

SEQ ID NO: 1869 - DNA, 946 bp, Quercus alba
gctttcagcctatcacgcagtgctgcgtcagatacgtggtataatgttttgctaagaatcgaaaagaaaagatctcatctataatcagtttcgtaaacaaaaagcacaccccgtgaacctgaacttcttaccgatccaaaagcaagaacagatctccatccaattttcccgcaaccaaacatgtcatcttcttcatccgaattcagcggcgacgaaaccgcacccttcttcgggttcctgggagcggcggcggctctggtgttctcgtgcatgggggcggcgtacgggacggcgaagagcggagttggggtggcgtcgatgggagtgatgcgtccggagctggttatgaagtcgatagtcccggttgttatggctggtgtgttgggtatctatggccttatcatagctgtcattattagtactgggattaaccccaaggctaagtcttactatctctttgatggctatgctcacttgtcttctggtctctcttgtggactcgctggtctctctgctggtatggccattgggattgtcggtgatgccggtgtcagggctaatgcacagcagccaaagctgttcgtgggtatgattctaatccttatctttgctgaagcacttgctctctatggtctcattgtggggatcatcctttcatcccgagcaggccaatctcgtgcagattaaaggaggccaagtttcagaaaatttttgcttctgtattatttgcagattggcagttggatgccttaacaacaatgtcattgttaagcttacgataatgttaaactggatcatacttgtccaaattgtactctatgaaggcagttgccatgacaacttttcaaataagcatttattagttataagaaatgtttatccttgtgtttagtcaagaggttttgcgtttctgatgttagttgtgataattagcggattgatactt

SEQ ID NO: 1870 - DNA, 877 bp, Silene vulgaris
tctctctctaaatccccagatccgatcaaacccagaaaaccatgtcttcttctgtcttcaatggcgatgaaactgcaccgttttttggtttccttggtgctgctgcagctctcattttctcctgtatgggagcagcttatggaacagcaaagagtggtgtaggagttgcatcaatgggagtgatgagacctgaattggttatgaagtcgattgttccagttgttatggctggagttttgggtatttacggtcttattattgcagttattatctcaaccggaattaatccaaaagccaagtcttactatttgtttgacggatatgctcacctttcatctggtattgcttgtggtctttctggtttggctgccggtatggctatcggtgttgttggtgatgctggtgttagggctaacgcacagcaaccaaagcttttcgttggaatgattcttattctcatctttgctgaagccctagctctatacggtctcattgttgggatcatcttgtcttctcgtgccggtcagtcaagagccgactaagtacagtcatgtatttatctgtcagcttgtattgatgcacgcggaacaaaatagaaactgtccccctctattattgctttcttcttcgttttttccctcccggtgaagggtagagaaaccctggtttatattgttaggttatgtgtgctgagaactatactcaattgttttgctaaaatacattatgaccggaaatttaatttaatgctctattgctactcgtagcactaggctcgtaaagaataaatgttttgcgaagttccttcgattcagatcactattattcatctttggaatgtgatggaataatggacaataactggttacttataccc

SEQ ID NO: 1871 - DNA, 530 bp, Musa acuminata
gggcttcttcgatctccggggcacgatgtctaccttcagcggcgacgaaaccgcccccttctttggcttcctcggcgccgcggccgccctcgtcttctcaggcatgggagcggcgtacgggacggcaaagagcggcgtcggggtggcctccatgggcgtgatgcggccggagctggtgatgaagtcgatcgtgcctgtggtcatggccggagtgctcgggatctacgggctgatcattgctgtgatcataagcaccgggatcaaccccaaggcgaagtcctattatctgtttgatgggtatgctcacctctcctctgggcttgcttgtggtcttgccggtttatctgctggcatggcaatcgggatagtcggtgatgctggtgtcaggtaaatgcacagcagccaaagctctttgtcggcatgattctgattctcattttcgctgaagcacttgcgctatatggtctcattgtcggcatcattctctcctctcgagctggtcaatctagggcagagtaagaaacacgagc

SEQ ID NO: 1872 - DNA, 672 bp, Arabidopsis lyrata
aatttggtaacagatctcatcggagcaacaatcatcatcaaagagccacaatggcttctggtttcagcggcgatgaaactgctcctttcttcggattcctcggcgccgccgccgcgctcgttttctcctgtatgggagcagcgtacgggacggcgaagagtggcgtcggagttgcgtcaatgggagtgatgagacctgaacttgttatgaaatcgattgttcctgtggtcatggctggtgttttaggtatttatggtctgatcatcgctgtcatcatcagtactgggattaaccccaaggccaagtcttattacctattcgatggctatgctcatctctcttctgggctagcttgtggtctctctctgctggtatggctattggaatcgtcggtgatgctggtgttagagcgaatgcgcaacaaccgaagctgtttgtgggaatgattctgattctcatctttgcggaagcgcttgcactgtatggtctcattgttggtatcatcctctcatctcgagctggtcagtctagagctgagtgaaagaagtggtgacttattgttagtatcaacatgtctcatatcagaagttttcatctaatgcataagcttctcctttcacttctttttttgtgagtttgagttctgttatgattggacacactgtaacttgg

SEQ ID NO: 1873 - DNA, 866 bp, Fraxinus spp
ccaccatacagcatacatcaaaacagtcagcagagagaactgagatctgttcatccaaacccccaaatcatctctctgtaactataactgataattcaacgtaatttttcagatccgttagtaattttttgcaatccaagcaaaaatgtcttcaatcttcaacggcgatgaaactgctccctttttcggcttcctcagcgctgcttctgccctcgtcctctcctgtatgggtgcggcgtatgggacggcgaagagtggggtaggtgtagcgtcgatgggagtgatgaggccggagctggtgatgaagtcgatcgtgccagtggttatggctggagtgttgggtatttagtgggttgattattgctgtgattatcagcactgggattaaccccaaggcaaagggttattatctgttcgatggctatgcgcatctctcttcaggcctcgcttgtggccttgctggcctctcagctggaatggcaattgggatcgttggcgatgctggcgtcagggctaatgcacagcagccaaagcttttcgttgggatgatcctcattctcatcttcgctgaagctctagccctttatggtctaatcgttggaattattttgtcttcacgagctggccagtctagagctgactgaggaatttggcttttaactagttcaactgcaatgtttaacgttatggagaaattcttaaaactctttcatacgagccctatttatcgccaagaatgttatatatatttctcatcgcattcacgctacggtagcttcgtgatgtttgtagaattattagaagtaccttttttttctccagaataagagcttaaatgcctgtggatgttggattaagtgtagttt

SEQ ID NO: 1874 - DNA, 640 bp, Antirrhinum majus
tgaactctcacgcacgtccaaagaaccaatcaatcaatcaaaacatttcatataaaagccgtacacctgtccaataactcatctccctctcatcttcatctctctgattatccccctctcagatccgatctcttcatcaaaatccaaatccgatcaaaaaaatgtcgtcaactttcagcggcgatgaaacggcaccgttcttcggcttcctcggcgccgccgcagcactcgtcttctcatgtatgggagcagcgtacggcaccgcaaagagcggcgtcggagttgcgtcgatgggagtgatgaggccggagctggtgatgaagtcgattgtgccggtggttatggctggtgttttgggtatttatggattgattatcgctgtgatcattagtaccggtattaaccctaaggcgaagtcgtattacttgtttgatggatacgctcatctctcgtctggactcgcgtgtggtcttgctggtctggctgccggtatggcgattggaatcgttggagatgctggtgttagagccaatgcacaacaaccaaagcttttcgtcggaatgattcttattcttatttttgccgaagccttggctctttatggtctcattgttggcattatcctctcttctcgagctgg

SEQ ID NO: 1875 - DNA, 752 bp, Cirsium arvense
ccggcgatgaaacggctccgtttttcggctttcttggcgctgctgccgccttagtcttctcctgtatgggggcggcctatgggacggcgaagagtggtgttggagtggcttcaatgggagtgatgaggcctgagcttgtaatgaagtcgattgtgccggtggttatggctggagttttaggtatttacggcctgattattgctgtgattattagtactgggattaaccctaaggccaagtcttattatctctttgatggatacgctcatctttcttctggtcttgcttgtggccttgctggtctttctgctggtatggccattggaatcgtgggtgatgctggtgtaagggctaatgcacaacaacccaaactttttgttggaatgattcttatcctgatttttgctgaggctctggctctctacggtcttattgttggtatcattctttcttctcgagctggtcaatcccgagcagactaagaatggattgtgttactgctttattcttgtggtggttagagttgcggtttgttccattgtttttgggcagtgaaccgagaccggctgattgctgtgtcctgagacaggattctacttatttcttttaataaagtcgtcattgttggcgctatatttttgcaaagaaaaaacctctttggacattctattattatttgtgtattttttttgtttaaggtcgcgaaatcatatttatttgtatcctacaactcattaataacatgtttttcg

SEQ ID NO: 1876 - DNA, 981 bp, Euonymus alatus
cggccgggggctacgttattttgaaagctactcgccattaattctttgttatctttctcctttctattatttagaaccgatcatcgagaaacatcatcgtttctctgcgcagataagctcgaaaatcgaactggaaatagcaaatcatctctatccgatttcttaagcagcgaaaatgtcttcgaatttcagcggcgacgaaactgcccccttcttcggcttcattggcgctgctgctgccctcgttttctcctgcatgggagcagcttatggaactgcgaagagcggagttggtgtagcctcgatgggtgtgatgaggccagagctggtgatgaagtcgattgtgcccgtggttatggctggagttttaggtatttatggtttgattattgcggtgattattactaccggtatcaaccctacggccaattcttactaccttttcgatggttatgcgcatctctcctctggtcttgcttgtggtcttgccgggctgtctgccggtatggctattgggattgttggcgatgccggtgttagagctaatgcacaacagcctaagctctttgtggggatgatccttattctcatttttgccgaagctctggctctttatggcttgattgttggcatcattctctcttctcgtgctggtcagtcaagagctgagtaaaaaggatggccatttgcttggtgtttgttcctttcttctgattcatgaagaactactactatgtttgcttaagcattggtgtagtatgtgtgattgtttacacggtggacagtgtattggctatatcgggaggtagaatatagtgatagaaattagtttcttttcctgcaataaaattagctcgttatcagatggtgtaacttatggatggattggagctcttgtagaataattgagtattatattttgaactctcaacagggtttgattgttactaatatgatttgcttggatctttaagggctgct

SEQ ID NO: 1877 - DNA, 1004 bp, Fagopyrum esculentum
gggggcctagcgtgagattgagggattgggggatagataaaacaacaaaaccaggataaccagtcgtatatacgttcccacaaatctcacgaagcgtttgcgagagagggagagtattaaacaagttggtcgcaagtaatcgatatttcgcagtaacagattttcagatccgaccgatattctgcaaaacgcccaaacctgaatcggaatggccaccttcaatggcgatgaaacggcaccgttctttggtttccttggtgcagctgcagctctcgtcttctcctgtatgggggcggcgtacgggacggcgaagagtggtgttggtgtggcgtcgatgggtgtgatgaggccggagctggtgatgaaatcgattgtgccagtcgttatggctggtgtgttgggtatttatggtctgattattgctgtgattattagtaccggcattaaccctaaggctaaagggtattatctctttgatggctatgctcatctctcttccggtctcgcttgtgggcttgctggtctctctgctggcatggccatcgggattgttggtgatgctggtgtcagagccaatgcacaacaaccaaagctttttgtcgggatgatcctaattctcattttcgctgaagccctagctttgtatggcttgattgttggaattattctctcttcacgtgctgggcagtcaagagctgaatagagcatggttaggttgatttcttctcctatatcttaaaggtacgtctgtttatgcgaggaaagacttgagttcacgatagcagtgttttcaagttcaaatgagttgtttggcttcgggtagcagaggtgtattgtttcttgggtgcagcatagtgttgaaatcagtagaatgggctgcttcaggcccttcctaaataaagggagtcggtatcattgtaataatgcctacattaatgctttcgtttggtgatttgcgttcaaactctcgtgcttgttactaatattcattatcaattgggatg

SEQ ID NO: 1878 - DNA, 950 bp, Fagopyrum esculentum
ggggaacacgaacactgattcgttatttgggataaacgatcgattattttgcaatcacagaagttgcgatccgatcgtatactctactgaagtctcgaaattagtcagatcagatcaacaatgactttcaacggagatgaaacggcaccgttcttcggcttccttggcgcagctgccgcgcttgtcttctcctgcatgggagcggcgtatgggaccgcaaagagcggtgttggggtggcgtcgatgggtgttatgaggccggaattggtgatgaaatcgattgttccggtcgttatggctggtgttttgggtatttatggtctgattattgctgtgattattagtactggtattaaccctaaggcgaaagggtattacctctttgatggttatgctcatttgtcttctggtctcgcttgtggtcttgctggtctatcagccggcatggccattggaatcgttggagatgctggtgttagagccaatgcacaacaaccaaaacttttcgtcgggatgatcctcattctcatttttgctgaagctcttgctttgtatggcttgattgtcggaatcattctctcttcgcgtgctggtcagtcaagagctgaataggcaattcctttctctcagtcaagagctgaataggcaattcctttctctctcaatcattggttcgtatttcgtctgctgtctccagaggttatttccccttacccaacaagagtttggattggctttacagctgaagggagttatcttcctagcaaagctatagactgttcctcaagtgcaaaatagtgtgttgacatagtttacataaactagtgttacctccaaaaaaacgggtttgtataatgtatttcttttactcttatgctcttgtttggagatttgagtttgaactacaagactaagactattagccatgatattaaaatcgtgattttatt

SEQ ID NO: 1879 - DNA, 846 bp, Fagopyrum esculentum
attcatctacccctttcccttactcgcctctctgcaatccccctagatttgcagatccaaatccataatctacgttctttcacttctctgcgcaatggctcacttcaatggcgacgaaactgcgcctttcttcggcttccttggcgcggctgctgccctcgtcttctcttgcatgggagcagcgtacgggacggcgaagagtggagtaggtgtggcatcgatgggagtgatgagaccggagctggtgatgaaatcgatcgttcctgtggttatggctggtgttttgggtatttatggtttgattattgctgtaattatcagtactggcattaaccctaaggcaaaagggtattatctctttgatggatatgctcatctctcatctggtttagcttgtggcttggctggtttgtccgctggtatggctattggaattgttggtgatgctggtgtgagagccaacgcacagcagccaaagctctttgttggaatgattctcattctcatttttgctgaagcacttgcactgtatggtctaattgttggaatcatcttgtcctccagagctgggcagtcgagagcagagtaaggctactagggaaatcatgtattttcgtctgagctaagggcttttcttggcctgtagctgaaaaaatgttgtcaattgctatggttgaagcattttctcttcaatccatttcattttatatggtttttgtatgttgatgttgccatttgtagtagtcctggatcgggaaaacaataaaattgcttctgggcgtcacttgattgtttccgtgaattgtgattcttttgtatcattcctgcactatcctattattaata

SEQ ID NO: 1880 - DNA, 1050 bp, Fagopyrum esculentum
agggagttttctagcttgccagatatcagaatcccaataggtcaacttcttccccaatcccaacctctatctcttctgagtttccgatcaatcgaaggatcagcagcctaatcatcgccagatcgccctgtagaaaagcaatccaccatggctaccttcaatggcgacgaaaccgctccattcttcggcttcctcggtgccgctgctgctctagtattctcttgtatgggggcggcgtatggaacggcgaagagcggagtaggtgtggcgtcgatgggggttatgaggccggaattggtgatgaaatcgattgttccagtggttatggctggtgttttggggatttatggtctgatcatagctgtgataatcagtacaggtattaaccctaaggccaaggggtattatctcttcgatggttatgctcatctttcatctggtcttgcttgtggtctcgctggattgtctgctggcatggctatcggcatcgttggggacgctggtgttagagccaatgctcagcagccgaagctgtttgttgggatgatcctcatccttattttcgccgaagcacttgcattgtacggtctaattgtcgggatcatcctctcatcccgagcaggtcaatcccgagccgagtaagctccactggaagcattcatggctaagacttgcggctccttttaccttgtttcctgtcattgctacccgtgaggtttgtgtttgtgttaatttcatattttgttgcatattgcatgtaatccagttgaatacttttcatgtgtaacaccaatttattcgaaagtggcacctatctttatctgattcatttgtggtctactccacgagcctcgagtagtagatcccataaagaatgtaactattctgtgagttttaatgatgtatagggaaattgcaggaataattccacctctttgagggcagttgtggagcctaagcttttaaagctgggaagaatagcctcttaactctctcttagtgaaaaattgcaggaaatggcctgattattgaggttattgcataatatcg

SEQ ID NO: 1881 - DNA, 783 bp, Fagopyrum esculentum
ccaccatgactacctttaatggcgacgaaaccgctccattcttcggcttcctcggtgccgctgctgctctagtattctcctgtatgggagcggcgtatgggacggcgaagagcggagtaggtgtggcgtcgatgggggttatgaggccggaattggtgatgaaatcgattgttccagtggttatggctggtgttttggggatttacggtctgatcatagctgtgataatcagtacaggtatcaaccctaaggccaaggggtattatctcttcgatggttatgctcatctttcctctggtcttgcttgtggtctcgctggattgtctgctggtatggctatcggcatcgttggggacgctggtgttagagccaatgctcagcagccgaagctgtttgttggaatgatcctcatccttatttttgccgaagcacttgcattgtacggtctaattgtcgggatcatcctctcatcccgagcaggccaatctcgagccgagtaagctccataggaagcattcatggcgaagactcgcggctccttttaccttgtttcctgtcattgctcctcatgaggtttgtgtttgtgttaatttcatattttcttgcatattgcatgtaatccaattgaatacttttcatctgtaacaccattttactcttcagtttgaagaaagtggcacctatctttatctgattcatttgtgggagacctcgagtagtagatgatataagggacggtttggattctgtgagttttaattatgtatatcgaaattacaggaa

SEQ ID NO: 1882 - DNA, 1000 bp, Fagopyrum esculentum
aggataaccagtcgtatatacgttcccacaaatctcacgaagcgtttacgagagagggagagtattgaacaagttggtcgcaagtaatcgatagttcgcagtaacagaatttcagatccaaccgatattctgccgctcaacctcaatcggaatggcgaccttcaacggcgatgaaacggcaccgttctttggtttcctcggtgcagctgcagctctcgtcttctcctgtatgggggcggcgtacgggacggcgaagagtggtgttggtgtggcgtcgatgggtgtgatgcggccggagttagtgatgaaatcgattgtgccagtcgttatggctggtgtgctgggtatttatggtctgattattgctgtgattattagtaccggtattaaccctaaggctaaagggtattatctctttgatggctatgctcatctctcttctggtctcgcttgtgggcttgctggtctctctgctggcatggccatcgggattgttggtgatgctggtgtcagagccaatgcacaacagccaaagctttttgtcggaatgatccttattctcattttcgctgaagccctagctttgtatggcttgattgttggaattattctttcttcacgtgctgggcagtcaagagctgaatagggcatggtcaggttgatttcttctcctatgttttaaaggtatgtctatttatgagaggaaagacttttcaagttcaaatgagttgtctggcttcggtagcagaggtgtattgtttattgggtgcagcatagtgttgaaatcagtagaatgggttgctttaggccctttctaaataaagcgagtttgtatcattgtaatgctacattaatgcttttgtttggtgatttgcgttcaaactctcgtgcttgttactaatattcattatcaaatgggatgctgaaattctttgatgtcttgctgagttacgcccttttatctcacttgtaagcatgctctaagcataattttgtgttc

SEQ ID NO: 1883 - DNA, 1207 bp, Medicago truncatula
gaatacttgcctgttattattacatgtggtgtggtgtgagtgatcgcaaacttagtgggatccactcaagaaacttccttttgatccaatccaaaattaatcaaataaaaaaaaaaaacaagtgaaaaagaaaataacaataataatagatctctatctatcttcaaaatctatcatcaccttgttcatttctcgattcatctcattttcacagaaaactaaaacaaaaatggctggtttcagcggcgatgaaactgctcctttcttcggcttcctcggcgccgccgctgccttaatcttctcctgtatgggagcggcatatggaacagcgaagagtggtgttggagtagcatcaatgggtgtgatgagacctgaacttgttatgaaatcaatcgttcctgttgttatggctggtgttttgggtatttatggtttgattattgctgtgattattagtactgggattaaccctaaggctaaatcttattatctttttgatggatatgctcatctttcttctggtcttgcttgtggtcttgctggcttgtctgctggtatggctattggtgttgttggtgatgctggtgttagagcaaatgcccaacagccgaaacttttcgttggaatgattctcattctcatctttgctgaggcgttggcattgtatggtcttattgttggcatcatcctctcctcccgtgctggccaatccagagctgagtaatataaaatttattgttgcctgtagtgcacagagccatagatccatggattgtgaactttataagagacctggtcatggtaagggtggagctttatcatgctcttcttttgtcttatgactctaatctactcgttataaaattgaggttatcgtggaataaagtctatcaaactagttacttggcattgctgtatttaattattttctgtcaaactagattagaaatttatgtaataaaccttgtgttgatttcaataaactagattactgttgaacatttcgcccccaatccaacatctctttatgtatgtattaagatgtagtatgttcagtgtatcaattttctacaccatggatcattttcaggagtaagtatgaccaataatttgtgtgggtcatgattatgaatagggctgttgatgaccaatgtgtttgtgttatctgtgtacgtacataaaaggtcggtcaggtagatggtatatt

SEQ ID NO: 1884 - DNA, 958 bp, Nicotiana benthamiana
  misc_feature (910)..(910): n is a, c, g, or t
gcacgaggcgtgaatatcaccgaattatcaattattgcgtcaacagccaatcaaagagggagagagaacgagggaggagcaaccagaaacagatctattcaactccaaaactcaaaaacactgtatatttacagttctcagatccaaatcctaacgacaatgtcgaccttcgccggagatgaaactgctcctttcttcggcttccttggcgccgccgcggccctcgttttctcctgtatgggggcagcttatggaacagcaaagagtggtgttggagtggcgtcaatgggagtgatgagacctgagttggtgatgaaatctattgtgccagtggttatggctggtgtgttaggtatttatgggttgattattgctgtgatcatcagtactgggattaaccccaaaacgaagtcgtattacctatttgatggctatgctcatctctcctccggtcttgcttgtggtcttgctggcctttctgctggaatggctattggtattgttggtgatgctggtgttagggctaatgcacaacaacctaagcttttcgttgggatgatcctcattctcattttcgctgaagctttggctctttatggacttattgttggcattatcttgtcttcccgagctggccagtctagagctgagtgaagttaactccattcttaccgcgttgtatgtgggacttcagtagaccaaggcagtcaaaagtatctaatacgtgtattgttattcattatcccacagctggaacttaattcagtggtgcaatgttctgtctgtagaaataggaattaaatttttctactcaataataatagcttaaagagctgtgcaatttggtcagtatttatcgtatattttgcggtgaacggtctgaaccattttgtttatgagattcgtgcangtatcatttcatcttgatttattatgttgattgtgccacatcttacaa

SEQ ID NO: 1885 - DNA, 1147 bp, Pinus taeda
ccttctgcagtccgtgcaactcgaagaaccggtagattgctcggataaaggcggtcagcggttctctccacgaggaattccattccgtttgtgccctgggtacgtctctatataccttctttctcccttcgtctccaagggatattaaagatcgatggattgagtgttctcttttttcaccttaatactctgcttccatcttcccgcgagatcatttaatccacgaattgcatttaaaaggttgatttcgtttgaaagatcggcagattatcagcgtagacgaaatggcggacccattcagcggagacgagctggcacctcttttcggattcctgggagctgcggcagcccttgttttctcatgcatgggggcagcttatgggacggcaaagagtggagttggagttgcatccatgggtgttatgaggccagaacttgtgatgaaatctatagtaccagttgttatggctggagtgttgggtatatatggtttgatcattgcagttattataagtaccggaatcaacccgaaggctaaatcctattatttatttgatggatatgcccacttatcatcagggctagcttgtggcctttctggtttgtctgcaggaatggcaattggcatcgtgggtgatgccggtgtcagagcaaatgcccagcagcctaagctttttgtgggcatgatcctcatactcatttttgcagaggcgcttgccctgtacggtttgattgtgggtattattttatcatcccgagctggtcagtcaagagctgactgatagaagtttgtaatgccaggtcacttgattgattgggggttcatttaaaaagaaccctatgtttcagaaatttcatcacagtgactggatatcttttgtatattttttagtcctttaaaatttctgtcaacttagtacgaagcattttttcactgtagctttgttgttgaatatcataagttattgatggttgtgaatatggtcaccttcataaatccaaggcgatgcttggtttaatgttcattcagaaatgtggatgttgcaagtctattccactttagagttcatgttcaaattctaccctacgaggttaataagatcaactgcactcaattattgtctttgtagtaaaaaaaaaaaaaaaa

SEQ ID NO: 1886 - DNA, 1003 bp, Podocarpus macrophillus
gaccggtcatctacttttgatccttgacacaacatttaccctccaattttttgagagttatagctacttataggtcaagagactcgaaccctcccaaccttcttggatcaatctcagtccagagacccgcaaatcagatctgtacaaaataatcagaagcaaacatgggggtagattttagtggagatgaaatagctcctttcttcggatttttgggagctgcagcggcccttgttttctcatgtatgggtgcagcctatggtacagcaaagagcggtgttggagttgcatcaatgggagttatgaggccagaactcgtgatgaaatctatagtacctgttgttatggctggtgtgctcggtatatatggtttgatcattgcagtcatcataagcacgggaatcaaccccaagactaaatcgtattacctgtttgatggttatgcccacttatcatcaggcttggcttgtggtctatctggtttgtctgcaggaatggccattggtattgttggtgatgctggtgtcagggcaaatgctcaacaacctaagctatttgttggaatgattcttatactcatttttgctgaggcacttgcactttatggtttgattgttggtatcattttatcttcaagagctggtcagtcaagagctgactaattccattgtagcactgccatcctactactggagcccgcccttacagagtgccatgtaaaggattcacagtgttgattccatgtcgttgtatatgttctcattgttggaagcaatcacaaacttagttatcctcattcctggattccttgaaatagacctttttggactttgccttgataggcaattgtacgcttatttgattatgacttttggatatagttattagtttcaaggtgactattcatgtaatgcttatctaaacatatgactatttatggcatgtttttcaggcgctgggcgaattctttgttagaagcggaataaaagtaataatatgtgcc

SEQ ID NO: 1887 - DNA, 923 bp, Secale cereale
agaccgcccccttcttcggcttcctcggcgccgccgccgccctcgtcttctcctgcatgggagcggcgtacgggacggccaagagcggggtgggggtggcgtcgatgggggtgatgcggccggagctggtgatgaagtcgatcgtgcccgtcgtcatggcgggggtgctcgggatctacggcctcatcatcgccgtcatcatctccaccgggatcaaccccaaggccaagccctacttcctcttcgacggctacgcgcacctctcctccggcctcgcctgcggcctcgcgggcctcgccgccggcatggccatcggcatcgtcggcgacgccggcgtcagggccaacgcgcagcagcccaagctgttcgttggaatgatcctcatcctcatctttgccgaagcccttgccctgtacggcctcatcgtcggcatcatcctctcctcgcgtgccggccaatcccgcgccgactagaaacaaagctgttgcaagcaaggagcatacggcccatcattgtattctatttcagaaagggtttatttcttcctagagacttgtttggcattacactgtggttctacttatgtgttcatgctcctcgaaagatcaaggaacataatgtggtttgggatcatatggatttccacgccctccatctgtaattttattctatccggcaacgcaaagctacctgtatctactcgtacctagcacctgttgtatttattgtttggagtaataatcggcgatgagccgcttgggacgtggtgaatgaataagcaaagctagacctagttccacttttgtgtgcaactcctgtgtctagattcattttgttatgtctggggcatgtggagtgaatgttgtgtttggttatgtttagtgtatattttgtgatgccaactactagttgtacccaactga

SEQ ID NO: 1888 - DNA, 845 bp, Silene vulgaris
cctcttctcccagatctaaatccccaataataaatcatgtctactttattcaacggcgatgaaatcgctcctttcttcggtttcctcggtgccgctgctgccctcgtcttctcctgtatgggagcggcgtacgggacagccaagagtggagtaggggtggcgtcaatgggagtgatgaggccggagctggtggtgaagtcgattgtgcccgtggttatggcgggagtgttgggtatttatggtttgattattgctgttattattagtaccggaattaaccctaaggctaaatcttactatctctttgatggttatgctcatctctcttctggtcttgcttgtggtctttcgggtttggctgctggtatggctattggtgttgtcggagatgccggtgttagagcaaatgcacaacagcccaagctttttgtaggaatgattttgattctcattttcgctgaagctttggccttgtatggtctcattgttggaatcatcctctcttcccgtgccggccagtcaagagctgactagacgagagctgtactcgagatgcatgtttttgttttccgggcagataaagattacttggcatgtgaattggtttctcttccgttgaagaattgttattcttttgctttatggtaatcgaccatttttgggacattttaccagactgtagcattactagttagtttcgcctcgaaataaagttatgctgtatcattatttatatctttcctctcctggatatggagattcagtttgaaaactttgaacaactgtaacagtacaatagattcttttggtgattaatatcgttttttcaagtataaattcgttaa

SEQ ID NO: 1889 - DNA, 918 bp, Nicotiana tabacum
accaatcagggagagagaacgagggaggagaaactacagacagatctattcaactccaaaactcaaaaactctctgtataatttacaattctcagatccaaatcctaacgacaatgtcgaccttttccggagatgaaactgctcctttcttcggcttccttggcgccgccgccgccctcgtcttctcctgtatgggggcagcttatggaacagcgaagagtggtgttggagtggcgtcaatgggagtgatgagacctgaattggtgatgaaatctattgtgccagtggttatggctggtgtgttaggtatttatgggttgattattgctgtgatcatctgtactgggattaaccccaaaaccaagtcgtattacctatttgatggctatgctcatctctcgtccggtcttgcttgtggtcttgctggcctttctgctggaatggctattggtattgttggtgatgctggtgttagggctaatgcacaacaacctaagcttttcgttgggatgatcctcattctcatttttgctgaagctttggctctttatgggcttattgttggcattatcttgtcttcccgagctgggcagtctagagctgagtaaagttaactccattcttatcgccctgtatgtgagacttcagaaggccaaggcagtcaaaaagtatctattacgtgtattgttattcatgataacacagctgccactttattcagtggtgcaatgttctctctgtagaaataggaattcaatttttctactcaataatagcttaaagagctgtgcaatttggtcagtatttatcgtgtattttgcagtgaacggtctgaaccattttgtttatgagattcctgcatgtatcatttcatcttaatttattatgtttactgtgcaacatctatgagtttgagct

SEQ ID NO: 1890 - DNA, 916 bp, Nicotiana tabacum
aaaactctgtataatttactattctcagatccaaatcctaacgacaatgtcgactttcgccggagatgaaactgctcctttcttcggcttccttggcgccgccgccgccctcgttttctcctgtatgggggcagcttatggaacagcgaagagtggtgttggagtggcgtcaatgggagtgatgagacctgagttggtgatgaaatctattgtgccagtggttatggctggtgtgttaggtatctatgggttgattattgctgtgatcatcagtactgggattaatcccaaaacgaagtcgtattacctatttgatggctatgctcatctctcctctggtcttgcttgtggtcttgctggcctttctgctggaatggctattggtattgttggtgatgctggtgttagggctaatgcacaacaacctaagcttttcgttgggatgatcctcattctcattttcgctgaagctttggctctttatgggcttattgttggcattatcttgtcttcccgagctgggcagtctagagctgagtgaagttaactccattcttaccgcatcgtatgtgggacttcagaagaccaaggtagtcaaaagtatctattacgtgtattgttattcattaccccacagctgccactttattcagtggtgcaatgttctgtctgtagaaataggaattcaatttttctactcaataatagcttaaagagctgtgcaatttggtcagtatttatcgtgtattttgcagtgaacggtctgaaccattttgtttatgagattcgtgcatgtatcatttcatcttaatttattatgtttactctacaacatcatgagtttgagcttgaatatttctttgatcaacaagttatatttggttgtactaattgaagatgcagatacttggtgctc

SEQ ID NO: 1891 - DNA, 852 bp, Vinca minor
tcagtggcgatgaaactgctcctttcttcggcttcctcggcgccgctgctgctctcgtcttctcctgtatgggagcggcatatggaactgctaagagcggagtaggagtggcgtcaatgggagtaatgaggccggagctggtgatgaagtctattgttccagtggttatggctggtgttttgggtatttatggtcttattatagctgttattatcagtaccggaattaaccccaagacaaaggcctattacctattcgatggctacgcacatctctcctccggtttagcgtgtggtctcgctggactttctgctggtatggccattggtattgtcggcgacgctggtgttagggccaatgctcagcagccaaagctttttgttggaatgatccttattcttatttttgccgaggctttggccttatatggtcttattgtgggtattattttgtcttcacgagctggccagtcaagagcagactaagaaagagaaaaatactaatgttgttatattgtgttgcccccggtggaactgttatcaattgggtgaaggaaatgaaatttggtcctatttttgtttagcatggctctctaggttatgcctcagcgtgaacttggaaagcaattgctcagccatatttaatttgatcgcacttactgctgtttgtagaagtagtgatggtgggtctttttctatacaataaagcttttataaagctaattttcacggagtttaggctgtttctacttcgaaattatattgagcaactatattgtagtagtaattattacttggagttggtgcgtttgtggtataatttggttttgttgactattcttttccagcaatc

SEQ ID NO: 1892 - DNA, 951 bp, Zamia vazquezii
  misc_feature (185)..(185): n is a, c, g, or t
  misc_feature (187)..(187): n is a, c, g, or t
  misc_feature (856)..(856): n is a, c, g, or t
gctaccggatttcttcttttttcccttggtttagaccagatcttacttgatcgatcgaagcgcagttccaggtctgcggttcgagactcgcagggcttgcagatctggtcttaagaagcagatctgtccaaatctctgttaaaatggcggaggcatttagcggagacgagactgctccatttttngntttccttggagctgctgcagcgcttgtattttcatgtatgggcgctgcatacgggacggccaagagcggcgtcggcgtggcatccatgggcgtgatgaggccggagctggtgatgaagtccattgtgccggtggttatggcaggagtgctaggtatctatggtttgatcattgccgtaattattagcacagggattaatccgaaggcaaagtcgtattatttatttgatggatacgcgcatctgtcgtctggacttgcctgcgggcttgctggcctctccgccggaatggccatcggtattgttggcgatgccggagtcagagcaaatgcacagcagccaaagctctttgttggtatgattcttatcttgatctttgcggaagcacttgcgctctatggccttattgtgggaattatactttcatcccgagctggtcaatcacgagcagaataaaggagttacaattggtcttgtgttactattggttcatttgtcagttttgatgtaagactgctgtctgcagatgtagaagatgcatttagtattgttagaaataactgggatcttgattaagttggatttctattctttctctgtgaaggtttcaacttttcatgtatttgacaaattttcaagcttctaagacgaggatgagtgaaacaagtagncattacctttccctctgtttagcttgatatgtaatgtagtgtatcattctaaattgagtcaaattttattgatgcaaaaaaaaaaaaccggtagc

SEQ ID NO: 1893 - DNA, 714 bp, Vaccinium corymbosum
aacacacgaatcaacaatctcgtcagaattcagcggcgatgaaactgctcccttcttcggcttcctgggcgccgcagccgcacttgtcttctcctgtatgggagctgcctatgggacggcgaagagcggtgtgggagtggcgtcgatgggcgtaatgaggcctgaattggtgatgaaatcgattgtgccagttgtcatggccggtgtgttggggatttacggcttgattatcgctgtgatcatcagcactggaattaaccctaaggccaagtcgtattacctcttcgacgggtacgcacacctgtcgtctggtcttgcttgtggtctcgctgggctttcggccggtatggctatcgggatcgttggtgatgctggtgtgagagctaatgcacaacagcctaagctgtttgttggaatgattctcattctcatctttgctgaggcattggcactgtatgggctcatcgtcggcatcatcctgtcctcccgtgctggccaatccagagcagattagagagaataccatccttgctggatcttttgtgttttgttcgcatcgcctcactcaggttagtggtgctagtttggaatgtgatttgtttcttgtttgctattatgttgcccttaatttcttcatcacttggaattttttacggattgtaatatggtgagcattttcctccctgaaataaatctgtgcaaagctagattctt

SEQ ID NO: 1894 - DNA, 711 bp, Antirrhinum majus
  misc_feature (133)..(133): n is a, c, g, or t
gaagaagagatgtcttcaccttcagcggcgatgaaactgctcctttcttcggcttcctcggcgctgccgccgccctcgttttctcctgcatgggagcagcgtacggaacggccaagagtggggtaggtgtggnttcaatgggggtgatgaggcccgaactggtgatgaaatcgattgttccggtggttatggccggtgttttggggatttacggtctgattattgcggtgattattagtaccggtattaaccctaaggctaaatcttattacctttttgatggatatgctcatctctcgtctggcttggcttgtggacttgctggactggccgctggaatggcgattgggatcgtcggagatgccggtgttagggctaatgcacaacagccaaagctttttgttggaatgatccttattctcatctttgctgaagctttggcgctctatggtttgattgttggaattattctatcttctcgagctggccaatcccgagctgagtagataaatgattgaattccactttagaaatatatcgtatagcctggaaagtaagcatggagaaatttcgtttatgccttgttcgactggctattttgtgctcccattattcttcaatgttataaatattgtatttttcctctcagattcattcagtgagaccatggtcctatttctagtattagataaaccactttctttttgttga

SEQ ID NO: 1895 - DNA, 835 bp, Castanea mollissima
gcacaccccaaccaacgactatttggtttgattcccgtggccgcgagtgactccaaatccaatcaatcatcaccttcagcggccactccctctccctgatccaaaaccaagaacatgtcatcttctgcatccggattcagcggcgacgaaaccgcacccttcttcgggttcctgggagcggcggcggctctggtgttctcgtgcatgggggcggcgtacgggacggcgaagagcggagttggggtggcgtcgatgggagtgatgcgtccggagctggtgatgaagtcgatagtcccggttgttatggctggggtgttgggtatctatggcctcatcatagctgttattattagtactgggattaacccgaaggctaagtcttactatctctttgatggctatgctcacttgtcttctggtctctcttgtggactcgctggtctctctgctggtatggccattgggattgtcggcgatgccggtgtcagggctaatgcacagcagccaaagctgttcgtgggtatgattctaatccttatctttgctgaagcacttgctctctatggtctcattgtggggatcatcctttcatcccgagcaggccaatctcgtgcagattaaaggaggccaagtttcagaaattttttgcttctgtactatttgcagattggcagttggatgccttaacaacaatgtcattgttaagcttacgataatgttaaactggatcatactggtccaaattgtactctatgaaggcagttgccatgaaaactttttaaataagcatttattagttataagaaatgttatccttgtgttttgtcaaaaaaaa

SEQ ID NO: 1896 - DNA, 526 bp, Malus domestica
taatcggaacaccgaaaagatggcgccatccaccttcagcggcgacgaaacggcaccgttcttcggcttcctcggcgcggcggcagcccttgtcttctcaggtatgggagcggcgtacgggacggcgaagagcggcgtgggcgtggcgtcgatgggggtgatgaggccggagctggtgatgaagtcgattgttccggttgttatggcgggagtgttgggtatctacggtttgatcattgctgtgattatcagcactgggattaacccaaaggccaaatcttactacctcttcgatgggtacgcccacctctcctccggtctggcttgtggacttgccggactttccgccggaatggccatcggcatcgttggcgatgccggtgttaggtaaatttggcacaacagccaaagctttttgttggcatgattctgattctcatctttgccgaagctttggctttgtatggcctgattgtcggtatcatcctttcatcgcgatctggacagtccagagcagattagagat

SEQ ID NO: 1897 - DNA, 1104 bp, Phaseolus coccineus
atggacgtgtggccgaaactggttcttcagtgtgaaggcccggaaaatgtgtttggcgttagtgataatgacagaggtggcagagagggtgggttcaagaaacttccgagagggaagaagcgagggagggaagagagaagggaaaattttagcaataataaaagtaatatcaacagatctcactctcgtttgcccaaagccaaaattcaaagaaggaaagaaagaatggttgatttcagcggcgatgaaactgctcccttcttcggcttcctgggcgccgcggcggccctcgttttctcctgcatgggtgcggcgtacggcacggctaagagcggcgtcggtgttgcctccatgggcgttatgaggccggagttggtgatgaaatcgattgtgccggttgtgatggcgggagtgctgggcatctacggcttgatcatcgcagtggccattacggccgggcattaaccctaaggcaaaatcctactatctcttcgacggctacgctcatctctcttctggtctcgcttgcggtctcgcgggtctctccgctggcatggccattggcatcgttggcgacgccggtgttagagcaaatgcccaacagccaaagctttttgttgggatgattctgattctcatctttgctgaggcactggccttgtatggtctcattgttggcatcatcctctcttcccgcgctggccaatccagagctgattagtatgatatttcatgttgcttagagcgcttagaaccatggattggatggtgaatgtggcgtaggactaggtattggtaagtaagagtgttggtttgtgatgctcttcattcaggttattcagaaataaaacgtccaaacgatatctttggccatttattgtatttacttgtgctatccaaactaaattagagatctctgagataaaacatgtttgtgtttaatttggataacatttagtattgtgtgtcgtgtgccattcgacacttagctctctctctctctccacaacccccaaaaccttatcttatggctgtaatgagatattaaatgtcaatttgattttttttataatgatcttgaaaattatggacatatctgaccca

SEQ ID NO: 1898 - DNA, 1223 bp, Fagopyrum esculentum
ttattcagaagaagccacatctaattactacaaaccaatcaatttgcttgtcttgttcgctttcctccgctcctctaatcccgatccacgataccctccatcgatttgcagatccaaaatatccacctctccgatccaccacaatgccgaccttcaacggcgatgaaacagcgccattctttggcttccttggtgccgctgccgcacttgttttctcatgtatgggagcggcatacgggacggcgaagagtggggttggagtggcgtcgatgggagtgatgaggccggagctggtgatgaaatcgatcgtccccgtggttatggctggtgtgttaggtatttatggtctgatcattgctgttatcatcagtaccggtattaatcctaaggccaaaggttactacctttttgatggatacgctcatctttcctccggattggcttgtggtttggctggtttgtccgctggtatggccattggtatcgttggtgatgctggtgtcagagccaatgcacagcaacccaagcttttgttggaatgattctgattctcatcttcgcagaagcacttgctctctatggtctcattgtcggaattatcttgtcttcaagagctggccaatcaagagcagaataaggcaagcatcatttccgccttgtgatttttgtattaatcaatgctggttatccagctgaacattttggtttggttctcgtcctcccaactgcatgaaagaaccaaaaagttgtcttatttcatcttagattaggatcattagttttattggaagtgcaaagaaacgggtatttatgctctggctggcggaaggatctatctgccattctgcctcattcaacctgccattcgtagttggactggaatattgaaaaccaataaagctctcctggagcattcacttgtttgtttcggtaacgcgttaagcatatctgtgtggtattctgttgataagaactggtaaagattacaggaccctcgtgctttaggtgttctggtgttgtctgctcatgtgtgcttgcatctttgtcaatcttgctgcaaatctctaagtgccatgtatggcttagtgggctgtccctttttgtaaagggcttgatgctttattattcaaaataagtttccaaagatttggtttgttgtttacatattgaaaaacctcttcaagttgcattttgcccgttgttttatgccctattttatgatg

SEQ ID NO: 1899 - DNA, 753 bp, Trigonella foenum-graecum
catttagcggtgatgaaactgctcctttcttcggcttcctcggagccgctgctgccctcgttttctcctgtatgggtgctgcgtacgggacggcgaagagcggtgtcgggtggcatcgatgggagtgatgaggccggtagctggtgatgaaatcgatcgtgcccgttgttatggctggagtttttaggtattttatgggttgattattgcggttattatcagcactgggattaacccaaaggccaaatcttactacctgttcgatggctatgctcatctttcctctggtctcgcttgtggcctcgccggtctctctgccggtatggccattggaatcgtcggcgatgctggcgttagagccaatgcccaacaaccaaagctttttgtcggaatgattcttattctcatttttgcggaggctttggctctgtatggactcatcgttggcatcatcctctcttctcgagctggccagtcccgagcagaatagagttcaaggttctgagacttgggttgttgctagttggtgttactcagttgtctcttctccaatagcatgcactgtgaaacatttttccagaagttattttgaatccattgatgaatttcttgaagtggtttatgctgtttgtatgattgagaagataggtgtaagttgaaataaacgttgttttgctattttctttttaatctatgcctttaggctgtaatttacatgtaagttgaatttaatgtaagattgctccactttgt

SEQ ID NO: 1900 - DNA, 1025 bp, Nicotiana benthamiana
cgtgaatatcaccgaattatcaattattgcgtcaacagccaatcaaagagggagagagaacgagggaggagcaaccagaaacagatctattcaactccaaaactcaaaaacactgtatatttacagttctcagatccaaatcctaacgacaatgtcgaccttcgccggagatgaaactgctcctttcttcggcttccttggcgccgccgcggccctcgttttctcctgtatgggggcagcttatggaacagcaaagagtggtgttggagtggcgtcaatgggagtgatgagacctgagttggtgatgaaatctattgtgccagtggttatggctggtgtgttaggtatttatgggttgattattgctgtgatcatcagtactgggattaaccccaaaacgaagtcgtattacctatttgatggctatgctcatctctcctccggtcttgcttgtggtcttgctggcctttctgatggaatggctattggtattgttggtgatgctggtgttagggctaatgcacaacaacctaagcttttcgttgggatgatcctcattctcattttcgctgaagctttggctctttatggacttattgttggcattatcttgtcttcccgagctggccagtctagagctgagtgaagttaactccattcttaccgcgttgtatgtgggacttcagtagaccaaggcagtcaaaagtatctaatacgtgtattgttattcattatcccacagctggaacttaattcagtggtgcaatgttctgtctgtagaaataggaattaaatttttctactcaataataatagcttaaagagctgtgcaatttggtcagtatttatcgtatattttgcggtgaacggtctgaaccattttgtttatgagattcgtgcatgtatcatttcatcttgatttattatgttgattgtgcaacatctatgagtttgagcttgaatatttctttgatcaaccagtaatatttggttgtactacttggagatgcagatacttggtgctc

SEQ ID NO: 1901 - DNA, 957 bp, Acacia harpophylla
gagagaacgctgcattattttgatacgatattccagaagggcagtgaaaggatactattgtaattccgcgactgtgctccgatccttggccgtgatcaagacgtagaaatccataattggacattgaatcatttactctggtccgatctctttcatcttcatctaccattccaaaaaggaggacaagcaagaagtctgtgtgagatggcaggtttcagcggtgacgaaactgcccctttcttcggtttcctcggagccgctgctgccctggtcttctcctgtatgggcactgcttatggaactgcaaagagtggagtaggcgtggcttccatgggagttatgcggcctgagctggtcatgaaatctattgttccggtggttatggctggagtgctgggtatttatggacttattatagctgttattattagtactggaataaatcccaaggctaaatcatactatctatttgatgggtatgcccacttgtcatctggccttgcttgtggccttgctggactctctgctggaatggcaattggaattgttggtgatgctggagttcgggcaaacgcccagcagccaaagctgtttgttggtatgattcttacattgatccttgctgaagctcttgctctctatggccttatcgtgggtatcattctttcatcccgagcaggccaatcccgtgctgagtgaggatgaatttgtatagatcgtagtccaaattttatgtttttggagttgtttgagcgaagcgttttgccgtgattcgtttagtttggctgtcgactcccctttcctatgttgtattttcttgcggaactgttcatttcgatggattgatgttgaagtttcgctattctagagttttctgaaacatatattcctataaacgaccaaacatgcgagtgtacttgttcgtgtcgtcttgtaaaattgcaaatttctcgataa

SEQ ID NO: 1902 - DNA, 604 bp, Bruguiera gymnorhiza
gagttaattgtcttttgcgtgcccgacggtgcttgaagaaaacggggagagggaggagagatcgaaccacgagaactctgtgtaatttcagatcctcaacggcaccgtcttcagatccgtgatcaaacatgtcttctgttttcagcggcgatgaaacagcaccgttcttcggcttcctcggcgccgccgccgcgctcgtcttttcctgtatgggagctgcatatggaacagctaaaagtggtgttggtgtggcatcaatgggtgtgatgaggcctgagctggtgatgaaatcgattgtgccagttgttatggccggtgtgttgggtatctacggcttgattattgctgtcattatcagcacagggattaaccccaaggccaaatcatactacctttttgatggttatgcgcatctctcttctggtcttgcatgtggccttgctgggctttctgctggaatggcaattggtattgttggtgatgctggtgtcagagctaatgcacagcaacctaaactgtttgttgggatgatccttatcctcattttcgcggaggcgttggccctttatgggcttattgttggtatcatcttgtcttctcgagc

SEQ ID NO: 1903 - DNA, 1009 bp, Cedrus atlantica
tttctctcctttcacattaaaactctccttccttctgcccggcgtggtcgtttaaccccctaactgcattagaaggtccggtttcatttgaaagatcagcatatcatcagcggaaaggaaatggcggactcattcagcggagacgatatggctcctttcttcggattcatgggagctgcggcagcccttgttttctcgtgcatgggagctgcttatgggaccgcaaagagtggagttggagttgcatccatgggtgttatgaggccagagcttgtgatgaaatctatagtgccagttgttatggctggagtgttgggtatatatggtttgatcattgcagttattataagtactggcatcaaccccaaggctaaatcctattatttatttgatggatacgctcatttatcatcagggctagcttgtggtctatctggtttgtctgcaggaatggcgattggcattgtgggtgatgctggtgtcagagcaaatgcccagcagcctaagctttttgtgggcatgatcctcatactcatttttgcagaggcacttgccctgtacggtttgattgtggggattattttatcatcgcgagctggtcagtcaagggctgactgatagaagtttaatccaggacagttatcagtcaagggctgactgatagaagtttattccaggacacttaattgattgcggcttcatttaaaaagaagcctatgtttcagagaattcatgatagtgactcaatatcttctgtataattttctgtcctttctgtcaacttagttatgcttatagttgttactcatttggcaaatatcatcttttcattgtggctctgttgaatatgatgatttattgatggttgtgaatatggtcaccttccttcataaatccaaggcgatggttggtttaatgttcattcagagacgtggatgttataagtttattccattttagagcacatgggcaaattgtaccctacgaagttaataagatcattggcact

SEQ ID NO: 1904 - DNA, 1323 bp, Selaginella moellendorffii
gtttcgtgctcgcaataatgtcgtcgggcatggacgccttcagtggcgatgagacggcgcccttctttggattcatcggcgctgccgcagctctcgtcttctcttgcatgggagctgcctatggcactgccaagagcggcgtgggcgtggcgtccatgggcgtcatgagaccggagctcgtgatgaaatcgatcgtcccggtggtgatggctggagttctcggcatctacggccttatcatcgcggtgattatcagcactgggatcaatcccaaggcgaaatcctactacctcttcgatggctacgcgcatctctcttccggattggcttgcgggcttgctggcctctcggctgggatggcgattggaattgttggagacgctggagtgagggccaacgctcaacagccaaagctcttcgtgggcatgatcttgatcctcatcttcgccgaggcgctggctctctacggattgatcgtggggatcattctttcatcccgagctgggcagtcgcgaggctagaagtaaattgttccatcgacacatcatggtctctacgtgtaagaagaacaagagggaagaactttttgagggactcctctctaggtcgccgccgagcgccagagctggattcgtcgcgcctcgccagagaatcgaaattccagccagagcgagcttcgggaggacaatgcggcagtgcgcgccactgatttcgctcatccatcccagggccagcgcttctctcgggatcgtggaaggtggtgtcaaggacgagagcgagaatttgaccctggatgccatccgggactcgttgatccaacaagaggataatattatctttagcttgatcgagcgagcgcagtacaagatgaatacgcggacgtatgatcctaacaggtttcgcattcctggctttgatggctcactggtggagttcatgctcaaagaaaccgagtgcctccatgccaaggttcgaagatactgcgcccctgatgaacacgcttttttcccagatgatttgccggagcctatacttcctccactcgagtatcccaaggtgctccatcaagcggccaaagccgtcaacattaacaccaggatctggaaaatgtactatagcaacttgctgccttcctttgtatctgacggggatgatggcaattatggctcaacagcggtctgtgacgtgaagtgtctccaggccctctcgaagagaatacactacgggaagttcgttgccgaggccaagtttcgtgagtcaccacatctattcgaacctcatatccgagcacaggacccgcaagaattaatgaagctggtcacg

SEQ ID NO: 1905 - DNA, 672 bp, Selaginella moellendorffii
cgcaataatgtcgtcggggatggacgccttcagtggcgatgagacggcgccattctttggattcatcggcgctgccgcagctctcgtcttctcttgcatgggagctgcctatggcactgccaagagcggcgtgggcgtggcgtccatgggcgtcatgagaccggagctcgtgatgaaatcgatcgtcccggtggtgatggctggagttctcggcatctacggccttatcatcgcggtgattatcagcactgggatcaatcccaaggcgaaatcctactacctcttcgatggctacgcgcatctctcttccggattggcttgcgggcttgctggtctctcggctgggatggcgattggaattgttggagacgctggagtgagggccaacgctcaacagccaaagctcttcgtgggcatgatcttgatcctcatcttcgccgaggcgctggctctctacggattgatcgtggggatcattctttcatcccgagctgggcaatcgcgaggctagaagtaaattattccatcgacacatcatggtctctacgtgtaagaagaacaagagggaagaactttttgaggtctgtgcctttaatccgggacccttaggttctctccagatttacttttggtcttcctcttcctcgtaataaaacgtggcaattttccttc

SEQ ID NO: 1906 - DNA, 677 bp, Juglans hindsii x Juglans regia
aagcttccttcatatctctgtctctttctctatctatcgaacggacgcatacacaatttctgatcaatctcccgaactctctcgtaaattcgtaatcgaatccttggaaagatgactacattcagcgggggcgaaacagctccgttcttcggcttcctcggcgctgcggctgccctcgttttctcttgtatgggtgccgcatatggcgctgcaaagagcggtgtgggcgtggcgtcgatgggagtgatgcggcccgagcttgtgatgaaatccatcgtgcccgttgttatggccggtgtgttaggtatctacggtttgatcattgcggttattatcagtacggggattaacccaaaggccaaatcttattaccttttcgacgggtatgcccacctctcgtccggtctcgcttgtggtcttgctggcctttccgctggtatggctatcggtatcgttggcgatgccggtgtgagagcgaatgcacaacagccaaagctttttgttggaatgattcttattctcatatttgctgaggccttggccttgtatggcctcattgttgggatcattttttcttcccgagctggccaatcgagagcagattagagaaaggttttctgcaagtggctgattttggtgttgcatatgtgacttcaggtccgtgatgcatacaaagt

SEQ ID NO: 1907 - DNA, 761 bp, Triticum aestivum
ccaatccgaaatctcgagctttcgcgccggcgaccacagcaaagaggaggccacagcacgacagcgccccagggttcctactctcgtcgcagcggcagcagtgaggggaagatgtcgtcggtgttcagcggcgatgagaccgcccccttcttcggcttccttggcgccgccgccgctctcgttttctcatgcatgggggcggcgtacgggacggccaagagtggcgtcggcgtggcgtccatgggtgtcatgcgcccagagctcgtcatgaagtccatcgtgcccgtggtcatggctggtgtgctcggtatctacggcctcatcatcgccgtcatcatcagcactgggatcaaccccaaggccaagccatactacctctttgacggctatgcccacctgtcgtccggccttgcctgtgtcttgctgggcttgctgcaagcatggcattggatcgttggtgatgctggtgtcagggcgaacgctcagcagccgaagttgtttgttggcatgatcctcatccttatttttgctgaagcgcttgccctctatggtctcatcgtcggcattatcctctcgtctcgtgccggccagtcccgcgcagattagaggcacgtttcaagatgtcaacaccgtgccgccgacagttgcctgggtcgtagctgggtcatgttctatatccatgagacaagaactggagcacttgactccttgagaagctacctttatgctgtctagtttccaacctccgttgagtccagaaa

SEQ ID NO: 1908 - DNA, 746 bp, Ipomoea batatas
gatcaattacacagttttctgcagatccgagtatacgaattcgccgaaaagctctgaaaagatggcttatacaaccttcagcggcgatgagacggcacccttctttggcttcctgggagctgctgcagccctggtcttctcctgtatgggagctgcctatgggaccgcaaagagtggggtaggtgtggcgtcgatgggtgtgatgaggccggagctcgtcatgaagtcgattgtcccagtggttatggctggtgttttaggtatttacggcctgattattgccgtgatcataagtaccggtattaaccctaagaccaagtcctactacctctttgatggctacgctcacctttcctctggtcttgcttgtggcctcgctggcctttctgctggcatggccattggaattgttggtgatgcaagtgtaagagcaaatgcacaacagcccaagctttttgtaaggatgattctcatcctcatttttgccgaagctctcgctctctacggacttattgttggaatcatcctctcttctcgcgctggccaatctagagcagagtagaggaagagcagagcacatttgtctctacgcaaatttatgtggtttatttggatgtggaatattttcttctctttccccaagattactcatggggttgggatggctattaaatttgctaatttatggggttgatgtcctggtggagaataaaacccccctgggccctcataagaacctggctcag

SEQ ID NO: 1909 - DNA, 750 bp, Festuca arundinacea
  misc_feature (444)..(444): n is a, c, g, or t
  misc_feature (459)..(459): n is a, c, g, or t
  misc_feature (485)..(485): n is a, c, g, or t
  misc_feature (488)..(488): n is a, c, g, or t
cccttcttcggcttcctcggtgccgccgccgccctcgtcttctcctgcatgggcgcggcgtacgggacggccaagagcggcgtgggcgtggcgtcgatgggggtcatgcgcccggagctggtcatgaagtccatcgtgcccgtcgtcatggcgggagtgctcgggatctacggcctcatcatcgccgtcatcatctccaccgggatcaaccccaaggccaagccttacttcctcttcgatggctacgcgcacctctcctccggcctcgcctgtggcctcgcggggctcgccgccggcatggccatcggcatcgttggtgacgccggagtcagggccaatgcgcagcagccaaagctgtttgtgggcatgatcctcatcctcatcttcgctgaagctcttgctctctatggcctcatcgtcggcatcatcctctcctcccgtgcnggccaatcccgcgcngactagaacaaagcccttgcaagaanggngcacactgtcccaccgttacattctatttcagagtggtgatttcttcctagagaactgttttggccttacgttgtggttcttccttgtccatatgaacataatgtgggtgggatcgtagaggtctccacgccctccatctcttgtaattttattcagtcggcaacacaaagctatcatgtgtattacttgtatttagcgcctactgttgttgcgctgttgtatttaattgtttggaataataattggcgatgagccagcctg

SEQ ID NO: 1910 - DNA, 1259 bp, Picea glauca
ggatcgcttggataaagcggttggcggtcctctcctcgggccatttcattccgtttgtgccccggttacgtctctatatatgtctctatataccttatttctctttctctcagggatactagaggtcaacagatcgaggtttctcttttccacattaaaactctcattccatcttcccggcgagatcgtttaatccctgatttgcattaaaaaggccgatttcatttgaaaaatcagcagatcatcagcagagacgaaatggcggacgcattcagcggagacgaaatggctcctttcttcggattcatgggagctgcggcagcccttgttttctcatgcatgggggcagcttatgggacggcaaagagtggagttggtgttgcatccatgggtgttatgaagccagagcttgtgatgaaatctatagtaccagttgttatggctggagtgttgggtatatatggtttgatcattgcagttattataagtaccggaatcaaccccaaggctaaatcctattatctatttgatggatatgcccacttatcatcagggctagcttgtggtctatctggtttgtctgcaggaatggcaattggcgttgtgggtgatgctggtgtcagagcaaatgcccagcagcctaagctttttgtgggtatgatcctcatactcatttttgcagaggcacttgccctgtacggtttgattgtggggattattttatcatcccgagctggtcagtcaagagctgactgatagaagtttatcatgccaggacacttgattgattggggtttcatgtaaaaagaaccctctgtttcagagaattcattatactgactcaatatattttgttatgcttatgttgttgcttttttagtaagaagcatattttcattgttgctttgttattgaatatcataacttatcgatggttgggaatatggtgaccttgataaatccaaggtgatgcttggtttaatgttcattcagaaatgtggatgttgtgtaagtttattccattttagagttcatgggcaaattctaccccacaaggttaataagatcatttgcactgaatcattgtctttgtattgagctaatttttttatatgatatatgttagtggatttagctctatggtaccgagctttcttgttcagtttagcttatttccataatgtgagttggaaaaaagagggttcagtgtttttggttgcactctccaaaacttctagagtgcgaagtgatgtatgatg

SEQ ID NO: 1911 - DNA, 762 bp, Phalaenopsis aphrodite
gtgcttcttccttcttctccggcgacgagataaggagggaggtagggggagggatagagaggagaaaattttcctaagaagatccgatcatcttccaatcaaccgaaatggccggattcagtggtgatgaaaccgctcctttcttcggcttcctcggcgccgccgctgcccttgtcttctcttgcatgggagctgcttacggaacggcgaagagtggtgtcggcgtggcttcgatgggggtgatgagacctgagctcgtgatgaagtcaatcgtgccggtggttatggctggagtgctaggtatctatggccttattattgctgttattatcagcacggggataaaccccaggcgaagtcttactacctctttgatggctatgcgcatctgtcatctggtttggcatgcggcctcgctggtctttctgccggtatggctatcgggatcgtgggtgatgccggggttagataatttgcagagccaatgcacagcagccgaagctgttcgtggggatgatactgatactgatatttgctgaggcgttggcgctctatggattgatagtgggcataattctgtcgtctagggctggccaatctagggctgattaaaattcttgctcttctttggttatctctatagcttccagcatttgaaccgggccttgtgctatttaggaaccacttttatattcagaacgttttaataagatcttctgctagtcgattgctacagactctatttattacatacatatatat

SEQ ID NO: 1912 - DNA, 901 bp, Abies balsamea
tttctctcctttgacaacaataatctctttcctttactacccggaaggtcgtttaacctctaatttcattaaaaaggccgatttcatttgagagataagcaggtcatcagccgagccgaaatggcggcggacacattcagcggagacgaaatggctcctttcttcggattcatgggagctgcggcagcccttgttttctcatgcatgggggcagcttatgggacggcaaagagtggagttggagttgcatccatgggtgttatgaggccagagcttgttatgaaatctatagtaccagttgttatggctggagtgttgggtatatatggtctgatcattgcagttattataagtactggaatcaaccccaaggctaaatcctattatttatttgatggatacgcacatttatcatcagggctagcttgtggtctatctggtttgtctgcaggaatggcaattggcattgtgggtgatgctggtgtcagagcaaatgcccagcagcctaagctgtttgtgggcatgatcctgatactcatttttgcggaggcacttgccctgtacggtttgattgtggggattattttagcatcccgagctggtcagtcaagagctgactgacacaagtttattgtaccgggacactttgattggggcttcatttaaaaagaaccctacgtttcagagaattcatgatagtgactcaatatcttctgtgtattttttttatctcaagtttccgttaacttggttatgcttatagttgttgcttctttattaggaagcattttttcattgtggctttgttgttgaatatcataacttattgatggtggtgaatatggtcaccttccttcataaatccaaggcgatgttcggtttaatgttcattcagagatat

SEQ ID NO: 1913 - DNA, 939 bp, Ceratodon purpureus
ctctcgccgaggaggaaggaagcccaagctccgggacatcatctctgcgagccgcgatctgcaccgccatctcgcagcgttaatctcaccccgtgcttcacctcgtcctcctcacatcaaccctgaatcgtttcgcacttggagttgccgtgattaagtttgagcgccatgtcgacatccgcggtcttcaacggcgatgagatcgcgcccttcttcggcttcatcggcgccgctgccgcgctcgtcttctcatgcatgggagctgcatatggaacagccaagagtggagtgggagtcgcgtccatgggtgtgatgcgacccgagctggtgatgaagtccattgtgcccgtggtcatggctggagtgttgggtatttacgggctaattatcgctgtgatcatcagtacgggaatcaacccgaagtcgaagccatactacgtgttcgacggctacgcgcacctgtcatccggtttgtcttgcgggttggccggtctgtctgcaggcatggccattggtatcgttggagatgccggtgtcagggccaatgcacaacaaccgaagctgttcgtgggcatgatcctgatcctgattttcgccgaggcgcttgctctatacggactgatcgtgggcatcatcttgtcttcccgtgctggacaatcacgagctgactaggttagctagagagttagcttcggttccatttgttgtaagcatgttgtggctacctgcttcagagaacgggttggtaggtcgagtattgtagggtattcttttgtatgtagaatgaagaaacagatgttgcagattgaagttctcaatatcgactactcttgattgactgcatctttaattattgtagaagggctttttcaccttgaataagatatcatacttaagcaaagaagatggtggaagagttttacctagtgagcatgtttt

SEQ ID NO: 1914 - DNA, 964 bp, Physcomitrella patens
cttactccttacttcttcactcgatcctgctggcttagatccgttcttcccaggacacagctttcactttcagtctacttcacttctctcgatccccagttgtttttcctgtttcgtttacgtcctgaattaataccggcgccatgtcgacctctgctgtgttcaacggagatgaggtcgcccccttcttcggcttcattggagctgcagctgctctcgtcttttcatgcatgggcgctgcttatgggacagccaagagtggagtgggagtggcatccatgggtgtgatgcggcccgagctggtgatgaagtcgatcgtgcctgtggtcatggctggagtgttgggtatctacgggctgattatcgccgtgattatcagtaccggaatcaacccaaagtcgaagccctactacgtgttcgacggctacgcgcacctttcatctggattgtcgtgtgggttggctggtctatcggcaggcatggccattggtatcgtcggagatgctggtgttagggccaatgcgcaacagcccaagctgtttgtaggaatgatcctgattctgattttcgccgaggcgctggctttatacggacttatcgtgggtatcattctgtcttcccgagctggccaatcacgagctgactaagatggcaccagtatgagcatgcttttctgtttgtaagatggatatgagtagtataagagacccctctgagtagaggcaggcaaaagtgggtagaggattcccaacatctactgctttcaatacatcacaatgcttgattgtggagaacagttgagcgtcatagtttcaaatactgagatcaagataagtagtgaaacacacgctgcgattggtggaaacgctgtccaatgtcattgccgttgaattttaaagctgcagcaaagacggagcgaatcacgttttcagaacacacaccatgtattggacacgatggactc

SEQ ID NO: 1915 - DNA, 1165 bp, Physcomitrella patens
tcatttcgacactcgctcgctcgagccccattgttgcgtggatctgctcctccccacgacccatctcccaatttttctccctcgcttgccgtcccgccatacccacttttcatttttgttttctcttgttggatttgcgtccttgtatcgaagccggcgccatgtcgacctctgctgtgttcaacggagatgaggtcgctcccttcttcggcttcattggagctgcagctgctctcgtcttctcatgcatgggcgctgcatatggaacagccaagagtggagtgggagtggcatccatgggtgtgatgcggcccgagctggtgatgaagtcgatcgtaccagtggtcatggctggagtgttgggtatctacgggctgattattgccgtgatcatcagcacgggcatcaacccgaagtcgaagccttactacgtgtttgacggctacgcgcatctttcatcgggattgtcttgcgggttggcaggactgtcggcaggcatggccatcggtatcgttggagatgctggtgtgagggcgaatgctcagcagccgaagctgttcgtggggatgatcctgatcctcattttcgctgaggcgcttgccttgtatggactgatcgtcggcattatcttgtcttcccgtgctgggcagtcccgagctgactaggccatcgtcgagtggagtaagtaccttctagcagtgctacaggtgtgctcatctatctgaggtggtcacagcagggacctgtgcaggagcgttcacttgtaccggttttttttcatagctaacgattacgaagcatagcgcagagcctggaaacttgtagttggggaattaaagttgtcatgttattgttgtgtatgtagagtttgggcaaattatccttattcttggtgtctataatgtaggacatcgctagaaccacgcttgtcaagtgcaagtgaattgtgaaagaggttttaattgtctctttgattcaaatcggttgttcattgtgagttcacatcggtagccttttgtgaagaagcagcagttttttcttcagttagttgatgctgcaacccgttgttgaattggtcaactccagcttttgtacctggacacttctaatttcagtggtggctcacttggaatgctgctactaattgctaaagatactttcgaaa

SEQ ID NO: 1916 - DNA, 1230 bp, Physcomitrella patens
gcggccgtggccgagtttgcttgcaagctcagtcccaccctcgcgagagccccccccccagtttattctattccttctcgacagcctgtgttacccagatctgtcacttgcagcatacatctttccatctcccctgctcaggacctccctccccacttgcccattcgaaatttctctctctcctctcccctcttcgtttcgaattcgatccggcgccatgtcgacctcggcggtgttcaatggggatgaggtcgctcctttcttcggcttcatcggagccgcagctgccctcgtcttctcatgcatgggcgctgcatatggaacagccaagagtggagtgggagtggcatccatgggtgtgatgcggccagagttggtgatgaaatctatcgtgccagtagtcatggctggagtattgggtatttacggactgattattgccgttatcattagcactggaatcaaccccaagtcaaagccctactacgtgtttgacggctatgcgcatctttcatctggtctgtcatgtgggttagccggcctgtccgcaggcatggcgattggcatcgttggagatgctggtgtcagagcgaatgcccagcagcccaagctcttcgttggtatgattttgatcctcatttttgccgaggcgcttgctttgtatggacttatcgtcggcatcatcttgtcttcccgtgctggacagtcccgagctgactagaccaacgttgatcaggttcgatgttttccgacagtatagaaggtgtgagcacacgtcctagatggttattagcagaggcttgtgtatgaccattcactggaatcggttttccccttttgcagaggatgttgtagcagaggcttgtagtcattggcaaatttgattttttaatgtagcgtttggatagatgtcccccgccatgatgtcgataccaatgacaccttataaatcatgccggtcaacttcaagtgggtggtttgaagggctttgaattcttcgtttttttgatgcaatttcattgattattgagattgattactctagaaatcattttcttctagttaagctgcatctctggtctaatcatagcatgtatagttctggactgtgtaccaattctgcaaaatgctttcccatttgtttagaacctacacatatgtagaactcaaatgagtgaaactttctctattttatgccagttgtaatgcgaaaattccaaattcacggtc

SEQ ID NO: 1917 - DNA, 983 bp, Pteridium aquilinum
cccgtgagttggcatgccaaaagtgtccgggcgggtagtgtgacaatataagggccgggctcttggccacgtttttttgcggcgctgtgacggggagggatcttactttctgcagatttccgagaacgagaaagaaatttagcagagagaaaacatgtcaaccactgaattcaatggggacaccacggctcccttcttcggcttcctcggtgcagcggcagcacttgtcttctcctgtatgggcgctgcatacggaactgcaaagagtggagtgggagtggcatccatgggcgttatgaggcctgagctggtcatgaagtcgattgtgccagttgtcatggctggtgtgctgggtatatatggactaattattgctgtgattatcagtacaggaataaaccccaagagcacagcatactatttatttgacggctatgctcatctctcgtctggtttagcttgtgggctagccggcctgtctgctgggatggccataggtattgttggtgatgcaggtgtaagagcaaatgcacaacaacccaagctgtttgtgggcatgatcctcatcctcatctttgcagaggctctggctctctacggattgattgtgggaatcatcctgtcatctcgtgcagggcagtcaagggaatgacaagtctgtgtggcgaagatctgaaggaccttttggattatttttgactgcgttgaagcttttttttgggaactgtttttgaactcttattcttcatcatttgttttcccaactagagcaatgccattcattaccattgcgtgtatattcattccattgtcaaagcaatcaaaatttagctggcttcgcaatagttgaaggttaaagctaagatccgagtttcatggtgtggctagacattctcatctagccatttaccattgataggaacctgaagggctgatcaagatgtggcattgggttatttatgagggtttttattcaaaaagaa

SEQ ID NO: 1918 - DNA, 657 bp, Selaginella moellendorffii
ccggcgtggattgccggggagcaacgcaagtcgggggagattcatggcttccaccgacgcattcagtggcgatgagacggcgcccttcttcggattcattggcgccgcggcagctctggtcttctcgtgcatgggagctgcctatggaaccgcaaagagtggtgttggagtggcatccatgggcgtgatgcggccggagctcgtgatgaaatcgatcgtgccagtggtcatggctggagtgctgggaatctacggcctcatcatcgctgtgattatcagcacgggcatcaacccaaaggcaaagtcctactacttgttcgatggctacgctcatctatcgtccgggctggcttgcggcctcgcgggtctctcggctggaatggcaatcgggattgtcggtgacgctggagtccgggcgaatgcgcagcaacccaagctttttgttggaatgatcctcattctcatctttgccgaggctttggctctatacggtctcattgtgggaatcatcctgtcgtcccgagctggccagtcgagagggtaagcacagcagcagcaagattaaggtggtgcataagccagcattttagcgcttttttttttcttcttactacctgtattattactattccttccaataatcctcgcttttctcgt

SEQ ID NO: 1919 - DNA, 674 bp, Selaginella moellendorffii
ctaagggatagatccggcgtggattgccggggagcaacgcaagtcgggggagattcatggcttccaccgacgcattcagtggcgatgagacggcgcccttcttcggattcattggcgccgcggcagctctggtcttctcgtgcatgggagctgcctatggaaccgcaaagagtggtgttggagtggcgtccatgggcgtgatgcggccggagctcgtgatgaaatcgatcgtgccagtggtcatggctggagtgctgggaatctacggcctcatcatcgctgtgattatcagcacgggcatcaacccaaaggcaaagtcctactacttgttcgatggctacgctcatctatcgtccgggctggcttgcggcctcgcgggtctctcggctggaatggcaatcgggattgtcggtgacgctggagtccgggcgaatgcgcagcaacccaagctttttgttggaatgatcctgattctcatctttgccgaggctttggctctatacggtctcattgtgggaatcatcctgtcgtctcgagctggccagtcgagagggtaagcacagcagcagcaagattaaggtggtgcataagccagcattctagcgctttttttttcttcttactacctgtattattactattccttccaataatcctcgcttttctcgtatgtt

SEQ ID NO: 1920 - DNA, 679 bp, Secale cereale
cgcccccttcttcggctttctcggcgccgccgcggcgctcgtcttctcatgcatggggcggcctacgggacggccaagagcggcgtcggcgtggcgtccatgggagtcatgcgcccggagctcgtcatgaagtctatcgtgcccgttgtcatggctggagtgctcggtatctacgggcttattatcgccgtcatcatcagtaccgggatcaacccctaaggccaagccctactacctcttcgacggctacgcccacctctcgtccgggctcgcctgtggccttgccggacttgctgctggcatggccatcggcattgttggtgatgctggagtcagggcaaatgctcagcagcccaagctgtttgtcggcatgatcctcatcctcatcttcgcagaggcgctcgctctctacggtctcattgtcggcatcatcctgtcatcccgagctggccagtctcgtgccgattagccaattaggcatgttccacacacgcggccctgtgtgccctcttgttttatattattcagacagcaaactgagctctagaggttatcatgtctagttttcattcttctgtttggtggagaaaaaaacatctgtagccaagggagttttgcccttgatgtaccattcttttcccgtcaagatgctgggagggggttggtgcttatgtatgca

SEQ ID NO: 1921 - DNA, 673 bp, Ocimum basilicum
attcagtggcgatgagacagctcccttttttcggattctttggcgctgctgctgcccttgtcttctcctgcatgggtgctgcctatggaacagctaagagtggtgtaggcgtggcatcgatgggagttatgaggcctgagctggtaatgaaatcaattgtgccagttgtcatggctggtgttttgggtatctatggtttgattattgccgttattatcagcactggtattaaccccaaagccaagtcctattacctttttgatggttatgcccatctctcttctggtcttgcctgtggcctagctgggcttgctgctggaatggctatcgggattgttggagatgctggtgttagggctaatgcacaacaaccaaagttgttcgttggaatgatccttattctcatttttgctgaagctttagcgctctatggtcttattgttggaattattttgtcttcacgagctggccagtctagagccgactaggaagcaaatcatcaattatagttctcctgaatcagagctgggagaaattgaccgtggcaggtttcggtggaccattttgcactaccattaatttccacatttgatcgtgctcggttttcttgtgtcttgagtccttgatgctatttgtatacaaatattgatcctctccagaataaaaagctttt

SEQ ID NO: 1922 - DNA, 649 bp, Hevea brasiliensis
gcaaggcgataaacgattatgaataatcaatcacgtgattcataccatccttcgctgatccgatcttccctgctctctgaaagccagataaggaaaccggaactgcagagatcaaggctcaagcacagtattacagcaattattctctgatctccgttaccgaatacccaatccaagtatgtcttcaggtttcagcggcgatgagactgctccttttttcggcttcctcggagccgccgcagctctcgtcttttcttgcatgggtgcggcttatgggactgcaaagagtggggtgggtgtggcttccatgggagtgatgcgacccgagctcgtaatgaagtcgatagttccagtagttatggctggagttttggggatttacggtttaattatagctgttattattagtactggtattaatcccaaggctaaatcttattatctttttgatggttatgctcatttgtcctctggtcttgcttgtgggcttgctggtttatctgctggtatggcaattgggatcgttggtgatgctggagtccgggctaatgcacagcaaccgaagctgttcgtaggaatgattctcatccttatctttgctgaagcacttgccctctacggtcttattgtgggaatcattctctcatcc

SEQ ID NO: 1923 - DNA, 850 bp, Juglans hindsii x Juglans regia
ggggatacgaggactgggacggtgcgatctacggaacaacaacaaaaactggaaattctcttctcagatttatagcaaaagtgaaatgtctcacggtgatgagaccgccccattctttggcttccttggcgctgccgccgcccttgtcttctcctgtatgggagctgcgtacggaaccgcaaagagtggggtaggcgtggcgtcgatgggtgtgatgaggccggagctggtgatgaagtctatcgtgccggtggtcatggctggagtgttgggtatctacggtcttatcattgccgtcatcatcagcaccgggattaaccctaaggccaaaccctattacctcttcgatggctacgcacatttctcctccggtctctcttgtggcctcgctggcctctctgccggcatggctattggggtcgttggtgacgctggtgttcgagcaaatgcacaacagccaaagctctttgttgggatgatcctcattcttatttttgctgaagcattggcgctctatggtcttattgttggcatcatcctctcttcccgagctggtcagtcaagagctgaatgaatgtgcacattcttctgctgggtggttgtgttttgtttctgtcaagccaaaagttttctttgttactacagattcttgttgatgagggtgattgtcttcccatttctatcaggaagtgtcatgttatggtgctaggatatagaattagaaattagtttttccgcttaataagttcaattcttcatctatatgattatgcattatgcggatttaattagaggctgtctagaaatagtgtatacttttataaaggatttagccaattaaaggctgtct

SEQ ID NO: 1924 - DNA, 903 bp, Ceratodon purpureus
ctctgcaggtggctttcactccacaccattcttcgcatcagccatctcgctctccgatctgcgaccgccctcgcccccgcgcttgcccccactgcgccctcgcttcactcctccgggcgccatgtcgaccgccgcggtcttcaatggcgatgaggtcgcgcccttcttcggcttcatcggcgctgcagctgcgctcgtcttctcctgcatgggcgctgcttatggaacggccaagagtggagtgggagtcgcgtccatgggtgtgatgcggcccgagctggtgatgaagtccatcgtgcccgtggtcatggctggagtgttgggtatctacgggctgatcatcgctgtgatcatcagtacgggaatcaaccccaagtcgaagccatactacgtgtttgacggctacgcgcacctgtcatctggtttgtcgtgcgggttggctggtttgtctgcaggcatggccattggtatcgttggagatgccggtgtcagagccaatgcccagcagcccaagctgttcgtgggtatgattctcattctcattttcgccgaggcgcttgcattgtacggacttattgtgggcatcatcttgtcttctcgtgctggacagtcccgagcggactgagctaccagctttgaatctgtatggtagtggcggagctgggagcaggtgaacccagaaatctggaccatcgtatcaaggttgtagagcaggtggacccagaaatttgcggtctgaaaccctctctgtagaggtttttcttgcatgaaacagataatgcacatagcctttaagattatgatccgtgcaaagagtatcggtaatactatcattgtaaattttgatttaagaaagtcattctaattgaatattccagcgaactacgcgattaacttcgcaat

SEQ ID NO: 1925 - DNA, 843 bp, Ceratodon purpureus
acgccttgagtgagccgcgatctgcaccaccctcgcggatcgccactctcaaaatcccacctccacttccacctccacctcgccttcttctgctggagctccctctcgcatcagaccacgcgcatcacttggaggaagctcgagtgccatgtcgaccgccgcggtcttcaatggcgatgaggtcgcgcccttcttcggcttcatcggcgctgcagctgcgctcgtcttctcctgcatgggagctgcatatggaacagccaagagtggagtgggagtcgcatccatgggtgtcatgaggcccgagctggtgatgaagtccatcgtgcccgtggtcatggctggagtgttgggtatctacgggctgattatcgctgtgatcattagcacgggaatcaacccgaagtcgaagccatactacgtgttcgacggctacgcgcacctgtcatccggtttgtcgtgcgggttggccggtctgtctgcaggcatggctatcggtatcgttggagatgccggtgtcagggccaatgcacaacaaccgaagctgttcgtgggcatgatcctgatcctgattttcgcggaggcgcttgctctgtacggactgatcgtgggcatcatcttgtcttcccgtgctggacaatcacgagctgactaggttagctagagagttagcttggttttcatttgttgtaagcatgttgtgcctacctgcttcagcgaaagaggttgagaaatgtaggttattctttctgtgtgctgaatcatcaaacaaatcttgcagattgaatttgtcaatataggctgcttttgattgatcgaaatgagaatggaggggttttgttcaac

SEQ ID NO: 1926 - DNA, 1126 bp, Ceratodon purpureus
cgaatcgctcgccgcttctgcgaatcagaacctcggaacgcaacccatcgcatcgcatcgcaacgcaacgcaacgcaacgcagagctcttcacttcacttgcttctcgcgcggtgctcactgcgcccaccagatctgctccatcgcctctcactcttgtgctctctgccctaccggtctcgaattcctgcatctgcttgtgctgggcatcttgggagcaaggcgtccgccatgtcgaccgccgcggtgtttaacggggatgagattgcgccattcttcggcttcatcggagccgctgctgcgctcgttttctcatgtatgggtgctgcctatggaacagccaagagtggagtgggagtggcgtccatgggtgtgatgcgtcctgagctcgtgatgaagtccatcgtgcccgttgtcatggctggagtgctgggtatctacgggctcattattgctgttattatcagtacaggaatcaaccccaagtcgaagccatactacgtgtttgatggctacgcacatctgtcgtctggattgtcttgcggtttggctggtctgtctgcaggcatggccattggcatcgttggagatgccggcgtcagagccaatgctcagcagcccaagctttttgtgggaatgatcttgatcctcattttcgctgaggcgcttgctttgtacggacttatcgtgggcatcatcctatcttctcgtgctggacagtccagagctgactaaggtactatggtctaagggagagagtgtttttcttagtagatgtgcctaaacggccgagatgttttagcaggagcttgtgtacgatcattcacttgtagtggtcttctccctcgatgtggaaggtgcagcacacatgatttatcttttctttattgtatatgtagatttgggactcaggttcctcattcacgattgtcatatttacatttcaaagtttgcactggctaagtgcgagtggattgttcaaatatttttcgagagttcaggttgtatttcttgctcaggatataaccctcagacgtcatctattcttgagaagcaccacagtctggtctctctaaacgttagaaatcttggccaagagaaaaatgtttattagaaaatactgagac

SEQ ID NO: 1927 - DNA, 594 bp, Adiantum capillus-veneris
catgttcctcgcccgagagagagagagagagagagagagagagattggggggttaactgttgccgtgtgcaggaagaggcccgggctgacccttactcgtcatgtctaccacagaattcaatggcgacactactgcgcccttctttggttttcttggagctgcagcagcccttgtcttctcttgtatgggtgctgcatatggaacagctaaaagtggtgtaggtgtggcttcgatgggtgttatgagaccagagttagtgatgaagtctattgtgccagtagttatggctggtgtgctgggtatttatggcttgattatagccgtgataataagtacaggcatcaatcccacgagtacagcctattatctatttgatggctatgctcacttatcgtctggcctcgcttgtggtttagctggtctttctgctggaatggctattggtattgttggcgatgccggtgtaagagcaaatgcccaacaacccaagcttttcgtgggaatgatactcatactcatctttgcagaggcccttgctttatatggtttgattgtaggtatcatcctctcttctcgtgctggccaatcaaggg

SEQ ID NO: 1928 - DNA, 830 bp, Nicotiana benthamiana
  misc_feature (288)..(288): n is a, c, g, or t
  misc_feature (412)..(412): n is a, c, g, or t
  misc_feature (414)..(414): n is a, c, g, or t
gcacgaggggaaaaattgtcatcaaaattccgatcggtcactggcgaaatctctgataaactgaaaaaaatgtcatcaactttcagcggcgatgaaacggcgcccttcttcggtttcctcggagcagctgcagctctcgttttctcctgtttgttctgcttatggaacggcgaatagtggggtgggggtagcctcaatgggagtaatgaggccagagcttgtgatgaagtcaattgtgccggttgttatggccggagtgttaggtatttatggtttgattattgcggnaattatcagtacgggaattaaccctaagaccaaatcatattacctttttgatggatatgcgcatctttcttctggtttggcttgtggtctggctggcctttccgctggaatggctattggaatngntggtgatgctggtgttagagcaaatgcacaacaaccaaaactgtttgttggtatgatcctgattctcatctttgccgaggcattggctttatacggactgattgtcggcatcatcctttcttcccgtgctggtcaatttagagcagaatagaaattaatgatttccaggttcatgatggaatcattttgcatcattgtgctggcagtttggtaactgatactggtttagaagatttattctaatccgtccccctgtgtagatttggaagctgcttttttccctgcatgcaatctagagaacgttcttttaatttttccaattgctatattttgcaataatgaggagcatcttgttggttgaatgctgatacaattgtatatttttgttggaatgcatttattacctcggtaaaaaa

SEQ ID NO: 1929 - DNA, 583 bp, Brassica juncea
aaaaaacgcagcgatatccacgctgctccatctctctctcgccagatatcaatcaatcatcgactcgctcctcagatttcagatccaaatctacacaccaaagcttcaacatgtctaccttcagcggcgatgaaacagctcctttcttcggcttcctcggcgccgcagccgctctcgtcttctcctgtatgggagctgcttatggaacagcaaagagtggagttggtgtggcttctatgggagtcatgagacccgagcttgtgatgaaatctatcgtccctgttgttatggctggtgtcttgggtatttacggattgattattgctgttatcatcagtaccgggattaaccccaaggctaagtcttactacctcttcgacggatacgcccatctctcttccggtcttgcttgtggtcttgctggtctttccgctggaatggccattggtattgtcggagatgctggtgtcagggcaaatgctcagcagcctaagctctttgtcgggatgattcttatccttatcttcgcagaagcgcttgcgctttacgggcttattgtaggaatcatcctctcctctagaga

SEQ ID NO: 1930 - DNA, 476 bp, Brassica juncea
tgaaaccgctcctttcttcggcttcctcggcgctgccgcagccctcgtcttctcctgtatgggagcagcatatgggacagccaagagtggtgtgggagtggcatcgatgggtgtgatgaggcctgagttggtgatgaggtcgattgtccctgttgttatggctggtgttttgggtatctatggtttgattattgctgttatcatcagtaccggtattaaccccaaggctaaatcttactacctcttcgacggatatgcacatctctcttctggtctcgcttgtggccttgctggtctttctgctggaatggccattggtattgtcggtgatgccggtgtcagggcaaatgctcagcagcctaagctctttgtcgggatgatccttatccttatcttcgcagaagcgcttgctctttacggccttattgtgggcatcatcctctcctcaagagctggccagtctagagcagaatgag

SEQ ID NO: 1931 - DNA, 806 bp, Zostera marina
cgtttatatctatataatcagctccccattttcttccttgtatgatcggatcatctcgtcatttttaaaattttagaattttttcctcggtctctcgatcttcaaacgacaatgtcaacgacaaccttcgccggcgatgagacagctccattctttggattcataggagccgcatctgcccttattttctcctgtatgggagcagcgtatgggacggcgaaaagtggagttggggtggcatcgatgggagtaatgcgaccggagttggtgatgaagtcgatcgtgcccgtcgtcatggcgggagttcttgggatttacggacttatcattgctgtcattattagtactgggattagtcccaagacaaagagctattatttgtttgatgggtatgcacatctatcatcaggtcttgcctgtggtctcgccggactttctgccgggatggccatcgggattgttggtgatgctggtgtcagggccaatgcgcagcagccgaagctctttgttggtatgattctcattctcattttcgcagaagctctcgccctttacggtcttattgtgggtatcatcctctcatctcgtgccggccaatctcgcgaagtttagtaggtctgattatttgttatgtttacttgaagaaggaaagaagaaaatgaatgaaaagtgtattgggtaaatttaaaagtctttttattccatgtttattatcatttcatcaagtaaatcaataaattaaaactttatctttatacctatgtttgcaagttctaatttttctcctccccttttgaggaaatcac

SEQ ID NO: 1932 - DNA, 1256 bp, Physcomitrella patens
gccctatcagcgcgggcaccgttctggccccgcggcctcgcggccccgtcgccactccggctcctcgtcctcctcccgcatcgcctttgtgtgttacttgcagccctcctcgcttgctgggatccccagatccgtcgcgttactcttcgcagcccagtgccaatctgccactgcgactttggcctgcgcgctctctctctctctctctcactcaacctgctagacaccatgtccactgctgctgtgttcaacggggatgaggtcgcccccttttttggcttcattggagctgcagctgccctcgttttctcatgcatgggcgctgcatatggaacagccaagagtggagtgggagtggcatccatgggtgtgatgcggcccgagctggtgatgaagtcgatcgtgccagtggtcatggctggagtgttgggtatctacgggctgatcattgccgtgatcatcagcacgggcatcaacccgaagtcgaaggcttactacgtgtttgacggctacgcgcatctttcttcgggattgtcttgcgggttggcaggactgtcggcaggcatggccatcggtatcgttggagatgctggtgtgagggcgaatgctcagcagccgaagctgttcgtggggatgatcctgatcctcattttcgctgaggcgcttgccttgtatggactgatcgtcggcattatcttgtcttcccgtgctggacaatcgcgagccgactagagtcgcaccaggatgagcttactgttttgtttgtaaccttgatgtggctagtgtgagattactcagtctgagctatggtacgtggagtttgtagatgatgctccttgcagtgcagctgcatcacaagttatgaacgattatttagatgtatacagacttattgttgtacactgttgataaagaatcggatgtttcaagttgaattattgaacatctactgccgttaattaatcatataatctaactgtaacgaccagtagaattttacgaagtgaagcaataagatcgagagataagagaatatgtatactaggattggttagaatactacgaaactacgactgtttggaacactagctttgagcccggccaggagagaattcgtgggtttgatgcaaggcatctagtcgataatgtgcaagagttggagttttcagactgcatgtggttcatgttgtttccggcgtattacctgcttccaagggcctggtaatcatatcaatttatgctctccttccaatcca

SEQ ID NO: 1933 - DNA, 810 bp, Physcomitrella patens
attactctcgtggaggttctcgtgttgtttctcattcttcgacgctggatttcttgctctcgccgagttcgcgtgggattctttctcgatcatcatgtcgactgccgcggcgttcaatggagatgaggtcgctcccttcttcggcttcatcggagctgcagctgcccttgtcttttcatgcatgggcgctgcctatggaacggccaaaagtggagttggagtggcatctatgggtgtcatgcgacctgagctagtgatgaagtccatcgtcccagtggtcatggctggagtgttgggtatttacgggctaattatcgccgtgatcattagtaccggaatcaaccctaagtcgaagccctactacgtgttcgacggctatgctcacctttcatctggtttgtcgtgcggtctagctggtctgtccgctggcatggccattggtattgttggagatgctggggtcagagccaatgcccagcagccgaagcttttcgtgggaatgatcttgattctcattttcgctgaggctcttgccttatacgggctgattgtgggcatcattttgtcttcccgtgcaggacagtcccgtgctgattagactcacagccacatcttattggtcgaatagttgtgtcaattgtttcatgccttagagattcagagttctacagattggtgtctcgtgtaacgtctttttcagcatctgttcagatattagtagcatgtcttgtctccactttttctttctctttttttacttcaagaaatataaaatataaaatttcaataaatatttcaaaaatttccaac

SEQ ID NO: 1934 - DNA, 837 bp, Pteridium aquilinum
taaaatctaggttctgtagaggagcagctcttcacaaagagtcatcacaggctgagatctgtgtgcgcttgtagagatgacgaccaccgagttcaatggcgacaccaccgcccctttcttcggttttctcggagctgcagcggcccttgtcttctcctgtatgggagctgcgtatggaacggcaaaaagtggtgttggtgtggcctccatgggtgtgatgaggccagagctggtaatgaagtcaattgtcccagttgttatggctggtgtgctgggtatctatggtctcatcatagctgtgattatcagtaccgggattaaccccaaaagtacagcctactatctgtttgacggatatgcacacctatcatctggccttgcttgtggtttagctggactttctgcaggaatggccattggtatcgttggtgatgcaggtgtcagagcgaatgcacagcaaccaaaactttttgttggtatgatacttattctcattttcgcagaggcgcttgcgctgtacggccttatcgtgggaattatcctttcgtctcgtgctggtcaatccagagagtgatcgagagtcctggtttgctcttgccttgttggaaagcctacctttttggccttgactggcaagtaacgttgtatgtccttatgagcatgccatcaaggctcggaaagctttctttgttgctgatgaatgctgtggaggtaacagagatccactactgcacagcagatttgcttaaataattggaggacaagacattaacacttctgttttctggagacaataaaatggacagattggagtgctctttgtactgcacatttttc

SEQ ID NO: 1935 - DNA, 842 bp, Flaveria ramosissima
gggtgtggttttccagttttcatctccgatcccaatctcatcaatttcactccaattcacaacgacaatggcagattccacattcagtggtgatgaaaccgctacctttctttggattcctcggtgccgctgctgcactcgtcttctcatgtatgggggctgcgtatgggacggctaagagtggtgtaggtgtggcttcgatgggagtgatgagacctgagctggtgatgaagtctattgttccggttgttatggctggtgtgcttggtatttatggtttgattattgctgttattatcagtactgggattaaccctaaggcgaaatcgtattatctgtttgatggatatgcacacctttcctctggtttggcttgtggtcttgctggtctttcggctggaatggctattggaattgttggtgatgctggtgttagagcaaatgcgcagcagccaaaacttttcgtgggaatgattcttattcttatttttgctgaagccttggccctatatggtctaattgtgggtatcatcttgtcttcccgtgcgggtcaatccagagcagattaagatgaagaaaccttgccatgtatcggtatgtagttattctgaaaaaatgaagatttattccattttcgtcgcggtccccacttaaatctggcagctttcgaacaacacttattgctttcctcaaaattttcttcttggtagcatttctggtctcatttgccatcttgtatggtttttatgcctgtggaataagagttgagaacttgtgtggttctgtacttttgagtcgtactttaagccatgtagaaaccattgctatggcataatgtgttt

SEQ ID NO: 1936 - DNA, 542 bp, Papaver somniferum
aaaagagagagatccaaaatctctcagcgtagaaaaaaacaacactcagatccgatcgaattctctaaaacttgaaaatgtcttcgacgttcagcggcgatgaaactgctccgttcttcggctttcttggtgccgcagctgccttagttttctcctgtatgggagcagcttatggaacggcaaagagcggtgttggtgtggcgtcaatgggtgtaatgaggcctgaattggtcatgaaatcgattgttccagttgttatggctggtgtgttgggtatttatggattgattattgctgttatcatcagtactgggattaacccaaaggccaaatcttactacctttttgatggttacgcacatctctcatctggtcttgcttgtggtctcgctggtctttctgctggaatggcaatcgggatcgttggtgatgctggtgttagagccaatgctcaacagccaaagcttttcgtcggtatgatccttatcctcattttcgcagaagcacttgccctgtacggactcattgtcggtatcatcctg

SEQ ID NO: 1937 - DNA, 2447 bp, Zostera marina
gaaagatctataagcctgttgtcgataccgatcttggtccaaatagcaatgagatctacattacagcaaaagttaaagcacctcggattgctgggtttatcctaaagatttgtgtgtggtttttggagttgaagattattggagatattctggtgtatatacagataaaaaacaatcttatacacaagtttgtctcatttgccaaaatcaaggagccacctttgttcgctcctaaccatgcttgggaagatccaaaagaccaacatatcatctcagtaaatccagatctttcggcagtagaacgaattcgagaagctacaaaatgtttgcttgatccaagcattgagaagaaatatttgaattgttcttatatatttcacagatggacaattatggatttttcaagagcttataattcaggcgaaacatcaccccttatggtagcaaaaaagtttgtatcttcacttcaggactcttcaaagccccatctacaaatgtcatttttcattgaatacaacattgaagatattttggaacaagccagagaatcaactcacagatatcaaaatggccgtccgatctctgttcttgatggagtactgattgcagttaaggatgagatagattgcttgccatactccacaacaggaggaaccaaatggttacagaggttcagaacatgtaagaaggatgcagcttgtatcaagaacttgagattatgtggagccatacttgttgggaagaccaatatgcatgaacttggtattggaacaagtggaattaatcctcattatggagttactagaaatccttatgacccagaaaagattgcaggtggatcttcaagtggatctgctgctgttgtatctgctggactgtgtccagttgcacttggtgttgatggtggtggatctgtacgaataccggcttctctgtgtggtgttgttggtctcaagccaaccaatggccggttttctcatgatggtattattcctctaaattggacagttggaaatgttggagtattagcaggaactgttgaggatgcatttatcgtctatgctgctctaagtgatcatcttttatccagttgctcgacaaaagttcaggcaatattgaaccttcctcttctgaaatcaacgaacttagtgtcagacatcaaactggccaaatatgacaagtggtttaatcattgtgcggatgatattcaaatctgctgtgataaagctttaagcattctatgtaagaaacatgggtggaagaaatttcaaggaaataggttgtgatacaagaatagcgctatgcatgtacagatcattcagtgggagagattatctcaatgctcaaaaaatcagaaatcggcagatgtattttcacaagaaaatattcaaaactgcagaaatcatcgttgcacctacaattggagtaacagcatatccaataaaagacggcgttttcaagacaggtgaacttgattacaaaaatggagaagcactggttagattctctattgcagggaacttccttgggctacctgcaatcactgttatggttgggtatgacagaagtggccttcctgttggtcttcagttcataggaaaaccctggtctgaagcaaccttactccatcttgcatatgctatgcaggaactttgcatcaatgactacaaaaagcctaaaatcttctttgatgttctcaaaaaagactgatctgatgttctctaaaatcttctcttaagcaaccttactccatcttgcatatgatatgcagaatttttttcctcggtctctcgatcttcaaacgacaatgtcaacgacaaccttcgccggcgatgagacagctccattctttggattcataggagccgcatctgcccttattttctcctgtatgggagcagcgtatgggacggcgaaaagtggagttggggtggcatcgatgggagtaatgcgaccggagttggtgatgaagtcgatcgtgcccgtcgtcatggcgggagttcttgggatttacggacttatcattgctgtcattattagtactgggattagtcccaagacaaagagctattatttgtttgatgggtatgcacatctatcatcaggtcttgcctgtggtctcgccggactttctgccgggatggccatcgggattgttggtgatgctggtgtcagggccaatgcgcagcagccgaagctctttgttggtatgattctcattctcattttcgcagaagctctcgccctttacggtcttattgtgggtatcatcctctcatctcgtgccggccaatctcgcgaagtttagtaggtctgattatttgttatgtttacttgaagaaggaaagaagaaaatgaatgaaaagtgtattgggtaaatttaaaagtctttttattccatgtttattatcatttcatcaagtaaatcaataaattaaaactttatc

SEQ ID NO: 1938 - DNA, 562 bp, Epimedium sagittatum
aacaacagaggagaggagacgagatagaaaacagcaaattcagatctaagattctcagatccgatctccatctctgcatctcctaacctaaatggctacatctacattcagcggagacgaaactgctccgttctttggcttccttggcgctgccgcagcgctcgttttctcttgtatgggagctgcttatggaacggcgaagagcggtgtaggtgtggcttccatgggtgtgatgaggccagagttggtgatgaaatcgattgtcccagttgttatggctggagttttgggtatttacgggctcattatcgctgttatcatcagtactggaattaaccctaaggctaagtcttattatctttttgatggttatgcacatctttcatctggtcttgcttgtggtcttgctggactttctgctggtatggctattgggatcgtcggtgatgctggtgtcagagcaaatgctcaacagcctaagctatttgtcgggatgatcctcatccttatctttgctgaagctctggctctttatggcctcattgttggtatcatcctgtcc

SEQ ID NO: 1939 - DNA, 1044 bp, Zostera marina
cctaacgatcagaggcttctaggaagcggatcccaaattttcaaatccagcgtcctcagatcgcaatagccgcaagcacaagtttctcgtagatcctcacgatcttcgtacagatccgattaatcatgtctacaaccttcagcggcgatgaaacagctcccttcttcggcttcctcggagccgcatcggctcttcgttttctcatgcagtggggcagcatatggaacggacgaaagtgggttggagtggcatcgatgggagtgatgagaccggagcttgtcatgaaatccattgttcctgttgttatggcgggagtgcttgggatctatggtgtatcattgcattattattagcactgggataatcccaaggctaagtcatactacctcttcgatggctacgctcatctttcctctggtcttgcttgtggtcttgccggtctttctgccggaatggccatcggaatcgtcggagatgcgggagtcagggctaatgcacagcagccaaaactctttgttggtatgattcttattctctattttgtctgaagcttcttgcactttatggtcttattgttggcatcatcctatcatctcgtgccggccaactcccgagcagaactaaagcagcaaaagaaaaaacatgctattctaaggaaagtaaaacttactatacacttccttacaagttggttacaaattcttttatttccattattactaattagcgagcatgtagtaataataatttcctattgaagttcgtttttcctctctccgtgtggctttattacggcctttatttgacacaacatacaaaacttagtttaaaatgtggtgtggtgtggtgcagtgttgtatcttcttccttcattcccttcttttgttagggttttaaaaccctatattttgatgagtatgggttaccgttggtttattttcctttcataataaatttcatgcgatgcaatacaaatcttattttatataaaatattccttttaagatgaaaatatttgttataaattatattgtccaccccggt

SEQ ID NO: 1940 - DNA, 615 bp, Utricularia gibba
cttcctcggtgccgcagcagctctagtcttctcctgtatgggagcagcgtatggaactgcaaagagcggagttggtgtggcgtccatgggtgtgatgaggcctgagttggtgatgaagtctattgttccggtggtcatggctggtgttctgggtatctacggattgattattgctgtgatcattagtaccggtattaatcccaaggcgaagtcctactacttgtttgatggatacgcacatctttcttccgggctcgcttgtggtctcgctggtcttgctgccggaatggccattggaattgtaggggatgctggtgttagagccaatgcacaacagccaaaactcttcgttgggatgattctgatccttattttcgctgaagcccttgccctttacggtctcatagtcggcatcatcctctcttcccgtgctggccagtctcgggctgattagagaagttgagttctcccccttttagcacctgtatgagtatcagttctgctggtttttaccttcctcatgttatatatttgtgatggcacttgtttggccacagatgctggatatcaacatttgtgcctgtagaatttagttgagactgctttcactgaata

SEQ ID NO: 1941 - DNA, 841 bp, Adiantum capillus-veneris
agctctctctctctctctctctctctctctcactgtctgacactctaatctccaagcaggctgagatccaagtgcccctgtgaacatgacgaccacagatttcaatggcgacaccactgcgcctttattcggattcctgggagctgcagcagctctcgtcttctcctgtatgggagctgcctatggaactgcaaaaagtgatgtcgatgtaacttctatgggtgtcatgaggccagagttggtgatgaagtcaattgttccagttgtcatggctggtgtcctgggtatctatggcttgattatagccgtgatcatcagtacaggcatcaaccccacaagtacagcctattatctttttgatggatatgcgcacctgtcttcaggccttgcttgtggtttagcaggtctttctgcaggaatggccattggtatcgttggtgacgcaggcgtaagggcaaatgcacagcaaccgaaactatttgtgggcatgatacttattttgatttttgcagaggcacttgctctgtacggtcttatcgtgggaatcatcctctcctcacgtgctggtcaatctagggagtaatttatagcgtatgtcttgtgctcacccttcactaacgagcctgttgtgctgtgcaagtagtaatgctctcttgagcatgccatgatgactgttacggatatagaatgttttggaggttgtgggaagcagctgctgcaccagcagattttgttgaataagtcgaggagaatatgtcgattcttgggttgtttccaaaaataaatcagttgtatgaacatttttttagatatgcaaagagcagtcatgctgacaactttg

SEQ ID NO: 1942 - DNA, 774 bp, Carthamus tinctorius
  misc_feature (142)..(142): n is a, c, g, or t
  misc_feature (145)..(145): n is a, c, g, or t
  misc_feature (148)..(148): n is a, c, g, or t
  misc_feature (159)..(159): n is a, c, g, or t
  misc_feature (173)..(173): n is a, c, g, or t
  misc_feature (189)..(189): n is a, c, g, or t
  misc_feature (207)..(207): n is a, c, g, or t
  misc_feature (215)..(215): n is a, c, g, or t
  misc_feature (244)..(244): n is a, c, g, or t
  misc_feature (253)..(254): n is a, c, g, or t
  misc_feature (420)..(420): n is a, c, g, or t
  misc_feature (462)..(462): n is a, c, g, or t
  misc_feature (475)..(475): n is a, c, g, or t
  misc_feature (553)..(553): n is a, c, g, or t
  misc_feature (555)..(555): n is a, c, g, or t
  misc_feature (629)..(629): n is a, c, g, or t
  misc_feature (635)..(635): n is a, c, g, or t
  misc_feature (683)..(683): n is a, c, g, or t
gacaaccatcgaaaacatccagattgcagatccaaattctctgaattcatcacccttctcccatccaaattcaatcgattttcctcctcccaattttcatcaacaatgagttcaggttcgacgttcagtggtgatgaaaccncanccntctttggattnctcggcgccgctgntgcccttgtcttctcntgcatgggggctgcctanggaacggncaagagtggtgtgggtgtggcatccatgngagtcatgnngcctgagctcgtcatgaagtccattgttcctgttgttatggctggtgtgcttggtatttatggtttgattattgctgtcattatcagtaccggaattaacccaaaggccaagtcttattatctgtttgatggatatgcgcacctttcctctggtttggcttgtggncttgctggtctctctgccggaatggccatcggcatagttggngatgctggtgttngagcgaacgcacaacaaccaaaacttttcgtgggaatgattcttattctcatctttgctgaagctctggccctatacngnctcatcgtgggtatcatcttgtcttcccgtgccggtcaatccagagcagattaacaagatgaagaaaccgttcngtacgnatgtagtttattatgataaacgaagaccaatttcagtatgtgttgggnccccatttaatttgccagatttctagcaaacacttactcttgaattattatttttcagtagaagcatttctgccttatttgcattcttttg

SEQ ID NO: 1943 - DNA, 925 bp, Pteridium aquilinum
ataactcgagtatgctgaggtcgtacgtagaattcaggaaggcagggtaattgttggttacacagagaaggttgtttacgtgcttgcgagtagtcgtgatgtctaccacaggcgacaccactgccccttcttcggttttcttggagctgcagcagccctggtcttctcctgtataggtgctgcgtatggaactgcaaagagtggcgttggtgtggcttccatgggtgtgatgaaacctgagttggtgatgaagtcaattgttccagttgttatggcaggtgtactgggtatctacggcttaattatagctgtgataataagtactggaatcaatcctgagagtacagcctattatttgtttgatggttatgcacacctagcatcgggcctttcttgtgggttggctggtcttgctgctggactggctatcggtattgttggtgatgcaggtgtcagagcaaatgcacaacagcccaagctgtttgtgggaatgatactcattctcatttttgcagaggctcttgctttatatggtcttattgtgggtatcatcctctcatctcgtgctggccaatcgagagagtgaccattgcaagctctcttcctttgttgcacgctgtgtcctatttggtgcatgttatgtcacgcaacacatcgacacattgtaaagctcaaatatattttttctgtgagaaacatgcattaagaagttcgacgtcaaacaccttgaataagctgtaatcagaggaggaagtaatgtgtttaatctcaagtgctctttgcaatcataatcatgctttcgagaggtaatgtagcttacttctgctatccataattgagagcacatgttgtctattagggctcaaagtacagcatcaggtttggaatccgtaatgattaggagctggtaatttgtttgaatagg

SEQ ID NO: 1944 - DNA, 926 bp, Camellia sinensis
ggggagaacttcagatagagaaggaagatctgactccgaaaaaactctctctttttctttctgtacaccacaaattttctcgcgatccaaacacgtttcgtcgctgagaaaatccaatcgaatccaaaagatgtcttcgacattcagcggtgatgaaactgctcctttcttcggcttcctcggcgccgctgctgccctcgtcttctcctgtatgggagctgcgtatgggacagcgaagagtggtgttggagtggcgtcgatgggtgtgatgaggccagaactggtgatgaagtcgatcgtccctgttgttatggctggagtgttaggtatttatggattgatcattgctgttatcatcagcactggtattaaccctaaggccaagtcctattacctgtttgatggttatgctcatctttcctctggcctcgcttgtggcctcgctggcctctctgctggaatggcgattgggatcgtcggcgatgccggtgttagagctaatgcacagcagccaaaacttttagttggaatgatcctcattctcatctttgctgaagccttggccctgtatggtctgattgtggcatcatatgtcttctcgagctggtcaatccagagcagactgagaagatggttttcttaaccccaaaagaacgaaaaagttagaacagcgcttacagggttcttcaaattcttcagtttaaaagtaattaccaccctattacattcattttgtggctattcagtgctgtttgtagaataggcttttgagtttatctgccgaataaagctttgttaagttcttgtttggttttatctattgctgtactttgccattacaacttcagacctctggggactattattttggaactatgtgtgtatcatttattatttattaaatatggaatcgactattgtgtgtc

SEQ ID NO: 1945 - DNA, 763 bp, Amaranthus tuberculatus
ctgggtgccgctgccgctctcgtcttctcctgtatgggagcagcatatggaacagcgaagagtggagtaggagttgcgtcaatgggagtgatgagaccagaattggtgatgaaatcgatagttccagttgttatggctggagttttgggtatttatgggttgattattgctgtgatcatcagtactggtattaaccccaaggcaaaatcctactatctttttgatggttacgctcatctatcttctggtcttgcttgtggtctcgctggtttatctgctggtatggctattggtatcgttggtgacgctggtgttagagccaatgcccaacagcccaagctttttgttggaatgatccttatcctcatttttgctgaagctttggctttgtacggactcatcgttggtatcattctttcttcccgtgctggtcagtcaagagccgactaatagaggttcacccttgatctctgtgttatcaacgccattgctggagatgcaattatttcttgtcaaggcagtgaaagagtttatatgatcttattttattctagttatgattggtgattcttctttatgaggaatttttaaaccataatgtagagagtttagcgtctcctccaaataaagtgatgctgtattatttcccatttttgctcttcagtttggacattctgtaacatgttagatgttaaatattctttcgagcttttcggtttccggatttatatataaaagtttcattctgaggcctgagctactc

SEQ ID NO: 1946 - DNA, 820 bp, Brassica juncea
ttcctcggcgctgcagccgcactcgtcttctcctgtatgggagctgcatatggaacagcaaagagtggtgttggtgtggcgtctatgggagtgatgaggcccgagctggtcatgaagtccattgtccccgttgttatggctggtgtgttgggtatttacggcttgattattgctgttatcatcagtaccggtattaacccaaaggccaagtcttactacctcttcgatggatacgctcacctctcctccggtcttgcttgtggtcttgctggtctttctgctggtatggccattggtattgtcggtgatgccggtgtcagggcaaatgctcagcagcctaagctctttgttgggatgattcttatccttatcttcgcagaagcacttgctctttacgggcttattgtaggaatcatcctctcctcaagagctggccagtctagagctgaatgagatatgtaacccacaagattttcccccgaaggtactttattttctctgtgtgttttgttctatcgttcattagtatgtatcctctcgggaactgaaaaaaattattggacgctctcctatttctctctcggtggttgctctccgatgtagggatttttattattttgttctgtaataaagagctctgatggagcttggtatgtctttgtattcttgtattgtcctgaggaaagttaaatacatttatttgtaaagaagtttgctttctgaaaccatcacgagtctctctgattgcttttctctggtgtttgtttatcaactttgttgttgtgttttctttgaacaagttccatttgactttgatttt

SEQ ID NO: 1947 - DNA, 964 bp, Mesostigma viride
caagcattgtgcagctacgagcccgtgaagtcaattaatttaccttagcagcccgcctaatcggcgttgatctaaaacagtcaacgacaatgacggggcagtatggtgatgaaactgcgccattctttggcttccttggggccgcctccgccctggtgttttcttgtatgggcgctgcctatgggacagcaaagagtggcgttggaatcgcatctatgggtgttatgaggcccgagttggttatgaagtccatcattccagtcgtcatggctggtgtgctcggtatttacgggctcattattgccgtcatcatcaccacgggcattgcccccggcaaaaccccatactacctgtttgatggctacgcgcacctctcgtccggccttgcctgcggtctcgcgggtctttccgctggaatggccattggaatcgtcggtgatgctggtgtccgggctaacgctcaacaaccaaagctgttcgtcggcatgatccttatcctcattttcgctgaagcgctggctctttatgggctgattgtcggcattatcttgtcttctcgtgccggaactagccacggataaagtgtttctccccaacatcctggtgaaagccagaaaatgatatagctggccttatcatttggtaccctaaatgggcattgcttactgcttttacacagctgctcaggtatcgaatgtctccatgatccgtgctgtagtctgggttacgtattttggagattggtggcaagtttggagttttctgtgcagtggccatggctaaatggccaccatcgtttgacctggttgcatcttgtctagaccaacagttagggcctactgtcttctgttggctcgtagcatagttttgcgttcagtattgggcatcaagctcatgatctcacaggttagtctataatttgaagtattgatcaatcattggcggcaaagctccattatcaatg

SEQ ID NO: 1948 - DNA, 967 bp, Mesostigma viride
cggcacgagggaaagcaagcattgggcagctacgagcccgtgaagtcaattaatttactttacagcccgcctaatcggcgttgatctaaaacagtcaacgacaatgactgggcagtatggtgatgaaactgcgccattttttggcttccttggggccgcctccgccctggtgttttcttgtatgggcgctgcctatgggacagcaaagagtggcgttggaatcgcatctatgggtgttatgaggcccgagttggttatgaagtccatcattccagtcgtcatggctggtgtgctcggtatttacgggctcattattgccgtcatcatcaccacgggcattgcccccggcaaaaccccatactacctgtttgatggctacgcgcacctctcttccggcctcgcctgcggtctcgcgggtctttccgccggaatggccattggaatcgtcggtgatgctggtgtccgggctaacgctcaacaaccaaagctgttcgtcggcatgatccttatcctcattttcgctgaagcgctggctctctatgggctgattgtcggcattatcttgtcttctcgtgccggaactagccacggataaaaggtttcttcgtaacatcttgttgaaagccagaaaatgacatagctggcctcttcatttggtaccatatatgggcattgctttactgcttttacacagctgctcaggtattgaatgtctccatgacccgtgctatagtctggattatctagctggatattggtggcaagtttcgatttttctgtgcagtggccatggctaaatggccaccagcgtttgacctggttgcatcttgtctagaccaacagttagggcctactgtttactgttggctcgtagcatagttttgcgttcagtattgggcatcaagctcatgatctcacaggttagtctgtaatttgaattattgataaatcattgtcggcaaagctc

SEQ ID NO: 1949 - DNA, 773 bp, Secale cereale
gccgccgccctcgtcttctcctgcatgggcgcggcgtacgggacggccaagagcggggtgggggtggcgtcgatgggggtgatgcggccggagctggtgatgaagtccatcgtgcccgtcgtcatggcgggggtgctcgggatctacggcctcatcatcgccgtcatcatctccaccgggatcaaccccaaggccaagccctacttcctcttcgacggctacgcgcacctctcctccggcctcgcctgcggcctcgcgggcctcgccgccggcatggccatcggcatcgtcggcgacgccggcgtcagggccaatgcacagcagcccaagctgttcgtcggaatgatcctcatcctcatctttgccgaagcgcttgccctgtacggcctcatcgtcggcatcatcctctcctcgcgtgccggccagtcccgcgccgactagaacaaagcggttgcaagcaaggagcatacggcccatcattgtattctgtttgaaagggtttgtttcttcttagagacttgtttggcattacactgtggttctacttctgtgttcatgctcctcgacggatcaatcaaggaacataatgtggtttgggatcatatggatttccacgccctccatctgtaattttattctatccggcaacgcaaagctacctgtatctactcgtacctagcacctgttgtatttattgtttggagtaataatcggcgatgagccgcgtgggacgtggtgaatgaataagcaaagctagacctagttccactttt

SEQ ID NO: 1950 - DNA, 725 bp, Zinnia violacea
gagatattacctgcggtactcctctctctctaatccaatcaggtccgatcatgtcttctaccttctccggcgatgaaacggcaccgttctttggatttctcggagccgctgccgcactagtcttttcctgtatgggggcggtgtatgggacggcgaagagcggtgtgggagtggcatcgatgggagtaatgaggccggagttggtgatgaagtcaattgtgccggttgttatggctggagtgttggggatttacggtttgattattgctgttattattagtactggtatcaaccctaaggctaagtcgtattacttgtttgatggatacgcgcatctttcttctggtcttgcttgtggtcttgctggtctttctgctggcatggctattggaatggttggtgatgctggtgttagagccaatgcacaacaaccaaaacttttcgtggggatgatcctgatcctcatttacgcggaagctcttgctctctacggtcttattgttggcatcatcctttcctctcgagctggtcagtcgagagccgactacaatcagtggatgatctacgcgtgtatttacagctattactagaagcagtttttggttgtctgttcggggtgaagtcgaagctgtctgtcggtattttcatagtctgtgggggtaattgtcgatggcattcgttgacgggtgggtgttaaccacagggtacctctccctatagtaagg

SEQ ID NO: 1951 - DNA, 464 bp, Cirsium arvense
catcaatggcagattcaggattcagcggtgatgaaactgctcctttcttcggtttcctaggcgcagctgctgctctcgtcttctcatgtatgggggcggcgtatggaacagctaagagtggtgtaggtgtggcctcgatgggtgtgatgaggcctgagctagtgatgaagtctattgttcctgtggttatggctggtgtgcttggtatttatggtttgattattgctgttattatcagtactgggattaaccctaaggccaagtcttattacctttttgatggttatgcacacctttcctctggtttggcttgtggtcttgctggtctttctgccggaatggcaatcggcatagttggtgatgctggtgttagagcaaacgcacaacaaccaaagcttttcgtgggaatgattcttattctcatctttgctgaagctctggccctatacggtctcatcgtgggt

SEQ ID NO: 1952 - DNA, 594 bp, Cirsium arvense
gatccagaagcacaggttgtccaacaacacacacacacacaaaaagatctaaaaaaaactttctggtttccacttctccgcttcaattccgatcgatttcaatttcaatcggaaatctgtaattattatcaacaatggcggattcaggattcagcggtgatgaaaccgctcctttcttcggtttccttggcgcagctgctgctctcgtcttctcatgtatgggggcagcatatggaaccgcaaagagcggtgtaggtgtggcatcgatgggtgtgatgaggcctgagctagtgatgaagtctattgtccctgtagttatggctggtgtgctcggtatttatggtttgattattgccgttattattagtaccgggattaacccaaaggcgaaatcgtattacctttttgatggctatgcgcatctttcttctggtttggcttgtggtcttgctggtctctctgcaggaatggcgattggaattgttggtgatgccggtgtcagagcgaacgcccagcagccgaagcttttcgtgggaatgattctcatcctcatctttgcggaagctctggccctatacggtctcattgttggta

SEQ ID NO: 1953 - DNA, 468 bp, Brassica juncea
cttggcgctgccgcagccctcgtcttctcctgcatgggagctgcatatgggactgccaagagtggtgtgggtgtggcatctatgggtgttatgagacctgagttggtcatgaagtctattgtccccgttgttatggctggtgtcttgggtatctatggtttgatcattgctgttatcatcagtaccggtattaaccccaaggctaaatcttactacctcttcgacggatatgcacatctctcttctggtctcgcttgtggtcttgctggtctctctgctggaatggccattggtattgttggtgatgctggtgtcagggccaatgctcagcagccaaagcttttcgttggtatgattcttatcctcattttcgctgaagctctggctctgtacggtctcatcgtggggatcatcttgtcctcccgagctggtcagtccagagccgaatgaggaagagaatgctgctct

SEQ ID NO: 1954 - DNA, 455 bp, Cicer arietinum
ttcctcggcgccgcggctgccctagttttctcatgtatgggagcggcatatggaactgcgaagagcggtgttggtgttgcatcgatgggtgtgatgagaccggagttagttatgaaatcgatcgtaccgttgttatggctggtgtgttgggtatttacggtttgattatcgccgtcattatcagcactggtattaatccaaaggctaaatcttattatctctttgatggttacgctcatctttcttctggtctcgcttgtggtctcgctggtctctctgctggcatggctattggcattgttggtgatgctggtgttagagcaaatgcccaacaacccaagcttttcgttggaatgattctaattctcatctttgctgaggctttggcgttgtatggtctcattgttggcatcatcctctcttcccgtgccggccaatccagagctgagtaatat

SEQ ID NO: 1955 - DNA, 507 bp, Cirsium arvense
tccaaaattcaatcgattttcctcccaattttccctaaatcaacaatgagttcaggttcgacattcagtggcgatgaaactgcaccattcttcggattcctcggtgccgctgccgcccttgtcttctcctgtatgggggctgcgtatgggacggccaagagtggtgtgggtgtggcatccatgggagtcatgaggcctgagctcgttatgaagtccattgttcctgttgttatggctggtgtgcttggtatttatggtttgattattgctgttattatcagtaccggaattaaccctaaggccaagtcttattacctttttgatggatatgcacacctttcctctggtttggcttgtggtcttgctggtctttctgccggaatggccattggcatagttggtgatgctggtgttagagcaaacgcacaacaaccaaagcttttcgtgggaatgattcttattctcatctttgctgaagctctggccctatacggtctcatcgtgggt

SEQ ID NO: 1956 - DNA, 695 bp, Eschscholzia californica
tggagcagcagctgccctagttttctcctgtatgggagctgcttatggaacagctaagagtggagttggggtagcatcaatgggggttatgagacctgaacttgtaatgaaatcaattgtaccagttgttatggctggagttttgggtatttatgggttgattattgctgttattatcagtactggtattaaccctaaagccaaatcttattacctttttgatggttatgctcatctttcatctggtttatcttgtggtcttgctggtttatctgctggtatggctattggaattgttggtgatgctggtgttagagccaatgctcagcaaccgaagctcttcgttggaatgatcctcatcctcattttcgctgaagctctggccttgtatggtctcattgttggtatcatcttgtcttcacgggctggtcaatccagagcagattagagaagcaaactcttgtgctcaggttttttgtgtcatttatgggtattctttgacttccattcttcttctctttctagcaagggtagtttaaaactttcaccgtctttttttataaatcttttatgttagttctggttgtataatacgaagagagtttcttcggaaataaagctttaggcaagctatctctgctttgtctagtctatctatctgcgtatttgcatataaagatattcgaactaatgca

SEQ ID NO: 1957 - DNA, 507 bp, Setaria italica
cccacaatgtcgtccgtcatgttcaacggcgacgaggtcgcccccttcttcggcttcatcggcgccgcctccgcgctcgtcttctcctgcatgggcgcggcgtacggcacggcgaagagcggcgtcggcgtggcgcacatgggcgtgatgcggccggagctggtgaccaagtccatcgtccccgtcgtcatggccggggtgctcggcatctacggcctcatcgtcgccgtcatcatctcctccgggatcaaccctgtcgccaagccctactacctcttcgacggcttcgcccacctcgccgccggcctctcctgcggcgtctcggggctcgccgccggcatggccatcggcatcgtcggcgacgcgggggtcagggccaacgcgcagcagcccaagctgttcgtcggcatgatcctcatgctcatcttcgccgaagcgctcgcactctacgggctcatcatcggcatcatcctctgcacgcgtgcgggacagtcccgggcagattaa

SEQ ID NO: 1958 - DNA, 784 bp, Guizotia abyssinica
ctcggccggggatctcaaataatttcatagatccaatcgatgatttgtttgataaaatctccgtcttctcgtgacccaaggacaggacaggacaggcgtttaaacacacagatctaaaactccgatcgtcttcaatctctaacaatgtcttccgcttcaggattcagcggtgatgaaactgcccctttctttggtttccttggcgcagctgcagcccttgtcttctcctgtatgggggctgcatatggaactgcaaagagtggtgtaggagtggcttctatgggtgggtgtgcttggtatttatggtttgattattgctgtcatcatcagtacagggattaaccctaaggccaaatcatattatctgtttgatggctatgcacatctttcctccggtttggcttgtggtcttgctggtctctctgctggaatggccattggaattgttggtgatgccggtgttagagccaatgcacagcagccaaagctttttgtgggtatgattcttattcttatatttgctgaagccctggccctatacggtcttattgttggtatcatcttatcttcccgtgcgggtcagtccagagcagattaagaagattatgatcagacaatggccatggattgattagttgtttgtcctgataaaccaagaacattctacatgttttctgttttccatcttcggaacatcaattattgaatttttgttgaggaaatacgtcgaggtctcgtcaccaaaaattcaaataaatgatgtgccgcctcggccctcgagaag

SEQ ID NO: 1959 - DNA, 581 bp, Cycas rumphii
gcttgctttctgccagatctcgtgtaggtcgatcgaagcgggctcccaggtttgcggttcgagtctctcgaagtgcttgcagatctggtctgaagaagctgtaacttctcgaggaaaaacccttccagatctctgttaaaatggcggatgtatttagcggagatgagactgctccattttttggttttcttggcgctgctgcagcgcttgtattctcttgtatgggtgccgcatacgggacggctaagagtggcgtgggtgtggcatctatgggtgtgatgaggccagagctggtgatgaaatccattgtgccggtggttatggcaggagtgttgggtatctatggtttgattattgctgtgattattagcacaggaattaatccaaaggcaaagtcatattatttgtttgatggctatgcgcatctgtcttccggactcgcttgtgggcttgctggactttctgctggtatggctatcggtattgttggtgacgcgggagtcagggccaatgcacagcagccaaagctctttgttggtatgattctcatattgatctttgctgaagcacttgcactctat

SEQ ID NO: 1960 - DNA, 983 bp, Chlamydomonas reinhardtii
agagcttacaacacatactttgttggcctactgcagccaagctttcctagcctagttgctgtgtttgtagcacaactcgcagcaagatggaccactaccgctctctgcttcaggagaccgcggcgtccaaccaggacaccgcgccgttcttcggctttatcggcgctgccgctgccctggtcttctcttgcatgggcgccgcgtatggcactgccaagtcgggcgtgggcattgcctccatgggtgtcatgcgccctgagctggtcatgaagagcattgtgcccgtggtcatggctggtgtgctcggtatctacggcctgattattgctgtgatcatctccaccggcgttaaccccgccacctacaagctctacgatggctttgctcacctggcctcgggcctggcttgcggtctcgccggtctggctgcgggtatggcgattggcatcgttggcgacgccggtgtgcgcgctaacgcccagcaacccaagctgttcgtcggtatgattctgattctgattttcgctgaggcgctcgctctttacggcctgattgtgggtatcattctgtcgtccaaggctggcgcttctgccgctgcccctcccgccgccctctaagcagcggacagcattatgcaaggctaaatcgtgcttcacatgtcgggggcggggtctcggaactttcgtgtgctaggttcgtccgcggggcgtcacttgggaggctgggccagggggctaagggtttaggctgtcggtcgcaaattgcggcggctaacggtaggtcagaccaggggggcatcgcgaggtctgtggtgcggtgtgcgtgcgacggggtgtacaatagggactaactgagagcgaagcgtgcgggccacatcacaagttatgactcacatccgaccagtggtgcgtccctggttcttccaacgcctgaaaggcactgacagcgtggtacccgagttttgtaacgctttcttgtgctgc

SEQ ID NO: 1961 - DNA, 514 bp, Oryza sativa
catgtcttccacgttcaacggcgacgagttcgccccgttcttgggcttcatcggcgccgccctcgccctcgtcttctcatgcatgggggcggcgtacgggacggctcggagcggcgtcggggtggcgcacatgggggtgatgcggccggagctggtgatgaagtcgatcgtgccggtggtgatggccggagtgctggggatctacggcctcatcatcgctgtcatcatcaccaccggcatcaacccgacggcgatgccgtactaccacttcgacggctccgtccacctcgccgcggggctcgccacggggctctgcgccctcgccgccggcctcgccatcggcgtcgtcggcgacgccggcgtcagggccaacgcgcagcagcccaagctgttcgtcggcatgatcctcatcctcatcttcgccgaggcgcttggcctctacggcctcatcgtcggcatcatcctctcctcccgcgccggccagtcgcgcgcccactaatccattacatcgcat

SEQ ID NO: 1962 - DNA, 956 bp, Taxus baccata
gggcggtatgaagtgtgtccattgtgaatcagcggcaaaccttgtgaaatagaggaggagagcgttcgcgatcgcgttgccaatcgccttccaaagcatctggattgattgagaaagaaaaaagaaaaagaatttttggatcagatcagatctggtttgaaaatggcggaggcattcagcggcgacgagacagcaccattcttcgggttcttaggcgcagctgcagcgcttgtattttcatgtatgggagcggcatatgggacggcaaagagtggcgtgggtgtggcctccatgggcgttatgaggccagagcttgtgatgaaatcgattgttccagtcgttatggctggtgttttgggtatttatggcttgattattgctgtcatcattagcacggggataaaccctaaggccaagtcgtattatctatttgacggatatgcgcatctctcatctggtctcgcttgcggcctttcaggcctttccgcagggatggccattggtattgttggcgacgctggtgtcagagctaatgcacagcagccaaagctgtttgttggcatgatacttatattgatctttgctgaagctcttgcactttatggtcttatcgttggtatcatactttcttctcgagcgggccgagtcacgagcagactagaaaagttagtggctggtcttatgtttacgcatttcatttgtcagttttgatttaaagacttctgcagtggaaaaatttgatccttgatctcagtaggagttaatattcccataaaattaaattgttattcaaccaattgcaatttgagttgtgattttcaaatttgaagcatctacaatgatgctattggctcagggaacaaatgagtatgattatctcagtaggagttaatttcagcaaggtttgtatttttaatttttattgaagtttaagacatgaatttattcaatttaat

SEQ ID NO: 1963 - DNA, 873 bp, Panicum virgatum
ctctctctctctctctctctctctctctctctctctctctctctctctctctctctctctctctctctctctctgccttgcaggcatgggggcggcgtacgggacagccaagagtggcgtaggcgtggcgtccatgggtgtcatgcgccctgagctcgtcatgaagtccatcgtgcccgtggtcatggctggtgtgctcggtatctacggcctcatcattgctgtcatcatcagtactgggatcaaccccaaggccaagccatactacctcttcgacggctacgcccacctgtcgtctggccttgcctgtggtcttgctgggcttgccgccggcatggccattggcattgtcggtgatgctggtgtcagggccaacgctcagcaacctaagctgttcgtgggcatgatcctcatcctcattttcgccgaagcgcttgccctctatggtctcattgtcggcatcatcctctcatcccgcgccggccagtcccgtgcagactaggcgcgttccagatgtcgataccatgtctggccgtggaagatccattatctgtagagggttaattttcattctgtctagtattctgtttgggtctgaggaaaaaaaaaacatgtgcatcctagggaggacttccccttgtggtgccggtgccattctttcgctgtctgtggtggtggtggtggtgggctgtggtcgatgcttagtatttatgcacagtttttttggttgggttatggctggacggcgttgtaatctggtgaataagaataagcaaggacatgcaatataatgcgacgagtgtcgaggacaccttttgttcatctgtttcgttcttgtgatggtgatgttatgactagcgttggggcaaatta

SEQ ID NO: 1964 - DNA, 711 bp, Leymus cinereus x Leymus triticoides
  misc_feature (544)..(544): n is a, c, g, or t
  misc_feature (567)..(567): n is a, c, g, or t
  misc_feature (569)..(569): n is a, c, g, or t
  misc_feature (572)..(572): n is a, c, g, or t
  misc_feature (609)..(609): n is a, c, g, or t
  misc_feature (641)..(641): n is a, c, g, or t
  misc_feature (644)..(644): n is a, c, g, or t
  misc_feature (680)..(680): n is a, c, g, or t
tcttctcatgtatgggggcggcctacgggacggccaagagcggcgtcggcgtggcgtccatgggagtcatgcgcccggagctcgtcatgaagtccatcgtgcccgttgtcatggctggagtgctcggtatctacgggcttattattgccgtcatcatcagtaccgggatcaaccccaaggccaagccctactacctcttcgacggctacgcccacctctcgtccgggctcgcctgtggccttgctggccttgctgctggcatggccatcggcattgttggtgatgctggagtcagggcgaatgctcagcagcccaagctgtttgttggcatgatccttatcctcatcttcgcagaggcgctcgcgctctacggtctcattgtcggcatcatcctgtcatcgcgagctggccagtctcgtgccgattaggcatgttccccacacgcggccctgtgtgccctcttgttttatattattcagacaacaaactgagctctagaggttatcatgtctagttttcattcttctgtttggtggagaaaaancatctgtagccaagggaggtttncnctngatgtaccattctttttccgtcaggatgctgggtggnggttgatgcttatttatgcacagttatttacnttntgggtctggctggacggtgtaatctggtgaataagngagaacttgcaatgcaattgagttttgtcca

SEQ ID NO: 1965 - DNA, 729 bp, Ocimum basilicum
ccttgggcgccggtgctgccctcgtttttttcctgtatgggagcagcgtatggaacggcgaagagtggagtaggtgtggcgtcaatgggcgtgatgcggccggagctggtgatgaagtctattgtgccggtggtcatggctggtgtgttgggtatttacggtttgattattgctgtgatcattagtaccggtatcaaccctaaggctaagtcttactacttgtttgatggatatgctcacctttcgtccggactcgcctgcggcctcgccggtctcgctgccggtatggccatcgggatcgtcggcgatgctggtgttagagccaacgcccagcaaccaaagctcttcgttgggatgattctcatccttatttttgctgaagccttggctctttacggtctcattgtgggcatcatcctttcttctcgtgctggtcagtctagagctgactagaagagtgcgttttactggaagattgctgcagattttgctctcaagaacgaatcatatttatgttatcctggttagcatggtagtttgtccacgaggctgtttttatgttgaaacctttaatgtgtggcaatttcttagccaggcaaattcagccattgcttttatgggatttattgtagattagaagttttgattttcttcgaagaaagcttgtgtttgttatcctatgtttctgttcaaacgtgtgtgattcatgcaaaaccatttttggacttg

SEQ ID NO: 1966 - DNA, 704 bp, Allium cepa
tataacttgttaattcttccaaacgaactctaggtttcaaatctcaatttcaatcatggtgggatttagcggagatgaaactgcccctttcttcggatttcttggcgccgctgccgcccttgttttttcatgcatgggagcagcttacggaacagcaaagagtggtgtaggagtagcatcgatgggagttatgagacccgagcttgtaatgaaatcgattgtgcctgttgtcatggctggagttctcggaatttatggattgattattgctgttattatcagtactggaataaatcctaaggcaaagtcatactatttgtttgatgggtatgctcatctttcttctggattggcttgtggtcttgcgggattgtctgctggtatggaatcgggattgttggtgatgctggtgttagagccaacgcacaacagccaaagctctttggttggtatgatcctgattctcatctttgctgaggcacttgctctttatggtctcatcgtcggcatcatcttatcttcccgtgctggccaatcccgtgctgactaattctctgtacaagtttcaatttgtggaatatcactgcacaagtgtgaccttgtgtctactttttctatttttctttttttgggaatcgttgattcttactcgaatactgctttatgagtagagttactcttgagttgagagaatctgatacttg

SEQ ID NO: 1967 - DNA, 763 bp, Panicum virgatum
gctgaagaaaagactgtaagaaagagtcaataacgaacaggagcagtgttgcaacgagtctcttgctctgctttcctgccgcggaccaacacaactccatcgtctcttgtcttgctctccggaccggaccgacgcttcatataatccaacgacacaaggtcctgctcgatcaagtgccctcgccgcgcctgctttcctcgctctcaacgccgtctcgccgtgtccctccaacaacagtacactcgacacgatgtcgtccacgttcaacggcgacgagctcgccccctttctgggcttcatcggcgccgcctccgcgctcgtcttctcctgcatgggcgcggcgtacggcacggccaagagcggcgtcggggtggcgcacatgggcgtcatgcgcccggagctggtcaccaagtccatcgtccccgtcgtcatggccggcgtcctcggcatctacggcctcatcgtcgccgtcatggtcacctccgccatcaaccccctcgccaagccctactacctcttcgacggctacgtgcacctcgcctccggactctcctgcggcatctcctgcctcgcctccggcatggccatcggcatcgtcggcgacgccggagtcagggccaacgcgcagcagcccaagctgttcgtcggcatgatcctcatcctcatcttcgccgaagctctcggactctacggtctcatcgttggaatcctactctcctcgcgcgccggccaatctcgtgcaaattagacgactactatactc

SEQ ID NO: 1968 - DNA, 1085 bp, Castanea mollissima
cgatcaatttcccaaactttcccaaatcaaaaacaaatcctacaaagaaagaaagaaaggaaaaaaaaaaaaataagtcttctgcagtattcagtggcgacgaaaccgctccattcttcggcttcctcggagctgcggctgccctagttttctcatgcatgggagctgcttatgggacagcgaagagtggagttggggtggcatcgatgggtgtgatgcgaccagaactggtgatgaaatcgatcgtgccggttgttatggctggtgtcttaggtatttacggtttgatcattgcggttattattagtaccgggattaaccctaaagccaaatcgtattacctttttgacggttatgcccatctctcctctggtctatcttgtggtctcgctggcctctccgctggtatggctatcggtatcgttggcgatgccggtgttagagctaatgctcaacagccaaagctttttgttggaatgattcttattctcatctttgctgaggccttggccttgtatggtctcattgttggtatcatcctttcttctcgtgctggccaatccagagcagattagaaaagggtttctgcatgctgctgatgttgttgttgtaggcgttgctcaaggtatgtgatgcatactaagtgggcaatcttgtgtcgagttattcattctgtatgtggactttccattacattttataagaggttctctgctaatttggaggtgagtttcaaaataaagcttgctgggctgttgctttacctattgctgtattgtagatgttagcttaaactagtctagaaactgtctttgaagcagatccctgtcaaacgttcactttacgtttctgatcgtcattattgtacttaaagttgtgtttctagactttctgtatgtctttgtgtgtttgtacttgaagaaatgtttctagtatggtctattctttaactctgtgtgtgtgagagagagattaagattcctgtactgtagccatttgtttcttgttagggtgtacttgatggagcctgaatttcagctttggacaagtaacaaaaaatatgagtatttgttgtgtctccgtaa

SEQ ID NO: 1969 - DNA, 614 bp, Papaver somniferum
tttctcatgtatgggagctgcttatggaactgctaagagtggtgttggtgtggcatcaatgggtgttatgaggccagaacttgtgatgaaatcaattgttccagttgttatggctggagttttgggtatttatggactgattattgctgttattatcagtactggaattaaccctaaggctaaatcgtattaccttttcgatggttacgctcatctttcatctggtctagcttgtggtcttgctggtctttctgctggaatggccatcgggatcgttggtgatgctggtgttagagccaatgctcagcagccaaagctctttgtcggaatgatccttatcctcattttcgctgaagccctggccttgtatggtctcattgttggtatcatcctctcctcacgtgctggccaatccagagcagattaagaaagtgggagctcatgcccctgggtatcttgtgttgtttatggctattctttaccgttggatttatttcaggatagcaagggtagtcagcacttgcaatgactttaaatatatatctattctggatgtgatttctccgccatcctcattgggtatttggtctgtgctgcttgtagaattggaaaag

SEQ ID NO: 1970 - DNA, 574 bp, Brassica juncea
ttctcatgtatgggagcagcgtacgggacagcgaagagcggggtcggcgtggcgtcgatgggtgtgatgagaccagagcttgtgatgaaatcgattgttcccgtggtcatggctggtgtgttaggtatctatggtctcatcattgctgtcatcatcagtactggtatcaaccctaaggccaagtcttactacctcttcgacggctatgctcatctctcttccggtcttgcctgtggtctcgccggtctctccgccggtatggctattggtatcgtcggcgacgctggtgttagagcgaatgcacaacaaccgaagctgtttgtgggaatgattttgattctcatctttgctgaagcactggcgctgtacggtctcattgttggtatcatcctctcgtctcgtgctggtcagtctagagccgagtgaactcagaaagcttttggtcaagtccttttgtaatgtttatgatatgtttcacttttggttttcttttgtggcattgtgagtttttgagtttctcatgggaacaagcaaaacatgggtgataatcatttgactttctggttctaattat

SEQ ID NO: 1971 - DNA, 654 bp, Musa acuminata
cctgcatgggggccgcgtacgggacggcgaagagcggagttggggtggcttcaatgggagtgatgcgaccggagctcgtgatgaagtcgatcgtgcccgttgtcatggcgggagtgctcgggatctatgggttgatcattgctgtgatcatcagcaccgggataaaccctaaggccaagccgtactatctcttcgacggctacgctcacctctcgtccggactggcttgtggtctcgctgggctttctgccgggatggcgatcgggatcgtcggagatgctggcgttagggccaatgcacagcagcccaagctgtttgttgggatgattcttattctcatttttgctgaagctcttgcactctatggtcttattgttggcatcatcctttcatctcgagctggtcaatctcgggcagattaagaaaacatgaagtctcggatgtcatttcccgttgcttcctatgtttgctacagaacatttgttctaaatatctattttctacttttctgattacactgtgaactatccagataacttgtattaaccagagccctttggcagttccatgtctttttaataatgtaaatgcatcaatctcattgtaatgaagagtgagagtttttttgcattaaatatttatgccttactatga

SEQ ID NO: 1972 - DNA, 696 bp, Curcuma longa
tcatgcatgggtgcggcgtatgggacggcgaagagcggcgtcggcgtggcgtcgatgggcgtgatgcggccggagctcgtgatgaaatcgatcgtgcccgtcgtcatggccggagtgctcgggatctatggcctgatcattgcggtgatcattagcacgggcataaaccccaaggccaagtcgtactacctcttcgacgggtacgcccacctttcctcagggctcgcttgcggcctcgccggactttccgccggaatggcgattgggatcgtcggagatgctggagtcagggcaaatgctcaacagccaaagctatttgtgggcatgattctaattctcattttcgcggaagctctagctctctacggtctcattgtcgggatcatcctctcttctcgagcgggtcaatctcgtgcagattaggaaaagaggagacatgctgtggtctccatgtcctatctacttgtttccaaggaaatggagagacgtttatttttgaagtttgttgtgcttttatttaggcgatacaaagaaatcttattactcgacccaagatcaaaccctagggtttatagtgtgttgcttggatcttgtagatcaagcagaggaccctttttccaccaataacattgccatcgtgggggcaaactgtgaaggacctggattagtggagttattaaataaatttcagttgaa

SEQ ID NO: 1973 - DNA, 697 bp, Camellia sinensis
gcgggggatccaaacgtggcatacaactaactaagaagtgacacagaagtagtgtcggttgcgagcttgcacgaaacttcctgcgtggtccgtccgtctgtgtaaacgtgtgatcgatcgacatctattcaattccaaatctctctccgatctgatcatcaatattcaatctttgaaaaatttgcaatcgataattcgaagagagagaaaaacaaaaatgtcgtctacgttcgccggcgatgaaactgctccgttcttcggcttcctcggcgctgcagctgccctcgttttctcctgtatgggagctgcctatggaacggcgaagagcggtgtgggagtggcttcaatgggtgtaatgaggccagagctcgtgatgaagtcaattgtgccagttgttatggctggcgtgttgggtatttacggtttgattatcgctgtgattatcagtactggaattaatcctaaggccaagtcgtattacctttttgatgggtacgcacacctgtcatcgggtctagcttgtggtcttgctgggctttcagccggaatggctatcgggattgttggtgatgctggtgttagagctaatgcacaacagcccaagctttttgttggaatgattctcattctcatctttgctgaagcattggcgctgtatgggcctcattgttggcatcatccctttctcctcgtgctg

SEQ ID NO: 1974 - DNA, 687 bp, Pteridium aquilinum
acagggagagaaggagaggacatgtcgaccaccgaattcaatggagacaccacggctcccttcttcggctccttggagctgctgcagcactcgtcttctcctgtatgggggctgcatatggtactgcaaagagtggggttggagtggcgtccatgggtgtgatgaggccggagctggtgatgaagtcgattgtgccagttgtcatggctggtgtgctgggtatttacggattaattatcgctgtgattatcagtacaggaatcaatcccaagagcacggcctactatttgtttgatggctatgcccatctctcatctggtcttgcttgtgggttagctggtctttctgctgggatggccatcggcattgttggtgacgcaggtgttagagcgaatgcacagcaacccaagctgtttgtgggcatgattttgatccttatttttgctgaggcgcttgctctttatggattgattgtgggcatcatcctgtcctcccgagcagggcagtccagggaatgatgaaaatcgaaggccaattttaaacctggtttgacagtcataagctcattagttaagtctatttataacatttttttgacagacagagctgttgtcattgtgtactcgtgtctatgcactctcgctattaagcaattgtcttgcaaagttgataggacttgtcaaaaaa

SEQ ID NO: 1975 - DNA, 806 bp, Secale cereale
gactgatcggcggccgatctgaccgcggtgtgcgtggtgcgtgtgatgcaggcatgggagcggcgtacgggacggccaagagcggggtgggggtggcgtcgatgggggtgatgcggccggagctggtgatgaagtcgatcgtgcccgtcgtcatggcgggggtcctcgggatctacggcctcatcatcgccgtcatcatctccaccgggatcaaccccaaggccaagccctacttcctcttcgacggctacgcgcacctctcctccggcctcgcctgcggcctcgcgggcctcgccgccggcatggccatcggcatcgtcggcgacgccggcgtcagggccaacgcacagcagcccaagctgttcgtcggaatgatcctcatcctcatctttgccgaagcccttgccctgtacggcctcatcgtcggcatcatcctctcctcgcgtgccggccaatcccgcgccgactagaaacaaagctgcttgcaagcaaagagcatacggtccatcattgtattctgtttgaaagggtttatttcttcctagagacttgtttggcattacactgtggttctacttctgtgctcatgctcctcgaccgatcaaggaacataatgtggtttgggatcatatggatttccacgccctccatctgtaattttattctatccggcaacgcaaagctacctgtatctactcgtacctagcacctgttgtatttattgtttgtggagtaataatcggcgatgagccgcttgggacgtgatgaatgaataagcaaagctagacctagttccaaaaaaagtc

SEQ ID NO: 1976 - DNA, 857 bp, Artemisia annua
aaccaaccccaaattcacatcttggatccatacataataattgaattaactacaatcataataataattcataaagaagaagaaaagaaagaggaggttcaacattcagtggtgatgaaaccgcacctttcttcggtttcctcggtgccgctgctgctctcgttttctcatgtatgggagcggcatatggaacagcaaagagtggtgtaggtgtggcatcaatgggagtcatgaggcctgaattggtgatgaagtcgattgttcctgttgttatggctggtgtgcttggtatctatggtttgattatcgctgttattattagtactggtatcaaccctaaggccaaatcgtattatttgtttgatggttatgcgcatttgtcgtctggtttggcttgtggtcttgctggtctttctgctggtatggcaattggtatcgttggtgatgctggtgttagagcgaatgcccaacagccaaagcttttcgtaggaatgatccttatcctcatctttgctgaagccctggccctatacggtctcattgtgggtatcatcttgtcttcccgtgccggtcagtccagagcagattaagaagatacagaaccatatcggtatgtagttattctgagaaatgaagatcgatctcattttcgtgcttggtcccccatttagtttgccaatttatggacaagactcattgtgttgctctaaatattttctcctcggtaacatttctggcattatttgcattcttttgtttatgactacaaaataagagtttccagtccatgacttggttacaaaatttctttcaagtctgatagaaactgttattatggtattaaggtgtttatgtgt

SEQ ID NO: 1977 - DNA, 920 bp, Euonymus alatus
tttcatcttgcacggtcaagaaaaagccacagagagagagagagagagagtcagagagatcagaaaacgctctggaacaacagcacaattcagacacgcttagcatcagatccaaacgacacaggtccagatctacttgaacgaaaatggcctcgactttcagcggagatgaaactgcaccgttcttcggcttccttggagcggctgcggccctcgtttttcctgtatgggtgccgcatatggaacagctaagagtggtgttggtgttgcttcaatgggagtgatgagaccagagctggtgatgaagtcaattgttcctgttgtcatggctggtgtcttgggtatctatggcttaattattgctgttattatcagtaccggaattaaccccaaagccaagtcgtactacctttttgatggatatgcacatctctcatctggtcttgcttgtgggctagctggactctctgctggaatggcaattggaattgttggcgatgcaggtgtcagagctaatgcccagcagccaaagctttttgttggaatgatcctcatcctcatctttgccgaagcattggccctctacgggcttattgttggaatcatcttgtcctctagagctgggcaatccagggcagactaaaagtaaactgtgcatcttgtattcttttttaattgcttttccgtgtcactccaggtagatttttatttcttctcaggttggctgttgtttgacagcccttgccggggtcttaagaattttactgtgtaactgctttttcagggcatcacgatggttgtctgtgctattagtagaatttttttagtttctccacggaataaaaaattgtgagtctgtccttttttggttctctatcagtgtattttgcagacttcaaaggatgataggtagcatgtgt

SEQ ID NO: 1978 - DNA, 867 bp, Fagopyrum esculentum
ggagacagttgccgatcaggatctaaggaagattcagctctgatcgatttgtctgcaaaagaaaaacagaaatggctccaagattcaacggagatgaaactgcaccgttttcggttttctcggcgcagctgcggccctcgtcttctcctgtatgggggcagcgtacgggacggccaaaagcggcgttggagtggcgtcgatgggtgtaatgagaccggagctggtgatgaaatcaattgttcctgtggttatggctggtgtcttaggtatttatggtctgatcattgctgttattatcagtactggcattaatcctaaggccaaaggttactacctctttgatggttatgcacatctctcctccggtctcgcttgtggtcttgctggtctttctgctggcatggccatcggaatcgtcggtgatgctggtgtcagggccaatgcacaacagccaaagcttttcgtcgggatgatccttatcctcatttttgctgaagctcttgctctatacgggttgatagttggcatcattctctcttcccgtgctggccagtccagagcagattaaggttgcccctccatggcttgccttattggcctcctgcctacggatacaataggccgtcgctctttcacgttccccaggagaaaaggattggaaaacaggaagcttccttcccagcagcagatgaagtatttcctaaatgccgacttgtgttgacatggtagaacataatctttgatctatacgtactgctaaataatttgaagtatactctctagagtctgcgctaatcctacatttcttggatatgctgaagctcttccataaacattgattagtgaaaatgataaaagttggcatga

SEQ ID NO: 1979 - DNA, 937 bp, Fagopyrum esculentum
gccgatcaagatctaaggaaggttcagctctgatcgatttctctgcaaagaaaaaccagaaatgccttcaagattcaacggagatgaaactgcaccgttttcggttttctcggcgcagctgcggccctcgtcttctcctgtatgggggcagcgtacgggacggccaagagcggcgttggagtggcgtcgatgggtgtaatgagaccagagctggtgatgaaatcaattgttcctgtggttatggctggtgtcttaggtatttatggtctgatcattgctgttattatcagtactggcattaatcctaaggccaaaggttactacctttttgatggttatgcacatctctcttccggtctcgcttgtggtcttgctggtctttctgctggcatggccatcggaatcgtcggtgatgctggtgtcagggccaatgcacaacaaccaaagcttttcgtcgggatgatccttatcctcattttcgctgaagctcttgctctatatgggttgatagttggcatcattctctcttcacgtgctggccagtccagagcagattgaggttgcccctccatggcttggtttattggtctcctgcctacggatacaaaaggcagttgctctttctccacaagaaaaagaattggaaaaacaggaagcttccttcccagcaccagatgaagtatttcctaaatgccgacttgtgttggcatggtagaacatagtctttgatccacacgtaatgctaaataattcgacactgtattatcatatttctatatatgcacattgacacttcttctcggaaattcggtatgaactctactctctagaggtctgagccaaattccgccaatcctacatttctttgatatgctgaagctctatcataaacattgattagtgaaaatgataagagttggcatgagttttttagact

SEQ ID NO: 1980 - DNA, 703 bp, Carpinus betulus
atcatcatcatcaccaccgatccgatctcttcctctcgcaggcgacagccaaaccaaggacagaattctgcccaaaactgtgattagcgcaccctttcccggcaaccaaacaccgggaagatgtcttcgtcctccttcagcggcgacgaaaccgcccccttcttcggcttcctcgggccgccgcggctctcgtcttctcatgtatgggcgcggcgtacgggacggcgaagagcggagtgggcgtggcgtccatgggagtgatgcggccggagctggtaatgaagtcaattgtaccggtggttatggccggagtgttggggatctacgggctgatcatagcggtgattatcagcactggaataaaccccaaggccaagtcgtattatctctttgatggctacgcgcacttgtcgtcagggcttgcttgtggcctcgctggcctctcagccggaatggccattgggatcgttggtgacgccggagtccgggctaatgcacagcagccgaagctgtttgtgggcatgattctgatcctcatctttgctgaagcacttgctctctatggtctcattgtggggattatcctttcatcccgagcaggccaatctcgcgcagattaaaaggaggccatgtttctttaatttattttatttttgtatatgcttctctgtattaaaatttaactgaaacagtttgttcaaac

SEQ ID NO: 1981 - DNA, 931 bp, Sarracenia psittacina
ccgtcggaaaacaaaaaattcctccctgaatagcgaaaacttgaggaattctcagatccgatcgatttatcttcaattagaaaccctagaaagcagattttaaaaaaatgtcttcgacgttcagcgggatgaaacagcgccgttcttcggtttccttggcgctgcagctgccttagtcttctcctgtatgggggctgcgtatgggacggcaaagagtggggttggagtggcgtcgatgggcgtgatgcggccggagttggtgatgaaatcgattgttccggtggttatggccggtgttttggggatctatggattgattattgctgtgatcataagtaccggtattaaccccaaggccaaatcttattatctctttgacggctacgcccatctttcctctggtcttgcttgtggcctcgctggcctatctgctggtatggctattggtattgttggcgatgccggcgttagagccaatgctcagcagccaaaactatttgttgggatgatcctcattctcatctttgctgaagcgcttgctctctatggccttattgtcggcattatcctctcttctcgagccggtcagtcgagagccgattaaaaccgagcattctgcttggtggtggtgtcacttgtcgccattgattaagaattatttcggtgttctctctggtttgaaatggtgattcaactgaggaagaagtgtcttatgctccccgattcttctatacttttggttggtggccggtgcttgcatcaggtggattgttggcttatttatgctaatggtagaatgcagattagctcttggtcgtgccctcgaatactgttgtatctgcttctttttaaagatgatgtgcttcataaatttgtctttgaattatggccattattatttattctgatttcttggtactacatttttcgt

SEQ ID NO: 1982 - DNA, 677 bp, Camellia sinensis
atgggagctgcatatggaacagcgaagagtggtgttggtgttgcatcgatgggtgtgatgaggccagagctggtgatgaagtcgatcgttcctgttgttatggctggtgtgttgggtatttatggcttgatcattgctgttatcatcagtactggtattaaccctaaggccaagtcgtattacctctttgatggttatgctcatctttcctctggtctcgcttgtggtctcgctggcctctctgctggaatggcaattgggatcgtcggtgatgctggtgttagagcaaatgcgcagcagccaaaactttttgttgggatgatcctcattcttatctttgctgaagcactggccctctatggcctcattgttggtatcatattgtcttctcgagctggccaatccagagcagactgagaaggatttgtgttttttaccttgggtccttttgtattgctttgtggtaaccatattcggaaagatgaaaaaaatttataagttttaaatcttcttaggttagaacagcactcgagagttcttcaaatttctcttgaattcgaagattgttgctcaaaatacactcattttttggctgctcattgctgtttatagagtagtagactgagtatatctctgcagaataaaatctcatgaaagtgtctctgttcggtttttag

SEQ ID NO: 1983 - DNA, 556 bp, Thalictrum flavum
tatgggagcagcttatggaacagcgaagagtggtgttggtgtagcatcaatgggtgtgatgagacctgaacttgtgatgaagtcaattgttccagttgttatggctggagttttgggtatttatggattgattattgctgttattattagtactggaatcaatccaaaagccaaatcgtattacctatttgatggttatgcccatctttcatctggtcttgcttgtggtcttgctggtctctctgctggtatggctattggaatcgttggtgatgctggtgttagggctaacgctcagcagcctaagctttttgttggaatgattctcatcctcatttttgctgaagctctggccctgtatggccttattgttggtatcatcctttcctcccgagctggccaatctagagcagactgagggaaacctctagtgttgatattttactgcactttgtggaaatcaccttccattccattcatttgagtctagtttgttgtagttcagaacttgcagtgctctctaaattgtttatgctggacatggtttctctgcctc

SEQ ID NO: 1984 - DNA, 546 bp, Thalictrum flavum
tatgggagcagcttatggaacagcgaagagtggtgttggtgtagcatcaatgggtgtgatgagacctgaacttgtgatgaagtcaattgttccagttgttatggctggagttttgggtatttatggattgattattgctgttattattagtactggaatcaatccaaaagccaaatcgtattacctatttgatggttatgcccatctttcatctggtcttgcttgtggtcttgctggtctttctgctggtatggctattgggattgttggtgatgctggtgttagggctaacgctcaacagcctaagctttttgttggaatgattctcatcctcatttttgctgaagctctggccctgtatggccttattgttggtatcatcctttcctctcgagctggccaatctagagctgactgagggaaacctctggtgttgatattttactgcacttcatggaaaccaccttccgttcaagactagttgttgtagttcagaacttacactgctctctaaattgtttactctggaggtggcttctctgcctc

SEQ ID NO: 1985 - DNA, 802 bp, Utricularia gibba
ggcacgatcaggaggaatgtcgtcgacttttagcggagatgagacggcgccgttctttggtttccttggcgctgcaacggcgctcgtcttttcatgtatgggggcggcgtacggcacggcgaagagcggcgtcggggtggcatccatgggtgtgatgaggccggagctggtgatgaaatctattgttcctgtggttatggctggtgttttgggtatttatgggctgattatcgctgtcatcatcagtactggaattaatccaaaggcgaaatcttactacttatttgatggctatgctcatctatcgtctggactcgcgtgtggtctggccggcctggctgctggtatggcaattggaatcgtcggtgatgctggcgttagggcaaatgcgcaacaaccaaagcttttcgttgggatgatcctcatcctatttttgctgaagcccttgcactgtacggtctgatcgtgggcattatcctctcatctcgtgccgggcagtctagagctgattaaaagggttcattcagttgactttttcttcccatcaactgcgctctttaacaaagcttccgctccctcccatagtgccgctgatgtgcttcatatcatcttatttaggttcgaggtaacttgtacgtcatgatgcttgagagttgagtgtgtgattgtaccttgtagatgatacgcttaatattggatgattaagtgtctggatccaagattcatctgtccagaaaatggagtgtagcatgcaatttgaactcgtctatgacatgtgctacgatagcttctccttttcact

SEQ ID NO: 1986 - DNA, 1978 bp, Volvox carteri
cagattaatttttttcttagtaaagctttcgctctatgtattgcgtcatattcgagtttcgcagttctcaggttccacctttccatgcctccagttatgcagtgctctggctccaatctttgttagcatccgttcatgtttgctgggcaattagcgaatttcgtcggtccttagtactacagcgccaaatgaaacggtatttctctaacctcacagcaaaagcatcatgcattagagaacactctagctgctcaccgctaagacggagccaggatacagatcgtgcggaaagcctaagtccttccaaaatgtttgcccctgaaatgtgcccttcaaatgcacgtagcgggccacgagcaacttcaaggttaagcgtcaaggactagcatggtttgaataatagcccgcggtcaacatacagaggccactccgttttgagtaagcccacaatctcctccagacatcatgttgagtagctggtgtgtgcaaaagtgcaaatgtttacatgagaacggtcggcagcagataggattgaaaaaatgcgggaggttgccgtacgtcattggcctccttttaattcagctaatctgtgccttatcatatcaatgctgtgttgctcagttgtatttgtctattagttggtttctggcctgaaatttatcaactggatttggtcgctttcatcctgcccaagtcgcactatggctgaccattaccgtgctctccttcagtccagctcgggcagcgatgctagtgctactgctccattctttggtttcatcggcgctgctgcggcgctggtgttttcatgcatgggcgccgcttacggcacagccaagtctggcgtgggcattgcatctatgggtgtcatgcgtcctgagctggttatgaagagcatcgtgcccgtggtcatggctggtgtgcttggcatttacggtctgattatcgctgtgatcatctctaccggcgtgaacccggtaaagtaccagctctttgatggtttcgctcaccttgcatctgggttggcttgcggtctggcgggattggctgctggcatggctattgggattgttggtgatgctggcgtcagggcgaacgcgcagcaaccgaagttgttcgtaggtatgattctgatcctcattttcgctgaggcgctggctctgtatggtctgattgttgggattatcctttcgtccaaggccggtgctgctgcaaccgcggagtaacatgacaatccaatggtgtctgggatcttaacggcgaagggtatggatttcacgttttacttggcagtcttgggcttttaccttatcttccaagtcgtgtaggtcgcttacatgaggcagaacttctcgggcagcgtggactggtgtgacgcaagtgacatcttggagggacgctggcatgggtagtagtgatgcatgccgtagatgtgcatatgacggctatcctttgcaacttgcgtcctatgatctatgcggcgtgtgtatgcttatccgtgagaacctaatcattctcctgtcttcggactttgtactgctgtaacttcgctggtaaattatatgcggctcttttataatctcctggtggcactggggaccattaccggtgctgggtggtccatggtgtatacgcagaatcttctgctaatgctttccgttcggtaagtactgctgcagctttcaagagaggaactgatgtgtagactgacgattaaaaggcgtgtaatggtcctttgggcttacacggcagtggctcgggcggtcattctgttcaccggtcgtttcccttgcttgccttttcgaggcttttaaatttttatggctcagcaccgataggacaacggtagaaaggtatgtcccgatggttgcctggcatttgcagagtgaccacatcgtgagctatgatctgccccacgaactaccaggaaattcacgaacctgcagcaggatgtaaccttcagcatgctgcatggtag

SEQ ID NO: 1987 - DNA, 1829 bp, Volvox carteri
cagattaatttttttcttagtaaagctttcgctctatgtattgcgtcatattcgagtttcgcagttctcaggttccacctttccatgcctccagttatgcagtgctctggctccaatctttgttagcatccgttcatgtttgctgggcaattagcgaatttcgtcggtccttagtactacagcgccaaatgaaacggtatttctctaacctcacagcaaaagcatcatgcattagagaacactctagctgctcaccgctaagacggagccaggatacagatcgtgcggaaagcctaagtccttccaaaatgtttgcccctgaaatgtgcccttcaaatgcacgtagcgggccacgagcaacttcaaggttaagcgtcaaggactagcatggtttgaataatagcccgcggtcaacatacagaggccactccgttttgagtaagcccacaatctcctccagacatcatgttgagtagctggtgtgtgcaaaagtgcaaatgtttacatgagaacggtcggcagcagataggattgaaaaaatgcgggaggttgccgtacgtcattggcctccttttaattcagctaatctgtgccttatcatatcaatgctgtgttgctcagttgtatttgtctattagttggtttctggcctgaaatttatcaactggatttggtcgctttcatcctgcccaagtcgcactatggctgaccattaccgtgctctccttcagtccagctcgggcagcgatgctagtgctactgctccattctttggtttcatcggcgctgctgcggcgctggtgttttcatgcatgggcgccgcttacggcacagccaagtctggcgtgggcattgcatctatgggtgtcatgcgtcctgagctggttatgaagagcatcgtgcccgtggtcatggctggtgtgcttggcatttacggtctgattatcgctgtgatcatctctaccggcgtgaacccggtaaagtaccagctctttgatggtttcgctcaccttgcatctgggttggcttgcggtctggcgggattggctgctggcatggctattgggattgttggtgatgctggcgtcagggcgaacgcgcagcaaccgaagttgttcgtaggtatgattctgatcctcattttcgctgaggcgctggctctgtatggtctgattgttgggattatcctttcgtccaaggccggtgctgctgcaaccgcggagtaacatgacaatccaatggtgtctgggatcttaacggcgaagggtatggatttcacgttttacttggcagtcttgggcttttaccttatcttccaagtcgtgtaggtcgcttacatgaggcagaacttctcgggcagcgtggactggtgtgacgcaagtgacatcttggagggacgctggcatgggtagtagtgatgcatgccgtagatgtgcatatgacggctatcctttgcaacttgcgtcctatgatctatgcggcgtgtgtatgcttatccgtgagaacctaatcattctcctgtcttcggactttgtactgctgtaacttcgctggtaaattatatgcggctcttttataatctcctggtggcactggggaccattaccggtgctgggtggtccatggtgtatacgcagaatcttctgctaatgctttccgttcggtaagtactgctgcagctttcaagagaggaactgatgtgtagactgacgattaaaaggcgtgtaatggtcctttgggcttacacggcagtggctcgggcggtcattctgttcaccggtcgtttcccttgcttgccttttcgaggcttttaaatttttatggctcag

SEQ ID NO: 1988 - DNA, 794 bp, Bruguiera gymnorhiza
  misc_feature (471)..(471): n is a, c, g, or t
  misc_feature (473)..(473): n is a, c, g, or t
gaccgtgtcggaaacaattcgaattaggcgatagaactgcgacaacatggcaccttcttcgttcagcggcgacgagacagcccctttcttcggcttcctaggagccgccgcagctctcgttttctctgtatgggggcggcgtatgggacggcgaagagcggagttggggtggcgtcgatgggcgtgatgaggccggaactagtaatgaaatcaatagtgccggtggtcatggccggagtgctgggtatctatggtctgatcattgctgtaattattagcaccgggattaaccctaaggccaaatcctattacctcttcgacggctacgcccacctgtcgtcgggactcgcttgtggcctcgccggcctttctgctggtatggctattggtatcgtcggcgatgctggtgttagagctaatgcgcagcagccaaagctttttgtcggaatgattctcattctcatcttcgcngnggcattggcattgtatggactcatcgttggaatcatcctctcttcccgagctggccaatccagagcagattagaactcctcattgttgccatcactggaccattcactttgttagtttcaataaaagagtgcgcaggtgctgtatcatattctcgttactactcctattgtcctttctttaatgatttggagtgagttttccccctaaaataaagcttgtcaagtctttaacttatttctctctgttgcattcatgcacatatgctaattcagaaaattgttgaaagcttgttgtatatgttacctgccagcaacttttcc

SEQ ID NO: 1989 - DNA, 1370 bp, Cannabis sativa
gggttgaaactatttgaagcctaattcaattcgtaagtaaggacaaccacagagtttagagagagagagagatcgaaactcgaagcagtaaagatctgagtttctaccttcagcggcgatgaaacggcaccgttcttcggattcctcggcgctgccgcggctctagttttctcctgtatgggagctgcctatggcacagcaaagagtggtgttggtgtggcatctatgggagtgatgagacccgagttggtcatgaagtccattgttccagttgttatggctggagttttgggtatttatggtcttattattgctgttatcatcagtacagggattaacccaaaggcaaaatcatactacctttttgatggttatgctcatctttcctctggtcttgcttgtggtcttgctggtctttcagctggaatggccattggtattgttggtgatgctggtgttagagctaatgcacagcagccaaaacttttcgttggtatgattcttatcctcatctttgccgaggctcttgccctgtacggtcttatcgtcggcattatcttgtcttctcgtgctggccagtccagagcagaatgagaagcggccattgcagccaaatattcttttatcgcttattatgttacttcaaggttgggcagaagcatttaattttttttcttgccattatcggttagtgaagatgataatagctggataaacgttgcaggatcccttaaaattatatatttgtggtagtaactgcccttccagtcacatggtgttgttttgctattagaagtaaagatctgagtttcttgaccgaataaaaagcttttgaagctgaaacccctttcgattctatattatgtcttttgtgtatttttgttgttagacacctttgaacgggtatagtatttataattatggaggtaagtaagtagtgcatgtaccatgttatattcattgaatacttttatcaaatctcaaactctgcattatgtgcttatctcaactttctttttagtttagtcattgaggatgccattgtttttctttcctggtttttgacaacgtgccaacaagtatgtgttggcattgtgatcaagcccagtttgtaggttgcatgattagcttaaatgatttgatcatatatatcaaattgactttaggtacaactagggacaagcttgtcaattgacctatttaaagtacaccacatcatcgttatttcttttcttttttgagttgaaattgaatttaattcaagaagctaatagcctaaccttgaattatcaggtttaaaaacctttacaaagaaattcgatatcagccaaaactaactttgtttcgacccaatcttgggcaagctttca

SEQ ID NO: 1990 - DNA, 867 bp, Cannabis sativa
aggtatgggagctgcctatggaaccgccaagagtggtgttggagttgcatcgatgggggttatgaggccggagctggtcatgaagtcgatcgtcccagtggttatggcgggagttttgggtatttacggtctcatcatagcagttattatcagtactggtattaatcccaaggctaaatcctattatctctttgatggctatgcccatctctcttctggtctcgcttgtggccttgctggcctctctgctggtatggctattggaattgtcggtgatgctggcgttagggctaatgcacaacagccaaaactttttgttggtatgattctaattctcatttttgctgaagcccttgctctatatggtctcattgttggtatcatcctctcatctcgagcgggtcagtcaagagctgaataagaaatatttccttctggttgctatattcatcattgctgtatatctagagctacttgttatcctttaaaaaagaaagctcagtgaagtgttctataagatcttgtttgcggtgtaattagaaattctatgaaattgtttgttaaagtttttagtttgggtgctgaattgctgatggtaggatatatatagaattggaaattagtttcactatctaatagcaacattttgtgcagactcattgcctgtattatagattgcgagttagctagctctctggatttgcattactattgccattttcattatccacacttctctacgttgtatttggattttaaatgttaatctttctcctgatttgtttctcagaaaagatttgtaaatgttctgatagacagtgttgacgaaattatcagtaccacttaatttgttgcataaatctatag

SEQ ID NO: 1991 - DNA, 1026 bp, Theobroma cacao
tttggtacacaaatccagcttgtatgcattaattactctgcattagtcactgttcacagggcgctgtcctccaaagttatgggcacatttgagtggccttaataaataaaaccttacgattaccattaggataaatcatcttatgatattttttattttatattaatataagtgatattttaattaataattttttgcactttaaaaagctattacaattaaggagcaaacattacattctcagatccgatccatcactatcttcaacattcagcggcgatgaaactgctcctttcttcggcttcctggaggccgctgctgcccttgttttctcctgtatgggagcggctttgggaccgcgaagagtgtgggtggtgtagggtcgatggggctgatgactgatgaggccggagctggtgatgaaggcgatcgttcccgtagttatggctggtgtgctcggtatttatggcttgattattgctgttattattggtaccggaattaatcccaaggctaactcttattacctttccgatggatacgcgcatctgtcttctggcattgctggtattcctattgggatcgttggtgatgctggcgttagaactaatgcacagcagccacagctaggtttttgttgggatgatcctcattctcatctttgctgaggctttggcactatatggtttgattgtcggcattattattctctcttccagagctggtcaatcaagagccgagtgaaagaaggcctagctagcgaccgcatgattggttgtgcttcctgcgggcggaattgtttcatatatttttcttttcttttactggttagaagaagcatattggttttgctcaggtgtctaatgtttctacagattgagaaatttacagtggttgatgatcagattagagatttatttaaattagttgtctcaataaagtttgtcaactttgtttcattattaaattatgtatttttagggaaaaaactattttcactccattgaatataataaaaataaaaat

SEQ ID NO: 1992 - DNA, 760 bp, Brassica napus
aaaaaaaaaatatctgctgaatccaaatctctctctctctctctctccccagtcttggatccgagaagatgtctacgttcagcggagatgagactgctcctttctttggcttcctcggcgctgccgccgccctcgtcttctcctgtatgggagctgcttacggaactgcaaagagtggtgttggtgtggcttccatgggagtgatgagacctgagttggtgatgaagtcgattgtccccgtggttatggctggtgtgttgggtatctatggactcatcatcgctgttatcatcagtaccggtatcaacccaaaggctaagtcttactacctctttgatggatacgcacacctttcctctggtcttgcttgtggtcttgctggtctctcagctggtatggccattggaatcgtgggagatgctggagtcaggtttgtttgttcttcttttgcaactgtataaatagttaccgagtggatggaacttgacttgtttggttttgggaaaatcttgtcagggcaaatgctcagcagcctaagcttttcgtcgggatgattcttatcctcatctttgcggaagcacttgctctctatggtctcattgtaggcatcatcttgtcctctcgagctggtcagtccagagcagaatgagaaacaaacaaatgtcagatgatgatttttcttttgtggaaccttgtgtggggctgccatatattctgcttcgttttggtgggtgcttgagcataggattgtttgtttttt

SEQ ID NO: 1993 - DNA, 708 bp, Hordeum vulgare
ggagtccagcgtcgtcacacctgtatacctccagagtttttatttctcaatacaagatcggatcgggtcggggcgaggagacgagaggagaggagaaaataaaagcaaacttgagagaccatccgttcctcaccctaccaaccatcttccttccttagcgacgaggccacccagagctccacacgaaggaaagcgcgaccggaggaggaggaagaagaggagcaagtatgtcgtcggtgttcagcggcgatgagacggcgcccttcttcggcttcctcggcgccgccgccgccctcgtcttctcatgcatgggggcggcctacgggacggccaagagcggcgtcggggtggcgtccatgggggtcatgcggccagagctcgtcatgaagtccatcgtgcccgtcgtcatggcgggagtgctcggaatctacggcctcatcatcgccgtcatcatcagcaccgggatcaatcccaaggccaagccctacttcctcttcgacggctacgcccatctctcctccgggctcgcctgtggcctcgcggggctcgccgccggcatggccattggcattgtcggtgatgctggagtcaggtaaagatgcacctgctgcttttatttgtttaactttaactttccgtctttgacttttaagcggtatgtgcatgctcgtagctagatagtgctgtgcattacggtttgattaataa

SEQ ID NO: 1994 - DNA, 480 bp, Ostreococcus lucimarinus
atgtcgacgagcgatgaagtcgcgccgttctttgggttcatgggcgcgacgagcgcgctcgtgttcagttgcatgggcgcggcgtacggcacggcgaagtccggcgtcggcatcgcgtccatgggggtgatgcggccggagttggtgatgaaatccatcgtcccggtggtcatggcgggcgtgctcgggatatacgggttgatcatcgcggtggtgatcagcacgaacatcgacgcgtcgtcgtacacgctgttccagggatacgcgcatctcggctctgggttggcgtgcggcctgagcggactgtcggcggggatgtgcatcgggatcgtgggcgacgcgggcgtcagggcgaacgcgcaacagccgaaattgttcgtcggggtgattttgattttgatcttcgccgaggcgttggcgctgtacggcatgatcgtcgggatcattctgtcgtccgccgcgagcgcggcgacgtcgtag

SEQ ID NO: 1995 - DNA, 690 bp, Secale cereale
ctccctcctccctcccccctccactcgtcgccgccgtccaatctccggcgacgatccccgccaccccccgccggcagccatgtcttccgtcttcagcggcgacgagacgcccctcttcggctcctcggcgcggccgccgccctcgtcttctcctgcatgggcgcggcgtacgggacggccaagagcggggtgggggtggcgtcgatgggggtgatgcggccggagctggtgatgaagtcgatcgtgcccgtcgtcatggcgggggtgctcgggatctacggcctcatcatcgccgtcatcatctccaccgggatcaaccccaaggccaagccctacttcctcttcgacggctacgcgcacctctcctccggcctcgcctgcggcctcgcgggcctcgccgccggcatggccatcggcatcgtcggcgacgccggcgtcagggccaacgcgcagcagcccaagctgttcgtcggaatgatcctcatcctcatctttgccgaagcgcttgccctgtacggcctcatcgtcggcatcatcctctcctcgcgtgccggccaatcccgcgccgactagaagaaagtccttgcacgaaaggaggacacggtccatcattgtattctatttcaaaaagggtattatttcttcctagagtacttgtttggcattacactgtggttctacttatgtgct

SEQ ID NO: 1996 - DNA, 417 bp, Eucalyptus grandis
atgggagctgcatatgggacagccaagagcggggtgggcgtagcatctatgggtgtgatgagacctgagctggttatgaagtccatagtgccagtggttatggcaggagtgctgggtatttatgggctgattatcgctgtcatcattagtaccgggattaatcccaaggcgaaatcttactacctctttgatgggtatgcacatctttcatctggcctggcttgtggtcttgctgggctgtcagctgggatggcaattggaatcgtcggagatgcgggtgtcaggtatgcaacacgcgcagcagccaaagctttttgtcgggatgatccttatcctcattttcgctgaagcactggctctctacggccttattgttggcatcatcttgtcttctagggcaggccagtccagagcaga

SEQ ID NO: 1997 - DNA, 699 bp, Brassica juncea
ggctgcttatggaacagcaaagagtggagttggtgtggcttctatgggagtcatgagacccgagcttgtgatgaaatccatcgtccctgttgttatggctggagtgttgggtatttacggattgattattgctgttatcatcagtaccgggattaacccaaaagctaagtcttactacctcttcgatggatacgcacatctctcctccggtcttgcttgtggtcttgctggtctttccgctggaatggccattgggattgtgggtgatgctggtgtcagggcaaatgctcagcagcctaagctctttgttgggatgattcttatccttattttcgcggaagcgcttgctctttacgggcttattgtaggtatcatcctttcctctagagctggtcagtctagagctgaatgagaaagtaatcacaagatttaccccaatggtactacttcctttacttttgtatgcgttctttagtatgtatcatcgaaactgaaaattttactggattcttggaactttgtttcagaagcaaaaccagctatggttatttattgtttggttatgtaataaagagctcagaggagcttgataagttttttttttgtattcttgtattgtcctgaggaagtaaaaatacatttatttgtaaagaagtttcctttctgaaaccaaaaaaaaaacataagttccaaaactga

SEQ ID NO: 1998 - DNA, 642 bp, Pisum sativum
tgcggcttatggaactgcgaagagcggtgttggtgtagcgtcgatgggtgtgatgagacccgaacttgttatgaaatcgattgtgcctgttgttatggctggtgtcttgggtatttatggtttgattatcgctgttattatcagtaccggcattaaccctaaggctaaatcttattatctttttgacggttatgctcatctttcttctgggcttgcttgtggtcttgctggtttgtctgctggcatggctattgggattgttggtgatgctggtgttagagcaaatgctcaacagccgaagctttttgtcggtatgattctcattctcatctttgctgaagcattggcattgtatggtctcattgttggcatcatcctctcttcccgtgctggccaatccagagctgagtaatatcaattttatcattgcttgtagggcacatagccacagattcatgtattgtgaactttattagagacttgggcagagtaagggtggagctttgtcatgtttttctttcttcttatgtagtcattataaaattaactctcctatggaataaagcctatcaaactatttccctggcattattgtatttattgacgttgagtcaaactagattagtgatctttgtaagaaac

SEQ ID NO: 1999 - DNA, 1435 bp, Pseudoroegneria spicata
  misc_feature (392)..(392): n is a, c, g, or t
  misc_feature (881)..(881): n is a, c, g, or t
gccgctggcttaaggaagcaagacctgaattggttgtctggccggtcatccagggagctaggccaaggatacacatggaggcgccggcggccagaggaggagcgcgaatgtggctgcggctggtcgtgtccgtggtggtggtgatggcgatggcggcagcgacggcgcgggcgcagctgcaggtcgggtactacgacacgctgtgcccggcggcggagatcatcgtgcagcaggaggtcagcaagggcgtctccggcagccccggcaccgccgccggcctcctccggctccacttccacgactgcttcgtcaggggttgcgacgggtcggtgctgctggactcgacgccgggcaaccaggcggagaaggacgcgccgcccaactcgagcctncgggggttcgaggtgatcgacgcggccaagacgcggctggagcaggcctgctacggcgtcgtctcctgcgccgacgtgctcgccttcgccgccagagacgccctcgccctggtcggaggcaacacgtaccaggtgccggcggggcggaaggacggcaacgtctcggtggcgggggagaccaacgggaacctgccgccgccgaccgccaacgtgaaccagctcaaccagatcttcggctccaagggcctctcccaagcccagatggtcgcgctctcaggggcgcacacggtggggatggcgcagtgcagctccttcagcagccggctctactcgtacgggaccagcggcgggaaggaccccagcatggacccgagctacctggccacgctcagcacgcagtgcccgcagtccggcgcgagccagcccgtggccatggaccccgtcacgcccaacaccttcgacaccaactactacgccaacgtcgccgcnaaccgcggcctgctcacctccgaccaggcgctgctcgccgacaacagcaccgccgcgcaggtcctcggctacaccaccagccccggcaccttccagaccgacttcgccaacgccatggtcgccatgggcgccatcggcgtgctcaccggcaacagcggcaccatcaggaccaactgcagggtcgtcggctgagctcatccatcaagcacctgatgaatctagttctggtactaccgatcgatcgagcgagcgcgcgattgaattgaaatgtactgtggcgtagatagggtgtaagaagctgtttgatcattcatttggtcgatctgttctgtactcgctagctagcttagcttagcttagcccggccgtcctctctcttcttcttgatcttgcatactttctttctctgcttgtactgtattctcttagcctctgtatgtatgtattatctagctactggaccgagaactgtatgtaatgacatgatcacagcatgattgggttgggtaccaatgtaccaatatacagtgcttaataaaaagctactacagaca

SEQ ID NO: 2000 - DNA, 1595 bp, Triticum aestivum
cggctccgctccacctggactcgcacgatttctcctcggctcatccttaaccaaagttaagaagatagcatcggcatcccacggattagatagcgccaccggaaagttgctgctgctgctgctatatatctcttgcggcctccaggctccagcgtcgaggattaattgccgccagcttaaggaagcaagacctgaattggttgtctggccggccatccagggagctaggccagggatatacatacatggaggcgccggcggccagaggaggagcgcgaatgcggctccggctggtgtccctggtggtggtggtggcgatggcggcggcgacggcgcgggcgcagctgcaggtcgggtactacgacacgctgtgcccggcggcggagatcatcgtgcagcaggaggtcagcaagggggtgtccggcagccccggcaccgccgccggcctcctccggctccacttccacgactgcttcgtcaggggctgcgacgggtcggtgctgctggactcgacgccgggcaaccaggcggagaaggacgcgccgccaaactcgagcctccgcgggttcgaggtgatcgacgcggccaagacgcggctggagcaggcctgctacggcgtcgtctcctgcgccgacgtgctcgccttcgccgccagagacgccctcgccctggtcggaggtaactcgtaccaggtgccggcggggcggcgagacggcaacgtctcggtggcgggggagaccaacgggaacctgccgccgccgaccgccaacgtgaaccagctcaaccagatcttcggctccaagggcctcacccaggcccagatggtcgcgctctcaggtgcgcacacggtggggatggcgcagtgcagctccttcagcagccggctctactcgtacgggaccagcgggggcaaggaccccagcatggacccgagctacctggcgacgctgagcacgcagtgcccgcagtccggcgccagccagcccgtggccatggaccccgtcacccccaacaccttcgacaccaactactacgccaacgtcgccgccaaccgcggcctgctcgcctccgaccaggcgctcctcgccgacaacagcaccgccgcgcaggtcctcggctacacctccagccccggcaccttccagaccgacttcgccagcgccatggtcgccatgggcgccatcggcgtgctcaccggcaaccaaggcaccatcaggaccaactgcagggtcgtcggctgagctcgtcgatcaaccacctgaactgaatttggttctggtatagagtgtaagaagctgtttgatcattcctttggtcgatctgtactagctagctagcttagcttagccccaccctcctctctcttcctctgcttcatcttgcagcatactttctttctctgcttttgtattctcttaattagcctctgtatgtatgtattactgtctagcgactggaccaagaactgtatgtaatgacatgatcacagcatgattgggttgggtaccaatgtaccaatatacagtacagtgcttaataaaaagctactacagacagacagacagacatgtgttccaaaaaaaaaaaaaaaacga

SEQ ID NO: 2001 - DNA, 1989 bp, Triticum aestivum
tcgactaatcatctgcggcgcctgcttggcgcaacgtgccctcttgtgtcacatgctcggtctcgccacatcgccacactgctcaccactgcaatcacactgacactgtccgatcgaattgcccgtctgtcgaccgatccgtccccagtaaatcaatctgcctcagatcaaaactgaaaaggtagtaagaaagaacaagcatttcaccgatgaacgcgtctttctgccatggatcacatcgatcaaaggttagtaattttatcgcctcaatgatagcccaaaaagtttgggcccgggtccctctcttccactaagctagttgtgctactacgccactctcaccacatggctcctgccaccctcgcctcgcctcacccgccttcgcccgcctacaaaaccggcctccgctcccacctggactcgcaccgatttctcctcggctccatccttaaccaaagttaagaagatagcatcggcatcccacggattagatagcgccaccggaaagttgctgctgctgctgctatatatctcttgcggcctccaggctccagcgtcgaggattaattgccgccagcttaaggaagcaagacctgaattggttgtctggccggccatccagggagctaggccagggatatacatacatggaggcgccggcggccagaggaggagcgcgaatgcggctccggctggtgtccctggtggtggtggtggcgatggcggcggcgacggcgcgggcgcagctgcaggtcgggtactacgacacgctgtgcccggcggcggagatcatcgtgcagcaggaggtcagcaagggggtgtccggcagccccggcaccgccgccggcctcctccggctccacttccacgactgcttcgtcaggggctgcgacgggtcggtgctgctggactcgacgccgggcaaccaggcggagaaggacgcgccgcccaactcgagcctccgcgggttcgaggtgatcgacgcggccaagacgcggctggagcaggcctgctacggcgtcgtctcctgcgccgacgtgctcgccttcgccgccagagacgccctcgccctggtcggaggcagctcgtaccaggtgccggccgggcgacgagacggcaacgtctccgtggcgggggagaccaacgggaacctgccgccgccgaccgccaacgtgaaccagctcaaccagatcttcggctccaagggcctctcccaggcccagatggtcgcgctctcaggggcgcacacggtggggatggcgcagtgcagctccttcagcagccggctctactcgtacgggaccaacggcggcaaggaccccagcatggacccggcctacctggccacgctgagcacgcagtgcccgcagtccggcgccagccagcccgtggccatggaccccgtcacgcccaacaccttcgacaccaactactacgccaacgtcgccgccaaccgcggcctgctcgcctccgaccaggccctcctcgccgacaacagcaccgccgcgcaggtcctcggctacaccgccagccccggcaccttccagaccgactttgccagcgccatggtcgccatgggcgccatcggcgtgctcaccggcaaccaaggcaccatcaggaccaactgcagggtcgtcggctagctgctcgtccatcaggaacctgaactgaatttggttctagtatagagtgtaagaagctgttcgatcgatctgtactagtagctagatagcttagcttagccccaccgtcctctcttcttcttcttcttcttcttcttcttcttcttcttcttcttcttcttcttcttcctcatgcatgctttctttctgcttttgtattctcttaattagcctctgtatgtatgtcttactatctagcaattggattgggaaatgtatgtaatgacatgatcacaacatgattgggtttgggtaccaatgtaccgatatacagtgcttaataaaaacctaatactactacagaaac

SEQ ID NO: 2002 - DNA, 2613 bp, Secale cereale
aggcaacttcctccatcatggcaccttcgtcatgcaaagagtttatacagatcacacggatgcattcacaacagtggccgctacttaataagctttacacattacaaaggttgccggccggagagccgacgttgttgtacagttcctgcacgcacggacgtacgtacgcgcgcagagccagcgtggcaaggtgatcaaccagtcgatcgacgcagaaacatgaatgaaaaccatgcgctccggctcctcgatctcctctcagcccggtgggctccgctcaagggccgtagatatttctggggatgacgatgtcgccgatgttgttgtgccacgggtcagccaggtgggtggccaggttctccagcgggccggtgccggggtacgccgactgctgcacgcagaaccccacgaacgccagcatcgccagccgcccgttcttgatctccttgagcttgagctcctcgaacttggcggggtccttggagaagccgagcgggtcgaaggcgccgccggggtacttcttcttctccgggtccttctccatggtgcgctgctgctccgcgaaggcgatggccaggaactcgatcgccaggatggtcggcaggttgccccacggcaccgggttgcccaggtacgtcgcctgcccgtcggggagcgccgcccactcctgcgccttcacccagttgcccagccccagcgcctccggcaccagcaccccaggcacgcagagcatggcccaacggcagtggtagatctcggactccttgaaccgctcgaagttctccggcacggtggcgaggcccagggggtcgaacccgaagtcccctggcgaggagccgtcgaggtgggcggggcggggctggccggggaaccactcggcggacatggtgacgcggccggaggtggtggcgtaggcgcagaacggcagcccggagcggccggaccgggacgaaggcgccagcaggctcggcacgccgacggcgctgcagctcctcagcccgctcgacgatgccatcgccattgttgctctctggatgctggctgttccttgctgcggtgagacaacaacaggaagataggcacgtccatcgcatcgatagatagcgccaccggaaagttgctgctgctgctataaactatctcttgcggcctccaggctccggcgtcgaggattacttggcgctggcttaaggaagcagagctgatcgatcgagtgtccggccggccatccagggagctaggccagggatatacatacatggaggcgccggcggccagagggggagcgcgaatgcggctgcggctgcggctggtgtgcctggtggtggtgatggcgacggcgcgggcgcagctgcaggtcgggtactacgacacgctgtgcccggcggcggagatcatcgtgcagcaggaggtcagcaagggcgtctccggcagccccggcaccgccgccggcctcctccggctccacttccacgactgcttcgtcagggggtgcgacgggtcggtgctgctggactcgacggcgggcaaccaggcggagaaggacgcggcgcccaactcgagcctgcgggggttcgaggtgatcgacgcggccaagacgcggctggagcaggcctgctacggcgtcgtctcctgcgccgacgtgctcgccttcgccgccagagacgccctcgccctggttggaggcagctcgtaccaggtgccggcggggcggcgagacggcaacgtctcggtggcgggggagaccaacggcaacctgccgccgccgaccgccaacgtgaaccagctcaaccagatcttcggctccaagggcctctcccaggcccagatggtcgcgctctcaggggcgcacacggtggggatggcgcagtgcagctccttcagcagccggctctactcgtacgggaccaacggggggaaggaccccagcatggacccgacctacctggccacgctgagcacgcagtgcccccagtccggcgccagccagcccgtggccatggaccccgtcacccccaacaccttcgacaccaactactacgccaacgtcgccgccaaccgcggcctgctcgcctccgaccaggccctcctcgccgacaactccaccgccgcgcaggtcctcgcctacaccgccagccccggcaccttccagaccgacttcgccagcgccatggtcgccatgggcgccatcggcgtgctcaccggcaaccaaggcaccgtcaggaccaactgcagggtcgtcggctagctgagctcatccatcaatcaaacaccttctgattctggttcttctcgtaccgatcgggcgatcgagagagcgcgtgatcgaattgaaatgtactatggccgtacagtagataggtatagagtgtaaactgtttggtcgatctgtactcgctagctcttaattagattagcttctctcttcttcttattcttcttcttcttattcttcatcttgcagcatactttctttctctgcttgaattctcttagcctctgtatatgtatgtattatctagctaccggcctgggaactgtatgtaatgacatgaacacaacatgattgggttgggtaccaatgtaccaaatatacagtgcttaataaaaaca

SEQ ID NO: 2003 - DNA, 1475 bp, Leymus cinereus x Leymus triticoides
  misc_feature (9)..(9): n is a, c, g, or t
gcaagatancagcgcatagatagatagatagatagcgccacccgaaagttgctggcgcttaaggaagcaagagctgatcaatcgagtgcccggccggccatccagggagctaggcgcgggatacatggaggcgcgaatgcggctgcggctgctgtccgtggtggtggcggtgatggtgatggcgatggcggcagggacggcgcgggcgcagctgcagatcgggtactacgacacgctgtgcccagcggcggagatcatcgtgcaggaggaggtcagcaagggggtgtccggcagccccggcacggccgccggcctcctccggctccacttccacgactgcttcgtcagggggtgcgacgggtcggtgctgctggactcgacgccgggcaaccaggcggagaaggacgcgccgcccaactcgagcctccggggcttcgaggtcattgacgcggccaagacgcggctggagcaggcctgctacggcgtcgtctcctgcgccgacgtgctcgccttcgccgcaagagacgccctcgccctggtgggaggcaactcgtaccaggtgccggccgggcgacgagacggcaacgtctcggtggcgggggaaaccaacgggaacctgccgccgccgaccgccaacgtgaaccagctcaaccagatcttcggctccaagggcctctcgcaggcccagatggtcgcgctctcaggggcgcacacggtggggatggcgcagtgcagctccttcagcaaccggctctactcgtacgggaccagcggcgggaaggacccaagcatggacccgagctacctggcgacgctgagcacgcagtgcccgcagtccggcggtgcaggccagctcgtggccatggaccccgtcacgcccaacaccttcgacaccaactactacgccaacgttgccgccaaccgcggcctgctcacctccgaccaggcgctgctcgccgacaacagcaccgccgcgcaggtcgtcggctacaccaacagccccggcaccttccagaccgacttcgccaacgccatggtcgccatgggcgccatcggcgtgctaaccggcagcagcggcaccatcaggaccaactgcagggtggtcggctagctgatcgatcaagcgcctgatgaatctgctcctgctaataccgatcgatcgatcgaccgcgcgatcaaattgaaattggaatgtatggcgtagataggtatagagtgtaagaagttgtttgatcattcatctggtcgatctgtactgtacacgctagctagcttagcttagcttagcccgaccgtcctctctcttcttgatctcgcatactttctttctctgcttgtattctcttagcctctgtatgtattatctagctactggactgggaactgtatgtaatgacatgatcacatgattgggttgggtaccaatgtaccgatagtgcttaataaaaagctactacagacatgtgctactacta

SEQ ID NO: 2004 - DNA, 1085 bp, Triticum aestivum
tgaaggggaaggggtggggccttttttttaatacccccattggcgaaagggggttttctcaacaagccaaattagggtgggaacccccggggtttctccaattccggccttttaaaacgggggccaatgatttttaaacgactccactatggggggaatgggcccgaacttgcatgctcccggccgcaatggcccgggatttagcgtggtcgcggccgaggtctcgcagctagatagatccatccaccatttctcaaaatagaaaaagaaaaaagaagatagatccatccaccatggccagcagcaagacattgctcctcgtcctgtgcgcggcggctgcggctgcgatgctgagcccggcttccgcggcggacgacctgaccaagttcaaggtgtacttccacgacgtgctagcggggaagagcccgacggcgatccggattgctcaggccgcgtccaccaacagctcctccaccttcttcggcgcggtggtggccatcgacgacccgctcaccactacccccgccgtcacgggctccgccaaatccaaggacgaggtgggccgcgcgcaggggagttacacgttcgccgaccaggccaccttcgggctcctcatgaacatgaacttcgtgttcaccgccggggactacaagggcagcagcctgaccatctacggccgcaacgaggtgctttcggcggtgagggagatgagcatcatcgggggcacgggcaagttccgcatggctcgcggctacgtccaggcgagcaccgtggactccggtgccaagtccggcgagaccgtcgtcgagtacactgtctacgtcaaggctgcggcggcgtagcggcggctgcctgacggaaaatattgtagttttgcttggaataagtggacttttgcagatttgttgcgtttgttatcgtgatggatgatgtgcatttacggatttcagtgctgtttcgtgtctgtggtttgtggttttgctaatcgcctcagctctttggaagatataatttgcgtccatttttatgtcaaatttctggttgctgaaatcaaccaaaaacctcggccgcgaccacgctaatcc

SEQ ID NO: 2005 - DNA, 1101 bp, Triticum aestivum
cgactccactatggggggaatgggcccgaacttgcatgctcccggccgcaatggcccgggatttagcgtggtcgcggccgaggtctcgcagctagatagatccatccaccatttctcaaaatagaaaaagaaaaaagaagatagatccatccaccatggccagcagcaagacattgctcctcgtcctgtgcgcggcggctgcggctgcgatgctgagcccggcttccgcggcggacgacctgaccaagttcaaggtgtacttccacgacgtgctagcggggaagagcccgacggcgatccggattgctcaggccgcgtccaccaacagctcctccaccttcttcggcgcggtggtggccatcgacgacccgctcaccactacccccgccgtcacgggctccgccaaatccaaggacgaggtgggccgcgcgcaggggagttacacgttcgccgaccaggccaccttcgggctcctcatgaacatgaacttcgtgttcaccgccggggactacaagggcagcagcctgaccatctacggccgcaacgaggtgctttcggcggtgagggagatgagcatcatcgggggcacgggcaagttccgcatggctcgcggctacgtccaggcgagcaccgtggactccggtgccaagtccggcgagaccgtcgtcgagtacactgtctacgtcaaggctgcggcggcgtagcggcggctgcctgacggaaaatattgtagttttgcttggaataagtggacttttgcagatttgttgcgtttgttatcgtgatggatgatgtgcatttacggatttcagtgctgtttcgtgtctgtggtttgtggttttgctaatcgcctcagctctttggaagatataatttgcgtccatttttatgtcaaatttctggttgctgaaatcaaccaaaaacctcggccgcgaccacgctaatccgccggcatggcgccgggacatgcacgtcgggccaatcgcctatagtgagtcgatacaatcactgcccgcgtttacacgtctgaatgggaaacctgccgttacaaattaatgctgtgagaatcccccttcgcattgggtatacgaagagccgcca

SEQ ID NO: 2006 - DNA, 794 bp, Secale cereale
gctagatccatccactatggccggcagcaaggtattgctcctcctcctgttcgcggcggcggctgctgctgcgatgctgagcccggcttccgcggcggacaacctgaccaagttcaaggtgtacttccacgacgtgctagcggggaagagcccgacggcgatccggattgcgcaggcggcgtccaccaacagctcctccaccttcttcggcgcggtggtggccatcgacgacccgctcaccaccagccccgccgtcacgggctccgccaaatccaaggacgaggtgggccgcgcgcaggggagctacacgttcgccgaccaggccaccttcggcctcctcatgaacatgaacttcgtgttcaccgctggggactacaagggcagcagcctgaccatctacggccgcaacgaggtgctctcgacggtgagggagatgagcatcatcgggggcacgggcaagttccgcatggctcgcggctacgtcgaggcgagcaccgtggactccggcgccaagtccggcgagaccgtcgtcgagtacactatccacgtcatggctgctgcggcgtagcggcggctgcccgacggaaaatattgtaattttgcttggaataaatggacttttgcagatttgttgcgtatgttatcgtgatggatgatggacatttacggatttgagtgatgtttcgtgtctctggtttctggttttgctaatcacttcacctctttggaagatataatttgcgtcggtttttatgtcaaatttgtggttgctgaaatcaatcaaccaaagatta

SEQ ID NO: 2007 - DNA, 810 bp, Pseudoroegneria spicata
acagtagcccgctcccccttttcgccattacccaggtcccagggctcacagctagctagatccaccagccatggccggaagcaaggcagtgctcctcctcctcctgtgcgcggcggcggcggcggtgctgctgaccccggcctccgcagcggacgacggcctgaccaagttcaagctgtattggcacgacgtgctggcggggacaagcccgaccgcgatccggattgcgcaggcggcgtccaccaacagctcctccaccttcttcggcgcggtggtggccatcgacgacccgctcaccaccggccccgccgtcacgggctccgccaaatccaaggacgagatcggccgcgcgcaggggacctacacgttcgcggaccaggccaccttcgggctcctcatgaacatgaacttcgtgttcaccgccggggactacaagggcagcggcctcaccatctacggccgcaacgaggtgctgtcggcggtgagggagatgagcatcgtcgggggcaccggcaagttccgcatggcgcgcggctacgtcgaggcgcgcaccatggactccggcgccaagtccggcgagaccgtcgtcgagtacaccgtctacgtcaaggcggcggcggcggcggcgtagcggcgtagcggcagctgccagagcttaatttagctaatgatgtccagtccatgactaacggaaaagatggttttgcttgtaataaatggatttcgcagatttgctgcgtttgttatcgtgatggatgatgggtgtttgcagatttgagtgttggatgtgtgtgatttgtggttttgcta

SEQ ID NO: 2008 - DNA, 711 bp, Hordeum vulgare
tagcccgctcccccttttcgtaattacccagggctctttgctaagctagatccaccagccatggccggcagcaaggcagtgctcctcctcctcctgtgcgcggcggcgctgctgaccccggcctccgcggcggacgacggcctgaccaagttcaagctgtactggcacgacgtgctggcggggacgagcccgaccgcgatccggattgcgcaggcggcgtccaccaacagctcctccaccttcttcggcgcggtcgtggccatcgacgacccgctcaccaccggccccgccgtcacgggctccgccaaatccaaggacgagattggccgcgcgcaggggacctacacgttcgcggaccaggccaccttcggcctcctcatgaacatgaacttcgtcttcaccgccggggactacaagggcagcggcctcaccatctacggccgcaacgaggtgctgtcggcggtgagggagatgagcatcgtcgggggcaccggcaagttccgcatggcgcgcggctacgtcgaggcgcgcaccatggactccggcgccaagtccggcgagaccgtcgtcgagtataccgtctacgttaaggcggcggcggcgtagcggcagctgccagagcttaattagctaatgatgtccggtccatgactaacggaagagatggttttgcttgtaataaatggattttgtatatttgctgcgtttgtt

SEQ ID NO: 2009 - DNA, 1068 bp, Hordeum vulgare
agcgcgtgcaacgcaaaggaaaaggagagaaaaacttaccataccaaccggcccgaccagtgtaggatacctgtcccacatgcgctgcgcaccgaatcaagtggccaccgagagagatagagtggagtagtggacaccgcgccacccactcccatgtccggtcaccctctcctcaaatacgccacactagcccgctcccccttttcgtaattacccagggctctttgctaagctagatccaccagccatggccggcagcaaggcagtgctcctcctcctcctgtgcgcggcggcgctgctgaccccggcctccgcggcggacgacggcctgaccaagttcaagctgtactggcacgacgtgctggcggggacgagcccgaccgcgatccggattgcgcaggcggcgtccaccaacagctcctccaccttcttcggcgcggtcgtggccatcgacgacccgctcaccaccggccccgccgtcacgggctccgccaaatccaaggacgagattggccgcgcgcaggggacctacacgttcgcggaccaggccaccttcggcctcctcatgaacatgaacttcgtcttcaccgccggggactacaagggcagcggcctcaccatctacggccgcaacgaggtgctgtcggcggtgagggagatgagcatcgtcgggggcaccggcaagttccgcatggcgcgcggctacgtcgaggcgcgcaccatggactccggcgccaagtccggcgagaccgtcgtcgagtataccgtctacgttaaggcggcggcggcgtagcggcagctgccagagcttaattagctaatgatgtccggtccatgactaacggaagagatggttttgcttgtaataaatggattttgtatatttgctgcgtttgttatcgtgatggatctgagtgctggctgtgtgtgatttgtggttttgttaactgacgggtcaacttttggaaggataataggaaatgtttatgacacggcgcgtcggtcgaactatttcggcccgacgtttgtccgatctggacggatcgcgctcgtcccctctgcaggtcg

SEQ ID NO: 2010 - DNA, 814 bp, Triticum aestivum
gtccggccaccccacctcgcctgacatctcctcaaatacgccacactagcccgcttccctttttcgccattacccagggctcacatacctagatccaccagccatggccggcggcaaggcagcgctcctcctcctcctgtgcgcggcggtgctgctggccccggcctccgcggcggacgacggcctgaccaagttcaagctgtactggcacgacgtgctggcggggacgagcccgaccgcgatccggatcgcgcaggcggcgtccaccaacagctcctccaccttcttcggcgcggtggtggccatcgacgacccgctcaccaccgggcccgccgtcacgggctccgccaagtccaaggacgagatcggccgcgcgcaggggacctacacgttcgccgaccaggccaccttcggcctcctcatgaacatgaacttcgtgttcaccgccggggactacaagggcagcggcctcaccatctacggccgcaacgaggtgctgtcagcggtgagggagatgagcatcatcgggggcaccggcaagttccgcatggcgcgcggctacgtcgaggcgcgtaccatggactccggcgccaagtccggcgagaccgtcgtcgagtacaccgtctacgtcaaggcggcggcggcgtagcggcagctgccagagcttaatttagttgatgatgtccactccatgactaacggaacatatggttttgcttgtaataaatggatttcgcagatttgctgcgtttgttatcgtgatggacgatgggtctttgcagatttgagtgctgactgtgtgtgatttgtggtt

SEQ ID NO: 2011 - DNA, 1318 bp, Triticum aestivum
atctcctcaaatacgccacactagcccgctcccctttttcgccattacccagggctcacagctagctagatccaccagccatggccggcggcaaggcagcgctcctcctcctcctgtgcgcggcggtgctgctgaccccggcctccgcggcggacgacggcctgaccaagttcaagctgtactggcacgacgtgctggcggggacgagcccgaccgcgatccggatcgcgcaggcggcgtccagcaacagctcctccaccttcttcggcgcggtggtggccatcgacgacccgctcaccaccggccccgccgtcacgggctccgccaagtccaaggacgagatcggccgcgcgcaggggacctacacgttcgccgaccaggccaccttcggcctcctcatgaacatgaacttcgtgttcaccgccggggactacaagggcagcggcctcaccatctacggccgcaacgaggtgctgtcggcggtgagggagatgagcatcatcgggggcacgggcaagttccgcatggcgcgcggctacgtcgaggcgcgcaccatggactccggcgccaagtccggcgagaccgtcgtcgagtacaccgtctacgtcaaggcggcggcggcggcgtagcggcagctgccagagcttaatttagctaatgatgtccagtccatgactaacggaaaagatggttttgcttgtaataaatggatttcgcagatttgctgcgtttgttatcgtgatggatgatgggtgtttgcagatttgagtgctggctgtgtgtgatttgtggttttgctaactggtgcgtcaactttttgggagggtaatttgcatcgattttatgttaatgttcctattgttttgggtggcagattccatatgttatttctcattgcgaatacagattcttcttgtaccgtagtagctcgactgctttcctgacttgactcgataactgctttcgcttccccaatcccagagcatccaagagattcgtttccacacgcctgatccgcagttcgattcgtgccggtgccggcaagagatcctgttcctgttgggcaagggattttctagctagaaaagcggcggattcgattctttctttgatagcagaacgggatattccactcttttagatgcgcaccgcacttcatcagtagaaaagcccggcgcctgaaacccaagctcaaaaccacccttcctttagttggaccggcatacatatcttatctcgtaagaaaccggggaatattgatttcgagtaagcatcgtatcctgatcctgctattgatgtagatttagccacacctgag

SEQ ID NO: 2012 - DNA, 827 bp, Triticum aestivum
gtccggccaccccacctcatctgacatctcctcaaatacgccacactagcccgctcccctttttcgccgttacccagggctcgcagctagccagatccaccagccatggccggcggcaaggcagcgctcctcctcctcctgtgcgcggcggggctgctgaccccggcctccgcggcggacgacggcctgaccaagttcaagctgtactggcacgacgtgctggcggggacgagccccaccgcgatccggatcgcgcaggcggcgtccagcaacagctcctccaccttcttcggcgcggtggtggccatcgacgacccgctcaccaccggccccgccgtcacgggctccgccaagtccaaggacgagatcggccgcgcgcaggggacctacacgttcgccgaccaggccaccttcggcctcctcatgaacatgaacttcgtgttcaccgccggggactacaagggcagcggcctcaccatctacggccgcaacgaggtgctgtcggcggtgagggagatgagcatcatcgggggcacgggcaagttccgcatggcgcgcggctacgtcgaggcgcgcaccatggactccggcgccaagtccggcgagaccgtcgtcgagtacaccgtctacgtcaaggcggcggcggcggcggcgtagcggcggctgcctgagcttaatttagctaatgatgtccagtccatgactaacggaaaagatggttttgcttgtaataaatggatttcgcagatttgctgcgtttgttgccgtgatggatgatgggtgtttgcagatttgagtgctggctgtgtgtgatttgtggttttgct

SEQ ID NO: 2013 - DNA, 711 bp, Triticum aestivum
  misc_feature (1)..(1): n is a, c, g, or t
  misc_feature (10)..(10): n is a, c, g, or t
  misc_feature (131)..(131): n is a, c, g, or t
  misc_feature (134)..(134): n is a, c, g, or t
  misc_feature (234)..(234): n is a, c, g, or t
naggctgtanccgtcccgaatttcccggaaatcgttgacccaggggtccccggaacgcgtgggagagctcgcagctagctagatccatccaccactggccggcagcaaggcattgctcctcctcctgtgcncgncggcggcggctgctatgctgagtcaggcttcgcgggccggcgacctgaccaagttcaaggtgtacctccacgacggaatagcggggaagagcccgacgcngatccggattgcgcaggcggcgtccaccaacagctcctccaccttcttcggcaccttgtggccattgatgacacgataaccactgacaccgccgtgacgtgagggtccacaaaatacaaggaagaggtggcccgcgcacaggggagctacacgttcgccgaccaggccaccttcgggctcctcatgaacatgaacttcgtgttcaccgccggggactacaagggcagcagcctgaccatctacggccgcaacgaggtgctttcggcggtgagggagatgagcatcattgggggcacgggcaagtttcgcatggctcgcggctatgtccaggcgagcaccgtggactccggcgccaagtccggcgagaccgtcgtcgagtacactatctacgtcaaggctgctgcggcgtagcggccgctgccggacggaaaatattgtaattttgcttggaataaatggacttttgcagatttgttg

SEQ ID NO: 2014 - DNA, 771 bp, Avena sativa
atggccagtcactccccacctctcattatcctaaaaaaagtacgccgcactagctagctcactcccctcttcccccactagctcacccagagctcacggccagatccatcggccatggccggccccaaggcagcgcttctcctcctcctgtgcgccatcgcggcggcgctgctgctgaccccggctaccgcggccgacgacggtctgaccaagttcaaggtgtactggcacgacgtgttcggggggaagagcccgacggcgatccggatcgcgcaggcggcgtccaccaacagctcctccaccttcttcggcgccgtggtggccatcgacgacccgctgaccaccacctccgccgtggcggggtccgccaggtccaaggacgaggtgggccgcgcgcagggcacctacaccttcgcggaccagcgcaccatcggctgcctcatgaacatgaacttcgtgttcaccgccggggactacaagggcagcggcctcaccatctacggccgcaacgaggtgctcacggccgtcagggagatgagcatcgtcggcggcaccggcaagttccgcatggcgcgcgggtacgtcgaggcccgcaccatcagcaacgacaacggcgagaccgtcgtcgagtacaccgtcttcgtcaagccggccgcggcggcctaggctgtagacggagctgaatttgttaggccgtagtgctagcagtgtctatctatccgctgatgagcgatgggtctggtcgaatgtctgatgctgaaaacgatggga

SEQ ID NO: 2015 - DNA, 2361 bp, Triticum aestivum
gattgatgattagtctggaaaggaaaatcatcctaaacaagccctctccactgcctctcctttctcccttccgctggcgcgccttgctctgcatctcctcgccttcgatctctctctaccggcgggcctcctcgctgtcgctgctgccgaggctgtttgttgcccatccagtagattgtgaattgctgtagacaagaggcacattggccacaatggctctaacactcctacgagggatcagaacacaaaccttatttggagcaaatgcaggcctgttctgtaccactcgacgtcatccgctagcccacttcacaactagggtggagagcgtgcagactagtgagcccaaatcagtgcgcaaatcaattcaacaggccaccaaggaggcggcggagcacaagacacaaggttttgaagcggtgatcggcattgagacccatgtccagctctcgaccatcacaaaggcattttgctcctgcccctacgactatggctcccagccaaacagcaccgtttgccccacctgcatgggccaccccgggacattgccggttctgaacgcaaaggttgttgaatgtgctgtcaagctaggcctcgctctcaactgtgagatttccatgacatccaagtttgaccgaaagcagtacttctacccagacctgcccaagggataccagatttcgcagtttgacattccgattgctgagaagggttaccttgatttggatattccaatggagtttggtggtggtcacaggcgatttggggtcacgcgggttcatatggaagaagatgctggcaagctgcttcactctgaatccgggagtttttctcaggttgacctaaatagagccggcgtccctttgctagagattgtctcagaaccagatatgaggacaggcatagaggctgctgagtatggtgctgagatacaaagggttgttagatacctgggagtgggcaatggcaacatgcaggaaggttccctccgctgtgatgtcaatgtatctgtccggcctattggacaatcagaattcggtacaaaggttgaaataaagaatatgaactcattttctgaaataagtagggcaatagattatgagatatcccgacagattcttcttcacaaagaaagccaggctgacaaaattgtacaggaaacccgtctatgggatgaatcttctcagaaaacttttacaatgcggaaaaaggagggacttgccgactacagatattttcctgagcctgatcttcctgaagttgttctgactagtgattacattgatgaaattcgtaattcaatgccggagcttccagaggcaaagcgtaggcgttatgagaacatggggctcagcatgcaagatgttattttccttgctaatgacgatattgttgctcatttcttcgattctacacttgagcgtggtgctgatgcaaagctggctgctaattggatcatgggtgacattacggcttatctgaagaatgaaaagctctctattgatgaaattaaactaacacctcttgagctttctgaactgattgcattcataaagaatggtactatcagtgggaagattggcaaggagattcttgttgagctcattaccaaaggcggaactgttaagtcggtgatagaggagaaagatttggttcagatagcagatccagcagcaattgaggccatggtagataaagtactcgccgagaatccgaagcaacttgagcagtatcgggctgggaaaaccaagttgcagggatttttcgctggccaggtgatgaaagcatcgaaaggtaaagcaagtcctgttttattgaacaaaatcctcggggagaagttgaagggcaattaaaattgccgaggggtgtttcggcacacagagaatattttgcccttgatgagtgaaccatcagattaactaaagtgaaaccctgcagcggaaccgcattcttttgtaaagacacttggagtttttttttgagttgttgattgttttttagatagctaaccgcttattccaagcggtgacacttggagtttgaagtgttgattacatttcgctctcttttcactagagagtggattttcgaaaagcaatccagttcacatgatacaatgaaggatatgcatggtatgtgtttgagctgataatagactggagtggcgtgttgtacagatgaatcagttgcatatgcttacatgtttctactcgcatcttttttgcatttgatcttacgcagctgtaaactcatttttaatttggacacatcagttacgatcctgaatgtggctttaccttttgaattactactaagttaagcccttgagtttgttccagcattatcatatcattttgaact

SEQ ID NO: 2016 - DNA, 2018 bp, Secale cereale
cctctcctttctcccttccgctggcgcgccttgctctgcacctcctcgccgtcgatctctctctaccggcgggcctcctcactgtcgctgccgccgaggctgtttcttgcccatccagtagattgtgaattgcagtagacaagaggcacattggccacaatggctctaacgctcctacgagggatcagaactcaaaccttatctggagcaaatgcagggctgttctgtaccactcgacgtcctccgctagcccacttcacagctagggtggagagtgtgcagactagtgagcccaaatcagtgcgcaaatcaattcaacaggctaccaaggaggcagcggagcacaagacacacggttttgaagcggtgatcggcattgagacccatgtccagctctcgaccatcacaaaggcattttgctcctgcccatacgactatggctcccagccaaacagcaccgtttgccccacctgcatgggccaccccgggacattgccggttctgaacgcaaaggttgttgaatgtgctgttaagctaggcctcgctctcaactgtgagatttccatggcatccaagtttgaccgaaagcagtacttctacccagacctgcccaagggataccagatttcgcagtttgacattccaattgctgagaagggttaccttgatttggatattccaatggagtttggtggtggtcacaggcgatttggggtcacgcgggttcatatggaagaagatgctggcaagctgcttcactctgaatccgggagtttttctcaggttgacctaaatagagccggcgtccctttgctagagattgtttcagagccagatatgaggacaggcatagaggctgctgagtatggtgctgagatacaaagggttgttagatacctgggagtgggcaatggcaacatgcaggaaggttccctccgctgtgatgtgaatgtatctgttcggcctattggacaatcagaattcggtacaaaggttgaaataaagaatatgaactcattttctgaaataagtagggcaatagattatgagatatcccgacagattcttcttcacaaagaaagccaggctgacaaaattgtacaagaaacccgtctatgggatgaatcttctcagaaaacttttacaatgcggaaaaaggagggacttgctgactacagatattttcctgagcctgatcttcctgaagttgttctgactagtgagtacattgatgaaattcgtaattcattgccggagcttccagaggcaaagcgtaggcgttatgagaacatggggctcagcatgcaagatgttattttccttgctaatgatgatattgttgctcatttcttcgattctacacttgagcgtggtgctgatgcaaagctggctgctaattggatcatgggtgacattacggcttatctgaagaatgaaaagctctctattgatgaaattaaattaacacctctggagctttctgaactgattgcgttcataaagaatggtactatcagtgggaagatcggcaaggagattcttgttgagctcattaccaaaggcggaactgttaagtcggtgatagaggagaaagatttggttcagatagcagatccagcagcaattgaggccatggttgataaagtactcgccgagaatccgaagcaacttgagcagtatcgggctgggaaaaccaagttacagggatttttcgctggccaggtgatgaaagcatcgaagggtaaagcaagtcctgttttattgaacaaaatcctcggggagaagttgaagggcaattaaaattgccgagaggtgttttggcacacagagaatatcttgtcctggatgagtgaaccatcagattaactaaagcgaaatcctgcagcggaaccgcattcatttgtaaagacacttgcttcgagtttggagtgttgattacctttcgctcttttttcgtgtatttaaccaaaaactaccacatttcatggaaacgtgcccaaaaactatcactttacgaa

SEQ ID NO: 2017 - DNA, 2200 bp, Triticum aestivum
cctttctcccttccgctggcgcgccttgctctgcacctccccgccgtctatctctgtctaccggcgggcctccccgctgtcgctgctgccgaggctgtttgttgcccatccagtagattgtgaattgcagtagacgagaggcacattggccacaatggctctaacgctcttacgagggatcagaacacaaaccttatctggagcaaatgcagggctgttctgtaccactcgacgtcctccgctagcccacttcacagctagggtggagagtgtgcagactagtgagcccaaatcagtgcacaaatcaattcaacaggctaccaaggaggcagtggagcagaagacacacggttttgaagcggtgatcggcattgagacccatgttcagctctcaaccatcacaaaggcattttgctcctgcccatacgactatggctcccagccaaacagcaccgtttgccccacctgcatgggccaccccgggacattgccggttctgaacgcaaaggttgttgaatgtgctgtcaagctaggcctcgctctcaactgtgagatttccatgacatccaagtttgacagaaagcagtacttctacccagatctgcccaagggataccagatttcgcagtttgacattccgattgctgagaagggttaccttgatttggatattccaatggagtttggtggtggtcacaggcgatttggggtcacgcgggttcatatggaagaagatgctggcaagctgcttcactctgaatctgggagtttttctcaggttgacctaaatagagccggcgtccctttgctagagattgtctcagagccagatatgaggacaggcatagaggctgctgagtatggtgctgagatacaaagggttgttagatacctgggtgtgggcaatggcaacatgcaggaaggttccctccgctgtgatgtcaatgtatctgtccggcccattggacaatcagaattcggtacaaaggttgaaataaagaatatgaactcattttctgaaataagtagggcaatagattatgagatatcccgacagattcttcttcacaaagaaagccaggctgacaaaattgtacaggaaacccgtctatgggatgaatcttctcagaaaacttttacaatgcggaaaaaggagggacttgccgactacagatattttcctgagcctgatcttcctgaagttgttctgactagtgagtacgttgatgaaattcgtaattcaatgccggagcttccagaggcaaagcgtaggcgttatgagaacatggggctcagcatgcaagatgttattttccttgctaatgatgatattgttgctcatttctttgattctacacttgagcgtggtgctgatgcaaagctagctgctaattggatcatgggtgacattacggcttatctgaagaatgaaaagctctctattgatgaaattaaattaacacctcttgagctttctgaactgattgcattcataaagaatggtactatcagtgggaagattggcaaggagattcttgttgagctcattaccaaaggcggaactgtcaagtcggtgatagaggagaaagatttggttcagatagcagatccagcagcaattgaggccatggtagataaagtactcgccgagaatccgaagcaacttgagcagtatcgggctgggaaaaccaagttgcagggattttttgctggccaggtgatgaaagcatcgaaaggtaaagcaagtcctgttttattgaacaaaatcctcggggagaagttgaagggcaattaaaattgccgaggggtgtttcggcacacagagaatattttgcccttgatgagtgaaccatcagattaactaaagtggaaccccgcagcggaaacgcattcttttgtaaagacacttggagtttttttttgagttgttgattgtttttgagatagctaaccgcttattcaaagcggtgacacttacttggagtttgaagtgttgattacatttcgctctcttttcactacagagtggattttggaaaagcaatcgagttcacatgatacaatgaaggatatgcatggtatgtgtttgagctgatgatggagtggccagttgtacagatgaatcagttgcgtatgcttacatgtttctactcgcgtctttttttgcatttgatcttacgcagctgtaaactcattttta

SEQ ID NO: 2018 - DNA, 2137 bp, Triticum aestivum
gcctctcctttctccgttcctctggcgcgccctgctctgcacctccccgccgttgatctctgtctaccggcgggcctccccgctgtcgcagctgccgtggctgtttgttgcccatccagtagattgtgaacgagaggcacattggccacaatggctctaacgctcctacgagggatcagaacacaaaccttatctggagcaaatgcagggctgttctgtaccactcgacgtcctccgctagcccacctcacagctagggtggagagtgtgcagactagcgagcccaaatcagtgcgcaaatcaattcaacaggctaccaaggaggcagtggagcagaagacacacggttttgaagcggtgatcggcattgagacccatgttcagctctcaaccatcacaaaggcattttgctcctgcccatacgactatggctcccagccaaacagcaccgtttgccccacctgcatgggccaccccgggacattgccggttctgaacgcaaaggttgttgaatgtgctgtgaagctaggcctcgctctcaactgtgagatttccatgacatccaagtttgatcggaagcagtacttctacccagatctgcccaagggataccagatttcgcagtttgacattccgattgctgaaaagggttaccttgatttggatattccaatggagtttggtggtggtcacaggcgatttggggtcacgcgggttcatatggaagaagatgctggcaagctgcttcactctgaatccgggagtttttctcaggttgacctaaatagagccggcgtccctttgctagagattgtctcagagccagatatgaggacaggcatagaggctgctgagtatggtgctgagatacaaagggctgttagatacctgggagtgggcaatggcaacatgcaggaaggttccctccgctgtgatgtgaatgtatctgtccggcctattggacaatcagaattcagtacaaaggttgaaataaagaatatgaactcattttctgaaataagtagggcaatagattatgagatagcccgacagattcttcttcacaaagaaagccaggctgacaaaattgtacaggaaacccgtctatgggatgaatcttctcagaaaacttttacaatgcggaaaaaggagggacttgccgactacagatattttcctgagcctgatcttcctgaagttgttctgactagtgattacattgatgaaattcgtaattcaatgccggagcttccagaggcaaagcgtaggcgttatgagaacatggggctcagcatgcaagatgttattttccttgctaacgacgatattgttgctcatttctttgattctacacttgagcatggtgctgatgcaaagctggctgctaattggatcatgggtgacattacggcttatctgaagaatgaaaagctctctattgatgaaattaaattaacacctcttgagctttctgaactgattgcattcataaagaatggtactatcagtgggaagattggcaaggagattcttgttgagctcattaccaaaggcggaactgttaagtcagtgatagaggagaaagatttggttcagatagcagatccagcagcaattgaggccatggtagataaagtactcgccgagaatccaaagcaacttgagcagtatcgggctgggaaaaccaagttgcagggatttttcgctggccaggtgatgaaagcatcgaaaggtaaagcaagtcctgttttattgaacaaaatcctcggggagaagttgaagggcaattaaaattgccgaggggtgtttcggcacacagagaatatcttgcccttgatgagtgaaaccatcagattttgtaaagacagcggaactgcattcttttgtaaagacacttacttggagtttttttttttgagttgttgattgtttttgagatagctaacggcttattccaagcggtgacacttacttggagtttggagtgttgattacatttcgctctcttttcactacagagcggattttggaaaagcaatccagttcacatgatacaatgaaggatatgcatggtatgtgtttgagctgataatagactggagtggcgtgttgtacagatgaatcagttgcatatgct

SEQ ID NO: 2019 - DNA, 1874 bp, Triticum aestivum
ggggacgcgccgctccactccaagctccggcgaccgcgccgccggcgccgctgaatcatctgtgctcccagcggtaagcagggctgtggtccaaccagtagattgtgaattgcaattcacgagaggcgcattggccacaatggctctaacgctcttacgagggatcagaacacaaaccttatctggagcaaatgcagggctgttctgtaccactcgacgtcctccgctagcccacttcacagctagggtggagagtgtgcagactagcgagcccaaatcagtgcacaaatcaattcaacaggctaccaaggaggcggcggagcagaagatacaaggttttgaatctgttatcggcatcgagacccatgtccagctatcgaccatcacaaaggcattttgctcctgcccaaacaactatggctcccagccgaacagcactgtttgccccacctgcatgggccacccggggacattgccggttctgaatgcaaaggttgttgaatgtgcagtgaaaatgagcctcgctctcaactgcaagatctccatgacatccaagtttgatcggaagcagtacttctacccggacctacccaaggggtaccagatttcgcagtttgacattccaattgccgagaagggttaccttgatgtggatattccaattgagtttggtggtggtcacaggcgatttggggtcacgagggttcatatggaagaagatgctggcaagctgcttcattctgaatccggaagttactctcaggttgacttaaatagagccggtgtacctttgcttgagattgtctcagagccagatatgaggacaggcatagaggctgctgagtatggtgctgagatacaaagggttgttagatacctgggagtgggcaatggcaacatgcaggaaggttccctccgctgtgatgtgaatgtatctgtccggcctattggacaatcagaattcggtacaaaggttgaaataaagaatatgaactcattttctgaaataagtagggcaatagattatgagatagcccgacagattcttcttcacaaagaaagccaggctgacaaaattgtacaggaaacccgtctatgggatgaatcttctcagaaaacttttacaatgcggaaaaaggagggacttgccgactacagatattttcctgagcctgatcttcctgaagttgttctgactagtgattacattgatgaaattcgtaattcaatgccggagcttccagaggcaaagcgtaggcgttatgagaacatggggctcagcatgcaagatgttattttccttgctaatgatgatattgttgctcatttctttgattctacacttgagcgtggtgctgatgcaaagctggctgctaattggatcatgggtgacattacggcttatctgaagaatgaaaagctctctattgatgaaattaaattaacacctcttgagctttctgaactgattgcattcataaagaatggtactatcagtgggaagattggcaaggagattcttgttgagctcattaccaaaggcggaactgttaagtcggtgatagaggagaaagatttggttcagatagcagatccagcagcaattgaggccatggtagacaaagtactcgccgagaatccgaagcaacttgagcagtatcgggctgggaaaaccaagttgcagggatattttgctggccaggtgatgaaagcatcgaaaggtaaagcaagtcctgttttattgaacaaaatcctcggggagaagttgaagggcaattaaaattgccgaggggtgtttcggcacacagagaatattttgcccttgatgagtgaaccatcagattaactaaagtggaaccccgcagcggaaactc

SEQ ID NO: 2020 - DNA, 2166 bp, Triticum aestivum
tgtgtcttctgctccactgcctctcctttctcccttccgctggcgcgccttgctctgcatctcctcgccttcgatctctctctaccggcgggcctcctcgctgtcgctgctgccgaggctgtttgttgcccatccagtagattgtgaattgcagtagacgagaggcacattggccacaatggctctaacgctcttacgagggatcagaacacaaaccttatctggagcaaatgcagggctgttctgtaccactcgacgtcctccgctagcccacctcacagctagggtggagagtgtgcagactagtgagcccaaatcagtgcacaaatcaattcaacaggctaccaaggaggcggcggagcagaagatacaaggttttgaatctgttatcggcatcgagacccatgtccagctctcgaccatcacaaaggcattttgctcctgcccaaacaactatggctcccagccgaacagcactgtttgccccacctgcatgggccaccccgggacattgccggttctgaatgcaaaggttgttgaatgtgctgtcaagctgggcctcgctctcaactgtgagatttccatgacatccaagtttgatcggaagcagtacttctacccagatctgcccaagggataccagatttcgcagtttgacattccgattgctgagaagggttaccttgatttggatattccaatggagtttggtggtggtcacaggcgatttggggtcacgcgggttcatatggaagaagatgctggcaagctgcttcactctgaatctgggagtttttctcaggttgacctaaatagagccggcgtccctttgctagagattgtctcagagccagatatgaggacaggcatagaggctgctgagtatggtgctgagatacaaagggttgttagatacctgggtgtgggcaatggcaacatgcaggaaggttccctccgctgtgatgtcaatgtatctgtccggcctattggacaatcagaattcggtacaaaggttgaaataaagaatatgaactcattttctgaaataagtagggcaatagattatgagatatcccgacagattcttcttcacaaagaaagccaggctgatcaaattgtacaggaaacccgtctttgggatgagtcttctcagaaacttttacaatgcgaaaaaggagggacttgccgactatagatattttcctgagcctgatcttcctgaagttgttctcactggtgattacattgatgaaattcgtaatttgatgcccgagcttccagaggcaaagcgtaggcgttatgagaacatggggctcagcatgcaagatgttattttccttgctaatgacgataaggttgctcatttctttgattccacactcgagcatggcgctgatgcaaagctagctgccaactggatcatgggtgatattactgcttatctgaaggatgaaaagctttctattgatgaaagtaaattaacacctctggagctttctgaaatgcttgcatacataaagaatggaactatcagtgggaaaattgccaaggagattgtggttgacctcattgccaaaggcggaactgttaagtctgtgatagaggagaaggatttggttcagattgcagatccagcagcaattgaggccatggtagatcaagtactcgctgacaatctgaagcaacttgagcagtatcgggctgggaaaaccaagttgcagggatattttgctggccaggtgatgaaagcatcaaagggtaaagcaagccctgttttattgaacaaaatcctgggggagaagctgaagggcagctgttgagggcttttttggcgcatcaagtggtccttgatgactggagcttcggaccaaagcaaaatcctgcagcaggaactacattttggggatccaaaacatctccgattctggtttttgcaggcgtagttgttgctttgaatttgggctggatcttgtttccctctcgtttagagcctggattttgtaagaaaaacaacaatactctgtttgacctgataataagaatggagtggagtggtgtggttatctgcgtagatttgcatgttactatgtgccattttttatatttgtggttttacaccgtggaacttcaattgtgagcatttgcatttcagttgtatgcaagctg

SEQ ID NO: 2021 - DNA, 2304 bp, Brachypodium distachyon
atgcatgaggagtttgatgctgctacaatccgacggacgagattagaggttctaagtacatctgacgggtggaccagggcagtacccctgacgcctagcgcgccccattttctatctcttcggctgggaagcggctgcggcgacctgcacggcggtgggccgttggcagcgccgacctcaccggagctccttccccatcccgctaccccgtcgtcccgcctgcaggttgtgagccaaccagtatattgtgaattgcaattgacgagaagtcttttggccacaatggctctaacgcttctccgagggatcagaactccaactttatttagaacgaatgttggtttgttctgtaccgctcgacatcctccactggcccacttcacaactagggcagggggtatgcagactactgagcctaaagcagcaccgaaatcaattcaacaggctaccaaggaggcggcggagcataagacaagaggttttgaagcggttattggaattgagacccatgtccagctctcgaccattacaaaggcattttgctcctgtccatacaactatggctcccagccaaacagcactgtctgccccacctgcatgggccaccctgggacattgccggttcttaatgctaaggttgttgattgtgcagtgaagctgggcctcgctctcaattgtgagatctctatgacatccaagtttgatcgcaagcagtacttctatccggatctgcccaaggggtaccagatttcacagtttgacattcccattgctgagaaaggttaccttgatttggatcttccagtggagtttggtggtggtcacaggcgttttggaatcacaagggttcatatggaagaagatgctggcaagctgcttcattctgaatccgggagttactctcaggttgacctaaatagggccggtgttcctttgcttgagattgtctcagagccagatatgaggacagggatagaggctgctgagtatggtgctgagatacaaaggcttgttaggtacctaggagtgggcaatggtaacatgcaggaaggttcccttcgttgtgatgtgaatgtatctgttcggcccattgggcaaccagaatttggtacaaaggttgaagtaaagaatatgaactcattttctgaaataagtagggcaatagattatgagatctcccgacagattcttcttcataaagaaagccaggctgatcaaattgtacaagaaacccggctgtgggatgaatcttctcagaaaacatttacaatgcgaaaaaaggagggacttgctgactacagatattttcctgagcctgatcttcctgaagttgttctcactagtgagtacatagatgaaattcgcaactcaatgccggagcttccagaggcaaagcgtaggcgttatgagaacatgggactcagcatgcaagatgttattttccttgctaatgacgataacgttgctcatttctttgatgctacacttgagcgtggtgctgatgcaaagctggctgccaattggatcatgggtgacattactgcttatctgaagaatgaaaaactgtctattgatgagattaaattaacacctctggagctttctgagctgattgcatccataaagaatggaactatcaatgggaagattggcaaggagattctggttgagctcattgccaaaggcggaactgtaaagtctgtgatagaggagaaagatttggttcagatagcagatccagcagcaattgaagccatcgtagatcaagtactcgccgacaatccaaagcaacttgagcagtatcgggctgggaaaaccaagttgcagggattttttgctggccaggtgatgaaagcatcgaagggtaaagcaagtcctgttttattgaacaaaatcctagccgagaagttgaagggcaatcagtgagagggtttcagcacatggagaatatcaagtagttctactggaaacacatttttttaagggggggaaggttgaaattatctccaattctggttttgtagctctttatttcttactttgaatgtggaatgtgattccaccttccctctattttccttggcaaacgaattttgtaagaacaatacacttacataatacaaaaatgaatgatatatgtgttcgagctgataataaaatggagtggcgtagtatacagatgaatatcgtttgtatagatttgttagtccatgccatttagtggcgttttattacagatgaatatcgtttgtatagatatgttagtccaatatcctggaactcaccgttctgtgtgcatatact

SEQ ID NO: 2022 - DNA, 1978 bp, Triticum aestivum
gcaattcacgagaggcgcattggccacaatggctctaacgcttctccgagggatcagaacaccaaccttacttagagcaaatttcagcctgctctgtaccacccaacgccatccactagctcacttcacaactagggctgagagtgtgcagaccactgagcccaaagcagtgcccaaatcaattcaacaggctaccaaggaggcagtggagcagaagacacacggttttgaagcggtgatcggcattgagacccatgtccagctctcgaccatcacaaaggcattttgctcctgcccatacgactatggctcccagccaaacagcaccgtttgccccacctgcatgggccaccccgggacattgccggttctgaacgcaaaggttgttgaatgtgctgtcaagctaggcctcgctctcaactgtgagatttccatgacatccaagtttgaccgaaagcagtacttctacccagacctgcccaagggataccagatttcgcagtttgacattccgattgctgagaagggttaccttgatttggatattccaatggagtttggtggtggtcacaggcgatttggggtcacgcgggttcatatggaagaagatgctggcaagctccttcactctgaatccgggagtttttctcaggttgacctaaatagagccggcgtccctttgctagagattgtctcagagccagatatgaggacagggatagaggctgctgagtatggtgctgagatacaaaggcttgttaggtacctgggagtgggcaatggtaacatggatgaaggttcccttcgctgtgatgtaaatgtatctgttcgaccaattggacaatcagaatttggtacaaaggttgaaataaagaatatgaactcattttctgcaataagtagggcgatagactatgagatctcccggcagattcttcttcacaaaggaagccaggctgatcaaattgtacaagaaacccgtctttgggatgagtcctctcagaaaacttttacaatgagaaaaaaggagggactcgccgactatagatattttcctgagcctgatctccctgaagttgttctcactggtgagtacattgatgaaattcgtaatttgatgcccgagcttccagaggcaaagcgtaggcgctatgagaacataggactcagcatgcaagatgttattttccttgctaatgacgataaggttgctcatttctttgattccacactcgagcatggcgctgatgcaaagctagctgccaactggatcatgggtgatattactgcttatctgaaggatgaaaagctttctattgatgaaagtaaattaacacctctggagctttctgaaatgattgcatacataaagaatggaactatcagtgggaaaattgccaaggagattgtggttgacctcattgccaaaggcggaactgttaagtctgtgatagaggagaaggatttggttcagattgcagatccagcagcaattgaggccatggtagaccaagtactcactgccaatccgaagcaacttgagcagtatcgggctgggaaaaccaagttgcagggatattctgctggccaggtgatgaaagcatcaaagggtaaagcaagccctgttttattgaacaaaatcctgggggagaagctgaagggcagctgttgagggctttttttggcgcatcaagtggtccttgatgactggagcatcgaacgaaatcaaaaccgtgcagcgggaactacattttggggggcgaaaatatctccgattctagtttttgtaggcgtggtccttgctttgaatttgggatggatctcgttcccccttgttcagagcacggatttcgtaagaaaaataataatccagttaacataatactgtttgaactgataataagaatggagttgtgtggtgtacagagtgaattatctgcgtagaccttaccatgttactatatgccatttttctatt

SEQ ID NO: 2023 - DNA, 2256 bp, Triticum aestivum
ggcccatttgcgtcgagcgaaccctggacatcgaggagcggtggaccagccgcgccacagtatctccccgtggggacgcgccgctccactccaagctccggcgaccgcgccgccggcgccgctgaatcatctgtgctcccagcggtaagcagggctgtggtccaaccagtagattgtgaattgcaattcacgagaggcgcatttgccacaatggctctaactcttctccgagggatcagaacaccaaccttacttagagcaaatttcagcctgttctgtaccactcaacgccatccactagctcacttcacaactagggtggagagtgtgcagactactgagcccaaagcagtgccaaaatcaattcaacaggctaccaaggaggcggcggagcagaagatacaaggttttgaatctgttatcggcatcgagacccatgtccagctatcgaccatcacaaaggcattttgctcctgcccaaacaactatggctcgcagcctaacagcactgtttgccccacctgcatgggccaccctggaacattgccgcttctgaatgcaaaggttgttgagtgtgcagtgaaaatgggccttgctctcaactgcaagatctccatgacatccaagtttgatcggaagcagtacttctacccggacctacccaaggggtaccagatttcgcagtttgacattccaattgctgagaagggttaccttgatgtggatattccagttgagtttggtggtggtcacaggcgatttggggtcacgagggttcatatggaagaagatgctggcaagctgcttcattctgaatccggaagttactctcaggttgacttaaacagagccggtgttcctttgcttgagattgtctcagagccagatatgaggacagggatagaggctgctgagtatggtgctgagatgcaaaggcttgttaggtacctgggagtgggcaatggtaacatggatgaaggttcccttcgctgtgatgtgaatgtttctgttcgaccaattggacaatcagaatttggtacaaaggttgaaataaagaatatgaactcattttctgcaataagtagggcaatagactatgagatctcccggcagattcttcttcacaaaggaagccaggctgatcaaattgtacaagaaacccgtctttgggatgagtcctctcagaaaacttttacaatgcgaaaaaaggagggactcgccgactatagatattttcccgagcctgatcttcctgaagttgttctcactagtgagtacattgatgaaattcgtaatttgatgcccgagcttcctgaggcaaagcgtaggcgctatgagaacatgggactcagcatgcaagatgttattttcctagctaatgacgataaggttgctcatttctttgattccacactcgagcatggcgctgatgcaaagctagctgccaactggatcatgggtgatattactgcttatctgaaggatgaaaaactttctattgatgaaagtaaattaacacctctggagctttctgaaatgattgcatacataaagaatggaactatcagtgggaaaattgccaaggagattgtggttgacctcattgccaaaggcggaactgttaagtctgtgatagaggagaaggatctggttcagattgcagatccagcagcaattgaggccatggtagatcaagtactcgctgacaatccgaagcaacttgagcagtatcgggctgggaaaaccaagttgcagggctattttgctggccaggtgatgaaagcatcaaagggtaaagcaagccctgttttattgaacaaaatcctgggggagaagctgaagggcagctgttgagggttttttcttggcgcatcaagtggtccttgatgactggaacatcgaacgaaagcaaaaccctgcagcgggaactacaattttgggcgaaaacatctccgattctggtttttgtaggcgtagttcttgctttgaatttgggatggatctcgtttccccctcgtttagagccggattttgtaagaaaaaacaatccagctcacataacactgtgtttgagctgataataagaatggagtagtgtgctgtacagatgaattatctgcgtagagttacatgttactatatcccgtttttctatttattgttttacatcctagaacttcaaatgtgagcatctacattttggttgtatgcagctgtaaacttttttttttcatttggaatttagaccactgcatc

SEQ ID NO: 2024 - DNA, 2089 bp, Triticum aestivum
ggggacgcgccgctccactccaagctccggcgaccgcgccgccggcgccgctgaatcatctgtgctcccagcggctgtggtccaaccagtagattgtgaattgcaattcacgagaggcgcatttgccacaatggctctaactcttctccgagggatcagaacaccaaccttacttagagcaaatttcagcctgttctgtaccactcaacgccatccactagctcacttcacaactagggtggagagtgtgcagactactgagcccaaagcagtgccaaaatcaattcaacaggctaccaaggaggcggcggagcagaagatacaaggttttgaatctgttatcggcatcgagacccatgtccagctatcgaccatcacaaaggcattttgctcctgcacaaacaactatggctcccagccgaacagcactgtttgccccacctgcatgggccacccggggacattgccggttctgaatgcaaaggttgttgaatgtgcagtgaaaatgagcctcgctctcaactgcaagatctccatgacatccaagtttgatcggaagcagtatttctacccagacctacccaagggctaccagatttcccagtttgacattccaattgccgagaagggttaccttgatgtggatattccacttgagtttggtggtggccacaggcgatttggggtcacgagggttcatatggaagaagatgctggcaagctccttcattctgaatccggaagttactctcaggttgacttaaacagagccggtgttcctttgcttgagattgtctcagagccagatatgaggacagggatagaggctgctgagtatggtgctgagatacaaaggcttgttaggtacctgggagtgggcaatggtaacatggatgaaggttcccttcgctgtgatgtgaatatatctgttcgaccaattggacaatcagaatttggtacaaaggttgaaataaagaatatgaactcattttctgcaataagtagggcgatagactatgagatctcccggcagattcttcttcacaaaggaagccaggctgatcaaattgtacaagaaacccgtctttgggatgagtcctctcagaaaacttttacaatgagaaaaaaggagggactcgccgactatagatattttcccgagcctgatcttcctgaagttgttctcactagtgagtacattgatgaaattcgcaatttaatgcccgagcttccagaggcaaagcgtaggcgctatgagaacatgggactcagcatgcaagatgttattttccttgctaatgacgataaggttgctcatttctttgattctacacttgagcatggtgctgatgcaaagctagctgccaactggatcatgggtgatattactgcttatctgaaggatgaaaagctttctattgatgaaagtaaattaacacctctggagctttccgaaatgattgcatacataaagaatggaactatcagtgggaaaattgccaaggagattgtggttgacctcattgccaaaggcggaactgttaagtctgtgatagaggagaaggatttagttcagatcgcagatccagcagcaattgaggctatggtagatcaagtactcgctgacaatccgaagcaacttgagcagtatcgggctgggaaaaccaagttgcagggatattttgctggccaggtgatgaaagcatcaaagggtaaagcaagccctgttttattgaacaaaatcctgggagagaagctgaagggcagctgttgaggttttttttttacgcatcaagtggtccttgatgagtggagcattgaacaaaagcaaaaccctgcagcaggaactacatttttgggggcgaaaacatctccgattctggtttttgtaggcgtagtccttgctttgaatttgggatggatcttgtttcccccctcgtttagagcatggattttgtaagaaaaaacaatccagttcgcataacactgtgtttgagctgataataagaatggagttgtgtgatgtaaagatgaattatctgcgtagacttgtgttactatatgccgtttttctatttattgttttaca

SEQ ID NO: 2025 - DNA, 2207 bp, Secale cereale
ggcccatttgcgtggaggcgaaccctggtcatcgaggagcggtggaccagggccgccacaatatatctccccggggggacgcgccgctccactccaagctccggcgaccgcgccgccggcgccgctgaatcatctctcctcccagccgtaagcaaagctgtggtccacccagtggattgtgaactgcaattcacgagaggcgcattgaccacaatggctctaacgcttctccgagggatcagaacaccaaccttacttagagcaaatttcagcctgttctgtaccactcaacgccatccactagctcacttcacaactagggcggagagtgtgcagactactgagcccaaagcagtgcccaaatcaattcaacaggctaccaaggaggcggcggagcagaagatacaaggttttgaatccgttatcggcatcgagacccatgtccagctctcgaccatcacaaaggcattttgctcctgtccgaacaactatggctcccagccgaacagcactgtttgccccacctgcatgggccacccggggacattgccggttctgaatgcaaaggttgttgaatgtgcagtgaaaatgagccttgctctcaactgcaagatctccatgacatccaagtttgatcggaagcagtatttctacccagacctacccaaggggtaccagatttcccagtttgacattccaattgctgagaaaggttaccttgatgtggatattccagttgagtttggtggtggtcacaggcgatttggtgtcacaagggttcatatggaagaagatgctggcaagctgcttcactctgaatccggaagttactctcaggttgacttaaatagagccggtgtacctttgcttgagattgtctcagagccggatatgaggtcagggatagaggctgccgagtatggtgctgagatacaaaggcttgttaggtacctgggagtgggcaatggtaacatggatgaaggttcccttcgctgtgatgtaaatgtatccgttcgaccaattggacaattggaatttggtacaaaggttgaaataaagaacatgaactcattttccgcggtaagtagggcaatagactatgagatctctagacagattcttcttcacaaagaaagccaggctgatcaaattgtacaagaaacccgtctttgggatgagtcctctcagaaaacttttacaatgcgaaaaaaggagggactcgctgactatagatattttcctgagcctgatctccctgaagttgttctcactgatgagtacattgatgaaattcgtaattcgatgcccgagcttccagaggcaaagcgtaggcgttatgagaacatgggactcagcatgcaagatgttattttccttgctaatgacgataaggttgctcatttctttgattccacactcgagcatggcgctgatgcaaagctagctgccaactggatcatgggtgatattactgcttatctgaaggatgaaaagctttctatcgatgaaagtaaattaacacctctggagctttctgaaatgattgcatacataaagaatggaactatcagtgggaaaattgccaaggagattgtggttgacctcattgccaaaggcgggactgttaagtctgtgatagaggaaaaggatttggttcagattgcagatccagcagcaattgaggccatggtagatcaagtactcgctgacaatccgaagcaacttgagcagtatcgagctgggaaaaccaagttgcagggatattttgctggccaggtgatgaaagcatcaaagggtaaagcaagccctgttttattgaacaaaatcctgggggagaagctgaagggcagctgttgagatttttttttggggcgcatcaagtggcccttgatgagtggagcatcgaacaaaagcaaaaccctgcagcgggaactacatttttgggggcgaaaacatctccgattccgttttttgtaggcgtagttcttgctttgaatttaggatggatcttgttgccccctcgtttagagcacgggttttgtaggaaatactatgtttgagttgataataagaatggacaatggagtggtgtggtgtacagatgaattatctgcatagacttgcatgttattatgcgccgtttttctctttattgttcacatcctgtaacttcaatcgtgagcaattgcatttcggttgtacgcaga

SEQ ID NO: 2026 - DNA, 2177 bp, Triticum aestivum
ggacatcgaggagcggtggaccagccgcgccacagtatctccccggggggacgcgccgctccactccaagctccggcgaccgcgccgccggcgccgctgaatcatctctgctcccagcggctgtgtagtccacccagtagattgtgaattgcaattcacgagaggcgcattggccacaatggctctaacgcttctccgagggatcagaacaccaaccttacttagagcaaatttcagcctgttctgtaccactcaacgccatccactagctcacttcacaactagggcggagagtgtgcagactactgagcccaaagcagtgcccaaatcaattcaacaggctaccaaggaggcggcggagcagaagatacaaggttttgaatctgttatcggcatcgagacccatgtccagctctcgaccatcacaaaggcattttgctcctgcccaaacaactatggctcccagccgaacagcactgtttgccccacctgcatgggccacccggggacattgccggttctgaatgcaaaggttgttgaatgtgcagtgaaaatgagcctcgctctcaactgcaagatctccatgacatccaagtttgatcggaagcagtatttctacccagacctacccaaggggtaccagatttcgcagtttgacattccaattgctgagaagggttaccttgatgtggatattccagttgagtttggtggtggtcacaggcgatttggggtcacaagggttcatatggaagaagatgctggcaagctgcttcactctgaatccggaagttactctcaggttgacttaaatagagccggtgtacctttgcttgagattgtctcagagccagatatgaggtcagggatagaggctgccgagtatggtgctgagatacaaaggcttgttaggtacctgggagtgggcaatggtaacatggatgaaggttcccttcgctgtgatgtaaatgtatctgttcgaccaattggacaatcggaatttggtacaaaggttgaaataaagaatatgaactcattttccgcaataagtagggcaatagactatgagatctccagacagattcttctttacaaagaaagccaggctgatcaaattgtacaagaaacccgtctttgggatgagtcctctcagaaaacttttacaatgcgaaaaaaggagggactcgccgactatagatattttcctgagcctgatctccctgaagttgttctcactggtgagtacattgatgaaattcgtaatttgatgcccgagcttccagaggcaaagcgtaggcgctatgagaacataggactcagcatgcaagatgttattttccttgctaatgacgataaggttgctcatttctttgattccacactcgagcatggcgctgatgcaaagctagctgccaactggatcatgggtgatattactgcttatctgaaggatgaaaagctttctattgatgaaagtaaattaacacctctggagctttctgaaatgattgcatacataaagaatggaactatcagtgggaaaattgccaaggagattgtggttgacctcattgccaaaggcggaactgttaagtctgtgatagaggagaaggatttggttcagattgcagatccagcagcaattgaggccatggtagaccaagtactcactgacaatccgaagcaacttgagcagtatcgggctgggaaaaccaagttgcagggatattttgctggccaggtgatgaaagcatcaaagggtaaagcaagccctgttttattgaacaaaatcctgggggagaagctgaagggaagctgttgaggtttttttttggcgcatcaagtggtccttgatgactggagcatcgaacgaaatcaaaaccgtgcagcgggaactacattttggggggcgaaaatatctccgattctagtttttgtaggcgtggtccttgctttgaatttgggatggatctcgttcccccttgtttagagcacggatttcgtaagaaaaataataatccagttaacataatactgtttgaactgataataagaatggagttgtgtggtgtacagatgaattatctgcgtagacttacatgttactatatgccatttttctatttattgttttacatcctagaacttcaaatgtgagcatttgcatttcggttgta

SEQ ID NO: 2027 - DNA, 1719 bp, Triticum aestivum
ccggggagggccgccacaaatatatctccccggggggacgcgccgctccactccaagctccggcgaccgcgccgccggcgccgctgaatcatctctgctcccagcggctgtgtggtccacccagtagattgtgaattgcaattcacgagaggcgcattggccacaatggctctaacgcttctccgagggatcagaacaccaaccttacttagagcaaatttcagcctgttctgtaccacccaacgccatccactagctcacttcacaactagggctgagagtgtgcagaccactgagcccaaagcagtgcccaaatcaattcaacaggctaccaaggaggcggcagagcagaagatacaaggttttgaatctgttattggcatcgagacccatgtccagctctcgaccatcacaaaggcattttgctcctgcccaaacaactatggctcccagccgaacagcactgtttgccccacctgcatgggccaccccggaacattgccggttctgaacgcaaaggttgttgaatgtgcagtgaaaataggcctcgctctcaactgcaagatctccatgacatccaagtttgaccgaaagcagtacttctacccagacctgcccaagggataccagatttcgcagtttgacattccgattgctgagaagggttaccttgatttggatattccaatggagtttggtggtggtcacaggcgatttggggtcacgcgggttcatatggaagaagatgctggcaagctgcttcactctgaatccgggagtttttctcaggttgacctaaatagagccggcgtccctttgctagagattgtctcagaaccagatatgaggacaggcatagaggctgctgagtatggtgctgagatacaaagggttgttagatacctgggagtgggcaatggcaacatgcaggaaggttccctccgctgtgatgtcaatgtatctgtccggcccattggacaatcagaattcggtacaaaggttgaaataaagaatatgaactcattttctgaaataagtagggcaatagattatgagatatcccgacagattcttcttcacaaagaaagccaggctgacaaaattgtacaggaaacccgtctatgggatgaatcttctcagaaaacttttacaatgcggaaaaaggagggacttgccgactacagatattttcctgagcctgatcttcctgaagttgttctgactagtgattacattgatgaaattcgtaattcaatgccggagcttccagaggcaaagcgtaggcgttatgagaacatggggctcagcatgcaagatgttattttccttgctaacgacgatattgttgctcatttctttgattctacacttgagcatggtgctgatgcaaagctggctgctaattggatcatgggtgacattacggcttatctgaagaatgaaaagctctctattgatgaaattaaattaacacctcttgagctttctgaactgattgcattcataaagaatggtactatcagtgggaagattggcaaggagattcttgttgagctcattaccaaaggcggaactgttaagtcggtgatagaggagaaagatttggttcagatagcagatccagcagcaattgaggccatggtagataaagtactcgccgagaatccgaagcaacttgagcagtatcgggctgggaaaaccaagttgcagggatatttc

SEQ ID NO: 2028 - DNA, 2244 bp, Triticum aestivum
ccctatcctccgtgtgctcgtgcgcgtcagacgagaggccgacgcagcggtagtctacgaccagagcggcggggagacgcgccgttcccaagctccggcgaccgcgccgccggcgctgctgaatcacctctcctcccagcggctgtgtagtccacccagtagattgtgaattgcaattcacgagaggcgcattggccacaatggctctaacgcttctccgagggatcagaacaccaaccttacttagagcaaatttcagcctgctctgtaccacccaacgccatccactagctcacttcacaactagggctgagagtgtgcagaccactcagcccaaagcagtgcccaaatcaattcaacaggctaccaaggaggcggcggagcagaagatacaaggttttgaatctgttatcggcatcgagacccatgtccagctctcgaccatcacaaaggcattttgctcctgcccaaacaactatggctcccagccgaacagcactgtttgccccacctgcatgggccacccggggacattgccggttctgaatgcaaaggttgttgaatgtgcagtgaaaatgagcctcgctctcaactgcaagatctccatgacatccaagtttgatcggaagcagtatttctacccagacctacccaaggggtaccagatttcgcagtttgacattccaattgctgagaagggttaccttgatgtggatattccagttgagtttggtggtggtcacaggcgatttggtgtcacaagggttcatatggaagaagatgctggcaagctgcttcactctgaatccggaagttactctcaggttgacttaaatagagccggtgtacctttgcttgagattgtctcagagccagatatgaggtcagggatagaggctgccgagtatggtgctgagatacaaaggcttgttaggtacctgggagtgggcaatggtaacatggatgaaggttcccttcgctgtgatgtaaatgtatctgttcgaccaattggacaatcggaatttggtacaaaggttgaaataaagaatatgaactcattttccgcaataagtagggcaatagactatgagatctccagacagattcttctttacaaagaaagccaggctgatcaaattgtacaagaaacccgtctttgggatgagtcctctcagaaaacttttacaatgcgaaaaaaggagggactcgccgactatagatattttcctgagcctgatctccctgaagttgttctcactggtgagtacattgatgaaattcgtaatttgatgcccgagcttccagaggcaaagcgtaggcgctatgagaacataggactcagcatgcaagatgttattttccttgctaatgacgataaggttgctcatttctttgattccacgctcgagcatggcactgatgcaaagctagctgccaactggatcatgggtgatattactgcttatctgaaggatgaaaagctttctattgatgaaagtaaattaacacctctggagctttctgaaatgattgcatacataaagaatggaactatcagtgggaaaattgccaaggagattgttgttgacctcattgccaaaggcggaactgttaagtctgtgatagaggagaaggatttggttcagattgcagatccagcagcaattgaggccatggtagaccaagtactcactgacaatccgaagcaacttgagcagtatcgggctgggaaaaccaagttgcagggatattttgctggccaggtgatgaaagcatcaaagggtaaagcaagccctgttttattgaacaaaatcctgggggagaagctgaagggaagctgttgaggtttttttttggcgcatcaagtggtccttgatgactggagcatcgaacgaaatcaaaaccgtgcagcgggaactacattttggggggcgaaaatatctccgattctagtttttgtaggcgtggtccttgctttgaatttgggatggatctcgttcccccttgtttagagcacggatttcgtaagaaaaataataatccagttaacataatactgtttgaactgataataagaatggagttgtgtggtgtacagatgaattatctgcgtagacttacatgttactatatgccatttttctatttattgttttacatcctagaacttcaaatgtgagcatttgcatttcggttgtacgcagctgtaaactctcttttttttcggaatttagaccactgctt

SEQ ID NO: 2029 - DNA, 2148 bp, Oryza sativa
catatttcgtccataaaccctctgactggtggaccctctcatatcctttttcccactcccctctatccactgtttccgccgccgccgccgccgccgccgccgcccgccgcgccggcgttctccccccgccgacgaagcacggcgtggagtgtagacgcagcctcctcgctctctctcacgccggcgagcagggtctggagccaggagcgacgcggcggccggggccggggcctccatctcggttcgaaccgcactgaaggtccctccctgcattagggcgcacaatggcactgacccttctcagagggatgcgaacgccggttgtagctagaaggaatgctggcttgttcttcaccacattgcagtctccgttgttgtcccgcttcacgatgagagcggagagcgcgcgggccgcagcgcccaagtcgattcagctggcgaccaaggaggcggcggagcagaaggcgcagggcttcgaggcggtcatcgggatcgagacccatgtccagctctcgacggtcacaaaggcgttctgctcgtgcccgtacagctacgggtcgcagccgaacagcaccgtctgccccacctgcatggggcaccccggaacgctgcccgttcttaacgcaaaggttgtcgaatgcgccgtgaggttgggcctcgctctcaattgcgagatcgcgatgacgtccaagtttgatcggaagcagtacttctacccggacctgcccaaggggtatcagatttcgcagtttgacattcccattgccaaggagggttaccttgatttggatcttccggtggagttcggcggtgggcataggagatttggggtcacaagggtgcatatggaagaagatgctggcaagctgcttcactctgaatccgggagttactctcaggttgacttaaatagggctggcgttcctttacttgaaattgtctcagagccagatatgagaacagggatagaggctgccgagtatggtgctgagctacagaggcttgttaggtacctgggcgtgagtaatggtaacatgcaggaaggttcccttcgctgtgatgtgaatgtttctgttcggccaattggacaatcaaattttggtacaaaggttgaaataaagaatatgaattcattttctgcaataagtagggcaatagattatgagatctcccggcagattcttcttcataaagaaggtcaggctgatcaaattgtacaagaaacccggctgtgggatgaatcttctcagaaaacttttacaatgcgaaaaaaggagggacttgctgattatagatattttcctgagcctgatcttcctgaagttgttcttactagtgagtacattgatgaaattcaaaactcaatgccagagcttcctgaagcaaagcgtaggcgcttcgagaatatgggactcagcatgcaagatgttcttttccttgctaatgacgataatgttgctcggttcttcgattctacccttgagcacggcgcggatgcaaagctggctgccaactggatcatgggtgacattgctgcttatttgaaaaatgaaaaactttccattgatgaaattaaattaacacctctggagctttctgaattgattgcatctataaggaatggaactatcagtgggaagattggaaaggagattctgattgaactcattgcgaaaggtggaactgtcaagtctgtgatagaggagaaagatttggttcagatagcagatcctgcagcaattgaggcaatggtagatcaagtattagctgataatccaaagcaacttgagcagtatcggtccgggaaaactaaattgcaaggattttttgctggccaggtgatgaaagcatcaaagggtaaagctaatcctgttttgttgaacaaaatcctcggggagaaattgaaggccaatagttgagggggtttgtcgacaaacggagactcatgttgtagtccacgagtggacaatcgaactaaaccctgcaatttggggtctatttttcaatgatgaattctctgttagctccagtagttgtaaatgttactactttgtgggtagtttatttttcttcttttctgaaagaaaattttgtaaaagcagcataatttacataataaaaagatgaatatttatgcatccaattaac

SEQ ID NO: 2030 - DNA, 2072 bp, Panicum virgatum
cacgcaggttgtgactggcacaatagattgtgattcacgggaggcgcattggcctcaatggctctaacgctcctccgagggatgaggacgccgatctcatttagatcaaatacaggcttattctttaccgttctacgacctcggttggcccgcttcacgaccagggcggagagtgcgcaggcaaccgaggccaaagcagcagccaaatcaattcagctggcgaccaaggaggcggcagagcagaagacacaagggtttgaagcgatcattggaattgagacccatgtccaactctcgaccgtcacaaaagcattttgttcttgcccgtacaactacgggtcccagcccaataccactatctgccccacctgcatgggccacccagggacactgccagttctgaatgagaaggtcgttgagtgtgctgtgaagttgggccttgctctcaactgtgagatctcgatgacatccaagtttgatcggaagcagtatttctacccggacctccccaaggggtaccagatttcccagtttgacattcccattgccaagaagggctatgttgatttggatcttccagtggaatttggtggtgggcacaggaagtttgggatcacaagggttcacatggaagaagatgctggcaaactgcttcattccgaatccggcagttactcgcaggttgacctaaacagggctggtgtacctttgcttgaaattgtctcggagccagacatgagaacagggatagaggctgctgaatatggtgctgaactgcaaaggatcgttaggtatctgggagtgagtaatggtaacatgcaggaaggttcccttcgttgtgatgtgaatgtttctgtccgacctgttggacaatcagaatttggtacaaaggtagaaataaagaatatgaactcattttctgagatcaatagggcaatcgattatgagatatcccgacaaattctgctccataaagaaggtcaggctgatcaaattgtgcaagaaacccgtctatgggatgaatcttctcagaaaacttttacaatgcgaaaaaaggagggacttgctgactacagatattttcctgagcctgatcttcctgaagttgttctcactactgactatattgatgaaatcagcaagtccttgccagagcttccagaagcaaaacgtaggcggtatgagaatatgggacttagcatgcaagatgttttgttccttgctaatgacgacaatgttgctcatttctttgattctactcttgagcatggtgctgatgcaaagttggcttgtaactggatcatgggtgacattgctgcttatctaaaaaatgaaaagctgtccattgatgaaactaaattaacacctctggagctttctgaacttatcgcatccatcaagaacggaactatcagtgggaagattggcaaggagatactggttgaactcatttccaaaggtggcaccgttaagggtgtgatagaggagaaagatttggttcagatagcagatccagcagaaatcgaggcaatggtagataaagtaattgctgagaatccaaagcaacttgagcagtaccgtgctgggaaaactaagttgcaaggattttttgcaggccaggtgatgaaagcatcgaagggtaaggccaaccctgttttgttgaataaaatccttggagagaagttaaatgccaattagttcttactgtccctcacattgattaatgagcacaacattgggtgaaatctcagagaattattcgccggttaggctaggaaatcccttggttggtctggaaattgttatctctattaaattcagaatgtgattatctatttcgtttccttgtggatattgtagaagtccagttcgcaattcgcatctttgtacttgactcagctcatttgaaaaggaagcataccgcttgcatctcatgcaagcagcaagtataactgcagattaaaattgcatacaatttccatggatgttgtactggtattattgacaatcccaatctttgtttataattttcatctttaacatataataaataacttttccttggaaccaaa

SEQ ID NO: 2031 - DNA, 1899 bp, Panicum virgatum
  misc_feature (94)..(94): n is a, c, g, or t
  misc_feature (121)..(121): n is a, c, g, or t
  misc_feature (138)..(139): n is a, c, g, or t
  misc_feature (148)..(148): n is a, c, g, or t
  misc_feature (161)..(161): n is a, c, g, or t
  misc_feature (178)..(178): n is a, c, g, or t
  misc_feature (196)..(196): n is a, c, g, or t
  misc_feature (225)..(225): n is a, c, g, or t
  misc_feature (265)..(265): n is a, c, g, or t
  misc_feature (298)..(298): n is a, c, g, or t
  misc_feature (301)..(301): n is a, c, g, or t
  misc_feature (388)..(388): n is a, c, g, or t
  misc_feature (391)..(391): n is a, c, g, or t
  misc_feature (622)..(622): n is a, c, g, or t
  misc_feature (640)..(640): n is a, c, g, or t
  misc_feature (1653)..(1653): n is a, c, g, or t
cacgggaggcgcattggcctcaatggctctaaccctcctccgagggatgaggacgccgatctcatttagatcaaatacaggcttattctttacngttcgacctcggttggcccgcttcacnaccagggcggagagtgnncaggcaacngaggccaaagcancagccaaatcaattcanctggcgaccaaggaggcngcagagcagaagacacaagggtttgaagngatcattggaattgagacccatgtccaactctcgaccgtnacaaaagcattttgttcttgcccgtacaactanggntcccagcccaataccactatctgccccacctgcatgggccacccagggacactgccagttctgaatgagaaggtcgttgagtgtgcngtnaagttgggccttgctctcaactgtgagatctcgatgacatccaagtttgatcggaagcagtatttctacccggacctccccaaggggtaccagatttcccagtttgacattcccattgccaagaagggctatgttgatttggatcttccagtggaatttggtggtgggcacaggaagtttgggatcacaagggttcacatggaagaagatgctggcaaactgcttcattcngaatccggcagttactcncaggttgacttaaacagggctggtgtacctttgcttgaaattgtctcggagccagacatgaggacagggatagaggctgctgaatatggtgctgaactgcaaaggatcgttaggtaccttggagtgagtaatggtaatatgcaggaaggttcccttcgttgtgatgtgaatgtttctgtccgacctgttggacaatcagaatttggtacaaaggtagaaataaagaatatgaactcattttctgagatcaatagggcaattgattatgagatatcccgacaaattctgctccataaagaaggtcaggctgatcaaattgtgcaagaaacccgtctatgggatgaatcttctcagaaaacttttacaatgcgaaaaaaggagggacttgccgactacagatattttcctgagcctgatcttcctgaagttattctctctactgactatattgatgaaatcagcaagtccttgccagagcttccagaagcaaaacgtaggcggtatgagaatatgggacttagcatgcaagatgttctgttccttgctaatgatgacaatgttgctcatttctttgattctactcttgagcatggtgctgatgcaaagctggcttgcaactggatcatgggtgacattgctgcttatctaaaaaatgaaaagctctccattgatgaaactaaattaacacctctggagctttctgaacttattgcatccatcaagaacggaactatcagtgggaagattggcaaggagatactggttgaactcatttccaaaggtggcacagttaagggtgtgatagaggagaaagatttggttcagatagcagatccagcagcaatcgaggcaatggtagataaagtaattgctgacaatccaaagcaacttgagcagtaccgtgctgggaaaactaagttgcaaggattttttgcgggccaggtgatgaaagcatcgaagggcaaggccaaccctgttttgttgaataaaatcctcggagagaagttaaatgncaattagttcttattgccctcacatggattaacgagcacgacatcgggtgaaatcccagaaaattatttgccggataggaaatcccttgttggggtctggaaattattatctctactccattaaattcagaatgtgattagctctttcgtttccttgtggatattgtagaagtccagttaacaatacgcatctttgtacttgactcagctcatttgaaaaggaagcatacccgttgcatcttaagc

SEQ ID NO: 2032 - DNA, 2257 bp, Setaria italica
cccgcacccaatcccctccgctccgccactcgcaggcgcggctcgccctccgccgcctccgccgctcgcagctctcccgctacgctccggtcctcaccctcaggccggagcactcaatctctcgccggacttctcctcaccccgccctccgccgccccattaccgctagcttcaaccgaggctgcacgatcaggctgtgaccggcgataactgattgcgatttgtagaggcgcattggccacacgcaatggctctaaccctcctccgagggatgaggacgccgatctcatttagatcgaattccggcctgctctttactgtactacgacctcggttgtcccgcttcacgaccagggcggagagtgcacaggctactgagcccaaagcagcgcccaagtcaattcaactggcgaccaaggaggcggcagagcagaagacacagggttttgaagctgtcattggaatcgagacccatgtccagctctcgaccgtcacaaaagcattttgttcttgcccgtacaactacggctcccagcccaacagcacaatctgccccacctgcatgggccacccaggggcgctgccggttctgaacgagaaggttgttgagtgtgccgtgaagctgggcctcgctctcaattgtgagatctcaatgatatccaagtttgatcggaagcagtatttctacccggacctccccaaggggtaccagatttcccagtttgatattcccatcgccaagaagggatacgtcaatttggatcttccggtggaatttggcggcgggcataggaagtttgggatcacaagggttcacatggaagaagatgctggcaagctgcttcattctgaatccaggagttattctcaggttgacctaaacagggctggcgtacctttgcttgaaattgtctcagagccagacatgagaacagggatagaggctgctgagtatggtgctgagctgcaaaggatcgttaggtaccttggagtgagtaatggtaacatgcaggaaggttcccttcgttgtgatgtgaatgtttctgtccgacctgttggacaatcagaatttggtacaaaggtagaaataaaaaatatgaactcattttcggagatcaatagggcaattgattatgagatctcccggcaaattatgctccataaagaaggccaggctgatcaaattgtgcaagaaacccgtctatgggatgaatcttctcagaaaacttttacaatgcgaaaaaaggagggacttgccgattacagatattttcctgagcctgatcttcctgaagttgttctcagtactgactatattgatgaaatcagcaagtccatgccggagcttccagaagcaaaacgcaggcgttatgagaatatgggacttagcatgcaagatgttctgttccttgctaatgacgataatgttgctcatttctttgattctactcttgaacatggagctgatgcaaagctggcttgcaactggatcatgggtgacattgctgcttatctaaaaaatgaaaagctctccattaatgaaactaaattaacacctctggagctttctgaacttattgaatccatcaagaacggaactatcagtgggaagattggcaaggagatactggttgagcttatcgccaaaggtggaacagttaagggtgtgatagaggagaaagatttagttcagatagcagatccagcagcaattgaggcaatggtagataaagtaattgctgacaatccaaagcaacttgagcagtaccgtgctgggaaaaccaagttgcaaggattttttgcaggccaggttatgaaagcatcgaagggtaaggccaaccctgttttgttgaataaaatccttggagagaagttaaatgccaattagtttgttttgacctcacctggattaacaagtgcgacattgggtgaaatcccagaacgataattttccagataggaaatctcttatttgggtctggaagctgttactctgcctcattaaattcagaatgtgattagctctttcttttccttatggattttgtaaatgtccagttcacaatacacatctttgaactcgaccagctaatttgaaaaggaagaatatccattgtaccttatgcaagctgcatcgcacaactgaagatgaaaattgcaatatgctttcaatggattttgtagtggtgtcattgacaatctccatcttggtttaaattttcatctgtaacatataatatttttttttggaaccaaa

SEQ ID NO: 2033 - DNA, 2059 bp, Zea mays
cagcccaactctctcgcagccaatcccgccgctccgccgcccgcacccaatccgtttctctcacccccgccactcgccagcaacgcggacacgccctccgccgctcttcctctgcaccccagtcctctcccacaaccacttccggcggccacgccctcggcttctccgtacttgctgctcgcccgtcccaccaccataattttccaccagcgattgtaaatttgtgggaggcacattcgccgaggatggctgtaaccctacttcgagggatgagaacgccgataccattcagatcgaactccggcttcttctccactgtcctacggcctcggttgtcccgcttcacgactagggcggagagtgcgcaggccacagaacccaaagcggcgcccaggtcaattcagctggcgaccaaggaggcggctgagcagaaaacacaaggcttcgaagccatcatcgggattgagacccatgtccagctctcgaccgtcacgaaggcgttctgctcctgcccttacagctatggttcccagcccaacagcactatctgccccacctgcatgggccacccggggacgctgccggttctgaatgagaaggtggtcgagtgcgccgtgaagctggggctcgccctcaactgcgagatctcaatgacgtccaagtttgatcgcaagcagtatttctacccggacctccccaaggggtaccagatttcccagtttgacatccccattgccaagaagggttgtgtcgatttggaccttccagtggagtttggtggtgggcataggaaatttggggtcacaagggttcacatggaagaagatgctggcaagctgcttcattctgaatccagcagctactctcaggttgacctaaacagggctggcgtacctttgctcgaaattgtctcagagccagacatgagaacagggatagaagctgctgagtatggtgctgaactgcaaaggattgttaggtacctgggagtgagtaatggtaatatgcaagaaggttcccttcgttgtgatgtgaacgtttctgttcgaccagttggacaatcagaatttggtacaaaggtggaaataaagaatatgaactcattttctgcgataaatagggcaatcgattatgagatctcccggcagattctgctccataaagaaggccaggctgatcaaattgtacaagaaacccgcctgtgggatgaatcttctcagaaaacttttacaatgcgaaaaaaggagggacttgccgactatagatattttccagaacctgatcttcctgaagtagttatcactagtgactatattaatgaaatcagcaagtcaatgccggagcttccagaagcaaagcgtaggcgttatgagaatatgggactcagcatgcaagatgttctgttccttgctaatgatgataatattggtcatttctttgattctactcttgagcatggtgctgatgcaaagctggctgccaactggatcatgggtgacatcgctgcttatctcaaagatgaaaaagtatccattgatgaaattaaattaacacctctagagctttctgaactgatagcatcaattaagaatggaactataagtgggaagatcggcaaggagatactggccgagctcattgccaaaggcggaacagttaaggctgtgatagaagagaaagatttggttcagatagcagatccagcagcaattgaggcaatggtagataaagtaattgctgataatccaaagcaacttgagcagtaccgtgctggaaaaactaagctacaaggattttttgctggccaggtgatgaaagcatcgaaggggaaggccaacccagttttgttgaataaaattcttggagagaagctaaatgccaaataattatttttacccccatactgaatctcaggcgtccatgaagaatgggacttcaaattcatagaatgagattaatgtgaacgacgtagaagttttgtccacaatacagatattattgtactaagctgatactttaaaagggcgtgttcattatattttatgcgatagcttgccct

SEQ ID NO: 2034 - DNA, 2227 bp, Sorghum bicolor
cagcccaactctctcgcagccaatccctccactccgccgcccgcacccaatccccttgccgccactcgccagcagcgcggccacgccctcccctccgccgctcctcttcctctgcgccccggtcatcgcccacacccgcttccggcggccacgccctccgcttctccgtacttgctgctcgccccgcccaccaccccgtattctccgccagcgattctaacctctgcgcggcacgcggcacactcgccgacgatggctctaaccctcctccgagggatgaggacgccagtctcctccggctcaaaccccggcctcttcttcgccgttctacgtcctcggctgtcccgcttcacggctcgggcggagagtgcgcaggccacggagcccaaagcggcgcccccgcccaggtcgattcagctggcgaccaaggaggcggcggagcagaagacacagggcttcgaagccgtcatcgggatcgagacccacgtccagctctccaccgtcaccaaggcgttctgctcctgcccgtacagctacggcgcccagcccaacagcaccgtctgccccacctgcatgggccacccggggacgctgccggttctcaacgagaaggtggtcgagtgcgccgtgaagctggggctcgcactcaactgcgagatctcgatgacgtccaagtttgatcgcaagcagtatttctacccggacctccccaaggggtaccagatttcgcagtttgacatccccattgccaagaagggtcatgtcgatttggaccttccggtggagtttggtggtgggcataggaagtttgggatcaccagggttcacatggaagaagatgcaggcaagctgcttcattctgaatccagcagttactctcaggtcgacctaaacagggctggtgtacctttgcttgaaattgtctcagagccagacatgagaacagggatagaggctgctgagtatggtgctgagctgcaaaggatcgttaggtacctgggagtgagtaatggtaacatgcaagaaggttcccttcgttgtgatgtgaatgtttctattcgaccagttgggcaatcagaatttggcacaaaggtggaaataaagaatatgaactcattttctgcgataaatagggcaatcgattatgagatctcccggcagattctgctccataaagaaggccaggctgatcaaattgtacaagaaacccgcctgtgggatgaatcttctcagaaaacttttacaatgagaaaaaaggagggacttgccgactatagatattttccagaacccgatcttcctgaagtagttctcactagtgactatattaatgaaatcagcaagtcaatgccggaacttccagaagcaaagcgtaggcgttatgaaaatatgggactcagcatgcaagatgttctgttccttgctaatgatgataatattggtcatttctatgattctactcttgagcatggtgctgacgcaaagctggctgccaactggatcatgggtgacattgctgcttatctcaaagatgaaaaggtctccattgatgaaattaaattaacacctctagagctttctgaactgatagcatccattaagaatggaacaataagtgggaagatcggcaaggagatactggccgagctcattgccaaaggtggaacagttaagggtgtgatagaagagaaagatttggttcagatagcagatccagcagcaatcgaggcaatggtggataaagtaattgctgataatccaaagcaacttgagcagtaccgtgctggaaaaactaagctacaaggattttttgctggccaggtgatgaaagcatcgaagggcaaggccaacccagttttgttgaataaaatccttggagagaagttgaatgccaattagttatttttgccatcatactgaaaatctcaaggagtgcacgaagaatgcaactgcaaacgaagtccctgaaccagcaaccgttgagttgagaatgtgattaatgtgaatgatgtagaagttttgttcacaatacggatatcattgtacttaggtgatacattgaaatggcatgttgattataatttatgcagtagcttaccccaatcatgtgtacaatttccacgtattttgtactactgcgttgacagtctgcattgctgtttttttttctctgcaacatacaatatttactacaattttcgttgaaccaaaaagatattgaacagca

SEQ ID NO: 2035 - DNA, 1343 bp, Triticum aestivum
tccgcgcgcggcgtcatgggctcgctcccggtgctctccccggcggaatgcgcgccgccgccgacggaggggacgcgggcgacggtggcggcgtcggacctggccgcgctcttcgacgcgcagcgccgccacctcgaccacttcttcgaccggctcgacatgccgcaggcggcggcgttcgcgcaggcgctgctcgacgcgcccggggccgtcttcttcaccggcgtcggcaagtccggcatcgtggcccgcaagctggcgcagacgctcgcctccctcggcttcgcgcgcgccgggttcctctcccccgtcgacgcgctccacggcgacatcggctccgtcttccccggggacgtcctcgtgctgctctccaagtccggcgcctccgacgagctgctcgcgctcgcgccctgcgcgcgcgccaagggcgccaagctcatctccctcacctccgcggcctccggcgccgactgcccgctcgccgccgcctgcgacctcaacgtgcacctcccgctgcagggagaggtctgccccttcggcctcgcgcccgtcacctccaccgccatacagatggtcttcggcgacaccgtcgtcgccgccatcatggaggcgcgccgcctcaccagggaccagtacgcgtcaaaccaccccgccggaaagatcggaaagaccctcatcttcaaggttaaggatgtcatgaagaaacaaaatgagcttccattgtgcaaggagggagatatgataatggatcaacttactgagctcactagtaaaggttgtggctgtcttcttgtggttgatgatgagtatcatttgattggaactttcaccgacggagacctccggcgtacactcaaggcaagcgggccagctattttcagtctaacagttggagagatgtgcaacaggaacccaaggacaatcactgcggatgcaatggccgttgaagccatggagaagatggagtcgcccccttcacctgtgcagttcctgcctgtcgtcgatgacaaaaacgtcgtgtctgggatcattacactgcatgggttggtctccgctggattgtaaccaattctttgtgtgtagcctgtcctggttctttgtggttctttgcacctgcttggtcctcccaagacatcagataaattcttgtgaatctgatcgacatcatcttatcgctgttgtagcatctgtagtctagatatttgaaagagcatgtgttcgaaggcactacctcatcgccccatagcccctgtgtatagtgttttgttaagaggaatatgtggaatcttgttcgttggttgttcaagtggagctgaagtcaaataaatcttaagttgtcaatt

SEQ ID NO: 2036 - DNA, 1474 bp, Secale cereale
cggggacgcgcaaacgacacacacccctctctcccgcggcgcccgtttcaccgtagagagagaatccctccccctcctccttccccctcgccgccccggcatttccgcgagcaccctccgcgccgccatgggctcgctcccggtgctctccccgccggaatgcgcgccgccgcgccccgcttcgccggaggggacgcgggcgacggtggcggcgtcggacctggccgcgctcttcgacgcgcagcgccgccacctcgaccacttcttcgaccggctcgacatgccgcaggcggcggcgttcgcgcaggcgctgctcgacgcgcccggggccgtcttcttcaccggcgtcggcaagtccggcatcgtggcccgcaagctggcgcagacgctcgcctccctcggcttcgcgcgcgccgggttcctgtcccccgtcgacgcgctccacggcgacatcggctccgtcttccccggggacgtcctcgtcctgctctccaagtccggcgcctccgacgagctgctcgcgctcgcgccctgcgcccgcgccaagggcgcgcagctcatctccctcacctccgcggcctccggcgccgactgcccgctcgccgccgcctgcgacctcaacgtgcacctcccgctgcagggggaggtctgccccttcggcctcgcgcccgtcacctccaccgccatacagatggtcttcggcgacaccgtcgtcgccgccatcatggaggcgcgccgcctcaccagggaccagtacgcgtcgaaccaccctgccggaaagatcggaaagaccctcatcttcaaggttaaggatgtcatgaagaaacaaaacgagcttccattgtgcaaggagggagatatgataatggatcaacttactgagctcactagtaaaggttgtggctgtcttcttgtggttgatgatgagtatcatttgattggaactttcaccgacggagacctccggcgtacactcaaggcaaacgggccagctattttcagtctaacagttggagagatgtgcaacaggaacccaaggacaatcaccgcagatgcaacggcagttgaagccatggagaagatggagtcggccccttcacctgtgcagttcctgcctgtcgtcgatgacaaaaacgtcgtgtctgggataattacattgcatgggttggtctccgctggattgtaactaggctaattgtaaccaattctgtgtgtgtagcctgcctctgttctttgtggttctttgtgcctgcttggtcgtcccaagaaatcagataaattcttgtgaatctgatcggcttcatcttatcgctgttgtagcatctgtagtctagatatttgaaagagtatgtgttcaaaggcactaccggcatcaccccatagcccttgtgtatagtgctttgttagcggaacatatgtgggaccttgctttttggttcaaggggagttgaggttaaataaatcttaagttgcc

SEQ ID NO: 2037 - DNA, 2035 bp, Brachypodium distachyon
gatcaaaaccagagatgcaaactgacccgaccacagatcaaaatccccccgattattttagctccagatcacatacatacaccgatgaataaatagcgctccgtgtcgagggacgtaaaagggtcaggatcgtttcttccctgcgcttcgcttcgatccccagttcccacttccccggttaatccccacgtctcacctcctcccgcgaacgcggcatttccgcgagcagcctccgcgcgcggccatgggatcgctccccgtgctgtcctcgccggaatgcgccccgccgcaggggccgcgggcgaaggtggcggcgtcggacctggcgccgctgttcgacgcgcagcggcggcacctgggtcacttcttcgagaacctcgacatgtcgcaggcggcggcgttcgcgcaggcgctgctggacgcgccgggtgccgtcttcttcacgggcgtgggcaagtccggcatcgtggcgcggaagctggcgcagacgctcgcgtccctagggttcggccgcgccgggttcctggcccccgtcgacgcgctccacggcgacatcggctccgtcttccccggggacgtcctcgtgctgctctccaagtcgggagcctccgacgagctgctcgcgctcgcgccctgcgcgcgcgccaagggcgcgcacctcatctccctcacctccgccgcatccggcgccgactgcccgctcgccgccgcctgcgacctcaacgtgcacctcccgctgcagggggaggtctgccccttcggcctcgcccccgtcacctccaccgccatacagatggtcttcggagacaccgtcgtcgccgccatcatggaggcgcgccgcctcaccagggaccagtacgcgtcaaaccaccccgccggcaagatcggcaagaccctcatcttcaaggttaaggatgttatgaagaaacaaaatgagcttccattgtgcaaggagagtgatatgataatggatcaacttactgagctcactagtaaaggttgtggctgtcttcttgtggttgatgatgagtaccatttgattggaactttcactgatggtgacctccggcgtacactcaaggcaagcgggccagctattttcaatctcacagttggagagatgtgcaacaggaacccgaggacaatcactgcagatgcaatggcggtcgaagccatggagaagatggagtcgcccccttcacctgtgcaattcttgcccgttgtcgacgagaaaaatatcgtgtctgggatcatcacattgcatgggttggtctctgctggattataatcaaaccttcatatgtctggagtcataaaatcgcatgggttctttgttattctttgtacctgctcactggtaagacatcacacaggataaattcttcttgcgagttggatctgatgatggcactttgtcattgtagtagcatctgtagtctagacaactgaaagtgtatgtggagacactaccgagtgcagagtgttctgttaatgaataagctgcaccttgctcgttgcttgtttaagtgagctttaagtggaataaaatcttacatttttgtgtgtatgtcaaggtaatgttttcatgactggtttctggcagatttgcatgactagcggtatccatccatttgaagcacacacagggtaggattaaacagacattgagcaatcatcaaaaggaagacagctaaactagaatggagattagcactggggggtagacatgcactgaacggacacaaggtttcgtggtgctccatcctaactccaatctcttcggaccataaactttcatacaaaaggttccctaatttgatctggaaggaaacacagttcaagcatcccaatttccatatgatagtggtttgactcctccctgtgccgatctgctgccacaatcaaggttcacctttcccattcagaatctgggtgtgggcgctccaccctgggcttgctagctggggccgtggggctttgagggtgacttgttagggcctggtcccagcccatgatgtgcggcaaagcatactgc

SEQ ID NO: 2038 - DNA, 1707 bp, Panicum virgatum
ctgttttttttcattccccccctaaataaatagggctcgatcttgcttgccacattcacaccagtttcaattgctcgctcgctcgcacccgtttcccctgatcccaaggaacgaacccaccccgctcgccgcacccgtttcccccgatcccaaggaacgaacccaccccgctcgccgcgggcattttctcgaacacccagcgcgcgcgcgggcgctcccccgccgccgcccatgggctccctcccggttaacgcctcgccggaatgcgccccgcaggggcgcgccacggtgtcggcgtcggacctggcgccgctcttctccgcgcagcgccggcacctggaccacttcttcgatcgcctcgacatgtcgcaggcggcggcgttcgcgcaggcgctgctcgacgcgcccggggccgtcttcttcacgggcgtcggcaagtccggcatcgtggcaaggaagatcgcgcagacgctggcgtcgctgggcttcgcgcgggcaggattcctggcccccgtcgacgcgctccacggcgacatcggcgcgctcttcccgggggacgtcctcgtgctgctctccaagtccggcgcctccgacgagctgctcgcgctcgcgccctgcgcgcgcgccaagggcgcctacctcatctcgctcacctcggcggcgtcgggggccgactgcccgctcgccgccgcctgcgacctcaatgtgcacctgccgctgcagggggaggtctgccccttcggcctcgcgcccgtcacctccaccgccatccagatggtgttcggggacaccgtcgtcgccgccatcatggaggcgcgccgactctccagggaccagtacgcctgcaaccaccccgccggcaagattggcaagaccctcatcttcaaggttaaagatgttatgaagaaacagaatgaacttcctctgtgcaaggagggagatatgataatggaccaactcacagagctcaccagtaaaggttgtgggtgtctgcttgtggttgatgaagagcatcatttgattggcaccttcactgatggtgatctccggcgtacattgaaggcaagcggcccagctattttcaatctcacagttggagagatgtgcaacaggaatccaaggacaatcactgccgatgcaatggcagtcgaagccatggagaagatggaatcacgtccttcacctgtgcagttcttgcctgtcgtcgacgacaacaacgtcgtgtgtgggatcattacactgcacggattggtctctgctggattgtagacttctgtggcatcatcaccttctgctggattacaaatttctgtaccagcttactgggttcttaatgattccgtttgtctacgtctatttggctctagactgccaattgcatgtattcttgccgttcagtttatacctgaacgtgttctgtcgctacagtattgtgtgtagcctagactgtcagtgtacccatatgtatagtgcatgataagaggaatatgcccgtgtccccatttgtatagtgtttggtaagaggaatatggccctagactatcggtgtaacctttacgtgtagttggctgcttgtgtatgtatcgtaccctgttctgtaaatgatcgcgtacgctgtgaaattccaatgctgtcgtgcaagctgaagccccacaagccttattgaacttttcattccttgtgtagggtcaactctgttggtgtttc

SEQ ID NO: 2039 - DNA, 1579 bp, Panicum virgatum
attgctcgctcgctcgcacgcgcaaacgccgcctcttcctcctcccgtcctccccccactcgccgcacccgtttccccagatcccaaggaacgaacccaccccgctcgccgcgggcattttctcgaacacccagcgcgcgcgcgggcgctcccccgccgccgcccatgggctccctcccggttaacgcctcgccggaatgcgccccgcaggggcgcgccacggtatcggcgtcggacctggcgccgctcttctccgcgcagcgccggcacctggaccacttcttcgaccgcctcgacatgtcgcaggcggcggcgttcgcgcaggcgctgctcgacgcgcccggggccgtcttcttcacgggcgtcggcaagtccggcatcgtggcgcggaagatcgcgcagacgctggcgtcgctgggcttcgcgcgggcaggcttcctggcccccgtcgacgcgctccacggcgacatcggcgcgctcttcccgggggacgtcctcgtgctgctctccaagtccggcgcctccgacgagctgctcgcgctcgcgccctgcgcgcgcgccaagggcgcctacctcatctcgctcacctcggcggcgtcgggggccgactgcccgctcgccgccgcctgcgacctcaatgtgcacctgccgctgcagggggaggtctgccccttcggcctcgcgcccgtcacctccaccgccatccagatggtgttcggggacaccgtcgtcgccgccatcatggaggcgcgccgactctccagggaccagtacgcctgcaaccaccccgccggcaagattggcaagaccctcatcttcaaggttaaagatgttatgaagaaacagaatgaacttcctctgtgcaaggagggagatatgataatggaccaactcacagagctcaccagtaaaggttgtgggtgtctgcttgtggttgatgaagagcatcatttgattggcaccttcactgatggtgatctccggcgtacattgaaggcaagcggcccagctattttcaatctcacagttggagagatgtgcaacaggaatccaaggacaatcactgccgatgcaatggcagtcgaagccatggagaagatggaatcacgtccttcacctgtgcagttcttgcctgtcgtcgacgacaacaacgtcgtgtgtgggatcattacactgcacggattggtctctgctggattgtagacttctgtggcatcatcaccttctgctggattacaaatttctgtaccagcttactgggttcttaatgattccgtttgtctacgtctatttggctctagactgccaattgcatgtattcttgccgttcagtttatacctgaacgtgttctgtcgctacagtattgtgtgtagcctagactgtcagtgtacccatatgtatagtgcatgataagaggaatatgcccgtgtacccatttgtatagtgtttggtaagaggaatatggccctagactatcggtgtaacctttacgtgtagttggctgcttgtgtatgtatcgtaccctgttctgtaaatgatcgcgtacgctgtgaaattccaatgctgtcgtgcaagctg

SEQ ID NO: 2040 - DNA, 1670 bp, Panicum virgatum
gctcgctcgcacgcgcaaacgccgcctcttcctcctcccgtcctcccaccccccaccccactcgccgcacccgtttccccagatcccaaggaacgaatccaccccgctcgccgcgggcatttcctcgaacatctagcgcgcgcgtgcgcgggtgccccgccgccgccgcccatgggctccctcccggttaacgcctctccggaatgcgccgcgcagaggcgcgccacggtgtcggcgtcggacctggcgccgctcttctccgcgcagcgccggcacctggaccacttcttcgaccgcctcgacatgtcgcaggcggcggcgttcgcgcaggcgctgctcgacgcgcccggggccgtcttcttcacgggcgtcggcaagtccggcatcgtggcgcggaagatcgcgcagacgctggcgtcgctcggcttcgcgcgggcaggcttcctggcccccgtcgacgcgctccacggcgacatcggcgcgctcttcccgggggacgtgctcgtgctgctctccaagtccggcgcctccgacgagctgctcgcgctcgcgccctgcgcgcgcgccaagggcgcctacctcatctcgctcacctcggcggcgtcgggggccgactgcccgctcgccgccgcctgcgacctcaatgtgcacctgccgctgcagggggaggtctgccccttcggcctcgcgcccgtcacctccaccgccatccagatggtgttcggggacaccgtcgtcgccgccatcatggaggcgcgccggctctccagggaccagtacgcctccaaccaccccgccggcaagattggcaagaccctcatcttaaaggttaaagatgttatgaagaaacagaatgaacttcctctgtgcaaggagggagatatgataatggaccaactcacagagctcaccagtaaaggttgtgggtgtctgcttgtggttgatgaagatcatcatttgattggcaccttcactgatggtgatctccggcgtacattgaaggcaagcggcccagctattttcaatctcacagttggagagatgtgcaacaggaatccaaggacaatcactgccgatgcaatggcagtcgaagccatggagaagatggaatcacctccttcacctgtgcagttcttgcctgttgtcgacgacaacaatgtcgtgtgtgggatcattacactgcacggattggtctctgccggattgtagacttctgtggcatcatcatctgctggattacaagtttctgtaccagcttaccggggtcttgatgattccgtttgtctatatctatttggctctcgactgccaattgcatgtattcatgccgttcagtctatacctgaacgcgttttgtcactacagtatcatgtgtagcctagactatcagtgtacccttatgttacgtatagtgtgcttggtaagaggaatatgctcctcaaggcgttttatcgctacagtatcatttctttgtagcctagattgtgtcggtgtaaccttatgtgcagttggctacttgtgcatgtatcgtaacctgttctgtaaatgatttcattttttgtgtagggtcgactgtgtcgctgtttctctaaatactgtgtgtggcagactgagctcacgcatttcgcctgactgctctatgtccatatgcaagtagtatcatttgttct

SEQ ID NO: 2041 - DNA, 1551 bp, Setaria italica
tgctcgctcgacgcgcaaaacgccgcctcttcctcctccgttcgccccaccccggaaccccgtttccccagatcccaaggaacgaacccaccacccctctcgccgcggcatttcctcgagcaccccgcgcgcccccggctgccgacgccccatgggctcactcccggtgctcgcctccccggaatgcgccccgcgggggcgcgccacggtgtcggcgtcggacctggcgccgctcttctccgcgcagcgccggcacctggaccacttcttcgaccgcctcgacatgtcgcaggcggccgcgttcgcgcaggcgctgctcgacgcgcccggggccgtcttcttcacgggcgtcggcaagtccggcatcgtggcgcggaagatcgcgcagacgctggcgtcgctgggcttcgcgcgggcgggcttcctcgcccccgtcgacgcgctccacggcgacatcggcgcgctcttcccaggggacgtgctcgtgctgctctccaagtcgggagcctccgacgagctgctcgcgctcgcgccctgcgcgcgcgccaagggctcctacctcatctcgctcacctcggcggcgtcgggaggcgactgcccgctcgccgccgcctgcgacctcaacgtgcacctgccgctgcagggggagatatgccccttcggcctcgcgcccgtcacctccaccgccatccagatggtgttcggggacaccgtcgtcgccgccatcatggaggcgcgccgcctctccagggaccagtacgcctccaaccaccccgccggcaagatcggcaagaccctcatcttcaaggttaaggatgttatgaagaaacagaatgaacttcctctgtgcaaggagggagatatgataatggaccaactcacggagctcaccagtaaaggttgtgggtgtctgcttgtggttgatgaagagcatcatttgattggcaccttcactgatggtgatcttcggcgaacactcaaggcaagcgggccagacatttttaatctcacagttggtgagatgtgcaacaggaatccaaggacaatcactgcagaggcaatggcagtcgaagccatggagaagatggaatcacctccttcacctgtgcagttcttgcctgttgtcgacgacaacaatgtcgtttgtgggatcattacactgcatggattggtctctgccggattgtagacttctgtggcatcatcaccttcagctggatttttagattctgtaccagcttgccgggttcttagtggttcctcccatctacttgtacttggccctagactgccaattgccagttttcctgccgctcagttcatacctgaaggcgtcttatcgcgatgcgtatgtgtagcctagactgtcagtgtacctttgtgtgtagtgcttggcaagaggaatatgctcctgaaggtgtttttatcgatgtagcaagaggaatatgttggtgtacatgccgtttcgcagttgccttggctgcctgtgttttgtaccctgttctgtaaatgatcgtggacgctgagaaattccaatgcagccgttcaagt

SEQ ID NO: 2042 - DNA, 2298 bp, Oryza sativa
ataaacttgtagctctcgttcgagctccaaatcaaaaaagctcccataaagccataccgctcgcggataccgcctctagttcgtcacctcgattagccccagatcccaagaaaagaacaaagcgatccgctccctcgcctcgccgcggcattttcacaagcaccctccgcgcgccgcgccgcgccgccgccgccgccgccgacaccgtcgcgagagggggtagggggggatgggctcgctccccgtgtcgtcgccggaatgcgcgccggggcggcgggtgacggtggcggcgtcggacctggcgccgctgttcggggcgcagcggcggcacctggaccacttcttcgaccggctcgacctctcgcaggcggcggcgttcgcgcaggcgctggtcgacgcccccggcgcggtgttcttcacgggcgtcggcaagtccgggatcgtggcgcggaagctggcgcagacgctggcgtcgctcgggttcacccgcgcggggttcctgtcccccgtcgacgcgctccacggcgacatcggctcggtcttccccggcgacctcctcgtcctgctctccaagtccggcgcctccgacgagctcctcgccctcgcgccctgcgcccgcgccaagggcgcccacctcatctccctcacctccgccgcatccggcgccgactgcccgctcgccgccgtgtgcgatctcaacgtgcaccttccgctgcaggccgaggtgtgccccttcggcctcgctccggtgacctccaccgccatacagatggtgttcggcgacaccgtcgtcgccgccatcatggaggctcgccgcctctccagggaccagtacgcctccaaccaccccgccggcaagattggcaaatccctcatcttcaaggttaaggatgttatgaagaagcaaaatgagcttccattgtgcaaggagggagatatgatcatggatcaactcactgaactcactagtaaaggctgtgggtgtctacttgtggttgatgatgagtaccatttgatcggaactttcactgatggtgatctccggcgtacactcaaggcaagtgggcaagcaattttcaatctgacagttggagagatgtgcaacaggcacccaagaacaatcaccgctgatgcaatggcagtacaggccatggagaagatggaatcgcccccttctccggtgcagttcttgccagttgttgatagcaacaacgttgtctgtgggatcatcacattgcacggattggtctcagctggactataatcttttcgcctcatctccttgcgattctttgcaagtatttggtccagtacatcatcacgctggttgcatggattcttgtcaaatggtgacgccttatctttgtactagtacgtgtagcctagagtgttaaagaggcattgtttaccagtgtctcctacgtctagtgttctaaaagagcaatgtgacagttgctcgctggatgaatgtacccttccctctgtaaatgaatgtgagtttaagatgcagtggaataaaaagtttaagcctaaacaagcagacatgttatttggtttagctttttaaagccataaaccactcctacactgttaagccaaaaactacgtttgagtagttttgcaagactccaccattttgcaaataacataagtcacattcaaaaggaaatgaatgtgagtttaagatgcagtggaataaaaagtttgagccttaacaaacagatatgttttttgtttagctttttaaagccataaccactcaactacgtttgagtagttttgtaagactccaccattttgcaaataacataagtcacacattcaaaaggcacaaggtgtcaaacgcaatgcatagctaactggagtagaattttgcaactagtaggcctggtgaagttcaaacatgcattgaacaaacacaacccttcatggtgtgctcaatctgtgacattcgatctttagctccatgaatctaatagatatctcctaattcgatttcgtggagaaagtgcaacagcatccaaattttggtagcgatgatgttcaaatccctccatgctgctggtgcctacaagggagcttcacctttcccactctgaatctgggtgtgggcgctccaccctgggcttgctagctggtgatggacttggctggtgattagtcaaggcctggtcccagcccaagatgtgcggcaatgcgaactgcacatacacacactaatcaaccacaaaaacacatggaagaagccctaagcagaatctttttaagataatggattcaaaacctggcagctacaat

SEQ ID NO: 2043 - DNA, 1487 bp, Zea mays
aattatcgaaagcctcgcctcgtgctccagtccttccatttccccgttttccccgtgacagttgctgtgacagttgctgcgtcgcactcgcaagcctcgcctcgtgctccagtccttccatttccccgttttggctgcgtgcatgcccgcgtgttcccagaccgcaaggaatcaaatccgcccgccgcccgacatctcgcctcgccgcggcatttcctcaaacgccccgctcacagcgcccatgggctcccttccggtgccggcctcaacggaatgcaccccgcaggggcgcgccacggtgtcggcgtcggacctggcgccgctcttctccgcgcagcgccggcacctggaccacttcttcgaccgcctcgacatgtcgcaggcggcggcgttcgcgcaggtgctgctcgacgcgccgggcgccgtcttcttcacgggcgtcggcaagtcgggcatcgtggcgcgcaagaccgcgcagacgctggcgtcgctgggcttcgcgcgcgccggcttcctcgcccccgtcgacgcgctccacggcgacatcggcgcgctcttccccggggacgtgctcgtgctcctctccaagtccggcgcctccgacgagctgctcgcgctcgtaccctgcgcgcgcgccaagggaggctacctcgtctcggtcacctccgcggcctcgggggccgactgcccgctcgccgcggcctgcgacctcaacgtccacctcccgctgcagggggaggtgtgccccttcggcctcgcgcccgtcacctccaccgccatccagatggtgttcggggacaccgttatcgccgccatcatggaggcaaggcgactctccagggaccagtacgcctccaaccatcctgctggcaagatcggcaagaccctcattttcaaggttaaggatgtcatgaagaaacagaatgaacttcccctgtgcaaggagggagatatgataatggaccaactcaccgagctcaccagtaaaggttgtggttgtctgcttgtggttgatgaagagcatcatttgattgggaccttcactgatggtgatctccgccggacactgaaggcaagcgggccagctatctttagtctcacagttggagagatgtgcaacaggaatccaagaacaatcactgcagacgcaatggctgttgaagccatggagaagatggagtcaccaccttcacctgtgcagttcttgcctgttgtgaacgacaacaacgtcgtgtgtggaatcatcacactgcatggattggtctctgccggcctgtaaacttctgtggcaccatcaccttctgctggactgtaagctgacgtgccagcttacccagttcatacaacaagtggttctgtcgactcctcttcagtgtacgcttatgtatagtggtggataagaggaatatggtacactgctgttggttgtttatcaatgctatcgttttgtactttaatctaaaatgcccatttccttggtttctctt

SEQ ID NO: 2044 - DNA, 1509 bp, Zea mays
aagttggtagactattgtctgatccgcaccgttggctgcgtcacattctctacgcctcgtgctccttcccttctaccgttcggctgcgtacccgcgtctccccagatccgctgccccgccctctcgacgcggcaattcctcgaacgccccgcgcgagccacgccctcgccgcccatgggctcgctcccggcgccggcctcggcggaattcgccccgcggccgcgggggcgcgccacggtggtggcgtcggacctggcgccgctcttctccgcgcagcgccggcacctggaccacttcttcgaccgcctcgacatggcgcaggcggcggcgttcgcgcaggcgctgctcgacgcgccgggcgccgtcttcttcacgggcgtcggcaagtcgggcatcgtggcgcgcaagaccgcgcagacgctggcgtcgctgggcctcgcgcgggccggcttcctcgcccccgtcgacgcgctccacggcgacatcggcgcgctcttccccggggacgtcctcgtgatcctctccaagtccggggcctccgacgagctgctcgcgctcgcgccctgcgcgcgcgccaagggcgcctacctcgtctcgctcacctccgcggcctcgggggatgactgcccgctcgccgcggcctgcgacctcaacgtccacctgccgctgcagggggaggtgtgcccctttggcctcgcgcccgtcacctccaccgccatccagatggtgtttggggacaccgtcatcgccgccatcatggaggcaaggcgactctccagggaccagtacgcttccaaccatcccgctggcaagatcggcaagaccctcatcttcaaggttaaggatgttatgaagaaacagaatgagcttcctctgtgcaaggagggagatatgataatggaccaactcaccgagctcaccagtaaaggttgtggttgtctgcttgtggttgatgaagagcatcatttgattgggaccttcactgatggtgatctccggcggacactgaaggcaagcgggccagctatcttcagtctcacagttggagagatgtgcaacaggaacccaaggacaatcactgcggaggcaatggcagttgaagccatggagaagatggaggcaccaccttcacccgtgcagttcttgcctgttgtcaacgagaacaacgtcgtgtgtggaatcatcacattgcatggattggtctctgccggattgtagacttgtgtggcaccattacctgttagctagctgttaccgctggagtatttatgtggagcctgaactcttcagtgtacccttatgtacagtatagtggtcgctaagaggaacatggtacactgcttataatgcttgtgtttttgtacttaattttaaatgccgattgccttggtttctcttgatggatccgggtgtgtggcaggctgagcttacgtactttgaccgactgaaacatgttaaaatgcaaatagataatgtccatcttttctagatgacagattgcatcgtgct

SEQ ID NO: 2045 - DNA, 1251 bp, Saccharum officinarum
gcagctaccgtccgtgattcccgggccgacctcgcgcgtgcgtgcaacctcacacataaaatgctgcagtcgacttgcacgcctcgtgctcgtgctccctcgcctccccggtttggcctgcgtgcccgcgtctccccagatcgcaaggaacgaaccccgcccgcaacccgccctctcgccgcggcatttcctcgaacgccccgcgcaccccgcgcccctcgccgcccatgggctccctcccggtgccagcctcggcggaatgcgccccgcaggggcgcgccacggtgtcggcgtcggacctggcgccgctcttctccgcgcagcgccggcacctggaccacttcttcgaccgcctcgacatgtcgcaggcggcggcgttcgcgcaggcgctgctggacgcgccgggcgccgtcttcttcacgggcgtcggcaagtcgggcatcgtggcgcgcaagatcgcgcagacgctggcgtcgctgggcttcgcgcgggcgggcttcctcgcccccgtcgacgcgctccacggcgacatcggcgcgctcttccccggggacgtcctcgtgatcctctccaagtcgggcgcctccgacgagctgctcgcgctcgcgccctgcgcgcgcgccaagggcgcctacctcatctcgctcacctccgcggcctccggggcggactgcccgctcgccgcggcatgcgacctcaacgtccacctgccgctgcagggggaggtctgccccttcggcctcgcgcccgtcaccttcaccgccatccaaatggtgtttggggacaccgtcatcgccgccatcatggaggcaaggcgactctccagggaccagtacgcctccaaccattccgctggcaagatcggcaagaccctcatcttcaaggttaaggatgttatgaagaaacagaatgaactttctctgtgcaaggagggagatatgataatggagcaactcacggagctcaacagtaaagggtggggttgtctgcttgtggtggatgaagaacatcatttgattgggaccttcactgatggtgatctccggcggacactgaaggcaagtgggccagctatttttaatctcacaggtggaaagatgtgcaacaggaatccaagaacaatcactggagaggcaatggcagttgaagccatggagaaaatggagtcaccaccttcccctggacaggtcttgccagttgtaaacgagaaaaacatcgtgtgggggatcaatacattggatggattgggct

SEQ ID NO: 2046 - DNA, 622 bp, Secale cereale
aatcgacgagtcgcctgcctccgcccccttcgcgaagtttccctgccccaccatttcgccatggccggcggcggcatcttcagcagggcgctgagctacgtcgtcaacgagttcctcgtcgagggcctcgccaacaaccgtgccttccagaggtttgctgtgaggaccaacaggactttggaggatctctctactaaagctaaacaagcgagggaggagatatcggagcaatttaaggatgctcgtggacccgatgatcgcttcaagcagtgatgcctgctacccgtgttccgagtcatctgttctcgtcgtggttctggatgccatccgcaagtggccattgtataaaatcggaatctaaattatcttatgttctatttagaaattgagaactagacggagagcattattgcatttctgtagcctgtccaacggaagtaattcgagaggagagactctccttggctggacctctgttttacaaatttctatgcttaatgttgttttatgagtagtaatatggaccatcgcagtctatctgttgttatgcccttgcctggcaaatctatataactctggctgcgttgatgacctggaaagattttgacgcacaaaaaaaaaa

SEQ ID NO: 2047 - DNA, 751 bp, Secale cereale
cttacgagtgtcgcatcacaacgccgttccaatcgacgagtcgcctgcctccgcccccttcgcgaagtttccgcgctccaccgtttcgccatggccggcggcggcatcttcagcagggcgctgagctacgtcgtcaacgagttcctcgtcgagggcctcgccaacaaccgtgccttccagaggtttgctgtgaggaccaacaggactttggaggatctctcaactaaagctaaacaagcgagggaggagatatcggagcaatttaaggatgttcgtggacccgatgatcgcttcaagcagtgatgcctgctacccgtgttccgagtcatctgttctcgtcgtggttctggatgccatccgcaagtggccattgtataaaatcggaatctaaattatcttatgttctatttagaaattgagaactagacggagagcattattgcatttctgtagcctgtccaacggaagtaattcgagaggagagactctccttggctggacctctgttttacaaatttctatgcttaatgttgttttatgagtagtaatatggaccatcgcagtctatctgttgttatgcccttgcctggcaaatctatataactctggctgcgttgatgacctggaaagtattttgacgaaacaaaaaaaaaaaaaaaaaagaaaaaaaaaaacgtaaatcctgtgtgttagactaacctgtcgggtagaacgcgtcgaaccggagaccgacaagggaaggtagacgggg

SEQ ID NO: 2048 - DNA, 577 bp, Secale cereale
acgagtcgcctgcctccgcccccttcgcgaagtttccgcgctccaccgtttcgccatggccggcggcggcatcttcagcagggcgctgagctacgtcgtcaacgagttcctcgtcgagggcctcgccaacaaccgtgccttccagaggtttgctgtgaggaccaacaggactttggaggatctctcaactaaagctaaacaagcgagggaggagatatcggagcaatttaaggatgttcgtggacccgatgatcgcttcaagcagtgatgcctgctacccgtgttccgagtcatctgttctcgtcgtggttctggatgccatccgcaagtggccattgtataaaatcggaatctagattatcttatgttctatttagaaattgagaactagacggagagcattattgcatttctgtagcctgtccaacggaagtaattcgagaggagagactctccttggctggacctctgttttacaaatttctatgcttaatgttgttttatgagtagtaatatggaccatcgcagtctatctgctgttatgcccttgcctggcaaatctatataactctggctg

SEQ ID NO: 2049 - DNA, 594 bp, Triticum aestivum
ggggagtgttcgcctcacaacgccgttccaattgaccggtcgcctgcctccgcccccttcccgaagtttccgcgctccaccatttcgccatggccggcggcggcatcttcagcagggcgctgagctacgtcgtcaacgagttcctcgtcgagggcctcgccaacaaccgtgccttccagaggtttgctgtgaggaccaacaggactttggaggatctctcttctaaagctaaacaagcgagggaggagatatcggagcaattcaaggatgctcgtggacccaatgatcgcttcaagcagtgatgcccgttccgagtcatctgttcttgccctggttcgggatgccatccacaagtggccattgtataaaatccgaatctaaattatgttattttctatttagaaattgagaactagacgcagtgcattattgcatttctgcagcctgcccaacggaagtaattcgagaggagagactctccttggctgggcctccgttttacaaatttctatgcttaatgttgttttatgagtagtaatatgtaccatcgcagtctatctgttgttatgcccttggctggcaaatctatataaa

SEQ ID NO: 2050 - DNA, 678 bp, Triticum aestivum
gcaggtctcaaaaaaaaaaaaggagctccccaggtctagttcaaccaactgctattctttacgagtgttcgcctcacaacgccgttccaattgaccggtcgcctgcctccgcccccttcccgaagtttccgcgctccaccatttcgccatggccggcggcggcatcttcagcagggcgctgagctacgtcgtcaacgagttcctcgtcgagggcctcgccaacaaccgtgccttccagaggtttgctgtgaggaccaacaggactttggaggatctctcttctaaagctaaacaagcgagggaggagatatcggagcaattcaaggatgctcgtggacccaatgatcgcttcaagcagtgatgcccgttccgagtcatctgttcttgccctggttcgggatgccatccacaagtggccattgtataaaatccgaatctaaattatgttattttctatttagaaattgagaactagacgcagtgcattattgcatttctgcagcctgcccaacggaagtaattcgagaggagagactctccttggctgggcctccgttttacaaatttctatgcttaatgttgttttatgagtagtaatatgtaccatcgcagtcgatctgttgttatgcccttggctggcaaatctatataactctggctgcgtcgataaaaaaaaaa

SEQ ID NO: 2051 - DNA, 584 bp, Triticum aestivum
tcgcatcacaacgccgttccaattgaccagtcgcctgcttccgcccccttcgcgaagtttccgcgctccaccatttcgccatggccggcggcggcatcttcagcagggcgctgagctacgtcgtcaacgagttcctcgtcgagggcctcgccaacaaccgtgccttccagaggtttgctgtgaggaccaacaggactttggaggatctctcatctaaagctaaacaagcgagggaggagatatcggagcaatttaaggatgctcgcggacccaatgatcgcttcaagcagtgatacttgccatcagcgttcccggtcatccgttcttgccctggttcgggatgccatccgcaagtggccattgtataaaatccgaatctaaagtatcttattttctatttagaaatctagacgcagtgaattaagtctgcccaagggaactaattctagcggagagactctccttggctggacctcggttttgcaaatttctatgcttgatgttgttttatgagtaatatgtaccatcgcagtctatctgttgttatgccattgcctggcaaatctatataactctggctgcgt

SEQ ID NO: 2052 - DNA, 857 bp, Triticum aestivum
attcttacgagtgtcgcatcgcatcaaaacgccgttccaattgaccagtcgcctgcttccgcccccttcgcgaagtttccgcgctccaccatttcgccatggccggcggcggcatcttcagcagggcgctgagctacgtcgtcaacgagttcctcgtcgagggcctcgccaacaaccgtgccttccagaggtttgctgtgaggaccaacaggactttggaggatctctcatctaaagctaaacaagcgagggaggagatatcggagcaatttaaggatgctcgcggacccaatgatcgcttcaagcagtgatacttgccatcagcgttcccggtcatccgttcttgccctggttcgggatgccatccgcaagtggccattgtataaaatccgaatctaaagtatcttattttctatttagaaatctagacgcagtgaattaagtctgcccaagggaactaattctagcggagagactctccttggctggacctcggttttgcaaatttctatgcttgatgttgttttatgagtaatatgtaccatcgcagtctatctgttgttatgccattgcctggcaaatctatataactctggctgcgttgataacctggaaagattttgacggtcacgttgtcgtttgttcttcttgccacccaggagccactggtgtgcttaagtttgaaaaagaggccatttagggataataatacgaccgctccagtgttcagtgaaagcaacgcgggagtgcctttcatcataaaagaaactgatactcctatgggaacgagaacgatagatttgttccttttacttgcaactggattttcatttttcgttgttcttctcctgtccttc

SEQ ID NO: 2053 - DNA, 546 bp, Triticum aestivum
cagtcgcctgcctccgcccccttcgcgaagtttccgcgctccaccatttcgccatggccggcggcggcatcttcagcagggcgctgagctacgtcgtcaacgagttcctcgtcgagggcctcgccaacaaccgtgccttccagaggtttgctgtgaggaccaacaggactttagaggaactctcatctaaagctaaacaagcgagggaggagatatcggagcaatttaaggatgctcgtggacccaatgatcgcttcaagcagtgatacccagtccagtcctaggcgtccatcaagttgctaactgcacaattctgctatcagcgttcccggtcatctgctcttgtcctggttctggatgccatcggcaagtagccattgtataaaatccgaacctaaattatcttattttctatttagaaattgagagctagatgcagtgcattattgcgtttctgtagcctgcccaatggaactagttctagaggagagactctccttggctgggcctcggttttacaaatttctatgcgtaatgttgttttat

SEQ ID NO: 2054 - DNA, 514 bp, Pseudoroegneria spicata
gcgctgagctacgtcgtcaacgagttcctcgtcgagggcctcgccaacaaccgtgccttccaaaggtttgctgtgaggaccaacaggactttggagaatctctcatccaaagctaaacaagcgagggaggagatatcggagcaatttaaggatgctcgtggacctgatgatcgcttcaagcagtgatacctgctatcagccagcgttcccggtcatctgttcttgtcctggttctggatgccatccgcaagtggccattgtataaaatccgaatctaaattatcttattttctatttagaaattgagaactagacgcagtgcattattgcatttctgtagcctgcccagcggaagtaattcgagaggagagactctccttggctggacctccgttttacaaatttctatgcttaatgttgttttatgagtagtaatatgtaccattgcagtgtatctgttgttatgcctttgcctggcaaatctatataactctgactgcgttgatgaccaaaa

SEQ ID NO: 2055 - DNA, 666 bp, Saccharum officinarum
cccttcccgtctccggaagcttcttccttctccgtcctccccttcgacctccgtcatggctggcggcaacctgttcgggcgggcgctgagctacgttgtcaacgagttcctcgtcgagggcctcgccaacaaccgtgcattccagaggtttgctgtgaagaccaacaggactcttgagaacctatcgtctaaagctaaggaagtgagggaggagttatcagagcaattgaaggaagctcgtggcgagaaagatcacttcaagcagtgaagctcgtccgcacatcgattcaacaagatgatactgacaatcttgcaacgagtttttctagtcctcgtctcggtccctttttatgaatatgacatttgaaggaattcctggatgtcattcaattgatggtgccgctgtatagtcttcagtttctctgcacttagtagacgcggagcacttgatctcctgtcccatgtataatgtatttttaataatatgtacctatgttcattttttttgttgaagtgtgaaatgtagaactgaacaacaattggtagaactatcttaatgcgtgcgttgatctcttgaatatatatgcaagtgaagtgcatccaacaggcatcttttcagaaggcaactgttggtaatagtaatttactccccccaaaagaaaaccg

SEQ ID NO: 2056 - DNA, 776 bp, Pennisetum glaucum
acgtcatcggaatgtccgcggagggtggtgatgtcctcgcctgtttcggcgttccagaccccgccgccttcacctcctcaccgattccggaaccttcctccttcccgtgcgccatggccggcggaaacctgttcgggcgggcgctgagctacgtcgtcaacgagttcctcgtcgagggcctcgccaacaaccgtgcattccagaggtttgctgtgaagaccaacagaactcttgagaacctatcgtctaaagctaaggaagtgagagaggagctatcggagcaactgaaggaagctcgtggcagggatgatcacttcaggcggtgaagctggtttgcacactggaaccaaagatgacgctgaccgtgcaatcttttggtgtagttttactagtacctgtctgggtccttgttattgatgtcattccattgatggagccgttccctcttatcttattttggatgtcactcaattgaaggaacctttgtatagtatagcatgtcttcagtttctatgcaccttgagtatcagaccaagcacagttaatgttcatgtcatttttctcttgtgctgtggaatggaaccacttgtaaccagcattagtgtactgttgataagatcggtgttgtttatatgactttgcatgttgacgttttctcgctggtattgacattgctgtccgtaggatcttcatgtgctgtataaaaatgttacgatcatgttggactctcacttctcagagcctttgtatagaaatgaatctgtgtgaactgcctg

SEQ ID NO: 2057 - DNA, 769 bp, Sorghum bicolor
tcttctatataagtcttggcccagctaaagcctttccattgacccgccgcctctagccctctacgatacgccctttcccgtctccggaagcttcttccttctcgcctccgacctccgtcatggccggcggcaacctgttcgggcgggcgctgagctacgttgtcaacgagttcctcgtcgagggcctcgccaacaaccgtgcattccagaggtttgctgtgaagaccaacaggactcttgagaacctatcgtctaaagctaaggaagtgagggaggaattatccgagcaattgaaggaagctcgtggcgagaaagatcacttcaagcattgaagctggttcacacatcgattcaacaagatgatgctgacaatcttgctactgagtttttctagtcctcgtctgggtccctatttatgaatatgacatctgaaggaatttttggatgtcattcaattgtggaaccgttgtatagtcttcagtttctctgcacttgattagtagacgcggaacactatctcatgtcccatgtataatgcattttaataagatgtacctgtgtttattttttagttaatttagttaaaagtgtgaaatgtagaattgaacaacatcttgtagaactatcttaatgcgtgcggtaaccttgagtatatatgcaagtgaagtggcccatccaaggtgccataggtagtaggtaactgcctaaaaatgttcgtaataactgtaactgaagtagttacctgtggcactgatgagtaatttgaatg

SEQ ID NO: 2058 - DNA, 1116 bp, Secale cereale
cgacccctcctcatcctccggcgatcgccggaaccctctctgccgtcaacccgccgcagccggcgcctcatgcctcctcttaccgcggccgcccgggccaccagcagtggcggcgacgccttcagcgagctggcctctgccgccgacttcgccgccatcgcctctcccgaaggccgcatctccgtcatcggcttcggctcccttctctccgagcggagcgcgaggagcacgttcccggagctggaggggttccgtgtggcggcgctgcgcgggttccggcgcgtcttcgcccactccgcccccatcttcttcgagcgcggcatcgccatcgaggccactaaggagttctcaagcttaagcgtggagtattgtgagggagaaatgataatcgtcactgtgtttgaaatcaaggaggaggaggtgccagcattcatcgagagggagctcgagttcagatttcttgcggtggtccctgaaggcctggatggagctccttttccacatccagctgttgtctgtgcacgctatagcgatgaagagtatttccaagtgagatgcaaaggaagcaaagagatatataatcagcactatggacgatacaacattgataaaatatggagggatgatattttaccctgtcgtctatatctcaggcactgtgttcttgctgccaagaatctgggagaaccagcatatagcaactttgtagaccacacctatctgggtgaccggagaaccacaataagggaatacttggccacgaccggagctggcatcatggaagaggagccaccggagacgctaagaagccgctacggcggctagctcgacgacgacgactctcacggccacagccaccccagatggacattctcacttgtgtgactgctgcctaccaaatcggcagtcgatatgaacagggatgcaccaaataatgcatgatgctccagtgcagaacatccaagattgcgattgttttgggcgcaaattatcggcgccaaacgcggtgatgtatgaccctgatgtgattgatgtacactgattaataaggcaacgattgtgactatttcccgtcataacagagacggatccatacacggaaaatgaggacaaaaa

SEQ ID NO: 2059 - DNA, 590 bp, Secale cereale
cacacacacttaacacatgggatccttgggccctgccgtgagcgtgagcatggccaaggccagcggcggcacggcggccgtcggcggccagcagcagcagcagcagccggagcgcggcacgttcagctgcggcttccggatgccgctgcactacccgcggtacaggaaggcggactacgaggcgatgccggagtggcgcgtcgactgcctgctccgggagtacggcctccccgtcgccggcgacgtcgaggacaagaggaggttcgccatgggcgccttcctctggcccagccagtattgattcaccttcttacatctcgccactaggagccgaggccggtcagcaagccagcgcctggcagagactgatcagcaatggcagcaccagcaacatcacgtacatccccatgtatgaagaagaaagacctcgtgaggatatttatattcttatatctatcatctgatcgtaatctccaattccccatagggaatatatatcatggttcttggagcatatgtatgtaagcagtggaagaaggtgtaatgtcgtgctttgtatgtacgggcgaccttgatccgttttgctctgc

SEQ ID NO: 2060 - DNA, 946 bp, Triticum aestivum
aagggaccaaaagccggagctcccccccggcggcgcccgctctagacctagcggatcccccgggccgcaggaattcggcccgaggcgcagctccagttgcttgcaagttacaaggcgttcagagggggcaaccaaacacacagacagacatgggatccttgggccctgccgtgagcgtgagcatggccaaggccaacggcggcacggctgccgtcggtggccagaagcagcagcagccggagcgcggcacgttcagctgcggcttccggatgccgctgcactacccgcggtacaggaaggcggactacgaggcgatgccggagtggcgcgtcgactgcctgctccgagagtacggcctccctgtcgccggcgacgtcgaggacaagaggaggttcgccatgggcgccttcctctggcccggccagtattgattcgccttcttacatcttgccactcggagcagaggccggtcagcaagctagcgcctagcagagactgatcagcaatggcagcagaaacatcacgtacgtccccatgtatgaagaagactggcgatatatattcttatctactccctccgtaaaaaagtgatctaaacgcttttatatttcttacagagggagtataatctaattgtatctccaattctccatagagaatatatatcatgcttcttgaagtatatgcatgtaagcagtggaagaaggtgttgtttctgaaattcatacgagtaatttagtgtttcctatgtacgtgcgaccttgatcgttttgcacaggctccagggtcctaagaatctgctctcttgtttgaggcgtgtcatctttctgcttgtgtcttcagagtagtcttggttgttgcatgctttctactgctcttacaattgattaccacttcaccggttaccatcacacatttacaattcgtttattgagttatttgcagg

SEQ ID NO: 2061 - DNA, 794 bp, Triticum aestivum
agttacaaggcgttcagagggggcaaccaaacacacagacagacatgggatccttgggccctgccgtgaacgtgagcatggccaaggccagcggcggcacggcggccgtcggcggccagcagcagcagcaggagcgcggcacgttcagctgcggcttccggatgccgctgcactacccgcggtacaggaaggcggactacgaggcgatgccggagtggcgcgtcgactgcctgctccgggagtacggcctccccgtcgccggcgacgtcgaggacaagaggaggttcgccatgggcgccttcctctggcccagccagtactgattcgccttcttacgtcttgccactcggagcagaggccggtcagcaagctagcgccgagcagagactgatcagcaatggcagcagaaagatcacgtacgtccccatgtatgaagatggcgatatatattcttatctactccctccgtaaaaaagtgatctaaacgcttttatatttcttacagagggagtataatctaattgtatctccaattctccatagaaaatatatatcatgcttcttgaagtatatgcatgtaagcagtggaagaaggtgttgtttctgaaattcatacgagtaatttagtgtttcctatgtacgtgcgaccttgatcgttttgcacaggctccagggtcctaagaatctgctctcttgtttgaggcgtgtcatctttctgcttgtgtcttcagagtagtcttggttgttgcatgctttctactgctcttacaattgattaccacttcaccgggttg

SEQ ID NO: 2062 - DNA, 634 bp, Secale cereale
gttgcttggaagttacagggcgttcagaggcagcaaccaaacacgcacacacatgggatccttgggccctgccgtgagcgtgagcatggccaaggccagcggcggcacggcgtccgtcggcggccagcagcagcagccggagcgcagcacgttcagctgcggcttccggatgccgctgcactacccgcggtacaggaaggcggactacgaggcgatgccggagtggcgcgtcgactgcctgctccgggagtacggcctccccgtcgccggcgacgtcgaggacaagaggaggttcgccatgggcgccttcctctggcccagccagtattgatccgccttcttacatctcgccactaggagccgaggccggtcagcaagccagcgcctggcagagactgatcagcaatggcagcagcaacatcacgtacatccccatgtatgaagaagaaagacctcgtgaggatatttatattattatatctatcatctgatcgtaatctccaattccccatagggaatatatatcatggttcttggagcatatgtatgtaagcagtggaagaaggtgtaatgtcgtgctttgtatgtacgggcgaccttgatccgttttgctctgctgttctgcagttccgat

SEQ ID NO: 2063 - DNA, 517 bp, Secale cereale
gttacaaggtgatcagaggcagcaaagaaacacacacatagtgagatgggatccttgggccctgccgtgagcgtgagcatggccaaggccaacggcggcacggctgccgtcggtggccagaagcagcagcagaagccggagcgcggcaggttcagctgcggcttccagatgccgctgcactacccgcggtataggaaagcggactacgaggcgatgccggagtggcgcgtcgactgcctgctccgagagtacggcctccctgtcacgggcgacgtcgaggagaagaggaggttcgccatgggcgccttcctctggcccggccagtattgattcgccctcttacatattgccactcggatcagaggccgatcagcaagctagcgcctaccagagagtcagagactgatcggcaatggcagcagcagcgtcacgtccccatcgtatgaagaagaccttgtgccgatactatattcctatctatcacctaatcgtaatctccaattgtccatagacaaaa

SEQ ID NO: 2064 - DNA, 690 bp, Triticum aestivum
ggggaacgaacacgagttgcttgtaatttacaaggtgatcagaggcagcaaagaacacacacacacacacagagatgggatccttgggccctgccgtgagcgtgagcatggccaaggccaacggcggcacggctgccgtcggtggccagaagcagcagcggaagccggagcgcggcacgttcagctgcggcttccagatgcctctgcactacccgcggtataggaaagcggactacgaggcgatgccggagtggcgcgtcgactgcctgctccgagagtacggcctccctgtcaccggcgacgtcgaggagaagaggaggttcgccatgggcgccttcctctggcccggccagtattgattcgccctcttacatattgccacttggagcagaggccgatcagcgagtgagcgcctagtagagactgatcagcaatggcagcagcaacatcacgtccccatgtatgaagaagacatcgtgtccatattattttatctactctctccgtaaattaatataggagtgtttatatcattaaagtttacggagggcgtatcatctatcataatctccaaccccccatagacaaatacagtataatctccaattctccatagacaaatattttgcttggagcagttctgatgtgcctacgtttacgtgtaagcagtggaagcaacgtgtttttttt

SEQ ID NO: 2065 - DNA, 575 bp, Festuca arundinacea
ggcacgaggcaaccacgagttgcttgcaagttacagagagttcagaggcagcaacgaaccacacgcatgggatccttgggccctgccgtgagcgtcagcatggccaaggccaacggcggcgcggcggccgtcggcggccaggaacagcagcagaagatggagcgcggcatgttcggctgcagcttccggatgccgctgcactacccgcggtacaagaaggcggactacgaggcgatgccggagtggcgcgtcgactgcctgctccgggagtacggcctccccgtcgccggcgacgtcgacgacaagaggcgcttcgccatgggcgccttcctctggcccggccagtactgatcgagcttggtgcaccttaattcccactctgattagaggccgatgagcaagctggcagagactgatcagcaatagcagcagcaacatcacatgcctggccatgtaatgtatgaagacctcgtgtcgatgttatagtcttatctgtcatctaatcgtaaatctccacggagaaaatatgtttcttggactattatatataagcaatggaagaatgtgttgtctct

SEQ ID NO: 2066 - DNA, 309 bp, Triticum aestivum
ctcgcgtgtcaagcagtggtatcaacgcagagactgatcagcagtggcagcagcatcaacatcacgtccccatgtatgaagaagacgagatctcgtgacaatattacatattcttatcgtatcatctaatcgtatctccaatcccccatagagaatatatatcatgtttcttggagtatatgtaagcagtggaagaaggggttgtttctgatattcatacgtgaaatgtagggcttcgtatgtactacgtgtgaccttgatcgttttgctctgaagttctgcacttctgatcgttttgcaaaaaaaaaa

SEQ ID NO: 2067 - DNA, 472 bp, Triticum aestivum
agttacaaggtgatgagaggcagcaagggaaacacaaacacacacacgcacacagagacatgggatccttgggccctgccgtgagcgtgagcatggccaaggccaacggcggcaaggtggccgtcggcggccagaagcagcagcagagcggcacgttcagctgcggcttccagatgccgctgcactacccgcggtacaggaaggcggactacgaggcgatgccggagtggcgcgtcgactgcctgctccgagagtacggcctccctgtcacaggcgacatcgaggaaaagaggaggttcgccatgggcgccttgctctggcccggccagtattgattcaccttgttacatgagtattacatatttccattcggagcagaggccgatcagcaagctaccgcctagcagagactgatcagcaatggcagcagcaacatcacgtctccatgaccatgtatgaagaagacctcgcg

SEQ ID NO: 2068 - DNA, 570 bp, Avena sativa
gttcccacgagtagacagatcgctcagaggcagaagcaaacacgcgcgcacgcatgggatccctgggccctgccgtgagcgtgggcgcgaccaaggccaacggcggcacggcggccataggaggcgcccagcagcttcagcagcagcagcaagccgagcgcggcatgttcagctgcggcttccggatgccgctgcactacccgcggtacaagaaggcggactacgaggcgatgccggagtggcgagtcgactgcctgctccgggagtacggactccccgtcgccggcgacgtcgaccacaagaggcgcttcgccatgggcgccttcctctggcccggccagtactgaccgagctccttacacgccttagttgcccactcgggatcagaggccgatcagcgagctacaccagcaacatcacatgccctgacatgtaatgtatgaagacctcgtgtccatactactatccatctatatctgccatcgaatcgaaatcgccacatagtagaaaagagtgtttcttggactacatatactactgtgcaagcaatgggagatttggtgttgtttc

SEQ ID NO: 2069 - DNA, 623 bp, Secale cereale
gttacaaggtgatcagaggcagcaaagaaacacacacatagtgagatgggatccttgggccctgccgtgagcgtgagcatggccaaggccaacggcggcacggctgccgtcggtggccagaagcagcagcagaagccggagcgcggtacgttcagctgcggcttccagatgcctctgcactacccgcggtataggaaagcggactacgaggcgatgccggagtggcgcgttgactgcctgctccgagagtacggcctccctgtcacgggcgacttcgaggagaagaggaggttcgccatggggcgccttcctctggcccggcagtattgattcgccctcctacatattgccactcggatcagaggccgatcagcaacctagcgcctagcagagagtccgagactgatcagcaatggcagcagcagcctcacgtccccttgtatgaagaagacctcgtgccgatattatattcctatctatcacctaatcgtaatctccaattgtccatagacaaaaatacaagtttcttggagaagttccgatgttcttacgtgtaagcagtacacgaagtaggtctgtaggtgttgtttctgagttcatacgtgtaatataatgctttctgt

SEQ ID NO: 2070 - DNA, 585 bp, Avena sativa
caagccacaaacacgcagatcgttcagaggcagaagcaaacacgcacgcacgcatgggatccctgggccctgccgtgagcgtggccaaggccaacggcggcggcgcggcggccgtaggaggcgtccagcagcttcagcagcagcagcaagccgagcgcggcatgttcagctgcggcttccggatgccgctgcactacccgcggtacaagaaggcggactacgaggccatgccggagtggcgcgtggactgcctgctccgggagtacggactccccgtcgccggcgacgtcgaccacaagcggcgcttcgccatgggcgccttcctctggccaggccagtactgatcgagctccttacacgccttagagttgccactcgggatcagaagccgacgatcagcaagctagcagagactcaccagcgattgcagcagcaaacatcagatgccctgccatgtaatgtatgaagacctcgtgtccatattatattcttatatatccatctatatatatcatcgaatcgaaatagccacatagaaaagagtgtttcttggactatatatatatatatatactgtaatacaag

SEQ ID NO: 2071 - DNA, 685 bp, Hordeum vulgare
cgcaaattgatcagaggcagcaaggaaacacacacccacacccacacacacacacacacacacatgggatccttgggccctgccgtgagcgtgaggatggccaaggccaacggcggccagaagcagcagcaaaagcaggagcgcggcacgttcagctgcggcttccagatgccgctgcactacccgcggtataggaaggcggactacgaggcgatgccagagtggcgcgtcgactgcctgctccgagagtacggcctccccgtcgccggtgacatcgaggagaagaggaggttcgccatgggcgcgttcctctggcccggtcagtattgaactattgattcactttgttacgtattgccactcggagcagaggccgatcagcaagctagcgcctagcactcgcagagagccactgactgatcagcaatggcagcagctgcatcacgtcatgaagaagacctcgtgccgatacgatattcctatctatcacctaatcgtaatctccagttgtccatagacaaaatatgtttcttggagcagttctgatgctcttacgtgtaagcagtactgaagatggtgttgtttctgatgttcatacatgtaatgtaatgctttctatgtacgtccgacgtttatcgttttgctctgcagttctgagctttgtttgaggcgtgtcttctttctg

SEQ ID NO: 2072 - DNA, 939 bp, Hordeum vulgare
ccggcgaggacggaacacgctgtcgtcggaatttattgctctacttgattgcacgagctcggtcattcgcatcacctgcagttcatttctttcagattatgtggttggctggagttaccactctggtcaggcaagacggtggattattactcctctatctcgcaccacctataaaacccttccatcagttggcacttccttctcaacaacacgagttgcttgtaagtcgcaaattgatcagaggcagcaaggaaacacacacccacacccacacacacacacacacacatgggatccttgggccctgccgtgagcgtgaggatggccaaggccaacggcggccagaagcagcagcaaaagcaggagcgcggcacgttcagctgcggcttccagatgccgctgcactacccgcggtataggaaggcggactacgaggcgatgccagagtggcgcgtcgactgcctgctccgagagtacggcctccccgtcgccggtgacatcgaggagaagaggaggttcgccatgggcgcgttcctctggcccggtcagtattgaactattgattcactttgttacgtattgccactcggagcagaggccgatcagcaagctagcgcctagcactcgcagagagccactgactgatcagcaatggcagcagctgcatcacgtcatgaagaagacctcgtgccgatacgatattcctatctatcacctaatcgtaatctccagttgtccatagacaaaatatgtttcttggagcagttctgatgctcttacgtgtaagcagtactgaagatggtgttgtttctgatgttcgtacatgtaatgtaatgctttctatgtacgtccgacgtttatcgttttgctctgcagttctgagctttgtttgaggcgtgtcttctttctgcgtgtgtcttcagaaagtctcaactgtcg

SEQ ID NO: 2073 - DNA, 506 bp, Avena sativa
cacacacgcatgggatccttggggcctgccgtgagcatgagcatggcgaaggccaaggtcaacggcggcactgcggccgtcgctggccagcagcaagccgagcgcggcatgtccagctgcagcttccagatgccgctgcactacccgcggtacaagaaagcggactacgaggcgatgccagagtggcgcctcgacggcctgctccgggagtacggcctccccctcgccggcgacttcgaccacaagaggcgattcgccatgggcgccttcctctggcctggccagtactgatcgagcttcgtgcaccccgcacggatcagaggccgaccacgaccagcatcaacaacgtcacatgccggtacatgtaatgtataatgacctcgtgtcaatggaagatttggagttcttacgtgtctgcgactctgcgtacgccttaaaatgttgcaagatttggagtttggactgctcttgcaattgcaattgattgccacctttacctatttacc

SEQ ID NO: 2074 - DNA, 2005 bp, Triticum aestivum
cccacgcgtgccggatcagttctagatcgcgagcgcccgcccgtctccgcctccatgcagcaccgctcgccggcggcggccacggcctccggagctgcctccactgcggccgccatggagccaggcgtcggcggcgtcgagcctgcggtgacgctcgaccaggtgccgcgctggagcgaccccgaccagcgcctgtacacgccgtcctcctcgtccgctaccgccgaagccgcggacggcggatccgagcccgcagcgtccaccttcctctccttctccgacccgctcaccggcgacgacggcggcgccgccggtggtggctgcgcgagcgcctcgcgcttgcccgtggaccacgagatcaactccaggatctacctctggcggggacacccctggaacatggaggtcgacgccgtcgtcaactccaccaacgagagcttggacgaggcgcacagtagtcccgggcttcacgctgcagcgggttctgggctcgcggaggaatgcgccaccttgggagggtgccgaactgggatggcaaagatgaccaatgcatacgatcttcctgcgaggaaggtcatccatacagtgggacccaaatatgctgtcaaatatcacacagctgcggaaaatgcacttagtcattgctaccggtcatgtttggaactactcattgagaacggccttgaaagcatcgcaatgggttgcatatacacggaagctaaaaactatcctcgtgaaacagctgcccatgtggcaatacggactgttagacgttttctggagaaacagaaaggcaagatagctggtcttattttttgtattacatcatcatctgatacagagatatacaaaagattgcttccgctatatttccctcgggacaagcaagaggaagagactgcggtatcaaaacttccagctgatgtcggggatgagaatggtgaaactgtaatagatgaaaggaaaataagaataagaccattgcctgctggtgcagcagatagaacagtggctacagctcctcttgatcttcctcttgagtctggattggcatcaaggagtacattcaaactggattcatatttggacccttcatttatgtcattaattaaagacccggatctgcggcgcaaggagcagtgggaaaaatcttctcaagctcaaaagggatttaattatgctaggttgcttggatatggtgatataggtttccctccattgtctgctgctgaggaatattcacttcattcacgataccttgcgaaagcaaattcccttaatctttcagagattgctgagatgaaaataatttatcgtggcggagttgatagtgaagggcgcccagttatggttgttgttggtgcgcactttcttctccgctgcctggatcttgaacggtttgttctacatgtagtgaaggagtttgaacctttgattcagaagccatatactattgtctatctccactcggcagcatcattacaaccgcaaccagatttaggattcatgaaacggatacaacaaatattaggtcggaaacaccagcgaaaccttcatgggatttatatactccacccaaccttggggttgagaacagctattctggggatgcagcttttgattgatggagaggtatggaagaaagttgtgtatgttgacaggctggtgcaattgttcagatatgtaccacgcgaacaattaactatcccagattttgtatttcagcatgatttggaggtgaatggtggtaggggcatgattgtggacccaagaacaaaacatatctatcagagaccatctggctgattcatgtcatttatgcagtccaaagctcatacttgttgcttgtgcaagtctttgtataattactcctttgttgatatttctcgttttcctttgtatcgaatttaggtgttctattcctttcattcgttcctcagccttcagggaaggggattattgtttgtatatgttaatttctacagctgaataaaagtggcgtctc

SEQ ID NO: 2075 - DNA, 1976 bp, Secale cereale
gactgcgccaggcgtcagctgcgtcgagcctgcggtgacgctcgaccaggtgccgcgctggagcgaccccgaccagcgcctgtacacaccgtcctcctcgcccgccgccgctgaagccgcggacggcggatccgagcccgcagcgtcctcgttcctttccttctccgacccgctcacgggcgacgacggcggcgccgccggtggtggctgcgcgggcgcctcgcgcttccccgtggaccacgagatcaactccaggatctacctctggcggggacacccctggaacatggaggtcgacgccgtcgtcaactccaccaacgagagcttggacgaggcacacagtagtcctgggctgcacgctgcagcaggttcagggctcgccgaggaatgcgccaccttgggagggtgccgaactgggatggcaaagatgaccaatgcatacgatcttcctgcgaggaaggtcatccatacagtgggacccaaatatgctgtcaagtatcacacagctgcagaaaatgcacttagccattgctaccggtcatgtttggagctactcattgagaacggccttgaaagcatcgcaatgggttgcatatacacggaagctaaaaactatcctcgtgaaccagctgcccatgtggcaataaggactgttagacgttttctggagaaacagaaaggcaagatagctggtgttattttttgtattacatcatcatctgatacagagatatacaaaagattgcttccactatatttccctcgggacaagcaagaggaagagactgcggtatcaaaacttccagctgatgtcggggatgagaatggtgaaactgtaatagatgaaaggaaaataagaataagaccattgcctgctggtgcagcagatagaacagtggctacagctcctcttgatcttcctcttgagtctggattggcatcaaggagtacattcaaactggattcatatttggacccttcatttatgtcattaattaaagacccggatctgcggcgcaaggagcagtgggaaaaatcttctcaagctcaaaagggatttaattatgctaggttgcttggatatggtgatataggtttccctccattgtctgctgccgaggaatattcacttcattcacgatatcttgcgaaagcaaattcccttaatctttcagagattgctgagatgaaaataatttatcgtggcggagttgatagtgaagggcgcccagttatggttgttgttggtgcgcactttcttcttcgctgcctggatcttgaacggtttgttctacatgtagtcaaggagtttgaacctttgattcagaagccatatactattgtctatctccactcggcagcatcattacaaccgcaaccagatttaggattcatgaaacgggtacaacaaatattaggccggaaacaccagcgaaaccttcatgggatttatatactccacccaaccttggggttgagaacagctattctggggatgcagcttttgattgatggagaggtatggaagaaagtagtgtatgttgacaggctggtgcaactgttcagatatgtaccacgcgaacaattaactatcccagattttgtatttcagcatgatttggaggtgaatggtggtaggggcatgattgtggacccaagaacaaaacatatctaccagagaccatctggctaattcatgtcatttatgcagtccaaagctcatacttcttgcttttgcaagtctttgtataattactccttaaagatatttctctttttcctttgtatctaatttaggtgttctattcctttcattcgttccccagccttcagggaaggggattattgtttgtatatgttaatttctacagctgaataaaagtggcgtctcagtactctacaaaaaaaaaaaaaaaaaacaaaaaaaaaaaaacaaaaactagacatacacgagacacagaggagagccccccccc

SEQ ID NO: 2076 - DNA, 2801 bp, Brachypodium distachyon
tgacgtggtccggcccacacgttcacggaccccacgagtcattgtccagatgatgcttctgttgttccctcgtgggctcgatcgatctcctcctccgcctcccttccggctcgtgtccgcctcctcttaacggccgcttggccgctcacgcacaccagcgccaccgctaccttccgcctccatgcagcaccgctcgccggcggcggccatggactccggcaccggccccgcgtccaccatggcgcccggcttgggcggcgtcgagccggcggtgacgctcgaccaggtgccgcgctggagcgaccccgaccagcgcctctacacgccttcctcctcatccgccgccgctgaggctgcggacggcggatccgagcccgccccgtccgccttcctctcattctccgacccgctcaccggcgacgacggcggcgccgccggcggtggccacgccgccgcctcgcgcttccccgtcgaccatgagatcaactccaggatctacctctggcgtggtcacccctggaaccttgaggtcgacgccgtcgtcaactccaccaacgagagcttggacgaagcgcacagtagtcctgggctgcacgctgcagcaggttcagggctcgcggaggaatgcaccaccttgggcgggtgccgaactggaatggcaaagatgaccaatgcatatgatcttcctgcaaggaaggtcatccatacagtgggccccaaatatgctgtcaagtatcatacagctgcggagaatgcacttagtcactgttatcggtcatgtttggaactactcattgagaatggccttgaaagcattgcaatgggttgcatatacacggaagctaaaaattatcctcgtgaaccagctgcccatgtggcaataaggactgttaggcgtttcctagagaaacaaaaaagcaagatagcaggtgttgttttttgtactacatcatcatctgatactgagatatacaaacgattgctcccactatatttccctcgagacaagcaggaggaagagattgcgatatcaaaacttccagctgatgtcggggatgagaatggtgaaactgtaatagacgaaaggaaaataagaataatgcctttgcctgctggtgtgacagatagaatagtagctacagctcctcttgctcttcctcttgattctgcaatggcatcaaagaggggttctttcaagttggattcgtatttggatccttcatttatgtcattaattaaagacccagatctgcggcgtaaggagcagtgggaaaaatcttctcaagcccaaaaaggatttaattatgctaggttacttggatatggtgatctgggtttcccttcattgtcggctgctgaagaatattcacttcattcacgataccttgctaaagcaaattctcttaatctttccgagattgctgaaatgaaaataatatatcgtggtggagttgatagtgaagggcgcccagttatggttgttgttggtgcgcactttcttcttcgatgcctggatcttgaacgatttgttctacatgtagtgaaggagtttgaacctttgattcagaagccatatacaattgtctatctccactctgcagcatcactgcaaccgcaaccagatttaggattcatgaaacggatacaacaaatattaggtcggaaacaccagcgaaaccttcatggaatatacattctccacccaacattggggttgagaacagctattttggcaatgcagcttttggttgatggagaggtctggaagaaagttgtatatgtcgatagacttgtgcagctcttcagatacgtaccacgcgaacaactaacagttccagattttgtctttcagcatgatttggaggtgaatggtgggaggggcctaattgtggacccaagaacgaaacatatctatcagagaccatctgggtgattcatggcgtttctgttgtccaaagctcattgttcttgctttttcaatacaatttacaagtccccgtattagtacttgttgttcatatttcctttttgtatgtagtataggcgttctattcctttcattcgtttctcaaccttctgggagaggagtttttgtttgtatatgttgatttgtacaaaccaaataaaagtgtcagtatcagtgcaatcctgaccaacaatccatgttccacccagattggtctgctctgatgttcaagttctgctctgatgttcaaagcttccagtgggacacagcagttcgatgttttggaagatacaacataaaattaaggtgctaacaaaacagcagcaaaaaacttagtgagatattatacgttcgctgagcacaaggttcagacaagaggttgccagaaatagagatagatagaaaacagttgcagactcatggcaatgcggtcgacaatagtggagccctttgttgcgttgaacagattgtcaaacaggagaccatgtatcttgtgggttagcagtcctgactacccaaacaaactagcttactgattttttacacacacccagctctcggtggggcagcacgattctactcactaaaaaatcagtaagctaagccccaccgagagctggctgcattttagtgcatgcgcgcttctgttaatgagaagacaaaatgaatggaatggcatagagaattattgttcctctgtttttcatttcatcaactagatatctctcaatgcgtgtgcatggttaatattaggatacaaccgtttcaatgcattgtctcctattgttatactatctaaaatctaaaatagttgttatttaatagatttgtgtga

SEQ ID NO: 2077 - DNA, 2305 bp, Oryza sativa
ctagttgagagattacggtgtttatctctctcctccgcctcgcttctcgcgtccatctcttaacggccgcttgacctctcccggctcaacgccgccaccgccgccgccgccgtctaatctccgccgccatgcagcaccgctcgccggcggcggccacggcgtcgtcggggccggtcgccgccgcggcctccgccgccatggcggtgccgggcgtgggcggcatcgagccggccgtgacgctcgaccaggtgccccgatggagcgaccccgaccagcgcctgtacgcgccttcgtcctcctccgccgcggccgccggaggtgtggaggcgggcgagggtggcggatccgagcccgccgcgtccgcgttcctctcgttctccgaccccctcaccggcgacgacggcggcggggtcaccggcggcggccgcggcggggcctcgaggttccccgtcgaccacgagatcaactccaggatctacctctggaggggccacccctggaacctggaggtcgacgctgtcgtcaactccactaacgagagcttggacgagtcgcacagcagtcctggtctgcacgccgcggcaggatcggggctcgcggaggaatgctccaccttgggaggatgccgaactgggatggcgaagatgaccaatgcttatgatctgcctgcaaggaaggtcattcatacagtcggccccaaatatgctgtcaagtatcacacagctgcagagaatgcacttagtcactgctaccgttcttgtttggaactcctcattgaaaatggccttgaaagcattgcaatgggctgcatttacacggaagctaaaaactaccctcgtgagccagctgcccatgtggcgataagaactgttagacgctttctggagaaacaaaaaagcaaaattgctggtgttgttttttgtactgtatcatcatctgatacagagatatacaagagattgctcccactatatttccctcgggacaggcaagaggaagagattgcggtatcaaaacttccagccgatgttggggatgagaatggtgaaacagtaattgatgaaaggaaaataagaataagacctttgcctgctggtgcaacagacagagctgcaactactgctcctatagatcttccttttgattctggattggcatcgaagaggagttctttcaagttggattcatatctggatccttcatttatgtcattaattaaagacccagatctgaggcgcaaggagcagtgggaaaaatctgctcaagctcaaaagggatttaattatgctaagttgcttggatatggagatctagcttgcccttcattatccgccgcagaggaatattcacttcattcaagataccttgctaaagcaaattctcttaatctttcagagattgctgaaatgaaaataatttatcgaggtggagttgacagtgaaggacgcccggttatggttgttgttggtgcacactttcttcttcgctgcttggatcttgaacggtttgttctacatgtagtaaaggagtttgaacctttgattcagaagccatatagcattgtctatttccattctgctgcatcattacaaccgcaaccagatttaggattcatgaagcgcctacaacaaatattgggtcgtaaacatcagcgcaaccttcatgccatatatgtcctccacccaacgttgggtttgagaacagctattctggcaatgcagatgtttgttgatggagaggtttggaagaaagttgtctacgtggataggcttgtgcatctgttcagatatgtaccacgcgaacaactaactattcctgattttgtctttcagcatgatttggaggtgaacggtgggagaggcctaattgttgacccaagaacaaaacacatttatcagagaccgtctggctgatgtagatatttctgcggtccaaagctctcattagtccttacctcactgtgccttctgatcttccctgtaccagtattccttgttaatgtttccttttgcatttgcatctagttaatgcgttttattccattcttttgttcctcgacctttttgggaaggaaagttctgtctgtatatgttcattttgtacaaccaaataaaggtggtgtctcagtgttattgtagaacagttcaagtttcaccaagcaggttaattgtgaatgtcatcctgtattatcatcagaattgggtactataggaacttgttatatcttctacacataaaacgactgaacagtttgacttcgttgtacactttcagttagtttcgtttgtgcagagaaacacctagc

SEQ ID NO: 2078 - DNA, 2158 bp, Setaria italica
ctcctcgcgtcgcgtccaccgctggcttaacggcctgcctgaccactcctcctcctccccgccgccgcttccgcctccacgcctacccgctgctgatcgcgtgtccaccccgcctccgtccccatgctgccgcgctcgccgccgtccgccgcggcgggcgccatggtgcccggcgttggcggcgtcgaaccggccgtgacgctggaccgggtgccgcgctggagcgaccccgaccagcgcatcttcccctcggcctccgacgaaacctcctccgcggagggcggcggatccgagccgcccgtcgcgtccggcttcctctccttctccgacccgctcaccggcgacggcgccggcggcggtggccgcggcggcgcctcgcggttccccgtcgaccaggagatcaactccaggatctacctgtggcgagggcacccctggaacctcgaggtcgacgccgtcgtcaattccaccaacgagagcttggacgaggcgcacagtagtcctggcctgcacgctgcagcagggtcagggctcgcggaggaatgcgccaccttgggcgggtgccggacagggatggcaaagatgactaatgcctatgatcttcctgcaaggaaggttatccatactgtgggccccaaatatgctgtcaagtatcacacagctgccgagaatgcacttagtcactgttaccggtcctgtttggaactgcttattgagaatggtcttgaaagcatcgcaatgggttgcatatacacagaagctaaaaactaccctcgtgaaccagctgctcatgtggcaataagaactgttagacgttttctggagaagcaaaaaggcaatatagctggtgttgtgttttgtactacatcttcatctgacacagagatatacaaacgattgctccctctatatttccctcgggacaagcaggaggaagaaattgcggtatcaaaactcccagctgatgtcggggatgagaatggtgaaacagtaattgatgaaaggaaaataagaataagacctttgcctgctggtgtggtagacagaacagtgactgcagcacctatagatcttcctctttctgattctggatcggcattgaagagggcttctttcaaattggattcatatttggatccttcgtttatgtcaataattaaagatccagatctgcggcgcagggagcagtgggaaaagtctgctcaagctcaaaaggggtttaattatgctaggttacttggatatggtgatcttggttgtccttcattatctgcagcagaggaatattcacttcattcacgataccttgctaaagcgaattctctgaatctttcagagattgctgaaatgaaaataatctatcgtggtggagttgatattgaaggacgcccggttatggtggttgttggtgcgcactttcttcttcgttgccttgatcttgaacggtttgttctgcatgtagtgaaggagtttgaacctttgattcagaagccatatacaattgtatacttgcactctgcagcatcattacaaccgcaaccagatttaggattcatgaagcgattacaacaaatacttggacggaaacatcagcgcaaccttcatgcgatttatgttctccacccaacattgggattgagaacagctgttttggcaatgcagatgtttgtagatggagaggtctggaagaaagttgtatatgtggataggcttgttcagctgttcagatacgtaccacgcgagcaacttacaattcccgattttgtctttcagcatgatctggaggtgaatggcgggaagggcctaatcgttgacccaagaactaagcacatttatcagagggcgtccagttcatgatggtaacagttctgaggaccaaagttcattagttcttgcactgtaccattctgatgtttgcttcttgtaactttattccatgttgatgtttctttctgtatctagttaagttggtctattccattcgttcgttcttctgccttcccatctgtatatgttgatttgtataactgaataaaagtggtctctagtctagatgatcaattttcactcagcctgtacaaaatttggccacctgaaatagaagtttatttcaatgcttcaccatttatatttcatttctgcacataagtactgattc

SEQ ID NO: 2079 - DNA, 2526 bp, Sorghum bicolor
cctctctctctctctctctccgtgcgtgtgcgggtgccggtgcgtgctcctctcttcttctatctcctcgcgagccccgctggcttaacggcctgatctcccagccgccgcttccgcctccgacggcctatcgcgtcccacccaccggcctccatctccatgcagccgcgctctccggcggtggcggaggccgccggcgccggcgccaccatggtgcccggcgtgggcggggtcgagccggccgtcacgctggaccaggtgccgcgctggagcgacccggaccagcgcatcttcctcgcctccgcgtccgacgaggcgtccgcggagggcgccggatccgaggcgacctccgcgtccggcttcatctccttctccgacccgctcacggtcgacgacgacgacggcgccggtgcgggtggccgcgccggggccgcctcgcgctttcccgtcgaccaggagatcaactccaggatctacctctggcgtggccagccctggaacctcgaggtcgacgccgtcgtcaattccactaacgagagcttggacgaggcgcacagtagtcccgggctgcacgctgctgctgggtcagggctcgccgaagagtgcgccaccttgggaggttgccgaactgggatggccaagatgaccaatggctacgatctgcctgcaaggaaggtcatccatactgtgggccctaaatatgctgtcaagtatcacacagctgcagagaatgcacttagtcactgctatcgatcctgcttggaactgctcattgagaatggtcttgaaagcatcgcaatgggttgtatatacacagaagctaaaaactaccctcgtgaaccagcttctcatgtggcaataagaactgttagacgttttctggagaagcaaaaaggcaaaatagctggtgttgttttttgtactacatcatcatctgatacagagatatacaaacgattgctcccactatatttccctcgggacaagcaggaggaagagattgcgatattaaagctcccagctgatgttggggatgagaatggtgagacggtaatagacgaaaggaaaataagaataagacctttgcctgctggtgtggtagacagaacagtgtctgcaactcttgttgatcttcctctttctgattctggatcggcattgaaaaggggttctttcaagttggattcatatttggatccttcgtttatgtcaataattaaagatccagatctgcggcgcaaggagcagtgggaaaaatccgctcaagctcaaaagggatttaattatgctaggttacttggatatggggatctaggttgcccttcattatcttcagcagaggaatactcacttcattcacgatacctcgctaaagcaaattctcttaatctttctgagattgctgaaatgaaaataatttatcgtggtggagttgatattgaagggcgcccggttatggttgttgttggtgcacactttcttcttcgatgccttgatcttgaacgatttgttctacatgtagtgaaggagttcgaacctttgattcagaagccatatacaattgtatatttccactccgcagcatcattacaaccgcaaccagatttaggattcatgaagcggttacaacaaatactagggcggaaacatcagcgcaaccttcatgcaatttatgtactccacccaacattgggtttgagaacagctgttttggcaatgcagatgtttgtagatggagaggtctggaagaaagttgtatacgtggataggcttgtgcagctgttcagatatgtaccacgcgagcaacttacaattcctgactttgtctttcagcacgatctggaggtgaatggtgggaggggcctaattgttgacccaagaacaaagcacatttatcagaggacgtccagttgatatgtgctggttctgaggcctgaagtttgttagttcttgcactgtaccattctaatgttcattcttgtaactgtattccatgtatttctttctgtatctagttaagttagtttattccattcgttcattctcctgccttccgcaaggggattctcatctgtatctgttgatatgtagaactgaataaaagtggtgtttactctagatgtttgtgttttgcttatcctgtacaaattttggcagttgatatgttcaagtttatttcaaagtttcatcccttctatttttttttctgcgtataagttctgaatcatgatttttccaagtgatacctaactggcattaaataatggtcttgtttgagtgcttgaacttcagcttacagaacaacagaaaacttcggaaagtacaagccaccccagtaccgaagagttgaagcttctctcaacaggcttctcagctaaagttaaatcctaaagtatggatatttcatgacaaggtaatttttcttagtcatccaaaatgtatttggtttgttacgctgttgtggagactaggcattttgggttcacaattagttcaaataaaaaagggaatggaaaattgcaaaat

SEQ ID NO: 2080 - DNA, 2627 bp, Zea mays
gtcatgaacgtcaagcacattaattcgtcctctctccgctgcccctcctatctcctcgcgagcaccgctggcctcgcttaacggcctgatctcccagccgccgcttccgcctcgcgtcccaccggtctccatctacatgcagccgcgctcgccaccgccgtcggaggcgcctgcgccctccgacgccatcatgatgcccggcgtgggcggcgtggagccggccgtcacgttgggccaggtgccgcgctggagcgaccccgaccagcgcatcttcctcgcctccacgtccgaagaggcgtccgcggaggacgacggatccggcacgacctctgcgtctggcttcatctctttctccgacccgctcacggtcgacgacggcgccgtcgggggtggccacgccgggggtgcctcgcgcttccccgtcgaccaggagatcaactctaggatctatctctggcgtggccagccctggaacctcgaggtcgacgcggtcgtcaattctaccaacgagagcttggacgaggcgcacagtagcccggggttgcatgctgctgccgggtcagggctcgccgaggagtgcgccaccttgggaggttgccgaactgggatggccaagatgaccaatgcctacgatctgcctgcaaggaaggtcatccataccgtgggccccaaatatgctgtcaagtatcacacagctgcagagaatgcacttagtcactgctatcggtcctgcttggaactgctcattgagaatggtcttgaaagcatcgcaatgggttgtatatacacagaagctaaaaactaccctcgtgaaccagctgctcatgtggcaataagaactgttagacgtttcctggagaagcaaaaagacaaaatagctggtgttgttttttgtactacatcatcatctgacacagagatatacaaacgattgctcccactatatttccctcgggacaagcaggaggaatatattgcgatagtaaagctcccagctgatgttggggatgagaatggtgagacggcaatagatgaaaggaaaataagaataagacctttgcctgctggtgtgctagacagaacagtgtctgcaaatcttgttgatcttcctctttccaattctggatcggcattgaagaggggttctttcaagttggattcatacttggatccttcatttatgtcaataattaaagatccagatctgcggcgcaaggagcagtgggaaaaatccgctcaagctcaaaagggatttaattatgctaggttatttggatatggggatctaggttgcccttcattatctgcagcagaggaatactcacttcattcacgatacctcactaaagcaaattctcttaatctttcagagattgctgaaatgaaaataatttatcgtggtggagttgatattgaaggacgcccggttatggtggttgttggtgcacactttcttcttcgatgccttgaccttgaacggtttgttcttcatgtagtgaaggagtttgaacctttgattcagaagccatatacaattgtatatttccactccgcagcatcattacaaccgcaaccagatttaggatttatgaagcggttacaacaaatactaggacggaaacatcagcgcaaccttcatgcaatttatgtactccacccaacgttgggtttgagaacagctgttttggcaatgcaaatgtttgtagatggagaggtctggaagaaagttgtatatgtggataggcttgtgcagctgttcagatatgtaccacgcgagcaacttacaattcctgactttgtttttcagcacgatctggaggtgaatggtgggaggggcctaattgtagacccaagaacaaagcacatataccagaggacgtccagttgatatatgccagttctgaggcctgaagtttgttagttcttgcactgtaccattctaatgttcacttgtaatttattccacgtgttcatttctgtacctagttaagttagtctattccattcgttcgttctcctgccttgtgcaagggggatttctcatctgtatctgttgatatgtagaactgaattaaaactggtgtctactctagatgttgttcaaacttcacttgtcctgtacaaattttggcagttgatatgttcaactttatttcaagtttcattccttctattgtattttccgcaaataacttctgaatcatgattttgtaagtgatccataactgacatcaaataatggtcttgttttagtgcttgagcttacaaaacaacaaaaaactttggaaagtacaagtcaccctgggactgaagagttgaagctcctgtcaactggcttctcaacctagttccgcaaagttgaatcctcaaagcttgcacattttattgcagggtaaattttcttgtatattgtttctaagcaaataatttctgttgtgcaggctaagcattttggattcacatttatatttcaataaaaaacaaaaagaatgtaaaaatgcacaatataaaaacaagaggtcaatgggcatctctcatgcgcatccaagggaatctagaacttgagatgaacttgagatgctttgattctccaatttaagataggtatataaacaatcagtgtattc

SEQ ID NO: 2081 - DNA, 2322 bp, Setaria italica
tccttcgtctacataatttctacagacagcaacaattattggggcatttaattattcccttaattctaatctcctttctctctcctccctcgcctcgtcgattcgatcccccaaagcttctcccacaccagtcacctccgcctcctcccgcttcgcgcgcgaacgcatctccctctcgcgctcagtaatccccatgacctcgcgtttctgatccggccacagccatgcagcaccgctcgccgtcggcggcgtcggcctccgcctccccgacggcttcgtcggcggcggcgtcccccatggcgccgggcgtcggcggggtggagccggccgtgacgctcgaccaggtcccgcgctggagcgaccccgaccagcgcatctccccgctctcccccacctccgccggatccgagaccccaccctcgtccttcctctccttctccgacccgctcaccggcgacgacgcggccgcggggcccgggggccgcggcgcgtcgcggttcccagtcgatcacgagatcaactcgaagatctacctctggaggggccacccgtggaacctagaggtcgatgccgttgtcaactccaccaacgagaacttggacgaggctcatagtagccctgggcttcacgctgctgcaggaccaggactcgccgaggagtgcgctacattgggtggctgccgcactgggatggctaagatgaccaatgcttatgatctgcctgccaggaaggtcatccacactgtgggccctaaatatgctgtaaagtatcacacagctgcagagaacgcgcttagccactgctacagatcttgtttggaactgctcattgagaacggccttgacagcattgcaactggttgcatatacacggaagccaagaattaccctcgtgaaccagctgctcatgtggcaattagaaccgtgagacgttttctggagaagcaaaaggacaaaataagagctattgtcttttgtacaacatcatcatctgacacagagatatataagagattgcttccactgtatttccctcgggataagcatgaagaagagatagccgcattgaaacttccagctgatgttggggatgagaatggtgagacagtaatagatgaaaggaaaataagaataaaacctttgcctgctggggcagcaaatagcaaaacaccaattcctacacttgcggatatccctcttcccgattctggattgacacgtagaaggaactctttcaagttggactcatatttggatcctgcctttatgtcaataattaaagatcctgatctccgacgcaaggagcaatgggaaaaatctgctcaggcaaacaagggaattaactttgctaacttgctcgggtttggtgatcttggcagccctccattatctgctgctgaagaatattcgcttcattcacgataccttgctaaagcaaattctatgaatctttcagatattgctgaaatgaaaataatttaccgtggaggagttgatagtgaagggcgcccagttatggttgttgttggtgctcactttcttcttcgctgcttggatcttgaacgatttgttctatatgtagtaaaggagtttgaacctttgattcaaaagccttactcaattgtctatttacactctgcagcatccctgcaaccacaacctgatttaggattcatgaaacgcttacagcaaatactaggccggaagcatcaaagaaatcttcatgctatatatgtactccacccaacactgggattgagaacggctattttggcgatgcaactttttgttgacggagaggtctggaagaaaacggtatacatcgacagacttgtgcagctgttcagatatgtaccacgtgaacaactaacgatccccgattttgtctttcagcatgaccttgaagtgaatggtggaaagggcataattgtagatccaagaacaaagcatgtctaccagaggccatctggttgatctgccatgggcttgctaatgagcggttcacaccttcgcataccactctgtacaacctatctgtcctctgtagaagtattcccttctagaactgtccattttgtatctagttgagttgacattattgctctgtgctattccttttcctttagggaggcgtaattatgtatgtcaattattctgtataaacaaataagggatgtatctatatgtctcttaagtttctctagagctcggtgtactctttgggtactgtaaaattttgacaggtccataggtattgagaaataagacgtttgttctgtctcacagaaatgaatcaacacgttgggatggtttgttaggcgtc

SEQ ID NO: 2082 - DNA, 2246 bp, Zea mays
ttttttttgtgtaggtcactttaattttaaattattttttggaccaagacgctacttgaatctacaatttctgcagacaggaacaattattgagaaatttaattgtactcatctatctaatctactttctctctcctcccccgtcccgtcgcttcgatcccccgagcttcgctcacaccggtcacctccgcctcctcccgcttcgcgcgcatctccttctatcgctccagcctccagcacacgtcctccatgccctcgcggttctgatccggccatagccatgcagcaccgctcgccggaggcggcttcggcatccgcctccccgacggccgcggcggtggaggccatggcgccgggcgtcggcggggttgagccggccgtgacgctcgaccaggttccgcgctggagcgacccggaccagcgcatctccctgctgtcccccaccgccgccggatccgagaccccggcctcgtccttcctctccttctccgacccgctcaccggcgacgacgcggccgcgggggccgggggccgtggcgcgtcgcggttccccgtcgattacgagatcaactcgaagatctacctctggcgaggccatccgtggaacctcgaggtcgacgccgtcgtcaactccaccaacgagaacttggacgaagctcatagcagtcctgggctccacgctgctgcaggttcggggctcgccgaggagtgcgccaccctgggtggctgccgcactgggatggctaagatgacaaatgcttatgatttgcctgccaggaaggtcatccatactgtgggcccaaaatatgctgtaaagtatcacacagctgcagagaatgcgcttagccactgctacaggtcttgtctagaactgctcattgagaatggccttgaaagcattgctactggctgcatttacacagaagccaagaattatcctcgtgaaccagctgctcatgtggcaataagaactgtgagacgttttctggagaaacaaaaggacaaaataacagctattgtcttctgtacgatatcatcatctgacacagagatatataagaggttgcttccactatatttccctcgggacaagcaagaagaagagatagccgcattgaaacttccagctgatgttggggatgagaatggtgagacagtaatagatgaaaggaaaataagaataaagcccttgcctgctggggaagcaaatagcaaaacaccaattcctacacttgcagatatcccgcttcctgattcgagtttgacacgtagaaggaattctttcaagttggactcatatttggatcctgcttttatgtctataattaaggatcctgatctccgacgcaaggagcaatgggaaaaatctcaggcaaacaagggacttaacttggctaacatgcttgggtttggtgatcttggcagtccaccattatctgctgctgaagaatattcacttcattcacgataccttgctaaagcgaattctatgaatctgtcagatgttgctgaaatgaaaataatttaccgtggaggagttgatagtgaagggcgtccagttatggtcattgttggtgctcactttcttcttcgctgcttggatctggaacgatttgttctatatgtagtaaaggaatttgaatctctgattcagaagccttacacaattgtctatttccactctgtggcatcattacaaccacagcctgatttaggattcatgaaacggttacaacagatactaggtcggaagcataaaaaaaatcttcatactatatacatactccacccgacactgggactgagaacagccgttatggcgatgcaactttttgttgacggggaggtctggaagaaagttgtatatgtcgacagacttgtgcagctattcagatatgtaccacgtgaacagctcaccattcctgattttgtgttccagcatgaccttgaagtgaatggtggaaagggcataatcgttgacccaagaacaaagcatatctaccagagaccatctggttgatctgtcataaacctgcaaatgaacgcttcacagtaccactctcactatgcacagactctccatgaatgactctgtccagtcctctgtagaagagtacccttctagagctgtgcattttgtatctagttgacattgttgctctgtgctattccttcgcctttttgggaggcatatttatgtatcttaataactattctgtataaacaaaaaaaatgctaaatgtctc

SEQ ID NO: 2083 - DNA, 2591 bp, Sorghum bicolor
ttgtcctgcacgcatcgtcttgcgtctacaatttctgcagacagcaacaattattgagtaatttaattactccttctatctaatctactttctctctcctactccgtcccgtcgcttcgatcccccgagcttcgctcacaccggtcacctccgcctccgcccgcttcgcgcgcgaacgcatctccttctatcgctccagcctccagcacacatccccatgccctcgcggtcctgatccggccacagccatgcagcaccgctcgccggaggcggcgtcggcctccgcctccccgacggccgcggcggcggcggccatggcgccgggcgtcggcggggtggagccggccgtgacgctcgaccaggtcccgcgttggagcgacccggaccagcgcatctccccgctgtcccccactgccgccggatccgagactccgccctcgtccttcctctccttctccgacccgctaaccggggacgacgcggccgcgggggccgggggccgtggcgcgtcgcggttccccgtcgatcacgagatcaactcgaagatctacctctggcgaggccacccgtggagcctcgaggtcgacgccgtcgtcaactccaccaacgagaacttggacgaagctcatagcagtcctgggcttcacgctgctgcagggacggggctcgccgaggagtgtgccactttgggtggttgccgcactgggatggctaagatgacaaatgcttatgatcttcctgccaggaaggtcatccataccgtgggcccaaaatatgctgtaaagtatcacacagctgcagagaatgcgcttagccactgctacagatcttgtctagaacttctcattgagaatggccttgaaagcattgctactggctgcatttacacagaagccaagaattatcctcgtgaaccagctgctcatgtggcaataagaactgtgagacgtttcctggagaaacaaaaggacaaaataacagctattgtcttctgtacaatatcatcatctgacacagagatatataagaggttgcttccactatatttccctcgggacaagcaagaagaagagatagccgcattgaagcttccagctgatgttggggatgagaatggtgagacagtaatagacgaaaggaaaataagaataaagcccttgcctgctggggcagaaaatagcaaaacaccaattcctacacttgcagatatccctcttcctgattcgagattgacacgtagaaggaattctttcaagttggactcatatttggatcctgcttttatgtctataattaaggatcctgatctccgacgcaaggagcaatgggaaaaatctgctcaggcaaacaagggacttaacttggctaacatgcttgggtttggtgatcttggcagtccaccattatctgctgctgaagaatattcacttcattcacgataccttgctaaagcgaattctatgaatctgtcagatgttgctgaaatgaaaataatttaccgtggaggagttgatagtgaagggcatccagttatggtcgttgttggtgctcactttcttcttcgctgcttggatcttgaacgatttgttttatatgtaataaaggagtttgaacctctgattcagaagccttactcaattgtctatttccactctgcagcatcattacaaccgcagcctgatttaggattcatgaaacggttgcaacagatactaggtcggaagcatcaaaaaaatcttcatacaatatatatactccacccgacgctgggattgagaacagctgttatggcaatgcagctttttgttgacggggaggtctggaagaaagttgtatatgtcgacagacttgtgcagctattcagatatgtaccgcgtgaacagctaaccattcctgattttgtattccagcatgatcttgaagtgaatggtggaaagggcataatcgttgacccaagaacaaagcatgtctaccagagaccatctggctgatctgtcatgaacctgcaaatgagcgcttcacggtaccactctctctgtagtctgtacagactctctgtccagtcctctgtagaaggtcctgtcctcctctgtagaagagttcccttctagagctgcgcattttgttgctctatgctattccttctccttttagggaggcatatttctgtataaacaaataaatgccgcatctaaatgtctctcaagttgcctagagctgggcgtgcttattaggtactgtaaaattttgacaggtccatagatattgagaaataagattgcagtctgttccgtctcagtaattgatcggcgcttggaatgccttaataggctgaagactgatgtgtttgctgttgcaaacagtagtagcaagtcctcaagacgaggaagaataaaatcttgtctattttgcttttggttagtttgacaaaatttgtgattctaattctgatcctgaggttctccgtccaaacattatactctcaataccttttattattatcatgaacccattttggaggttttcgttatttggcaacaatttgtccaaacatggtacttcattctaaattataagacgtttgacttttg

SEQ ID NO: 2084 - DNA, 2338 bp, Oryza sativa
aaagagaagaaaagaacacacgccctctcctccgcggctgagcggctgcggctccgcctcctcccatcccaccatcccaaacttctctcgcaccagtcaccctcctcccgtcgcttggccgctctctctcacttcgcgcgcgcgcgcgaacccgcacctatcgccgcccatgccctcgcgctcgcggctctgatccggtcgccatgcagcagcgctcgccgacggccgcgtcggcctcggcctcggcctcctcggtggcggcggcggcgggcgtgggcggggtggagccggccgtgacgctcgaccaggtgccgcggtggagcgacgccgaccagcgcctctccccctcctcatcccccaccgccgccggatccgacgagacccccgcctcgtcgttcctctcgttcgccgacccgctcatcggcgacggcgcggccgctggggccgggggccgtggcgcgtcgcggttccccgtcgaccacgagatcaactcgaagatctgtctctggcgcggccacccgtggaaccttgaggtcgatgccgttgtcaattcgacaaatgagaacttggacgaggcgcatagtagtccagggctgcatgcagcggctgggccagggctcgccgaggagtgcaccaccctgggtggttgccggactgggatggctaagatgaccaatgcatatgatctgcctgctcggaaggtaattcatactgtgggccctaaatatgctgtcaagtatcacacagctgcagagaatgcacttagccactgctacaggtcttgtttggaacttctcattgagaatggtctggaaagcattgcaatgggttgcatatatacagaagccaaaaattaccctcgtgaaccggctgctcatgttgcaataagaactgttagacgttttctggagaagcagaaaggcaaaataactgctgttgtcttttgtactactacatcatctgatacagagatatataagcgattgcttcccctatatttccctcgggacaagaaagaggaagagattgcttcattgaaacttccagctgatgttggggatgagaatggtgaaacaataatagatgaacggaaaatacgaataaaacctttgcctgctgggtctgctattaacaaatctgcagctcctgcgccagtagatattcctctttctgattctggattgacacgtagtaggaattctttcaagttagattcatatttggatcctgcctttatgtcactaattaaagatccagatctccgacgcaaggagcagttggaaaagtctgttcaggcaaacaagggatttaattgggctaaattggttggatttggcgaccttggtggtcctccattatctgctgctgaagattattcacttcattcatgacaccttgctaaagcaaattctctcagtctctcagagattgctgagatgaaaataatttaccgcggtggagttgatagtgaagggcgtcctgttatggtggttgttggtgctcactttctacttcgctgtttggatcttgagcgatttattctatatgtagtaaaggagtttgaaccattgattcaaaagccttactcaattgtctatttccactcagcagcatctttacaagtgcgaccagatttaggattcatgaagcggttgcaacaaatattaggtcggaagcatcagcgcaatcttcatgctatatatgtacttcacccaactttgggattgagaacagctatattggctttgcagcttttcgttgatggggaggtctggaagaaagttatctatgtcgacagacttgtgcagctgttcagatacgtaccacgtgaacaactgacaattcctgattttgtcttccagcatgatctcgaagtgaatggtggaaagggcataataattgaccctagaacaaagcatgtctaccaaagaccatcaggttgataaatatagcctgctatatgcagagatcctccaataccacactgtacaatctctttgccctctatagaagattttccttcttgatctgtgcattttgtatctagttgagttggcagtgttttgtagccttctagtcttttctttctgttctgtcagggaagcgtagattattatgtatatgtatcgctctatataataataaaaaatgctgtggccgtctcaaattctccagctaggctggcctcttgggtgctgtgtaattctggctggtctttgcaatgaacatatgttcgtagagaaataaagtgatcattgtctaagtggccaggaaataacatcttcttatcttccctttcaataaaggataatttgttcagtataagagaagtccaagc

SEQ ID NO: 2085 - DNA, 2382 bp, Brachypodium distachyon
atttccgcagacagaaataataattggggcaaattttaaaacgacctaaaaatctaatcccctttctctctcttcgcttccggctcctcgcctcgatccccaacccaagcatcttcccgcaccagccatcctcccctgccccgccctgccacgctaatagttggcgcgcgaacccgtctccatgcgctcgcggctctgatcccggccgtccccatgcagaaccgctcgccggcggccgcatcggcctccgcctcaccgacggcggcggcggctgtcatggtgcccagcgtcggcggggtggagccggccgtgacgctcgaccaggtcccgcgctggagcgatcccgaccagcgcctctactcctcttcccccaccgcagccggatccgagaccgccgcctcgcccttcctctcgttcgccgaccccctcacgggcgacgacgcggcctccggagctggggggcgcggcgcggctcgcttccccgtcgaccacgaggtcaactcgaagctctacctctggcggggccacccgtggaacctcgaggtcgacgccgttgtcaactccaccaacgagagcttagacgaggcacacagtagcccgggattgcatgcatcggcggggccagggctcgccgaggagtgtgccaccttgggtgggtgccggactgggatggcgaagatgaccaatgcatatgatctgcctgcaaggaaagtcatccatacagtgggccctaaatatgctgtcaagtatcacacagctgcagagagtgcacttagccactgctataggtcttgtttggaactactcgtcgagaatggtcttgaaagcattgcaatgggttgcatctacacagaagccaaaaattatcctcgtgaaccagctgctcatgtcgcaataagaactgtgagacgttttctggagaagcaaaaagataaaataagtgctcttgtcttctgtaccacatcatcatctgatacagagatatataagagattacttcctctatattttcctcgggacaaacaggaggaagtgatagcttcagtaaaacttccagctgatgttggggatgagaatggtgagccaataatcgatgaaaggaaaataagaataaaaaccttgcctgcagaagcaacaaatagcaaatatgcagtttctccgcctgcagatattcctcttgctggttctggattgacacgtagaagaaattctaagttggattcatatttggatcctgcctttatgtccataattaaagatccagatctccgtcgcaaagagcaatgggaaaagtctgctcaggcaagcaagggatttaattgtgctaagttgcttggatttggtgatcttgctggtcctccattatcggctgctgaagaatattcacttcattcacgataccttgctaaagcaaattcacttaatctttcagaaattgctgaaatgaaaataatttaccgtggtggagttgatagtgaagggcgcccaattatggttgttgttggtgctcactttctccttcgttgtctggatcttgaacgatttgttctgtatgtagtaaaggagtttgaacccttgattcaaaaaccttactcaattgtctatttccactcagcagcatccttacaagtacaaccagacttgggattcatgaagcggttacaacaaatgctaggtcggaagcatcagcgaaatcttcatgctatatatgtactccacccaacattgggattaagaacggctattttggcgttgcagctttttgttgatggagatgtctggaagaaagttgtttatgtcgacagacttatgcagctgttcagatacgtaccacgggaacaacttaccattccagattttgtctttcagcatgatctcgaagtgaatggtgggaggggcataattgttgatcctagaacaaagcatgtctaccaaagaccatcaggttgatatatatttagtagcttgttactccaagttccttggttaccgctctgtaaaatctcttttgtccgctgtagaaaagttcacatgtagatccgtgcattatgtatctagttgagtcggcattatgttctgttatattttttcttctcttagcggaggtaattatgtatatgtatcttgttctgtataaccaaataatgtttcaagttctgccccgtgacttagtcacctactccttgactccttttttttaagctgtactccctaacttcttgtgtactgccaaactttgactggtccttggaataaaagtagcataacgttccaggtattgaataggttgtccggttatatgttctggacatgctagtgtaatcatcttgtgtaaagtaacatgcatcttggagatagggttcgtacaccatattgtgcgca

SEQ ID NO: 2086 - DNA, 1925 bp, Triticum aestivum
cgcctcgcgcttgcccgtggaccacgagatcaactccaggatctacctctggcggggacacccctggaacatggaggtcgacgccgtcgtcaactccaccaacgagagcttggacgaggcgcacagtagtcccgggcttcacgctgcagcgggttctgggctcgcggaggaatgcgccaccttgggagggtgccgaactgggatggcaaagatgaccaatgcatacgatcttcctgcgaggaaggtcatccatacagtgggacccaaatatgctgtcaaatatcacacagctgcggaaaatgcacttagtcattgctaccggtcatgtttggaactactcattgagaacggccttgaaagcatcgcaatgggttgcatatacacggaagctaaaaactatcctcgtgaaccagctgcccatgtggcaatacggactgttagacgttttctggagaaacagaaaggcaagatagctggtgttattttttgtattacatcatcatctgatacagagatatacaaaagattgcttccgctatatttccctcgggacaagcaagaggaagagactgcggtatcaaaacttccagctgatgtcggggatgagaatggtgaaactgtaatagatgaaaggaaaataagaataagaccattgcctgctggtgcagcagatagaacagtggctacagctcctcttgatcttcctcttgagtctggattggcatcaaggagtacattcaaactggattcatatttggacccttcatttatgtcattaattaaagacccggatctgcggcgcaaggagcagtgggaaaaatcttctcaagctcaaaagggatttaattatgctaggttgcttggatatggtgatataggtttccctccattgtctgctgctgaggaatattcacttcattcacgataccttgcgaaagcaaattcccttaatctttcagagattgctgagatgaaaataatttatcgtggcggagttgatagtgaagggcgcccagttatggttgttgttggtgcgcactttcttctccgctgcctggatcttgaacggtttgttctacatgtagtgaaggagtttgaacctttgattcagaagccatatactattgtctatctccactcggcagcatcattacaaccgcaaccagatttaggattcatgaaacggatacaacaaatattaggtcggaaacaccagcgaaaccttcatgggatttatatactccacccaaccttggggttgagaacagctattctggggatgcagcttttgattgatggagaggtatggaagaaagttgtgtatgttgacaggctggtgcaattgttcagatatgtaccacgcgaacaattaactatcccagattttgtatttcagcatgatttggaggtgaatggtggtaggggcatgattgtggacccaagaacaaaacatatctatcagagaccatctggctgattcatgtcatttatgcagtccaaagctcatacttgttgcttgtgcaagtctttgtataattactcctttgttgatatttctcgttttcctttgtatcgaatttaggtgttctattcctttcattcgttcctcagccttcagggaaggggattattgtttgtatatgttaatttctacagctgaataaaagtggcgtctcagtgctcgtcagtttaagttccaccagacagggcattcgtctagcataaaatatggtactctctcctatccaacataagtgacccagttttgaactaagcttagttcaaccttatttgtgtcgttcaaccttagttcaaaactgtgacacttattatggatccaagggagtaagctaaaattgtgtcagtctttctgcagtctcgtcacaattgtgtatttgtgtgcctgaagcgtatttaaaattggg

SEQ ID NO: 2087 - DNA, 2063 bp, Secale cereale
ccccaaactcgtcccgcaccggacagccacctccccgcctcctcgcgcgcgcgcgaaccccgcccctcctccgccccccatgccctcgccgcggccatggcgcccggcgtgggcggggtcgagccggccgtggcgctcgaccaggtcccgcgctggagcgaccccgaccagcgcctccactccccgtcctcccccaccgccgccggatccgaggcccccgcctcctccttcctctccttcgccgacccgctcgacgcggccgcgggcgccgggggccacggcgcctgccgcttccccgtcgaccccgaggtcaactccaggatctacctctggcggggccacccctggaacctcgaggtcgacgccgtcgtcaactccaccaacgagagcttggacgaggcgcatagcagcccggggctgcatgccgcggcggggccggagctcgctgaggagtgtgccaccttgggtgggtgccggactgggatggccaagatgaccaatgcgtatgatctgcctgctaggaaagtcatccatacagtgggccctaaatatgctgtcaagtatcacacagctgcagagagtgcacttagccactgctacaggtcttgcttggaactactcgtagagaatggtcttgaaagcatcgcaatgggctgcatatacacagaagccaaaaattatccccgtgaaccggctgcccatgtggcaataagaacggtgaggcgttttctggagaagcagaaggacaaaataactgctgttgtcttttgtactacatcatcaactgatacagagatatataagcgattgcttcctctttatttcccacgggacaaacaagaggaagagatagcttcattaaaacttccagctgatgttggggatgagaatggtgagccaataatagatgaaaggaaaataagaataaaaacattgcctgctgaggcagcaaatagcaagtatgcagttcccgtgcccgcagatattcctctttctggttctggattgacacgtagaagaaattctaagttggattcatatttggatccatcctttatgtccataattaaagatccagatctccgacgcaaggagcaatgggaaaagtctgctcaggcaaggaagggatttaattttgctaagttgcttggttttggtgatcttggtggtccagcattaacggctgcagaagaatattcacttcatcaacgataccttgctaaagcaaattccctcaatctttcagaaatcgctgaaatgaaaataatttaccgtggcggagttgacagtgaagggcgcccaattatggttgttgttggcgctcacttccttcttcgctgtttggatctggaacgatttattctgtatgtagtaaaggagtttgaacctttgattcaaaagccttactcaattgtctatttccactcggcagcatccttacaagtacaaccagacttgggattcatgaagcggttacaacaaatgctaggtcggaagcatcagcgaaatcttcaggctatatatgtactccacccaacgctgggattgagaacggctattttggcgttgcagcttcttgttgatggagatgtctggaagaaagttgtctatgttgacagacttatgcagctgttcagatacgtgccacgggaacaactaacaattccagattttgtctttcagcatgatctagaagtgaatggtggaaagggcataatcgttgatcctagaacaaagcatgtctaccaaagaccgtcaggttgatattttgcaacttgtccctcccagttcccggtcacccctccgtcagtcaaatctctgttctctgtagaagagttcacatatagatccgtgaagtatgtatctagttgagttgacattatgttctacattacattctttcttatcttaggaaggtagttatgtatatgtatcttgttctgtataaccaaataaaggctgtaactaaatgtctctcaagttcttccgctgggctaaatcgcctagtccttttgtactgtaaaattttgactggtccttgaatagattgccctgttatcagt

SEQ ID NO: 2088 - DNA, 2047 bp, Triticum aestivum
cggcggccatggcgcccggcgtgggcggggtcgagccggccgtggcgctcgaccaggtcccgcgctggagcgaccccgaccagcgcttccactcgccctcctcccccaccgcggccggatccgaggcccccgcctcctccttcctctccttcgccgacccgctcgacgcggccgcggcgggggccacggcgcgtgccgcttccccgtcgaccccgaggtcaactccaggatctacctctggcggggccacccctggaacctcgaggtcgacgccgtcgtcaactccaccaacgagagcttggacgaggcgcatagtagccctgggctgcatgcggcggcggggccggagctcgctgaggagtgtgccaccttgggtgggtgccggactgggatggcgaagatgaccaatgcgtatgatctgcctgctaggaaagtcatccatacagtgggccctaaatatgctgtcaagtatcacacagctgcagagagtgcacttagccactgctacaggtcttgcctggaactactcgtagagaatggtcttgaaagcattgcaatgggctgcatatacacagaagccaaaaattatccccgtgaaccggctgcccatgtggcaataagaactgtgagacgttttctggagaagcagaaggacaaaataactgctgttgtcttttgtaccatatcatcaactgatacagagatatataagcgactgcttcctctttatttcccacgggacaaacaagaggaagagatggcttcgttaaaacttccagctgatgttggggatgagaatggtgagccaataatagatgaaaggaaaataagaataaaaacattgcctgctgaggcagcaaatagcaagtatgcagttcccgtgcccgcagatattcctctttctggttctggattgacacgtagaagaaattctaagttggattcatatttggatccatcctttatgtccataattaaagatccggatctccgacgcaaggagcaatgggaaaagtctgcgcaggcaaagaagggatttaattttgctaagttgcttggttttggtgatcttggtggtcctgcattatcggctgcagaagaatattcacttcatcaacgttaccttgctaaagcaaattcccttaatctttcagaaatcgctgaaatgaaaataatttaccgtggcggagttgacagtgaagggcgtccaattatggttgttgttggcgctcactttcttcttcgctgtttggacctggaacgatttattctatatgtagtaaaggagtttgaacctttgattcaaaagccttactcaattgtctatttccactcagcagcgtccttacaagtacagccagacttgggattcatgaagcggttacaacaaatgctaggtcgtaagcatcagcgaaatcttcaggctatatatgtactccacccaacgctgggattgagaacagctattttggcgttgcagcttcttgttgatggagatgtctggaagaaagttgtctatgtcgacagacttatgcagctgttcagatacgtgccacgggaacaactaacaattccagattttgtcttccagcatgatctagaagtgaatggtggaaagggcataatcgttgatcctagaacaaagcatgtctaccaaagaccgtcaggttgacatttagcaacttgttgctcccagtttccggtcacccctctgtcaaatctctgttctctgtagaagagttcacatctagatccgtgaagtatgtatctagttgagttgacattatgttctgcattacattctttcttatcttaggaaggtagttatgtatatgtatcttgttctgtataaccaaataaaggctgtgtctctcaagttcttccgctgggctaaatcgcctagtccttgtgtactgtaaaattttgactggtccttgcagtggagcaacagattgtcctgttatcaatgttctggacatgctggcgtaataatcttgtaaagtcacgtagatacccttcccagatagaattcgtactgtatggtgtg

SEQ ID NO: 2089 - DNA, 1298 bp, Triticum aestivum
caacagcgcacatcagcagcagcagcagccatgaaacactgcttcagcctcgccgcggcgctggccgtcgtgaccctggccgcgcttctctcgtcggacgccgtggtcgcatgcatcgacgtgggcttctacgacaggaccagcccgtccgccgagaccctggtgcagcagaccgtggccgccgccttcggcaacgactccggcgtccctccggccatcatccgcctccacttccatgactgcttcgtcaagggctgcgacggctccgtgctgatcgactcgacgcctggcaacaaggcggagaaggactcggcgcccaacttccccagcctccgcttcttcgacgtggtggaccgcgccaaggcggccctcgaggcgcagtgccccggcgtcgtctcctgcgccgacgtcctcgccttcgccgcgcgggacagcgtcgttctgtcgggcggcctcgggtaccaggtgcccgccgggcgccgggacggccgtgtgtccaccgaaacggacgcgctcaacaacctgcccgggccgacgtccaccgcctccgacctggtcgccggcttcgccgccaagaacctcaccgtcgaggacatcgtcgtcctctcgggcgcccacaacatcggcgtctcccactgcagcagcttcaccgagcgaatctacaacttccccaacacaaccgacgggattgacccgaagctgagcaaggcgtacgcgttcttgctcaagggcatctgcccgccgaacagcaaccagacgttcccgacgacgacgaccctcatggacctcatcacgccggcgaggttcgacaacaagtactacgtggggctgaccaacaacctgggcctcttccagtcggacgcggcgctgctgaccaacgccaccatgaaatcgctggtcgactccttcgtgcgcagcgaggcggcgttccggaccaggttcgccaggtccatgctcaagatggggcagatcgaggtgctctccggggcacagggcgagatcaggcgcaactgcagggtcatcaaccccaccaacgtcactagtgccggcgccgttcaccatcatcttctccccagatcatcagcttcttcaggatccaaccaggtggccgcaagctgattagttggtcgtcagtagagatttgtactgcgtgcatgacagcatgaggtcgagtgctctagtgtgatgcaataaattatctgatgttttgtctgaacgtctgtgctacgatttgcgagcgtttgaaatgaaccagttccaaaatgttcctatatatgagaattaagcatattcggttt

SEQ ID NO: 2090 - DNA, 1309 bp, Secale cereale
gttcttgtctttctagtccttcgtccgtcggtcgctggcttgtcgtgaccctggccgcgcttctctcgtccgacgccgtggtcgcctgcatcgacgtgggcttctacgacaggacctgcccgtccgccgagaccctggtgcagcagaccgtggccgccgccttcggtaacgactccggcgtcgctccggccatcatccgcctccacttccacgactgcttcgtcaagggctgcgacggctccgtgctgatcgactcgacgcctggcaacaaggcggagaaggactcggcacccaacttccccagcctccgcttcttcgacgtggtggaccgcgccaaggcggccgtcgaggcgcggtgtcccggcgtcgtctcctgcgccgacgtccttgccttcgcggcgcgggacagcgtcgttctgtcgggcggcctcgggtaccaggtgcccgccgggcgccgggacggccgtgtgtccaccgaagcgaacgcgctcaacaacctgcccgggccgacgtccaccgcctctgacctggtcgccggcttcgccgccaagaacctcaccgtcgaggacatcgtcgtcctctccggcgcccacaccatcggcgtctcccactgcagcagcttcaccgagcggatctacaacttcccgaacacaaccgacgggattgatcctaagctgagcaaggcgtatgcgttcttgctcaagggcatctgcccgccgaacagcaaccagacgttcccgacgacgacgacgctcatggacctcgtcacgccggcgaggttcgacaacaagtactacgtggggctgaccaacaacctgggcctcttccagtcggacgcggcgctgctgacaaacgccaccatgaagtcgctggtcgactccttcgtgcgcagcgaggcggcgttccggaccaggttcgccaggtccatgctcaagatggggcagatcgaggtgctctccggggcacagggcgagatcaggcgcaactgcagggtcatcaaccctaccaacgccactagtaccggcgccgttcaccatcatcttctccccagatcatcaggttcttcaggatccaaccaggtggctgcaagctgattagttggtggtcagtcgagacatgtgtacgtgcagtgtgcatgaggtcgagtgctccggtcagtgtgaaataataaattatctgatgttttgtctgatcgtctgtgctacgatttgcgagcgtttgaaatgaacagttccaaaatgttcctattacaattaagcatattccgtttctcaagttaaataagaaaaaacatgtatgtttctcagtc

SEQ ID NO: 2091 - DNA, 2333 bp, Hordeum vulgare
gcaagctttactgtcactcaaaagcagggagagagagagagacagaaggggaaaaaaaggatgcatggtctgtggaggtgcggtggttgcttcgagcctctgcaatattttgcgacggccgttcggtgcgctgctttcgagctgcttcgccgtgatcccgatggccgaccttcccccctttatataccgccggccgccgcgatccctcccccatctcaccgcaccaccgcgccacctgccaccgacgacaagcacgctcctcctcccctgcctcctcctcgtcctcttagctccatggcctgcagctgcgctcacggggtggagttcgacgccaacgtgatccggaacagcgcgctggaggacgggctcgccgggtgggcggcggtaggcgcgtgcacggagctgtcggtgcgccatgaggagtcggccagggtgcccacggagaccatcaacgacgtggaggacgggtacaggccgagcggcaggtacattctggcggcgggccgcggcggcgaggaggacggcctctgccaggccatccccgccggcgcgctcaagcccagggtcacgtaccgggtggccgggtggatcggcctcggcgacggcgccgccggggagcacgcggtgcgcgtcaacattcgtttggacggcggcgagggcggggagtgcgcgatggtggtcgagggcggcgcggtgtgcgccgaggccggcaggtggacggagatcaagggcgtgttccggctcaaagccatcccgccgtccggcgccgcggtgcacgtccagggcgcgccccccggcgtcgacgtcaaggtgatggatctccaggtgttcgccacggaccgcaaggcccgcttcaagaagctcaggaagaagactgacaaggtgcggaggcgggacgtggtgctcaagttcgccggcgccggggcgtcgtcggcggtgtcgggggcgtcgatccgggtgatgcagatggacacgagcttcgcgttcggcgcgtgcatcaacccggcggtgatccaggagccggcgttcgtggactacttcaccaagcacttcgactgggcggtgttcgagaacgagctcaagtggtaccacacggaggcggtgcaggggcagctcaactacgccgaccccgacgcgctgctcgacttctgcgaccggcacggcaagccggtgcgcggccactgcatcttctgggccgtcgaccgcatggtgcagaagtgggtcaaggacctgcccaacgaccagctcgccgccgccgtccagggccgcctcaccagcctcctcacccgctacgccggccggttcccgcactacgacgtcaacaacgagatgctccacggcaccttcttccaggaccgcctcggcgacgacatcaacgccttcatgttcaaggagacggccaggatcgaccccggcgccgccctcttcgtcaacgactacaacgtcgagggcggcagcgaccccagcgccaccccggacaagtacatcgcgcaggtcaacgcgctcatggagaagggcgcccccgtcggcggcatcggcctgcagggccacgtcaccaaccccgccggcgagatcatctgcgacgcgctcgacaagctcgccaccaccgacctgcccgtctggctcaccgagctcgacgtgtgcgagtccgacgtctgcctccgcgccgaggacctcgaggtggtgctccgggaggcgtacgcgcacccggccgtcgagggcgtcgtgctctgggggttcatgcaggggcacatgtggcgccaggacgcctgcctcgtcaacgccgacggcaccatcaacgacgccggccagaggttcatcaacctgcggcaggagtggacgtcgcacgcgcgcgggaagatcgacagcgacggcaacttcaagttcagagggtaccacggctcgtacgtcgtgcagctcgccacggccacggggaagatgcacaaggccttcagcgtcgacaagggggacacacctctcgtgctggacatggacgtgtgacaacggttacctactacggctattatctccgagtatatatatatatatagttatactatatatactccttggtatactaactaatactctacacacatacaagcacacattgattaatttgatctaatggggtcggcaaagggattgtaccacatactacaacaactagtatagttttgcgtttctacgtttggtatatattgtactgttgagagattgtaatcaaggtactgtattggttaaaattaatggaaatgaatgaataaaattaacgatattgtaaatcctcgttttatcgaaaatggtactgtatgctttccctcctttccgag

SEQ ID NO: 2092 - DNA, 1479 bp, Brassica rapa
aactatcagagccaacaataactaaggagagtcatgcggatggaaacacaaggcaaagttatcacttgcagagcggctgtggcatggggagcaggagaagctctagtgatggaggatgtaaaagtggatcctcctcagagattggaagttagactacgaatcctcttcacttccatctgtcacactgatcttagcgcatggaaaggcgagaacgaggctcagcaagcataccctcgaatccttggtcatgaggctgcagggatagtggagagcgtaggggaaggagtggaagatatgaaggcaggggatcatgtgctccctattttcaccggagaatgtggtgattgcagagtctgtaaacgagacggagccaatctttgcgagaggttccgagtggatccaatgaagaaagtgatggtaggtgatgggaagaccagattcttcaccagcaaagacaacaagcccatctaccattttcttaacacatccaccttctccgagtacaccgtcatagactcggcctgtgtggtgaaggtggaccctcggtttcctctagagaagatgagcctcctcagctgcggtgtctcaactggagtgggtgcggcctggaacgtggctgatattcagcctggctccaccgtcgctatctttgggctgggcgctgttgggcttgcggtagctgagggtgcaagagcaaagggggcctcaaaaatcattgggatcgacgtcaaccctgacaagttctcattagggagagaagtagggataagtgagttcataaacccaaaggagagtgacaagacggttcatgagagggtgatggagataactgagggaggagttgagtacagcttcgagtgtgcgggaagaattgaagcacttcgagaagcttttttatctacaaactcgggagtgggagtgacagtgttgcttggcgttcacgcaagcccacagcttctacctatccatcccatggagctcttccaaggcagatcaatcactgcctctgtttttggaggtttcaaacccaaaacacagttgcctcttctattcacacagtgcctccaaggccagctcaatctagacctcttcatctctcaccagcttcctttcagtgatattaacgaagctatgcagctcctacatcagggcaaggctctccgttgtcttctccgcctctgatcatttctttcatattcatgtgtttacaagttgtggtgatgattttattacaaaagttaagttgtggtgatgatgatttgattatggtttcctgctgtattacctttgttgggtccacctccattcctacacttaattgtccttttggtcacaatacttcataaatgcgaaacccacaactcttttaaatggccacgaaactccatgtggtctctgttaaatctaacgggtcgttgatggttgatcaccaccaaccctgaatatcacacgttacatggcgaacaaacaaaattggac

SEQ ID NO: 2093 - DNA, 1324 bp, Brassica juncea
gatcagagccaacaataactaaggagagtcatgcggatggaaacacaaggcaaagttatcacttgcagagcggctgtggcatggggagcaggagaagctctagtgatggaggatgtaaaagtggatcctcctcagagattggaagttagactacgaatcctcttcacttccatctgtcacactgatcttagcgcatggaaaggcgagaacgaggctcagcaagcataccctcgaatccttggtcatgaggctgcagggatagtggaaagtgtaggggaaggagtggaagatatgaaggcaggggatcatgtgctccctattttcaccggagaatgtggtgattgcagagtctgcaaacgagaaggagccaatctgtgcgagaaatttcgagtggatccaatgaagaaggtgatggtaggtgacgggaagaccagattcttcaccagcaaagacaacaagcccatctaccattttcttaacacatccaccttctccgagtacacggtcatagactcggcctgtgtggtcaaggtggaccctcggtttcctctagagaagatgagcctcctcagctgcggtgtctcaactggagtgggtgcggcctggaacgtggctgatattcagcctggctccaccgtcgctatctttgggctgggtgctgttgggcttgcggtagctgagggtgcaagagcaaagggggcatcaaaaatcattgggatcgacgtcaaccctgacaagttcccattagggagagaagtggggatcaatgagttcataaacccaaaggagagtgacaagacggttcatgagagggtgatggagataacagagggaggagttgagtacagtttcgagtgtgcgggaaggattgaagcacttcgagaggcttttttgtctacaaactcgggagtgggagtgacagtgatgcttggcgttcacgcaagcccacagcttctacctatccatcccatggagctcttccaaggcagatcaatcactgcctctgtttttggaggtttcaaacccaaaacacagatgcctcttctattcacccagtgcctccaaggtcagctcaatctagacctcttcatctctcaccagcttcctttcaaagacattaacaaagcaatgcaactcctccaccaaggcaaggctctccgttgtcttctccgcctctgatcatctctttcatatttatgtgtgtacaagttggcgtgacgatgctttgattatgtttgattgttttcctactgtattaccttgttgggtccacctccactcctagacttaattgtccttttgattacattactttataaatgcg

SEQ ID NO: 2094 - DNA, 1319 bp, Raphanus sativus
  misc_feature (761)..(761): n is a, c, g, or t
  misc_feature (1167)..(1167): n is a, c, g, or t
ggatcagagcgaacagtaaactaaggagagatttgcggatggaaacacaaggcaaagtcatcacttgcagagcggctgtggcatggggagcaggagaagctctagtgatggaggatgtaaaagtggatcctcctcagagattggaagttagactacgaatcctcttcacttctatctgtcacactgatcttagcgcatggaaaggcgagaacgaggctcagcaagcataccctcgaatccttggtcatgaggctgcagggatagtggagagcgtaggggaaggagtggaagatatgaaggcaggggatcatgtgctccctattttcacaggagaatgtggtgattgcagagtctgtaagcgagacggagccaatctgtgcgagagattccgagtggatccaatgaagaaggtgatggtaggtgatgggaagaccaggttcttcaccagcaaagacaacaaacccatctaccattttcttaacacatccaccttctccgagtacacggtcatagactcggcatgtgtggtcaaggtggaccctcggtttcctctagagaagatgagcctcctcagctgcggtgtctcaaccggagtgggtgcggcctggaacgtggctaatattcagcctggctccaccgtggctatctttgggctgggtgctgttgggcttgcggtagctgagggtgcaaaagcaaggggggcctcaaaaataattgggattgacatcaaccctgacaagttcccattagggagagaagtnggaatcagtgagttcataaacccaaaggaatgtgacaagacggttcatgagagagtgatggagataacagagggaggagtggagtacagcttcgagtgtgcgggaagaattgaagcacttcgagaggcttttctgtcaacacactctggagtggggaagacagtgttgcttggcgttcacgcaagcccacagcttctccctatacatcccatggagctcttccaaggcagatcaatcactgcctctgtttttggaggtttcaaacccaaaacacagctgcctcttctattcaaccagtgcctccaaggtcagctcaatctagacctcttcatctctcaccagcttcctttcaatgatattaacaaagccatgcaactcctccaccaaggcaaggctctccgttgtnttatccgcctttgataatctatttcctatttatgtgcgttacaagttgtcgtaatgatgatttgattatgttttcctactgtattaccttgttgggtccacctccactcctacaatcaattgtccttttgatcaacaattcacaatgctaca

SEQ ID NO: 2095 - DNA, 1240 bp, Eutrema parvulum
gctgatggaaacacaaggcaaagtcattacttgcagagcggctgtggcatggggagccggggaagctctacagatggaggatgtaaaagtggttcctcctcagagattggaagtgagactacggattctcttcacttccatctgtcacaccgatcttagtgcatggaaaggcgagaacgaggctcagcaagcataccctcgaatccttggtcatgaggctgcagggatagtggagagcgtaggggaaggagtggaagagatgaaggcaggggatcatgtgctacctattttcaccggagagtgtggagagtgcagagtctgcaagcgagacggagccaatctgtgcgagagattccgagtggatccgatgaagaaggtgatggtaagtgatgggaagaccaggttcttcaccagcaaggacaacaagcccatataccattttcttaatacatccaccttctccgagtacacggtcgtagactcggcctgtgtggtcaaggtggaccctctgtttcctctggagaagatgagcctcttgagctgcggtgtctccactggggtgggtgcggcgtggaacgtggctaatattcaacctggctccaccgtagctgtctttggactgggcgctgttggacttgcggtggctgagggtgcaagagccaggggagcctctaaaatcattgggatcgacgtcaaccccgacaagttcccattagggagagaagtagggatcagtgaattcataaatccaaaggagagtgacaaggcagttcatgagaggatgatggagataacagagggaggaggagtggagtacagcttcgagtgtgcgggaaacattggagcacttcgagaggcgtttttgtctacaaactcgggagtgggagtgacagtgttgcttggcgttcacgcaagcccacagcttctccctatccatcccatggagctcttccaaggcagatccattactgcctctgtttttggaggcttcaaacccaaaacccaattgcctcttttcatcacccaatgcctccaaggtctgctcaacctcgaactcttcatctctcaccagcttcctttccacgatatcaacaaagccatgcagctgctccaccaaggcaaggctctccgttgccttctccgcctttgatccagttacaagttgttgtgttgagagccgcttcatgattgggtccactcccacacttaattgttcttttgatcaccaattcataatgct

SEQ ID NO: 2096 - DNA, 1393 bp, Arabidopsis lyrata
aaaagaaaaaaagagaagacttttagttagatcctaccgtttaacatttatgaccttaatatatatatctggtgagacattctgctatatatgcagtttcaactttcaaagccaataataaactaaggagagataatatggaaacacaaggcaaagtaatcacttgcagagctgctgtggcatggggagctggagaacctctagtgatggaagatgtaaaagtggatcctcctcaaagattggaagtgagacttcgaatcctcttcacttccatctgtcacactgatcttagcgcatggaaaggcgagaacgagtctcagcgagcataccctcgaatccttggccatgaggcggcagggatagtggagagcgtaggggaaggagtggaagagatgaaggcaggagatcatgtgctccctattttcacaggagagtgtggagattgcagagtctgcaagcaagacgaagccaatctgtgcgagagattccgagtagatccgatgaagaaggtgatggtaaccgatggaaagaccagattcttcacaagcaaagacaacaaacccatctaccattttctcaacacatccaccttctccgagtacacggtcatagactcggcttgcgtgctcaaggtgaaccctctgtttcctctggagaagataagcctcctcagctgcggtgtctccactggagtcggtgcggcgtggaatgtggctgatattcaacctggctccaccgtcgctatatttggacttggcgctgttggacttgccgtggctgaaggtgcaagagtcaggggagcctctaaaatcattgggatcgacgtcaaccctgacaagttcccattaggcagagaagcagggatcagtgaattcataaatccaaaggagagtgacaaggcagttcatgagagagtaagggagataacagagggaggagtggagtgcagctttgagtgtgcgggaagcatagaagcacttagagaagcctttctgtctactaactcaggagtgggagtgacagtgttgctgggcgttcacgcaagcccacagcttcttcctatccatcccatggagctcttccaaggcagatccatcaccgcctctgttttcggaggcttcaaacccaaaacccaattaccctttctcatcacccaatgcctccaaggtcttctcaatctcgatctcttcatctctcaccagcttccattccacgatatcaacaaagccatgcagctgcttcaccaaggcaaagctattcgttgccttctccgcctctgaatagaaacatccttttcattttccaagtctgtgtgattattgtactgctttcagagtttccttattgggtctggtccaccccccatactaaaataaaagttggaaatgttttc

SEQ ID NO: 2097 - DNA, 1417 bp, Arabidopsis thaliana
ttggagttcaacaaaagaagaaaacgaagacttttagttagatcctacattactgaactcattatatatatctggtgagacattctcctatatatgcagtttcaactttcaaagccagcaaataataaacagaggagaaatatggaaacacaaggcaaagtaatcacttgcaaagctgctgtggcatggggagctggagagcctctagtaatggaagatgtaaaagtggatcctcctcaaagattggaagtgagaattcgaatcctcttcacttccatctgtcacactgatctcagcgcatggaaaggcgagaacgaggctcagcgagcataccctcgaatccttggccatgaggcagcagggatagtggagagcgtaggggaaggtgtggaagagatgatggcaggagatcatgtgctccctattttcacaggagagtgtggagactgcagagtgtgcaagcgagacggagccaatctgtgcgagagattccgagtggatccgatgaagaaggtgatggtaaccgatggaaagaccagattcttcaccagcaaagacaacaaaccaatctaccattttctcaacacatccaccttctccgagtacacggtcatagactcggcctgcgtgctcaaggtggaccctctgtttcctctggagaagataagcctcctcagctgcggtgtctccactggagtcggtgcggcgtggaatgtggctgatattcaacctgcctccaccgtcgctatttttggacttggcgctgttggacttgccgtggctgaaggtgcaagagccagaggagcctctaaaatcattgggatcgacatcaaccctgacaagttccaactaggcagagaagcagggattagtgaattcataaatccaaaggagagtgacaaggcagttcatgagagagtaatggagataacagagggaggagtggagtacagcttcgagtgtgcaggaagtatagaagcacttagagaagcctttctgtctacaaactcaggagtgggagtgactgtcatgctgggcgttcacgcaagcccacagcttctccctatccatcccatggagctcttccaaggcagatccatcaccgcctctgttttcggaggcttcaaacccaaaacccaattaccctttttcatcacccagtgcctccaaggtcttctcaatctcgatctcttcatctctcaccagcttcccttccacgatatcaacgaagccatgcagctgcttcaccaaggcaaagctcttcgttgccttctccacctctaaactgaacaaacatcttttacattttccaaatccgtttgattgattgttctactgcttttagagtttccttattgggtctggtccacccccatactaaaataaaagttggaaatgttttctccaacttgctact

SEQ ID NO: 2098 - DNA, 1349 bp, Eutrema halophilum
aacattcagagctaaaaataactcaggagagtcttgcggatggaaaaacaaggcaaatttatcacttgtagagcggctgtggcatggagagctggagaagatctagtgatggaggatgtaaaagtggatcctcctcagagattggaagtgagacttcgaatcctcttcacttccatctgtcacacagatcttagcgcatggaaaggcgagaacatggcccagcaagcatacccacgaatccttggtcatgaggctgcagggatagtggagagcgtaggggaaggagtggaaaatatccaggcaggggatcatgtgctccctattttcaccggagagtgtggagagtgcagagtctgcaagcgagacggagcaaatctgtgcgagagattccgagtggacccgatgaagaaggtgatggtaagcgacgggaagaccagattcttcaccagcaaagacaacaaacccatcttccattttcttaacacatccaccttctccgagtacacggtcatagactcggcctgcgttgtcaaggtggaccctttgtttcctctggagaagatgagcctcttaagctgcggtgtctccactggagtgggtgcggcgtggaatgtggctgatattcagcctggctccaccgtcgctgtctttggactgggcgctgttggacttgccgtggccgagggtgcaagagcccggggagcctctaaaatcattgggatcgacgtcaaccctgacaagttcccattagggagagaggcagggataagtgagttcataaacccaaaggagagtgacaaggcggttcatgagagagtgatggagataacagagggatcaggagtggagtacagcttcgagtgtgcgggaagcattgaagcacttcgagagtcctttttgtctacaaactcgggagtgggagtgacagtgttgcttggcgttcacgcaagcccacagcttctccctatccatcccatggagctcttccaaggcagatccatcaccgcctctgttttcggaggcttcaaacccaaaacccaattgcctcttttcatcacccaatgcctccaaggccttgtcaatctcgacctcttcatctctcaccaccttcccttccacgatatcaacaaagccatgcagctgctccaccaaggcaaggctctccgctgccttctccgcctctgatcattccatcttttttattttattttgttgttcaaatgttattgtgatcatttttgttttctactgttgattgtggatctcaacttgagaagtcaattctgtaatttgagtcggaaagactcttcttattcataaatcgagttcggaatacaatgttcgagttc

SEQ ID NO: 2099 - DNA, 1974 bp, Gossypium raimondii
aatattctaagtggaagtgaacgtcactgtaaacgtgtccaagttcatttcacaattaacatgttattgttttcttcattacacacctagctgggttagtttctattttctctgtagtttccactacaacgataagcaagcgtttcattcaaatcatctttcatttcacgaccagattgcccggccctactgcactgatcctccattggcttacccattgtaaaaatcttcgacgctattatcgaatctttttattctttttactctacagtctacagtcccaacgtttgaagttaagtcacgcatctctcttccttaaatctctgtacatcgctcttcacttcttcttagaacccctcaaaaggactgcctcaaacaaggaagtcaatgtcgttttctgagttcaggccactagacgagaactcgctcatcgaatacattaaagccacgccgtctttgtcatcgaagatcggccacaactatgatggtttaaagattaaggaagttggagatggcaatcttaatttcgtctacatcatcgttgccccttctggttcttttgtaatcaagcaggcacttccctacatacgatgtattggggaatcttggcccatgactaaggaaagagcatatttcgaagtgttagcgttaaaacaacatggtgcgttatgcccagaacatgttcctgaagtttatcactttgaccgtaccatgtccttgattggaatgcggtatttagagccgccccatataatcctgagaaaagggttaattgctgggattgaatatcctttgttggcggaacatatgtcagaatacatggccaagactcttttctgcacatctctcctatatcggtcaaccacagagcacaaacgtgcagtggccgaattttgtgggaatgtggaactatgcaggctcactgagcaggttgttttttctgacccctataaagtatctgaatataaccgttggacttcaccttatcttgaccgtgatgcggagactgtccgggaggataatctattgaagattgaagtagctgaattgaaatctaagttctgtgaaagagctcaggctcttatacatggagatctccatactggttctgtaatggttacccctgattcaactcaggtcatagatccagagtttgcattttatggaccaatgggatttgatattggtgcttttattggaaacttgattctggctttctttgcacaagatggacatgctggtcaagggaatgacagaaaatcatacaaagagtggatattgaagacaattgaggatacttggaatcttttccaccaaaagtttaccgcactatgggatgaacacaaaaatggctctggggaggcttatcttcctgcaatttataacaatcctgagcttcagaaacttatacaggaaaagtatatgaaggaattgttccacgatactcttgggtttggtgctgctaagatgataaggagaattgtaggtgttgctcatgttgaggattttgaatcaattaaagaagctaacataagagcagattgcgagcgacgggctcttgaattaggcaagacacttctaaagaggaggcgagagtttgtgtctattagtgaagttatttcagccatgaagcacgtctaatcatgatggaaatgatggaaactgctgtgcacgtatccataaaagcttttgcgcttaaatagatggaaggttttacaggatccataatttaataaagttttcatggtccttgaggcataggcctttgattgtgtgttaatgagcaaaggttcctgtctatctaacattagtgctggaccggacttgtgctgttgcaaaacacgattatgttttgattgtcttgattattctgaatgttgcacttgactttgggcaatgcagattgcatcgtaagttaaatcaatgaagctttcaaatgaattttcagaaaaaaaaaaaggtttaaatattgaa

SEQ ID NO: 2100 - DNA, 1697 bp, Gossypium hirsutum
tacgaatctttttttttttactctacagtctacagtgccaacgtttgaagttaagtcacgcatctctcttccttaaatctctgtacatcgcttcttcacttcttcttaaaacccctcaaaaggactgcctcaaacaaggaagtcaatggcgttttctgagttcaggccactagacgagaagtcgctcatcgaatacattaaagcaacgccgtctttgtcatcgaagatcgtcgacaactatgatggtttaaagattaaggaagttggagatggcaatcttaatttcgtctacatcatcgttgccccttctggttcttttgtaatcaagcaggcacttccctacatacgatgtattggggaatcttggcccatgactaaggaaagagcatatttcgaagtgttagcgttaaaacaacatggtgcgttatgcccagaacatgttcctgaagtttatcactttgaccgtaccatgtccttgattggaatgcggtatttagagccgccccatataatcctgagaaaagggttaattgctgggattgaatatcctttgttggcggaacatatgtcagaatacatggccaagactcttttctgcacatctctcctatatcggtcaaccacagagcacaaacgtgctgtggccgaattttgtgggaatgtggaactatgcaggctcactgagcaggttgttttttctgacccctataaagtatctgaatataaccgttggacttcaccttatcttgaccgtgatgcggagactgtccgggaggataatctattgaagattgaagtagctgaattgaaatctaagttctgtgaaagagctcaggctcttatacatggagatctccatactggttctgtaatggttacccctgattcaactcaggtcatagatccagagtttgcattttatggaccaatgggatttgatattggtgcttttattggaaacttgattctggctttctttgcacaagatggacatgctggtcaagggaatgacagaaaatcatacaaagagtggatattgaagacaattgaggatacttggaatcttttccaccaaaagtttaccgcactatgggatgaacacaaaaatggctctggggaggcttatcttcctgcaatttataacaatcctgagcttcagaaacttatacaggaaaagtatatgaaggaattgttccacgatactcttgggtttggtgctgctaagatgataaggagaattgtaggtgttgctcatgtcgaggattttgaatcaattaaagaagctaacataagagcagatttcgagcaacgggctcttgaattaggcaagacacttctgaagaggaggcgagagtttgtgtcgattagtgaagttatttcagccatgaagcacgtccaatcatgatggaaatgctggaaactgctgtgcacgtatccataaaagcttttgcgcttaaatagatggaaggttttacaggatccataatttaataaagttttcatggtccttgaggcataggcctttgattgtgtgttaatgagcaaaggttgctgtctatctaacattagtgctggaccggacttgtgctgttgcaaaacacgattatgttttgattgtcttgattattctgaatgttgcacttgactttgggcaatgcagattgcatcgtaagttaaatcaatgaagctttcaaatg

SEQ ID NO: 2101 - DNA, 1680 bp, Gossypium raimondii
aacgtttgaagttaagtcacgcctctctcttaaatctctgtacatcgcttcttcacttcttcttaaaacccctcaaaaggactgcctcaaacaaggaaaacaatggcgttttctgagttcaggccactagacgagaactcgctcatcgaatacattaaagccacgccgtctttgtcatcgaagatcgtcgacaactatgatggtttaaagattaaggaagttggagatggcaatcttaatttcgtctacatcatcgttgccccttctggttcttttgtaatcaagcaggcacttccctacgtacgacttattggggaatcttggcccatgactaaggaacgagcatatttcgaagcgttggcgttaaaacaacatggtgcgttatgccctgaacatgttcctgaagtttatcactttgaccgtaccatgtccttgattggaatgcggtatttagagccgccccatataatccttagaaacgggttaattgctgggattgaatatcctttgttggcggaacatatgtcagaatacatggccaagactcttttctgcacatctctcctctatcggtcaaccacagagcacaaacgtgcagtggccgaattttgtgggaatgtggaactatgcaggctcactgagcaggttgttttttctgacccctataaagtatctgaatataaccgttggacttcaccttatcttgaccgtgatgcggagactgtccgggaggataatctattgaagattgaagtagctgaattgaaatctaagttctgtgaaagagctcaggctcttatacatggagatctccatactagttctgtaatggttacccctgattcaactcaggtcatagatccagagtttgcattttatggaccaatgggatttgatattggtgcttttattggaaacttgattctggctttctttgcacaagatggacatgctggtcaagggaatgacagaaaatcatacaaagagtggatattgaagacaattgaggatacttggaatcttttccaccaaaagtttaccgcactatgggatgaacacaaaaatggctctggggaggcttatcttcctgcaatttataacaatcctgagcttcagaaacttatacaggaaaagtatatgaaggaattgttccacgatactcttgggtttggtgctgctaagatgataaggagaattgtaggtgttgctcatgtcgaggattttgaatcaattaaagaagctaacataagagcagattgcgagcaacgggctcttgaattaggcaagacacttctgaagaggaggcgagagtttgtgtcgattagtgaagttatttcagccatgaagcacgtccaatcatgatggaaatgctggaaactgctgtgcacgtatccataaaagcttttgcgcttaaatagatggaaggttttacaggatccataatttaataaagttttcatggtccttgaggcataggcctttgattgtgtgttaatgagcaaaggttgctgtctatctagcattagtgctggaccgaactggtgctgttgcaaaacacccaaaatatattctgccgagtcctatagtttaagtcaaatgaatttttttgtccttgtcctataaagaatggatggctcactttttaaaagctttactacggttagaggcctgagttaagtt

SEQ ID NO: 2102 - DNA, 1590 bp, Theobroma cacao
agacttctctgttgttctttattatttttcttaaacccctccaaagcaccgctagaacaaacagctccgggaacaattaagtgaaaataaaatggcattttctgagttcaggccactaaacgagaagtctctcgtcgaatacataaaagcgacgccgtctttgtcatcgaagatcggggacaagtacgatgatttaaagattaaggaagttggagatggcaatcttaatttcgtctacatcatcgttggcgcttctggttcttttgtcatcaagcaggctcttccttacatacggtgtattggggaatcttggccgatgacaaaggaaagagcatatttcgaagcaatagctttaaaagagcatggtggattgtgccctcaacatgttcctgaagtttatcattttgaccgtaccatgtctttgattggaatgcgttatatagagcctccccatataattctccgaaaagggttgattgctggaattgaatatccattgctggcggaacatatgtcagaatacatggccaagactcttttctgcacatctcttatatatcggtcaaccacagagcacaagcgtgctgtggctgaattttgtgggaatgtggaactatgcaggctcactgagcaggttgttttttctgacccgtataaagtatctgaatataaccgttggacttctccttatctcgatcatgatgccttggctgtccgggaggatgatatattgaagcttgaagtagctgaattgaaatctaagttctgtgaaagagcccaggcccttattcatggagatctccacactggttctatcatggttacccgtgattcaactcaggtcatagatcctgagtttgcattttatggaccaatgggatttgatattggtgcttttattgggaacttgattctggctttctttgcacaagatggacatgctgatcaagtcaatgacagaaaaatatacaaagagtggatattgaagacaattgaggatacttggaatcttttccaccaaaaattcactgctctttgggatcaacacaaggatggctccggggaggcttatcttccagcaatttataacaaccctgagctccagaagcttatacaagaaaaatatatgaaagaattgttccatgacacacttggatttggtgctgctaagatgataaggagaattgttggtgttgcacatgtcgaggattttgaatcaattagagaagctagcataagagcagattgtgagcggcaggctcttgaattagctaagacccttctcaagaagaggcaagaattcctgtcaattggtgaagttatctcagccatcacgcatgcccaattatgatggaaattacctgaaaattgtggtttgctcctggtattagttccctcattaagcatcttcagatttttgtgcttagaccaggccgctctttgctgcagttattccaaatttgtgtgtggtaggccatcatttactctaattttgttcgtgtaaaaccgctgttgttctgcatctgccagctttgcatgatccagaaattacttactgtttataatttaaagttatcatgctttctcgta

SEQ ID NO: 2103 - DNA, 1765 bp, Theobroma cacao
cttttctcttgaatagtccaacgttagtgacgtctctctttcttgtgctttcttctttcttcttcttcttaaacccctcagaagcacagccagaaatgctacaagcaaaaagaagtgaaataaaaaaaaaatggcatttcctgagttcaggccactagacgagaagtctctcgtcgaatacataaaagtgacgccgtttttgtcatcgaagatcggggacaagtacgatgatataaaaattaaggaagttggagatggcaatcttaatttcgtctacatcgtcgttggcgcttctggttcttttgtcattaagcaggcgctaccttacgtacgaagtcttacggaatcttggccgatgacaaaggaaagagcatatttcgaagctgtagcgttaaaagagcatggtggtttgtgccctcgacatgttcctgaagtttatcattttgaccgtaccatgtctttgattggaatgcgatatttagagcctccccatataattctcagaaaagggttgattgctggaatcgaatatccattcctggcggaacatgtgtcagtatatatggccaagactctcttctgcacatctcttttatatcggtcaactacagagcacaaacgtgctgacaacgtagtcatcccaaatgtcatggcactcgaaagaaatgcttctgtattggctgaattttgtgggaatgtggaactatgcagactcactgagcaagttgttttttctgacccgtataaagtgtctgaatataaccgttggacttctccttatctcgatcatgatgccgaggctgtccgggatgatgttatattgaagcttgaagtagctgagttgaaatctaagttttgtgaaagagcccaggcccttattcatggagatctccatacaggttctgtcatggttacccgtgattcaactcaggtcatagatccagagtttgcattttatggaccaatggggtatgatattggcgctttcattgggaacttaattctggctttctttgcacaagatggacatgctgatcaagggaatgacagaaaaatatacaaagagtggatattgaagacaattgaggatacttggaatcttttccaccaaaaattcacagcactttgggatcaacacaaggatggccccggggaggcttatcttccagcaatttacaacaaccctgagcttcaaaagcttatacaagaaaaatatatgaaagaattgttccatgacacacttggatttggtgctgctaagatgataaggagaattgttggtgttgctcatgtcgaggattttgaatcaattaaagaagctagcatacgagcagactgtgagcggcgggctcttgaattagctaagactcttctcaagagaaggcgagaattcctgtcaattagtgaagttatttcagccatcaggcatgtccaatcatgacgtaaaattacctgcaaataatggtttgctcctggtattagttccctcattaagcatcttcagatttttgttctggaccaagccgctcttgctgcagagcccatcaattactctaattttgttcgtgtgaaaccgctgttgttctgcatctggccagctcttgtgctaaatagatgtaatgcttttcatgatccagaaattacttgctgttgtaatttaataaagtcatgctttcttgtatgaaccgggtctatcagttctaatattgatgggttcatctgtgaaccaaatggtgtttcaggttaataaagatttggtaactca

SEQ ID NO: 2104 - DNA, 1552 bp, Fagus grandifolia
ttctttttttatctttcttctccatcaataaaaaaacacattcccttcttcattcttaaacccccagtaatcaatactcacttgtcagtaccacatccagcatttctcacaaatggctttctcagagttcaggccgctcgacgagaagtccctcatcgagtacataaaagccgtgcccgccctcaactctaagctcgggaacaacctcgatgaccttaaggttcaagaggtcggagatggcaacctcaatttcgtctacctcgtcgtcgccccgggcggttctttcgtcatcaagcaggctcttccatacatacgttgtattggggaatcttggccgatgactaaggaaagggcatattttgaggcagtggcactgaaagagcagggtcgattgagtccggagcatgtgcccgaagtttatcattttgatcgtactatgtcgttgattggcatgcgttacttggagcctccgcatataatcctgagaaaaggctttattgctggaattgaatacccattgctggcagaacatatgtcagaattcatggcaaagactctttatttcacatccctcctttatcgttccaccacggagcacaaacgtgatgttgctgaattttgtgggaatgtggagttatgcaggctcactgagcaggttgtcttttctgacccttacaaggtttcccagtataaccgttggacttctcctcatcttgatcgtgatgctgaggctgttcgggaggataatgttttgaagcttgaagttgctgagttgaaatctaagttctgtgagagagcccaggctcttatacatggagatctccacactggttctgtgatggttactcgtgagtcaacacaagttatagatccggaatttgcattttatgggcctatgggttttgacattggagcatttgttggaaacttgattttggctttctttgcacaagatggacatgctgatcaagtgaatgacagaaaaacatataaggagtggattttgaggacaattgaagagacttggaatcttttccacaagaaattcattgcactttgggatgagcacaaggatggttctggtgaggcatatcttcctgcaatatataacaatcctgagcttcagcagcttgtacaaaagaatttatggaagatttattccatgacacccttggatttggtgctgccaaaatgataaggagaattgttggtgtggcacatgttgaggatttggaatcaatcactgatgctagcagacgagcagattgtgaacaccgggctcttgaagtggcaaagttgcttctcaaggaaaggagaaaattccatgccattactgaagttatttcagccattaaaaaattccagtaatgacaaagttttgtaaatcatagtttgcttgaatttcggggttttcggacaagaatttccaaatctatgtttagaaagaactgttactacttatattgtaatgtcaacgttaagacaaagtaataagatacttatttgcttttctggctgttattttggttgcttcactgctgtgaactgtggt

SEQ ID NO: 2105 - DNA, 1568 bp, Citrus clementina
cgccactatttatctgtcaatccactttcatgcctcttttagaagtggcctcttctgctactccttaaaatccccgagctctattaagcgattattcttcacgccccattcactctcatcttgcttaatccccagcgccgaccaatctcacgaccaaacatatggcttttacggagtttcgaccactcgacgataaatctctgctcgagtatattaaagcgacgccgtctttgtcgtctaagattggtaacaagttcgacgacttgacgatcaaagaagtcggagacggcaaccttaatttcgtctacatcgttgtcggcacttctggttctttcgtcatcaagcaggctcttccgtatgtacgttgcattggtgaatcatggcccatgacaaaggaaagagcgtattttgaggcactagcattgaaagagcatggcaaattgtgtcctgaccatgttcccgaagtctatcattttgaccgtacaatgtctttgattggtatgcggtacctggagcctcctcatattatcctgagaaaggggttgattgctggaataaagtatccattacttgcggaacacatgtcagaattcatggcaaagactcttttctacacatctcttttatatcgtaccaccacagagcacaaacgtaatgttgctgaattttgtgggaatgtggagctatgcaggctcacggagcaggttgttttctcggacccctacaaagtatctaagtttaaccattggacttctccttatcttgatcgtgacgctgaggctgttcgggaggataatacattaaagctggaagttgctgggttgaaatccatgttctgtgaaagagcacaagccctgatacatggagatctccacactggctctgttatggtcactcctaattcaactcaggttatagatccagaatttgcattttatggaccaatgggttttgacattggagcttttgttggaaacttgattttggccttttttgcccaagatggacatgctgctgaagggaatgacaggaaagagtataaggagtggattttgaggacaattgaagagacttggactctgttccaccagaagttcactgcactttggcatcaacacaaggatggttctggtgaggcataccttccagaaatttataacaaacctgagcttcagcagcttgtgcaagaaaaatttatgaaagatctattccatgacacccttggatttggtgctgccaaaatgataaggaggattgtcggtgtagcccatgttgaggattttgaatcaattaaggatgatagcaagcgagcaacttgtgagcggcaagctctcgaactggcaaagttgcttctcaaagaaaggcggaatttccaggccatcactgaagtggtctcagcgattcggaagctccatgcgtaaattagtgaattttaatggtttgcttaatatagtaaggtttcatcaaatagttggtttcacactgccgataatattttggttgtcgtcattatgatggcttgttttatgtcacataataataaaaatgttgttaccttttgacctttc

SEQ ID NO: 2106 - DNA, 1597 bp, Quercus alba
gggactctattctcattcctcatccatcatttcaacgaataatcgcaagactcacgcctcttcttttcgaccattcttcccccccacaaaaaaggaaaaacctcgaataacgccaaacactctcacttctcttttttagactaaaaaaaaagccactactttgttcaccactgctcacaaatcacaatggctttcacagagttcaggcctctggacgagaagtctctgatcgagtacataaaaaccgtgcccgctctgcactctaagctcgggaacaacctcgacgacatcaaggttaaggaggtcggagatggcaaccttaatttcgtcttcatcatcgttggccctgatggttctttcgtcatcaagcaggctcttccgtacatacgttgtataggggaatcatggccgatgactaaggaaagggcatattttgaggcggtggcactgagagaggaagctcgcttgagtcctgagcatgtccctgaagtttatcattttgatcgtactatgtctttgattggcatgcgttacttagagcctccgcatataattctgaggaaagggttgattgccggaattgaataccccttgctggcagaacacatttcagaattcatggcaaggacactttatttcacatccctccttcatcgttccaccacggagcacaaacgtgctgttgccgaattttgtgggaatgtggaattatgcaggctcactgagcaggttgttttttctgacccttacaaagtttctgagtataaccgttggacttccccttttcttgatcttgaagctgaggctattcgaaaggacaatattttgaagcttgaggttgcagaattgaaatctaagttctgtgagagagcccaggctcttatacatggagatctccacactggttctgtaatggttactcgtgagtcaactcaagttatagatccagaatttgcattttatgggcctatgggttttgacattggagcatttcttggaaacttgattttggctttctttgcacaagatggacatgctgatcaagcgaatgacagaaaaacatataaggagtggattttgaggacaattgaagagacttggaatcttttccgcaagaaattcattgcactttgggatgagcacaaggatggttctggtgaggcatatcttcctgcaatatataacaatcctgagcttcagcagcttgtacaagagaaatttatggatgatctgttccatgacacccttggatttggtgctgccaaaatgataaggagaattgttggtgtggcacatgttgaggattttgaatcaatcactgatgctagcagacgagcagattgtgaactccgggcccttgaagtggcaaagttgcttctcaaggaaaggagaaaattccatgccattactgaagttatttcagccatgcaaaaattccagtcataactaagtttttggtaaaatgatagtttgcttgaatgttggggttttccagacaagaatttccagatatttgtagaatgaattgttactatgtgtattgtaatgtcaacattaagacaaagtaataagatttcctttttttgctgttattttg

SEQ ID NO: 2107 - DNA, 1695 bp, Manihot esculenta
ataggtcacgcctccaatttagtcaatgccaatgcttgttaaaatccttctaccgccttaaaatcaccgcagccaccactagcaccaccggaagcaccaccgatagttatggcgttctcagagtttaggccacttgatgagaaatctttgattgagtacatcaaggccacgcctgtattgtccaacaaggttggcagaaattacgatgacttgaaaatcaaagaagttggagatgggaatctcaattttgtttacattgttgtcggctccgctggctcttttgtcatcaagcaggcccttccttacatacgttgtattggagaatcatggcccatgactaaggaaagagcctattttgaggctttggcacttaaagtgcatggtcagttgtgccctgaacatgttcctgaagtttatcattttgaccgtaccatgtctttgattggtatgcgatacttggagcctccccatattatcctaagaaaaggattaattgctggaatcaagtatccttatctagcagaacatatgtcaacttacatgtcaaagactcttttttacacatcccttttgtatcgtaccaccactgagcataaacgtgatgttgctgagttctgtgggaatgtggagttatgcaggcttacagagcaagttattttttctgatccatataaagtatctcaatacaaccattggacttccccttaccttgatcgtgatgctgaggctgtacgtgaggataatgtcttaaagcttgaaattgctgaattgaaatccaagttctgtgaaagagcccaagccttaatacatggagatcttcacactggttctgtcatggttacttccgactcaactcaggttatagatccagaatttgcattttatggaccaatgggttttgatgtgggtgctttcattggaaacttatttttggcttactttgctcaagatggccatgctgattcatttgatgaccgaagatcatataaagaatggattttgaggatgactgagggcacatggaatctttttcacaaaaaattcacagcattttgggacaagcacaaggatggacctggtgaggcatatcttccagcaatatataacaaccctgagcttcagcagattgtacaggaaaaattcatgaaagatttgttccatgacacccttggatttggtgcagccaaaatgatacggagaattgttggtgtagcacatgttgaggattttgaatcaattaaagatgatagcaaacgagctgaatgtgagcgcaaggccctcgattttgcaaaactgcttcttaaggaaaggcggcgattccagtccatcaatgaagtggtgtcagccattcctgcataggattcatgacaaacttatgggtaaaatgttatactctgttactgattctggttctgaatacagccttttccagtccatgctctacgcttctcttcaggagaaaattacttgaattaacttcactatcatgtcagtatttctaagaaataatacttgctctttcaatcagtgatccaatgcttctggctttcttctgtgtttattcccactgttacattatagacgataatgagccaaaaaatattatctaaccagttgtatatccgttctattttggagctaacgactgtttgtttcatagaaaatattttagtaaaatatttttcacaatttttc

SEQ ID NO: 2108 - DNA, 1554 bp, Castanea mollissima
caacaaacaatcgcaagactcacgcctcttcttttcgaccattcttccacccacaaaaaagaaaaacctcgaataacaacaaacacttcaacttctcttttttagtactaaaaaaaaaaccaactactttcttcaccactgctcacaaatcacaatggctttcacagagttcaggcctctggacgagaagtcgctgatcgagtacataaaaaccgtgcccgccctgcactctaggctcgggaacaacctcgacgacatcaagattaaggaggtcggagatggcaaccttaatttcgtctacatcatcgttggccctgatggttctttcgtcatcaagcaggctcttccgtacatacgttgtataggggaatcatggccgatgactaaggaaagggcatattttgaggcggtggcactgagagagcaagctcgcttgagtcctgagcatgtccctgaagtttatcattttgatcgtactatgtctttgattggcatgcgttacttagagcctccacatataattctgaggaaagggttgattgccggaattgaataccccttgctggcagaacacatttcagaattcatggcaaggacactttatttcacatccctccttcatcgttccacaacggagcacaaacgtgctgttgccgaattttgtgggaatgtggaattatgcaggctcactgagcaggttgttttttctgacccttacaaagtttctgagtataaccgttggacatccccttttcttgatcttgaagctgaggctgttcgaaaggacaatattttgaagcttgaggttgcagaattgaaatctaagttctgtgagagagcccaggctcttatacatggagatctccacactggttctgtaatggttactcgtgagtcaactcaagttatagatccggaatttgcattttatgggcctatgggttttgacgttggagcatttcttggaaacttgattttggctttctttgcacaagatggccatgctgatcaagcgtatgacagaaaaacatataaggcgtggattttgaggacaattgaagagacttggaatcttttccgcaagaaattcattgcactttgggatgagcacaaggatggttctggtgaggcatatcttcctgcaatatataacaatcctgagcttcagctgcttgtacaagagaaatttatggacgatctgttccatgacacccttggatttggtgctgccaaaatgataaggagaattgttggtgtggcacatgttgaggattttgaatcaatcactgatgctagcagacgagcagattgtgaactccgagccctcgaagtggcaaagttgcttctcaaggaaaggagaaaattccatgccattactgaagttatttcagccattcaaaaattctagtcatgactatgtttttggtaaatgatagtttgcttgaatattggggttttccagacaagaatttccagatatttgtagaatgaactgttactatgtgtattgtaatgtcaactttaactcaaagtaataagatttccttttttgct

SEQ ID NO: 2109 - DNA, 1352 bp, Fagus grandifolia
cccagtaatcaatactcacttgtcatgtcagtaccacatccagcatttctcacaaatggctttctcagagttcaggccgctcgacgagaagtccctcatcgagtacataaaagccgtgcccgccctctactctaagctcgggaacaacctcgatgaccttaaggttcaagaggtcggagatggcaacctcaatttcgtctacatcgtcgtcgcccccggcggttctttcgtcatcaagcaggctcttccatacatacgttgtattggggaatcttggccgatgactaaggaaagggcgtattttgaggcagtggcactgaaagagcagggtcgattgagtccggagcatgtgcccgaagtttatcattttgatcgtactatgtcgttgattggcatgcgttacttggagcctccgcatataatcctgagaaaaggctttattgctggaattgaatacccattgctggcagaacatatgtcagaattcatggcaaagactctttatttcacatccctcctttatcgttccaccacggagcacaaacgtgatgttgctgaattttgtgggaatgtggagttatgcagtcacactgcgcaggttgtcttttctgacccttacaggtttcccagtataaccgttgacttctcctcatcttgatcgtgatgctgaggctgttcgggaggataatgttttgaagcttgaagttgctgagttgaaatctaagttctgtgagagagcccaggcttttatacatggagatctccacactggttctgtgatggttactcgtgagtcaacacaagttatggatccggaatttgcattttatgggcctatgggttttgacattggagcatttgttggaaacttgattttggctttctttgcacaagatggacatgctgatcaagtgaatgacagaaaaacatataaggagtggattttgaggacaattgaagagacttggaatcttttccacaagaaattcattgcactttgggatgagcacaaggatggttctggtgaggcatatcttcctgcaatatataacaatcctgagcttcagcagcttgtacaaaagaatttatggaagatttattccatgacacccttggatttggtgctgccaaaatgataaggagaattgttggtgtggcacatgttgaggatttggaatcaatcactgatgccagcagacgagcagattgtgaacaccgggctcttgaagcggcaaagttgcttctcaaggaaaggagaaaattccatgccattactgaagttatttcagccattagaaattccagtaatgacagtttgtaatcatagtttgcttgaatttcagggttttccg

SEQ ID NO: 2110 - DNA, 1646 bp, Cajanus cajan
gagacatcgtgttagaaaaatcaaattctagtaaccaaatttttagcgtatttcctccgaaagcaaaagaaaaacgcactacaagaagagcacaaacattggtcactcccactcccactccctcttgggcaccgtcgctggccacgatgacgttctcggagttccgaccactcgacgagaagtccctcatcgaatacatcaagtccgtcccctccctctcctccaaactcgccgacaacttcgaccacttatccatcaaagaagtcggagatggcaaccttaacttcgtcttcattgtttccaactccgcaggttcttttgtcatcaaacaggctctgccgtacgttcgttgcataggggaatcgtggcctatgacgaaggagagagcgtattttgagtcactggcactgaaagaagagggtcgtttgagtcccgaacatgttcctgaagtgtatcactttgaccgtaccatgtctttgatcggtatgcggtacttggagcccccacacataatcctccgaaaagggttgattgctgggattgagtaccctcttttggctgatcacatggctgatttcatggcaaagacactcttctttacgtctctgcttttccgttccactactgaccacaaacgagacgttgccgaatattgtgggaatgtggagttatgcaggctcactgagcaggtcgttttctctgacccttataaagtttctcaatataatcgttggacatccccctttctcgacagtgatgctgaggctgttcgggaagataatctgctgaagcttgaagttgctgagctgaaatccaagttctgcgagagggcacaagcactaatacatggagatttacacaccggttctgtgatggttactcgcgaatcaactcaagttattgatccagaatttgcattttatggaccaatgggttttgatattggagcattcttgggaaacttgattttggctttctttgctcaagatggacatgctgatcaagcaaatgatcgaaaagcctataaggagtggattctcaagacaattgaagacagttggaatcttttccaccaaaaattcacttcactttgggatgagcacagaaatggtgttggtgaagcatatcttccagcaatctataacaatcctgaggttcaactgcttgttcagaagaaatacatgacagatttgtttcatgatagtcttggatttggcgcagctaaaatgataaggagaattgtcggtgtggcacatgttgaggatttcgaatccattactgatgctggtaaaagggcaacttgtgaacgacgagcacttgatttagctaagatgcttctcaaagaaagaagaaaatttgaaggcattgctgaaattatttcagcaattaggcaattctagccataactacaagtttttgctatatcaatagttcaatacgtccttaatgtatcgtgtgcactactagataattgtttccttgtcaacattatgtatggaaaattatatacatttttctgtttcttctatccgggacagtttttgctttctaattaatagtttaatactatacatcggccaataattattggatgctgcggaagaacatgagttagaaaaatataaaaacaagtttgagagtcgttt

SEQ ID NO: 2111 - DNA, 1668 bp, Glycine max
cacttttacatttaacactaattcaaaacatagatttcaatttattttcttttcatttttctcatcaataattttaatctgttatctttctcaaaagaataaaaaatgacactagacatgaagaatcaaaatcctgttaaaaaattcacgaatttgttagcgtctctcctccaaatggaatagaaaaacgcactaaagattccatccatttggaacttgggagagtagagtaccattgctccactgtcgccggccaccatgtctttctcggagttccgaccactcgacgacacgtccctcatcgaatacataaagtccgtccccgccctctcctccaaactcgccgacaacctcgacgacttatcagtcaaagaagtcggagatggcaatcttaacttcgtcttcattgtttccaaccccgcaggttcttttgtcatcaaacaggctctgccgtacgttcgttgcataggggaatcgtggcctatgacgaaggagagagcgtattttgagtcgctggcactgaaagaagagggtcgtttaatccccgaacatgttcctgaagtgtatcactttgaccgtaccatgtctttgatcggtatgcgttacttggagcccccacatataatcctcagaaaagggttgattgctgggattgagtacccttttttggctgaacacatggctgatttcatggcgaagacactcttcttcacgtctctgcttttccgttccactgctgaccacaaacgggacgttgccgaattttgtgggaatgtggagttatgcaggctcactgaacaggtcgttttctctgacccttataaagtttctcaatataatcgttgtacttccccctatcttgatcgtgatgctgaggctgttcgggaagacaatctgctgaagcttgaagttgctgagctgaaatccaagttcattgagagggcccaggcactaatacatggagatctacacactggttctgtgatggttactcgtgaatcaactcaagttattgatccagaatttgcattttatggaccaatgggttttgatattggagcattcttgggaaacttgattttggctttctttgctcaagatgggcatgctgatcaagcaaatgatcgaaaatcctataaggagtggattcttaagacgattgaagacagttggaatcttttctataaaaaattcacttcactttgggatgagcacaaagacggtgctggtgaagcatatcttccagcaatctataacaatcctgaggttcaactgcttgtacagaagaaatacatgacagatttgtttcacgacagtcttggatttggtgctgctaaaatgattaggagaattgttggtgtggcacatgttgaggatttcgaatccattgctgatgctgctaaacgggctagttgtgaacggcgggcacttgatttagctaagatgcttctcaaagaaagaagaaaatttgaaggcattgctgaaattatttcagcaattcggcaatactagctataacaaggttttgctatatcaacagttccatacctccgtaacgtatcgtgcttcccaacattttggctgtgtgtacgtaccaatagataacagttttcctgtcaacattatgatgacaaattatatttatatatctctgtttcttctatctgg

SEQ ID NO: 2112 - DNA, 1825 bp, Glycine max
cacttttacatttaacactaattcaaaacatagatttcaatttattttcttttcatttttctcatcaataattttaatctgttatctttctcaaaagaataaaaaatgacactagacatgaagaatcaaaatcctgttaaaaaattcacgaatttgttagcgtctctcctccaaatggaatagaaaaacgcactaaagattccatccatttggaacttgggagagtagagtaccattgctccactgtcgccggccaccatgtctttctcggagttccgaccactcgacgacacgtccctcatcgaatacataaagtccgtccccgccctctcctccaaactcgccgacaacctcgacgacttatcagtcaaagaagtcggagatggcaatcttaacttcgtcttcattgtttccaaccccgcaggttcttttgtcatcaaacaggctctgccgtacgttcgttgcataggggaatcgtggcctatgacgaaggagagagcgtattttgagtcgctggcactgaaagaagagggtcgtttaatccccgaacatgttcctgaagtgtatcactttgaccgtaccatgtctttgatcggtatgcgttacttggagcccccacatataatcctcagaaaagggttgattgctgggattgagtacccttttttggctgaacacatggctgatttcatggcgaagacactcttcttcacgtctctgcttttccgttccactgctgaccacaaacgggacgttgccgaattttgtgggaatgtggagttatgcaggctcactgaacaggtcgttttctctgacccttataaagtttctcaatataatcgttgtacttccccctatcttgatcgtgatgctgaggctgttcgggaagacaatctgctgaagcttgaagttgctgagctgaaatccaagttcattgagagggcccaggcactaatacatggagatctacacactggttctgtgatggttactcgtgaatcaactcaagttattgatccagaatttgcattttatggaccaatgggttttgatattggagcattcttgggaaacttgattttggctttctttgctcaagatgggcatgctgatcaagcaaatgatcgaaaatcctataaggagtggattcttaagacgattgaagacagttggaatcttttctataaaaaattcacttcactttgggatgagcacaaagacggtgctggtgaagcatatcttccagcaatctataacaatcctgaggttcaactgcttgtacagaagaaatacatgacagatttgtttcacgacagtcttggatttggtgctgctaaaatgattaggagaattgttggtgtggcacatgttgaggatttcgaatccattgctgatgctgctaaacgggctagttgtgaacggcgggcacttgatttagctaagatgcttctcaaagaaagaagaaaatttgaaggcattgctgaaattatttcagcaattcggcaatactagctataacaaggttttgctatatcaacagttccatacctccgtaacgtatcgtgcttcccaacattttggctgtgtgtacgtaccaatagataacagttttcctgtcaacattatgatgacaaattatatttatatatctctgtttcttctatctgggagttgctctagcaacagtttttattactttttaattaatatccatcctgataacatttctcttacaaacatctctgtgtggaccatcttaaaaattatatccaccgtgatttttgaataatttttatattgactgtataaatatttttttgtgtaa

SEQ ID NO: 2113 - DNA, 1285 bp, Manihot esculenta
tgccaccaccctcaatcattatggctttctcagagtttaggccacttgatgaacaatctctgatcgagtacatcaaggccacgcctgtattatccgctaagattggcaaaaattacgatgacttgaaaatcaaagaagttggagatgggaatctcaactttgtgtacatcgttgttggttcagctggctcttttgtcatgaagcaggctcttccttatgtccgtagtattggagaatcatggcccatgactaaggaaagatcctattttgaggctctggcacttaaagagcatggtcagttgtgccctgaacatgtccctgaagtttatcattttgatcgtactatgtctttgattggcatgcgatatttggagcctccacatattatcctaaggaaagggttggttgctggaattgagtatccttatctggctgaacacatgtcagattacatgtcgagaactcttttttacacatcccttttgtatcgtaccaccactcagcacaagcatgatgttgctgaattctgtgggaatgtggggctgtgcaggcttactgagcaagttattttttctgatccatacaaagtttctcaatataaccactggacttctccttaccttgatgatgatgctgaggctgtccgtgaggataatattttaaagcttgaaattgctgaattgaaatccaagttctgtgaaagagcccaagccttaatacatggagatcttcacactagttctgtcatggttactccttattcaacacaagttatagatccagaatttgcattttatggaccaatgggttttgatttgggagcttttattggaaacttgattttggcatactttgctcaagatggccatgctgatccagcaaatgacagaaaatcatataaagagtggattctgaggacgattgaagattcatggaatcttttcaacaaaaaattcactgcactttggaatgagcacaaggatggacctggtgaagcatatcttccagcaatttataacaatcctgagcttcagcagcttgtgcagcaaaaattcatgaaagatttgttccatgacaccctcggatttggtgcagccaaaattattcggagaatttttggtgtagcccatgttgaggattttgagtcaattaaagaagcaagcaaacgagctgaatgtgagcggcaggctctcaagtttgcaaaactacttctgaaggaaaggaggggattccagtccattaatgatgttgtgtcagccattagggcataggattcatggcaaaa

SEQ ID NO: 2114 - DNA, 1645 bp, Quercus alba
atgggggtggttcacgggttttgtggatgtcttatgagtatgagtagggaatggaatagtcggatgagacaccatatcaaaagaagtcgtcctactctcattagtgactagtctcatctcactcttcatttgattcattttgcgtttccaccaatagtgattcaacctcttcttttttatatcatattcattgctgctcaaaatggctttcactgagttcaggcctctggatgagaagtccctgattgagtacataaagaccgtgccctctctctactctaagctcggcagcgacctcaaggttaaagaggtcggagatggcaacctcaattttgtctacatcgtagtcagccatgccggatctttcgtcatcaagcaggctcttccatacatgcgttgtataggggaatcttggccaatgactaaggaacgggcatattttgaggcagtggcattgagagagctgggtcgattgaatcctgagcatgtgcctgaagtttatcattttgatcagactatgtctttgattggcatgcgttatttggagcctccacatattatagtgagaaaagggttgattgctggaattgaataccccttgctggcagaacacatgtcagaattcatggcgaggacactttatttcacatccctcctttatcgttccaccacggagcacaaacgtgcagttgctgagttttgtgggaacgtggagttatgcaggctcactgagcaggttgttttttctgacccttacaaggtttctcagtataaccattggacttccccttatcttgatcgtgatgctgaggctcttcgagaggataatgttttgaagcttgaagttgctgagttgaaatctaaattctgtgagagagcccaggctcttctacatggagatctccacactagttctatcatggttactcaagagtcaactcaagttttagatccggaatttgcattttatgggcctatgggttttgatattggagcatttcttggaaacttgattttggctttctttgcacaaaatggacatgctgatcaagtgaatgacagaaaaacatacaaggagtggatattgaggacaattgaagatacttggaatcttttccacaagaaattcattgcactttgggatgagcacaagggtggttctggtgaggcatatcttcctgcaatatataacaatcctgagcttcagcagcttgtacaaaagaaatttatggaagatttgttccatgacacacttggatttagtgctgccaaaatgataaggagaattgttggtgttgcacatgttgaggattttgaatcaatcactgatgctagtagacgagcagattgtgaacgccgggctcttgaagtggcaaagttgcttcttaaggaaaggagaaaatttcatgccattactgaagttatttcaaccattcaaaaactccagtcataactaagttattggtaaatcatagtttgcttgaatattggggttttgcggacaagattttccagatcctttgtaaatgaacttttaccatgtgtgttgtaatgtcaacattaagacaaaggaataagatttccttttattgctgttgttttgattgctttaatgctgtgaactgcgattgcagaaggtccttgc

SEQ ID NO: 2115 - DNA, 1601 bp, Populus trichocarpa
gaccagattcaatgaaccacaatacagttcgcgaagtcccgcaaatcttaccataatgtccaccatgtatcacgcctcctcgtcctgaagtctaatctctccctccttaaaaccctcactgccaccaccgtccaccagatcaatatcggtataaaaatggcattcacagagttcaggccactggacgagaaatatttagtggagtacattaaggccactcctgctttgtcagataagatcggcaacaatttcgacgacttgaagatcaaagaagttggcgatggaaatctcaatttcgtctacatcgttgttagcccagctggttcttttgtcatcaagcaggcaattccatacatacgttgtattggagaatcatggccaatgactaaggaaagagcatactttgaggctttgacacttagagagcatggccgattgagccctgaaaatgtgcctgaagtttatcattttgaccgtattatgtctgtgattggtatgcgatatttggagcccccacatataatcctgagaaaagggttggttgctggaattgagtatccattgctagcagaacacatatcagattatatggcaaagactctttaccacacatcgcttctttatcatactaccactgagcataaacacaacgttgctgaattctgtgggaacgtggagttatgcaggcttactgagcaggttgttttctctgacccttacaaagtatccgaatataaccgctggacttccccttatcttgatcgtgatgctgaggctgtccgtgaagataatattttaaagcttgaagttgctgagttgaaatccaagttttgtgagagagcccaagccttagtacatggagatctccacactggatccatcatggttacccatgaatctactcaagttatagatccagaatttgcattttatggtccaatgggttttgatattggagcttttattggaaacttgatattggctttttatgctcaagatggacacgctgatcaagggaatgaccgaaaaacatataaagagtggattttgaggacaattaaagagacctggagtcttttctacaagaagttcactgcactgtgggacgagcacaaggatggctctggtgaggcttatcttccaggaatttataataaccctgagcttcatcagcttgtacagagaaaattcatgcaagacttgttccatgacaccttgggatttggtgcggccaaaatgataaggagaattgttggtgtagctcatgtggaggattttgaatcaattcctgacgctagcaaacgagcccaatgtgagcggctggctcttgacctggcgaagatgcttctcaaggaaaggcgaaaattccagtccatagatgaagttgtatcagccattcagcaactgcagtgatgacatacttaggggtaaaaatttgcttcaaatgttggagctttgtgtgacctatcttcacattttcctcgtagtaaaacttattaaactgtaaacttatcagactgtcagtttcctcttgaaagatggaaataaatatctaatgtttttgtcccctgtaagagtcttttacaattttcttcactctt

SEQ ID NO: 2116 - DNA, 1434 bp, Mimulus guttatus
ttataaaccctttccgccctcctccgccgccgtagaaccgccagcaaaatgtcttccgacggattccgaccgctggacgagaagtcattggtggagtacttgaaggcaactccgtccctctccgtgaaactcggcgaccagttcgataagcttgaaatcaaagaagtcggcgatggaaacctcaacttcgtttacattgttatcggccaatctggatccttcgtcatcaaacaggcccttccatacattcgctgtatcggagaatcatggccgatgacaaaagaacgtgcctatttcgaagcatctactttagaagagcacggccgactatgtccggatcatgttcccgaggtttaccatttcgaccggaaaatgtgtttgatcggcatgcggtacattaagccacctcatataattctaagaaaaggattgatatctgggattgagtatccgttacttgcggaacatatgtcggaatatatggcccggacgctgttttttacttccctgctttatttgaccactacggagcataaaagtgcagttgctaaattttgcgggaatgtggagttatgcagacttaccgaacaggttgtcttttccgacccctacaaagtgtctgaatacaaccattggacatctccttaccttgacgctgatgccgaggcagttcgagaggataaccttttgaaacttgaaatcgctgagctaaaatccaaattctgtgagagagcccaagctcttatacacggtgatctccatacaggttcggtcatggttaccactgagtcaactcaagtgatcgaccctgaattttctttctacggaccaatgggatttgatattggagcttttattggaaatctgattttagcttatttttcacaagatggacatgctgagaaggacgctgatcgtaaactatacaaagagtggattttgaagacaatatcggatacttggaatctcttctacgaaaagttcacggctctttgggatcaacacaaggatgggcccggcgaagcttatcttgcagcaatttataataattcggaactccaattgctcgttaaacaaaaatacatggacgatcttttccatgatactcttggatttggtgctgcaaaaatgataaggagaattgtcggagtggctcatgtggaagatttcgaatcaatcaaggaagccgacaaacgtgcagaatgcgaacgcaaggctctaaacctcgctaaaaccctcctcaaagataggaaaacgttccacaatataagtgaagtcatttctgcaattaagcatctcgacaaataataaaatcttcgtcacttattttctgcaaatttcatttgcatatgatataatttatataataatgcattgaagttactctcgaatttcgtattactctagtatttatacgaaactccattacatcaa

SEQ ID NO: 2117 - DNA, 1491 bp, Mimulus guttatus
aacgttattcatgcctgaatacccaacttactatttataaaccctttccgccctcctccgccgccgtagaaccgccagcaaaatgtcttccgacggattccgaccgctggacgagaagtcattggtggagtacttgaaggcaactccgtccctctccgtgaaactcggcgaccagttcgataagcttgaaatcaaagaagtcggcgatggaaacctcaacttcgtttacattgttatcggccaatctggatccttcgtcatcaaacaggcccttccatacattcgctgtatcggagaatcatggccgatgacaaaagaacgtgcctatttcgaagcatctactttagaagagcacggccgactatgtccggatcatgttcccgaggtttaccatttcgaccggaaaatgtgtttgatcggcatgcggtacattaagccacctcatataattctaagaaaaggattgatatctgggattgagtatccgttacttgcggaacatatgtcggaatatatggcccggacgctgttttttacttccctgctttatttgaccactacggagcataaaagtgcagttgctaaattttgcgggaatgtggagttatgcagacttaccgaacaggttgtcttttccgacccctacaaagtgtctgaatacaaccattggacatctccttaccttgacgctgatgccgaggcagttcgagaggataaccttttgaaacttgaaatcgctgagctaaaatccaaattctgtgagagagcccaagctcttatacacggtgatctccatacaggttcggtcatggttaccactgagtcaactcaagtgatcgaccctgaattttctttctacggaccaatgggatttgatattggagcttttattggaaatctgattttagcttatttttcacaagatggacatgctgagaaggacgctgatcgtaaactatacaaagagtggattttgaagacaatatcggatacttggaatctcttctacgaaaagttcacggctctttgggatcaacacaaggatgggcccggcgaagcttatcttgcagcaatttataataattcggaactccaattgctcgttaaacaaaaatacatggacgatcttttccatgatactcttggatttggtgctgcaaaaatgataaggagaattgtcggagtggctcatgtggaagatttcgaatcaatcaaggaagccgacaaacgtgcagaatgcgaacgcaaggctctaaacctcgctaaaaccctcctcaaagataggaaaacgttccacaatataagtgaagtcatttctgcaattaagcatctcgacaaataataaaatcttcgtcacttattttctgcaaatttcatttgcatatgatataatttatataataatgcattgaagttactctcgaatttcgtattactctagtatttatacgaaactccattacatcaatttattatttttcccatacttgg

SEQ ID NO: 2118 - DNA, 1513 bp, Populus trichocarpa
acgcctcctcgtcctaaagtctaatctctccctccttaaaaccctcactgccaccaccgtccaccagatcaatatcggtataaaaatggtattcacagagttcaggccactggacgagaaatatttagtggagtacattaaggccactcctgctttgtcagataagatcggcaacaatttcgacgacttgaagatcaaagaagttggcgatggaaatctcaatttcgtctacatcgttgttagcccagctggttcttttgtcatcaagcaggcaattccatacatacgttgtattggagaatcatggccaatgactaaggaaagagcatactttgaggcattgacacttagagagcatggccgatggagccctgaaaatgtgcctgaagtttatcattttgaccgtattatgtctgtgattggtatgcgatatttggagcccccacatataatcctgagaaaagggttggttgctggaattgagtatccattgctagcagaacacatatcagattatatggcaaagactctttaccacacatcgcttctttttcatactaccactgagcataaacacaacgttgctgaattctgtgggaacgtggagttatgcaggcttactgagcaggttgttttctctgacccttacaaagtatccgaatataaccgctggacttccccttatcttgatcgtgatgctgaggctgtccgtgaagataatattttaaagcttgaagttgctgagttgaaatccaagttttgtgagagagcccaagccttagtacatggagatctccacactggatccgtcatggttacccatgaatctactcaagttatagatccagaatttgcattttatggtcccatgggttttgatattggagcttttattggaaacttgatattggctttttttgctcaagatggacacgctgatcaagggaatgaccgaaaaacatataaagagtggattttgaggacaattaaagagacctggagtcttttctacaagaagttcactgcactgtgggacgagcacaaggatggctctggtgaggcatatcttccaggaatttataataaccctgagcttcatcagcttgtacagagaaaattcatgcaagacttgttccatgacaccttgggatttggtgcggccaaaatgataaggagaattgttggtgtagctcatgtggaggattttgaatcaattcctgacgctagcaaacgagcccaatgtgagcggccggctcttgacctggcgaagatgcttatcaaggaaaggcgaaaattccagtccatagatgaagttgtatcagccattcagcaactgcagtgatgacatacttaggggtaaaaatttgcttcaaatgttggagctttgtgtaacctatcttcacattttcctcgtagtaaaacttattaaactgtaaacttatcagactgtcagtttcctcttgaaagatggaaataaatatctaatgtttttgtcccctgtaagagtctttta

SEQ ID NO: 2119 - DNA, 1613 bp, Glycine max
aaaattcctgttaccgtaaaaaaaaaaaaagaattcccaggaatttgttagcgtctctctactccaaatggaatagaaaaaacgcacgaaagattccatccatttgcgacttgggagagagtaccattgctccactccctctccctcttcgccggcggccaccatgtctttgtcggagttccgaccactcgacgacaagttcctcatcgaatacataaagtccgtccccgccctctcctccaaactcgccgacaacttcgacgacttatctgtcaaagaagtcggagatggcaaccttaacttcgtcttcattgtttccaaccccgcaggttcttttgtcatcaaacaggctctgccatacgttcgttgcataggggaatcgtggcctatgacgaaggagagagcgtattttgagtcactggcactgaaagaagagggtcgtttgagccccgaacatgttcctgaagtatatcactttgaccgtaccatgtctttgattggtatgcgttacttggagcctccacatataatcctcagaaaagggttgattgctgggattgagtaccctcttttggctcaacacatggctgatttcatggcaaagacactcttcttcacgtctctgcttttccgttccacatctgaccacaaacgagacgttgccgaattttgtgggaatgtggagttatgcaggctcactgagcaggttgttttctccgacccttataaagtttctcaatataatcgttggacttccccctatctcgatcgtgatgctgaggcagttcgggaagacaatccgctgaagcttgaagttgctgagctgaaatctaagttcattgagagggcccaggcactaatacatggagatctacacactggttctgtgatggttacccgtgaatcaactcaagttattgatccagaatttgcattttatggaccaatgggttttgatattggagcattcttgggaaacttgattttggctttctttgctcaagatgggcatgctgatcaagcaaatgatcgaaaagcctataaggagtggattcttaagacaatcgaagacagttggaatcttttctatcaaaaattcacttcactttgggatgagcacaaaaatggtgctggtgaagcatatcttccaacaatctataacaatcctgaggttcaactgcttgtacagaagaaatacatgacagatttgtttcacgacagtcttggatttggtgctgctaaaattattaggagaattgttggtgtggcacatgttgaggatttcgaatccattactgatgctgctaaacgggcaagttgtgaacggcgggcacttgatttagctaagatgcttctcaaagaaagaagaaaatttgaaggcattgctgaaattatttcagcaattcggcaatactagccataacaaggttttgctatatcaatagttcaatacctccgtaatgtatcgtgttccccaacattttaactgagttgctctagtaacagttttgatcactttctaattatattatccatactgataacatttctcttgtggaccatcttaaaatttatatccaccgtgatttttgaatgatttttatattgactgc

SEQ ID NO: 2120 - DNA, 1819 bp, Glycine max
ccccaagtattagtactggtatttcatttttgtgaatgaatccctaagtaatagaagtatgcaacaccaatttttaattttctcatcaataatttaatctgttacctttctcaaaaataaaataaaataattgaccctagacatgaagaataaaattcctgttaccgtaaaaaaaaaaaaagaattcccaggaatttgttagcgtctctctactccaaatggaatagaaaaaacgcacgaaagattccatccatttgcgacttgggagagagtaccattgctccactccctctccctcttcgccggcggccaccatgtctttgtcggagttccgaccactcgacgacaagttcctcatcgaatacataaagtccgtccccgccctctcctccaaactcgccgacaacttcgacgacttatctgtcaaagaagtcggagatggcaaccttaacttcgtcttcattgtttccaaccccgcaggttcttttgtcatcaaacaggctctgccatacgttcgttgcataggggaatcgtggcctatgacgaaggagagagcgtattttgagtcactggcactgaaagaagagggtcgtttgagccccgaacatgttcctgaagtatatcactttgaccgtaccatgtctttgattggtatgcgttacttggagcctccacatataatcctcagaaaagggttgattgctgggattgagtaccctcttttggctcaacacatggctgatttcatggcaaagacactcttcttcacgtctctgcttttccgttccacatctgaccacaaacgagacgttgccgaattttgtgggaatgtggagttatgcaggctcactgagcaggttgttttctccgacccttataaagtttctcaatataatcgttggacttccccctatctcgatcgtgatgctgaggcagttcgggaagacaatccgctgaagcttgaagttgctgagctgaaatctaagttcattgagagggcccaggcactaatacatggagatctacacactggttctgtgatggttacccgtgaatcaactcaagttattgatccagaatttgcattttatggaccaatgggttttgatattggagcattcttgggaaacttgattttggctttctttgctcaagatgggcatgctgatcaagcaaatgatcgaaaagcctataaggagtggattcttaagacaatcgaagacagttggaatcttttctatcaaaaattcacttcactttgggatgagcacaaaaatggtgctggtgaagcatatcttccaacaatctataacaatcctgaggttcaactgcttgtacagaagaaatacatgacagatttgtttcacgacagtcttggatttggtgctgctaaaattattaggagaattgttggtgtggcacatgttgaggatttcgaatccattactgatgctgctaaacgggcaagttgtgaacggcgggcacttgatttagctaagatgcttctcaaagaaagaagaaaatttgaaggcattgctgaaattatttcagcaattcggcaatactagccataacaaggttttgctatatcaatagttcaatacctccgtaatgtatcgtgttccccaacattttaactgagttgctctagtaacagttttgatcactttctaattatattatccatactgataacatttctcttgtggaccatcttaaaatttatatccaccgtgatttttgaatgatttttatattgactgcatactattgtttttggtgtacacagtatgtagaaatccaactccataaaaattac

SEQ ID NO: 2121 - DNA, 1546 bp, Citrullus lanatus
gttcaatttctcattcgattattccaataatcgtccagattcaatgtccctctcctccgattggctcccctaaatgttcatttcctcccacattccattatcagtcaagaattttggctgatgaagtagagatttcacccttcacttcttagttcttactttattagaccccaaagcaaatcccgccggagctccccactctcccccgttcctaatggccttctctgaattccgtcccctcaacgagagctccttgattgagtacattaagactgttccttcgttgtccgacaagctcggtaataaattcgatgacattaagattaaggaagtcggagatggcaaccttaatttcgtttacatagttgtagcttcatccggttccttcgttatcaagcaggctcttccttacgttcgttgcataggggagtcgtggccaatgacaaaggagcgagcatattttgaggcagtgacattgagaaagcatggacatttgtgcccaaatcatgtgcctgatgtttatcacttcgaccgtacgatgtcgttgattggcatgcgttacttggaacctcctcatataatcctgaggaaaggtttgatcgccggaattgagtatccattgctggcagatcacgtatcagaatacatggcgaagactctcttcggcacatccatcctttataattcgaccaccgtgcacaaagtatccgttgcggagttctgtggcaatgtggagttatgcaggctcaccgaacaagttgtgttttctgacccctacaaagtgtctgaatacaaccgttggacatcaccatatcttgatcgtgatgccgaggctgttagagaagacaatgatttgaaggttgagattgctgagttgaaagcaaagtttatagagagaacccaggcccttattcatggagatcttcacacagggtcaattatggtcactcaagaatcaactcaagtcatagatccggagtttgcattctatggaccaatgggtttcgatatcggagcctttttggggaacttaatcttggccttcttttcacaagatggacatgctgtggaaggtaacgatcgaaagacatacaaagagtggattttgaggacgattgaagagacttggaatctgtttcgtaagaaattcgtgggactttgggagctgcacaaggatggtcctggggaggcttatctccctgccatttacaacaaccctgagcttcagcagctggtacagaacaaatacttgacagacttgttccatgacagccttggttttggagctgctaaaatgattaggagaatagtgggagtggctcatgtggaagattttgaatccatcaatgacccaagcaagcgagcagggtgtgagaggcgagcccttgaattggctaagttacttttgaagaaaaggcgatctttcaattcaatttcgcaggtcatttctgccattcgggagctccaataatctatgtctgcctctacttattggaggcagaaacagagcgtttgggtgtagaaaatgagattcgaaaatttcagt

SEQ ID NO: 2122 - DNA, 1617 bp, Arachis hypogaea
agtccaacctttctagcttagctattagcgtccctcctccgaaagcaaaacaaaacaagattcccatttttggggggatcattgctccgtctccccccgcctcagtactccgccgcatccaatggccttctcagagttccgaccactcgacgacaactccctcatcgaatacataaaatcagtaccggccctctcctctaagatcggcaacgacttcgacaccttgtccgtcaaagaagttggagatggcaaccttaacttcgtcttcatcgttctcaattccacaggttcttttgtcatcaagcaggctttgccttatattcgctgcattggggatcatggccgatgacgaaggagagagcatattttgaatacctggggctgaaagaagagggtcgcttgagccctgagcatgttcctgaagtttaccactttgaccgtacaatgtcattgatcggcatgcgttacttggaaccaccacatataatattaagaaaagggttgatagctggaattgagtaccctttgcttgcagagcacatggctgatttcatggccaagacactctttttcacctctctccttttccgtacaacttccgagcacaaaagggacgttgccgaatattgtggtaatgtggagttatgcagactcaccgagcaggtcgtgttctctgacccttataaagtttctcaatataatcgttggacttccccttatcttgatcgtgatgctgaggctgttcgggaagacaatctgctgaagcttgaagttgctgagctgaaatccaagttctgtgagagggcccaggctctaatacatggagatctgcacactggttctgttatggttacccgtgaatcaacacaagttattgatccagaatttgcattttatggaccaatgggttttgatattggagcattcctgggaaatttgattctggcttacttttctcaagatgggcatgcagatcaagcaaatgatcgaaaagcgtacaaggagtggattcttaagacaatcgaagatacctggaatcttttccatcacaaattcactgctctttgggatgagcacagaaatggtgcgggtgaggcatatcttccagctatatataacaatcctgaggttcagctgcttgtacagaagaaatacatgacagatttgtttcatgatagtcttgggtttggtgctgccaaaatgataaatagttggtgtagctcatgttgaggattttgaatccattgccgatgctgctaaacgtgcaacatgtgaaaagcgagcacttgatttagctaaggcgattctcaaagaaaggagaaaatttgaaggcattgctgaaattgtatcagcaattcggcaatatgaatcctgattcatggttttcatatcgatacctcatcatgtatcacgttttcctcctgtacactactcgagattttggtgttctgctacatttaacagtttcactgtcaacattatgtatcaaaaatataaattttctgcttgagtgtactaattacagttttatgttacatcttacttgcagcaaggacgttttgttaacacaactttgttcagctcagttgttacttattatattgtagatatattatt

SEQ ID NO: 2123 - DNA, 1721 bp, Vitis vinifera
tccagattcaatgtatcgaattaaccggagagaatccggttcctttccctgtcatctccaacgttagtcgtgccctttcatcttctctagactcaaaactaccaaactaccctctccctttcttcaaatactcctccctcccccgccgtctccactaccaccaccgccaattccttcgcaacgatggcgtcatctggattccggccccttgacgacaagtctctcatagagtacataaaggcgacgcccgctctctcctccaagcttgcaaaccagctcgatggattgcagatcaaagaagtgggcgacggcaatctcaacttcgtctacatcgtcatctcctccagtggatccttcgtcatcaaacaggcgttgccgtacatacgttgtataggggaatcgtggccgatgacgaaggaacgggcgtattttgaagcgacggcattgagagagcagcgtcgctggtgctccgatcatgtgccggaggtttatcattttgatagggaaatggctttaatcggtatgaggtacttggagcctccgcatataattcttagaaagggcctgattgctggaattgagtaccctttgcttgctgaacacatgtctgagtttatggcgaggactcttttcttcacatctcttctataccatgacacaaccgagcacaaacgtgcagttgctgaattttgtggtaatgtggagttatgtcggctcactgagcaagttgtgttctctgatccatacaaagtatctcagtacaatcggtggacttctccttatcttgaccgtgatgctgaggcagttcgagaggataacattttgaagcttgaagttgccgagttgaaatctatgttctgtgagagatcacaagccctagtacatggagatcttcatactggttcagttatggttacccctgattcgactcaagttatagatccagaatttggattttatggaccaatggggtttgatataggcgcatttttaggaaacttgattttggcttactttgcacaagatgggcatgctgatcaagtgaatgatagaaaaacatataaagaatggattttgaaggcaatagaacagacttggaatcttttccacaaaaaatttactgcattatgggatgaacacaggaatggctctggtgaggcgtatcttccagaaatttataataactctgaacttcagcttcttacacaaaagaaatacatgcaaggtttgttgcatgacaccctcggatttggtgctgccaaaatgataaggagaattgttggtgtagcacatgttgaggattttgaatcaattgttgatgctagcaagcgagctaactgtgagagacaggcacttgtatttgcaaagatgcttttgaaggaaaggagaaaatttcaggctatcactgaagttgttttagccgttcagcaagaacaatcatgagaaaagtattaggtaaagttgaatgtttggttagggcatgcagaattagttggggtgggtgttctgatatgatttggatcccaaattgccatttggagcaatgatgatacgatattatatctggtttataccaatgatctgaattgcacttcttgctgtatttgcttctgttgtttgctacaaatgattctcataaggtcctgatgaaattatcaatccacagattgatacattttaaaaattttaccaatattttctatatctgatcagctttacta

SEQ ID NO: 2124 - DNA, 1604 bp, Medicago truncatula
aaagtaaaatctaacattctgtaacaccattgctcaaaccacgttaccatgtcgaatttctcagagttcaaacctctgaacgagaaaacgctcatcgaatacataaaatccatccctgcactttcatccaaactcgccaacaatttctccgacttatccgtcaaagaagtcggagatggcaaccttaattttgtcttcatcgtttccaacaccaacggttcttttgtcatcaaacaggctttaccatatgttcgttgcataggagaatcatggccaatgacgaaagaaagagcctattttgagtcattggcattgaaagaagagggtaaattgagtcctgatcatgttcctgaagtgtatcattttgatcgtactatgtctttgattggtatgcgttatttggagccaccacatataattctcagaaaagggttgattgctggtgttgagtatcctttgttggctgatcacatgtctgattttatggctaatacactcttctttacttctttgctttaccgttctacgacggagcataaacgggatgttgctgaattttgcgggaatgtggagttatgcaggctcactgagcaggttgttttctctgacccatataaagtttctgagtataatcgttggacttcacctaatcttgaccgtgatgctgaggctgttcgggaagacaatctactaaagcttgaagttgctgagctaaaatcaaagttctgtgagagggctcaggcactaatacatggagatctacacactggttctgtgatggttacacgtgaatcaactcaagttattgatcctgaatttgcattttatggaccaatgggttttgatatcggagcattcctaggaaacttgattttggctttcttttctcaggatggacatgctgatcaagcaaacgatagaaaagcatataaggaatggattcttaagacaattgcagacacttggaatcttttccaccataaattcactgcactttgggatgagcataaaaatggtgctggtgaggcatatcttccaggaatctataacaatcctgatgttcaactacttgtacagaagaaatacatgacagatttatttcatgacagtctcggatttggtgctgccaagatgataaggagaattgttggtgtggcacatgttgaggatcttgaatctatagctgacactggtaaacgggcaacttgtgaacggcgggcacttgatttagctaagatgcttttcaaagaaagaagaaaatttgagagcatttctgaaattgtctcagcaattcagcaattttagttgtgacaaggttttgctatatcaataccttgacatccatcatttatctgttttcaaaatatatcatctcttagatttttcccgagtgagtactacttgatagctgtttccctatcaaattatgtatagtgaataaactttctcggttcctctccatgggaagctgggagatggtactgatagcataacagtttctaattgttgtacaccccatcattaaatgtgttgttctggagtttcgtgtgattacttaagattccattagaagttatttttattacgatacttaattatcaagc

SEQ ID NO: 2125 - DNA, 1478 bp, Populus trichocarpa
aacttcactgccaccaagagttcaacatcgtcaataaaaaatggcattcacagagttcaggccgctggccgagaaatctttaattgagtacattaaggccacttctgttttgtcagataagatcggtaacaatttcggtgacttgaagatcaaagaagtcggtgatgggaatctaaatttcgtctacatagtcgctagcccatctgggtcttttgtcatcaagcaagcacttccatacatacgatgtattggagaatcatggccaatgacaaaggaaagagcatattttgaggctttggcactcagagagcatggccgattgtgcccggaaaatgtgcctgaagtttatcattttgaccgtactatgtctgtgattgctatgcgatatttggagcccccacatataatcttgagaaaagggttgattgctggaattgagtatcccttgctagcagaacacatgtctgattatattgcaaagactctttactacacttcgcttctctatcgtactaccactgagcataaacgtgatgttgctgaattctgtgggaatgtggagttatccaggcttactgagcaggttgttttctctgacccatacaaaatatctcaatataatcgttggacttccccttatcttgaccgtgatgctgaggctgtccgtgaagataatattttaaaactcgaagttgctgagttgaaatccatgttttgtgagagagcccaagccttagtacatggagatctccacactggttctgtcatggttacccatgattctactcaagttatagatccagaatttgcattttatggtccaatgggttttgatattggagcttttattggaaatttgattttggccttttatgctcaagacgggcatgctgatcaaatgaatgaccgaaaaagatataaagagtggattttaaggacaatcagagagacctggagtcttttctacaaaaagttcactgcactctgggatgagcataaggatggctctggtgaggcatatcttccagaaatttataataatcctgagcttcggctgcttgtacagagaaaattcatgcaagacttgctccatgacaccttgggatttggtgcggctaaaatgataaggagaattgttggcgtagcccatgttgaggattttgaatcaattactgatgctagcaaacgagccaaatgcgagcagcaggctcttgacctggcgaagatggttctcaaagaaaggaaaaaattccaatccatcgatgaagttgtattagccattcagcaggtgcagtgatgacatgcttgggggtaaagtttgggtataaataatggagatttggttgagctatttacacattcacctcggagtaaaaacgcatgtcaccgcaacattatatcagattgtaattttcctctaaaggaaaagaaataaatctgcactcctcccctgtgagagtaattttataattttcttg

SEQ ID NO: 2126 - DNA, 1586 bp, Prunus persica
atggagccatgcattcatacctcaattcaagggatagacagaaaatcaagcaccaaagaccaaaaaatgtttgatcattcacctcagaaggttcaagctctgaactctaactttctcacccctcctcttcatcgccgccaccacaccatggccttctctgagtttcgcccactggacgagaaggtcctcatagaatacataaaggccacaccttctctctcttctaagctcaacaacaagtttgacaacttaacaatcaaagaagtgggtgatggcaacctcaatttcgtcttcatcgtcgttggctccactggttctttcgtcatcaagcaggctcttccatatattcgttgtattggggagtcatggccaatgacaaaggaaagggcatattttgaggcattggcactgagagagcatggtggtttaagtcctgatcatgtccctgaagtttatcattttgatcggaccatgtctttgattggcatgcgctatttggagcctccacatatcatactgagaaaaggattgattgctggaattgagtaccccttgctggcggaccacatgtcggactatattgcaaggactctgttcttcacatccctcctttatcgtaataccacggaccacaaacgagctgttgctgaattttgtggcaatgtggagttatgcaggcttactgagcaggttgttttttctgatccatacaaaatatctcaatataaccactggacttctccttatcttgattctgacgctgaggctatacgggaggataatgctttgaagcttgaagttgctgagttgaaatctttgttctgtgagagagcccaagccctaatacatggagatcttcacactggttctgtaatggtgactcatgattcaactcaagttatagatccagaatttgcatattatggaccaatgggttttgatattggcgcttttctgggtaacttgattttggctttctttgcacaagatgggcatgctgatgagcagaatgatcgaaaagcatacaaggattggattttgaggacaattgaaaacacttggaaccttttcgacagaaaattcgttgcactgtgggatacaaacaatgattctggtgacgcatatcttcctgcgatttataacaaccctgggcttctacagcttgtacaaaagaaatatattaaagatctgcttcatgactcccttggttttggtgctgcgaaaatgataaggagaattgttggtgttgcacatgttgaagattttgaatcaatcgccgatgctagcaaacgggcaggttgtgagcgtcgggctcttgaggttgcaaagttgcttcttaaggagaggagaaagtttcagggcattgctgaagttatttcagccattcaacaagtccagtaataactaatgagtcaatgagacgacgtttatgtttgaaataggagtcttctagaaagaaaaatatgcagatttttggtgtggctgtgtgctgcttgtaccttgattgctctaacaatgaccatgaccataacaaataaaggacatggctctttcagctcttttatataatattgtgcttttgagtc

SEQ ID NO: 2127 - DNA, 1728 bp, Trigonella foenum-graecum
cagtagcgtctctcttccgaaagtaaaatcaaataattccatttctattctgtaacaccattgctcaaaccatgtcaaatttctcagagttcaaacctttgaacgagaaaacactaatcgaatacataaaatccatccctgcactttcatccaaactcgccaacaatttctccgacttatccgttaaagaagtcggtgatggcaaccttaatttcgtcttcatcgtttccaacaccaacggttcttttgtcatcaaacaggctttgccatatgttcgttgcataggagaatcatggccaatgacgaaagaaagagcgtattttgagtctttggcgttgaaagaagagggtaaattgagtcctgagcatgttcctgaagtgtatcattttgatcgtactatgtctttgattggtatgcgttatttggagccaccgcatataattctcagaaaagggttgattgctggtgttgagtaccctttgttggctgatcacatgtctggctttatggctaatacactctttttcacttctttgcttttccgttctacgactgagcataaacgggatgttgcggagttttgcggcaatgtggagttatgcaggctcactgagcaggttgttttctctgacccttataaagtttccgagtataatcgctggacttcccctcatcttgacagtgatgctgaggctgttcgggaagacaatctacttaagcttgaaattgctgagctaaaatcaaagttctgtgagagggctcaggcactaatacatggagatctacacactggttctgtgatggttactcgtgaatcaactcaagttattgatccggaatttgcattttatggtccaatgggttttgacattggagcattcttgggaaacttgattttggctttcttttctcaggatggacatgctgatcaagcaaacgatcgaaaagaatataaggaatggattcttaagacaattgcagacacttggaatcttttccaccataaattcactgcactttgggatgagcataaaaatggggctggtgaggcatatcttccaggaatctataacaatcctgatgttcaactacttgtacagaagaaatacatgacagatttatttcatgacagtctcggatttggtgctgccaaaatgataaggagaattgttggtgtggcacacgttgaggatcttgaatctatagctgacgctggtaaacgggcaacctgtgaacggcgggcacttgatttagctaagatgcttctcaaagaaagaagaaaatttgagagcatttctgaaattgtctcagcaattcagcaattttagttgtgacaaggtttttcgatatcaatacctttaactccatcatttatctgtttcccaatatatcatctcttagattttggctgagtggttactatttgataactgtttccctgtcaaattatgtatattgaataaattttctcgcttcttctccatgagaagctgggagatggtactgatagcatcacaacagtttctaattgttgtacaccccatcattaaatgtgttgtttaggaatttcgtgtgattacttaaggttccattagaagttatctttattatgatactcaattatcaaatatgacggataaggtgctgcttgtactgattcagtcttgtaaattgtaatttcaatgttcttggatttatgtaatatatttacataatatttaatggtta

SEQ ID NO: 2128 - DNA, 1742 bp, Ricinus communis
tactagtccgattggagctgcatctgcgtattagtgaagcagactgggcacaaaacgactaggttcaacgaaccacatcgacgccttgggtccagcaagagtcacgcctccagcagtttggtcaaagtcatcactcatcctccttattcaccaaaagaaaaaaaaaacagaaagccaattcctttttcctccttaaaaacccaccatcgttccatcaccatcacaaccacaaccacaatctccgcctttgcatccacatggcattctcagagtttaggccactggacgagaagtctttgatagagtatataaggggtactcctgtattggccaataagattggcgacaagtttgatgacttgaagattaaagaagttggcgatgggaatcttaattttgtctacatagttgttagttctgatggttcttttgttattaagcaggcactcccttacatacgctgtattggcgaatcatggcctatgacaaaggaaagagcctattttgaagctcggactcttaaagagcatggccggttgtgcccggaacatgttcctgatgtttatcactttgatcacactatgtgtttgattggcatgcgatacttggagcctcctcatattatccttagaaaagggctaattggtggacatgagtaccctcatttagcagaacatatgtcggattatatggcaaagactcttttttatacatcccttctgtatcttaccaccactgagcacaaacgtgctgttgctgaattctgtgggaatgtggagttatgcaggctaactgagcaggttgttttctctgacccgtacaaagtttctcaatacaaccattggacttccccttaccttgatcacgatgctgaggctgtccgtgaggataatattttgaagcttgaaattgctgaattaaaatccaagttctgtgaaagaggccaagccttaatacatggagatctccacactggttcagtcatggttactccttcttcaactcaggttatagatccagaattttcattttatggtccaatgggttttgatattggagcttttattgggaacctgattttggcatactttgctcaagctggccatgctgattcagcaaatgatcgtaaatcatataaagagtggattttgaagataatcgaaaatacatggaatcttttcgacaaaaagttcattgcactttgggatgagcacaaggatggacctggtgaggcatatcttccagaaatttataataagcccgaagttcggcagcttgtacagagaaaattcatgagagacttgttccatgacacgcttggatttggtgcagcaaaaatgataaggagaatagttggggtagcccatgttgaggattttgaatcaattaaggatgctagcaaacgagctgaatgcgagcggaaggcactcgattttgcaaaaatgcttctcaagaataggcgagattttgattccattgatggagtcgtgtcagccatgcagccattggatagttgtcaaacttttgggtagagcttctgccttgttactgatattatggctctgagtattgttttatacagtccagaatactttttaagagtgaattgctttatctgcaatctttatttctttatctgcgatcaatcgatgctgtactgctaatatatttaattcaagtgaatgggggttggctatacaagttctctttctcccactcgtgcatcttcataaagatataag

SEQ ID NO: 2129 - DNA, 1474 bp, Chelidonium majus
aaccaccagtccaccaccaataatggcgacagaagggtttagggcattagatgagaaatctctgatcgaatacataaaagccacaccttctctttgttcgaagcttgggaaccagctcgatggcatacagattaaagaagtcggagatggaaatcttaattttgtctacatcgttactggtactgctggttctttcgttatcaagcaggctcttccatatattcgctgcataggagaatcatggccaatgacaaaggagcgtgcatattttgaggcaacgactttaaaagaacatggtcgttggtgcccagatcgtgttccagaagtttatcattttgaccgtgttatgtccttgattggtatgcgctacttggagcctccacatattatcctgcgaaaaggcttgattgctggagttgaatatccattgcttgcagagcacatgtcagaatatatgtcaaagactcttttctgcacatccctgctgtaccattccaccactgtgcatagacaggctgttgctgaattttgtgggaatttggagttatgtaggctcactgagcaggttgttttttctgacccttacaaggagtctgaatataaccgttggaattctccttatcttgaccgcgatgctgaggctgtgcgggaggataatcttttgaagcttgaagttgctgagttgaagtcaatgttctgtgaaagagcacaagccttaatacatggagatctccatactggttctgtcatggtgacccttgattccacccaggtcatagatccagaatttgcagtttatggaccaatggggtatgacataggagccttcattggaaacttgattttggcattcttttctcaagatggacacgctgatccagcaaatgatcgcagagaatataaacagtggattttgaggacgatagaggacacttggaaccttttcgagaagaagttcaccgcactttgggatgaaaacaagaatggatccggtgaagcatatctttcagcaatatataacaatcctgagcttttcctgcttgcacaaaggaagtacatgaaagatttgtttcatgacagtcttggatttggttctgccaaaatgataaggagaatagtgggtgttgctcacgttgaggattttgagtcgattgatgatgctagcaaacgagcatactgcgagcgtcgagctcttgattttgcaaagatgcttctaaaggaaaggcgcaaattccagactatcaatgaagttgtttctgcaattcaggcccttccttcttgacaatgtcttttatgcgattgactgggttgctttaaatttgaagagtttctaagctacagatttcataagatagtgtaactaagtttgttccttcacttgtaacactagtttatggataaaagcaatttctggagaggaattcgaaagacactagtttgctcctccattatctcatttcataatcttacaaac

SEQ ID NO: 2130 - DNA, 2016 bp, Prunus mume
ttttttgcgtttcagtttttcctgaattggagcatccggtgccatccattctacagcgccattatcacttggccaatgagaaaagcgagaaccagaccagattcattgcacttgcaccaatcaaccaaaagtctcaatttttctatttcgtcggataaaaaagtccacaactttcaccatccaaagattccaattccaacgttattcagacctttatcttctcagttcaacctctgaactctaactttctcacccctgctcttcatcgcctccaccacaccatggccttctctgagtttcgcccactggacgagaaggtcctcatagaatacataaaggccacaccttctctctcttctcagctcaacaacaattttgacaacttaacaatcaaagaagtgggtgatggcaacctcaatttcgtcttcatcgtcgttggctccactggttctttcgtcatcaagcaggctctgccatatattcgttgtattggggagtcatggccaatgacaaaggaaagagcatattttgaggcattggcactgagagagcatggtggtttaagtcctgatcatgtccctgaagtttatcattttgatcggaccatgtctttgattggcatgcgctatttggagcctccacatatcatactgagaaaaggattgattgctggaattgagtaccccttgctggcggaccacatgtcggactatattgcaaggactctgttcttcacatccctcctttatcgtaataccacggaccacaaacgagctgttgctgaattttgtggcaatgtggagttatgcaggcttactgagcaggttgttttttctgatccatacaaaatatctcaatataaccactggacttctccttatcttgattctgatgctgaggctatacgggaggataatgctttgaagctcgaagttgctgagttgaaatctttgttctgtgagagagcccaagccctgatacatggagatcttcacactggttctgtaatggtgactcatgattcaactcaagttatagatccagaatttgcattttatggaccaatgggttttgatattggcgcttttctgggtaacttgattttggctttctttgcacaagatgggcatgctgatgagcagaatgatcgaaaagcatacaaggattggattttgaggacaattgaaaacacttggaaccttttcgacagaaaattcgttgcactatgggatacaaacaaggattctggtgacgcatatcttcctgcgatttataacaaccctgggcttctacagcttgtacaaaagaaatttattaaagatctgcttcatgactcccttggttttggtgctgcgaaaatgataaggagaatcgttggtgttgcacatgttgaagattttgaatcaatcgccgatgctagcaaacgggcaggttgtgagcgtcgggctcttgagatagcaaagttgcttcttaaggagaggagaaagtttcagggcattgctgaagttattttagccattcaacaagtccagtaataactaatgagtaatgagacgacgtttatgtttgaaatagagatatttattaaactatgataatgaacaatggtaatgactgctcttgtaccttgataaatatagatttttggtgtggctgtgtgctgcttgtaccttgattgctctgaccattaccatgaccatatcaaataaaggacatggctctttcaggtcttttatataatatgtgcttttgagtctctggcctgtgattctgtcaatgcttatctgctcccaaactatgtgatccaaatctccagcccttctcaacttctcttcctctgtctctttcagctacatgggttttcttttccctgaaaaaaggttttttttcatcttttttcctttttggattggtgttggagaagatagagcgtactatgaaatgatgacttgatttaagcctacgtatatgtagattttatggtattgaattgataagtgggtatatatctgccat

SEQ ID NO: 2131 - DNA, 1521 bp, Populus trichocarpa
ttcaacatgagtcgccactcgccaccttttcctaatatctaacttcactgccaccaagagttcaacatcgtcaataaaaaatggcattcacagagttcaggccgctggccgagaaatctttaattgagtacattaaggccacttctgttttgtcagataagatcggtaacaatttcggtgacttgaagatcaaagaagtcggtgatgggaatctaaatttcgtctacatagtcgctagcccatctgggtcttttgtcatcaagcaagcacttccatacatacgatgtattggagaatcatggccaatgacaaaggaaagagcatattttgaggctttggcactcagagagcacggccgattgtgcccggaaaatgtgcctgaagtttatcattttgaccgtactatgtctgtgattgctatgcgatatttggagtccccacatataatcttgagaaaagggttgattgctggaattgagtatcccttgctagcagaacacatgtctgattatattgcaaagactctttattacacttcgcttctctatcgtactaccactgagcataaacgtgatgttgctgaattctgtgggaatgtggagttatccaggcttactgagcaggttgttttctctgacccatacaaaatatctcaatataatcgttggacttccccttatcttgaccgtgatgctgaggctgtccgtgaagataatattttaaaactcgaagttgctgagttgaaatccatgttttgtgagagagcccaagccttagtacatggagatctccacactggttctgtcatggttacccatgattctactcaagttatagatccagaatttgcattttatggtccaatgggttttgatattggagcttttattggaaatttgattttggccttttatgctcaagacgggcatgctgatcaaatgaatgaccgaaaaagatataaagagtggattttaaggacaatcagagagacctggagtcttttctacaaaaagttcactgcactctgggatgagcataaggatggctctggtgaggcatatcttccagaaatttataataatcctgagcttcggctgcttgtacagagaaaattcatgcaagacttgctccatgacaccttgggatttggtgcggctaaaatgataaggagaattgttggcgtagcccatgttgaggattttgaatcaattactgatgctagcaaacgagccaaatgcgagcagcaggctcttgacctggcgaagatggttctcaaagaaaggaaaaaattccaatccatcgatgaagttgtattagccattcagcaggtgcagtgatgacatgcttgggggtaaagtttgggtataaataatggagctttggttgagctattttcacattcacctcggagtaaaaacgcatgtcaccgcaacattatatcagattgtaattttcctctaaaggaaaagaaataaatctgcactcctcccctgtgagagtaattttataattttcttggaa

SEQ ID NO: 2132 - DNA, 2732 bp, Eucalyptus grandis
atcttctttcatcgtacctctcgaactgcgtcgctgagcccgagcccgagttcgagttcgagttcggacccctttcgacaccgccgcccgccgtccccgccggcgacgcgccgccgcttccgtcatggctttcgcggagttccggccgctggacgagaagtcgctgctggagtacatccagcacacccccgccctcgcctcgaagctggggaacaagttcgacgacctgaagatcagagaagtcggagacggcaatctcaacttcgtctacatcgtcgtgggctctgctggctctttcgtcatcaagcaggctatcccttacgttcggtgcattggggaatcatggccaatgacaaaagagcgagcatacttcgaggcagtggcattgaaagagcaagggcattggtgcccggaccatgttccggaggtttatcactttgaccgtactatgtctctaataggcatgcgttacttagagcctccacatataatcctgaggaagggattgattgctggaattgagtacccattacttgccgagcacatgtcagaatatatggcaagaacactcttctccacgtcccttctgtatcattccaccacagagcacaaacgtgcagtagcagagttctgtggaaatgtcgagatgtgcaggctgactgagcaggttgttttttctgacccttacaaagtatcccaatacaaccattggacttccccttatctggatgctgatgctgaggctgtaagggaggataatgatttaaagcttgcaatagctgagttgaaatccatgttctgtgaaagagcgcaagcactggtacatggagatctccatactggttcggtcatggttacccaagattcgacccaagtaatagatccagaattcgcattttatgggccaatggggtttgatgttggagccttcctaggaaatttgtttttgtcattcttctctcaggatgggcatgcaaatcaagggaacgacagaaagggatacaaggaatggattttgcaaaccactgaagagacgtggaatctattccaacagaagtttgtaagcctttgggatgaacacaagaatgggtctggtgaggcatatctaccagcaatctataacaatgatgtgctgctcaagctggtccagaggaaattcatgaaggatttattccatgattctcttggatttggggctgcaaaaatgataaggagaattgttggggtcgcacatgtggaggatcttgagtccataactgatgctagtaagcgtgcagactgcgagcgccgagctctcaattttgcccggatgcttctgaaggaaaggcgaaaattcgaagaaatcagtgaagtagtctcattagttcggaaatcaaactaacccttgggcttaatgtattgaggtttcttgtgggtcccccctccttcactgttgtgtccttatgcatttcgaagctacggaggctctgtatttccaatgtagcgtcccatgcactgcctgctcaaatcattagcagctctatgctgtctttgatggttagttccgctgacgagtccttgctccgatgaatctacttgaactttgtctacgtcagatcaatggatgatgactatgctgaggcctttctcgactttgcttgatgcagagctgcctatggaactaccatatgcagatggcgattcttttttttggtggctttctttttggttgttgttcgggcgtcctcactgtttgaactgttggatatgatcactgtggtcatcgtgctaataatatcccggaatcgagaggtaaataagttgggtgtatgatgacttttcggatgtgctaagtaacattaagttcctcagcattcgcttgttatagaacaattctatcctaatgaagcgcttgaataaaacccagtctaggatgtgtttcctctgcaaacttgctccttgttttcagaagaaggtatttatttgtttgatacccaattttctttcattgtttttaccttcaccttttatttctcctatatcagaaagcaaattgaatacttgatcagttaatagggaacgtattagcttaaccacgcctcctaactttgaacttctttatggaagaaacgaaagacgtaagtggctgagctttaaatcggcacgatacagagaatgactgcgcgtaacctcttcttcccaggaaaacatttacctggactttattcattacagaaaaagtaacctaaattccatatttagccttgtagtcgctccagagctgatcaactgtcttccccagcaactcaacaaaatactcggggctatagcctgtcttcatcttcttgttcatgtctgctacaaacccactcagaagaccatcacaatagtccagaaaatgtgctgtgacatcatagccctggtcccaccggtttccctggcctggtttcacccagtggctcggtgcatatcccgccttcagcctcacaaaatctgctattccctctgtcaaaccagtcggcgcttctcgattggcaaaccactgccatatatgcgtcatctcgtgatacaaaaccccggttatctcgttcttcacgtcaccggagtagtttcctatgtactctgagctcacgtgaatttcgtttgtgtcgataagggcatatgccaccccctccatggattcaataaaaacacttacattttgcacattccttactgtcctctgaggtcaattcttggaaaatttgccaaat

SEQ ID NO: 2133 - DNA, 1581 bp, Solanum phureja
gatgaccaggtacaatgtaactacaaaaactcaatatagccaatagctaggcatggtacatgcgtcgttgatattcaggtcaacctaaatactttccaactattaatgacacaaaaataaaaaaaagcagcattttactcgtgcctcccctttgccccaaatcaacaatggcatctgatgggttcaggccgttggacgagaagtcactagtggagtacataaaatcgactccttctttggtttcaattttgggaaaacagttcgataaacttgaaatcaaggaagttggtgatggaaatctcaactttgtctatattgttgttgccccatctggttcgattgtcatcaaacaggctcttccttatattcgatgcataggagagtcatggccaatggcaaaagaacgtgcttactttgaagccactgcactaaaagagcatgctcgtctgtctcctgagcatgtacctgaagtttaccattttgacaggactatgtgtttgattggtatgcgctaccttgaacctcctcatattatattgaggaagggattgattgctggggttgagtatccattgcttgcacaacacatttcagactatatggcaaagactctttttttcacctccctgctttatcttacgacaacggatcacaaacgtgcagttgctgagttttgtggaaacgtcgagttgtgtaggctcactgagcaggttgtcttctcggacccctacaaagtgtcagaatataatcgctgtacatctccttatcttgatgccgatgctgaggcagttcgcaacgataatggtttgaagattgaagttgctgagcttaaatccaagttttgtgagagagcccaagctcttatacatggtgatctccatactggttctttgatggtcactcacgattcaacccaagtaattgacccagaattttctttctatgggccaatgggttttgatattggagcatttattggaaatctaattctggcgtacttttcccaagatggacatgcagatcaggccaatgaccgcaagtcatataaactttggattttgaagacaataacagagacttggaacctctttcaccaaaagtttcttgcactctgggatgagcacaaggatggtcctggtgaggcatatcttcctgaaatatacaataatactgagcttcgacaactggtaaagcagaaatatatgaaagaactctttgaggacacccttggatttggtgctgctaaaatgataaggagaatagttggagtggctcatgtagaagattttgaatcaatcaaggatgttgccaaacgagctgattgtgaacgacaagcgctcagctgtgcaaagaagcttctgaaagaaagacgaaacatcaagagtattgaggaagttgtttccacaattgagcaagttcagttgcagtaatgtcttaagttaaaatggatgatcatgtaacatgttggccttttgactaagcgttgatatgtttgctttatgactaagcattttggagtctattaagatatataaaatgcatattgacaataaataatccccttttaggtatacattatgc

SEQ ID NO: 2134 - DNA, 1680 bp, Solanum lycopersicum
atgtgatgaccaggtacaatgtaactctgaaaattcaatatagccaataggtaggcatgatacatgcgtcagttgagattgaggtcaacctaatcaaactatttatgacccaaaaataaagaagcattattttactcgtgcttccccaaatcaacaatggcatctgatgggtttaggccgttggacgagaagtcactagtcgagtacatcaaatcgactccttctttgctttcaatcttggggaaacagttcgataatcttgaaattaaggaagttggtgatggaaatctcaactttgtttatattgttgttgccccttctggttcaattgtcatcaaacaggctcttccttatattcgatgcataggagagtcatggccaatggcaaaagaacgtgcttactttgaagccactgcactaaaagagcatggtcgtctctctcctgagcatgtacctgaagtttaccattttgacaggactatgtgtttgattggtatgcgttaccttgaacctcctcatattatattgaggaagggattggttgctggggttgaatatccattgcttgcacaacacatttcagactatatggcaaagactctttttttcacctccttgctttatcttaacacaacggatcacaaacgtgcagttgctgagttttgtggaaacgtcgagttatgtaggctcactgagcaagttgtcttctcggacccctacaaagtgtcagaatacaatcgctgtacatctccttatcttgatgccgatgcagaggcagttcgcaatgataatggtttgaagattgaagttgctgagcttaaatccaagttttgtgagagagcccaagctcttatacatggtgatcttcatactggttctttgatggtcactcaagattcaacccaagtaattgacccagaattttctttctatgggccaatgggttttgatattggagcatatattggaaatctgattctggcgtacttttcccaagatggacatgcagatcaggccaatgaccgcaagtcatataaagtttggattttgaagacaataacggagacttggaacctctttcaccaaaagtttcttgcactctgggatgagcacaaggatggtcctggtgaggcatatcttcctgaaatatacaataataccgagcttcgacaactggtaaagcagaaatacatgaaagaactcttcgaggacacccttggatttggtgctgctaaaatgataaggagaatagttggggtggctcatgtagaagattttgaatcaatcaaggatgttgccaaacgagctgattgtgaacgacaagcactcagctgtgcaaagaagcttctgaaagaaaggcgaacaatcaagagtattgaggaagttatttccaccattgagcaagttcagttgcagtaatgtccaagttaaaatggatgatcatgtaacatgttggccttatgaccaagcgttgatatgtttgctttttgactaagcattctggagtctatttagatatattgaatgcctattgataacaaataatatccttttaggtatacattatgcttaaaatggtgagttttctttgctcagtagtcattctattggtggaggaacattatcatttccagtttattttcagcaccaactaaatatattttcgcactctgttctatt

SEQ ID NO: 2135 - DNA, 1708 bp, Nicotiana benthamiana
ctcttctttcctatcttcatttttataatatcaaaatttttatatttccaaatacttcaagtggctcctagtactattaaatccctttgccccaatacatctgtcttcattcgccatccaccccgactagtcaactatatccgccaccgcgtacctaccgtcttctccgccggcaccgacgatgccatccgatgggttccggcctttggacgagaaatcattagtggagtacataagagctactcctgctttggtttcaatattaggcaaggagttcgataagcttgaaattaaggaagtgggtgatggaaatctcaactttgtttacattgttgttgctccctctggttcggttgtcatcaaacaggctcttccttatattcgatgcattggagagtcgtggccaatgacaaaagagcgtgcgtactttgaatccactgcgctaaaagagcatgggcgtctgtgtcccgagcatgtacctgaggtttaccattttgacaggaccatgtgtgtgatcgggatgcgctaccttgaacctcctcatattatattgaggaagggattgattgctggggtcgagtatccattactcgcagaaaacatttcagactatatggcgaagactcttttcttcacctccctgctttatcttacaacaacggatcacaaacgtgcagttgctgaattttgtggaaacgtcgagttgtgtcggctcactgagcaggttgtcttctcagatccctacaaagcgtcacaatacaatcgatgtacatctccttatctagatgccgatgcagaggcagttcgcaaggataatggtttgaagattgaagttgctgagcttaaatccaagttttgtgagagagctcaagctctaatacatggcgatctccatactggttctttgatggtcactcaggattcaacccaagtaattgatccggaatttgctttctatgggccaatgggttttgatattggagcatttattggaaatctaattctggcgtacttttcccaagatggacatgcggatcaggccaatgaccgcaagtcgtataaagtttggattctgaagacaataacagagacttggaacctctttcacaaaaagtttcttgcactctgggatgagcacaaggatggtcctggtgaggcgtatcttcctgaaatatacaacaacactgagcttcgagaactggtacagcagaaatacatgaaagaactctttgaggacacccttggatttggtggtgctaaaatgataaggagaatagttggggtagctcatgtagaagattttgaatcaatcaaggatgctgccaaacgagctgattgtgaacggcgagcgcttaactgtgcaaagaagcttctgaaagaaagacgaaacgtcaagagcattgaagaagttgtttccacaattgagaaagttcatttgcagtaatgtcaaggtaaaatggatgatataacatgttggccttttgggtaaaatcgatgatataacatgtttgctttcgactaagcattttggagtatgttagggatacgtaatgcatattgataaaaaataatccccttttatttgctgcaagttgcctgtcggttggcaatgctaagcatacgggacaattgtactatgttggatctgttctctgttcctttagggggttaaaactatcttgataaaatatggtgtgtttttttttgg

SEQ ID NO: 2136 - DNA, 1966 bp, Aristolochia fimbriata
cgaaggagagagcattcctcatttccttgaagcgaggcccttgaaaaatgaaagagcgtggagggctgacctcgaattcagatatgtctaaacgacgtcttcaccatcgattaccacaatcgtcatgactccagtcgtgtttgtccgatcgttcgaacaatttcaagttttcaacagggacgcggaaccgcatgacccgtgcctgcgcggcggtgaacgcgagggggcgccagtttcagcatttatggcactcaaatagtgaaacgccatttttagaagattcgtgctactagatttcgtacgcggacagtgtttgaaagtgaccaggttcatcgtacctctgcttccttataatcaatctttccttaatctttcagaaagcagattattctttcgttgctcatcctcctccgacggtccctgcatctctctctgtctctgatggatttgacccagttccgccctctggacgacaaattgctggtggaatacataaaagctacgcctgctctctcctctctgcttgggaatcagtttgatgacctgacaatcaaagaggttggagatggcaatctgaactacgtctatattgttcttggcgcagccggatcgtttgtcgtcaaacaggctcttccatacattcgctgcattggggagtcatggcccatgacgaaggaaagagcttactttgaagcgaggactttgaaagagcatggagggttgtgccctgagcatgtcccagaagtctaccattttgatgtgaacatgtcattgattgctatgcgatatttaaagccaccccatataatcctgaggaaaggattgattgctggaattgagtatccattacttgctgaacatatctctgaatatatggcaaaaactcttttcaagacatcacttctttatcattctacaactgagcacagaaaggctgtggcagaattctgtggaaatgtcgagctttgtagactcacagagcaggttgtgttttctgatccctataagatctctgagtataacaggtggacaagtccttatcttgatcaggaggctgaggcagtccgagaagacaatctattaaagcttgaagtcgctgaattaaaatcaatgttctgtgagagagcacaggctttgattcatggggacctccatactggttctgttatggtgacaaatgattctacccaggttattgatccagagtttgccttttatggacctatgggctttgacattggagcatttataggaaacttgattttggctttctttgctcaagatggacatgcagaccaagaaaatgatcgccagctgtataaacaatggattttgaagacaatagaagacacttggaacctgttccagaataagtttatcaaactttggaatgagagcaaaaatggtgaagcatatcttgaggaaatttataacaaacctgaattgcgaaatcttgtgcaagagaaatacatgacagacttgcttcatgatacccttgggttcggtgcagccaaaatgatcaggaggatagttggtgtagcacatgtggaagactttgagtcgattcaagacaacgcgaagcgtgcagagtgtgagcgacgtgctcttgggttagctaaagagctgcttaaaaagagaagagaattcaagtccatcagtcaagttgttgcagccattaaggaggttgctcactgaaggaaattccggagcataaataatgggatttgcccttcagatttctcatctgcatcaacagccttcagacttgtgttgataccatcatcatgtagcaattaccttagaaagaaagtattgttatgagttcaaaacttgaaaatatacttttctcagtaaaacagattttgtggtttcttccatttccgagaatgatatcctccttccattgaggagtcatagttaaaggtttttttttaaatattttaaaaactactaaaaaaaaaaaaaa

SEQ ID NO: 2137 - DNA, 1649 bp, Cicer arietinum
cagtagaactccagttattcaactaatacactactatttccagactccctagtaaatacaaataaaaaacgcaggcaaccaaggtagcgtctctcttccgaaagcaaagttaaaacgcagaacacaatacaactactgtgcactctattttcgttcattttgtgacaccatcgctctcactatgtctttctcagagttcaaaccgcttaatgagaacacactcatcgaatacattcaatccgttccgtccctctcatcaattcttggcaacaatttctccgacttatccgttaaagaagttggagatggcaaccttaacttcgtcttcattgtctccaattccacaggatcctttgtgctcaaacaggctttgccatatgttcgttgcataggtgaatcatggccaatgacgaaagagagagcgtattttgagtcattggcgttgaaagaagagggtcgattgagtcctgatcatgtaccagaagtgtatcattttgaccgtacaatgtctttgattggtatgcgttatttggagccaccgcacataattctcagaaaaggattcattgctggtattgagtaccctttgttagctcaacacatgtctgatttcattacaaacacactcttctttacttctctgcttttccgttctactactgagcataaacgggacgttgccgaattttgtggcaatgtggagttatgcaggcttactgagcaagttgttttttctgacccttacaaagtttctgaatataatcgctggaattccccttatcttgatcgtgatgctgaggctgttcgggaagacaatctactgaagcttgaagttgctgagctgaaatcaaagttctgtgagagagctcaggcactaatacatggagatcttcacactggttctgtgatggttactcgtgaatcaactcaagttattgatccagaatttgcattttatggaccaatgggttttgatatcggagcattcctgggaaatttgattctggctttcttttctcaggatggacatgctgatcaagcaaacgatcggaaaggatataaggaatggattctcaagacaattgaagatacttggaatcttttccaccataaattcactgcactttgggaaaagcatagaaatggggctggtgaggcatatcttccaggagtctataataatcctgaggttcatctgcttgtacagaagaaatacatgacagatttgtttcatgacagtctcggattcggtgctgccaaaatgataaggagaattgttggtgtggcacatgttgaggattttgaatccattgctgatgctggtaaacgggcaacctgtgaacggcgggcacttgatttagctaagatgcttcttaaagaaagaagaaagtttgagggcatttctgaaattgtttcagcaattaagcaattttaatcatgacaaggttttgatatatcaacacctctccattttatctttgttttcaaatatatcatctcttagattttggagtgagtgctgtaagacaactgtttccgtgtcatattatgtatagtgaataaattttcttgtttcttctccctaggaattggttctgataacataacactttataattggagtacaccgcatcattaaatgtgttgtt

SEQ ID NO: 2138 - DNA, 1782 bp, Cicer arietinum
atgatcaacatatcatatctctcttattgattcaaccttttattatctctcttttaaagtatgaccaggttcagtgaactccagttattcaactaatcactacattttccagactcccctgtaaaatcaaataaaaaacgcaggcaaccaaggtagcgtctctcttccgaaagcaaagttaaaacgcagaacacaatacaactactgtgcactctattttcgttcattttgtgacaccatcgctctcactatgtctttctcagagttcaaaccgcttaatgagaacacactcatcgaatacattcaatccgttccgtccctctcatcaattcttggcaacaatttctccgacttatccgttaaagaagttggagatggcaaccttaacttcgtcttcattgtctccaattccacaggatcctttgtgctcaaacaggctttgccatatgttcgttgcataggtgaatcatggccaatgacgaaagagagagcgtattttgagtcattggcgttgaaagaagagggtcgattgagtcctgatcatgtaccagaagtgtatcattttgaccgtacaatgtctttgattggtatgcgttatttggagccaccgcacataattctcagaaaaggattcattgctggtattgagtaccctttgttagctcaacacatgtctgatttcattacaaacacactcttctttacttctctgcttttccgttctactactgagcataaacgggacgttgccgaattttgtggcaatgtggagttatgcaggcttactgagcaagttgttttttctgacccttacaaagtttctgaatataatcgctggaattccccttatcttgatcgtgatgctgaggctgttcgggaagacaatctactgaagcttgaagttgctgagctgaaatcaaagttctgtgagagagctcaggcactaatacatggagatcttcacactggttctgtgatggttactcgtgaatcaactcaagttattgatccagaatttgcattttatggaccaatgggttttgatatcggagcattcctgggaaatttgattctggctttcttttctcaggatggacatgctgatcaagcaaacgatcggaaaggatataaggaatggattctcaagacaattgaagatacttggaatcttttccaccataaattcactgcactttgggaaaagcatagaaatggggctggtgaggcatatcttccaggagtctataataatcctgaggttcatctgcttgtacagaagaaatacatgacagatttgtttcatgacagtctcggattcggtgctgccaaaatgataaggagaattgttggtgtggcacatgttgaggattttgaatccattgctgatgctggtaaacgggcaacctgtgaacggcgggcacttgatttagctaagatgcttcttaaagaaagaagaaagtttgagggcatttctgaaattgtttcagcaattaagcaattttaatcatgacaaggttttgatatatcaacacctctccattttatctttgttttcaaatatatcatctcttagattttggagtgagtgctgtaagacaactgtttccgtgtcatattatgtatagtgaataaattttcttgtttcttctccctaggaattggttctgataacataacactttataattggagtacaccgcatcattaaatgtgttgtttgcgtatttcgtgtgattacataacgttccattcaaagttatttttcaattatggtaatcaaat

SEQ ID NO: 2139 - DNA, 1900 bp, Nicotiana benthamiana
gtacaatgtaactatgaaaactcaatatagccgtgcttcatcttattctcgttaacctaaaatcactttcatctatttgggacacagtactcctcctcccagtacttgtcacaaaataagcagcatttttctcgttgtaattactactcctattaaaattaaatccctttgccccaatacatatttcttcattcgccacctaccctaactagtcaactataaccgccaccgcgtcctaccgtatcctccgacggcaacgatggcatccgatggattccggccgttggacgagaaatccttagtggagtacataaaagctactcctgctttgttttccatattaggcaaggagttcgataagcttgaaattaaggaagtgggtgatggaaatctcaactttgtttatattgttgttgctccctctggttcgtttatcatcaaacaggctcttccctatattcgatgcattggagagtcatggccaatgacaaaagaacgcgcttactttgaagccactgtgctaaaagagcatggccgtctgtgtccagagcacgtacctgaggtttactattttgacaggactatgtgtgtgattgggatgcgctaccttgaacctcctcatattatattgaggaagggattgattgctggggtcgagtatccattgctggcagaaaacatttcggactatatggcaaagacccttttcttcacctccctgctttatcttacaacaatggatcacaaacgtgcagttgctgaattttgtggaaacgttgagttgtgtcggctcactgagcaggttgtattctcggatccgtacaaagtgtcacaatataatcgctgtacatctccttatctagatgccgatgcagaggccgttcgcaatgataacagtttgaagattgaagttgctgagcttaaatccaagttttgtgagagagcccaagctctaatacatggcgatctccatactggttctttgatggtcactcaggattcaacccaagtaattgatccggaatttgctttctatgggccaatgggttttgatattggagcatttattggaaatctaattctggcgtacttttcccaagatggacatgcggatcaggccaatgaccgcaagtcctataaagtttggattctgaagacaataacagagacttggaacctctttcacaaaaagtttcttgcactctgggatgagcacaaggatagtcctggtgaggcatatcttcctgaaatctacaacaatactgagcttcgacaactggtgaagcagaaatacatgaaagaactctttgaggacacccttggatttggtgctgctaaaatgataaggcgaatagttggggtagctcatgtcgaagatttcgaatcaatcaaggatgctgccaaacgagctgattgtgaacgactagcgctcaactgtgcaaagaagcttctgaaggaaagacgaaacttcaagagcattgatgaagttgtttctacaattgagcaagttcatttgcagtaatgtcaaggtaaaattgacaatgtaacatgttggccattttgactaagcgttttggagtcattaagatgcatattaatcagaaataattctctgttatttagtgcaattgcatgtcggttggcaatggttagcataggacaattgtactatgttgaatctgttctttcagtactgttaggggttaaagtatcctggttaaaattggtgagttttccgttggttcattaggcattctattacggaggaactttatcatttccagtttacttctgcaccagcttcatatttttgacattctgttcgcttcagttgatcttgatagttgcctataggattttaacagattatactgcagtcttgttgtgtattcatctgaaa

SEQ ID NO: 2140 - DNA, 1641 bp, Nicotiana benthamiana
  misc_feature (976)..(976): n is a, c, g, or t
gatgtactattaaatccctttgccccaatacatctgtcttcattcgccatccaccccgactagtcaactatatccgccaccgcgtacctaccgtcttctccgccggcaccgacgatgccatccgatgggttccggcctttggacgagaaatcattagtggagtacataagagctactcctgctttggtttcaatattaggcaaggagttcgataagcttgaaattaaggaagtgggtgatggaaatctcaactttgtttacattgttgttgctccctctggttcggttgtcatcaaacaggctcttccttatattcgatgcattggagagtcgtggccaatgacaaaagagcgtgcgtactttgaatccactgcgctaaaagagcatgggcgtctgtgtcccgagcatgtacctgaggtttaccattttgacaggaccatgtgtgtgatcgggatgcgctaccttgaacctcctcatattatattgaggaagggattgattgctggggtcgagtatccattactcgcagaaaacatttcagactatatggcgaagactcttttcttcacctccctgctttatcttacaacaacggatcacaaacgtgcagttgctgaattttgtggaaacgtcgagttgtgtcggctcactgagcaggttgtcttctcagatccctacaaagcgtcacaatacaatcgatgtacatctccttatctagatgccgatgcagaggcagttcgcaaggataatggtttgaagattgaagttgctgagcttaaatccaagttttgtgagagagctcaagctctaatacatggcgatctccatactggttctttgatggtcactcaggattcaacccaagtaattgatccggaatttgctttctatgggccaatgggttttgatattggagcatttattggaaatctaattctggcgtacttttcccaagatggacatgcggatcaggccnatgaccgcaagtcgtataaagtttggattctgaagacaataacagagacttggaacctctttcacaaaaagtttcttgcactctgggatgagcacaaggatggtcctggtgaggcgtatcttcctgaaatatacaacaacactgagcttcgagaactggtacagcagaaatacatgaaagaactctttgaggacacccttggatttggtggtgctaaaatgataaggagaatagttggggtagctcatgtagaagattttgaatcaatcaaggatgctgccaaacgagctgattgtgaacggcgagcgcttaactgtgcaaagaagcttctgaaagaaagacgaaacgtcaagagcattgaagaagttgtttccacaattgagaaagttcatttgcagtaatgtcaaggtaaaatggatgatataacatgttggccttttgggtaaaatcgatgatataacatgtttgctttcgactaagcattttggagtatgttagggatacgtaatgcatattgataaaaaataatccccttttatttgctgcaagttgcctgtcggttggcaatgctaagcatacgggacaattgtactatgttggatctgttctctgttcctttagggggttaaaactatcttgataaaatatggtgtgtttttttttgg

SEQ ID NO: 2141 - DNA, 1653 bp, Phaseolus coccineus
tgattacaacacattttttgattaaaatatatgatagttaaatttctcaaaaaaagatgacagtggatatagtctcaggagaatcaaatgaaattggtgtgaaaaaaatctcagtttcagtttctagcgtgcttcctccaaacaaagaatagtaagacgcacttcaaagattccatccatttgggagttgagagagtaccattgctccactccctccttcccaccatcgccggccaccatggctttctccgagttccgaccgctcaacgagaagtccctcatcgaatacataaagtccgttcctgctctctcctccaaactcgccaacaattttgatgacttatcagttaaagaagttggagatggtaaccttaacttcgtctacattgtttccaactctgcaggttcttttgtcatcaaacaggctctgccgtacgttcgttgcattggggagtcgtggcctattacggcggagagggcttattttgagtcgctgacactgaaagaagagggtcggttgtgccctgagcatgtccctgaagtgtatcactttgatcgtaccatgtctttgatcgccatgcgttacttagagcccccgcatataatccttagaaaagggttgattgcaggaactgaataccctcttttagctgagcatatggctgatttcatggcaaagacactcttcttcacgtctctgcttttccgttccaccactgaccacaaacgagacgttgccgaattttgtgggaatgtggagctatgcaggcttactgagcaggtcgttttctctgacccttacaaaatttctgaatataatcgttggactgcgccctatcttgatcgtgatgcagaggctgttcgggaagacaacctgctgaagcttgaagttgctgagctgaaatctgtgttcattgagagggcccaggcactattacatggtgatctacacactggttctgtgatggttactagtgaatcaactcaagttattgatccagaattttcattttatggaccaatgggttttgatgttggagcattcttgggaaacttgattttggctttctttgctcaagacgggcatgctgatccaacaaatgatcgaaaagcctataaggagtggattcttaagacaatcgaagacacttggaaccttttccagcacaaattcacttcactttgggatgagcacaggaatggcgctggtgaagcgtatcttccagcaatctataacaatcccgaggttcaactccttgtacagaagaaatacatgacaaatttgtttcacgatagtcttggatttggtgctgctaaaatgataaggagaattgttggtgtggcgcatgttgaggatttcgaatccattgctgatgctgctaaaagggcaacttgtgaacggcgagctcttgatttagctaagatgcttctcaaagaaagaagaaaatttgaaggcattgctgaaattatttcagcaattcggcaatactaatacacaacccaataccagcttttgctacctcaataatacttccttaatggatcgtgttttccaacgtttttttttttggttgtgtaccactatatacgtgtttccaaaaacattatgtacgaaaaattatataaatttttaaggagaggttttgtctgata

SEQ ID NO: 2142 - DNA, 1728 bp, Sesamum indicum
tgcctacattatcgtctgctaaacccaagccaacgggtcaagctacgaactactatttgaaacagggtcgggcattgatccgccttcgccgccgcggttgctgcacagggtatgtcttccgatgggtttcgcccgctggacgagaagttattggtggagtatttgaagggaactccatctctggccgcgaagctgggcagtcagttcgataagcttgaaatcaaggaagtaggcgatggaaatctcaactttgtttacattgttatcggctcatcgggtgctgtagtcatcaaacaggctcttccatacattcgttgtataggagagtcatggccaatgacaaaggaacgtgcctattttgaagcgacaactttacaagaccatggtcgcttatgtccagctcatgttcctgaggtttaccatttcgatagggaaatgtgtttgattggcatgcgttacatcgagccacctcatataatattaagaaaaggattgattgccgggattgagtatccattacttgcagaacatatatcagaatatttggccaggacactgttctacacgtccctgctttatctgaccactacaaatcataaaagtgcagtcgcaaaatattgtgggaatgtggagttatgcagacttacagaacaggttgtcttctccgacccctacaaagtgtccgaatataaccgttggacaacaccttaccttgatgctgatgctgaggcagttcgcgaggatagcattttgaaagttgaagttgctcagctaaaatccaagttctgtgagagagcccaagctcttatacatggtgatctccatacaggttcagtcatggttaccactgattcaactcaagtgatcgatcctgaatttgcgttctatgggccaatgggatttgacattggagctttcattggaaacctgattttagcgtattttgcacaagatggacatgcagaaaaggggactgatcgtaaactgtacaaagagtggattttgaagaccatatcagatacttggaacctcttctacagaaagtttactgctctttgggataaaaacaaggacggtccgggcgaggcttatcttcctgcaatttataataatccagaactccaattgctggtacaacagaaatacatggaagatcttttccatgacagtcttggatttggtgctgccaaaatgataaggagaatcgttggggtggctcatgttgaagattttgaatcaataaaggaggccagcaaacgcgcagactgtgagcgcaaggctctgaactttgctaagacccttctaaaggagaggaagaagttccacaacataagtgaagttgttgctgcaattgagcatctcgacaaatgatacgatctatgtatgattctaaactcggcatcttgggcatctttaggaatgacaaatgttttattttgcttgggttgtgctttatgaatgtgaaacagcgtgagaataaatgagttccagtttgtacttgcttatcttgcttttggtggttctgctcatcattcctcatgcttggtccctccgtcgtgttgatatacgttctttgaaccaaaatcccttttgctattactaaataggtctagtaactcctcataagccagacatcaatctggcttatggtttcttagtaaattaagttgaaacaaaacttcaaattatactggaattctgacttgatttactattctataatcgagc

SEQ ID NO: 2143 - DNA, 1721 bp, Cannabis sativa
aatggtaaataaaatattaagaaatgactacattcaatgcaccaaaagtcttctctaatcgaatctctctgttcaaatgttgaacaatacgaggagaggagggactgggacacctttttctacttttcccaggtttttatttggcatttaaccctactcacactcacacacacttccacttccaacctcttacccctcctcctgcttccaaacatctcctacttggatggctttctctgagtttcgtccgttggatgagaagacccttgttgattacgtaaaggctgtacctgctctctcctctaagctcggaggcaacctcgacgatttgaccattaaggaagtcggagatggtaatctcaatttcgtctacattgtaatcggctcctctggctctttagtcatcaagcaggctctgccatacatacgctgtataggggagtcatggccaatgacaaaggaaagagcatactttgaagcagtgacattaaaagagcatggtcgctggtgcccgaataatgttccagaagtttttcatttcgaccgcaccatgtcgttgattgccatgcggtatttggagcctccacatataatcctaagaaaagggttgattgctggagttgagtacccactgctggctgaacacatatcagattacatggcaaatactcttttctacacatctctcatttatcggtccacaacagagcacaaaaaggctgttgctgaattttgtgggaatgtggagttatgcaggctcactgagcaagttgttttctctgacccttataaagtatcagaatataaccattggacttccccttatcttgatgaagatgctgaggctgttcgaaatgatgatggtttgaaggttgaaatcgctgagttaaaatccaagttctgtgagagatcccaagcgctaattcatggggatcttcacactggttctgtgatggtcactcatgactcaactcaagttatagatccagaatttgcgttttatggaccaatgggttttgatatcggtgcttttttgggaaacttgattttggcttactttgcacaagatgggcatgctgttggtgaaaatgatcgtaagaattacaaggagtggattttgaagacaattgaggatacctggaatcttttccgtaagaaatttacagctctttgggacaagcacaaagatggttccggcgaggcatatcttcctgcaatttataacaaccctgagcttcagctccttgttcaaaagaagtattttgaagatttattacacgacacagttggctttggttctgcaaaaatgataaggagaattgttggtgtggcacatgttgaggatttagaatctattgctgatcctagcaaacgagctacatgcgagaaacgtgctctttatttggcaaagatgctgctgaaagaaaggcgtaagtttcacgacatttctgaaattgtttcagctgttaggaacgtccagtaatgactgatatctaagtattagggaaacaaaatatatgataactggcatgaaaaatatgtcttcgtggaaatggtttcgagtgcctgatattggttgtttttactgcacaatatgaagctttgcataataataaaatgtgtgtaccttgtgttcttgcaatgccgagttggcccgatcctttttgggggggagttaggcaaggcaatggaaacaaatctgattcttggtgggtgtttgg

SEQ ID NO: 2144 - DNA, 1618 bp, Cucumis melo
acccacaaagcaaatcccgccggagctcctcactctccgccacttctaatggacttctctcagttccgtccactcgacgagacctccctgattgagtatattaagactgttccttccttgtccgacaagctcggcaataagttcgatggcattgagattaaggaagtcggagatggtaaccttaatttcgtttacatagtcgtgggttcatccggttccttcgttatcaagcaggctattccttacgttcgttgcataggggagtcatggccaatgacaaaggagcgagcatattttgaggcagtggcattgagaaagcatggacatttgtgcccaaatcatgttcctgatgtttatcacttcgatcgtacaatgtcgttgattggcatgcgttacttggaacctcctcatataatcttgaggaaggggttgattgctggaattgagtacccattgctggcagatcacatgtcagaatacatggcaaagactctcttcggcacatccatcctttataattcaaccacagtgcacaaagaatccgttgcagagttctgtgggaatgtggagttatgcaggctcactgaacaagttgtgttttctgacccatataaagtgtctgaacacaaccggtggacatcaccatatcttgatcgtgatgctgaggctattagagaagacaatgagttgaaggttgagattgctgagttgaaagctaagtttatagagagaacccaggcccttgttcatggagatcttcacacagggtcaattatggtcactcaagagtcaactcaagtcatcgatccggagtttgcattctatggaccaatgggttttgatatcggagcgtttttggggaacttaatcttggccttcttttcacaagatggacatgctgtggaaggtaacgatcgaaaggcatacaaagagtggattctgagaatgattgaagagacttggaatctgtttcgtaagaagcttgtggcactttgggagctgcacaaggatggtcctggggaggcttatctccctgccatttacaacaaccccgagcttcagcagctcgttcagaacaaatatttgactgagttgttccatgacagccttggttttggagctgctaaaatgatcaggagaatagtgggagtggctcatgtggcagattttgaaaccatcaaggaccccagcaagcgagcagagtgcgagaggcaagcccttgaattggcgaagttagttctgaagaaaaggagaaatttcaattcaatatctcaggtcatctctgccattcgtgagatccaataaatctatttgtctgactctgctcattggacacagaaacaaagtgtttgtgtacccaataatctttgttttctgttttcccaattcatgattttaggagtttttagttgaaataagatgataggcttatgctcattttggcatacaacttgtctacttgtactatcagcctcataaacagaggttcgatgtgcccatactcaaaagtgtccaaaaaagaaaaaggaacgagtttgattggaattgctatcatttgccttagtaaaactaatgcctatcttcattactctacattttgagcttttcctgtaattaa

SEQ ID NO: 2145 - DNA, 2023 bp, Beta vulgaris
gaagcgactcgaaaagcttatgcgtctattccaaatttattcggcaaaaaacaacgtttgttcactgttctgatttctgaatttgacaaaactccaactccagatagacacggagaaatttcccttccaactccaacagtccaacgccagtcatgccgctttattctctgttttaaactttaacaaaccaaaactcctccatcaaccaagcttcaacacacacacacatactctctctctttcatattcactctccagcaccagtaaaaatgtcaacatttgatgagttcagaccacttgacgagaaatcactcgtggaatacattaaagcaaccccttctctctcctctttacttggtgtctccgacaatttgcagatcaaagaagtcggcgatggcaaccttaactttgtctatatcattgtctctccttatacttctgttgtcatcaagcaggctcttccttacatacgttgcataggggaatcatggccaatgactaaagaacgtgcatattttgaggcgacgacattaaagaaacatggtagtttgtgtcctgctcatgttccagaggtttatcattttgatcgtatgatgtctttaatcggcatgcgttatctggaacctccacacattatccttaggaaaggtttgattgctggagctgaatatccattgcttgctgaacacatggcagaatatatgtcaaggactttgttctacacctctcttctttatactaccacaacggagcataaacgtgcagttgctgaattttgtggaaatgtggagttgtgccggcttactgagcaagttgtattctctgatccctatagagtatctgaatataatcgttggacctctcctcaccttgatcatgatgctgaggcagttcgtgaggacaatgtcctgaagcttgaagtagctcaattgaaatcaatgttctgtgaaagggcacaagcccttattcatggagatcttcacactggttctgtcatggttacgcaggattcaactcaagtgattgatccagaatttgccttctatgggccaatgggatttgacataggagcctttcttgggaatcttattttagccttctttgctcaagatggacatgcaaatcaagaaaacgaccgaaagacttacaagaaatggatcctcaagatcttcggagagacttggaatcttttccacaaaaaatttatcacactgtggaatgaaaataagggtggtcccggtgaggcatatcttccacatatctataacaatcctgatgtttggcaactcatacagacaaactatatgcgagatctgttccatgattcccttggattcgggtctgcgaaaatgattaggagaattgtcggagtagcacatgttgaggactttgaatcaataactgatgctgctaaacgagctgattgtgagagaaaagcactcaattttgcgaaaatgctcatgaaagaaaggaggaagtttgtatctattgaggatgtagtttcggccatagaacaagttgatctataaggttctcttatgcacagattgcattactcggcagattttcttagagtagtttggggaattattgatagcttcccctgagattatgatctacgagtgtgttgattgtaatacatcgtgtagaagaaacattacatctagactctagtgaactaataatcttttcttgagctcgatgcaaaacaggcgtactggatgtttttgaccttgtcaaataagttcacgatatttatagagtttatttttgtactcgggatgaaatgatatggagtgtgataaaactaaaagctacagatgcattccaatgaaaacaggtggtatttgggaaaaagatcaagaaattgctcctcttgtcaaatttgggaaaaagatcattacaagacttacagttcaacttgtgttctgtagtctggccactcaggagtttggtctatcactgtttctcttgcttctcagttctctgatagttgtttcacttgttttaatgatgtattaat

SEQ ID NO: 2146 - DNA, 1744 bp, Nicotiana tabacum
  misc_feature (16)..(16): n is a, c, g, or t
  misc_feature (21)..(21): n is a, c, g, or t
  misc_feature (29)..(29): n is a, c, g, or t
  misc_feature (41)..(41): n is a, c, g, or t
  misc_feature (538)..(538): n is a, c, g, or t
  misc_feature (714)..(714): n is a, c, g, or t
  misc_feature (918)..(918): n is a, c, g, or t
ctagtactattaaatnccttngccccaanacatctgtcttnattcgccacctagtcaactaccaccgcgtacctaccgtcttctccgccggcagcgacgatgacatccgatgggttccggccgttggacgagaaatcattagtggagtacattagagctactcctgctttggtttcaatattaggcacggagttcgataaacttgaaattaaggaagttggtgatggaaatctcaactttgtttatattgttgttgctccctctggttcgtttgtcatcaaacaggctcttccttatattcgatgcattggagagtcatggccaatgacaaaagagcgcgcttactttgaagccactgcgctaaaagagcatggtcgtctgtgtcccgagcacgtacctgaggtttactattttgacaggactatgtgtgtgattggtatgcgctaccttgaacctcctcatattatattgaggaagggattgattgctggggtcgagtatccattgctggcagaaaacatttcggactatatggcanagactcttttcttcacctccctgctttatcttacaacaacggatcacaaacatgcagttgctgaattttgtggaaacgtcgagttgtgtcggctcactgagcaggttgtcttctcggatccctacaaagtgtcacaatataatcgatgtacatctccttatctagatgccgatgcngaggcagttcgcaacgataatggtttgaagattgaagttgctgagcttaaatccaagttttgtgagagagcccaagctctagtccatggcgatctccatactggttctttgatggtcactcacaattcgacccaagtaattgatccggaatttgctttctatgggccaatgggttttgatattggagcatttattggaaatctnattctggcgtacttttcccaagatggacatgcggatcaggccaatgaccgcaagtcatataaagtttggattctgaagacaataacagagacttggaacctctttcacaaaaagtttcttgcactctgggatgagcacaaggatggtcctggtgaggcatatcttcctgaaatatacaacaatactgagcttcgacagctggtgaagcagaaatacatgaaagaactctttgaggatacccttggatttggtgctgctaaaatgataaggcgaatagttggggtagctcatgtagaagatttcgaatcaatcaaggatgctgccaaacgagctgattgtgaacgactagcgcttaactgtgcaaagaagcttctgaaggatagacgaaacttcaagagcatcgatgaagttgtttccataattgagcaagttcatttgcagtaatgtcaaggtaaaatagacaatgtaacatgttggccattttgactaagcgttttggagtctattaagatgcatattaatcagaaataatcccctgttatttagtgcaattgcatgtcggttggcaatggttagcataccggacaattgtactatgtcgtatctgttctttcagttctgttaggttaaagtatcttggtaaaaattggtgaatttttctttggttcaatagtcattctatcacggaggaactttatcatttccagtttacttctgcaccaacttcatatttttcacattctgttcgcttcagttgatcttgatagttgcctattggattttaacagaattatactgcagtcttgttgtgtatttatctggaaaa

SEQ ID NO: 2147 - DNA, 2029 bp, Panicum virgatum
gccgaggatcgctcaccctcagcgggagacgagacgagacggagacgtaacctcgcctcccccacatggcctgggcgcgcctcgccgcccgctgccgtctccgcccgggcgccgcctccgccgtcggccgaggcccacacgccccgccgcctccgcagccgcaggcgggacacgcggcccctgccgcgccgccgctctggcgggacctccgcgtcccccaactccactccgccgccgccgcgtcctcggcgccacacgcgcggctgctcggcgaccggtggcagcgcctgggcgccgcgaggaggtggctcgccagcgaagcctccgcggcgccggcgccggcgggggaagcggctgagctggtggaggttccgctggcgcagactggggaaggcatcgccgagtgcgagctgctgcgctggttcgtcaccgagggtgaccaagtagatgaattccagccactctgtgaagtacagagtgacaaagcaactattgagataacaagtcgtttcaaaggaaaagtacatcagattcactttggccctggtgacatagttaaggttggtgaaactttactgaaaatgattgtgggtgacagccaaattgtatctccagatagcatatttccatccgctgataagtcacttggagtagagtctgcggttccttcaagtgaaggcaatgttcctagtggaacactctctacaccagctgttaggcatctagcaaagcagtatgggatcaacataaatgaaatcgttggaacagggaaagatggtagggttttgaaagaagatgtgttgaactatgctgttaacaagggtctttgcgaagaacaatcatcatcgttggaagagaacattggtcaagttgagttactggaggaaaggaaatcattatccgacatgcccttgtatgaagataagaaaattcttctcaggggttaccagagagcaatggtcaaatcaatgagcctggctgcaaaagttccacattttcattatctggaggaaataaattgtgattctcttgtgcaactgaagaccagatttcaaaatgagaacaaagataacactatcaagcacactttccttccgttcctcataaagtcactttctatggccctgagtaaatatcctatgttgaacagctctttcattgaggaaaccaatgaagttgtgttgaaaggatcccataacattgggatagcaatggctacatcacatggtttagtcgtgccaaacatcaagaaagtgcagtcactgtcaatattggagatcacaaaggaattggtgcggttgcatgagatggcatcacacaacaggctaagcactgcagatattgaaggtggcaccataacacttagcaacataggcgccattggtggcaagttcggctctccacttctgaacctgcctgaagttgccatcattgccctggggcgcattcagaaacttcctcgctttgatgatgacgaaaatgtttacccttcatccataatcaatgttactgttggagcagatcaccgagttgttgatggggccatggttgcaagattctgcaatgagtggaagggcctcgtggagaagccagagctgctcttgctgcatatgcgatgatccagtaagatacctgatgcgaggggattgcccagaatttgtaaagatgggctgaaatggaggcattccggcatcgcagcttcacaccgtaagcctatataggcagtcactcacgtatgtatacaaataagacgtcgcctgcaaatagtggactcgcatcatgtatatgaccgtacacctttgcaataaaacgggggatttttatttcagagtataagatcaattgtgatgcgttcgctgcgtccttctagcccttctctaaacagagtggcggctgttggtgccgctccatctccaagaacttttgagggttgtgttggggaaattcttggagctagattttagatgattgagtaataattttattattaactttgtttgctacaaataacaaatcccacatggcgcac

SEQ ID NO: 2148 - DNA, 2345 bp, Sorghum bicolor
caggacggacaggagcagcagctctgcagccgatgataagctaggcagagtccccactccactctgctccttgtcagctgctcgcacttgttgcagtgtcccgctcccgcactcctcttcctccctccctccctccatcctcttctcgtcgtacacagcgcgcgcacgcagctgccaccggccaccgcgccaaccaatccaaaactccgccgcgcgcagatcaagactgccaccagccaccagcactccagcagcgcttcagcgggagacgtgacgactgacgagacgaagcttgcgcctctcctcccccccacgccgcccacatggcctgggctcgccttgcctcccgctcccgtctgcgccccgcggcctccgcctccgcctccgccgccgtcggccgaccgccaaacgcctcaccgtcggttccgcctcccacaccgcccactgtgcctgcggccacctccgcgccaccgctccggcatctcctcctccttccccggcaccggtttgctgccgccgcgtcctcggcgtcgaccgcgcggctgctcggtgcccggtggccccagggtcacggtaggagatgcttcgcgagcgaggcctccgcggcgcaggcgccgccgggggaggcctctgagctggtggaggtgccactggcgcagactggggaaggcatcgccgagtgcgagctgctgcgctggttcgtcgccgagggtgaccaagtagatgaattccagcccctttgtgaagtacagagtgacaaagcaactatcgagataacaagtcgtttcaagggaaaagtacatcagattaactttggccctggtgacatagtcaaggttggtgaaactttactgaaaatgattgtgggtgacagccaaattgtttccccagataatatagttccatctgctgataagtccaatggagtagagtctgcagtttccttaagtgaaggcaatgttcctagtggaactctctctacaccagctgttaggcatctagcaaagcagtacgggatcaacataaatgaaatcgttggaacagggaaagatggtagggttttgaaagaagatgtgttgaattatgctgtcagcaagggtgtttgcaaagaacaatcgtcagctttggaagggaacattgatcaagttgagttactggaggaagggaaatcattactcgatgagcacgtctatgaagataagaaaatccttctcaggggataccagagatcaatggtcaaatcaatgagcctggctgcaaaagttccacattttcattatctggaggaaataaactgtgattctcttgtacaactaaagaccacatttcaaaatgagaacaaggatcatactatcaagcacacattccttccgttcctcataaagtcactttctatggcactgagtaaataccctatattgaacagctctttcatcgaggaaactagtgaagttgtgttcaaagggtcccacaatattggggtcgcaatggctacagcacatggattagtcgtgccaaacatcaagaaagtgcagtccctatcaatattggagatcacgaaggaattggcgcgattgcatgagatggcatcgcacaacaggctaagcgctgcagatattgaaggtggcactataacacttagcaacataggtgccattggtggcaagtttggctctccccttctgaacctacctgaagttgccatcattgcccttgggcggattcaaaaacttcctcgctttgatgatgacgaaaacgtttacccttcatccacaatcaatgttactattggagccgatcaccgagttgttgatggggccacggttgcaagattctgtaacgagtggaagagcctcgtggagaagccagagctactcttgctgcatatgcgatgatccagtaagatactagtacctactacgagagatcgcccaaacctttttaagatgatctgaaatggaggcattccggtatcacagtgaaatccatgtattcaaataaatgatcaacgtggcttctctgcctgcaaacagtggaaataaagcggagagttattctcgaaagtcctaactaataagcttgcctcgcctcagaacgttatgtttttctttgctgacatccatagatattcttgctccgcctatcaatctaagatgtatttttatttaaagattggaagttttgaacaacaattagtgaaacaaatccgttaatctgtttgcttgcataattagtacatgggcaataaaacccatctaacgagacagattgattcaaggtggtttcttctttcatgcgattaaagatttccaaacgggctgcataaaacgagctggcccgagttt

SEQ ID NO: 2149 - DNA, 1840 bp, Pennisetum glaucum
ataacacacaacagctttgaacagcagggctctctggaaccgtgcagcaatggcagcgcctgggggtagcgaggaggaggtggttcaccagcgacgcctccgcggcgccggcggaggaggcggcggagctggtggaggtgccactggcgcagactggggaaggcatcgctgagtgcgagctgctgcgctggttcgtgaatgagggcgaccaagtagatgaattccagcctctttgtgaagtacagagtgacaaagcaactattgagataacaagtcgtttcagaggaaaagtacatcagattcactttggccctggtgacatagtgaaggttggtgaaactttattgaaaatgattgtgggtgacagccaaattgtatctccagataatatatttccatccgctgataagtcacttgaagaagagcctgcagttccttcaagtgaaggcaatattcctagtggaactctctctacaccatctgttagacatctagcaaagcagtatggactcaaaataaatgaaatcgttggaacaggtaaagatggtcgggttttgaaagaagatgtgttgaattatgctgtcagcaagggtctttacagagaacaatcatcatctttggaagagaacattggtttaaatgacttggtggaggaagggaaatcattacccgatgtacccttctatgaagataagaagattcttctcaggggataccagagagcaatggtcaaatcaatgagcctggctgccaaagttccacattttcattatctggaggaaataaattgtgattctcttgtacaactgaagaaagcatttcaaaatgagaataaagataatactatcaagcacactttccttccgttcctcataaagtcgctctctatggcactgagtaaatatcctatgttgaacagctctttcattgaggaaaccaatgaagttattttgaaaggatcccacaacattgggatagcaatggctacagcacatggtttagtcgttccaaacatcaagaaagtgcagtcactatcaatattggagatcacaaaggaactggcccgattgcaagagattgcatcacacaacaggctgagcgctgcagatattgaaggtggcaccataacacttagcaacataggcgccattggtggcaagttcggctctccacttctgaacctgcctgaagttgccatcattgcccttgggcgcattcagaaacttcctcgctttgacgatgacgaaaatgtttatccttcatccataatcaatgttactgttggagccgatcaccgagttgttgatggggccacggttgcaagattctgtaacgagtggaagggcctcgtggagaagccagagctcctcttgctgcatatgcgatgatctcgtgagatatacctgatacgaaggattgcccaaagtttctaaagataaactgaaatggaggcattccggcatcgcaacttcaagcgaaagcctacagcaagtcactcgtgtatgtatacaaataaataatcagcgcagcttctgcccttgcaataaagctgtttttttaccagagtataagatcttatgtacacacgcgcgcgcactaccctcacgaccaactctaaacagattggaggcctattctcacgtagtcgcatataccacaggcacgttctttgatcacactaaacatgtgtgatatgtgcgtgtattgggccagttgggtatccctctagctccaggaatatgtaatggagtctattggtatagctctagctccaggagttttgagagctgctcatcgtctcattaaaattaggtagtggtatccctttttgtatggtaat

SEQ ID NO: 2150 - DNA, 1239 bp, Panicum virgatum
cccatgacccgtgccacgtcaggacatgggcagccaatcgcacccacatggccacgcacgcaggcggcggcacgattgcacgaacccgtttcgaactcgcgcgattacgcgattcgcagggtcctttattgcaatccccgtcccgtgaacccgtcgcgtctcggcttcctcctcaccgccccgccgtgcacgagcggagctcgccgtcgcctccctcgccgagaggcccggggcctgatccccacgccgagagcagtggtggtgcgaggaggttagcgatggcgaggtggcgcccggcggagctgctgctggtggtgctggcggcggtcctggcggcggcgcggcgggcggacgcgctgtcggtgacggtgacggacaccgagtgcatccacgagttcgtgccctacgagggcgacaccgtgtccgggaacttcgtcgtcgtcgaccacgacatcttctggagctccgaccaccccggcatcgacctcacggtaacttcaccaggtggcaacactgtacatacgttgaaggggaaatctggtgataaatttgagtttaaagctccaaggggtggcatgtacaagttttgcttccataacccatatggagcacctgaaactgtttctttctacattcatgttgggcacatacccaatgaacacaatctggcaaaagatgagcacttggaccctattaacgttaaaattgcggagctgaaggaagcattggaatccgtaactgctgagcagaagtacctaaaggcacgggaagctcgtcaccgacacacaaacgagagcacgcgaaagcgtgtgatgttctacacaatggcggagtacctagctttcatggcagctagcgcattgcaagtcgtctacatccgccgcttgttcagtaaaaatgtggcatacaacagagtgtaggatacagctctactttgaaggcgtcaatggaagcagcgcatggttggaatgggaaaacatcttctgtcaatttgacaaattgtagctctgcaccctcttttcttcttttcttagtctataagcaaaactttttaatctatcatgtacttttagcaactcttgtgagatgtgaagtgcatttgttgtgaacgttgatccataattaatcttcagagaattgtcgtgaaagctattgtcctggtacagatcctgattctatgtgattctgtgatgaaggggctctaagcagaagagcattatctttccttacaataggagg

SEQ ID NO: 2151 - DNA, 1032 bp, Panicum virgatum
caccgcctccccgttgcaatctccgctcccgtgaacccgtcgcgtctcggcttcctcctcaccgccccgccgtgcacgagcggagctcgccgtcgcctccctcgccgagaggcccggggcctgatccccacgccgagagcagtggtggtgcgaggaggttagcgatggcgaggtggcgcccggcggagctgctgctggtggtgctggcggcggtcctggcggcggcgcggcgggcggacgcgctgtcggtgacggtgacggacaccgagtgcatccacgagttcgtgccctacgagggcgacaccgtgtccgggaacttcgtcgtcgtcgaccacgacatcttctggagctccgaccaccccggcatcgacctcacggtaacttcaccaggtggcaacactgtacatacgttgaaggggaaatctggtgataaatttgagtttaaagctccaaggggtggcatgtacaagttttgcttccataacccatatggagcacctgaaactgtttctttctacattcatgttgggcacatacccaatgaacacaatctggcaaaagatgagcacttggaccctattaacgttaaaattgcggagctgaaggaagcattggaatccgtaactgctgagcagaagtacctaaaggcacgtgaagctcgtcaccgacacacaaacgagagcacgcgaaagcgtgtgatgttctacacaatggcggagtacctagctttcatggcagctagcgcattgcaagtcgtctacatccgccgcttgttcagtaaaaatgtggcatacaacagagtgtaggatacagctctactttgaaggcgtcaatggaagcagcgcatggttggaatgggaaaacatcttctgtcaatttgacaaattgtagctctgcaccctcttttcttctttttttagtctataagcaaaactttttaatctatcatgtacttttagcaactcttgtgagatgtgaagtgcatttgttgtgaacatagatccataattaatcttcagaggattgtcgtgg

SEQ ID NO: 2152 - DNA, 1532 bp, Panicum virgatum
atattaattatcaaataataacgaaatttctagagtacaaaaactcaaaattattcacgtattctttacgggaagccaagacactcattttcagagtctgctggaggctggaggtggagatgcagagttgcagacgctcaccacgtgattctctctcgtcatctcgtgcaaccggatcgccgtcggatgaaggggaaacataggcttcgatgaagcccggactcaaaattcggcccaagtctgaacacgatgggcccattgcaatttactgcgccttctctgtgttgaccccggctcgagcacggcccatgacccgtgccacgtcaggacatgggcagccaatcgcacccacatgggcacgcaggcgggcacgaacccgtttcgagctcgcgcgattacgcgattcgcagggtcctttattgcaaaaccacggcaccgcctccccgtcgccatctccgctcccgtgaacccgtcgcgtcccggcttccccctcaccgccccgccgtgcacgcgcggagctcgccgtcgcctcccccgccgagaggcccgaggcctgatccccacgccgagagcagtggtgctgctaggagattagcgatggcgaggtggcgcccagcggcgctgctggtagtggcgctggcggcggtcctggcggcggcgcggcgggcggacgcgctgtcggtgaccgtgaccgacaccgagtgcatccacgagttcgtgccctacgagggcgacaccgtgtccgggaacttcgtcgtcgtcgaccacgacatcttctggagctccgaccaccccggcatcgacctcacggtaacttcaccaggtggcaacactgtacatacgttgaaggggaaatctggtgataaatttgagtttaaagctccaaggggtggcatgtacaagttttgcttccataacccatatggggcacctgaaactgtttctttctacattcatgttgggcacatacccaatgaacacaatctggcaaaagatgagcacttggaccctattaacgttaaaattgcggagctgaaggaagcattggaatccgtcactgctgagcagaagtacctaaaagcacgtgaagctcgtcaccgacacacaaacgagagcacgcgaaatcgtgtgatgttctacacaatggcggagtacctagctttcatggcagctagcgcattgcaagtcgtctacatccgccgcttgttcagtaaaaatgtggcatacaacagagtgtaggatacaactctactttgaaggcgtcaatggaagcagctaatggttggaacgggaaaacattttctgtcagtttgacaaattatagctctgcaccctcttttcttctttttttagtctataagcaaaactttttaatctatcatgtacttttagcaactcttgtgagatgtgaagtgcatttgttttgaacatagatccataattaatcttcagaggattgtcgtgaaacctgttgtcctggtacagatcctgattctatgtcattctgtgatccataattaatctttccttac

SEQ ID NO: 2153 - DNA, 1061 bp, Cenchrus ciliaris
  misc_feature (18)..(18): n is a, c, g, or t
  misc_feature (44)..(44): n is a, c, g, or t
gggccccccctgaccccntcggcctcctcctccccgccccgccncgccccgccgcgcacgaggcggagctcgctgccgccgccgcccgcctgtcccgctgagaggccctagccctgatccgcttgctgagagttgcggtaccgagagattagcgatggcgaggcggcggccgggggcgctgctgctggtattggcgctggcggcggtcctgacggcggcgcggcgggcggatgcgctgtctgtgacggtgaccgacaccgagtgcatccacgagttcgtgccctacgagggcgacaccgtgtccgggaacttcgtcgttgtcgaccacgacatcttctggagctccgaccaccccggcatcgaccttacggtgacttcaccaggtggcaatactgtacacacgttgaaggggaaatctggtgacaaatttgagtttaaagctccaaggggtggcatgtacaagttttgctttcataacccatatggagcacctgaaactgtttctttctacattcacgtcgggcacatacccaatgagcacaatctggcaaaagatgagcacttggaccccattaatgttaaaattgcggagctgaaggaggcattagagtctgtcactgccgagcagaagtacctaaaagcacgtgaagctcgtcaccgacacacaaatgagagcaccagaaagcgtgtcatgttctacacaatagcggagtacctagctttcatggcagctagcgctttgcaagtcgtctacatacgccgcttgttcagtaaaaacgtggcatacaacagagtgtaggatacaactctactctgaaggtgaaagtggaagcatcatgtggttggaaggggaaaacgtctctgttcgtttgacaaattgtagctctgcaccctcttttcttcttttgttagtgataagcaacacttttttaatttaatcttgtacttttagcaactcttgtgagatgtgaagtgcatttgttgtgaacatagatccataattaatcttcagaggatcatcaagaatgctgtcgccctgttacagattttgattctttgta

SEQ ID NO: 2154 - DNA, 1108 bp, Pennisetum glaucum
cgcacgcaacgcaggcggcacgaacccgtttcgtgctcgcgcgatttcgcgattcgcacggccctttattgcaaaaccacggcatcaccttcccctccgtttgcccacatctcgactcccgtgaggccgtccgtgaccccgtcggcttctcctccccgccccgccgcgcacgaggcggagctcgctgccgccgctcgcccgccccactgagaggaccgagccctgatccgcgcgctgatagctgtggtagcgagagattagcgatggcgaggcggcggccgggggcgctgctgctggtgttggcgctggcggcggtcctgtcggcggcgcggcgggcggacgcgctgtcggtgacggtgaccgacaccgagtgcatccacgagttcgtgccctacgagggcgacaccgtgtccgggaacttcgtcgtcgtcgaccacgacatcttctggagctccgaccaccccggcatcgacctcacggtgacttcaccaggtggcaatactgtacatacattaaaggggaaatctggtgacaaatttgagtttaaagctccaaggggtggcatgtacaagttttgcttccataacccatatggagcacctgaaactgtttctttctacattcatgtcgggcacatacccaatgagcacaatctggcaaaagatgagcacttggaccccatcaatgttaaaattgcagagctgaaggaagcattagagtccgttactgccgagcagaagtacctaaaagcacgtgaagcacgccaccgacacacaaatgagagcaccagaaagcgtgtcatgttctacacaatagcggagtacctagctttcatggcagctagcgctttgcaagtcatctacatacgccgcttgttcagtaaaaacgtggcatacaacagagtgtaggatgcaactctactttgaaggtggatgtggaagcagcatgtggttggaaggggaaaacgtctctgtccgtttgacaaattgtagctctgcaccctcttttcttcttttgttagtttatataaacaacactttttctaatataatcttgtactcttagcaactcttgtgagatgtgaagtgcatttgttgtgaacatagat

SEQ ID NO: 2155 - DNA, 1092 bp, Zea mays
gcaaggagtacgaccccccgcccccgttccgtacccacgcgattacgcgattagccgagtcctttattgcaaaaacacgcatcacctccgtcgccatcccgatccctgataccacgctgagggcggtggtattaggagattagcgatggcgaggtggcggccggcggcgctgctggtagtggctctggcggcggttctatcggcggcgtggcgggcggatgcgctatcggttacggtgaccgacaccgagtgcatccacgagttcgtgccctatgagggcgacaccgtgtccgggaacttcgtcgtcgtcgaccacgacatcttctggagctccgaccacccaggaatcgacctcacggtaacgtcaccaggtggcaacactgtgtacacattgaagggaaaatctggtgagaaatttgagtttaaagctccaagaggtggcatgtataagttctgcttccataacccatatggagcacctgaaactgtttctttctacatccatgttgggcacatacccaatgagcacaatctggcgaaagatgagcacttggaccctatcaacgttaaaatcgcggagctgaaggaagcattagaatccgttaccgccgagcagaagtacctaaaagcacgcgaagctcgtcaccgacacaccaatgagagcaccagaaagcgtgtcatgttctatacgatggcggagtacctggctttcatggctgctagcgcgttgcaggtcctctacatccgccgcttgttcagtaaaaatgtgggatacaacagagtgtaggatagaaatctacttcaaaggcgacggtggaagcaccttatatggtcggaacgggaaacattctctgccagtttgacaaattgtagttctgcaccctctttttttttgttagtttataagaaacactttaatttatcatcatgtacttttagcaacacttgtggtatgttaagtgcatttggtgctgaacattgttccataactgatcttcagaggattgttatgaaagttagtattgttctgctaccgatttcgatcatatctaatcttgtgatgtcttaacgggctctatgcctctgccaatg

SEQ ID NO: 2156 - DNA, 1216 bp, Sorghum bicolor
accaatcgcaccacatggccacgcaacgagcacgaccccgttacccacgcgattacacgattttcagggtcctttattgcaaaaacaagcatcacctccgttgccatctcgctcccgtgacccaccccgtcgcgtttcggcttggcttccttctcccgacgaccgccgtgcaggagcggagctcccgccgcttctcttttccccttccgagaggcccgagtcctgatcccacgctcagggaggtggtatttggagattagcgatggcgaggtggcggccggcggtgctgctggtagtggctctggcggcggttttgtcggcggcgtggcgggcggatgcgctatcggtgacggtaaccgacaccgagtgcatccacgagttcgtgccctacgagggtgacacagtgtccgggaacttcgtcgtcgtcgaccacgacatcttctggagctccgaccacccaggcatcgacctcacggtaacgtcaccaggtggcaacactgtgcacacattgaagggaaaatctggtgacaaatttgagtttaaagctccgaggggtggcatgtacaagttctgcttccataacccatatggagcgcctgaaactgtttctttctacattcatgttgggcacatacccaatgagcacaatctggcgaaagatgagcacttggatcctatcaacgtcaaaatcgcggagctgaaggaagcattagaatctgtcaccgccgagcagaagtacctaaaagcacgcgaagctcgtcaccgacacactaatgagagtaccagaaagcgtgtcatgttctatacaatggcagagtacatagctttcatggcagctagcgcgttgcaagtcctctacatccgccgcttgttcagtaaaaatgtgggatacaacagagtgtaggatacaactctacttcaaaggcgacattgcaagcaccacatggccggaacgggaaacattctctgccaatttgacaaattgtagctctgcaccctctcttttttcttcttcttttgttagattatgagaaacactttttaatttatatcatcgtgtacttttagcaacacttgtgatatgttaagtgcatttgatgctgaacatagtccataattaatcttcagaggattgttatgaaagttagtattgttctgctaccgatttgattgttaatcctgtgatgtctataagaacagttatgtctccatgcca

SEQ ID NO: 2157 - DNA, 1074 bp, Saccharum officinarum
gacccatcccgtcgcgtctcggcttggcttcctcctcccgacgaccgccgtgcaggagcggagctccccgccgcttctctctcccccttctgagaggcccgagccctgatctcacgctgagagcggtggtattaggagattagcgatggcgaggtggcggccggcggcgctgctggtagtggcgctggcggcggttctgtcggcggcgtggcgggcggatgcgctatcggtgacggtgaccgacaccgagtgcatccacgagttcgtgccgtacgagggtgacaccgtgtccgggaacttcgtcgtcgtcgaccacgacatcttctggagctccgatcacccaggcatcgacctcacggtaacgtcaccaggtggcaacactgtgcacacattgaagggaaaatctggtgacaaatttgagtttaaagctccgaggggtggcatgtacaagttctgcttccataacccatatggagcacctgaaactgtttctttctacattcatgttgggcacatacccaatgagcacaatctggcgaaagatgagcacttggaccctatcaacgttaaaatcgcggagctgaaggaagcattagaatccgtcaccgccgagcagaagtacctaaaagcacgcgaagctcgtcaccgacacactaatgagagcaccagaaagcgtgtcatgttctatacaatggcggagtacatagctttcatggctgccagtgcgttgcaagtcctctacatccgccgcttgttcagtaaaaatgtgggatacaacagagtgtaggatacaactctacttccaaggcgacagcggaagcagcacatgatccgaacgggaaacattctctgccaatttgacaaattgtagcgctgcaccctctttttttttgttagtttataagaaacactttttaatttatcatcgtgtacttttagcaacactagtgatatgttgagtgcatttgaagctgaacatagttccctaattaatcttcagaggattgttgtgaaagttagtattgttctgctaccgattttgattctatgtaatccagtgatggcttaacgggc

SEQ ID NO: 2158 - DNA, 1125 bp, Zea mays
ggcacggaaggagcatgacccccgtttcgcaccgcacccccgcgattacgcgattcgcagggtccttcatcattgcaaaaacacgcataacttacattgtcatcttcgctcccgtgacctacatcgtcgtgtctcggcttggcttggcttcctcctccccgacgaccaccccgcgcttctcctctccccccgtcccaccttccgagaggctcgagccctgatcccacgctgagggcggcggtgttaggagtttagcgatggcgaggtggcggccggcggcgctgctggtagtggcgctgacagcggttctgtcggcggcgcggcgggcggatgcgctctcagtgacggtgaccgacaccgagtgtatccacgagttcgttccgtacgagggtgacaccgtgtccgggaacttcgtcgttgtcgaccacgacatcttctggagctccgatcacccaggcatcgacctcacggtaacgtcaccaggtggtaacactgtgcacacattgaagggaaaatctggtgacaaatttgagtttaaagctccgaagggtggcatgtacaagttctgcttccataacccatatggagcacctgaaactgtttctttctacattcatgttgggcacatacccaatgagcacaatctggcgaaagatgagcacttggaccctatcaacgttaaaatcgcggagctgaaggaagtattagaatccgtcaccgccgagcagaagtacctaaaagcacgcgaagctcgtcatagacacactaatgagagcaccagaaagcgtgtcatgttctacacaatggcggagtacatagctttcgtggctgctagcacgttgcaagtcctctacatccgccgcatgttcagtaagaatgtgggatacaacagagtgtaggatacagctctacttcaaaggcgacagtggaagaagcaccacatggtcggaacgggaaacattctctgccaatttgacaaattgtagctctgcaccctctttctttttgttagtttacaagaaacacttttacatttatcatgtacttttagcaacacttgcgatatgttacgtgcatttgatgctgaacatagttccagaattaattttcagagaatttgtagta

SEQ ID NO: 2159 - DNA, 1042 bp, Avena sativa
aagagaacaccggagctcacctccttgccctcccctccccgtccacgcccctgaaccccagccttagaccaggggtcctggtgcatctggtacgggagtcatccgagctgagctaccgaccggcgggccatggctaggtggcggccggcgatgctgctggtagcggcgctggcactggcggcggccgcggggtggcgcgcggaggcgctgtcggtgacggtcaccgacaccgagtgcatccacgagttcgtgccctacgagggcgacgccgtcaccgggaacttcgtcgtcgtcgaccacgacatcttctggagctccgatcaccccggcatcgacctcacggtaacttcaccaggtggtaacactgtacattcaattaagggaaagtctggtgacaaatttgagttcaaagctccaaggggtggaatgtacaagttctgcttccataatccatacggggcacctgaaaccgtttctttctacattcatgttgggcacatacccaatgagcacaatctggcgaaagatgagcacttggaccctatcaatgtgaaaattgcagagcttaaggaagcattagaatctgtcactgctgagcagaagtacctaaaagcacgcgaggctcgtcaccgacacacaaacgagagcacaagaagaagggtcatgttctacacgatggcagagtacctggctttcatggctgctagcgcgttgcaagttgtctacatccgccggctgttcagtaaaaatgtggcgtacaacagggtctagtacaccagacttcttcaaggcagcatcggatggctgcagcagggaaatattgtcatattgtagcttttcacccccaccccctttggtgttagtctaaagatacccttttaatttatcaccttgtacctttagcaactattgtgaaatgtgaagcacacttgttgtggaaacatagatacataattaatcttcagagagtgttgacgtcaaaatggaaaaaaaggtggcatctggcaagagactggtgatgtgtaatgagttttgtaatccg

SEQ ID NO: 2160 - DNA, 1452 bp, Brachypodium distachyon
acgcaactcggggagtcctttattgcaaaacacgcgacaccttccccgtctcgtctccgatctcgccctcgtgacttcgtctcgtctccgctcgcctgcccctcccgaacccccgtcgtcgtgcacgaccggagctcaccgcctcgccctctccccccgaaccctagccctaaacccagcggctctggttcgctggtgccgcccttgactgagctaccgaccggcgggccatggcgacgtggcggccggcgatgctgctggtagcggtggtggcgctggcggcggccgcggggtggcgggcggatgcgctgtcggtgaccgtcacggacaccgagtgcatccacgagttcgtgccctacgagggcgactccgtcacggggaacttcgtcgtcgtcgaccacgacatcttctggagctccgaccaccccggcatcgacctcacggtaacttcaccaggcggtaacactgtatattcactgaagggaaaatctggtgacaaatttgattttaaagctccaaggggtggaatgtacaagttttgcttccataatccatatggggcacctgaaactgtttctttctacattcatgttgggcacatccccaatgagcacgatctggcaaaagatgagcacttggatcctatcaatgtgaaaatagcagagcttaaggaggcattagaatctgtcacttctgagcagaagtacctaaaagcgcgtgaggctcgtcaccgacacacaaatgagagcaccagaaggcgggtcatgttctacactatggcagagtacctggctttcatggctgctagcgcattgcaagttgtttacatccggcgcctattcagtaaaaacgtggcatacaacagggtctaggacaccgtctacttcaaggcagcagaagatggctggaacagggaatatgttctgtcatattgtagcttttcaccctccccacccgcttctttggtgttagtctaaaaatacttcttttttaatttatcaacatgtacctttagcaagtcttgtgagatgtgaagcgtacctgttgctgaacataaatccataatttatcttcagagtgttaatgtcaaagaaacaaaaaaattaaggcacggttactgatggtttgttatgaagactgtaactctggtatacatactcactctcttattctagcgcagattggtccagtaaaggaatgacctaaactgggctacactgccattgcaagggaatgaaggaatatgtgaagttattttgtacggttcaaaatgtactaaaaagactcgaaagtggagtatcatggatagtagtactcgactgtagacgaaattttggttcaatgtttggtatccagtcccaatatatacagtgaacttcagtcttgctgtacggtattaggcacaccgatcgttactgaatgaactgtgaataagatccgaatagttaaaaa

SEQ ID NO: 2161 - DNA, 1217 bp, Secale cereale
cgccctctccccgtgacctccgtctcgcgtgccctccccgtccccgaccccgtcgtgcgcgacctgagctcaccgcccaccccccctgaaccctagccgtacaccaggcacgccggtgcgagcgttgtctgggccgccaaaccggcgggccatggcgaggtggcggccggcgatgctgctggtagcggcgctggcgctggcggcggccgccgggtggcgggcggaggcgctgtcggtgaccgtgacggacaccgagtgcatccacgagttcgtgccctacgagggcgactccgtctcgggcaacttcgtcgtcgtcgaccacgacatcttctggagctccgaccaccccggcatcgacctcacggtaacttcacccggtggtaacactgtatatacaataaagggaaagtctggtgacaaatttgagttcaaagctccaaggggtggaatgtacaagttttgcttccataatccatatggagcacctgaaacagtttctttctacattcatgttgggcacatacccaatgagcacaatctggcgaaagatgagcacttggaccctatcaatgtgaaaattgcagagctgaaggaagcactggaatctgttactgcggagcagaagtacctcaaagcacgtgacgctcgtcaccgacacacaaacgagagcactagaagacgtgtcatgttctacacgatggcagagtacgcggctttcatggctgccagcgcgttgcaagttgtttacatccgccgcctattcagtaaaaatgtggggtacaacagggtctagggcaccgtctacttcaaggcatgggcatggcagcagcagcagcagcagcaggtggctccaacagggaatgttttctgtcatattgtagcttttcacccccttttcctggcgctagtctaaagaaaacactccttttaatttatcaccttgtacccttagcagcaactatcgtgaaatgtgaagcgcatttgttgtggaacatagatacataattaatcttcagagtcttcatcatattgaaaagaaagagagaggtgtcgacatgtgctatgaagtttgtaaatcctggtacaaagttcttgttctatcttcatttttttttgggcacaaatgttctctcttattctaccacgtcttggtcaagtactgtagtagggaatgtggtaataatggcttttgcaatggaactaagcgatgatgtagc

SEQ ID NO: 2162 - DNA, 1201 bp, Hordeum vulgare
ggaaaaacacgcgacatctgccccttccccgtctccaatctcgccctcgtgacttccgtctcgcgtgccctcccctcccctccccgaccccgccgtgcgcgaccggagctcaccgcccgcccccctgaaccccagccctagaccagtggcgttggtgcttctggtacgagcgttcgatcggctacccaccggcgggccatggcgaggtggcggccggcgatgctgctggtagcggcgctggcgctggcggcggccgcagggtggcgggcggaggcgctgtcggttaccgtgacggacaccgagtgcatccacgagttcgtgccctacgagggcgactccgtcacggggaatttcgtcgtcgtcgaccacgacatcttctggagctccgaccaccccggcatcgacctcacggtaacttcaccaggtggcaacactgtatatacaatgaagggaaagtctggtgacaaatttgagttcaaagctccaaggggcggaatgtacaagttttgcttccataatccatatggggcacctgaaaccgtttctttctacattcatgttgggcacatacccaatgagcacaatctggcgaaagatgagcacttggaccctatcaatgtgaaaattgcagagctgaaggaagcactggaatctgtcactgccgagcagaagtacctaaaagcacgtgacgctcgtcaccgacacacaaacgagagcaccagaaggcgtgtcatgttctacacaatggcggagtatgcagctttcatggctgccagtgcgttgcaagtcgtttacatccgccgcctgttcagtaaaaacgtggggtacaacagggtctagggcaccgtctacttggcatggcagcagcagatggctccaacagggaatattttctgtcatattgtagcatttcaccccctctctttggtgctagtctaaaaaaaacactcctctttttaatttatcaccttgtacctttagcatcaactattatgaaatgtgaagcttacttgtggaacatagatacataattaatcctcagagtcttcatatcgaaaagaagaaaaaaagaggtgtcaagagtactgatgatgtgtcaccaagtttgtaatcctcgtacaaagttcttgttctctcttgttccactataccccagcttgatcaagtagaagagaatgtcgatgattggttgatctatgtg

SEQ ID NO: 2163 - DNA, 1265 bp, Oryza sativa
cacaagcagccactcgcgcgcacatggccacgtcacgcaaaacccgcagaattacgcgattcgctgagcccttttctgcaaaaacacgcagcctccctcttctccccaatctagcccgtgacctcctcgccggggctacttctccatcgccatcgacctcgacctcgccgcctcctcctcctcctcctccccgtgcgaactccgggctcgtgccgagggggtggacgcgccggtggtgagagcggacgcggtgcggtgggccatggcggtggggtggcggccggcgatgctggtggtggtggtggcggtggcggcgtggcgcggggaggcgctgtcggtgacggtgaccgacacggagtgcatccacgagttcgtgccctacgagggggacaccgtgtcggggaacttcgtcgtcgtcgaccacgacatcttctggagctccgaccaccccggcatcgacctcacggtaacttcaccaggtggcaacactgtgtatacattgaaggggaagtctggtgacaaatttgaatttaaagctccaaggggtggaatgtacaagttctgcttccataatccatatggagcacctgaaaccgtttctttctacattcatgttgggcacatacccaacgagcacaatctggcaaaagatgagcacttggaccctatcaatgtgaaaatagcggagctgaaggaagcattagaatctgtcactgctgagcagaaataccttaaagcccgtgaagctcgtcaccgacacacaaatgagagcacaagaaggcgtgtcatgttctacacaatagcggagtacctagctttcatgggtgcaagcgctttgcaagttgtttacatccgtcgcctattcagcaaaaacgtggcatacaacagggtgtagaacagagtctacttcaaggcagcagaaaatggttggagcaggaaaaaaatatttccaacatattgtgttagcttttgcagccattttttttgggtttagtctaaaacgtggcacttttaaatttattgccttgtactttagaacttcagtgagatatgaagcacatttgttgctgaacaagtgaacacagatccgtaactaatcttcaaagggttgatgtctcaaagcaccacttgtgttattgtgttaatatgacttatgagggtcttcgttctgatataaattgatcaaattttatcctggtctatgcaattcattcaaagcacaacgtttcctcgttatggaatgaaaaggaagtgttctatgtcac

SEQ ID NO: 2164 - DNA, 1123 bp, Triticum aestivum
ctcgtgccgaattcggcacgaggcgacatctgccccctccccgtctgcaaccttgccctcgtgacctccgtctcgcgtgccctcccctccctcccctcccccgtcgtgcgcgaccggagctcgccgcccaccacccgtgaaccccagccctagaccagcggggctggtgattctggtgcgagcgttggatcagctacccaccggcgggccatggcgaggtggcggccggcgatgctgctggtagcggcgctggcgctggcggcggccgccgggtggcgggcggaggcgctgtcggtgaccgtgacggacaccgagtgcatccacgagttcgtgccctacgagggcgactccgtctcgggcaacttcgtcgtcgtcgaccacgacatcttctggagctccgaccaccccggcatcgacctcacggtaacttcaccaggtggtaacaccgtatatacgatgaagggaaagtctggtgacaaatttgacttcaaagctccaaggggtggaatgtacaagttttgcttccataatccatatggggcacctgaaactgtttctttctacattcatgttgggcacatacccaatgagcacaatttggcgaaagatgagcacttggaccctatcaatgtgaaaattgcagagctgaaggaagcactggaatctgtcactgccgagcagaagtacctaaaagcacgtgacgctcgtcaccgacacacaaacgagagcaccaggaggcgtgtcatgttctacactatggcggagtatgcggctttcatggccgccagtgcgttgcaagtcgtttacatccgccgcctgttcagtaaaaacgtggggtacaacagggtctagggcaccgtctacttcaaggcatggcagcagcaggtggctccaacagggaatgttttctgtcatattgtagcttttcacccctttttcttggtgttagtctaaaaatactctttaatttatatcaccatgtacctttagcagcaactatcgtgaaatgtgaagggcacttgtgggacatagatacataattaatcctcagagtcttcatcatattgaaaggggaaaaaagggtgtcgagagtatcgatgatgtgctatgaatttgtcaatcc

SEQ ID NO: 2165 - DNA, 1358 bp, Triticum aestivum
ctccgtctcgcgtgccctcccctccctccccgaccccgtcgtgcgcgaccggagctcgccgcccaccccccgtgaaccccagccctagaccagcggcgctggtgcttctggtgcgagcgttggatcagctacccaccggcgggccatggcgaggtggcggccggcgatgctgctggtagcggcgctggcgctggcggcggccgccgggtggcgggcggaggcgctctcggtgaccgtgacggacaccgagtgcatccacgagttcgtgccctacgagggcgactccgtctcgggcaacttcgtcgtcgtcgaccacgacatcttctggagctccgaccaccccggcatcgacctcacggtaacttcaccaggtggtaacactgtatatacgatgaagggaaagtctggtgacaaatttgacttcaaagctccaaggggtggaatgtacaagttttgcttccataatccatatggggcacctgaaactgtttctttctacattcatgttgggcacatacccaatgagcacaatttggcgaaagatgagcacttggaccctatcaatgtgaaaattgcagagctgaaggaagcactggaatctgtcactgccgagcagaagtacctaaaagcacgtgacgctcgtcaccgacacacaaacgagagcaccagaaggcgtgtcatgttctacacgatggcagagtacgcggctttcatggccgccagtgcgttgcaagtcgtttacatccgccgcctgttcagtaaaaacgtggggtacaacagggtctagggcaccgtctacttcaaggcatggcagcagcaggtggctccaacagggaatgttttatgtcatattgtagcttttcacccctttttcttggtgttagtctaaaaatactctttaatttatatcaccatgtacctttagcagcaactatcgtgaaatgtgaagggcacttgtgggacatagatacataattaatcctcagagtcttcatcatattgaaagggaaaaaaagggtgtcgagagtatcgatgatgtgctatgaagtttgtaaatcctggtacaaagttcttgttctctcttttattctatcacgtcttggtccagggacagggaatgggctaatggcttgcaatgaaattgcgatgatctagctaagcctcatgggggtgtgatttgtgtctaggatgccgaaaagcttggtaatatcatgggtggtactgggtatggaggaaaattttgttgtaaactctgtttacagtgtcaaaatttcatgggtatttattgctcctcttttgtgaacggtacactacatgcaagtgaaactttgcaagacagaaggacattgttgtttgta

SEQ ID NO: 2166 - DNA, 1093 bp, Triticum aestivum
ctcgtgacctccgtctcgcgtgccctcccctccctccccgaccccgtcgtgcgcgaccggagctcgccgcccaccccccgtgaaccccagccctagaccagcggcgctggtgcttctggtgcgagcgttggatcagctacccaccggcgggccatggcgaggtggcggccggcgatgctgctgatagcggcgctggcgctggcggcggccgcggggtggcgggcggaggcgctctcggtgaccgtgacggacaccgagtgcatccacgagttcgtgccctacgagggcgactccgtctcgggcaacttcgtcgtcgtcgaccacgacatcttctggagctccgaccaccccggcatcgacctcacggtaacttcaccaggtggtaacactgtatatacgatgaagggaaagtctggtgacaaatttgacttcaaagctccaaggggtggaatgtacaagttttgcttccataatccatatggggcacctgaaactgtttctttctacattcatgttgggcacatacccaatgagcacaatttggcgaaagatgagcacttggaccctatcaatgtgaaaattgcagagctgaaggaagcactggaatctgtcactgccgagcagaagtacctaaaagcacgtgacgctcgtcaccgacacacaaacgagagcaccagaaggcgtgtcatgttctacacgatggcagagtacgcggctttcatggccgccagtgcattgcaagtcatttacatccgtcgcctgttcagtaaaaacgtggggtacaacagggtctagggcaccgtctacttcaaggcatggcagcagcaggtggctccaacagggaatgttttatgtcatattgtagcttttcactccttttttttggtgttagtctaaaaatacactctttaatttatatcaccatgtacctttagcagcaactatcgtgaaatgtgaagggcacttgtgggacatagatacataattaatcctcagagtcttcatcatattgaaagggaaaaaaagggtgtcgagagtaccgatgatgtgctatgaagtttgtaaatcctggtataaagttctggttctctct

SEQ ID NO: 2167 - DNA, 1005 bp, Leymus cinereus x Leymus triticoides
gacctccttctcgcctctcgcgtgccctcccctctcgaccccgtcgtaggcgaccggagctcaccgcccaccccctctgaaccccagccctagaccagcggcgctggtgcttctggtacgagcgttggatcagctacccaccggcgggccatggcgacgtggcgaccggcgatgctgctggtagcggcgctggcgctggcggcggccaccggctggcgggcggaggcgctgtcggtgacggtcacggacaccgagtgcatccacgagttcgtgccctacgagggcgactccgtcacggggaacttcgtcgttgtcgaccacgacatcttctggagctccgaccaccccggcatcgacctcacggtaacttcaccaggtggtaacactgtatatacaatgaagggaaagtctggtgacaaatttgagttcaaagctccaaggggcggaatgtacaaattttgcttccataatccatacggggcacctgaaaccgtttctttctacattcatgttgggcacatacccaatgagcacaatctggcgaaagatgagcacttggaccctatcaatgtgaaaattggagagctgaaggaagcactggaatctgtcactgccgagcagaagtacctaaaagcacgtgacgctcgtcacagacacacaaacgagagcaccagaaggcgtgtcatgttctacacgatggcagagtacgcggctttcatggctgccagcgcgttgcaagtcgtttacatccgccgcctgttcagtaaaaacgtggggtacaacagggtctagggcaccgtctacttggcatggcagcagcaggtggctccaacagggaatattttctgtcatattgtagcttttcaccctctctttggtgctagtctaaaaaaacactcctctttttaatttatcaccttgtacctttagcagcaactattgtgaaatgtgaagcttacttgtggaacatagatacataattaatcctcagagtcttcatatcga

SEQ ID NO: 2168 - DNA, 726 bp, Pseudoroegneria spicata
ggggtggcgggcggaggcgctctcggtgaccgtgacggacaccgagtgcatccacgagttcgtgccctacgagggcgactccgtctcgggcaacttcgtcgtcgtcgaccacgacatcttctggagctccgaccaccccggcatcgacctcacggtaacttcaccaggtggtaacactgtatatacgatgaagggaaagtctggtgacaaatttgagttcaaagctccaaggggtggaatgtacaagttttgcttccataatccatatggggcacctgaaactgtttctttctacattcatgttgggcacatacccaatgagcacaatctggcgaaagatgagcacttggaccctatcaatgtgaaaattgcagagctgaaggaagcactggaatctgtcactgccgagcagaagtacctaaaagcacgcgacgctcggcaccgacacacaaacgagagcaccagaaggcgtgtcatgttctacacgatggcagagtacgcggctttcatggccgccagtgcgttgcaagtcgtttacatccgccgcctgttcagtaaaaacgtggggtacaacagggtctagggcaccgtctacttcaaggcatggcagcagcaggtggctccaacagggaatgttttctgtcatattgtagcttttcacccctttttttggtgttagtctaaaaatactctttaatttatatcaccatgtacctttagcagcaa

SEQ ID NO: 2169 - DNA, 753 bp, Lolium multiflorum
gtggcgcgcggaggcgctgtcggtgacggtcaccgacaccgattgcatccacgagttcgtgccctacgagggcgactccgtcacggggaacttcgtcgtcgtcgaccacgacatcttctggagctccgaccaccccggcatcgacctcacggtaacttcaccaggtggtaacactgtacattcaatgaagggaaagtctggtgacaaatttgagtttaaagctccaaggggtggaatgtacaagttttgcttccacaatccttacggggcacctgaaacggtttctttctacattcatgttgggcacatacccaatgagcacaatctggcgaaagatgagcacttggatcctatcaatgtgaaaattgcagagcttaaggaagcattagaatctgtcactgctgagcagaagtacctaaaagcacgcgaggctcgtcaccggcacacaaatgagagcaccagaagacgtgtcatgttctacacgatcgcggagtacctagctttcatggctgctagcgcgttgcaagtggtctacatccggcgcctgttcagtaaaaacgtggggtacaacagggtctaggacaccagacttcttgaaggcagcagcagatgttcgcaacagggaaatattttctgtcatattgtagcttttcaccctcttttttggtgttagtctaaagatgctggtttaatttatcaccatgtaccttacctttagcaactattgtgaaatgtgaagcgcaattgttgtgc

SEQ ID NO: 2170 - DNA, 2133 bp, Panicum virgatum
tggatcgtagcagcaaccgctgcgaaaaacgccaagctgctaccggcggattgaaaactgccacttgccgggagtcggagctcggaaggaatccgagtcatcggctaccgccgcccatcactccagttggccgcgcagctcacccactcctctgatcgctccaataatgcgagcacagcccgcgcggatcgcactgccgtcgcggttctcctttcggacggcattccattatcgctcgctgggcgtggatgacacgaaagcacaagggtttggacgcctccaagcgccacaagcaatcgtccgaaagcaggaatcccaagagcggaaaggttggcgccttggcggggggcgtgccgcgtgcggggggcctggccttgttgttagtctctcgcccgttcacgcgcccccattggacggacagggacagcaggagtctccgcccccttcccgcgccgctctgccaatgcgtgcaagacaccagacatgaccgggcagtggtgggtgacttgccatcgcgcgcaactgctgctgctgctgttatatattgggagtcggtggtgcccgcggcccggtcgtggcacctcgtttccagtttgctctcgagtggcagggggcgatggcgaagggcagcgctgccatggccgccgccgccgccgcggtcctcgccctggcggcgctcctgtgcgcgccggccgccgcggagctggcccggctggagcacccggccaagaacgacgggtcgctcagcctgctcgtcgtcggagactggggccgcaagggcacgtacaaccaatccagggtcgccgagcagatggggaaggttggggagcagctcggcatcgacttcgtcgtatccaccggcgacaacttctacgagaacggcctgactggcacagatgaccaggcgttcgagcaatccttcaccgacatctacacggccaagagcttgcagaagccgtggtacctcgttctgggaaatcatgactacaggggtgatgttcttgcacagctgagcccagtcctgcgaaagatcgacagccgattcatttgcatgaggtcgttcatcgttaacgcagaaattgtggatttcttctttgttgacaccactccatttcaactgaagtactggactcaccctaaagatgatcattatgactggagaggagtggcgcctcgagagaagtacttagccaatttgctgaaggatctggacgaggccatgaggaaatcaacagcaacgtggaagattgctgtgggccatcataccatgaggagtgtcagtgatcatggtgacaccaaggagcttctgcagctacttcttccagtcctccaggccaatggcatcgacttctacatcaacggacacgaccactgcctggaacatattagcagcaaaaacagcccaatccaatacttcacaagcggaggcggttcgaaagcatggagaggagtgttccagcccaacgaagacaacgttgagttcttctatgatgggcaagggttcatgtccctccagctcgaccacaaccaagccgagttcaccttttatgacgtcaatgggaatgtgttgtaccaatacacgcagtcaagcctgaggaaaacaagccacctccagccctctggctatgccactgaggaatgaggcggatgcagatcaccaacagagaatagagaccggttcaggtatatcccacatccgtgtgaaatttgaatgtggtattgtagtaagcggcagaagtggtctatagaggaaatgtactagtcttaactagtcctgaagtatggtatgtggttcatctatccagagagaagggatatttaggttgtgcttcaataccgctttcaacatttatcactgctttttgagattatgtggctcatgacaccatctctaaaagtaccatgatacaaattcaaaatgttcgttgtgcacccccaacataaaaacaagcggaacgaggtgaacactcatagagggaggagaggcaaaagggaggaggtggggtagtgcggtgggtcgaatgacggcacttgccggagcgggtgaaagaggagaatagaacagagcagggagatggccgaggaatggggtactgggaactcactccgcttccatatgagccagatggagcg

SEQ ID NO: 2171 - DNA, 1312 bp, Panicum virgatum
tctcgagtggcagggggcgatggcgaagggcagcgctgccatggccgccgccgccgccgcggtcctcgccctggcggcgctcctgtgcgcgccggccgccgcggagctggcccggctggagcacccggccaagaacgacgggtcgctcagcctgctcgtcgtcggagactggggccgcaagggcacgtacaaccaatccagggtcgccgagcagatggggaaggttggggagcagctcggcatcgacttcgtcgtatccaccggcgacaacttctacgagaacggcctgactggcacagatgaccaggcgttcgagcaatccttcaccgacatctacacggccaagagcttgcagaagccgtggtacctcgttctgggaaatcatgactacaggggtgatgttcttgcacagctgagcccagtcctgcgaaagatcgacagccgattcatttgcatgaggtcgttcatcgttaacgcagaaattgtggatttcttctttgttgacaccactccatttcaactgaagtactggactcaccctaaagatgatcattatgactggagaggagtggcgcctcgagagaagtacttagccaatttgctgaaggatctggacgaggccatgaggaaatcaacagcaacgtggaagattgctgtgggccatcataccatgaggagtgtcagtgatcatggtgacaccaaggagcttctgcagctacttcttccagtcctccaggccaatggcatcgacttctacatcaacggacacgaccactgcctggaacatattagcagcaaaaacagcccaatccaatacttcacaagcggaggcggttcgaaagcatggagaggagtgttccagcccaacgaagacaacgttgagttcttctatgatgggcaagggttcatgtccctccagctcgaccacaaccaagccgagttcaccttttatgacgtcaatgggaatgtgttgtaccaatacacgcagtcaagcctgaggaaaacaagccacctccagccctctggctatgccactgaggaatgaggcggatgcagatcaccaacagagaatagagaccggttcaggtatatcccacatccgtgtgaaatttgaatgtggtattgtagtaagcggcagaagtggtctatagaggaaatgtactagtcttaactagtcctgaagtatggtatgtggttcatctatccagagagaagggatatttaggttgtgcttcaataccgctttcaacatttatcactgctttttgagattatgtggctcaagacaccatctctaaaagtaccatgatac

SEQ ID NO: 2172 - DNA, 1446 bp, Pennisetum glaucum
accccggccgcctcctccctccctcctcttccttcccgggtggtggagtggtgacttgccgtcgcgtcgcgtgccactgccgctattatatatcggccgtcagtgtcccgcccccatcttttccagtttgcttcgagtgcggactgcggagtgccgaggggagggggagcgatcgatggcgaagggcagcgctgccatggccgccacctccgccgcggcggtcctcgcactggccgcgctcctgttgtgttcttcgccgaccgccgcggagctgcctcggctggagcaccacccggccaagaacggcgggtcgctcagcctcctcgtcgtcggcgactggggacgcaagggcgcgtacaaccaatccagggtcgccgagcagatggggaaggttggggaggagctcgacatcgacttcgtcgtgtccaccggtgacaacttctacgagaatgggctgacgggcacagatgaccaggcgttcgagcaatccttcaccgacatctacacggccaagagcctgcagaagccctggtacctcgttctgggaaaccatgactacaggggtgatgttcttgcacagctcagcccagtcctgcaaaagattgacagccgattcatttgcatgaggtcgtttattgttaacgcagaaacagtggatttcttctttgttgacaccaccccatttcaactgaagtactggactcaccctaaagatagccattatgactggagagaagtggcacctcgagcaaaatacttagccaatttgttgcaggatttggacgaggcaatgaagaaatcaaccgcaacgtggaagattgccgtgggacatcacaccatgaggagtgtcagtgatcacggtgacaccaaggagcttctgcagctgttacttccagtccttcaggccaacgacgtcgacttctacatcaacgggcacgaccactgcctggagcacattagcagcagggacagcccgatccagtacttcacaagcggaggcggttcgaaagcatggagaggagtgttccagcccaacgaagataatctcgagttcttctacgacgggcaagggttcatgtccctcgtgctcgaccacaaccaagccgagttcaccttctacgacgtcgatgggaatgtgctctaccaatatactcggtcgagcctgatgaaaacaagccaccagcagccctcgggcggctatgccacagaggaatgagtcggatgcaggtcgtcgccaccggagaatagatcgagacaggttcaggtagccgatgtaaaatttgaatgtggcattgtgataagcggcggagaagtgatctgacacacaaaaaaatgtactattagtgctgaaggtatggcttgtagtagttcaccagctctccacggagaaaaggaataactagaggtttactgatcacttctctttgaatttgatgccagggaatc

SEQ ID NO: 2173 - DNA, 1303 bp, Cenchrus ciliaris
  misc_feature (842)..(842): n is a, c, g, or t
  misc_feature (893)..(893): n is a, c, g, or t
  misc_feature (936)..(936): n is a, c, g, or t
  misc_feature (942)..(942): n is a, c, g, or t
  misc_feature (972)..(972): n is a, c, g, or t
  misc_feature (984)..(984): n is a, c, g, or t
  misc_feature (997)..(997): n is a, c, g, or t
  misc_feature (1008)..(1008): n is a, c, g, or t
  misc_feature (1015)..(1015): n is a, c, g, or t
  misc_feature (1017)..(1017): n is a, c, g, or t
  misc_feature (1029)..(1029): n is a, c, g, or t
  misc_feature (1058)..(1058): n is a, c, g, or t
  misc_feature (1102)..(1102): n is a, c, g, or t
  misc_feature (1177)..(1177): n is a, c, g, or t
  misc_feature (1225)..(1225): n is a, c, g, or t
  misc_feature (1248)..(1248): n is a, c, g, or t
  misc_feature (1252)..(1252): n is a, c, g, or t
  misc_feature (1269)..(1269): n is a, c, g, or t
cgatatcgttttcagtttcattcgggtgcttgccctgcttggggggagggagagcgatcgaaggcgaagggcagcgctgccatggccgccacctcctcctccgccgcggcggtcctcgcactggccgcgctcctgttgtgttcgccggccgccgcggagctgccgcggctggagcaccacccggccaagaacggcgggtcgctcagcctcctcgtcgtcggcgactggggacgcaagggcacgtacaaccaatccagggtcgccgagcagatggggaaggttggggagcagctcgacatcgacttcgttgtatccaccggcgacaacttctacgagaacggcctgaagggcacggatgatgaggcgttcgagcaatccttcaccgacatctacacggccaagagcctgcagaagccctggtacctcgttctgggaaaccatgactacaggggtgatgttcttgcacagctcagcccagtcctgcaaaagattgacagccgattcatttgcatgaggtcgtttattgttaacgcagaaattgtggatttcttctttgttgacaccaccccatttcaactgaagtactggactcaccctaaagataaccattatgactggagagaagtggcacctcgagcaaaatacttagccaatttgctgcaggatttggacgaggcgatgaagaaatcaaccgcaacgtggaagattgccgtgggccatcacaccatgaggagtgtcagcgatcacggtgacaccaaggagcttctgcagatgctacttccagtccttcaggccaacgacgtggacttctacatcaacgggcacgatcactgcctggagcncattagcagcagggacagcccgatccagtacttcacaagcggaggcggttngaaagcgtggagaggagtgttccagcccaacgaagataagctngagttnttttacgacgggcaagggttcatgtcgatngagctcgaccanaaccaagccgacntcaccttttangacgtcnangggaatgtgctntaccaatatacgcggtcgagcctgatganaacaagccacctccagccctccggctatgccaccgaggaataangagtcggatgcagctaggtcacccgctggagaatagagatgggttcaggtatcctgtatccgtgtaagatttgantgtgccgtacgttgtgatagagcgggagagaagtggtagagagggaantggtgtacgactagcactaagtntggngtgtactagctcatttntccatggagagaaggaatccctaggtttatgtga

SEQ ID NO: 2174 - DNA, 1206 bp, Saccharum officinarum
ctgcttccagtgcccgacgaggccgatcgacgatggcgcagcgcaaagctgccatggtggccgcagcgttcttcgtccttctcgccgtggccccgctcctgtgcgcaccggccgccgcggagctggtccgcctggagcacccggccaagaacgacggctccctcagcctgctcgtcgtcggcgactggggccgcaagggcacgtacaaccagtccagggtcgcccagcagatgggcaaggttggggagcagctcaacatcgacttcgtcatatccaccggggacaacttctacgagaacggcctgacgggcacggatgaccaggcgttcgagcagtccttcaccgatatctacacggcaaagagcctgcagaagccgtggtacctggtactgggaaaccatgactacaggggtgatgcgctcgcacagctgagcccagtcctgcaaaagatcgacagccgattcatctgcatgaaatcattcatcgttaatgcagaaattgtggacttcttctttgttgacaccactccgtttcaactcaagtactggactcaccctaaagatgatcactatgactggagaggagtggcaccacgagaaaaatacataaataatttgctcaaggatttggatgaggccatgaagaaatcaactgcagcgtggaagattgctgtgggccaccataccatgaggagtgtcagtgatcatggtgacactaaggagctattgcagctactgcttccagtcctccaggccaacggcgtggatttctacatcaatgggcatgaccactgcctggaacacattagcagcagagacagcccaatccaatacttcacaagcggaggcggttcgaaagcatggagaggagtgcaaaacaccaacgaggatgacctcaagttcttctatgatgggcaagggtttatgtccctccagctcgaccatagcgaagcctatttcaacttttacgatgtcgacgggaaagagctgtaccattactcgcggccgagcctgaggaaaactgcaggccacctccaagcctccggctatgtcaacgaggaatgaagcaggagcgagaataatcagcagctggagaatagtgatcgattctgatcagtgtaaaattcgaatgtgactgatgagcggcatacgtggtttacagaggaagtgtattagtagcatttattgaagtacgagatgtgtggtt

SEQ ID NO: 2175 - DNA, 2162 bp, Sorghum bicolor
atcgcattataccccggcttttctgtcttttctcgacgccgctttccattatcgctcgctgcctgtgaatgacacgcaagtgaaaactgtttcgacgtccccaagcgcgacaacccgacaagcaatcagaaagccgaaggaggggaaggattattggcaggtgcgaggcctcgtcacccgttcacccgcccattggccggacagggacagccggagcctcctccagtatccccgtcaatgcttgcaagacacccaaacaggcagtgacttgccgtcgcgtgctaccaccccctgataactgatatattatatatatcggccgctgtcaagcccggcactgccatcgatcgagcgatcggcttctcggctcctgcttccagtgcccgacgaggccgacgatggcgcagcgcaaagttgccatggcggccgcagcgttcttcgcccttctcgccgtggcttcgctcctgtgcgcgccggccgccgcggggctggtccgcatggagcacccggccaagaacgacggctccctcagcctgctcgtcgtcggcgactggggccgcaagggcacgtacaaccagtccagggtcgcctatcagatgggcaaggttggggagcagctcaacatcgactttgtcatttccaccggggacaacttctacgagaacggcctgacgggcacggatgatcaagggttcgagcagtccttcaccgatatctacacggcgaagagcctgcagaagccgtggtacctggtactgggaaaccatgactacaggggtgatgcgctcgcacagctgagcccagtcctgcgaaagattgacagccgattcatttgcatgaaatcatttatcgttaatgcagaaattgtggacttcttctttgttgacaccactccgtttcaactcaagtactggactcaccctaaagatgatcactatgactggagaggagtggcacctcgagaaaaatacataaatattttgctcaaggatttggatgaggccatgaagaaatcaactgcggcgtggaagattgccgtgggccaccataccatgaggagtgtcagtgatcatggtgacactaaggagctactgcaactactgcttccagtccttcaggccaacggcgtcgatttctacatcaacgggcatgaccactgcctggaacacatcagcagcagagacagcccaatccaatacttcacaagcggaggcggttcgaaagcatggagaggagtgcaaaataccaacgaagatgacctcaagttcttctatgatggacaagggttcatgtccctccagctagaccatagcgaagcccatttcaccttttacgatgtcgatggagaggcactgtaccattacacgcggccgagcctgaggaaaactgcaggccacctccaagcctccggctatgtcaacgaggaatgaagcaggagcgagaataatcagctagcagcagctggagaatagtgatcgattctgatcagtgtgaaattcgaatgtgactgatgagcgggcatacgtggtctacagaggaagtgtattattagtagcatttatttaagtatgagatgtggttcatctgtcactgccgttggaaactatttggcccatgccaccggttccaaaacatgccctgcaagtttgcacggcggccccatcgctccagtatctagttgctcggtcatattgttcgcggccctcgccatcactccatttgatcatgtaagatctttttcctttggatgacaggttgacaactatgggctgcttggaacggattctagatagattttggcgaaaatattaaacctatagcctcgggcgacgtgttttttgacccgcttcttctctcctagtctgccgccctacccccgtgcctcctcctccatccaccagagcagacggagccaacctcgccacaattgttgttgaatggcttatgagtgggcctgtcgcccatcaccgaaccagaggagagtcagcgttgcaacagcttgcctccttttcttcatcacggagacctgcctcatcctccttgtcctcgtcagtaaggggcgtagcccagtggaggctagagcccaagcaggtgggccgtgcccgttgccgacgagcgagcatcgtgcttctatgtcttgtgtttttctactataaaatctg

SEQ ID NO: 2176 - DNA, 1719 bp, Zea mays
cccccgtcaatgcttgcaagacagaagacacctgacctgatctgaccaggcagatcgagtggcttgccgtcgcgtgcaaccgcaaccgccgctggtattatatagagacccctattacatatatcggccgctgtggcgcttgtcgtcgatcgttccatcgaccggcggccggccagcctagctcttggctcttgctccgatcggatcgagcgccggacaagtcaaggcagccgtacgtacgacgatggcgcagggcagccgcagcgctgccgtgcccgccgcagcgtccttcttcgcccttctcgccgtggcggccccgctgctcctgtgctgcgcgccggccgccgcggagctggccaggctggagcacccgcccaaggacggcggctcgctcagcctgctcgtcgtcggcgactggggccgaaagggcacgttcaaccagtccagggtcgcccatcagatgggcagggttggggagcagctcagcatcgacttcgtcatatccaccggcgacaacttctacgagaacggcctgacgggcacggatgacgaggcgttcgagcagtctttcaccgatatctacacggcgaagagcctgcagaagccgtggtacctggtgctgggaaaccatgactacaggggtgacgcgctcgcgcagctgagcccggtcctgcggaagatcgacagccggttcatttgcatcaaatcattcgtcgtcaacgcagaaatcgtggagttcttcttcgttgacaccaccccgtttcaactcaagtactggactcaccctaaggacgatcactacgactggagaggggtggcgcctcgggaaaactacataaacaatctgctcaaggatttggacggggccatgaagacatcgactgcggcgtggaaggttgccgtgggccaccataccatgaggagtgtcagtgatcatggtgacaccaaggagctactgcagctactgcttccagtcctccaggccaacggcgtcgatttctacatcaacgggcatgaccactgcctggaacacatcagcagcagagacagcccaatccagtacttcacaagcggaggcggttccaaggcatggagaggagtgcagaaccccaccgaagatgacctcaagttcttctacgacgggcaaggcttcatgtccctccagctagaccgtagccaagccaagttcaccttttacgatgtcgacgggaaggcgctgtacagttacacacggtcgagcctgatggaaacaggccaccacctccaagcctccggctacgtcaacgaggaatgaagcaggggcgagtcagcatgcagcgctggagaactgagatcgatgcagttcaagcgtacgtataaattctcgagtgcttgatgtggttcatctgtcaagggcaacaacagttaggtttatatgtgtgcccttgcatctctcgacatctgtcactgccgtccggtactatttggggtcatgccatcgattcgaaaacatgacatggtaggggcagccatgatgtagcaaaaaaaaaaatagtgcaaatattcattatcgaggagttaaaacattaattgtgtggacagcggccgagcataggaccaaaatcagcagggggcaatcaacagattatgtaaaaattacatggttcagtggtgcgacaataaagacacagtatatatatggaaatatatcgtatgcaatcaagcgatgtgctacaccct

SEQ ID NO: 2177 - DNA, 1516 bp, Setaria italica
atatctccctccccggggttccctattggttggcctattccctacctttcccttccttccccttctgcctgcctgtggcaactgccaagacacctgaccgaggtgtgggcttgctttgctgcggcgcacgcgcgctaccaactggtgccctccgttcttgctccctccgggtgcgccgcgctatggcgaagggcggcgctgccatggcgctcgccctcctggccgcggcggccgcgctcttgtgcgctgtggcggcgctgccccggctggagcacccggccaagaccgacgggtcgctcagcctgctcgtcgtcggggactggggccgcaaggggatgtacaaccagtcccgggtcgccgagcagatgggcagggtcggggaggagctcgacatcgacttcgtcgtatccaccggcgacaacttctacgagaccgggctgacgggcgtggatgaccatgcgttcgagcaatccttcacagacatctacacggcgaagagcttacagaagccgtggtacctcgttctgggaaatcatgactacaagggtaatgctttagcgcagtttagcccagtcctacggaagatcgacagccgatttatttgcatgagatcattcatcgtgaacgcagaaattgcggatttcttctttattgacaccaccccatttcaactgaaatattggactcacccgaaaggaaatcattatgattggagaggagtagcaccccgcgagaaatacataaccaacttactgaaggatttggatgaggcaatgaagaaatcaaccgcaaagtggaagattgctgttggccatcataccatgaggagtgtcagtcaccatggtgacaccaaggagcttctccagctgcttcttccaatcctcaagattaacggcgttgacttctacatcaatgggcatgaccactgcctggaacacataagcagcagagacagtccaatccaatacttcacaagcggtggcggttccagagcatggagaggattcttccagccaaatgaagatagcctcaagttcttttatgatgggcaagggttcatgtccctccagctacaccaggaccaagctgacttcatcttttacgacgttgatgggaatatactgtaccggtactcccagtggagcttgagaaaagcatacctccctgcaagctatttcgctgaagaatgaggcagatccaaatcaccattgtagcattagattggtgcagttctctgtgaaaaatttgaatgagccattgcggtaagtggcataagtggtctggaaatgaaaaaaatgctagtatttaatatgttgtgtcatctgccaaagaaacatgtagtggcatgcacttcctactacagtaggagcagagatgcaatgtggatgtgcaagcctgcaaggtccatttgtttctggcatatgagccactgggaactacttatgcaatataggattcgattgtaggaatatttacagattccacaaattaagaaccatgttctctcttgtgtttc

SEQ ID NO: 2178 - DNA, 1387 bp, Leymus cinereus x Leymus triticoides
  misc_feature (41)..(41): n is a, c, g, or t
  misc_feature (147)..(147): n is a, c, g, or t
  misc_feature (224)..(224): n is a, c, g, or t
  misc_feature (234)..(234): n is a, c, g, or t
  misc_feature (236)..(236): n is a, c, g, or t
  misc_feature (1278)..(1278): n is a, c, g, or t
  misc_feature (1285)..(1285): n is a, c, g, or t
  misc_feature (1312)..(1312): n is a, c, g, or t
  misc_feature (1315)..(1315): n is a, c, g, or t
  misc_feature (1343)..(1343): n is a, c, g, or t
  misc_feature (1345)..(1345): n is a, c, g, or t
  misc_feature (1347)..(1348): n is a, c, g, or t
ccgttgctgtcgattaaccacactgcggccgtccccgtccncgtccggccacccatggcgaggaggagcggcgcttccatggccgtggtgctcgccgtcctggccgtggccgcgctccggtgcgcgccggccgccgcggagctcccnctggtggagcacccggccaagaacgacgggtcgctgagcctgctcgtcatcggggactggggccgcaagggcacctncaaccaatcnanggtcgcagagcagatggggaaggtcggggagaagctggacatcgacttcgtggtctccaccggcgacaacttctacgagaacggcctcacgggcgtccatgaccagcagttcgaacaatccttcaccaacatctacaccgcccagagcttgcagaagccgtggtacctcgttcttggaaaccatgactacaggggtgatgcgctagcacagcttgacccagtcatgcggaagatcgacgagcgattcgtttgcatgagatcatttgttgtcaatgcagagatcgtggagttcttcttcatcgacactactccatttcaactcaagtactggactcaccctaaagacagtcactatgactggagaggagtggcgcctcgagaaaactacatagctaatctgctgaaggatttggatgaggcaatgaagaaatcaactgcaaagtggaagattgctgttgggcatcataccatgaggagtgtcagtgaccatggggacaccaaggagctcctgcaattgcttcttccagtcctcaaggttaacggcatcgacttctacatcaatgggcatgaccactgcctggaacacattagcagcagagacagtccaatccaatacttcactagtggaggcggttcaaaagcctggaggggagtctaccaaccaaatgatgataagctccagttcttttatgatgggcaagggttcatgtccctccagctaaaccaggaccaagctgacttcgtcttttatgatgtttctgggaaagtcttgtacgagtggacctcgcgcaaaacaaaccacttccagccctccatctatgtcactgcagaatgagggagatgcagatcatggcaggagaattagttcggtagcgctatttgtgaaaaaattgaatgtgccactgtggtaacagtggtaaaggtaatagattggtattaagtatggtgtgtggttcagtgctgaagaaatatttaactggctgcaataagggagcagagatgctcagtatggtgtccattggttctgatgcatacatgagtngcagggntctactgatgcgatgtgcatttagagntangacataaactctagtattgtgcccctgnantnnaaaaattaaataaactagtatctggcggtgacctttgca

SEQ ID NO: 2179 - DNA, 2185 bp, Brachypodium distachyon
gtatgcgtgccccagtgtttctcgaagaaaaacactattgcttgcttgcttgcgattgcaaggcagctaaccaaccagaaccaagtgcatgtaaccactaacttgccctggtatccctcttgaaccctgcgggctcgatccgctaccactatatatccgcatcgtactgtccatcgctttctcgcttgccttaaccccattgctgccgtgcccagcccttcgccatccggccatcgatcgatccccatggcgagaagccgcgctccgatggccgcgttcctcgcgctcctggccgttgccgctggtgtcgccgcggccgagctcacccgggtggagcacccggccaagaacgacgggtcgctgagcctgctcgtcgtcggcgactggggccggaagggcaattacaaccagtccagggtcgccgagcagatggggaagattggggagaagctggacatcgacttcgtggtctccaccggggacaacttctacgagaacggcctcacgggcgtccatgaccagcagtttgaagaatccttcaccaatatctacaccgccaagagcttgcagaagccgtggtacctcgtcctagggaatcatgactacaggggtgatgcgctagcacagcttagcccagtcttgcagaagctcgatgagagattcttttgcatgagatcattcattgttaatgcagaaattgtggatatcttcttcatcgacaccaccccatttcaactcaagtactggactcacccaaaggacagtcactacgactggagagaagtggcacctcgagaaacatacatagctgatctgctgaaggatatggacaaggagatgaagaaatcaactgcaaagtggaagattgctattggccatcataccatgaggagtgtcagtgaccacggggacaccaaggagctactgcaattgcttcttcccgtcctcaaggttaacggcattgacttctatatcaatgggcacgaccactgcctggaacacattagcagtaaagacagtccaatccaatacttcactagtggaggtggttcaaaagcatggcgaggggtctaccagccaaatgatgataatctccagttcttttatgatggacaagggttcatgtccctccagctaaaccaggaccaagctgacttcatcttttatgatgtttctgggaacatcttgtaccagtggagctcaagtaaaataagccacctccagccctccatctatgtcactgaaaaatgaggcagatgcagaccatggcagagaattagctcggctatgctatttgtaaaaaattgaatgtgctactgtggtaacagtggagaaggaaatagattggcattaattatggtgtgtggttcgctgctgaataaatattagactggctgtgaattctgtacaagtatgttggtgttcattcattggttctgaacttctgatggataaaacagtcacagggatttacttatgtgatacacatttagagagatggcatataaactaagtagtcacctttgcatattggtaaggattcaacaagagtgcaagactattaagagtgaaagaagtactaaaaactattacatcaggcatgaaaactataaatagtatactaaatttacacttgtgaaaacgcaggcaaaaagtaaatataacctgcttgcaaggtaactgacgactcatatagaacgttcttcaaaatagaacaggtaagagctaacatttaaatccaagactctccaaagatttgttggattaatgctagataacgtcatatttatgttatcgttatgctatatttccatatcatcaggtcagtgctgaattcccttcacaatatacctgggtttcggaggaattaacaacaaaaattgtttcattggacagccaaaagggcagaaatgttgacaactttctcttcaattcttctgaataactctcccacatagcaactgctaacacaaaatcgctccattcaaaagcaaactccatattgtcataagatccaaatatggtttgtgcaaggccatggtcgcacggcaatggtagtttcattcctcttgattgttgtatttgtatagtatgattgcaaactgtttctgaaccaccagcagtctgttttctccttgctgccaactcaggtgctttccagtagtagaactgcaccacctgatta

SEQ ID NO: 2180 - DNA, 3814 bp, Panicum virgatum
gctttcctttcgggattcgaaggcgccccccttccggctgtcgcgatcgcgtggagaccgagcgggcggacgaggagcggggcgagcagcgcatgactggtggggtccgtccggtgagggaccacacgtcggtgggggtgggtgggttcgacggtggctgccgcatgtgtcgccgcgggaatgcggcgcagtcgggggccgcggcgggtgggcggggcgcgcactttttggtcgactcgcggggagagcggcggggccgcgacgtgctccgttccgtggccgttggatcggtagatgtggcggaggcaggcaggctggctccgccgcgtgatggcccaagaacatgaagcccaaccagtgattggcccataaggccccaaagacttaggcctagcctaaaccctcgccgtttcttcaccagttctctgtccggttctccaccatctgccgttagcccgcggccgccgcctcctcccgccacccagccaccgccgcctcggatggccgagccgccgcagcagccatcatcgggccccaccactccgccgcaggaagacaaccaaagcgctaagacaaatagcaagaaaagccgcggcacgaagaaatcgaagcgagccagcgcctcctcgttgggctccagcaccatggctgaggacccgttcttcgtcctcgccggcggcaaggaaggagggttcctggagttggaggagattgacgaggcggacttcgggattgtaggggcagacgtggggcacgtgggagcggatgaggggaaggcgggcggggaccgggggaagaagaagaagaagaagaaaaagaagcggaagcgtggggatgacgacgagaagaggaattcggatgatgacgagggcttgaatggcgatggcaattcggtagttgagaatgtccaggagggggagaaggagaaggagaagaagaagacgaagacgaagacgaagagaaagaggaacaggaagaagaggaaggtgaaggatagtgagaagagtgcagagagcgatgaagaagtcgctgacgacaatgcagaaggcatgcaagatgaaaatgagaatatggaacaagacaaggacgatcagcttattttgggcgaggatgatgtttttgcatggcacgagcttaggcttcaccctctgctagtcaaggcaatgtgcaggcttggattcaaagagccaactcctatacaaaagtcttgctttcctgcagcagctcatcaaggcaaggatgttattggtgcagcagagacaggttctggaaagacacttgcttttggcctccccattttgcaacgtctccttgaagagcgagaaaaggctgcaagattacaccaggatgatgaaaaaatggaagaaagttctggaggaagccctcttcgtgctcttattttgacacccaccagggagcttgcaaaacaggtatgcgatcatctaaaggatgcagccaagttcttaggaatccatgctgttcctattgttggtggtctatcaatggaaaagcaagaacgacttttgaaaaagaagcctgaaattgttgttggaactcccggaagattgtgggagctcatgtcaatgaacaatcaacacctagttgagctgcattcgttgtcattctttgtgttggatgaggctgatagaatgatcgaacgaggccatttccatgaattacaatctatcattgagatgctcccgctgactactggttctgatgaacatgctgcaagaacaatgccaaactgtgagactgtgccgatcttgcaaataaaaaagaggcaaacctttgtgttctcagccacacttgcactttcatctaatttccggaagaagctgaagcgtggcctatctatttcaaaggcatcaactgatgatgtgagctctattgaagcactgtcaaagcaggctggaatgaaaccaaatgcagaaatagttgatctgacaaaggcttcaatcttgcctgagaagcttgaagaatcttttatcgagtgcagtgaagaggataaggatgcctatctgtattatatactgagtgttcatgggcaaggtcgcacgataatattttgtacatcgattgctgcattacgccacatttcctccatattgcgaattcttggaattaatgtcttgacaaaccatgctcaaatgcaacaaagggctcgcatgaaggctgtggatcgtttccgtggaagtgagaattccattttggtcgcaactgatggttttgcaaggggtatggattttgatgatgtgcgaacagttatccactatcagttgccacattcaactgatgtttatatccatagaagtggaaggacagcacgcagatcattggctggctgcagcattgcattaatttcttctgctgacaagtcgaagttttactctctttgcaagtcattgtcaaaggagaacctccagcaatttcctgtagatcatgcttacatgcctgaggtaatgaataggctctcgcttgctcggcagattgacaagattgcgcgtaaaagttcacaggaaaatgctaacaaatcctggcttcagaggaatgctgaatccatgggattgctattggagacaagtgacagtgaagaagaacgtgtaaaaggccacatgcaacgaaaggcaacttctgcacatctccaaaagcttcaacaggaattgagtgatcttttgaaacgccccttgcagccaaagactttctcacgatgctatttggctggggctggtatttcaccattacttcagaagcaactagaagagttgaccaagagaaatgtaagcaacaaaagcagcaagtctgagaataaagggcctcgccttgttgttattggtcaggatcgtgtcgaacccttacaagcacttcagaattctgggcaagaggtctgtgtgaacttagacaaacaaaaagaaaagcaaagacttgctcagaactggaagcggaagaagcatgaagaaaagaaacgcacacgagagcagaagagaaaggagaagagaaaagcaaaagggacggagtaacaggtgagatgggtctgtttgcggaaaaggacctattgtggaattaccttcgacgcttgcgtggattcatttgaggaatgcactcgtcatgtcttcacactgatacattgggtgtgcctaccagcccttcaacaagatcgcgaggtggatggttgatgttttgtggctcaagatgattaggttagcgcgggcaccgcgacatgatttgtgcaacatgggcacgttttgtcatactccatgttcaaatctgctacaagtgtgtacatcttttcatccattgccatatttttttccccgggtgatattaattctggtgcctggtggatgtaagttcatcaagaaaaaacagcagcctagtttcactgctctactgttcggtagcaactgattcaagcatagtttggcgtgaacaacaccgaactcatttgcggagcttgacttacctctcgatgaatcagaatctccaagtggacaggagccccccgattgctagccgagcacagcacgcgcaatactgcggcctaacgtaacgtctatcactctctcggtagagggaagcaaatataacgagcaagtgcaacaaaaggaacaacgcagatcaattagaaagataacaaagatgatggccacagaagttttggcagggcaacatctgtagttctggaccattcgaaactgactggtggaaacaaacgttttagccggcaaatgttacgctgttagaaatttctatttccaactgaggttatatacaaatgcagatgctagatttgtaaggcatggaaaccaaggag

SEQ ID NO: 2181 - DNA, 3026 bp, Panicum virgatum
cattagcgctgtgctcgcccgacacttgcgccgcctcccgcacgcagccacgcaggagcgaccgagcgacggcgcagaccgcaggagggaggagcgccgccggtcgccggccatcgccgcgccgagcgtgctgaccgccgtcaaggcgcgaagagggggaggaagcttcaagccgctgcggcaccgcttgaatctaccgcggcacgaagaaattgaagcgggccagcgcctcctcgttgggctccagcgccatggctgagaacccattcttcgtcctcgccggcggcaaggaaggaggattcttggagttggaggagattgacgaggcggacttcgggattgtagggggagacgtggaggacgcgagagcagatgaggggaatgcgggcaaggacctggggaagaagatgatgaagaagaagaagcggaagcgtggggatgatgacgagaagaggaattcggatgatgacaagggcttgaacggcgatggcaattcggtagttgagaatgagcaggagggggagaaggagaagaagaagacgaagagaaagaggaacaggaagaagaggaaggtgaaggatagtgagaagagtggggagagcgatgaggaagttactgacgacaatgcagaagacatgcaagatgaaaatgagaatatggaacatgataaggatgatgagcttgtttttggcgaggatggtgtttttgcatggcgcgagcttaggcttcaccctctgctagtcaaggcaatgcgcaggcttggattcaaagagccaactcctatacaaaagtcttgctttcctgcagcagctcatcaaggcaaggatgttattggtgcagcagagacaggttctggaaagacacttgcttttggcctccccattttgcaacgtctccttgaagagcgagaaaaggctgcaagattacaccacgatgatgaaaaaatggaggaaagttctggaggaatccctcttcgtgctcttattttgacacccaccagggagcttgcaaaacaggtatgcgatcatctaaaagatgcagccaagttcttaggaattcatgttgttcctattgttggtggtctatcaatggaaaagcaagaacggcttttgaaaaagaagcctgaaattgttgttggaactcccggaagattgtgggagctcatgtcaatgaacaatcaacatctagttgagctgcattcattgtcattctttgtgttggatgaggctgatagaatgattgagcgaggccatttccatgaattacaatctatcattgagatgctcccacttactaatggttctgatgaacaagctgcaagaacaatgccaaactgtgagactgtgccaatcttgcaaataaagaagaggcaaacctttgtgttctcagccacacttgcactttcatctaatttccggaagaagctgaagcgtggcctatctacttcaaaggcatcaaccgatgatgtgagctctattgaagcactgtcaaagcaggctggaatgaaaccaaatgcagaaatagttgatctgacaaaggcttcaatcttgcctgagaagcttgaagaatcttttatcgagtgcagtgaagaggataaggatgcctatctgtattatatactgagtgttcatgggcaaggtcgcacaataatattttgtacatcgattgctgcattacgccacatttcctccatattgcgcattcttggaattaatgtcttgacaaaccatgctcaaatgcaacaaagggctcgcatgaaggctgtggatcgtttccgtggaagtgagaattccattttggtcgcaactgatggttttgcaaggggtatggattttgatgatgtgcgaacagttatccactatcagttgccacattcaactgatgtttatatccatagaagtggaaggacagcacgcaaatcgttggctggctgcagcattgcattaatttctcctactgacaagtcgaagttttactctctttgcaagtcattgtcaaaggagaatctccagcaatttcctgtagatcatgcttacatgcctgaggtaatgaataggctctcacttgctcggcagattgacaagattgcgcgtaaaagttcacaggaaaatgctaacaaatcctggcttcagaggaatgctgaatccatgggattgctattggagacgagtgacagtgaagaagaacgtgtaaaaagccacaagcaacgaaaggcaacttctgcacatctccaaaagcttcaacaggaactgagtgatcttttgaaacgccccttgcagccaaagactttctcacgacgctatttggctggggctggtatttcaccattacttcagaagcaactagaagagttggccaagagaaatgtaagcaacaaaagcagcaagtctgagaataaagggtcttgccttgttgttattggtcaggatcgtattgaacccttacaagcacttcagaattctgggcaagaggtctgtgtgaacttagacaaacaaaaagaaaagcgaaaacttgctcagaactggaagcggaagaagcatgaagaaaagaaatgcacacgagagcagaagagaaaggagaagagaaaagctaaagggatggagtaggtaacaggtgagagatgggtttgtttgcggaaaaggacctattttggaatccccttcgtcgcctgcgtggattcatttgagaaatgacactcgtaatgtcttcaccatgatacaatgggcgtgccaagttagcactaggccttgaacaagatcgcgaggtggatgattgatattttgcggctcaagatgatttgtttagcgcgggcaccgctacatgatttgtgtaacatgtgcacgttttgtcatgctgcatgatcagatctggtacaagtttatacatcttttcatccattgccatatttttttcccgtgtgacattagtgctggtgcctggtggatgcaagttcatcaaggaaaatcagcagtctagtttactgctctactgttcggtagcaactgattctagcatagttttgcgcg

SEQ ID NO: 2182 - DNA, 3077 bp, Zea mays
ggtggcggtggcggctgaaagcctgcaaccaaacaggccccctcgattagcgaaaaaaagcccagcgaaaactaaaaccctcgcatctttcctttcctccccaactgcggccgcctccacccgctccaccgccgatggccgagcctgagcctctgccgcaggtgtcgtctgaacctaccactccgccgcaggaaggcagcggaaggactaagacaaagaacaagaagaatcgttccaagaagcaaccgaagcgagccggcgctgacaccgacgggttatcctcaggcgccagcaccatggttgaggaccctttcttcgtcctcgccggcggaaaggaaggagggtttctggatttggaggagatcgatgaggcagacttcggcatcttcggaggcgtcttggatgacgtaggacagagcgtcgaggaagctgggaaggatcatgggaagaagaagaagaaaacaaagaagcggaagcgtgggggtgatggcgagggcttcagtggcgacgctgcgttggtagttgagaatgaccaggtggatgtcgagaaagtggagaaaaaggtcgaggatggggagaaaggggataagaaggggaagagaaagatgaacatgaagaagaggaaggtgaaggataatgagatgaacagggagagtgatgaggatgttgctagtgacaaagcagaagacatgcaagatgacactgagaatatggaacaaaatgaggacgatgagctgattttgggcgaagatgatgtctctgcatggagggagcttaggctgcaccctctgcttctcaaggcgatgcgcagacttggattcaaagagccaacacctatacaaaagtcttgctttcctgctgcagctcatcgaggcaaggatgttatcggtgctgcagagacaggttccggaaagacacttgcttttggcctcccagttttgcaacgtctccttgaagagcgagaaaaggccacaagattgcagcaggaagatgaaaaaatggaggaacgttcttgtggaagccctcttcgtgctcttattctgacacccactagggagctcgccaaacaggtatgcgatcatctaaaagatgtggccaagttcttaggaatccatgttgttccaattgttggtggtctatcaatggaaaaacaagagagacttttgaaaaaaaagcctgaaattgttgttggaactcctggaagattgtgggaacacatgtcgatgaacaatcaacacctagttgagctgcactcattgtcattcttcatcttggatgaggctgatagaatgatcgaacgaggccatttccgtgaattacaatctatcattgagatgcttccactgaccaatggttctgatgaacaagctgcaagaacaatgccaaactgtgagactgtaccaattttgcaaataaagaagcggcaaacctttgtgttctcagccacacttgcactctcatctaattttcggaagaagttgaagcgtggcctatctacttcgaaggcatcgacgcctgatgatgtcagctctattgaagcattgtcaaaacaagctggaatgaaatctaatgctgaaatagttgatttgacaaaggcttcaatcttgcctgagaagcttgaagaatcttttattgagtgcagtgaagaggataaggatgcctatctgtattatatattgagtgttcatggtcaaggtcgcacaataatattttgtacatcaatcgccgcattacgtcacatttcttccatactgcgcattcttggaattaatgtattgacaaaccatgctcaaatgcaacaaagagctcgcatgaaggctgtggatcgcttccgtgaaagtgaaaattccattttggtcgcaactgatggttttgcaaggggtatggattttgatgatgtgcgaacagttatccattatcagttgccacattcaactgatgtctatatccacagaagtggaaggacagcacgcaagtcattggctggctgcagcattgctttaatctctcctactgacaagtccaggttttattctctttgcaaatctttgtcaaaggagaatctccagcagtttcctgtagatcatgcttacatgtctggagtgatgaacagactctcacttgctcggcagattgacaagattgcccgtaaaacttcacaggaaaatgctaacaaatcctggcttcaaaggaatgctgaatctatgggattgattttggatgctagtgacagtgaagaagaccatgtgcagggacacaagaaacgaaaggctacttctgcacatctccaaaagcttcaacaggagttgagtgatctcttgcaatgcccattgcagcctaagactttttctcgacgctatttggctggggctggtgtctcgccattacttcagaagcaactagaagagttggccaagagaaatgcaagcaacaatagcagcaagagtaagaataaaggatctgggtttgttgttattggtcaggatcgtgtcgagcccttgcaagcacttcaaaattctgggcaagaggtctgtgtgaacatagacaaagaaagggaaaagcgaagagtctctgagaactggaggcggaagaagcatgaagaaaagaaacgtacacgagagcagaagcgaaaggataagagaaaagctaaagagatggcttgatgacacatgagatagctaggggccttcaaggggtttacggaagctctttaagctcgcgtcaatcctttcagaaaggaacggaatgcattcatcaatgttttgctgtaatacaatgcgtgcgctaagttagcgcttgcctttaacagattggaggtggtagtttgattttgttttgcggctgaagaaaataaacttagaatgcacgagcactggctctggatgagaaaagaaattaagcagatagctcacgtataacctcattggatctgtaatatgtacgcctatcagatttaaggtacaaattaattttattagggatgggaatcgactgacctggcctatctttggacttggacctggcccattgccttaaggccaattttaggagtgatggagattatgatcttgctggct

SEQ ID NO: 2183 - DNA, 2989 bp, Brachypodium distachyon
cccgaaggcccaaggacaaagcaagtccaaaaaccaaaaccctcattcttcctccttcccttgtgtcgccaccggcagcgccaccgcctcctcctcccgccgccctcagtccccgatggacgaagcaccggagcagccgtcgtcggacccccccactccgcctcaggagctcaaccaaaggtccaagaaaaacaagaaaggccgcacgaagaaaccgaagcgagccgccgccgctgccacctcctcttctggccccaccatggtcgaggaccccttcttcgtcctcgccggcggcaaggaaggagggttcctggagctggaggagatcgacggggccgactttggaatcttcgggggcaccgtagaggacgtggaagcaagtgacaggaaggtggggagtgaccagaagaagaagaagaagaagaaaaagcggaagcgcgggcatggtgccgagcgcttggatggggacgatgatggcgattgcgcatcaggcgagctggtttttgagagcaaggaggagggtaacaagggtgagaagaagggaaagagtaagaagagaaacaggaagaagaggaaggtgaaagatacggagcaggattcagagagcaaggaggatgttgacaatgtggaagatatgcaagatggcattgaaaatatgaaacaagataacgatgatgagctgaaattgggtgaagatgaattttatgcatggctagagctaagactgcacccccttcttgtcaaggcaatgcacagacttggatttaaagaaccaacacctatacagaaggcttgctttcctgcaggggctcatcaaggcaaggatgttattggtgcagctgagacaggttctggtaagacacttgcttttggtctccctattttgcaacgccttcttgaagaacgagagaaggccacaagattaaatgtagaagacaaaaaggcgatggaggaaagttctacaggaggcccactccgtgcacttattttgacacccaccagagaacttgccaaacaggtttgtgatcatctaaaagaagcatcaaagttcttgggaatccacgttgttcctatagttggtggtttgtccatggaaaagcaagagcgacttttgaaaaagaagcctgaaattgttgttggaactccaggaagattatgggagctaatgtcaacaggcaatcagcacctagttgagctgcattcattgtcattcttcgtgttggatgaagctgatagaatgatagagcggggtcatttcaaagaactgcactcaattattgagatgcttccactgtctaacagttctgatgaacaagctgtaagagccacgccaagctgtgaaactgtgctaaatttgcaaataaagaagaggcaaacctttgtcttctcagccacgctggcactatcggctaactttcgcagcaagttgaagcgtggcctatctacttcaaaggcatcgatggctgataatcttagctctattgaagcactttcgaagcaggctggtatgaaacctaatgcagaaatcgttgatctgacaaatgcttcgatcttgcctgagaaacttgaagaatcattcatcgagtgtagcgatgatgacaaggatgccaatctgtattatatattaagtgttcatgggcaaggccgcacgataatattctgcacatcaatcgctgcactgcgtcacatttcttccttattgcgcattcttggaattaatgtcttaactaatcacgctcaaatgcaacaaagggcccgcatgaaggctgttgaccgtttccgtgaaagtgagaattccattttggttgcgaccgatggttttgcaaggggcatggactttgataatgttcgaactgttatccattatcaactgccacactcaagtgatgtttatatccacaggagtggaaggacagctcgtaaatcattggctggctgcagtattgcgttaatatctcccgctgacaaggccaagttttactctctttgcaagtcattttcaaaggagaacctgcagcagtttcctgttgatcatgcctacatgcctgcagtaatgaataggctctcccttgctcggcagatcgacaagatatcacgtaaaaattcacaggaaaatgctaacaaatcatggcttcagaggaatgctgaatccatgggattgatattggagggtagtgacagtgaggaagagcgtgtacagggccacaaacaacgaaaggcaatttctgcacagctccagaagcttcaacaggatttgaacgaactcttgcaacgtcccttgcagcctaaaacattctcacggcgctatttggctggggctggtgtttcaccgttgcttcaaaagcaactagaagagttgtctaaaagggatgtaaatggtaatagcagtaagaacgaaaataaaggatctcagtttgttattattggtcaggatcgtatggaacccttgcaagctcttcaaaattctggacaagagatttgtgtgaacatggacaagcaaagagaaaagcgaagacttgctgagaattggaagcggaagaagcacgaagaaaagaaaagcacacgagagcaaaagaggaaggacaggcgaaaagctaaagagagggactgaataacagaggaaatcgggaaagaggagccatttatcttggggttagaagaagttgaagtttgccccttgagttccacagttcattttaagatagcctgcaccgatgtttttgttgagatagatcattgaaggcaccaaatttagttggcggaaacgaaattgagtagatggatgtcatctagcagctgaagttagaaccgagccccagcatagagagatggaaaacctaagcacattgctcggttgtgttgtgaacaattaactcatttctgtaacatgtatacgtttgccacagtacttttcttggaaatggaggtggtactccgcccttagcctccattaatgcatacagccatgcaagcatggctttgatcatca

SEQ ID NO: 2184 - DNA, 2892 bp, Oryza sativa
aaaaaggcccatgtaggaaacaagtccaaaaccaaaaccctcgcctcttcttccccctcctgctgccgcccacaccgccaccgcctccccccaacccgccgcttccgtctccgatggccgcagcgccgccgccgccaccgcctccgcagctgcagtcctcggatccctccactccgcctcaggagaccagccaggtacgcaagggaaagaagagtcgtggcgcgaagaaacctaggagagccgccgctgccgccgccgcctcgacctcctcggccggcacgatggtcgaggaccccttcctcgtactcgccggaggcaaggaaggagggttcctggagcttgaggagatcgacgaggcggacttcggaatctttggcggtgccgtggaggatctaggagaaattgacaggaaggcaggaaaggatcagaagaagaagaagaggaagaagcggaagcgaggtgacgatgactatgctttacctggtgatggtgatttggtagttgaatgtgaggaggagggagagaagggtgagaagagggtgaaaaagaagaggaggagcaggaagaagagaaaggtgaaggaaatggaggaaaaaatggagagcaaggaagatgtctccgatgacaatgtggaagatatgcaagatggcaatgacatggaacaagataacaatgatgggctgattttgggagaggatgaagtctatgcatggcgagagcttagactgcaccctcttcttattacagcggtgcgcaggcttggattcaaagaaccaacaccaatacaaaaggcttgctttcctgcagcggctcatcaaggcaaggatgttattggtgcagcagagacaggttctggtaaaacacttgcttttggcctccctatcttgcagcgccttcttgaagaacaagagaaggccatgagattgtctcgggaggatgagagtacacaagatgaaaattctagagaaagtccacttcgtgctcttattttaacacccaccagggagcttgccaagcaggtctgcgatcatctaaaagaagcagccaagttcttaagaatccaagttgttcccattgttggtggtctatccatggaaaagcaagaacggcttctgaaaaggaaacctgagattgttgttggaaccccaggaagattgtgggagcttatgtcaacaggcaaccaacacctaattaagttacattcattatcattcttcgtgttggacgaggctgatagaatgatagagcgaggccatttccatgaactgcaatctatcattgagatgttaccagtgactaacggttctgatgaacaaactgttgggaccacgccaagttgcgaaactgtgcctatattgcaaataaagaagagacagacatttgtattctcagcaacacttgctctctcagctaattttcggaaaaagttgaagcgaggcctagttactgcaaaagcgtctgcatctactgatttgagttctattgaagcactttcgaagcaggcccgtatgaaacctaacgcagaaatagttgatctgacgaaggcttctatcttacctgagaaacttgaagagtcttttattgagtgtagtgatgatgataaggatgcctacctgtattatatattgagtgtccatggacaaggccgcacaataatattttgtacatcaatagctgcattacgtcacctttcatctatattacgagttcttggaattaatgtcctgacaaatcatgctcaaatgcaacaaagggctcgcatgaaggctgtggatcgtttccgtgaaagtgaaaattcaattttggttgcaactgatggttttgcaaggggcatggattttgatgatgtccgaactgtgattcattatcaattgccacactcaactgatgtttacatccacagaagtggaaggacagcgcggaaatcaatggcaggttgcagcattgcattaatctctcctgcagacaaggccaagttttactcactttgcaagtcactgtcaaaggagaacctccagcagtttcctgttgaccatgcttacatgcctgcagtaatgaataggctcacccttgctcggcagattgacaagattacacgtaaaaattcccaggaaaatgccaacaaatcatggcttcagaggaatgctgagtccatgggattattattggagacaagtgacagtgaggaggaacgtgtacaggggcataagcaaaggaaagcaacttctgcgaacctccagaagcttcaacaggatttgagtgagctcttgcaacgccccttgcagcctaagactttttcgcggcgctatttagctggggctggtgtttcaccgttacttcaaaagcaactggaagagttgtccaaaaggaatgttaagggcagtgctagtgtaaatgcaaataaaggatcccgatttgttgttattggtcaggatcaaatagaacccttgcaagctcttcagaattctgggcaagaggtgtgtgtgagcattgacaagcaaagagaaaagcgaaggcttgctgaaaattggaggcgaaagaagcaaaaagagaagaaaagtacacgagagcaaaagagaaaggagaagaggatagctaaagaaagggactaaatgacaacgttgtccaactactcatcattgtaggcactacattgttactgttgggaaacaagttttgggggtgttggatatcatttttgcaattgaagatagggttataatcaactgtaccagcatcatatctgagcatcaactgtggcatgcatgatacccaccagtttattgatctgatggttgctggatgcatgaaatattttcttcaaccacatacacctgattgattgaatcttaccaaagacgtagaaaacttcgtttgtgatcatcactaagg

SEQ ID NO: 2185 - DNA, 2237 bp, Panicum virgatum
tcggcccacaggaagcccacgattccagcgcagaggtccagttgggcttccgtcgccatcgcgctccgcggctgttggcgtggctcccggtccgcgggcaaaaaccctactcggctcggcacatccctccgccgccgccgctgccggagatggaggacatcgaggacgtgctgggcccggccgggctctccggcggcggagcgtctccggggctccgccaccctgtggccgccgtcgcggtcaagcccaagcgccggtcgtccagggttgcgcagacgccgacccaacccgagcctcggatccccggcacgcagacgatatatgtcaagacgttcgggtgctcacataaccagagtgacagtgagtacatgtcggggcagctatcggcatttggatatgctattactgaagaacccgaaggagcagatttgtggctaattaacacatgcacagtgaaaaatcctagtcaatctgcaatgacaaccctcatatcgaaatgcaagaatgcaaacaaaccactagtagttgctggatgtgtaccacaagggagccagggtctcaaggagcttgaaggtattagtataattggagttcaacagatagaccgggttgttgaagtggttgaggaaaccttaaaaggccatgaggttcggctactgagtcggaaaacactgccctcacttgatttaccgaaggtaagaaagaacaagtttattgagattcttcctattaacgtggggtgtttaggcgcctgcacttactgtaagacaaagcatgctcgtggccatttgggaagctatactattgacagcttggtggatcgtgtgaaaactgttgtctctgaaggtgtccgagagatatggttgagcagtgaagatactggtgcttatggcagggacatcggtacaaatcttccaaatctgttaaatgcaattgtcgcagagcttcctgtcgaccgaagcacaatgctccgcataggcatgacaaaccctcctttcatactagagcatctgaaggagatagctgccgttttgcgtcatccttctgtttattctttcctccatgttcctgtgcagtctggaagtgatgctgttttaacggcaatgaatcgtgaatacactgttggtgagttcagaaaggtcgttgacactctgtgtgaacttgtccctggaatgcaaattgctactgatattatctgtggctttcctggtgagactgatgaagatttcgctgaaactgttaatctcgtaaaggaatatcaatttcctcaagtccacatatcacagttttaccccagaccagggacacctgctgctaggatgaagaaagttccaagcaatgatgtgaagaagcggagtcgtgaactgacttctgtttttgaatcattttcaccctaccaaggaatggaaggcaaggtagagcgaatctggatcactgagatagctaccgatggtgttcacttggttggacataccaagggatatatccaggtgctggtcattgccactgatagcatgctaggaacatcagcgagtgtgaagatcacatcagttgggcgatggtctgtgttcggtgaggtgatagatggatctgtggttgtaggggaagcacctaagcaaaccagcagtgaaccgcagaaacaacacatacagaatcaggtggaggaagctggttgctgtgccaccgactcttgtggcgcctgtgcgtgctccgacgtagcacaacactgcagacctgaacgatgcgaggatatacctgatgcaccccagaccagtggtggcgttaatcatcaggaggcagtccagcagtctacgcttgtgaggagaaacgtggagggatcgacgaaagcaagcaaaagcaatgcagcacggtcggtagggaaggaacagcaggtgaacgttgtaactaggagaggcgtaaacgttgacacgattttgtggtgtggtttggccgtgagcttcgctgcaactgtagcgcttcttgtactccttaccggcaagatttgatcgacatcctcctactaggctaggtggtgagtggtgactgtaacttgtagcaattgttcttgagcgtttgctgatcaattttggcggttttctgtagtctacctgccatgtatgtcgttgcaaagttgtggcactacaaatacatgtgtgcaaaacaggttttgtcattgtcgctccagaacggaacaaggtttggtgatgcaattttaagttttctactgttcgaaacaa

SEQ ID NO: 2186 - DNA, 2158 bp, Panicum virgatum
ggcgtggctcccggtccgcgggcaaaaaccctactcggctcggcacatccctccgccgccgccgccgctgccggagatggaggacatcgaggacgtgctgggcccggccgggctctccggcggcggagcgtctccggggctccgccacccttgggccgccgtcgcggtcaagcccaagcgccggtcgtccagggttgcgcagacgccgacccaacccgagcctcggatccccggcacgcagacgatatatgtcaagacgttcgggtgctcacataaccagagtgacagtgagtacatgtcggggcagctatcggcatttggatatgctattactgaagaacccgaaggagcagatttgtggctaattaacacatgcacagtgaaaaatcctagtcaatctgcaatgacaaccctcatatcgaaatgcaagaatgcaaacaaaccactagtagttgctggatgtgtaccacaagggagccagggtctcaaggagcttgaaggtattagtataattggagttcaacagatagaccgggttgttgaagtggttgaggaaaccttaaaaggccatgaggttcggctactgagtcggaaaacactgccctcacttgatttaccgaaggtaagaaagaacaagtttattgagattcttcctattaacgtggggtgtttaggcgcctgcacttactgtaagacaaagcatgctcgtggccatttgggaagctatactattgacagcttggtggatcgtgtgaaaactgttgtctctgaaggtgtccgagagatatggttgagcagtgaagatactggtgcttatggcagggacatcggtacaaatcttccaaatctgttaaatgcaattgtcgcagagcttcctgtcgaccgaagcacaatgctccgcataggcatgacaaaccctcctttcatactagagcatctgaaggagatagctgccgttttgcgtcatccttctgtttattctttcctccatgtgcctgtgcagtctggaagtgatgctgttttaacggccatgaatcgtgaatacactaatagtgaattcagaaaggtagttgacactctgtgtgaacttgtccctggaatgcaaattgctactgatattatatgtggctttcctggtgagactgataaagattttgctgaaactgttaatctcgtaaaggaatatcaatttcctcaagtccacatatcacagttttaccccagaccagggacacctgctgctaggatgaagaaagttccaagcaatgatgtgaagaagcggagtcgtgaactgacttctgtttttgaatcattttcaccctaccaaggaatggaaggcaaggtagagcgaatctggatcactgagatagctaccgatggtgttcacttggttggacataccaagggatatatccaggtgctggtcattgccactgatagcatgctaggaacatcagcgagtgtgaagatcacatcagttgggcgatggtctgtgttcggtgaggtgatagatggatctgtggttgtaggggaagcacctaagcaaaccagcagtgaaccgcagaaacaacacatacagaatcaggtggaggaagctggttgctgtgccaccgactcttgtggcgcctgtgcgtgctccgacgtagcacaacactgcagacctgaacgatgcgaggatatacctgatgcaccccagaccagtggtggcgttaatcatcaggaggcagtccagcagtctacgcttgtgaggagaaacgtggagggatcgacgaaagcaagcaaaagcaatgcagcacggtcggtagggaaggaacagcaggtgaacgttgtaactaggagaggcgtaaacgttgacacgattttgtggtgtggtttggccgtgagcttcgctgcaactgtagcgcttcttgtactccttaccggcaagatttgatcgacatcctcctactaggctaggtggtgagtggtgactgtaacttgtagcaattgttcttgagcgtttgctgatcaattttggcggttttctgtagtctacctgccatgtatgtcgttgcaaagttgtggcactacaaatacatgtgtgcaaaacaggttttgtcattgtcgctccagaacggaacaaggtttggtgatgcaattttaagttttctactgttcg

SEQ ID NO: 2187 - DNA, 2349 bp, Sorghum bicolor
ggctttttgagcaatataggccaggccggcatcatcagcccggatcgcttggcctggtcgtaaacaaaaagcccattagtcagctgagaggcccagttactttccggcctcgcgtggcaccgggtccgcagcccgcaggcaaaaaccctactcggctcggcgcaccgctccctggtctcgccgcagctggagatggaggacatcgaggacgtgctgggtccggccgacctctctggcggcggagcgcctccggggctccggctcccgctagccgccgtcgcggtgaagcccaagcgacggtcgtccagggtcgcgcaggcgccgcctcagcccgaggcccggatccccggcacgcagacgatttacgtcaagactttcgggtgctcacataaccagagtgacagtgaatacatgtcaggtcagctctctgcatttggatatgcgatcactgaagagcccgaaggagcagatttgtggctaattaacacatgcacagtgaaaaatccaagtcaatctgcaatgacaaccctcatatctaaatgcaagaatgcaaacaagccactagtagtggctggatgtgtaccccaaggaagccagggcctcaaggagcttgaaggtattagtataattggagtgcaacagatagaccgggttgttgaagtggttgaggaaactttaaagggccatgaggttcggctgttgagtcggaaaacactgccctcgcttgatttacctaaggtaagaaagaacaagtttatcgagattcttcctattaatgtgggatgtttaggtgcctgcacatactgtaagacaaagcatgctcgtggtcatttgggaagctatactattgacagcttggtggatcgtgtgaaaactgttgtctccgaaggtgtcagggagatctggttgagcagcgaagatactggtgcttatggacgggatatcagtacgaaccttcccaatttgttaaatgcgattgttgcagagcttcctgttgaccaaagcacaatgctccgcataggcatgacaaatcctcctttcatactagagcatttgaaggagatagctgccgttttgtgtcatccctgcgtttactctttcctccatgttcctgtgcaatctggaagcgatgctgttttaacggcaatgaatcgtgaatacactgttgctgagttcagaaaggtagttgacactctgtatgagcttgtccctggaatgcaaattgctacagacattatctgtggctttcctggcgagactgatgaagatttctctgagactgttaacctcgtaaaggaatatcaattccctcaagttcacatttcacagttttacccgaggccagggacacctgctgctaggatgaagaaagtaccaagcaatgaagtgaaaaagcggagtcgtgaactgacttcagttttcgaattattttcaccataccaaggaatggaaggcaaagtagagaggatctggatcaccgagattgcgactgatggtgttcacttagttggacataccaagggatatatccaggttctggtaattgctcctgatagcttgttaggaacgtcagcaaatgtgaagatcacatctgttggacgatggtctgtctttggtgaagtgatagaaggatctgttgtagtaggagaagcaccaaagcaaactagtgccaaactgcagaaagaacacatacagaatcaggtggaggaagctggttgttgtgccactgactcttgtggcacctgtgcatgctccaatgaggcacagcagtgcagtccagaacgatgtgaagacacatctcatgctccggagacctgtggtgatgttactcgtcaggaggcactccagcctacgcttgtgaggagaagcgtagagggaactacgaaaggaagtaaaagcagtgcagcacattcactagggaaggaacagcaggtgaaagtagtaactaggagaggggtaaatatcgacacgattttgtggtgcggtttggccgtcagcttcgccgtaacgatagccctgcttgtaatccttaccagcaagatttcatcgacatcgtccccctaggccctaggctaaggcggtgtttgtaacttgtagtgatttgttcttgggcgcgtctctgatcaattttggcggtttgtttactcgatctgttctgtatgtcgttgcaaaattgtgccactatacaaatacatgcctgttcggctgcatgtattgcagctttgcagcactggcaactcttattactctctgctgacactgacactatgcaactgctgtttttggttgcaaacaagtttcctcgtaggcatctgatgctgcatcacggatcagggtttgatgaaagtg

SEQ ID NO: 2188 - DNA, 2311 bp, Zea mays
ggggaacggtgtccgaaaaccctactcggcccagcgcaccgctcggctccccgccaccgccgcagccgagatggaggacatcgaggacgtgctgggcgcggccggcctttctggcggcggagcgcctccggggctccgcctcccgctagccgccgtcgcggtgaagcccaagcgccggtcgtccagggtcgcacaggcgccgcctcagcccgaggccgggatccccggcacgcagacgatttacgtcaagacattcgggtgctcacataaccagagtgacagtgaatacatgtcaggtcagctctctgcatttggatatgcgatcactgaagatcctgaaggagccgatttgtggctaattaacacatgcacagtgaaaaatccaagtcaatctgcaatgacaaccctcatatctaaatgcaagaatgcgaacaagccacttgtagtggctggatgtgtaccccaaggaagccagggcctcaaggagcttgaaggtattagtataattggagttcaacagatagaccgggttgttgaagtggttgaggaaactttaaagggacacgaggttcgcttgttgagtcggaaaacattgccgtcacttgatttacctaaggtaagaaagaacaagtttattgagattcttcctattaatgtgggatgtttaggcgcctgcacatactgtaagacaaagcatgctcgtggccatttgggaagctatactattgacagcttggtggatcgtgtgaaaactgtcgtctccgaaggtgtccgggagatctggttgagcagcgaagatactggtgcttatggacgggatatcggtacaaatcttccaaatttgttaaatgcgatcgttgcggagcttcctgttgaccaaagcacaatgctccgcataggcatgacaaatcctcctttcatactagagcatttgaaggagatagctgccgttttgtgtcatccctgtgtttactctttcctccatgtccctgtgcaatctggaagcgattctgttttaaaggcaatgaatcgtgaatatactgttggcgagttcagaaaggtagtcgacactctgtgtgagcttgtccctggaatgcaaattgctacagatattatctgtggctttcctggtgagaccgacgaagatttctctgagactgttaacctcgtaaaggaatatcaattccctcaagtccacatttcgcagttctaccccagaccagggacgcctgctgctaggatgaagaaagtaccaagcaacgaagtgaagaagcggagccgtgaattgacttcagtcttcgaatcgttttcgccataccaaggaatggaaggcaaagtagagaagatctggatcaccgagattgcgtctgatggtgttcacctggtcggacataccaagggatacatccaggtgctggtaactgctcctgatagcatgttgggaacgtccgcggacgcgaagatcacgtctgtcggacgatggtccgtcttcggtgtagtggtagaaggatctgttgcagtcatagaagcaccaatacaaactagtgccgaactgcaggaggaacacgtacagaatcaggtggaggaagctggttgctgtgccaccgactcctgtggcgcctgcgcgtgctccaatgaggcgcaaccgtgtggcccagaccgatgtggagatgcacttcgtgccccgcagacctgtggtggtgacgttgttacaactcgccaggaggcactccagcctacgctcgtgaggagaagcgtagatggaaccacgaaaggaagcgacagtactgcggcgcattcagcagggaaggaacagcgggtggaagtagtgactaggcgtggggtagatatcgacacggttctgtggtgcggtttggccgcgagcttcgctgtgacggtagccctgcttgcactcctcaccagcaagattttgtcgacgacatcacactagggctaataaggcgaagctttgtaacttgtggtttggttcttgagcgtgtcgctggatcgattttggcggtctctttctttacttgatccgcctgtatgtcgttgcaaaaaactgtgccactgtatacaaaaacacgtggttgcaaacaagttttctcgttgctttcgggtgctggctgcatcaatgatcagggttccatgaaggtgaagtacattatgtgtgtttgccaccgtgctaaaaatagccgaaaaggggagcaggtgctgccaaacgaacaggtcggagaaacgattgagcaggagggaaccagacaacagcagcaaacagactgaagcacaaaaaatcggaagaataaaaaaa

SEQ ID NO: 2189 - DNA, 1938 bp, Saccharum officinarum
gctccgcctcccgctagcggctgtcgcagtcaagcccaagcgccggtcgtccagggtcgcgcaggcgccgcctcagcccgaggcccggatccccggcacgcagacgatttacgttaagactttcgggtgctcacataaccagagtgacagtgaatacatgtcaggtcagctctctgcatttggatatgcgatcactgaagagcccgaaggagcagatttgtggctaattaacacatgcacagtgaaaaatccaagtcaatctgcaatgacaaccctcatatctaaatgcaagaatgcaaacaagccactagtagtggctggatgtgtaccccaaggaagccagggcctcaaggagcttgaaggtattagtatcattggagtgcaacagatagaccgagttgttgaagtggttgaggaaactttgaagggccacgaggttcggctgttgagtcggaaaacactgccttcacttgatttacctaaggtaagaaagaacaagttaatcgagattcttactattaatgtgggatgtttaggcgcctgcacatactgtaagacaaagcatgctcgtggtcatttgggaagctatactattgacagcttggtggatcgtgtgaagactgttgtctccgaaggtgtccgggagatctggttgagcagcgaagatactggtgcttatggacgggatatcagtacaaaccttgcaaatttgttaaatgcgattgttgcggagcttcctgttgaccaaagcacaatgctccgcataggcatgacaaatcctcctttcatactagagcatttgaaggagatagctgccgttttgcgtcatccctgcgtttactctttcctccatattcctgtgcaatctggaagcgatgctgttttaacggcaatgaatcgtgaatacactgttggcgagttcagaaaggtagttgacactctgtgtgagcttgtccctggaatgcaaattgctacagatattatctgtggctttcctggtgagactgatcaagatttctctgagactgttaacctcgtaaaggaatatcaattccctcaagtccacatttcacagttttaccccagaccagggacacctgctgctaggatgaagaaggtaccaagcaatgaagtgaaaaagcgaagtcgtgagctgacttcagttttcgaatcattttcaccataccaaggaatggaaggcaaagtagagaggatctggatcaccgagattgcgactgatggtgttcacttggttggacataccaagggatatatccaggtgctggtaattgctcctgatagcttgttaggaacgtcagcaaatgtgaagatcacatctgttggacgatggtctgtctttggtgatgtgatagaaggatctgttgcagtaggagaagcaccgaagcaaactagtgccaaactgcagaaagaacatggacagaatcaggtggaggaagctggttgttgtgccactgactcttgtggcacctgtgcatgctccaatgaggcacaacagtgtggcccagaacgatgtgaagacgcatctcatgcaccagagacctgtggtgatgttactcgtcagggggcactccagcctactacgcttgtgaggagaagcgcagagggaactacgaaaggaagcgacagcagtgcagcacatttactagggaaggaacagcaggtgaaagtagtaactaggagaggggtaaatattgacacgattttgtggtgcggtctggccgtgagcttggctgtaacgatagccctgcttgtaatccttaccagcaagatttcatcgacatcctcccaataggctaagggggtgtttgtagcttgtagtgattgtcctcgagcgtgtcgcaattttggcggtttgtttactctgttctgtatgtcgttgcaaaattgtgccattatacaaatacatggttgcacaca

SEQ ID NO: 2190 - DNA, 2391 bp, Oryza sativa
gttctcgcgcgcgtgcgggcgcggccggtggaaaggtggggcggcccaaaaaatcgaattgggtgggcttcgtctcggcctgcaaaggatagcccacaaagcgggcccaaaccgagaagcccactttcactcgcgtcgtcgcgacgcaagcgagaaaccctactcggtcggggaagccaccagcccacgacgactcgcctggacgcgccgccgccgtcgccgccgccgccgcagcagcagcagccgccggagatggagatggaggacatcgaggacgtgctggggccggccgggatcgccggcggcggggcggctccggggctccgtctcccgctcgccgccgtcgccgtgaagcccaagcgtccgagatcgtccagggtcgcgcagacccggccgcagcccgaggcccggatccccgggacgcagacgatatatgtgaagacgttcgggtgctcgcataaccagagtgacagtgagtacatgtcagggcagctgtcagcgtttggatatgcgatcactgaagagcccgaaggagcggatttgtggctaattaacacatgcactgtgaaaaacccaagtcagtctgccatgacaactctcatatcgaagtgcaagagtgcaaacaagcctttggttgtggctggatgtgtaccacaaggaagccgggatctgaaagagcttgaaggtattagcgttattggagtgcaacagattgaccgcgttgttgaagttgttgaagaaaccttaaaaggccatgaggttcggttgttgagtcggaaaacactgccctcacttgatttacctaaggtaaggaagaacaaatttatcgagattcttcctattaatgttgggtgtttgggtgcttgcacatactgcaagacaaagcatgctcgtggtcatcttggaagctatactatagaaagtttggtagatcgtgtgaaaattgttgtctctgaaggtgtccgagaaatatggttgagtagtgaggatactggtgcttatggcagggatatcggtacaaatcttccaaatctattaaatggaattgctgctgagcttcctgcggacagaagcacgatgcttcgcattggcatgaccaatcctcctttcatattggagcatttgaaggagattgctagtgttttgtgccatccctgtgtttattctttcctccacgttcctgtacaatcaggaagtgatgcagttttaacggcaatgaatcgtgaatacactgtgagtgaattcaggagggtagttgacactctttgtgagcttgtccctggaatgcaaattgctacagatattatttgtggattccccggtgagactgatgaggatttctctcaaactgttaaccttgtaaaacaatatctattccctcaggttcacatatcacaattctaccccagaccaggaacacctgctgctaggatgaaaaaggttccaagcgttgaagtgaagaaaaggagccgtgaattgacctcagttttcgagtcattttcaccctaccaaggaatggaaggcaaagtagagaggatatggatcactgaaatagctactgatggtgttcatttggttggacataccaaaggatatatccaggtgcttgtcattgctcctgatagcatgttaggaacatcagcagatgtgaagatcacatctgttgggagatggtctgtgtttggtgaagtgatagaaggatccgttgtagcaaaggaaacacagaagcataatcacagtgaactgcaagaagaatacaggccaagtcaggttgaggaagccacttgctgcggcacggactcttgtggtgcctgcacatgctctgatgcagcacagcaatgcaatcccggtccagagcgatccgaaaattcgacgccccaatcctgtggtgatgctactcatcaggaagctgttcagtctaaacttgtgagaagaaatgttgaaggagcggtgaaaagtagcgaaagtgatacagcgaaacaggtaggggagattcagcgactaaatgtagcagctaggaggttcccagatgttgatacgattctgtggggtggtttggccgtgagctttgccacgacagtaaccctcattgcactgctagcttacaagatttcttccacgccctcctactagtaagtctggtgcatgtgtaactgtagttgagctgtgtgttactgctcagttttgaccatttttctgtatccatcctcgatccttctgtttgccgcaaagatatgcaatggaactgtaattcattatctcaacaagttctctaataacctttccccccgacctttctaaataactagaagatacaattagtatttttaagattaatgatgaacaaggagagttggtgatctaactcgtaattgcgtttatctgagctcg

SEQ ID NO: 2191 - DNA, 2248 bp, Secale cereale
cccactgtccccgcagaaccctactcagccaccgcccgcatcgactggacgctactccgccgccggggatggaggacatcgaagacgtgctgggaccggccgggttttccggcggcggagcgcctcccgggctccgtctacccctctccactgtcgccgttaagcccaagcgcaggtcgtccaggctcgtgcagacgcagccccagcccgatgcctggatcccaggcacgcagacgatatacgtcaagacattcgggtgctcacataaccagagtgacagtgagtacatgtcggggcagctctcggcgtttggatatgcaattactgaagagcccgaaggagctgatttgtggctaattaacacatgcactgtgaaaaatccaagtcaatctgccatgtcaactctcatatcaaaatgcaagacggcaaacaagccactggttgtagctggctgtgtgccacaaggaagccgggatctgaaggagcttgaaggtattagtataataggagtgcagcagatagatcgggttgttgaagtagttgaggaaactttaaaagggcatgaggttcggttgctgagtcggaaaacactgccctcacttgatttacccaaggttcgaaagaataaatttattgagattcttccaataaatgtcgggtgtctaggcgcttgcacttactgcaagacaaagcatgctcgtggtcatctgggaagctattctatagacagcttggtagatcgtgtaaaaattgttgtctcagaaggtgttcgtgagatatggttgagcagtgaagatactggtgcttatggtagggatatcggtacaaatctcccaaatctcttaaatgcaattgttgctgagcttcctgcggacagaagcacaatgcttcgcatagggatgacaaatcctcctttcatactggagcatttgaatgagatagctagtgttttgcgccatccttgtgtttatactttccttcatgttcctgtgcaatcaggaagtgatgctgttttaaaggcaatgaatcgtgaatacactgtcagtgagttcagaatggtagtcgatactctctgcgagcttgtcccaggcatgcaaattgccacggatattatttgtggctttcctggcgaaactgatgaagattttgttgaaacggttaaccttataaaagaatatcagttacctcaagttcacatatcacagttttatcccagaccaggaacacctgctgctaggatgaagaaagtgcctagcattgaagtgaaaaaacgaagtcgtgaattgacctcagtttttgaagctttttcaccatacgaaggactgaaaggcaaagtggagaggatatggatcactgaaatagctaccgatggtgttcatttggttggacatacgaaagggtatatccaggtccttgtcattgctccagatagtatgctaggaacatcagctgatgcgaagatcacgtctgtcggaagatggtctgtatttggtgaagtgatagaaggatccgttgcagtgaaggaagcagcgcctcaacaaaattctgctaaagggcaggtagaaaacaggccaaatcgcgtggaggaagccgcttgttctacaaacacctgtgattcctgtgcatgctcgggtgcagaaagcgtggcacaacaatgtactccacagcgatgtgaaggtccatctgatgcacccacaaattgtggtgatgctactcgtccggaaacacctcaatctatgctcgtgagaagaaatgtcgagggggcagggaaaacaagtgaaagtgatgcagaaaaatcgagacgggaggatcagcaggtacatgtggttaccaggagcgcactaaacgttgacaggattctttggggtggtttggccgtaagctttgccacaacagtggccatacttgtgctgcttacctacaagcttttttacacgtcctcctaaggctggtggttgtaactgtaatttttgtctccactttggggatttttcatgcggaacccttgtattgccaacttgtgttgctgaaatacaaatcctcatgtattccgtttctctcgttcttatatccttataaacttgtatccgaagagaaatggtgttctttttatctggcagtttgtcagtgtctgaataagttttgagtgtctaaaaaaaaaaaaaaaaaaaaaaaaaaaaaaaaaaaaaaaaaaaaagaaaaaagaaagaagagacacgacgacgacacgagagagaggggggggggg

SEQ ID NO: 2192 - DNA, 2030 bp, Hordeum vulgare
accgcaagcatcgattggacgctacaccgccgccggggaatggaggacatcgaggacgtgctgggaccggccgggttttccggcggcggagcgcctcccgggctccgcctacctctctccactgtcgccgtcaagcccaagcgcaggccgtccaggctcgtgcagacgcagccccagccagatgcccggatcccaggcacgcagacgatatacgtcaagacattcgggtgctcacataaccagagtgacagtgagtacatgtcggggcagctctcggcgtttggatatgcaattactgaagagcctgaaggagctgatttgtggctaattaacacatgcactgtgaaaaatccaagtcaatctgccatgtcaactctcatatcaaaatgcaagacggcaaacaagccactggttgtagctggctgtgtgccacaaggaagccgggatctgaaggagcttgaaggtattagtataataggagtgcagcagatagatcgggttgttgaagtagttgaggaaactttaaaagggcatgaggttcggttgttgagtcggaaaacactgccctcacttgatttacccaaggttcgaaagaatagatttattgagattcttcccataaatgtcgggtgtctaggcgcttgcacttactgcaagacaaagcatgctcgtggtcatctgggaagctattctatagacagcttggtagatcgcgtgaaaattgttgtctcagaaggtgttcgtgagatatggttgagcagtgaagatactggtgcttatggtagggatatcggtacaaatcttccaaatctcttaaatgcaattgttgctgagcttcctgcggacagaagcacaatgcttcgcatcgggatgacaaatcctcctttcatactggagcatttgaatgagatagctagtattttgcgccatccttgtgtttatactttccttcatgttcccgtgcaatcgggaagtgatgctgttttacaggcaatgaatcgtgaatacactgtcagtgaattcagaatggtagttgatactctctgtgagcttgtcccgggcatgcaaattgccacggatattatttgtggctttcctggtgaaaccgatgaagattttgttgaaacggttaaccttataaaagaatatcagttacctcaagttcacatatcacagttttatcccagaccaggaacacctgctgctaggatgaagaaagtgcctagcattgaagtgaaaaaacgaagtcgtgaattgacgtcagtttttgaagctttttcaccatacgaaggactgaaaggcaaagtggagaggatatggatcactgaaatagctactgatggtgttcatctggttggacataccaaagggtatatccaggttcttgtcattgctccagatagtatgctaggaacatcagcagatgcgaagatcacatctgtcggaagatggtctgtatttggtgaagtgatagaaggaaccattgcagtaaaggaagcagcgcttcaacaaaattctgctgaagtgcaggtagaaaacaggccgaatcgtgtggaggaagccgtttgttctacaaacacctgcgattccgattcctgtgcatgctcgggtgtagaaagtgtggcacaacaatgtactccacaacgatgtgaaggtccatctgatgcaccggcaaattatggtgatgccactcgtcaggaaacccctcaatctacgcttgtgagaagaaacgtcgacggggcagggaaaacaagtgaaagtgacgcagaaaaatcgagaggagatgatcatcaggtaaatgtggttaccaggagagcactaaacattgacaggatcctttggggtggtttggccgtaagttttgccacaacagtggccatacttgtgatgcttacctacaagatcttttacacgtcctcctaaggctagtggttgtaactgtaattttttgtttccactatggtgatttttcatgtggaacccttgtattgtcaacttatgttgctgaaataaaaattctcatgtattcc

SEQ ID NO: 2193 - DNA, 2095 bp, Triticum aestivum
gttcggttcgcctccgcccactgtccccgcagaaccctattcagcccccgcccgcatcgacgggacgctactccgccgccggcgatggaggacatcgaggacgtgctgggaccggccgggttttccggcggcggagctcctcccgggctccgcctacccctctccactgtcgccgtcaagcccaagcgcaggtcgtccaagctcgtgcagacgcagccccagcccgatgcccggatcccaggcacccagacgatatacgtcaagacattcgggtgctcacataaccagagtgacagtgagtacatgtcggggcagctctcggcgtttggatatgcaattactgaagagcctgaaggagctgatttgtggctaattaacacatgcactgtgaaaaatccaagtcaatctgccatgtcaactctcatatcaaaatgcaagacggcaaacaagccactggttgtagctggctgtgtgccacaaggaagccgggatctgaaggagcttgaaggtattagtataataggagtgcagcagatagatcgggttgttgaagtagttgaggaaactttaaaagggcatgaggttcggttgttgagtcggaaaacactgccctcacttgatttacccaaggttcgaaagaataaatttattgagatccttccaataaatgttgggtgtctaggtgcttgcacttactgcaagacaaagcatgctcgtggtcatcttggaagctattctatagacagcttggtagatcgtgtgaaaattgttgtctcagaaggtgttcgtgagatatggttgagcagtgaagatactggtgcttatggtagggatatcggtacaaatcttccgaatctcttaaatgcaattgttgctgagcttcctgcggacagaagcacaatgcttcgcatagggatgacaaatcctcccttcatactggagcatttgaatgagatagctagtgttttgcgccatccttgtgtttatactttccttcatgttcctgtgcaatcaggaagtgatgctgttttaaaggcaatgaatcgtgaatacactgtcagtgagttcagaatggtagttgatactctctgtgagcttgtcccgggcatgcaaattgccacggatattatttgtggctttcctggcgaaactgatgaagattttgttgaaacggttaaccttataaaagagtatcagttacctcaagttcacatatcacagttttatcccagaccaggaacacctgctgctaggatgaagaaagtgcctagcattgaagtgaaaaaacgaagccgtgaattgacctcagttttcgaagctttttcaccatacgaaggactgaaaggcaaagtggagaggatatggattactgaaatagctaccgatggtgttcatttggttggacataccaaagggtatatccaggtccttgtcattgctccagatagtatgctaggaacatcagctgatgcgaagatcacatctgtcggaagatggtctttatttggtgaagtgatagaaggaaccgttgccataaaggaagcagcgcttgaacaaaattctgctgaagtgcaggtaaaaaacagcccaaatcgtgtggaggaagccgcttgttctacaaacacctgcgattcctgtgcatgctcgggtgcagaaagcgtggcacaacaatgtactccacagcgatgtgaaggtccatctgatgcaccgacaaattgtggtgatgctactcgtcaggaaacacctcaatctacgcttgtgagaagaaatgtcgagggggcagggaaaacaagtggaagtgatacagaaaaatctagaggggacgatcagcaggtaaatgtgattaccaggggagcagtaaacattgacaggattctttggggtggtctggccgtaagctttgccacaacagtggccatacttgtgctgcttacctgcaagattttttacacgtcctcctaaggctggtggttgtaactgtaatttttgtctccattttggtgacttttcatgtggaaccatcgtatcaccaagttatgttgctgaaatacaaattctcatgtatccttataaacttgtatacgacgagaaatgg

SEQ ID NO: 2194 - DNA, 1848 bp, Pennisetum glaucum
gtcaagcccaagcgccggtcgtccagggtcgcgcagacgccgccccagcccgaggcccggatccctggcacgcagacgatatacgtcaagacgttcgggtgctcacataaccagagtgacagtgaatacatgtcagggcagctctcggcatttggatatgctattactgaagaaccagaaggagcagatttgtggctaatcaacacatgcacagtgaaaaatcctagtcaatctgcaatgaccacccttatatcgaaatgcaagaacgcaaacaaaccattagtagtggctggatgtgtaccgcaaggaagccagggtctcaaggagcttgaaggcattagtataattggagtgcaacagattgaccgggttgttgaagtggttgaggaaaccttgaaaggccatgaggttcggctgttgagtcggaaaacactgccctcacttgatttacctaaggtaagaaagaacaagtttattgagattcttcctattaacgtggggtgtttaggcgcctgcacatactgcaagacaaagcatgctcgtggtcatttgggaagctattctattggcagcttggtggatcgtgtgaaaattgttgtctcagaaggtgtccgagagatatggttgagcagtgaagatactggtgcttatggcagggatattggtacaaatcttccaaatctgttgaatgcaattgtcgcagagcttcctgctgaccgaagcaccatgctccgcgtaggcatgacaaaccctcctttcatactagagcatttgaaggagatagctgctgttttgcgtcatccttgtgtttattctttcctccatgttcctgtgcaatctggaagcgatgctgttttaacgggaatgaatcgtgaatacactgtcggtgagttcaggaaggtagttgacactctctgtgagcttgtccctgggatgcaaattgcaacagatattatctgtggctttcctggtgagactgatgaagattttgccgagactgttaaccttgtaaaggactatcagttccctcaagtccacatatcacagttctaccccagaccagggacacctgctgctaggatgaagaaggtgccaagcaatgatgtgaagaagcggagtcgtgaactgacttctgtatttgaatcattttcaccctaccaaggaatggaaggcaaggtagagcgaatctggataactgagatagctactgatggtgttcacttggttggacataccaagggatatatccaagtgctggtcattgcccctgatagcatgctaggaacatctgcggatgtgaagatcacatcagttggacgatggtccgtattcggcgaggtgatagaaggttctgttgtagtagaagcacccaagcaaaccagctctgaaccacagaaagaacatagtcagaatcaggtggaggaagctggttgttgcggcaccaactcttgtggtacctgtgcatgctccgacccggtacaacactgcagccctgaacgatgtgataatacgcccaatgctccccagaccattggtgatgttaattgtgaggaggcaatccagcctacgcttgtgaggagaaacgtagagggatcaacgaaagcaagtgaaaacagtgctgtagcacgatcggtaggacaggaacaggaggtgaacttagtaactaggaggggagtagatgtcgacacgattttgtggtgtggtttagctgtcagctttgctgcaacagtagccttgattgtactccttaccagcaagatatcgtcgacatcctcctaataggttaggtggtgattgtaacttgtaacaatttgttcttgagcgtattgctgtcatggcggtttgttt

SEQ ID NO: 2195 - DNA, 2090 bp, Brachypodium distachyon
cccagaaccctactcggaagctggagcccaagccaccgcccgcatcgacaggacgctgctccgccgccggcgccagggatggaagacatcgaggacgtgttggggccggccggtttttccggcggaggagcgcctcccgggctccgtctccccctctccaccgtcgctgtcaagcccaagcgcaggtcgtccaggctcgcacagacgcagcagcagccggaggcccggatcccaggcacgcagacgatatatgtgaagacattcgggtgctcacataaccagagtgacagtgaatacatgtcggggcagctctcggcgtttggatatgcaatcactgaagagcctgaaggagctgatttgtggctaattaacacatgcactgtgaaaaatccaagtcaatctgccatgacaactttaatatcaaaatgcaagaacgcaaacaagccactagttgtagctggatgtgtaccacaaggaagccgggatctgaaggagcttgaaggtattagcataataggagtacagcagatagatcgtgttgttgaagtagttgaggaaacattgaaggggcatgaagttcggctattgagtcggaaaacactgccctcacttgatttacctaaggttcgaaagaacaaatttatcgagattcttcccataaatgttgggtgtttaggtgcttgcacttactgcaagacaaagcatgctcgtggtcacctggggagttattctatagatggcttggttgatcgtgtgaaaattgttgtctcggaaggtgtccgggagatatggttaagcagtgaagatactggtgcttatggtagggatattggtacaaatcttccgaatctcttaagtgcaattgttgctgagcttccggcagacagaagcacaatgcttcgcataggcatgacaaatccccctttcatactggagcatttgaatgagatagctagtgttttgcgtcatccttgtgtttatactttccttcatgttcctgtgcaatcaggaagtgatgctgttttaaaggctatgaatcgtgaatacactgtcagtgagttcagaatggtagttgatactctctgtgagcttgtccctggaatgcaaattgccacagatattatttgtggctttcctggcgagactgatgaagattttgctcaaactgttaagcttataaaggaatataagttacctcaagttcacatatcacaattttatcccagaccaggaacacctgctgccaggatgaagaaagtgcctagcattgaagtgaaaaagcgaagtcgcgagttgacctcagtttttgaagctttttcaccataccaagggctggaaggcaaagttgagaggatatggatcactgaaatagctaccgatggtgttcatttggttggacataccaaagggtatatccaggtccttgtcattgctccagatagtatgttgggcacatcggcaaatgttaagatcacatccgtgggaagatggtctgtatttggtgaagtgatagaaggatctattgcagcaaaagaagtacttaaacaaaatcctgctgaagcacaggaagaatatagggaaaatcacgcggaggaagccacctgttctacaaattcttgtggttcctgtgcatgctcgggtgcagaaaatgtggcacaacaatgtggtccacaccgatctgaagatccatctgatgcacccacagattgtggtgatgctacttgtgaggaagcagctcaatatacgcttgtgagaagaaatgtagagagaacaatgaaaacaagagaaagtgatacaggaaaaccagtagtgaaggatcagcaagtaaatttagctaataggagagtcataaatattgataggattctttgggttggtttggctgtcagctttgccacaacattagccctatttgttctgcttagttacaagatcttttggtcctcttattaagctagggcttgtacctgtaattgagtatgcgttattactgcttgattttgttgatttttgttctgaaacatatactgttgtcaatttctgttacagtactaaaataaaaaaaatcatgcagttgttttgccactgta

SEQ ID NO: 2196 - DNA, 1894 bp, Panicum virgatum
tccctttgtctgccctgcagagtgacagtgagtacatgtcgggacagctatcggcatttggatatgctattactgaagaacccgaaggagcagatttatggctaattaacacatgcacagtgaaaaatcctagtcaatctgcaatgacaaccctcatatcgaaatgcaagaacgcaaacaaaccactagtagtcgctggatgtgtaccacaaggaagccagggtctcaaggagcttgaaggtattagtataattggagtgcaacagatagaccgggttgttgaagtggttgaggaaaccttaaaaggccatgaggttcggttactgagtcggaaaacactgccctcacttgatttacctaaggtaagaaagaacaagtttatcgagattcttcctattaatgtggggtgtttaggcgcctgcacttactgtaagacaaagcatgctcgtggtcatttgggaagctatactattgacagcttggtggatcgtgtgaaaactgttgtatctgaaggtgtccgagagatatggttgagcagtgaagatactggtgcttatggcagggacatcagtacaaatcttccaaatctgttaaatgcaattgtccaagagcttcctgttgaccgaagcacaatgctccgcataggcatgacaaaccctcctttcatactagagcatctgaaggagatagctgccgttttgcgtcatccttgtgtttattctttcctccatgtgcctgtgcagtctggaagtgatgctgttttaacggccatgaatcgtgaatacactgttggtgagttcaggaaggtagttgacactctgtgtgaacttgtccctggaatgcaaattgctactgatattatatgtggctttcctggtgagactgatgaagattttgctgagactgttaatctcgtaaaggaatatcaatttcctcaagtccacatatcacagttttaccccagaccagggacacctgctgctaggatgaagaaagtgccaagcaatgatgtgaagaagcggagtcgtgaactgacttctgtttttgaatcattttcaccctacaaaggaatggaaggcaaggtagagcgaatctggatcactgagatagctaccgatggtgttcacttggttggacataccaagggatatatccaggtgctggtcattgccccagatagcatgctagggacatcggcgaatgtgaagatcacatcagttgggcgatggtctgtgttcggtgaggtgatagaaggatctgtggttgcaggggaagcacctaagcaaaccagcagtgaaccacagaaagaacacatacagaatcaggcggaggatgctggttgttgtgccaccgactcttgtggcgcctgtgcgtgctccgacgtcgcacaacactgcggccctgaacgatgcgaggatatacctgatgcaccccagaccagtggtaacgttaatcaacagggggcagtccagtctacgcttgtcaggagaaacgtggagggatcgacgaaagcaagtgaaagcaatgcagcacagtcggtagggaaggaacagcaggtgaacattgtaactaggagaggcgtaaacgttgacacgattttgtggtgcggtttggccgtgagcttcgctgcaattgtagcgcttcttgtactccttaccggcaggatttcgtcgacatcctcctactagtctaggcggtgattgtaacttgtaacaattgttcttgagcgtttactgatcaattttggcggttttctttagtcgatctgccatgtatgtcgttgcaaagttgtggcaccacaaatacatgtatgcaaacaggttttgtcattgtcgctccagaacggaacaaggtttggtgatgcaatttttgatttttctactgttcgaaacaa

SEQ ID NO: 2197 - DNA, 658 bp, Zea mays
aggcccgttcatgaaatctactcaagttttccggtattcggcccaatcgcgcattaaactgccgcccaaacccggctctggccaactctagggttgagataaaagaaatcttcaagtcattggcccgtgtaacgactttccatcgacccgccgcctgtagcccttcccgtctctggagtctggaagcttcttcctcctcgcctccgactccgtcatggccggcggcaacctgttcgggcgggcgctgagctacgtagtcaacgagctcctcgtcgagggcctcgccaacaaccgtgcattccagaggttcgctgtgaagaccaacaggactcttgagagcctatcgtctaaagctaaggaagtgagggaggagttatcggaacaattgaaggaagctcgtggccagaaagatcacttcaagcagtgaagctggttcccacatcgattcagcaagatgatactgacaatcttgttacgagtttagtccttgtctgggtactatttatgaatgacattctggatgtcattcaatggaaattagtcttaagtttctctgcacttagattagtagacgcagagcagttggtctcatgtcctttgtcataaactattgtataatttttaataatgtgtgcctatgttgatattttttcttgaa

SEQ ID NO: 2198 - DNA, 643 bp, Panicum virgatum
gacccttctcctattaggctcgaccatctcccacctttccttttgacccgccgccgcctccccgtttccggaagcttcttccgcctcctccacccccagggcacgccatggccggcggcaacttgttggggcgggcgctgagctacgtcgtcaacgagttcctcgtcgagggcctcgccaacagccgtgcattccagaggtttgcagtgaagaccaacaggactcttgagagcctatcatctaaagctaaggaagtgagagaggagctatcagagcaattaaaggatgcgcgtggccagaatgatcacttcaagcggtgaagctggttcgcacattggttcaccgagatgatgctgtccgagcaatcattctatagtttttgtagtattcgtctgggtcctatttatggatgtaattccattgaaggaaacgtgcttgagctgatcctttattggataacattcaactgaaggaacctttgtatagtatcatcagtttcacgtgactagattatcagacgcgcagagcagcgagcagtttgtcttgtcccccctcctagtgctgtgaaatggaacacgaactactggcaagcagcattcgtgtatgttgataagatatatctatgttgattatctgactttgt

SEQ ID NO: 2199 - DNA, 820 bp, Panicum virgatum
ggcgttctcctataaggctcgaccatcccccgcctttccttttgacccgccgcctcctccccgtttccggaagcttcttcttcctcctcctccacccccagggttagccatggccgccggcaacctgttcgggcgggcgctgagctacgtcgtcaacgagttcctcgttgagggtctcgccaacagccgtgcattccagaggtttgctgtgaagaccaacaggactcttgagaacctatcatctaaagctaaggaagtgagagaggagctatccgagcaattaaaggatgcgcgtggccagaatgatcacttcaagcggtgaagctggatcgcacattggttcaccaagatgatgcctgccgtgtgcaacctttccatagttttcctagtattcatctggatcctatttatggatgtcattccatcaaagggagcggtcttgacctgttcctattttggatgtcattcaattgaaggaacctttgtatagtatcttcagtttcactggacttgattatcagacacagagcagagagcagttgatgtctagcccctccctagtgttgtgaaatggaacacgaactactggcaagcagcattcgtgtattgttattaagatacatatctatgctgattatctgactttgtatttgtggatatgtgtgttacggttgtggttggtcttgatcaacgtgatcatagttctttgccctgtacaaaaatgttacgtttctgttgaaatggtgtcactttcagagcttttgtgtagaaatgattctgtgtgagtgtgatctgctctccatttgggagaaatcttcag

SEQ ID NO: 2200 - DNA, 672 bp, Panicum virgatum
gccgcctcctccccgtttccggaagcttcttcttcctcctcctccacccccagggttagccatggccgccggcaacctgttcgggcgggcgctgagctacgtcgtcaacgagttcctcgttgagggtctcgccaacagccgtgcattccagaggtttgctgtgaagaccaacaggactcttgagaacctatcatctaaagctaaggaagtgagagaggagctatccgagcaattaaaggatgcgcgtggccagaatgatcacttcaagcggtgaagctggatcgcacattggttcaccaagatgatgcctgccgtgtgcaacctttccatagttttcctagtattcatctggatcctatttatggatgtcattccatcaaagggagcggtcttgacctgttcctattttggatgtcattcaattgaaggaacctttgtatagtatcttcagtttcactggacttgattatcagacacagagcagagagcagttgatgtctagcccctccctagtgttgtgaaatggaacacgaactactggcaagcagcattcgtgtattgttattaagatacatatctatgctgattatctgactttgtatttgtggatatgtgtgttacggttgtggttggtcttgatcaacgtgatcatagttctttgccctgtacaag

SEQ ID NO: 2201 - DNA, 541 bp, Zea mays
atataaagtcttacatctctcgtcttcccattgacccgccgcctctacgcctttcagtatccggaagaccggaagcttcttcctcctcgcctctgacatggccggcggcaacctattcggtcgagcgctgagctacgttgtcaacgagttcttcgtccagggcctcgccaacaaccgtgcagtccagaggtttgctgtgaagaccaacaagactcttgagagcctatcgtctaaagccaaggaaatgagggaggagttatcggaacaattcaaggatgctcgtggccagaaagatcacttcaagcagtgaagccgatccccaaagttgattcaacgacacgaatctagctatgagttttttctagttctcgtccgggtcctatttatgaatggcatttgaagggatttcttggtgtcgttcaatggacggatccgttgtataaagtttatctgcacttagattagtagatatattggtagacacatcactttctgctgcccctttttcataaatacatatatctcgatctctactgtatta

SEQ ID NO: 2202 - DNA, 647 bp, Avena sativa
attccccaaccgaccaggcgcctccgcagcagtcccttctcgaaggttctccccctctcgtcagccatggccggcggcaacctgttcgggagggcgctcagctacgtcgtcaaccagttcctcgtcgagggcctcgccaacaaccgtgccttccagaggtttgctgtgaggaccaacaggacttttgagaatctctcgtctaaagctaaagaagtgaagcaggaagtatcagagaaatggagggatgttcgtggacaggatgatcatttcaggcagtgatgccaagaacattccttggcgtccatcaagttgttctccgtacaatcctgctgtttattttcctgctgcttgtgctactttcggatgtcatcaacctgccgaagtgtccattgtataggatcgataattatctaagttagtttgaatttgagaagtagacgacaagacagtattgtgtgttctatcatctgttaggtggcattctcgttcttggagtcacccgcttctctatgtgctgtggaaaaaattgttaatctgtagtattagatgcttagataaactcaagcaattcctgaatatggtgccttttccttgtgcaacaagagtggctgaatgtcatagcctggcgggcatctgataaatttttt

SEQ ID NO: 2203 - DNA, 779 bp, Oryza sativa
ctccctccgcctcagcaagcgccgctccggttaataatagcaaaatcccctcccacccccgccttctctctggaagcttcctcctgctcttcgccatggccggcggcgggaacctgttcgggagggtgctcagctacgtcgtcaacgagttcatcgtcgaggggctcgccaacaaccgtaccttccagagatttgctgtgaggaccaacaagtctcttgagaatctatcgtccaaagctaaagaagtgagggaggagctatcggagcaatggaggaattctcgtggcaatgatgatcatttcaggcagtgaagctggtcattttatgaggactatgaagtcgttgctaactgtacaatcttgctatcggctttcctagtgctatgattgctatttttctatattgtcgcatggaagaaaccattgtatagaaaccatgtgatctcaatttttgtgaacttgataagtagaaatcagaccactttcatgtcgtacttccctattatcttccgagtatactttgtaatggagaaatcctgcataagttaactcttgatgatgacggaatgatagacccgcatttaaacgttcgttggtgtcctatgttggtctatgaatgttgacagtattataagctcgcttgctaacccttcccttccccaaggggatctaaggttgtttggttcattgtcaaaactaaccctatcaaagaatatttggcacttgtaattgagcgtcatggctgacgaatttcttaatcaaggattatagcttcttttt

SEQ ID NO: 2204 - DNA, 381 bp, Lolium multiflorum
agcgtggtcgcggccgaggtacgcgggggccctattctcgcatcgcgtccccaattgaccaggcgcctccgcagcagtctcttctcttctccaaggttcgcagccatggccggcggcaacctcttcggcagggcgctcagctacgtcgtcaaccagttcctcgtcgagggcctcgccaacaaccgtgccttccagaggtttgctgtgaggacaaacaggacttttgagaatctttcgtctaaagctaaagaagtgaagcaggatgtatcagagaaatggagggatgtccgtggacaggatgatcatttcaggcagtgatgctcggcacatttcttggcatccatcaagttgcttgcagtacctgcccgggcggccgctcga

SEQ ID NO: 2205 - DNA, 1119 bp, Panicum virgatum
acacgacacatgcggcgagagaagagcaggcgcgcaccaagaaaggccataaaaagaaagcgagctcggagcggatcgagcggaagaagaggcagtcctctcctgctgctcgcagctcaccttctcctccgacactccaaagcccagctcgagcgcgcgacgagctcccagatcccaatttgtcccctgcgggcagaggatagctcagatggcgatgcccgcgcggccgctgctggtgctggccgccctgctgctggcggcgctcctgctctccgccgcctcggccgccgacagcaagaacaaccctgccgatcagctcgtgtcattgatcaacagcaaccgtactgccagcaaggcctcttccctttctgataatcaaggtctgggatgcattgctctgcagtacatcaaagcatatgaaggtcaatgcagtgatgtgcgtgacaagaagcctccggagaccagtttcgccgaaatatttgccccgagctgtggtgtccaagtggcaacgctttcaaagattactgggaggctcgtgggttgccagtccaagtacccatctccacctgaggccttcgacatcctggttaatgacgcgaaggatctccaggtgctgcacagcaagaaccacacggaaatcggggtagccgtgagtggcaccgacggcggtgggccgtacttctggtgtgtcctgttcagtggtgggaagcccgccaccagcttcaaggtggacggcgaagtgcccaagaccgccatgcacccgggatgcttcagcggcaacaatgacgactgcgcgggtccgaagaacggcgccattccgatcagtgctggcgcatcgaggctggcggcagcgcttctttttgtgtagcttgtgcctttgctttgtgagcttgagtagggggggttatattttccaccattctttttactgcaccattcttttgcttgttttgagcagatggactatgtaaggatctgaagatcattgttcagcgttcgagtctgtccgttacctgttcagaatccaaagatcattgttcagcattttgagactatctgtatctgttcagaattcagaatgttcgaagtgattttgagactatctcttcagatgtttgc

SEQ ID NO: 2206 - DNA, 962 bp, Panicum virgatum
tgctggtgctggccgtcctgctgctgccggcgctcctgctctccgccgcctcggccgccgacagcaagaacaaccctgccgatgagctcgtggcattgatcaacagcaaccgtactgccagcaaggcctcttccctttctgataatcaaggtctgggatgcattgctctgcagtacatcaaagcatatgaaggtcaatgcagtgatgtgcgtgataagaagcctccggagaccagtttcgccgaaatatttgccccgggctgtggtgtccaagtggcaacgctttcaaaaattactgggaggctcgtgggctgccagtccaagtacccttctccacctgaggccttcgacatccttgttaacgacgcgaaggacctccaggtcctgcacagcaagaaccacacggagatcggggcagccgtgagcggcaccgacggcggtgggccgtacttctggtgtgtcctcttcagtggcgggaagcccgccaccagcttcaaggtggagggcgaagtgccaaagaccgccatgcacccgggatgcttcagcggcaacaatgacgactgcgcgggtccgaagaatggcgccactccgatcagtgctggcgcatcgagactggtggcagcgcttctttttgttgtagcttgtgccgtcactttgtgagcttcagtagtggggttatatttaccaccattctttttgctttgtgaggaaggagcagcgcaacaccctcctgttgcagtactactaccgcgccattcttttgcttgtttgagcagatgaactatgtaaggatctgaagatcattgttcagcgttcgagtctgtccgttacctgtccagaatccaaagatcattgttcagcattttgaaactatttgttacctgttcagaaatcagaatgttcgccaaagtaatcttgtgtactctcttcagatgtttgctggcactgtaagaaccttttgac

SEQ ID NO: 2207 - DNA, 1770 bp, Panicum virgatum
taattaaatataaattttttgattctttaagattgttggaatgtcttttaatatggaacggagggagtatttgcagtacacgagcctatccgactctgagggcctgttcggctgaccgcatgaataatataatgctgatagaatgaatattattctgtgagagaaaataagctgatacaactcaagacaagacaagccgaacaggtttagagttgggctcctggaagaaaaaaaactcgagctgagttgtaggctcggctggatgcgaggctcactcagaccgactcggctcgggatgctatcgaacggaactctcatctcctgtttccttcccctcccccccccccccccttcgtctcggactctctctcctcccttgctcttccttccctggcggcggcgccgactgcgagaccggcggcgccattccgtcacgtcttcgcccagtccttttccggcgccgagcatccaccaggagacttcagggggtttcgcaacaatgtcctggtgcacgattgagtctgaccctggtgttttcaccgagttgattcagcaaatgcaagtgaaaggtgtgcaggtggaagaactttactctcttgacgtggactctcttagtgaactgcggccagtatacgggctaatttttctcttcaagtggatacctggggaaaaggatgaacggcctgttgtcagagatcctaatccaaaccttttctttgctcaacaagtcatcaataatgcatgtgctactcaagctattctctcagttctcatgaatcgcccagaaattgacataggtccagaactatctcaactgaaggaattcacaggagctttcacacctgatctgaagggcttagctatcagcaacagcgaatctattcggacagctcataacagttttgcaaggccagagccattcatttccgatgagcagagagcagcgactaaggatgatgatgtgtaccatttcataagttatttaccttttgaaggtgtcctctatgagctggatgggctgaaggaagggcctgtgaaccttgggcagtgcgatggttctgatgaccttgattggctacggatggtgcagccagttattcaagaaaggattgagtgctattcacagagtgagattcggttcaatctcatggcaatcataaagaataggaaagaggtgtacagtgctgagctggaggaactggagaagaggagggagcaaattttgcaggagatgaacaatacttccgccacagaatccttgaacaactcgcttacagaggtgatatcagcaattgagacagtcagcgagaagatcatcatagaagaagagaagttcaagaagtggaagacggagaacatccggaggaagcacaactatatcccgttcctgttcaacctgttgaagatgctcgcagaaaagcagcagctaaaacctctggtcgagaaggccaagcagcaaaagtcatcaagcgctagcactagatgatggtgaaatgtcataggccggtagactgatgtatcaggtgccaagggttagagaaatcattgctaaggttatagaccatcttgctcgctgtggtgtgttgtcaactgcgccagttttggtgagcacgcacgttgtggaaacggtcaaattggttgtttattttgtcagtttattaattgttttcttctggattatagaatgtgtggctgtggatcgttctggattatgctaatcttttgaggtgacagcttgctaatctttattagattagatacagcccctgt

SEQ ID NO: 2208 - DNA, 1928 bp, Sorghum bicolor
tggccctacacggaccggacctgcctattcgctgcaaccctcccccttctccttccgttacccagcgtgcgcgctgcactctccctcctccccacttctctctcgtggcgacggcggcgacgacgacgactgggcggccgtcgctgcctcgctactcgccaggttcccaggtcttcttcggcctctttgctgtcggcgagcaccaccagggaaccaggatacttcagtggttttgcaaggatgtcctggtgcactattgagtctgatcctggtgtgttcaccgagctgattcagcaaatgcaagtgaaaggtgtacaggtggaagagctttattctcttgatgtggattctcttagtcaactgcggccagtatatgggctaatttttctcttcaagtggatacctggggagaaggatgaacggcttgttgtcagagatcctaatccaaaccttttctttgcacaccaagtcatcactaacgcatgtgctactcaagctattctctcagttctcatgaatcgccctgaaattgacatcggtccagaattatctcaattgaaggaattcacaggagctttcacacctgatctgaagggcttagctatcagcaacagcgaatccatccggacagctcataacagctttgcaaggccagagccatttatttctgatgagcagagagccgcgactaaggatgatgatgtttaccatttcataagctatttaccttttgaaggtgtcctgtatgagctggatgggctgaaggaagggcctgtaaatcttgggcagtgcggtggtgctgatgaccttgattggctacggatggtgcagccagttattcaagaaaggattgagcgctactcacagagtgagatcaggttcaatcttatggccatcataaagaacaggaaagaggtgtacagtgctgagctggaggagctggagaagagaagggagcagattttgcaggagatgaacaagactgccgccacagaatccttgaacaactcgcttacagaggtgatatcggcaatcgaaaccgtcagagagaagatggtcatggaagaagagaagttcaagaagtggaagacggagaacattcggaggaagcataactacatccctttcctcttcaacttgctgaagatgcttgcagagaagcagcaactaaaacctctggtcgagaaagccaaacagcaaaagtcatcaagccctagcacaagatgatggtgaaatgtcatagactggtagcttttgcgatgtcctctgtgagcgcgttatcttatcgaacacattgtctagttggcagcttagagaaattattaccaaggttattgaccattgtgcacgctgtgttgtgtcagcagctacgccatttttgctgagtacgtacgttgttgaagtggtcaattttagtcgtttatttattttgtgtcaggttaattgtgccagtggattataaaacgcgttgaaggctgtggatcgtttttggtaatgtttttgagataccacttgctagttgagtacgggattcatgttagcttcggcagcggagctgcaccaaatgatgcaggtcggtgaggaggagccgttgggtgaggagctgttttctcgtacggcaagcagaggctgctgtgatttcgggctttggcagaagggctccgctccggcattggagcgcgcggtgcggagtcttgccaaactgccccctatgggggctacaatgcaacacaacggtattgttttgcctcctaaaagaaacaactattctagaccgtgaaatttatactatcttcgattacctacaccgcctttttaatatactcctttcattgtaaacaattgcatatattgttttgcaaggaattattttatctcgttcattgagaaatcatttttaaatttgatcaaattatagaaactattat

SEQ ID NO: 2209 - DNA, 1576 bp, Panicum virgatum
gctcgggggagctcggctcattgacagcccttcccccctcgggctcatctctgaactctctcctcgcccttggctctttgctcttccttccctggcggcggcggctgcgcgagcggcggcgccattccgtcacgtcttggcccagccccctctgccggcggcgagcatccaccaggagacttcagggggtttcgcaacgatgtcctggtgcacgattgagtctgaccctggtgttttcaccgagttgattcagcaaatgcaagtgaaaggtgtgcaggtggaagagctttactctcttgatgtggactctcttagcgaactgcggccagtatacgggctaatttttctcttcaagtggatacctggggaaaaggatgaacggcctgttgtcagagatcctaatccaaaccttttctttgctcagcaagtcatcaataatgcatgtgctactcaagctattctctcagttctcatgaatcgcccagaaattgacataggtccagaactatctcaactgaaggaattcacaggagctttcacacctgatctgaggggcttagctatcagcaacagcgaatctattcggacagctcataacagttttgctaggccagagccgttcatttcagatgagcagagagcagcgactaaggatgatgatgtgtaccatttcataagttatttaccttttgaaggtgtcctctatgagctggatgggctgaaggaaggacctgtgaaccttgggcagtgcgatggttctgatgaccttgattggctacggatggtgcagccagttattcaagaaaggatcgaacgctattcacagagtgagattaggttcaatctcatggcaatcataaagaataggaaagaggtgtacagtgccgagctggaggaactggagaagagaagggagcaaattttgcaggagataaacaatacttctgccacagaatccttgaacaactcgcttacagaggtgatatcagcaattgagacagttagcgagaagatcatcatggaagaagagaagtttaagaagtggaagacggagaacatccggaggaagcacaactacatcccgttcctgttcaacctgttgaaggtgctcgcagagaagcagcagctaaaacctctggtcgagaaggccaaacagcaaaagtcttcaagctctggcactaaatgatggtgaaatgtcataggctggtagattgatgtatcaggtgcctagggttcattgtaccttcgtctctacaagcgcattacctgatagttggcagcttagagaaatcattgctaaggttatggaccatcttgctcgctgcggtgtgttgtcaactgcgccagttttggtgagcacgcacgttgtggaaacggtcaaattggttgtttattttgtcaagttattttttctggattatagaatgtgttgaaggttgtggatcgtttcggataatgctaatcttttgatgtgacagcttgctcatctttattagattagataccctggctgatgctactgacgaatcaagtttgtgtggaacacaacacgattattgcatcatcaaatacgatt

SEQ ID NO: 2210 - DNA, 1460 bp, Saccharum officinarum
cccttttctccttccgttacccagcgtgcgcgctgcactctccctccccacttcttctctctcgtggcgacggcgacggcgacgacgacgactgggcggccgtcgctgccgcgctactcgccaggtgcccaggtcttcttcggccccttcgctgtcgacgagcaccataagggcaaccaggatacttcagtggtttcgcaaggatgtcctggtgcactattgagtctgatcctggtgtgttcaccgagctgattcagcaaatgcaagtgaaaggtgtacaggtggaagagctttattctcttgatgtggactctcttagtctactgcggccagtatatggactaatttttctcttcaagtggatacctggggagaaggatgaacggcctgttgtcagagatcctaatccaaaccttttctttgcacaccaagtcatcactaatgcatgtgctactcaagctattctctcagttctcatgaatcgccctgaaattgacatcggtccggaattatctcaattgaaggaattcacaggagctttcacacctgatctgaagggcttagctatcagcaacagcgaatctatccggacagctcataacagctttgcaaggccagagccatttatttctgatgagcagagagccgtgactaaggatgatgatgtttaccatttcataagctatttaccttttgaaggtgtcctgtatgagctggatgggctgaaggaagggcctgtaaatcttgggcagtgcggtggtgctgatgaccttgattggctacggatggtgcagccagttattcaagaaaggattgagcgctactcacagagtgagatcaggttcaatcttatggccatcataaagaataggaaagaggtgtacagtgctgagctggaggaactggagaggagaagggagcagattttgcaggagaacaagacttcggccacagaatccttgaacaactcgcttacagaggtgatatcagcaatggaaaccgtcacagagaagatgatcatggaagaagagaagttcaagaagtggaagacggagaacattcggaggaagcataactacatccctttcctcttcaacttgctgaagatgcttgcagagaagcagcaactaaaacctctggtcgagaaagccaaacagcagaagtcatcaagccgtagcacaagatgatggtgaaatgtcagactggtagcttttgcgatgtcctctgtgagggtgttatcttatcagaacacattgcctagttggcagcttagagaaattattaccaaggttattgaccattttgcacgctgtgttgtgtcagcagctacgccatttttgctgagtacgtacgatgttgaagcggtcaattttagtcgtctattttgtgtcaggttaattgtccctgtggattataaaacgcgttgaaggctgtggatcgttttgggtaatatttttgag

SEQ ID NO: 2211 - DNA, 1947 bp, Zea mays
ctgcacaggggtttcgattttttcgattaaactgaaaactgaaccgaagcatacggttaactgaatcttcggttttccttttttctaaacaaaatttcggttaaccaaacttaaaaaaaaaactaaaaaaccaaaccgaaaaatttcggttactcaattgcccagccctgtgggcctcgtgccgctcactagactttaaagcccgtttggccctctacacggaccagacctgccttttcttcttcagcgtgcacattccttccccacttctctctctctctcgtgacgacggcgacggcaacgactggggcgacagtcgctgccgccctacttgccggttgctcggatcttcttcggcccgttagccgtcgacgagcaccaccagggcaaccagatacttcagtggcttcgcaaggatgtcctggtgcactattgagtctgatcctggtgtgttcactgagctgattcagcaaatgcaagtgaaaggtgtacaggtggaagagctttactctctcgatgtgggctctcttagtcaactgcggccagtatatgggctaatttttctcttcaagtggatacccggggagaaggatgaacggcctgttgtcagagatcctaacccaaaccttttctttgcgcaccaagtcatcactaatgcatgtgctactcaagctattctctcagttctcatgaatcgccctgaaattgacattggcccagaattatctcaattgaaggaattcacaggagcttttacaccagatctgaagggcttggctattagcaacagcgaatctatccggacagctcataacagctttgcaaggccagagccatttatttctgatgagcagagggccgcaactaaggatgatgatgtttaccatttcataagctatttaccttttgaaggtgtcctgtatgagctggatggactgaaggaagggcctgtgaatcttgggcagtgcgatggtgctgatgatcttgattggctacggatggtgcagccagttattcaagaaaggattgagcgctactcacaaagcgagatcaggttcaatctcatggccatcataaagaacaggaaagaggtgtacagtgctgagcttgaggaactggagaagagaagggagcagattttgcaggagatgaataatgcttcctccacagaatccttgagcagttcgcttacggaggtgatatcggcaatcgaaactgtcacggagaaggtcatcatggaagaagagaagttcaagaagtggaagaaggagaacattcggaggaaacataactacatccctttcttgttcaacttgctgaagatgcttgcagagaagcagcagctaaaacctctggtcgagaaggccaaacagcaaaagtcagcaagcccgagcacgagttgatggtgaaatgtcaatagactggtagcttttgccgatgtcttctgagcgtcgtgttatcttatcagatacattgccaagtcggcagctcagataaattatgaccgatgttatttataccatgttgcacgccgtgatgtatcagcagctatgccattttttttttgcagagcacgtgcgttgttgaagtggttaattttagtcgtttagagagattgtttgagagtaagggtaatggaatggactgaggaggttgaatcactcaatattcaattttaaataatgatgggttccagccctctcaatcccctccattccacctactcctaaacaaactcttaggtctagttttgcaactcttttttgtcaaggaattttcattttatcaagagaaattagttcatttatacttagaaaaatggagttgacaatctagcctttagccgtttattttgtgttaggttaattgtccctgtggatttgttgatggttgtggatcattttgggtaataattttgagataccacttgctagttgagtacaagat

SEQ ID NO: 2212 - DNA, 1290 bp, Pennisetum glaucum
ctcctccggctgggtgggtcctctcggggcttaagaggatttcgcaaggatgtcttggtgcacgattgagtccgaccctggtgttttcaccgagttgattcagcaaatgcaagtgaaaggcgtgcaggtggaagagctctactctcttgatgtggactctcttagtgaactgcggccgatatatgggttaatttttctcttcaagtggatacctggggaaaaggatgaacggcctgttgtcagagatcctaatccaaaccttttctttgctcaccaagtcatcaataatgcatgtgctacccaagctattctctcagttctcatgaaccgcccagaaattgacataggtccggagttatctcagttgaaggagttcacaggagcctttacacctgatctgaagggcctagccattggcaacagcgaatccattcgggcggctcataacggttttgcaagaccggagccattcatttctgacgagcagagagccgcgactaaggatgacgatgtgtaccatttcataagctatttaccctttgaaggtgtgctgtacgagctggatgggctgaaggaagggcctgtaaaccttgggcagtgcggtggtcttgacgacctcgattggctacggatggtgcagccagtgatccaagagaggatcgagcgttattcgcagagtgagattaggttcaaccttatggccatcataaagaacaggaaggacgtgtacagcgccgagctggaggagctggagaagaggagggaggaaatcttacaggagatgaacaaggcccccgccgccgcggaatccctgaacagctcgctcacagaggtggtatcggcgatcgaaaccgtccgcgagaggatcatcatggaagaggagaagttgaagaagtggaaggcggagaacgtccggaggaagcacaactacatccctttcctgttcaacttgctgaagacgctcgcagagaagcagcagctaagacctctggtggagaaggcgaggcagcagcacaagtcgccgagccctagcacgacgagatgatggcgacacgttgcccgtgggccgccggccggtagcttgacgcatccggtgctcttgtgcttagggttgactactgcatcttgctctcagtgtgcccgctggctggcagcttagataaaatcagtactaaggttataatagacaattttgcctcgctgttggtgtgtatcaactgcgccagttttggtggagcacgcacgcacgcacgacgattggttgtttaattgttcttttggattgtgaaa

SEQ ID NO: 2213 - DNA, 2702 bp, Oryza sativa
cttagcttccaaaatcattgcgcctcgactcgagtttctctcccccgccgccttccgctcgtcgcgcatctggcgagcagagcaggggagggggcgccgccgccgccgccgtccttgtgcatcctcatcccggttttgggggtggttctgtcccaggttggatccgcgccccctggctgtcaccgtaatctttcagggttttcgcgaggatgtcgtggtgcacgattgagtctgatcccggtgttttcaccgaattgatccaggagatgcaagtaaaaggtgttcaggtggaagaactttactctcttgatgtggactctattagtgaactgcggccagtttatgggctaatttttctcttcaagtggatggctggggaaaaggatgaacggcctgtcgtcaaagatccaaacccaaaccttttctttgctagccaggtcatccctaatgcatgtgctactcaagctattctgtcaatcctcatgaatcgcccagaaattgacataggtccagaactatccaacttgaaggaattcacaggagcttttgcacctgacatgaagggccttgctattaacaacagtgattctattcgcacagcccataacagttttgccaggcctgagccatttgtctcagatgagcaaagagctgcgggtaaggatgatgaagtgtaccatttcataagctatttaccttttgaaggagtcctctatgagcttgatggattgaaggaaggacccataagccttgggcagtgttctggtgggcctgatgatcttgattggctaaggatggtgcagccagttatacaaaaaagaattgaacgctattcccagagcgagattaggtttaaccttatggccatcattaagaataggaaggatgtatatactgctgagctgaaggagctggagaagagaagggaccagcttttgcaggagatgaatgagtcctcagcagcagagtccttaaacagcgaacttgcagaggtgacatcagccattgagactgtcagcgagaagattatcatggaagaagagaagttcaagaagtggaggacggagaacatcaggaggaagcacaactacattccctttctattcaactttctcaagatgctggcggaaaagaagcagctaaagccattggttgagaaggccaaacaacagaaggcttccagcacaagcacgagtgcaagatgaagccaagtgccaccaatggctgtaccgaattcgttggttctcattttgaggaaagcatacgttcatgggttactgggatgacaaggagaagccaacccatctgaggtttctggtatcaaacacggcagcaggatgcattattggcaagggtggatcaaccattaatgaatttcagtcccagtctggggctcgtattcagctatcgcgtagccatgagttcttccctggtacaaatgacagaattatcatggtttctggtctgtttgatgaagtaataaaggccatggagctgattctcgagaagcttttagctgagggggaagaaagcaatgaagctgaagctagacctaaagttagacttgtagttcctaacagttcttgtggtggaatcattggtaaaggagggtcaacaatcaagtcattcattgaagactcacatgctggaatcaagatttcaccacaggataacaattttgttggtttgcatgatagactcgttactgtcacaggacccttggaccatcagatgcgtgcaatatatttgatattaagcaagttatcggaggacgttcactacccacctaatctgagttccccatttccatatgcaggccttggtttccctagttaccctggtgttcctgttgggtatatgatcccacaggtgccgtataataatgctgtgaactatggacctaatgggtatggaggaaggtaccaaaacaacaagcccagtacacctatgagatcacctgctaacaatgatgcccaagattctctcactattggtattgctgatgaacatattggtgctgtcgtaggacgtgccggaaggaacattacagagatcattcaggctagtggtgccaggatcaagatatctgataggggtgacttcattgctggcacatctgagaggaaagtgacgataactggaacatcagaagctattcaggcagcagagtctatgataatgcagagggtgacagccagttccgagaggtgataaaatctcatgaagacgaggggcatcatctgatggaaaagaagcctgatgccaagttaggaggaggggttggagattgtcttttctagttttagcactatccgcaaaaaaagcttgagagaaaatttaagataatctattgttccttattgagtctgattgtgttagtaactggagtagtcagtcaatcagctgttctatttatttcttatttttgttgggaataggattatatttcacaacatgtttggctgttgtcataactcaacaacgctggtgtgctaccctagttttgataattgtgatccttaggttacccttgaccccttgtctttgcctgtttgtttgtctcctcaaaagtcgaaatgactcgttttgctgaaagacaaagttgcttcctagtgagaggctgcatcttctgtccaatttgttgcatttccatgatgttgcctccaaaatcttgcaagtccaaagccaggaaaaaaaagcga

SEQ ID NO: 2214 - DNA, 1707 bp, Brachypodium distachyon
aaactccgtctcctcttctctcccgttcccgtacctcctctttcctgactcaacccaacccgggatatcccccaacccggcccgtgccctacaggctgctacagcctctaccgccgccgccgtgccctacagcctaccgccgccgccgccggcctcaatcccgcccccagcaccgccgcctcttacgcgcgtctccgccatcgccgccgctcccgctctccctccctcatcgggacatcgtgttcctgctgtctccaccccgcccgcaatctctgggtgggttctaaggccctcgcttgctgctaccggaggatttcgcgaggatgtcgtggtgcacgatcgagtctgatcctggtgttttcaccgagttgattcaggaaatgcaggtgaaaggggtacaggtggaggagctttactctctcgatgtggactctcttagtgaactacggccagtttatgggttaatttttctcttcaagtgggtggctggaggaaaggatgaaaggcccgttgtcaacgacccgaacccaaaccttttctttgctcgacaggtcatcacgaatgcatgtgccactcaagctattctctcaattctaatgaatcgcccagaaattgacattggtccagaattatcaaatttgaaagaattcacaggagcttttgcacctgacatgaagggcttggctatcaacaacagcgattctattcgggctgcccacaacagttttgcaaggccagagccatttgtttctgatgagcagaaagttgcgggtaaggatgatgatgtataccatttcataagctatttaccctttgagggcgtcctctatgagctggatgggttgaaggaagggcccatcagccttggccagtattctggcgggcccaatgacctgggttggctacagatggtgcaaccagttatacaagagagaattgagcgctattcgcagagtgagatcaggttcaaccttatggccatcataaagaacagaaaggatgtatatactgctgagctgaaggagctggagaagaaaagggagcaaatcctgcaggagatgaacaagaccaccgctgcagagtcattaaacagtgagctctcagaggtggcatcagcaatcgagacagtcggtgagaagatcatgatggaggaagagaagttcatgaagtggaagacagagaacgtccggaggaagcacaattacatccctttcctcttcaacctcctcaagacgctggcggagaagaagcagctgaagccattggtagagaaggccaggcaacaaaagactcccagcgctagcacaagttagaccgcgacttttagagtgccatagttggctgtatcaagttcgggttaatcacatctttcttttccagaatgcactatgttatcagatattatcagatacagtacctagttggcagcttggagatatcattactaaggttataaacctgcttaaattttcttttgcactgctgtatcgtcaactttttgactggtagaactgtagaggcggccaatttaatgttgagggtggtagaacttatttctgtcagcctaaattagatcgagacagctcctaagaggaaagggagcatcgtttgtttaacagaaatgtggttccgaggccccatgtcagtatggtattctgtctttgctgttgttgggcagttggggtcctgagccacgtcggtgtggtg

SEQ ID NO: 2215 - DNA, 1372 bp, Triticum aestivum
tcgcctctctcgctcgctgctgcgccgtcggaggatcccgcgaggatgtcgtggtgcaccatcgagtccgatcccggtgttttcaccgagttgattcaggagatgcaagtaaaaggtgtacaggtggaggagctttactctctcgatgtggactctcttagtcaactacagccagtatatgggttaatttttctcttcaagtggatgcctggaggaaatgatgaacggcctgttgtcagcgacccaaacccaaacctgttctttgctcgccaggtgatcacgaatgcatgtgccactcaagctatcctctcaatcctcatgaaccgcccagaaatcgacataggtccagagctatcaaacctgaaggagttcacaggagctttcgcgcctgacatgaagggcctggctatcaacaacagcgactccatccgggctgcccacaacagcttcgcaaggccagagccattcgtctccgatgagcagaaagccgccaccaaggacgacgaggtctaccacttcataagctacataccattcgagggcgtcctgtacgaactggacgggctgaaggaagggccgatcagcctggggcagtacccgggcgggccagaggacctcgggtggctgcagatggtgcagccggtgatccaggagaggatcgagcgctactcgcagagcgagatcaggttcaacctcatggccatcataaagaacaggaaggacgtgtacactgccgagctgaaggagctggagaagaagagggagcagatcctgcaggagctgagcaatgaggccacagccgccgcagaaaaggagtccctgaacggcacactggcggaggtggcgttggcggtggaggccgtgggagagaagatcgcgatggaggaggagaagttcaggaagtggaagacggagaacgtccggaggaagcacaactacatcccgttcctgttcaacctcctcaaggcgctggcggagaagaagcagctgacgccgctcgtcgagaaggcccggcagcagaaggcccccgccaccgccggcgccagcgccagcacgagctgaccgtgtccgccgtagttggttgggtagttgaacctggtcatcttttgagaatgcatcatgttatcagacactcctacatacagtacctagttggcggcttagagatgttgttgctgctgaggctataaaccattttctgctgaaatcttgttttgcggtgtgctggattatcgatgttattgctggttagagctgtagaaggggtctatttaatcttaaattaaaggagggtgtggcaggtactttgtctgaaggatataatggtgttgcctggtatggatggtatggataacagagtatgatattctcc

SEQ ID NO: 2216 - DNA, 1374 bp, Leymus cinereus x Leymus triticoides
  misc_feature (8)..(9): n is a, c, g, or t
ccgctcgnngtctccacagccccccggcgcgtgcggaggcccggccagctccgtctctcccccaggttcgcctccctcgctcgctgctgcgccgtgggaggatctcgcgaggatgtcgtggtgcacgatcgagtctgaccccggtgttttcaccgagttgattcaggagatgcaagtaaaaggtgtacaggtggaggagctttactctctcgatgtggactctcttagtcaactacggccagtatatgggttgatttttctcttcaagtggatgcctggaggaaatgatgaacgtcctgttgtcagcgacccaaacctaaacctgttctttgctcgccaggtcatcacgaatgcatgtgccactcaagctatcctctcaatcctgatgaatcgcccagaaatcgacattggtccagagctatcaaacctgaaggaattcacaggggctttcgcgcctgacatgaagggtctggccatcaacaacagcgactccatccgggccgcccacaacagctttgcaaggccagagccattcgtctccgatgagcagaaagccgccaccaaggacaatgaggtctaccacttcataagctacataccgtttgagggcgtcctctacgagctggacgggctcaaggaaggaccgatcagcctggggcagtactcgggcgggcccgaggacctcgggtggctgcagatggtgcagccggtgatccaggagaggatcgagcgctactcgcagagcgagatcaggttcaacctcatggccatcataaagaacaggaaggacgtgtacaccgccgagctgaaggagctggagaagaagagggagcatatcctgcaggagctgagcaacgaggccaccgccaccgccgaaaaggagtccctgaacggcgcgctggcggaggtggcgtcggcggtcgaggccgtgggcgagaagatcgcgatggaggaggagaagttcaggaagtggaagacggagaatgttaggaggaagcacaactacatcccgttcctgttcaacctcctcaaggcgctggcggagaagcagcagctcaagccgctcgtcgagaaggcccggcagcagaaggcccctgccaccaccaccggtgctagtgctagcacgagctgaccgcgtccctagatgcgccgtagttcgttgggtagttggaccacgtcatcttttgagactgcatcatgttatcagacactcctacatacagtacctagttggcagcttagagatgttgctaaggctataaaccattttctgttgaattcttcttttgcggcgtgctggattattgatactattatgctggttagagctgtagaagcggtctatttgatctgaagggagggtggtaggtacga

SEQ ID NO: 2217 - DNA, 1692 bp, Secale cereale
gacttccttttctttcaagcctccccccgccccctctctgctagctaggtctcgtctcgtcagcacgcccgcgccgccgccccctcccgtcgcgccaccgccggagtgcgacggaactcctccctcgccgtctccacagcccccggcgcgcgcggaggcccgtccagccccgcctcttccccaggcaggctcgcatctctcgcccgctgctgcgccgtcggaggatcccgcgaggatgtcgtggtgtaccatcgagtccgaccccggtgttttcactgagttgattcaggagatgcaagtaaaaggtgtacaggtggaggagctttactctctcgatgtggactctcttagtcaactacagccagtatatgggttaatttttctcttcaagtggatgcctggaggaaatgatgaacggcctgttgtcagcgacccaaacccaaacctgttttttgctcgccaggtgatcacgaatgcatgtgccactcaagctatcctctcaatcctcatgaaccgcccagaaatcgacattggcccagagctatcaaacctgaaggaattcacaggagcttttgcgcctgacatgaagggcctggccatcaacaacagcgactccatccgggccgcccacaacagctttgcaaggccagagccatttgtctccgatgagcagaaagtcgccaccaaggacgacgaggtctaccacttcataagctacataccattcgagggcgtcctctacgagctggacgggctgaaggaagggccggtcagcctggggcagtacacgggcggacccgaggacctcgggtggctgcagatggtgcagccggtgatccaggagaggatcgagcgctactcgcagagcgagatcaggttcaacctcatggccatcataaagaacaggaaggacgtgtacaccgccgagctgaaggagctggagaagaagagggagcagatcctgcaggagctgagcaacgaggccgccgacaaggaggccctgaacggcgcgctggcggaggtggcgttggcggtggaggccgtgggcgagaagatcgcgatggaggaggagaagttcaggaagtggaagacggagaacgtccggaggaagcacaactacatcccgttcctgttcaacctcctcaaggcgctggcagagaagaagcagctgacgccgctcgtcgagaaggcccggcagcagaaggcccccgccaccggcgccagcgccagcacgagctgaccgcgtccgccgtagttggttgggtagctggacctcgtcatcttctgagactgcatcatgctatcagacactcctacacacagtacctagttggcagcttagagatgttgctgtcgaggctataaaccattttttctgctgaattcttcttttgcggtgtgctggattatcgttttttaaatgctggttagagctgtagaagcgtttaatttattttaatcttgagggagggtggtgggtgctttgtctgaagaagagaatgatgttgcctggtatggatggcagagtatgatattctccacctcttgcatctttgttgtatcaatgacatgtggggcccactaacaacaggctctagttgagcgtccttagggcatgtacaatggtggcatatggatactgatgccccatgaataaaaagtagtttagagacatcttactttgatagagga

SEQ ID NO: 2218 - DNA, 1647 bp, Triticum aestivum
ctcgtcagcacgcccgcgccgccgccccctcccgtcgccaccgccggagactgacggaactcctcgctcgccctctccacagcccccggcgcgcgcggaggcccgtctccccccaggcaggttcgcctctctcgctcgctgccgcgccgtcggaggatcccgcgaggatgtcgtggtgcaccatcgaatccgatcccggtgttttcaccgagttgattcaggagatgcaagtaaaaggtgtacaggtggaggagctttactctcttgatgtggactctcttagtcaactacagccagtatatgggttaatttttctcttcaagtggatgcctggaggaaatgatgaacggcctgttgtcagcgacccaaacccaaacctgttctttgctcgccaggtgatcacgaatgcatgtgccactcaagctatcctctcaatcctcatgaaccgcccagaaatcgacataggtccagagctatcaaacctgaaggagttcacaggggctttcgcgcctgacatgaagggcctggctatcaacaacagcgactccatccgggctgcccacaacagcttcgcaaggccagagccattcgtctccgatgagcagaaagccgccaccaaggacgacgaggtctaccacttcataagctacataccattcgagggcgtcctgtacgagctggacgggctgaaggaagggccgatcagcctggggcagtacccgggcgggccagaggacctcgggtggctgcagatggtgcagccggtgatccaggagaggatcgagcgctactcgcagagcgagatcaggttcaacctcatggccatcatcaagaacaggaaggacgtgtacactgccgagctgaaggagctggagaagaagagggagcagatcctgcaggagctgagcaacgaggccacagccgccgcagaaaaggagcccctgaacggcgcgctggcggaggtggcgttggcggtggaggccgtgggcgagaagatcgcgatggaggaggagaagttcaggaagtggaagacggagaacgtccggaggaagcacaactacatcccgttcctgttcaacctcctcaaggcgctggcggagaagaagcagctgacgccgctcgtcgagaaggccaggcagcagaaggcccccgccgccgccggcgccagcgccagcgccagcacgagctgaccgcgtcagccgtagttggttgggtagttgaacctcgtcgtcatcttttgagaatgcatcatgttatcagacactcctacatacagtacctagttggcggcttagagatgttgctgctgctgaggctataaaccattttctgctgaaatcttgttttgcggtgtgctggattatcgatattattgctggttagagctgtagaaggggtctatttaatcttgaattaaatgagggtgtggtaggtactctgtctgaaggataatggtgttgcctgggtatggataacagagtatgatattctcccaactcttgcatctttgctgtatcaatgacatgtgggaccacgtgccatggtgatgttagctatgtgccggggaactcgtagtgcggagcagcaacgttcagttccgtaaaccgtaatatagctttgagcgagtaatctgttaaaaaaaaaaaa

SEQ ID NO: 2219 - DNA, 1908 bp, Pennisetum glaucum
tagaaatcaaagccgccgccgaacccgccgccgaccaaaactctaagcctaaggacgccaagacccacgagcccacagccgaagccgaagccgggttcgcagaggaagagtatgaagaggatggagaggagtacgaggaggatgaggatgaggacgaggagctggacgggcccgcggccgcggcggcggagcgggagcggatgcagtccgtgttccggaggctgtcgtccgaccccgtgggcatccgcgtccacgacgtgattatcaagggcaacaccaagacgcgggacgagctcatcgaggcggaggtcttcgacctgctccgcgccgcccccaccgtgcaggacctgctccgcgctgccagcgtcgccaccggccggctgcacaggctcgacgtcttcgacgccgtcaagatcacgctcgacgcggggccacccgagctgcccggcaccaccaacgtcgtcgtcgaggtcgtcgaggccgccaaccccctcaccggtaccgccggcgtgtactcgaagcctgaggcaagatcttggtcgttggaagggtcacttaagttgaagaatccgttgggctatggtgacatctgggatgcatcaggttcctatggttgggaccaaacaacagaggttggagttggagtctacctaccaaggtttaaatcgataccaacaccattgatggcccgggcctctttgtcatcacaagattggctgaagttttcgtcatataaagagcgtctacttggcctttcatttggcttgatttcaacaatgaaccatgacttgtcttacaaccttacgtggcgtaccttaactgatccgtcacgtgcctcatctaaggctataaggaggcagttagggcataaccttctttctgcactgaagtacacatacaagatcgatgagagggattcactgctcagaccaacaaaaggatatgcatttcagtcaacttctcaagttggtggtctatggggaaacaagggcttgagattttttcggcaggagtttgatgttcgtggcgctgtgcctttgggattttataatgctgctctaaatgttggtgtcggagcgggtgtcattttaccacttggaagggggttcatgaattcgtcttcacctgtgcctgataggtttttccttggaggtcattcttctccagtttgcaacttgagcgggttgtcatccctgctgggttttaaaacacgaggagttggcccaacagaagcacggaggcttgtccccaatgaatcagacagtggctctgctccggctccaggaagggactacttgggaggtgatttggctgtgtctgcctttgctgacctttcttttgctctgccactgaagttattcagagatgctggaatccatggtcatgcatttctgactgctggtaaccttgcgaaattgtcggagggcgagtataagaatttctcagtatctgattttaagcgcacattcaggagctctgctggtgctggcattattttacctactaaacttttccgggtggaggtcaactattgttacattctgaagcaagctgagcatgacagtggaaaaactggaatacagttcagcttctcctcgcccatgtagaaacctgctatgagatgttttgcagctgaagtagcttttctctccccccgtcccccttgtagacctgcgttctccattgttctttccttactgaagcaattgcaaaatgatcgtagtctctcgtatcattggattttgttttgacgctcgatcttgagcatgaggagcatgagcccggacctgctcattctttttggtgtctgagttacttcacttttctgacacgaaggatttatccttcacaactcaaatactgcaatggtggatagaataaagtttgggcaaagcatgttttacatca

SEQ ID NO: 2220 - DNA, 2176 bp, Panicum virgatum
cacggggacgcacgtcttgctaaacacgaagaagcgccgctctcccctagcttcccccaaaccccaaccatggcagccgccgccgaccgcgccgccgaccaaaaccctaagcctagggacgccgagacccacgtgcccgccgccgaaaccgagcctgagttcgcggaggggtacgaagaggatggagaggaggagtacgaagaggatggggaggagtacgaggacgacgaggaggagctggacgggcccgcggccgcggcggcggagcgggagcgggtgcagtccgtgtttaagcggctctcgtcggaccccgtggccattcgcgtccacgacgtggtcatcaagggcaacaccaagacgcgggacgagctcatcgaggcggaggtcgccgacctgctccgcgccgcgcccaccgtgcaggaactgctccgcgccgccagcgtcgccacctcgcggctgcacaggctcgacgtcttcgatgccgtcaagatcacgctcgacgcggggccgcccgagctgcccggcaccaccaacgtcgtaatcgaggtcgtcgaggccgccaatcccctcaccggtagcgccggcgtctactcgaagcccgaggcaagatcttggtcgttggaagggtcacttaagttgaagaatttgttcggctatggtgacatctgggatgcatcaggttcatatggttgggaccaaactacagaggttggagttggagtctacctaccaaggtttaaatctgtaccaacaccattgatggcccgggcatctttgtcatcacaagattggctgaagttttcatcatacaaggagcgtctacttggcctttcattcggtttgctttcgacaatgaaccatgacttgtcttacaaccttacatggcgtgccttaactgatccttcgcgcgcttcatcaaaggccataaggaggcagttagggcataaccttctttctgcactgaagtacacatacaagatcgatcagagggattcacttctcaggccaacaaaaggatacgcatttcagtcaacttctcaagttggtggtctatgggataacaagggcttgaaattttttcggcaggagtttgatgtccgtggtgctgtgcctttgggattttataatgctgctctaaatgttggcataggagcgggtgtcattttaccacttggacgggggttcatgaattcgtcttcacctgtgcctgataggtttttccttggaggtcattcttctccagtttgcagcctgggtgggctgtcatccctgctgggttttaggacaagaggagttggccccacagaagcacggaggcttgtccccagtgaatcagacagtgactctgctgcctctccaggaagggattacttgggaggtgatctggctgtgtctgcctttgctgacctttcttttgatctgcctctcaagttattcagagatgctggaatccatggtcatgcatttctcactgctgggaaccttgcaaagttgtcggagggggagtacaagaatttctcagtttctgaatttcagcgcacatttaggagctctgctggtgttggcattattttgcctactaaacttttccgggtggaggtgaactattgttacattctaaagcaagctgagcatgacagtggaaagactggaatccagttcagcttctcgtcccccatgtagagacctgccatgaaatgttttgcagccaaagtagcttctctttcccctgtagacttgtgttcgtccattgttcttgtcttactgaagcgattgcaaaacaaccgtagtcgcatgtcgtcggcttttcttttcttttgacgcttgtttggcatgaggagcctgagcctagatttgctcattctttttggtgtctgcaaagttacttccctattctgacacgaaggatttgtccttcacaacccaaatactgcaaatggtggaatgaataaaattttgggccaagaatgtttacaccagttcaattttgtgatcctctcgcattttaatggtaaaaaaacgcttggagaccttgtgtgcttgtggtgattggtgtatgaggcaacagtggtcagatagacagaagttacatgcatctctacatatatcttgtacaaagttcagctaggcgctaggcggtgacccttagcctagtgcctagtcgggattaatcgcg

SEQ ID NO: 2221 - DNA, 2049 bp, Sorghum bicolor
ctttaacggcaaattcggcttagttatgcggcacggccgcacgggatccgggtaagcacggcttgctaaacacgaagaaaagagaagccgctctccctccgcttcccccaaaccccaaccatggcagccgccgccgattctgccgccggccaaaaccctaaggacgacgagcggcacgtgctcaccgctgactccgacgccaggttctcggaggaggagtacgaagaggatggggaggaggaatacgaggaggaggaggaggaggaggagctggacgggccggcggccgaggcggcggagcgggagcgggtgcagtccgtgttccggcggctgtcatccaaccccgtgggcatccgcgtccacgacgtgctcatcaagggaaacaccaagacgcgggacgagctcatcgaggcggaggtcgccgacctgctccgcgccgcacccaccgtgcaggatctgctccgcgccgccagtgtcgccaccgcgcggctgcacagtctcgacgtcttcgacaccgtcaagatcacgctcgacgcggggccgcccgagctgcccggcaccaccaacgtcgtcatcgaggtcgtcgaggcggccaaccccctcactggcaccgccggcgtctattcgaagcccgaggcaagatcttggtcgctggaagggtcacttaagttgaagaatttgtttggctatggtgacatctgggatgcatcagggtcctttggttgggaccaaacaacagaggttggtgttggagtctacctaccgaggttcaaatcaataccaacaccattgatggcccgggcatctttgtcatcacaagattggctgaagttttcatcatacaaggagcgcctacttggcctttcatttggtttgctgtcaacaaggaaccatgacttgtcatataaccttacatggcgtaccttaactgatccatcgcatgtctcatcaaaggccataaggaggcagttagggcataatcttctttctgcattgaagtacatatacaagattgataagagggattcacatcttaggccaacaaaaggatatgcgtttcagtcaacttctcaagttggtggtctatggaatagcaaaggattgagatattttcggcaggagtttgatgtgcgtggtgctgtgcctttgggattttataatgctgctctcaatgttggtgttggagcgggtgtcattttaccacttggagggggattcatgaattcgacttcaccagtgccagagaggttttatcttggaggcaattcttctccagtttgcagcttgggcggactgtcatctctgctgggtttcagattaaggggagttggcccaacagaggcacggaggcatgtccttgataaaccggagagtggctcgggtgaccctggaagggattacttgggaggtgatctggccgtgtctgcctttgctgacctttcttttgatctgcctctcaagatattcagagatgctggaattcatggccatgcattcctaactgccggaaaccttgcaaaattgtcggagggtgagtataagaacttcacggcttctgaatttcagcgcacattccggagctctgctggtgttggcattattttgcctaccaaacttttccgggtggaggtgaactattgtcacatcctaaagcaagctgagcatgacagttcgaagactggaatccagttcagcttctcctcgcccatgtagaaacttgccatggcagccgaagtagcttctctttcctctatagacttgcaattcttcccgttcttttcatgcagaagcaattgcagaagttatttacatgcacccttttcttgtgagccttgttcattggcacgaggagcctgagactggagctgctcctttttttgtgtgtctgcaggagatgagtttaattcctgtttttgacatcatgagggatttgtcctcttagaactcaaatactgatgctgtggctacacaatggtggatagaataatattttggctaatgatgttatacttcgtgccacctcagttgtgccattcgctcttattcgcg

SEQ ID NO: 2222 - DNA, 1952 bp, Zea mays
cccgcacgggaaccgggcagcacggcttgctaaacacgcagaaaagaaaagccgttctccctccgtttccccaaaccccaaggtccccaaccatggcagccgccgccgattctgcctccgaccaaaaccctaaggacgccgagcggcacgtgctcaccgccgaatccgacgccgatttctccgaggaggactacgacgaggatggggaggaggaatacgaggaggaggaggagctggacgggccggcggcggcggcggcggagcgggagcggatgcagtccgtgttacggaggctgtcatccgaccccgtgggcatccgcgtccacgacgtgatcatcaagggcaacaccaagacgcaggacgagctcatcgaggcggaggtcgccgagctgctccgcgccgcccccaccgtgcaggacctgctccgcgccgccagtgtcgccactgcgcggctgcacgatctcgacatcttcgacgccgtcaagatcacgctcgacgccgggccgcccgagctgcctggcaccaccaacgtcgtcatcgaggtcgtcgaggtggccaaccccctcactggcaccgccggcgtctattcgaagcccgaagcaagatcttggtcgctggaagggtcacttaagttgaagaacttgtttggctatggtgacatctgggatgcatcaggatcctttggttgggaccaaacaacagaggttggtgttggagtctgcctaccgaggtttaaatcaataccaacaccattgatggctcgggcatctttgtcatcacaagattggctgaagttttcatcatacaaggagcgcctacttggcctttcatttggtttgctgtcaacaaggaaccatgacttgtcatacaaccttgcgtggcgtaccttaactgatccatcacgtgtctcatcaaaggccataaggaggcagttagggcataaccttctttctgcattgaagtacacatacaagattgataagagggattcacatcttaggccaacgaaaggatatgcgtttcagtcaacttctcaagttggtggtctatggaatagcaaaggattgagatatttccggcaggagttcgatgtacgtggtgctgtgcctttgggattttatagtgctgctctcaacgttggtgtaggagcgggtgtcattttaccgcttgcagggggattcatgaattcgacttcatcagtgccagagaggttttatcttggaggtaattcttctccagtgtgcagcttgggcggaccgtcatctctgctgggtttcagattaaggggagttggcccaacagaggcgcggaggcatgtccttaataactcggagagtggctcggctgaccctggaagggattacttgggaggtgatctggccgtgtctgccttcgctgacctttcttttgatctgcccctcaagatattcagagacgctggaatccatggccacgcattccttactgctggaaaccttgcgaaactgtcggagggtgagtacaagaacttttcggcttctgaatttcggcaaacgttccggagctctgctggcgttgggattattttgcctaccaaacttttccgggtagaggtgaactattgccgcatcctaaagcaagctgagcatgacagcgcgaagactggaatccagttcagcttttcctcgcccatgtaggaacttgccatggcagccgaaacagctgcactttcctctgtagacttgcatttcttcccgttcttttcatgctgaagcaattgaagaggttatttacgtgctcccttttcttgtgacgcttgttcattgacacgaggagctgctccttttttttggtgtcttcaggagatgggtttattatttgctgtttttgacctcacgagggatttgtcctcgcacaactcaaataccgatgctgtggctacacaatggtggatagaataatattttggccca

SEQ ID NO: 2223 - DNA, 1884 bp, Saccharum officinarum
cggacgcgtgggccgccgccgattctgccaccggccaaaaccctaaggacaccgagcggcacgtcctcaccgctgaatccgacgccgagttctccgaggaggagtacgacgaggatggggaggaggaatacgaggaggaggaggagctggacgggccggcggccgaggctgcggagcgggagcgggtgcagtccgtgttacggcggctgtcatccaaccccgtgggcatccgcgtccacgatgtgatcatcaagggcaacaccaagacccgggacgagctcatcgaggcggaggtcgccgccctgctccgcgccgcccccaccgtgcaggatctgctccgcgccgccagtgtcgccaccgcgcggctgcacagtctcgacgtcttcgacgccgtcaaaatcacgctcgacgcggggccgcccgagctgcccggaaccaccaacgtcgtcatcgaggtcgtcgaggcggccaaccccctcactggcaccggcggcgtctattcgaagcccgatgcaagatcttggtcgctggaagggtcacttaagttgaagaatttgtttggctatggtgacatctgggatgcatcagggtcctttggttgggaccaaacaacagaggttggtgttggagtctacctaccgaggttttaaatcaataccaacaccattgatggctcgggcatctttgtcatcacaagattgggtgaagttttcatcatacaaggagcgcctacttggcctttcattgggtttgctgtcaaaaaggaaccatgacttgtcatataaccttacatggcgtacctaaactgatccatcgcacgtctcatcaaaggccataaggaggcagttagggcataatcttctttctgcattgaagtacatatacaagattgataaaagggattcacatcttaggccaacaaaaggatatgcatttcagtcaacttctcaagttggtggtctatggaatagcaaaggattgagatattttcggcaggagtttgatgtgcgtggtgctgtgcctttgggattttataatgctgctctcaacgttggtgtaggagcaggtgtcattttaccacttgtagggggattcatgaattcgacttcaccagtgccagagaggttttatcttggaggtaattcttctccagtttgcagcttggggggactctcatctctgctgggtttcagattaaggggagttggcccaacagaggcacggaggcatgtccttgataaatcggagagtggctcggctgaccctggaagggattacttgggaggtgatctggctgtgtctgcctttgctgacctttcttttgatctacctctcaagatattcagagatgctggaattcatggccatgcattccttactgctggaaaccttgcaaaattgtcggagggtgagtataagaacttctcggcttctgaatttcggcacacattccggagctctgctggtgttggcattattttgcctactaaacttttccgggcggaggtgaactattggcacatcctaaagcaagctgagcatgacagttccaagactggaatccagttcagcttctcctcgcccatgtagaaacttgccatggcagccgaagtagcttctccttcctctgtagacttgcaattcttcccattcttttcatgctgaagaaattgaagttatttgcatgcacccttttcttgtgaggcttattcattggcacgaggagcctgagcctggagctgctccttttttgtgtctgcaggagatgagttaaattcctatatttgacatcacgagggatttgtcctctcacaactcaaatactgatgctgtggctacacaatggtggatagaataatgttttggccaataatgttgtgtact

SEQ ID NO: 2224 - DNA, 3472 bp, Oryza sativa
tgtgatttagcagtggccatagtacaatggttttttaagtgggctgcctcttgtgggcctcgtgtagtaattggaaatgaggcccatgggccattctctgtttttggctagatgggcatgaaatctcggtacagcctgtccagattgctaagcacgaaacgcctcctctcctctcaactcctcattccccttctccccgaaactctcccaaaccccaagtccccaaccatggcgaccgccgccgaccaaaaccctaacgacgcggagcaccgggaggccgcggcgggagccaatgcggcggcggaggagtacgaggaggaggatgaggaggaggaggaggtggagctggacgggccggcagccgtggcggcggagcgggagaaggtgcaggccgtgttcaagcggctgtcgtcggaccccgtgggcatccgcgtccacgacgtgatcatcaagggcaacgccaagacgaaggaggagctcatcgaggcggaggtcgccgagctcctccgcgccgcccccaccgtgcaggacctgctgcgcaacgccagcatcgccagcgcgcgcctgcgccagctcgacgtgttcgactccgtcaacatcacgctcgacgccggcccaccagagctgcccggcaccaccaacgtcgtcgtcgaggtcgtcgaggccgccaaccctatcacggggagtgcgggagtatactccaagcctgaggcaagatcttggtcacttgaaggctcggttaagttgaagaacctgtttggctatggtgacatctgggatgcttcaggtgcatacagttgggatcagacatctgaggttggcattggagtgtccctgccaagatttaaatcaatatcaacacccttgatggctcgggcgtcattgtcgtcccaagattggctgaaattttcttcttacaaggagcgcctgcttggcctttcatttggtttgatttcaaccatgcaacatgatttgtcttataatcttacatggcgtaccttaactgatccatcacaagtctcatcgaagtccataaggaggcaattagggcacaatcttctctctgcgttgaaatatacatacaagattgatcaaaggaattcacatctcaggccaacaaaaggatacgcgtttctctcaacttctcaagttggaggtctatgggatagcaaagggttgagatttttccgccaggagtttgatgttcgtggtgctgtacctttgggattctataatagtgctctcaatgttggccttggagtgggtgccattcttccactggggagaggatttatgaatctatcttcatctgtgcctgatagattttacctcggaggtcattcttctccagtttgcagcttgagtggactgtcatccttgttgggtttcagaacaagagggattggtccaacagaaccacggaggcttgtccctagtgaatctgaggatggatctgctgcctcaccagggcgggattacttgggtggtgatcttgctgtctctgcctttgctgacctttcgtttgatttgcctctgaagatatttagagatgctggaatacatggtcatgcatttctaactgctgggaaccttgcgaaactgtcggagggtgagtataagaagttctcactttctgaatttgggcgtacatttaggagctctgcaggtgttggcattattttgcctactaagcttttccgagtggaggtgaactactgttacattttgaagcaggctgagcatgactctgggagaacgggaatacagttcagcttttcgtcacccctgtagtgaccagaaataccttttagccaaagttagcttctcccgtagaatgctattgctgccccttatattctttcctgcttaatcaaacttcccaacaaacatatttgcatttcattgacttcacctgtgctatgacgctcttttatcggcacgaggagcctagagtatctaatactgttcggcattttgcacttctgagaagttttcccttctttttgcaccaagtgatgtcaagaacaacgtttgtacaactggaatacaaatgctgcaattggtggaggcaataaaatttttgggaaactgtttagaccaaagatgctttggttcgtgcactcatatgttggtatgtttgccagtcctgcatggtaattataccagggattgtcttcatcattcatagggaaccgtttcgattctgatgaaatgtctggtatgatgcttgcttgtacactagtcgaaatctttctaactacacattttccacatgccataaactactggagtggtacactagtttctggacgcagcggagttgagggcggctcgacgctgccggagtttctggacggtggcaaacagccattggttgcacccggagactgctatgagcggtcacgcgcttacgagtaacagggacaccgtgtaggcgttctaccaaggctggacgagtggatggattatggatatcgacgttatgctgcaaagttctactcgaacttgccaagaaaattctgattacccagcaaaatccaaagccatctccgccagccgaaccccaacgaaaacagacacaagaccggtgctacacccagaggccatcacttcagagtacaacaattcagcagaggaaaccaaagctttcctgccaggaacatacgacacgctagtactctaaccgcagtcaacagccttttacagctgagacggcacagagcaatattgtgggtagttcggcaccggcaagaccgtcagtaaagtttggtggcgctgcctgcctgacggcctccggccggtggcgcggcgccccccatgatctcttgtcgaagcaacaggtgaaggcaaaagcatgcagctcgcaacagaaaggcgacgggtgacagatcgcggacgatctgtctgggcaacaggtgggacggttggtggccatttcatgtcacgcttctcgcgatcatactatgatttctgcacagaaatggactgaaataggagttgatacatgtcccatgactagatcactagacttcaggggagaagaatgagggagccggatgcgactcaaacatcatactcctgatcagatatacggaaagtgagcacaagccacacaggatctatcaaagtcccaaaagactaacctttgaaagaaggttcattgtatgacttggactcacccaatgacagacattttgctccctttcatgggtacctcgccgactatttaacagagcagaacgttcaacttcaccagggtatcagccttgaatattatgtgcccaagaatagcaagttactggttttgtccagcagtagtttttcagtctcaactacttgaagaaaatgtcaatgaccgatgttatatcatctgtaattctgcaaacgtacccaattcttgctaattcagagttgtaaagactgatcgaccgtgcgtaaccatttaaggcaacaatggaacataacaaatgtg

SEQ ID NO: 2225 - DNA, 2066 bp, Panicum virgatum
cgccacgggggcgcacgtcttgctaaacacgaagaagcgccgctctcccccagcttcccccaaaccccaaccatggcagccgccgtcgaccccgccgccgaccaaaaccctaagcctagggacgccgatccccacgtgcccgccgccgaagtggagcccgagttcgcggaggagtacgaagaggatggggaggaggagtacgacgatgaggaggaggggggaggagctggacgggcccgcggccgcggcggcggagcgggagcgggtgcagtccgtgttcaagcggctctcgtccgaccccgtggccattcgcgtccacgacgtggtcgtcaagggcaacaccaagacgcgggacgagctcatcgaggcggaggtcggcgacctgctccgcgccgtccccaccgtgcaggagctgctccgcgcctccagcgtcgccacctcgcggctgcacaggctcgacgtcttcgatgccgtcaagatcacgctcgacgcggggccgcccgagctgcccggcaccaccaacgtcgtcatcgaggtcgtcgaggccgccaatcccctcaccggtaacgccggcgtctactcgaagcccgaggcaagatcttggtcgttggaagggtcacttaagttgaagaatttgttcggctatggtgacatctgggatgcatcaggttcctatggttgggaccaaactacagaggttggagttggagtctacctaccaaggtttaaatcagtaccaacaccattgatggcccgggcatctttgtcatcacaagattggctgaagttttcatcatacaaggagcgtctacttggcctttcatttggtttgatttcaaccatgaaccatgacttgtcttacaaccttacatggtgtgccttaactgatccgtcgcatgcttcatcaaaggcgataaggaggcagttagggcataaccttctttctgcactgaagtacacatacaagatcgatcagagggattcacttctcaggccaacaaaaggatacgcatttcagtcaacttctcaagttggtggtctatgggataacaaggggttgaaattttttcggcaggagtttgatgtccgtggcgctgtgcctttgggattttataatgctgctctaaatgttggcgtaggagcgggtgtcattttaccacttggacaggggttcatgaattcgtcttcacctgtgcctgataggtttttccttggaggtcattcttctccagtttgcagcttgagtgggctgtcatccctgctgggttttagaacaagaggagttggccccacagaagcacggagacttgtacccagtgaatcagacagtgactctgctgtcgctccaggaagggattacttgggaggtgatctggctgtgtctgcctttgctgacctttcttttgatctgcctctcaagttattcagagacgctggaatccacggtcatgcgtttctcactgctgggaaccttgcgaagttgtcggagggtgagtacaagaatttctcagtttctgaatttcagcgcacattcaggagctctgctggtgttggcattattttgcctactaaactattccgggtggaggtgaactattgttacattctaaagcaagctgagcatgacagtggaaagaccggaatccagttcagcttctcgtcacccatgtagaaacctgccgtgaaatgttttgcagccgaaatagcttctctttcccctgtagacttgtgtttgtccattgttcttgtcttactgaagcgattgcaaaacgattgtagtcgcatatcatcggcttttcttttgacgctcgtagtttggcgtgaggagcttgagcctagatttgctcattcttttttgtatctgtgaagttacttccctattctgacacgaaggatttgcccttcacaactcagatactgcagtggtggataaaataaaattttgggccaagaatgtttacaccagttcaattttgtgatcctctcgcattgtaatggtaaacagcgcttggagaccttgtgtgcttgtggtgattcgtcaggcaacagtggtcagataaacagat

SEQ ID NO: 2226 - DNA, 1770 bp, Oryza sativa
ttagatactctaggctcctcgtgccgataaaagagcgtcatagcacaggtgaagtcaatgaaatgcaaatatgtttgttgggaagtttgattaagcaggaaagaatataaggggcagcaatagcattctacgggagaagctaactttggctaaaaggtatttctggtcactacaggggtgacgaaaagctgaactgtattcccgttctcccagagtcctgctcagcctgcttcaaaatgtaacagtagttcacctccactcggaaaagcttagtaggcaaaataatgccaacacctgcagagctcctaaatgtacgcccaaattcagaaagtgagaacttcttatactcaccctccgacagtttcgcaaggttcccagcagttagaaatgcatgaccatgtattccagcatctctaaatatcttcagaggcaaatcaaacgaaaggtcagcaaaggcagagacagcaagatcaccacccaagtaatcccgccctggtgaggcagcagatccatcctcagattcactagggacaagcctccgtggttctgttggaccaatccctcttgttctgaaacccaacaaggatgacagtccactcaagctgcaaactggagaagaatgacctccgaggtaaaatctatcaggcacagatgaagatagattcataaatcctctccccagtggaagaatggcacccactccaaggccaacattgagagcactattatagaatcccaaaggtacagcaccacgaacatcaaactcctgaaaacctggcggaaaaatctcaaccctttgctatcccatagacctccaacttgagaagttgagagaaacgcgtatccttttgttggcctgagatgtgaattcctttgatcaatcttgtatgtatatttcaacgcagagagaagattgtgccctaattgcctccttatggacttcgatgagacttgtgatggatcagttaaggtacgccatgtaagattataagacaaatcatgttgcatggttgaaatcaaaccaaatgaaaggccaagcaggcgctccttgtaagaagaaaatttcagccaatcttgggacgacaatgacgcccgagccatcaagggtgttgatattgatttaaatcttggcagggacactccaatgccaacctcagatgtctgatcccaactgtatgcacctgaagcatcccagatgtcaccatagccaaacaggttcttcaacttaaccgagccttcaagtgaccaagatcttgcctacagaagcttggagtatactcccgcactccccgtgatagggttggcggcctcgacgacctcgacgacgacgttggtggtgccgggcagctctggtgggccggcgtcgagcgtgatgttgacggagtcgaacacgtcgagctggcgcaggcgcgcgctggcgatgctggcgttgcgcagcaggtcctgcacggtgggggcggcgcggaggagctcggcgacctccgcctcgatgagctcctccttcgtcttggcgttgcccttgatgatcacgtcgtggacgcggatgcccacggggtccgacgacagccgcttgaacacggcctgcaccttctcccgctccgccgccacggctgccggcccgtccagctccacctcctcctcctcctcatcctcctcctcgtactcctccgccgccgcattggctcccgccgcggcctcccggtgctccgcgtcgttagggttttggtcggcggcggtcgccatggttggggacttggggtttgggagagt

SEQ ID NO: 2227 - DNA, 2022 bp, Brachypodium distachyon
ttggtaagcacgaaagacttccctgaaacaccgaacaactctttccccaaaccccaccatggccgccgccgccgccgaccctgattccgccgccgaccaaaaccctaatacccctaacaccggaacccacgtgccggaaccctgggtcgaatccgatgaacttgctgaggaggagtacgacgaggaggaggaggagctggacgggccggcggccgcagctgtcgagcgggagaaggtgcagtccgtattccggaggctctcatcggaccctgtggaaatccgtgtccacgacgtcatcatcaagggcaacagaaaaacgcgggaggagctcatcgaggcggaggtcgccgaactcctccgcgccgctgtcactgtgcaggacctgctgcgcgccgcgaccatcgctagcgcgcggctgcgcgggctcgatgtgttcgacgccgtcaatatcacgctcgatgcgggcccacccgagctgcccggcaccaccaatgtcgtcgtcgaagtcgtcgaggccgccaatcccgtctcaggaaccgccggtgtctactccaagcccgaggcacggtcttggtcactggaagggtcgcttaaattgaagaacctggctggctacggggacctgtgggatgcatcagttgcatatggttgggaccaaacatcagaacttggcattggagtcaggctaccaagatttaaatcaatatcaacacccttgatggctcgggcatcattgttgtcacaagattggctgaagttttcatcatacaaggagcgcctgcttggtctttcatttggtttggtttcaaccatgcaccatgacttgtcttataaccttatgtggcggaccttaactgatccaacacatggcgcatcaaagtccataagaagacagttagggcataacttcctatctgcattgaaatatacatacaagattgatcgaagggactcacatctcaggcccacacaaggatatgcgtttctctcgacctctcaagttggtggtctttgggataacaaaggattaagatttttccgtcaggagttcgatgtacgctgtgccgtgccttttggattctataatgctgctctcaatgttggcctgggagcgggtgtcattcttccactaggaagaggatttatgaattcttcttcacctgtgactgatagattcaaccttggaggtcattcttctccagtttgcagcttgggtggaatatcatccttattgggttttagaacaagaggagttggtccaacagaacctcgaaggcttgtccccagcgcatctgaaaatgactctgctcttccagggagggattacttaggtggtgatcttgctgtttctgcctttgctgacctttctttcgatctgcctctgaagttatttagagatgctggaatacatggtcatgcatttctcactgctgggaaccttgcgaaattatcggagaatgagtacaagaacttttcatttgctgaattccagcgcacatttaggagctctgctggcgttggcataatcttacctactaaacttttccgggtggaggtgaactactgttatattctgaagcaatctgagcatgattgtggaaagactggaattcagttcagcttctcctcgcccttgtagagacttgcaatcaagtgttcagcagcagaaatagcgtcctttgcccctgcgttgaccaatttgctcctccttgtacccttttgtttctcaagaaaactggtcaacaaccagatttgcgtttcactgactaagcatgtgattctttgggcatcaggagcctggagtgtcttgcaatgtttggcgttttggatttctaaagagttcccttcccttaacacactaatgatgtgccccggtctcaatgtctcatagatatgatgtacggctcaaatactcgccctgcagcggtggatataataaaattttaggtgggcactaatattcatataactggatactatgttgtgaattgtgaaccagtctgcccaaaattgtagatttca

SEQ ID NO: 2228 - DNA, 2020 bp, Sorghum bicolor
cacccaagcagcgtttgcaccgacgtggccgaatccacggtgccatgggccatgggcggcgataaggcgcgagcggacgatagaaagccgcggccgccaactcgcccacgcagcaaggcacgggccactcccgccttcgccacccgcctggcgcctgcctgtggtcgcctgccgcgtcgcgtgtcaccggctcaccgcactcacaaaaactgcaagacgcctgggccgcgcacgctgccaccaccgccacccgacccgaggagcatgagcatggcggcgccgtcgtcctccctcgcctcttcctgccacatctcccgccgcgccaccgccaccgccacggccgcggcccagtcgcactcgcctccgctgccgcagcagctccgcctcgggtgcttccagcgcggcgcgcgcgcgcagagcgcctgcagggcggcatcgaggaggcgcacgccaggtgtttgcttcgtggtctcaccaagccagccaggtcttgctgcgatcgacgtaccggcggcgcctaatgcgacgaccgtccccgaccgtacttcggtgtcctcgcttttggaggttgtttcggacgacttgctgaaactaaacaacaatctaaaatcgcttgttggtgcagaaaatcctgttctggtttctgcggctgaacaaatttttggtgccggtggaaagagattaagaccagcattagtttttctggtgtctagagcaactgctgagttagctggtttgtcggagctaagtacagaacaccaacgattggcagagattatagagatgattcacaccgcaagtttaatacatgatgatgtcatagatgatagtgggatgcgaagaggaaaggaaactattcatcagctatatggtacacgggtggctgtacttgctggtgattttatgtttgcacaatcttcttggtttcttgcaaacctagaaaacattgaagttataaagctgatcagtcaggtcatcaaggacttcgcaagtggtgagataaaacaagcatccactctttttgactgtgacatcactcttgatgattaccttctcaagagctactacaaaactgcatctctgatcgcagcaagcacaaggtcagccgccatattcagtggcgtcagcaccagtatttgtgaacaaatgtatgaatatggcaggaatcttgggctgtccttccaggtagttgatgacatcctggactttacccaatcagctgagcaacttggcaaaccagcaggaagtgacctggcgaagggaaacctgacagctccagtcatctttgctttgcaagatgaaccagagctaagagagatcatcgattccgagttcagtgagactgattcattagctgctgcgatagagcttgttcacaggagcggtggaataaggagggcacatgaacttgcgagagagaagggtgacatggctatccaaaacctgcagtgccttccgagaagtgatttcagaagtacccttgagagtatggtaaaatataaccttgaaaggattgaatagatggattcagttgattcctgtaccagtccactagatacaggcctccagtatggtattggtgtaactccaaaacccatcttttcagccccttctcggaagatacggtttcaaagaaagtactaggagaaattgatctatttcatactattctggggaactcctgtgaagcaggccagagttatcttgttgattatatgagatgatttatgcaggatcatcagaaagcaaggacctagctgcatactcttacgcgttgagcctgcatctgagtattctacttttgcagctcttgtaaatataaggagcttactgtatcctagcattcttttatttttgctatctgcgcaacaaattaagtgctatacttgtatgggaacctaacaggctgacactcgcataatagctgtgtactctagatcactggggtgtatttttctataaacatgttggctgatgagtaattggaacatacttcgacataaacaaggggcctctccag

SEQ ID NO: 2229 - DNA, 3944 bp, Panicum virgatum
cgcacgccacaggtcccgcccccgccacccgcttgtcgcctgccgcgtcgcgtgtcatcacaagctcccaagaagtgcaaaagcgcccgtggccgcgcattgtgtcgccaccggcacccaaagtatggcggcgccgtcgtcctccctcgcctccacctcccacctctcccgccgcgccacggccgcggtcggcccgtgctccacccgccgccagctgcgcatccggtgctgctgggccggcggcagggtggcgtccaggtggcgcgcgccaggtgtttgcttcgtggtctcacccagccagccaggtcttgctgcggtcgacgtgccggcggcgaccatgtccgagcgtacttcggtgtcctcacttttggaggttgtctcggacgatttgctgaagcttaacaacaatctcaaatcgcttgttggtgcagaaaatccagttttggtttctgcggctgaacaaatttttggtgccggtgggaagagattaagaccagcattagtttttctggtgtctagagcaactgctgaattagctggtttgtcggagctaagtacagaacatcaacgcttagcagagattattgagatgattcacactgcaagtttaatacatgatgatgtcatagatgatagtgggatgcgaagagggaaggaaactattcatcagctatatggtacacgggtggctgtacttgctggtgattttatgtttgcacagtcttcttggttccttgcaaacctagaaaacattgaagttataaagctgatcagtcaggtaatcaaggactttgcaagtggtgagataaaacaagcatccactctgtttgactgtgacatcacccttgacgattaccttctcaagagctactacaaaactgcatctctgatagcagcaagcacaaggtcagccgccatattcagtggcgtcagcaccgcagtttgtgaacaaatgtatgaatatggcaggaatcttggcctctccttccaggtagtcgatgacatcctggacttcacccaatcagctgagcaacttggcaaaccagcaggaagtgacttggcaaagggaaacctgacagctccggtcatcttcgctttgcaagatgaaccagagctgagggagatcatcgattctgagttcagtgagacagattcgttagctgctgcaatagaccttgttcatagaagtggtggaataaggagggcacatgagcttgcaagagagaagggtgacttggccatccaaaatctgcagtgccttccgagaagcgacttccaaagtacccttgagaagatggtgaaatataatcttgaaaggattgagtagattgatttactttaatgctccttcaagtacagatctcctttgcacgggtttgagtagctcctatataaacccatcattcgacccatttttggtggatacgattttgcaggaaacttgggaggaaatgccctataacatacattttctggggaacccttgatttcgcaggaaacttggaggaaatgcactataacatacattttctggggaagcaggctattacttttgttgaacctgtgaggtgatttatgcaggatcctcagaaaagcaaggacttcacataccccgacccccaacaccttgtgcccatattttatctgaatgtgagcttactttgcagctcctgtaaatgaaagaagcgtaaactaacttagcattcttttattttgcaaattgcgcatgctcagaagcaacaaattatgcgctatacttgtacgtgtcctgactggctgacactttgtataacagttgtgcactcactgggatgtatgtttctacatatatgatagccaatggtgtacatactccaacatcacttacaatattcatgtatgcaacaattcacagcaactcaacgagtgtgatacttctacttacactagtctggaagcttgtgaactagaacgtgctttggacactggcttaaatataacagagttacagaggtactcataagaggtccagcaaatgttgaagaaacagacagaacatacatatataaaattatgtcagtaatttactgcaaggcgcaagcaactacgagcatattatacagattatagtatctgaccatgcattctagtttggaaatttcaactcaaacaagagcttcagatagattacacagatttttcgccaggaaggtacgacggagaactgctgccagcatggctcttcttcttgtggaacatgctcgtgatgtttggcagcataaagctcttcctcaatagcgtcctggtattcctttggtggccctcgttcttctcagtcgctttcccagcagaaccctgtggtacaggtggagatgcacctgcaacttcttgtgctcctgtggaaggctgcatctctgcagttttcttctgctccttctcgcgccatctcttaagctcgccttctacagcctttttggctgcctctgccatctctgccctcttcagtgcctcttctgttgccaattccatgtcctccatctccttacgggcagcttccagtttcttgattgcctcgttctcactggctctgacggcttccacttgagccatagctgcagcaactttcatctcactcagtttctctgactcctcgacctttcggcttagagaatcaaactcatcttttgagattgtgatatttgctgcagactctgaagttgaggctcgtgcagcacttgctcgatctgagagttccttgatctgatcaagggcccttgcttcagctgctttggcctcttctgcttccttcaaagcaagctgcaacctttgctcggcctcagctaattcaacccgagctttttcagcttcatctcttagctctgccgcactcttctgcatcatctcagcttcctgcagggcactctttgactcagaagacagctgctgaagggccaacatcaagtcatcagaagctgatgttgctttggactcagcagctacagctgcctcaagctcggacttgcatttctgaagcttaacatgtagatccccaacaattgattcagtttctgtgtccttctctttgagctgattgtgctcctgctttacagcctctaactcaactttcagtgattcgactaaaccccgaagagaactttcctcctctgctactttctgcaacatttccttagcatcatccaactctgtgctgacaatagcaacagactctaaatcccgagcccgagcatcttctatctttttctgcatagatgcaatctcagaattggtttggtctaacttctccttgagactttcataagcagcaggatcaaaatcattcctcaaagatgacaacttcttctgtgtttcttccaaagcttgtttgtatgtggtcctagcaacatccttctcagtacggatctgtgcctcctcctcatgtgcttgctgtgtagctgccttaacgtgcataagcgactcttgaatttctgcaatctcactacgaagttgattagctttttccttgttggcttcagttgtgtgcagtgattcctcttcctgctgagcagcagacaacctcatatccaatgaggtttcaaaatctttcttgagctttctaagctcctgttttgctgcatcaaggtctgccaaagcaacagcatactgctcccttgcactttccagttcctgcttcagaggaccatctgtgccaagaccttcatttgagctgccaccttcaagctgtttggttcgagtcttcgcatccgctgttgcttgaatggctagctctttagacttgttgattgcatcaagcttggtggttagctcctcaacagtttttttagctttctcaagctcagagagggcctgtactcttgttgtctcagcattattcagctgttccttgtatttattcaactctttctgggctaggtgcagctctgtctccttagctaacaccctctgtg

SEQ ID NO: 2230 - DNA, 1863 bp, Panicum virgatum
gcaacccgcctgtggtcgcctgccgcgtcgcgtgtcatcacaagcccccaagtgcaaaagcgcccgtggccgcgcattgtgtcgccaccggcacccaagagtatggcggcgccgtcgtcctccctcgcctccacctcccacctctcccgccgcgccacggccgcggtcggcccgtgctccacccgccgccagctgcgcatccggtgctgctgggccggcggcagggtggcgtccaggtggcgcgcgccaggtgtttgcttcgtggtctcacccagccagccaggtcttgctgcggtcgacgtgccggcggcgaccatgtccgagcgtacttcggtgtcctcacttttggaggttgtctcggacgatttgctgaagcttaacaacaatctcaaatcgcttgttggtgcagaaaatccagttttggtttctgcggctgaacaaatttttggtgccggtgggaagagattaagaccagcattagtttttctggtgtctagagcaactgctgaattagctggtttgtcggagctaagtacagaacatcaacgcttagcagagattattgagatgattcacactgcaagtttaatacatgatgatgtcatagatgatagtgggatgcgaagagggaaggaaactattcatcagctatatggtacacgggtggctgtacttgctggtgattttatgtttgcacagtcttcttggttccttgcaaacctagaaaacattgaagttataaagctgatcagtcaggtaatcaaggactttgcaagtggtgagataaaacaagcatccactctgtttgactgtgacatcacccttgacgattaccttctcaagagctactacaaaactgcatctctgatagcagcaagcacaaggtcagccgccatattcagtggcgtcagcaccgcagtttgtgaacaaatgtatgaatatggcaggaatcttggcctctccttccaggtagtcgatgacatcctggacttcacccaatcagctgagcaacttggcaaaccagcaggaagtgacttggcaaagggaaacctgacagctccggtcatcttcgctttgcaagatgaaccagagctgagggagatcatcgattctgagttcagtgagacagattcgttagctgctgcaatagaccttgttcatagaagtggtggaataaggagggcacatgagcttgcaagagagaagggtgacttggccatccaaaatctgcagtgccttccgagaagcgacttccaaagtacccttgagaagatggtgaaatataatcttgaaaggattgagtagattgatttactttaatgctccttcaagtacagatctcctttgcacgggtttgagtagctcctatataaacccatcattcgacccatttttggtggatacgattttgcaggaaacttgggaggaaatgccctataacatacattttctggggaacccttgatttcgcaggaaacttggaggaaatgcactataacatacattttctggggaagcaggctattacttttgttgaacctgtgaggtgatttatgcaggatcctcagaaaagcaaggacttcacataccccgacccccaacaccttgtgcccatattttatctgaatgtgagcttactttgcagctcctgtaaatgaaagaagcgtaaactaacttagcattcttttattttgcaaattgcgcatgctcagaagcaacaaattatgcgctatacttgtacgtgtcctgactggctgacactttgtataacagttgtgcactcactgggatgtatgtttctacatatatgatagccaatggtgtacatactccaacatcacttacaatattcatgtatgcaac

SEQ ID NO: 2231 - DNA, 1417 bp, Saccharum officinarum
cgcgtcacaaaaactgcaagacgccgccacgccggggccgcgcacgctgccaccaccgcgccacccgaggagcatgagcatggcggcgccgtcgtcctccctcgcctcttcctcccacctctcccgccgcgccaccgccacggccgcggcccagtcacactcgcctcatctgctgcagcagctccgcctcgggtgcttccagcgcggcgcgcgcgcgcagaacgttcggctccggcacagctgggcctgcagggcggcatcgaagaggcgcacgccaggtgtttgcttcgtggtctcaccaagccagccaggtcttgctgcgatcgacgtaccggcggcgaccattcctaatgcgacgaccgtccccgaccgtacttcggtgtcctcgcttttggaggttgtttcggacgacttgctgaaactaaacaacaatctaaaatcgcttgttggtgcagaaaatcctgttctggtttctgcggctgaacaaatttttggtgccggtggaaagagattaagaccagcattagtttttctggtgtctagagcaactgctgagttagctgctttgtcggagctaactacagaacaccaacgattggcagagattatagagatgattcacactgcaagtttaatacatgatgatgtcatagatgatagtgggatgcgaagaggaaaggaaactattcatcagctatatggtacacgggtggctgtacttgctggtgattttatgtttgcacaatcttcttggtttcttgcaaacctagaaaacattgaagttataaagctgatcagtcaggtcatcaaggacttcgcaagtggtgagataaaacaagcatccactctttttgactgtgacatcactcttgatgattaccttctcaagagctactacaaaactgcatctctgatcgcagcaagcacaaggtcagccgccatattcagtggcgtcagcaccactatttgtgaacaaatgtatgaatatggcaggaatcttgggctgtccttccaggtagttgatgacatcctggactttacccaatcagctgagcaacttggcaaaccagcaggaagtgacttggcgaagggaaacctgacggctccagtcatctttgctttgcaagatgaaccagagctaagagagatcatcgattccgagttcagtgagactgattcgttagctgccgcgatagagcttgttcacaggagcggtggaataaggagggcacatgagcttgcgagagagaaaggtgacttggctataccaaacctgcagtgccttccgagaagtgatttcagaagttcccttgaaagtttgtaaaatataaccttgaaaggattgaatagatggatttcatttattcctttaccatgtcactaaaatcaggcttcattattggaattgtgtatctcc

SEQ ID NO: 2232 - DNA, 1949 bp, Zea mays
agccaggcacggctccagcaacgacacccgagtacggagtacccgacccgcctgcctgcctcctgcctgcctgtggtcgcctgtatcacaagctcccaaaaccgccgcgcacgctgccaccaccggtacccaacgaacatggcggcggcgccgtcctccctcgcctcctcgtcgcatatcccccgccgcgccacagccacggccccagcacagtcgcactcgcctccgttgccgcagcagctccgccccgccaggtccttcaaacgcggggcgctcgcgcagcacgtccggtacagctttgccggcagggaggcatcgaggcggcgcacaccaggtgcttgcttcgtggtctcatccagccagccaggccttgctgccatcgatgtgccggcagcgactattcctgatgccacgacgacaagcgtcactgagcggacttcggtttcatctcttttagaggttgtatcggaggacttgctcagccttaacaacaatctgaaatcgcttgttggtgcagaaaatccagttttggtttctgcagctgaacaaatttttggtgctggtggaaaaagattaaggccagcattggttttcctggtgtctagagcaactgctgaattagctggtttgtcggagttaactgcagaacatcgacggttggcagagataatcgagatgattcacactgcgagtttaatacatgatgatgtcatagatgatagtgggatgagaagagggaaggaaactattcaccaactatatggtacacgtgtggctgtacttgctggtgattttatgtttgcacaatcttcttggtttcttgcaaacctagaaaatattgaagttataaaattgatcagtcaggtcatcaaggactttgcaagcggcgagataaaacaagcttccactctttttgattgtgacatcacacttgacgactaccttctcaagagctactacaagactgcatctttgattgcagccagcacaaaatcagcttccatattcagtggcgtcagcaccactatttgtgaaaaaatgtatgcatatggcaggaatcttggtctatccttccaggttgtcgatgacatcctggatttcacccagtcagccgaacaacttggcaaaccagcagcaagtgacttggcaaagggaaacctgactgctccagtcatcttcgctttgcaaagtgaaccagagctaagggagatcattgattctgagttcagtgacacggattcgttagctactgcaatagagctcgttcatagaagtggtgggatacggagggcacatgagcttgcaagagagaagggtgacttggcaatccaaaatctgcagtgccttccaagaagtgacttcagaagtgcccttgagaagatggtggaatacaatcttgagaggattgagtagtggattttacttgaatgctccatcaggtacatatctccatttggggtttggggtagttctcatatagatctttatattcagcccctttgggaagatacatttcactgaaaaatcagatgaatcacactatttcatacaaattctggggatagcctttgagcaggccactactatcaagttgattttgtaacagcttgtgcagaatcataagaaaccctaggacttgaccgcagccccttgcgcctacatgtatccgagcattctacttggcagttcttgtaaataatagaaccatacagtaacttagcattcttttttgttttgcaatctgagcatgcttacaagcaacaaagtgtgtgctatatttgtacggatctacgtgcacctaacatcatgcacttgtacaattgctttgcactattatgtactatttccgatttaacagtaatacggatttaacagtaataataccgttcattttctacataagatttaaccgtttgttctattttaaaagctgataagcatgtgactac

SEQ ID NO: 2233 - DNA, 1918 bp, Oryza sativa
aaaaaacgagccgtcgccgcgcgcgcacgccagggcacccccgcccacgcccacgcccacccaccacccctcgcctctcgttgcccgccgcgtcgcgctcacgagatcccagaagaggacgcacggcggagcgggagcggaagctagcaagcaagcaagcaaagcaagcggccacgaagccatggcggcgccgtcctccctcgcgtcgtcctcgcacctgtcccgccgcgccaccgccgcggcgtcgccgtcgatccctcctccttctccccctcctcctccgcagcggctccggtgcggctgggtcggacgcgcggcgccgccgacgcggcgcgcgccaggtgtttgctccgtggtctcgcccagcaagccaggtgttgctgctgttgacgtgccggccgcgacgattcctgacgcggcggcgaccggcgtcggcgtcgccgagcgcatttcggtgtcgtcgctgctggaggttgtggcggacgacttgctcaagcttaacaacaacctcaaatcgcttgttggtgcagaaaatccagttttagtttctgcggctgaacaaatatttggtgccggtggaaaaagattaagaccggcactagtttttctggtatccagagcaactgctgaattggctggtttattggaactaactacagaacaccaacgtttggcagagatcatagagatgatccacactgcaagtttaatacatgacgacgtcatagatgatagtgggatgcgaagagggaaggaaactattcatcagctatatggaacacgggtggctgtacttgctggtgattttatgtttgcacaatcttcttggtttcttgcaaaccttgaaaatattgaagttataaagctcatcagtcaggtaatcaaggattttgccagtggtgaaataaaacaagcatcaacactttttgactgtgacatcacccttgatgattacctgctcaagagctactacaagactgcttctctgattgcagcaagcacaaggtcagctgccatatttagtggtgtcagcactgctatatgtgaacaaatgtatgaatacggaaggaatctcggtctctccttccaggtagtcgatgacattcttgacttcacccaatcagctgaacaacttgggaaacctgcaggaagtgacctggcaaagggtaatctaacagccccggtcattttcgctttgcaagatgaaccacagctcagggagatcattgattccgagttcagtgaaacaaattccttggctactgcaatagagctagttcatagaagtggtggaataaagagggctcatgagcttgcaagagagaagggtgaaatagctatccaaagtctgcagtgtcttccaaggagtgagttcagaagcactcttgagaacatggtgaaatataatctagaaaggattgattaggcagctttacttatttcacaatcggatacagaacctcctttgtgagcttacagtagctccccaaaaaggcaaactttttaaggttttgggccctgtttggatcagtggattgccaatggaaaataagggaaaatgacattattttcttacaaaatgatcctgtggaattctcacgaaacagaccatttggttatgtgagatgaatgatgcaggacaaaatcatcggaaagcagcgaccttgccaggttcctcccaccttgcgcctacatgtatcctagcattttatttttgcacgtcttgtaaataaaagaagtatattgacattagcattctttagttttgcaattttcacatgcatatagaaaacacgttgtgtgtacttgtatgggcacctcacctgacaggctctcacaacatttgtgtattctgtgctgctgagatatgatgttaccaattaaattactactaatgtgatgtatggctgaattagac

SEQ ID NO: 2234 - DNA, 2086 bp, Brachypodium distachyon
cgtggccgcggactcgtgcacgcaaccaaaccaaccgcgcgcgggggtgccccgcacacctaacctcgctcagcgcgcctccgtggcctaccgccgtcctcttcgcaatcaccaaaaaaactgccgggaccgcggcgcgcacgctgctgtcaccgacggccaccgcgcgcgccgtcgcagcggagagccagccaggcaggcaggcaggcagacgaaaatggcggcgccgtcgtccctcgcggcctcctcccacctctccgccccgtcgcagcagcgcgtcgccgtcgctgcggctgtacatgcggccggcaaggcgaggcgccggtgccgctggtcgggacggacccggcgcgcgccaggtgtttgcttcgtggcctcgcccagccagcccgcaggtcttgccgcggttgatctgccgcctgcagcccatacgacgatccctagtgcgacggcagcgagcgtcccggatcgcacttcggtttcgtccttgttggaggtcgtatcggacgatttgctgaaccttaacaacaatctgaaatcgcttgttggtgcagaaaatcctgttttagtttctgcggcggaacaaatttttggtgctggtggaaagagattaagaccagcattagtttttctggtgtccagagcaactgctgaattagctggtttatcggagctaactacagaacaccaacgcttagcagagatcatagagatgattcacactgcaagtttaatacatgatgatgtcatagatgacagtggaatgcgaagagggaaagaaaccattcatcaattatatggaacacgggtggctgtgcttgctggtgattttatgtttgcccaatcttcttggtttcttgcaaacctagagaatattgaagttataaagctcatcagccaggtaattaaggattttgccagtggcgagataaaacaacaatctactctttttgactgtgatgtcacccttgatgactacttgctgaagagctactacaaaactgcctctctgatcgctgcaagcacaaggtcatcagccatatttagtggtgtcagcactgctatatgtgaacaaatgtatgagtacggaaggaatctcggactctccttccaggtagtagatgacattcttgacttcacccaatcagctgagcaacttggcaaaccagcagcaagtgacttggcaaagggaaatctgacagctccagtcatttttgctttgcaagatgaaacacagctaagggagatcatcgactccgagttcagtgaaacagattccttagctgctgcaatagagctagttcatagaagtggtggaataaggagggctcatgagcttgcaagagagaagggtgacttggctatccaaaatctgcagtgccttccgaggagcgagttcagagatgcgcttgagaacatggtgagatataatctccaaaggattgaatagacgggattgcttgatttctctatcagatacatgcctcgtttgtgggtttagagtagctcccagtctcccacagaaatatgtcttatcatgccccatttggagcagagtattgccaaatgaaactaggagggaggaactgcgctatttccctttgacacgcctacgggattcctgtaaaacaggccattagtaccactttcgatctttgggatcattggtgcacgatatcacaatccagcgagttatccaggtgcctgccgccttgtacctacatgtatcttagcacttcattttgctgctcttgtaaataaaaggagcatgctgtatcttggcattcttttattttgcaatttgcacatgcttatagacaacaagctgtgtgttgggaacttgacagaatgacaatagtatagcagttgtgcactctgggctgatgagatgtgtatgttcttgcacgaaataatatagtactacattccagttttgttactactgtcatgctatatggaatctgggaggcacactgtattaaaggctgtcatgagaaaatcaccttgttatccctcttccctttttgtatctctccagttctgggtgtaagaaaaccacctttttaacattgttgtatcaaataaa

SEQ ID NO: 2235 - DNA, 2008 bp, Oryza sativa
tcacacgctgctttgctcctgagctcacacaatcgccttcgttctatggccctcatggatccacaaatccccctttctcctcctccgcatgctccatatttaaatcccccacaccctccgtccctccatccggagccgccacttccttccttccaaaaaggaagaggggaaaaaaaatctatagccaccaaattgagcaagattctcacacgaaaccaatcacaagctagcattcgtttaatttcttggctgctattgtccggggaagaggttcttggtgtccaaagaatttgtcggttctagggagctccaagttgctgtagcttcatttcttggttctttgggttcttggattggcggtactgattgtgggagatgttgtctgtgagctgcccgagagtgtacatgagcaggaaggcgctggatttcggtcagctggcctcctgccggtgccgttgggctggccggtccggcatgcgggtggcgccgaggcggcgcatgccatgtgtttgtttcgtggcctcaccgagccagccaggccttgctgcagttgatgtgccagcagaggcgatttctagtgcgagaacaacaacaatgatccctgagcgaatttctgtttcttcacttttggaggttgtctccgacgacctgctgaaactcaacaataatctgaaatcgcttgttggtgcagaaaatccagttttagtttctgcggcagaacaaattttcggtgctggtggaaaaaggttaagaccagcattagtttttctggtgtccagagcaactgctgaattagctggtttgttggagcttactacagagcatcaacgcctggcagagatcatagagatgattcacacagcaagtttaatacatgatgatgtcatagatgatagtggcatgaggagagggaaagaaactattcatcagctatatggaacacgggtggccgtacttgctggtgattttatgtttgcacaatcttcttggttcctagcgaacttagaaaacatcgaagttattaagctcatcagccaggtgatcaaggactttgccagtggtgagataaaacaagcatctactctttttgactgcgacgtcacccttgatgattacttgctcaagagctattataaaaccgcttcgttgctcgcctcaagcacaagatctgctgcaatattcagtggtgtaagcaccactatatgcgaacaaatgtatgaatacggcaggaatctcgggctctcgttccaggtagtagatgatattcttgactttacccaatcagctgagcaacttgggaaaccagcagggagtgacttagcaaagggaaacctgacagctccagtcatattcgctttgcaagatgaacccaaactaagggagataatcgattctgagttcagtgaaagtgattcattggctactgcaatcgacttggttcacagaagtggtggaataagaagggcgcaggagcttgcaaaggagaaaggtgacttggctctccaaaatttgcagtgccttcccaagagccagttcagaagtacccttgagaacgtggtgaaatataatcttcagaggattgactgatggattcacttgattcctctgaatcacttgatttctctgaatataagatgctcgcacccatgtgggttagtagctcccaaagaagttcatcttgctagaataatgtcgatcttgggaagatgattacaagcagcaactttttgttgtggatccaccaccaacatgtatcatagcatcctattttgcagtttatgtaactacaaggcagataaaggaactaaggaagcatagtgtatatttcatagtagtttcagcttcttgatacacgaaatagtatttttttcccctcccctttctgccatttcatttgtcattggagaacgactatgaattaattaacatgattatactttatagccagcacactgcgagtcacatgggcacctatcgattattggaaaacagcatttagattctggaa

SEQ ID NO: 2236 - DNA, 1556 bp, Panicum virgatum
gtcatcggtcataaaagaaaactttcctctatcccggtattcccgtctctttccctccctcctctctgcgccctgcccagcagtcagcgacggcgacgacggccgctctccctcgtctcttctctccgactctccctccagcggctcaggggtaagggcaggccgcagttccccgtcggcgcaggcgcagtgcgggcctgcggggttccctatcggcgcggcaaccaccaccggggcaggggaccgctgctccccgtcggcgcaaggcaaggggcgtccacaccatggtgatccccgtcgccttctcctcctccctcgtggtccggtcggctgtcggcgcgttgctggcggccctcatcgcagcgcgcgcggtccgccgccgctccctggacgcctcaggcggaatcgccggcttcgtcgtcatggcggtccacattgcctgcggctacaggtacggcgctctgctgctggccttcttcttgtcctcgtccaaggtcaccaagatcggggaggaccgcaagcgccgcgtcgaggaggactttaaggagggcggccagcgcaattggatccaagtactagcaaatagcatagttgccactatactggttgtgatatttgaaataatgactggagggcaagatcagtgcttggactcaaatggttcaaagattataactggtattataggtggtattattggccattactgttgctgcaatggggatacttggtcgtccgaaattggcgtgcttagtaacgaacaaccacggcttattacaactctgaagcctgtcaggaagggtacaaatggtggagtgaccttacaaggacttcttgctgccactggaggaggcctgatcattggtctcactttcgttatcgttggactgctgacagctgaatgttcttttgatatggccctccggcagctcctagtgctacccatctctgttgcggctggtttgcttgggagtcttattgattcattgctgggagctacacttcagttcagtggatactgcagtgttcggaagaaggtcgtcagcaaaagaggtcctactgttacaaagatttctgggatcactgtcctggacaatgatgctgttaatgcagtatcaatcctaataacaactgcgcttacagcttatgcgtgcatttacatcttttaaaaattatttgtgaattttttttacttgtttctgatcctcggtctcatttataaatacaaagggtcacagtatgacagtgacagcctagtcacatagggctgcttgacggtaaaatctgctcgacttgatgacttcgagcaaaatttgggctgaatgctagtgccagttgaaaggcatcgatttatgtaagcatacacgtctgtttatgcatcagaataaaaactagacttgggtaatcttgaacatagcaatgtgttgtgccctttccttgcatggcactggaacaatttgcaactgctgtattaatagaatttttgtggcacacagatattgacatatactttaacccactagatttttttttacattcacattccacaaaagtac

SEQ ID NO: 2237 - DNA, 1453 bp, Panicum virgatum
ccttggagcgcccggttttaaatttcagatatccgtactatagcattaccgttcctctgtccccgttccctatagtctctctgcgctctgcgctctgcccagtagccggcgacggcggccgctctccctcctcgtctcctctccctcaaacgatacaggggtcagggcagaccgcagcttcccgtcggcgaaggggcagtgcgggcctgcgcgggaaccggggcagggggctgccgctccccgccggcgcaaggggcgtccacgccatggtgatcccccccgccttctcctccctcgtggttcggtcggccgtaggcgcgtcgcttgcggccctcatcgcagcgcgcgcggtccgccgcggctccctggatgcctcgggcgggatcgctggcttcgtcgtcatggcggtccacatcgcctgcggctacaggtacggcgcgctgctgctggccttcttcttgtcctcgtccaaggtcaccaagatcggggaggaccgcaagcgccgcgtcgaggacgactttaaggagggcggccagcgcaactggatccaagtactagcaaatagcacagttgccactatactggttgtgatatttcaaataatgactggagggcaagatcagtgcttggactcaaatggttcaaagattataactggtattataggtggtattattggacattactgttgctgcaatggagatacttggtcgtccgaaattggtgtgctcagtaacgaacaaccacggcttattacaactctgaagcctgtcaggaagggtacaaatggtggagtgaccttacaaggacttcttgctgccactggaggaggccttatcattggtctcactttcgttatcattggactgttgacagctgaatgttcttttgatatggccctccggcagctcctagtgctacccatctctgctgcggctggtttgcttgggagtcttattgattcattgctgggagcaacacttcagttcagtggatactgcagtgttcggaagaaggtcgtcagcaaaagaggtcctactgttacaaagatttctgggatcactgtcctggacaatgatgctgttaatgcagtatcagtcctaataacaactgcgcttacagcttatgcgtgcatttatatcttttaaaattatttgtgattttttttcaattgtttctgatcctcgagggtcacagtatgacagtgacagcctagtcacatagggctgcttgatggtaaaatctgctcaacttgatgacttcgagcaaaatttgggttgaatgctagtgcgagttgaaaggaatcgatttatgtaagcatacacgtttatgcatcagaataaaaactaaacttgggtaatgttgaacatagcaatgtactgcaccctttccttgcatggcaccggaaaaatttgcaacttctctgtattaatagaatttttgtggcacacag

SEQ ID NO: 2238 - DNA, 1348 bp, Sorghum bicolor
tttgtctcccacgtgatttggcacgtgaaaacgccgaacggacagcagagtgagctgaactccggcttcgcacccaaactcccctacaaactcgctccaccggcggctccggctgcgaaccgcggctgactgctgctgaccccaagcggtaccggcgcgctcgtcccgccatggctatccccaccgccttcgcctcccccctcgcggtccggtcggccgtcggcgcggctctggcggccgtcatcgccgcgcgcgcggtccgccgccgctccctggacgcctcgggcggggccgccggcttcgtcgtcatggcggtccacatcgcctgcggctacaggtacggggcgctgctgctggccttcttcttctcctcatccaaggtaaccaagatcggggaggaccggaagcgccgcgtcgaagaggatttcaaggagggcgggcagcgcaactggatccaagttctagcaaatagcacaattgccactgtactggttgtgatatttgcactattgactggagggcaagatcagtgtttggactcaaatggttcaaagcttataactggtattataggtggtatcattggccactactgttgctgcaatggagatacttggtcatctgaaatcggtgtgcttagtaatgaacaaccaaggcttattacaacccttaagcctgtcaggaagggtacaaatggtggagtgaccttacaaggacttcttgctgccacaggaggaggccttatcattggtctcactttcgtcgttgttggacttttgactgctgaatgttcgtctgatatggccctcttgcagctcctagtactacccatctctgctgcagctggtttgcttgggagtctaattgattcattgctgggagctacacttcaatttagtgggtactgcagtgttcggaagaaggtggtcagcaaaaggggtcccacggttacaaagatttccgggatgactatcctggataacgatgctgttaatgcagtgtctgttctgctaacaactgtgcttacagcttatgtgtgcatttacatcttttagaaactatatgtgaaattttctcacttcattctatttgtgaaactatatggaaatggaacggtctgcaacttctctgtattgatagaatttatattatggtacagaaaggctgattcacctccactttgatactaatagttcactgcaaactttttatattcccattgcaaaaagttatccttcctacggatttacccgctgtttttttaggggtgtggcaatctttcggatggtaccgatgcagttttggatccagtttttagagttttagctagtttcatgcctctcgtgga

SEQ ID NO: 2239 - DNA, 1333 bp, Zea mays
aaatcagcctgttcggtcaccaaatcacttagaaaatcacgttgcgagtcgcccggtcgcccgtcgtggtggttaactggtctgggactctgggagtcatctccacgctccgggttcgcgcccgactcccctacaaattcgctccaccggcggctccggctgcaaaccgcgactgactgctgaccccgagcggcaccagcgcgcccgccccgccatggctatccccaacgcctttgactcccccctcgcggccaggtccgccgtcggcgcggcgctggcggccgtcatcgccgtccgcgcggtccgccgccgctccctagacgcctcgggcggggtcgccggcttcgtcgtcatggcggtccacatctcatgcggctacaggtacggggcgctgctgctggccttcttcttctcatcgtccaaggtaaccaagatcggggaggaccacaagcgccgcatcgaggagaacttcaaggagggcgggcagcgcaactggatccaagttctagcaaatagcacaattgccactgtactggttgtgatatttgcactaatgactggagggcaagatcagtgcatggactcaaatggttcaaagcttataactggcatcataggtggtatcattggccactactgttgctgcaatggagatacttggtcatctgaaatcggtgtgcttagtaatgaacaaccaaggcttattacatcccttaagcctgtcaggaagggtacaaatggtgcagtcaccttacaaggacttcttgctgccacaggaggaggccttatcattggtctcactttcgttgttgttggactgttgactgctgaatgttcttccgatatggccatcaggcagctcctagtactacccatctctgctgcagctggtttgcttgggagtctaattgattcattgctgggagctacacttgaattcagtgggtattgcagtgttcggaagaaggtggtcagcaaaaggggccctacggttacaaagatttctgggatgactatcctggacaacgatgctgttaatgcagtatctattctgctaacaactgtacttacagcttatgtatgcatttgcatcttttagaaaactagttgggtaaatcttgagttgaaccctatttttcattgggcaatgtattgtgaccttagcctgcacggttcctggaaatggaacagcctgcaacttctctgtgtattggtacaatttgtattatggcacagaaaggccgattcatctccagcttgatactaatggttcactggaaactttttatattcccattgcaaaatgttacgatattggaatcacccttcatac

SEQ ID NO: 2240 - DNA, 1040 bp, Pseudoroegneria spicata
cccaaatccgcgcgcctctcacatcccagaccgctgctgagcctggccgacatggccaccgcctcgctcgccgtccgctcggccgtcggtgtcgccctggccgccttgatcgcggcgcgtgccgtccggcggcgctcgctggacgcctcgggcggagctgccgggttcgccgtgatggcgctccaccttgcctgcggctataggtacggagcgctgctgctggctttcttcttcacttcgtcgaaggtgaccaagatcggcgaggaccgcaagcggcgtgttgaggaggacttcaaggagggtggccagcgcaactggatccaagttctggcgaatagtgcaatagcaactgtattggttatcctattggcgataatgactgggggtgaagatcaatgcttggactcaaatggttcaaaggttataactggtataataggtgctattattggccattattgctgctgcaatggagacacttggtcatctgaaatcggtgtgcttagtgatgaacaaccacggcttgtcactaccctgaagcctgtcaggaaaggaacaaatagtggagtgaccttacaaggacttcttgctgccacagcaggtggtctaaccattggtctgacttttgttgctgttggactgatgacagctgaatgttcttttgatatgtcgcttcaacagctcctagtaatacctatctctgctgctgctggtttgcttgggagtctaattgattcattgttgggtgccacacttcagttcagcggatactgcagtgttcggaacaaggtggtcagtaaacggggacctactgtcaccaagatttctggaatgactatcctggataatgatgctgttaatgcagtgtccgtgctgctaacatctgtgattacagcttatgcttgcattttcttcttctagaaacaagggtttcgttaggtttttcacctatcctagtactcggtcatgtgtaatgcaaatattccaagggcggaatgactgatgtttacttcaagcaagatgaacaatgaagtgttgga

SEQ ID NO: 2241 - DNA, 1379 bp, Triticum aestivum
gcgcctgcttgctgccatccaaacagcccccaaatccgctcgcctctcacatcccagaccgctgctgagcctggccgacatggccaccgcctcgctcgccgtccgctcggccttcggtgtcgccctggccgccttgatcgcggcgcgtgccgtccggcggcgctcgctggacgcctcgggcggagctgccgggttcgccgtgatggcgctccaccttgcctgcggctataggtacggtgcgctgctgctggctttcttcgtcacctcgtccaaggtgaccaagatcggcgaggaccgcaagcggcgcgttgaggaggatttcaaggagggtggccagcgcaactggatccaagttcttgcgaatagtgcaatagcaactgtattggttatcctattggcgataatgactgggggtcaagatcaatgcttggactcaaatggttcaaaggttataactggtataataggtgctattattggccattattgctgctgcaatggagacacttggtcatctgaaatcggtgtgcttagtgatgaacaaccaaggcttgtcactaccctgaagcctgtcaggaaaggtacaaatggtggagtgaccttacaaggacttcttgctgccacagcaggtggtctaaccattggtctgacttttgttgctgttggactgatgacagctgaatgttcttttgatatgtcgtttcaacagctcctagtaatacctatctctgctgctgctggtttgcttgggagtctaattgattcattgctgggtgccacacttcagttcagcggatactgcagtgttcggaacaaggtggtcagtaaacggggacctactgtcaccaagatttctggaatgactatcctggataatgatgctgttaatgcagtgtctgtgctgctaacatcggtgattacagcttatgcctgcattttcttcttctagaagcaagggtttggttggctttttcgcctgtccctaatgcgcagtgatgtgtaatgtgaatattccaaggacagaatgactgatgtttacttcaagcaagatgaacaatgaagtgttggaaatctttggctatttgctgggcacaattgacgagcctgatgacgtttgctccaggcagctagtttggtaatagtgcaagttgggaaatttcaaattgttttaagcaagaaaaggctgtgctgtaatgcggaattgacaattatggtttttcgaaacctatctgtgtcgaagaaagtatctagttcgccgttttagaccacaatccaacaattatccccttgccaaattatagttaagttttgtctgaagtcaaattttgtgaactctgaccaattttatattatagagaaaaatatgaacatttacaata

SEQ ID NO: 2242 - DNA, 1447 bp, Secale cereale
tcagaatccgcgtgcctctcctatcccagaccgctgctgagcctgtccgacatggccaccgcctcgctcgccgtccgctcggccttcgttgtcgccctggccgccttgatcgcggcgcgtgccgttcggcgtcgctcgctggacgcctcgggcggagctgctgggttcgccgtgatggcgctccaccttgcctgcggctataggtacggtgcgctgctgctggctttcttcttcacctcgtccaaggtgaccaagatcggcgaggaccgcaagcggcgtgttgaggaggctttcaaggagggtggccagcgcaactggatccaagttcttgcgaatagtgcaatagcaactgtattggttatcctattggcgataatgactgggggtcaagatcaatgcttggactcaaatagttcaaaggttataactggtataataggtgctattattggccattattgctgctgcaatggagacacttggtcatctgaaatcggtgtgcttagtgatgaacaaccacggcttgtcactaccctgaagcctgtcaggaaaggtacaaatggtggagtgaccttacaaggacttcttgctgccacagcaggtggtctaaccattggtctgacttttgttgctgttggactgatgacagctgaatgttcttttgatatgtcgcttcaacagctcctagtaatacctatctctgctgctgctggtttgcttgggagtctaattgattcattgctgggtgccacacttcagttcagcggatactgcagtgttcggaacaaggtggtcagtaaacggggacctactgtcaccaagatttctggaatgactatcctggataatgatgctgttaatgcagtgtctgtgctgctaacatctgtgattacagcttatgcctgcattttcttattctagaagcaagggtttggttggctttttcacctgtccctaatgtgcagtcatatgtaatgtgaatattccaagggcagaatgactgatgtttacttcaagcaagatgaacaatgaagtgttggaaatctttggctatttgctgggcacagttgacgagcctgaggacgtttgctccaggcagctagtttggtaatagtgcaagttgggaaattgcaaattgttttaagcaagaaaagctgtgctgtaatgacaattatgtttttctcgaaagctatctgtgtcgaagaaagtactccctctgtaacactcttatattagtttatggaggagtatctagttcgccgttttagacgacaaccaacaattatccccttgccaaattatagttaagttttctctgaagttaaattttatgaactctgaataaacaaaaaaaaaaaaaaaaaaaacaaaaaaaaaaaaacaaaaaaaaaaaaaacaaaaaaaaacaaaaacaaagaactacacgacgacgacagacggagtagag

SEQ ID NO: 2243 - DNA, 1350 bp, Triticum aestivum
cccaaatccgcgcgcctctcacatcccagaccgctgctgagcctggccgacatggccaccgcctcgctcgccgtccgctcggccttcggtgtcgccctggccgccttgatcgcggcgcgtgccgtccggcggcgctcgctggacgcctcgggcggagctgccgggttcgccgtgatggcgctccaccttgcctgcggctataggtacggtgcgctgctgctggctttcttcgtcacctcgtccaaggtgaccaagatcggcgaggaccgcaagcggcgcgttgaggaggatttcaaggagggtggccagcgcaactggatccaagttcttgcgaatagtgcaatagcaactgtattggttatcctattggcgataatgactgggggtcaagatcaatgcttggactcaaatggttcaaaggttataactggtataataggtgctattattggccattattgctgctgcaatggagacacttggtcatctgaaatcggtgtgcttagtgatgaacaaccaaggcttgtcactaccctgaagcctgtcaggaaaggtacaaatggtggagtgaccttacaaggacttcttgctgccacagcaggtggtctaaccattggtctgacttttgttgctgttggactgatgacagctgaatgttcttttgatatgtcgtttcaacagctcctagtaatacctatctctgctactgctggtttgcttgggagtctaattgattcattgctgggtgccacacttcagttcagcggatactgcagtgttcggaacaaggtggtcagtaaacggggacctactgtcaccaagatttctggaatgactatcctggataatgatgctgttaatgcagtgtctgtgctgctaacatcggtgattacagcttatgcctgcattttcttcttctagaagcaagggtttggttggctttttcgcctgtccctaatgcgcagtgatgtgtaatgtgaatattccaaggacagaatgactgatgtttacttcaagcaagatgaacaatgaagtgttggaaatctttggctatttgctgggcacaattgacgagcctgatgatgtttgctccaggcagctagtttggtaatagtgcaagttggggaatttcaaattgttttaagcaagaaaaagccgtggtataatgcggaattgacaattatggtttttcgaaacctatctgtgtcgaagaaagtatctagttcgctgttttagaccacaatccaacaattatccccttgccaaattatagttaagttttgtctgaagtcaaattttgtgaactctgaccaattttatattatagagaaaaatatgaacatttacaat

SEQ ID NO: 2244 - DNA, 1269 bp, Brachypodium distachyon
ggcgctagagaagtctgctgcgtggctggccgccgggcatcttgattcgccgcctagcgttgaaagtcaaatcgcgaattcctaaaatccccacccaactcctcactagcgcagaccgcagccggcttgagcctgcgcccgagcccgagcccgcccctctccccagccccgccaatggccgctgcctccctcgccgtccgctgggccgtcggcgccgccctcgccgccgtgatcgccgcgcgcgccgtccggcgccgctcgctcgacgcctcgggcggggtcgccgggttcgccgtcatggcgatccacctcgcctgcggctacaggtacggggcgctgctgctggccttcttcttcacctcctccaaggtcaccaagatcggcgaggaccgcaagcgccgcctcgaggaggacttcaaggaggggggccagcgcaactggatccaagttctagcaaatagtgcaatagctactgtattggtcatcgtattggcaataatgactggggggcaagatcaatgcttggactcgaatgactcaaaggttataactggtattataggtgctattattggccactattgctgctgtaatggagacacttggtcatctgaaattggtgtgcttagtgatgaacaaccacggcttatcaccacacttaagcctgtcaggaaaggtacaaatggtggagttacctttcaaggacttcttgctgccacaggaggaggcctaaccattggtctcacatttactgctgtgggactcatgactgctaaatgttcttttgatatggcccttcgacaactcctagtaatacccatctctgctgctgctggtttgcttgggagtctaattgattcgttgctgggtgccacactcgagttcagtggatactgcagtgttcgaaagaaggtggtcagtaaaccggggcctactgttaccaagatttctggaatgactatcctggataatgatgctgttaatgcaatctctgtgctactaacagctgcgattacagcttatgtgtgtatttgcttattctagaagcagagttgagacttttcacttgttctgttcagtaatgtcatatgtaatgtaatttagattcaaagcgccaaaggatatgatgtttacgccaaaaaaaataaatcgtgaaatgatcgatggaaatctttgtgcggccgtttttgctcattttgatcaaaataggcattctctgttcatgcgccggtacacaaaattaataaacatttactatttttcacgaag

SEQ ID NO: 2245 - DNA, 1140 bp, Pennisetum glaucum
ccgcgatggcggggaagcgcaacggctacgacgacgacaacgtgaaccccttcgcgggaggaagtgttccaccagccaccaattctcggctctcacctctatcgcatgaaccagctgatttctacaatgtagacattcctcttgattcaacgaaggatctgaagaaaaaggagaaagagctccaggctatggaggctgagctaaacaaaagagaaagggaattgaaaaggaaggaagaggcggcatcacgagctggcattgtgatagaagagaagaattggcctccccttttccctctcatccaccatgacatttccaatgagatacctatccatctacaaaggacgcagtaccttgcattttcatcatttttgggattggtaggatgcctcttttttaatgtcatagcaactacaacagcatggattaaaggggaaggtgttatcatctggctgcttgccattatctacttcatctctggtgcacctggggcttatgtgttatggtaccgccctctttataatgcaatgagaactgagagtgctttgaagtttgggtggttttttctgttctacatgattcatatcatcttctgtgtgtgggcagctgtggctcctccgtttcctttcaaaggaaaatccttggctggaattttgccagcaattgatgtcataagcaagagtgctattgttgggatattttactttgttggatttggcttgttctgccttgaatcacttctgagcatcgctgtcattcagcaagtatacatgtacttccgtggaagtggaaaagccgcagagatgaaacgtgaggcggcacgtggtgcgctaagttctgctttctgatgaacatacggatctgattacagccagttgatggatagaaggaaaccagatgtgtcattttgaggcatggggtcttgcacatggctgcagcacgcgtatttgggtcatggaaatcgtacagctgatccaccttttgctcttatgtaagatacgaatacggatgcgtaaggatgttggtttccatttcttgccacgcgttagatttggttgacaggcaaatcggtggattttgttggtggaatagtaggatatgtatttgtatacgcttgcatctgagtgaaatcgcttgatt

SEQ ID NO: 2246 - DNA, 1973 bp, Panicum virgatum
cagatcaatcggtccgtattatttttactatcgtgtactacctcagcttgtacggaacggtgcgcaaatgatatatagaaatttctgaaaatggggaaagggacgcctcaccaacaggctcagttgaccccacctgtcgtaggtgacaggccccctccgcgcctcccctcgtttctctttccgcgtactcgaaggctgcgcgacagtacgccactagcgcagcagcggttggccaccacccgacgccggaggaggcagcggcggcgcggcgatggcggggaagcacggccgcaacggctacgacgacgacaacgtcaaccccttcgcgggaggaagtgttccaccagccaccaattctcggctctcacctctatcgcatgaaccagctgatttctacaatgtagatattcctcttgattcaacaaaggatctgaagaaaaaggagaaagagctccaggctatggaagctgagctaaacaaaagagagagggaattgaaaaggaaggaagaggcggcatcccgagctggcattgtgatagaagagaagaattggcctccctttttccctctcatccaccacaacatttccaatgagatacctatccatctacaaaggatgcagtatcttgcattttcgtcgtttttgggattgatagcatgcctattttttaatatcattgcaactacaacagcatggatcaaaggggaaggtgtaatcatctggttgcttgccattatctacttcatatctggtgcacctggggcctatgtgttatggtatcgccctctttataatgcaatgagaactgagagtgctttgaaatttgggtggttttttctgttttacatgattcatattatcttctgtgtgtgggcagctgtggctcctccctttccttttaaaggaaaatccctggctggaattttgccagcaattgatgtcataagcaagagtgctattgttgggatattttactttgttggatttggcttgttctgccttgaatcacttctgagcattgctgtaattcagcaagtatacatgtacttccgtgggagtggaaaagccgcagagatgaaacgtgaggcggcacgtggtgctctaagttctgccttctgatgaacatatgtcaatctgattacagccagttgatggatggaaggaaaccggatgtgtcatttgaggcctggggtcttgtacatcactgcagtccattatggatcatggaaagcgtacagctgatcctcttttcgctcttctgtaagattcggacagtcctcgtacggatgcttcagggaggtgttggtttccatttcttgccacggtttagatgtggttgataggcaaaatggcagattttgttggtggaatagtaggatataatgtatttgtatacgcttgcattgcatgcgactgtgtgaatgaaatcgtttggtttatttcctggcggctgctgtgcttgttggccaagacgacccttcatcatttttttttctttttctttttctgagaccgacgacccttcatccttgtgtggtacagaatggtctaccctttccattatactgcaagtctgcaaccttcttcaatgcaacggttatgccgtgttttgttggcgctgcgctgtaatctcctatcacgttcaggaatgctgaaagtcaggacctgaatcctttgtacttgctcacacagtatttggatagtttcacaaggaagcctacgtgttaaagtcgatggcgaagaagacacggcttattgggaagaatggcttatcgggatagcgtggatttttgcaattaacgatgcatcaggagagaagaaataggctgggccctgtgatgagaggactagagaggttgcgatagcagatagaagcgatatattatgacaaccagtctttgatccatgagaatgctgtcatgacttgaatttcaacccacacttacatattaacatggtctcagcttatctc

SEQ ID NO: 2247 - DNA, 1265 bp, Zea mays
cccttcctgcacagtacagtggtacttgaagtcgaaggcagcgcagcaggtacgccaggacgccattagcagcggttggccaccagcccaccacccgacgccggaggcccggaggaggaggcggcgatggcggggaagcacgggcgcaacggcttcgacgacgacaacgtcaaccctttcgcgggaggaagtgttccacctgccaccaattctcgtctctcacctctatcacatgaaccggctgatttctacaatgtggacattcctctcgactcatcaaaggatctgaagaaaaaggagaaagaactccaggctatggaggctgagctaaacaaaagagaacgggaattgaaaaggaaggaagaggcggcatcccgagctggcgttgtgatagaagagaaaaactggcctccctttttccccctcatccaccacgacatttccaatgaaatacctatccatctacaaaggatgcagtaccttgcattctcatcattcttgggattgatagcgtgtctcttttggaatgtcatagcaactacaacagcatggattaaaggggaaggtgttatgatctggctgcttgccattatctacttcatatctggtgcgcctggggcttatgtgttatggtatcgacctctttataatgcaatgagaactgagagcgctttgaagtttgggtggtttttcctattttacatgattcatataatattctgtgtgtgggcagctgtggctcctccattccctttcaaaggaaaatctttggctgggattttaccagcaattgatgtcataagcaagaatgctattgtcgggatattttacttcgttggatttggcttgttctgccttgaatcacttctgagcatcggtgtcattcagcaagtctacatgtatttccgtggaagtggaaaagctgcagagatgaaacgtgaggcagcacgtagtgctctaagttcagccttctgatgaacatagggcggtctgattagagcagtagatggataagggaagggaacgagatgtgccaattaagccacgcggtcttgtacatcactgcagtacgtggatttggatcgctgaaagcgtacagctgatcgtctttttgctcttctgtaaaatatgaacaatcatcatatggtccggatgcgtcagggtgttggtttcatttcttgccatggtttagatgtggttgatagggaaaacggtgaagtatttttttggagcagcgaatataatgtatcttcatcgtactttta

SEQ ID NO: 2248 - DNA, 1442 bp, Sorghum bicolor
cttttggatccccggggccaccggacagacttacctgaccccacctgtcattgactacgaaccgcaccgcccccttctgcatactcgaagtcgaaggcagcgcggcaggtagcacggcactagcaggtagcagcggttggccaccagcacccgacgccggaggcccggaggaggaggaggcggcggcgatggcggggaagcacgggcgcaacggctacgacgacgacaacgtcaaccccttcgcgggaggaagtgttccacctgccaccaattctcgtctctcacctctatcacatgaaccggctgatttctacaatgtggacattcctctcgactcatcaaaggatctgaagaaaaaggagaaagaactccaggctatggaggctgagctaaacaaaagagaacgggaattgaaaaggaaggaagaggcagcatcccgagctggcattgtgatagaagagaaaaattggcctcccttttttcccctcatccaccacgacatttccaatgagatacctatccatctacaaaggatgcagtaccttgcattctcgtcattcttgggattggtagcgtgtctcttttggaatatcatagcaactacaacagcatggattaaaggggaaggtgttatgatctggctgcttgccattatctacttcatatctggtgcacctggggcttatgtgttatggtatcgacctctttataatgcaatgagaactgagagcgctttgaagtttgggtggttttttctattttacatgattcatataatcttctgtgtgtgggcagctgtggctcctccattccctttcaaaggaaaatctttggctgggattttacctgcaattgatgtcataagcaagaatgctattgtggggatattttactttgttggatttggcttgttctgccttgaatcacttctgagcatcggtgtcattcagcaagtatacatgtatttccgtggaagtggaaaagctgcagagatgaaacgtgaggcagcacgtagtgctctaagttcagccttctgatgaacagagggcggtgtgatcacagccagttgatggatagaaggaaatgagatgtgccaaatgagccacgtggatttggatctctgaaatcgtacagctgatcatctttttgctcttctgtaaaatatgaacaatcctcatatggatgcgtcagggttcacttattgccatggtttaggtgtcgttgatagggaaaacggtgaagttttttgtagtagtgaatataatgtatcttcatcatacgtttgcatgtgagtgtaatagcttggtggtcatttttcttgtggtatgaatgcaggtttgctgtgttttcggccaaggcaaaaacacttgttttatgacacttcctgccaaccatttttggtgcaagaatcgtatattgagattgtcatccgtagtattggg

SEQ ID NO: 2249 - DNA, 1202 bp, Saccharum officinarum
gtagcagctcggcactagcgggtagcagcggttggccaccaccccacacgacgccggaggcccggaggaggaggaggcggcggcgatggcggggaagcacgggcgcaacggctacgacgacgacaacgtcaaccctttcgcgggaggaagtgttccacctgccaccaattctcgtctctcacctctatcacatgaaccggctgatttctacaatgtggacattcctctcgactcatcaaaggatctaaagaaaaaggagaaagaactccaggctatggaggctgagctaaacaaaagagaacgggaattgaaaaggaaggaagaggcggcatcccgtgctggcattgtgatagaagagaaaaattggcctcccttttttcctctcatccaccacgacatttcaaatgagatacctatccatctacaaaggatgcagtaccttgcattctcgtcattcttgggattggtagcgtgtctcttttggaatatcatagcaactacaacagcatggattaaaggggaaggtgttatgatctggctgcttgccattatctacttcatatctggtgcgcccggggcttatgtgctatggtatcgaccgctttataatgcaatgagaactgagagcgctttgaagtttgggtggttttttctattttacatgattcatataatcttctgtgtgtgggcagctgtagctcctccattccctttcaaaggaaaatctttggctgggattttacctgcaattgatgtcataagcaagaatgctattgtggggatattttactttgttggattcggcttgttctgccttgaatcacttctgagcatcggtgtcattcagcaagtatacatgtatttccgtggaagtggaaaagctgcagagatgaaacgtgaggcagcacgtagtgctttaagttcagccttctgatgaacatagggcggtctgatcacagacagttgatggatagaaggaaatgagatgtgccaaatgagccacgtggatttggatatctgaaagcgtacagctgatcatcattttgctcttctgtaaaatatgaacaatcctcatatggatgcgtaagggtgttggtttcatttattgccatggtttagatgtgagcgatagggaaaacggtgaagtttttttttttgaagtagtgaatataatgtatctaaatacgtttgcatgtgagcgt

SEQ ID NO: 2250 - DNA, 1351 bp, Zea mays
tactcgaagtcgaaggcagcgcggcaggtagcagcagtacgccagcacgcacaccaccagcagcagttgccggttggccaccacccgacgccggaggcctggacgaggaggcggcggcgatggcggggaagcacgggcgcaacggcttcgacgacgacaacgtcaaccccttcgcgggtggaagtgttccacctgccaccaattctcgtctctcacctctatcacatgaaccggctgatttctacaatgtggacattcctctcgagtcgtcaaaggatctgaagaaaaaggagaaagaactccaggctatggaggctgagctaaacaaaagagaacgggaattgaaaaggaaggaagatgcggcatcccgagctggcattgtgatagaagagaaaaattggcctccctttttccccctcatccaccatgacatttctaatgagatacctatccatctacaaaggatgcaataccttgcattctcgtcatttttgggattgatagcgtgcctcttttggaatatcatagcaactacaacagcatggattaaaggggaaggtgttatgatctggctgcttgccattatctacttcatatctggtgtgcccggggcttatgtgttatggtatcggcctctttataatgcaatgagaactgagagcgctttgaagtttgggtggttttttctattttacatgattcatataatcttctgtgtctgggcagctgtggctcctccatttcctttcaaaggaaaatctttggctgggattttgccagcaattgatgtcataggcaagaatgctattgtggggatattttacttcgttggattcggcttgttctgccttgaatcacttatgagtatcggtgtcattcagcaagtatacatgtatttccgtggaagtggaaaagctgcagagattaaacgtgaggcagcacgtagtgctctaagttcagccttctgatgaacatctttttgtaaggtctggttacagccagtcgatggatagaagggaacgagatgtgccgattgagccacgggacggtgtcttgtacatcactgcagtacgtggatttggatctctgaaagcgtacagctgatacctgataatctttttgcacttctgtaaaatatgaactatcctcatggatgcgtcagtgtgctggtgccatttcttgtcatggtttaggtgtggttgatagggaaaacggtgttttttttttagtggcgaatataatgtatcttcacgtgagtgtaatagccagtttatttttgtggcatgaatgcagttcgctgtgttttttggccaagacaatccacatgtcaggacacttctctgcccgcacc

SEQ ID NO: 2251 - DNA, 1426 bp, Oryza sativa
ctacaacacggggactacgcggagagagagacagcgcacgctagtggagcagctgctgcagcggttggccaccgcctccatcgccgtcgccgactcgccgccatcgtcgttgccgtcgtcgccgtcggcggagtaggcaggcggccatggcggggaagcacggccgcaacggcttcgaggacgacgacgtcaatcccttcgcgggaggaagtgttcctcctgccaacaattctcgactcccacctctctcccatgagccagctgatttttacaatgtggacattcctcttgactcgtctaaggatttgaagaaaaaggagaaagaactccaggcaatggaagctgaactaaacaaaagagaaagggaactgaaaaggaaggaagaggctgcagcccaagctggcattgtcattgaagataaaaattggccaccctttttccctctcattcaccataatatttcaaatgagatacctattcatctacaaagaatgcagtaccttgcattttcatcgtttttgggattggcagcctgcctattttggaatatcatagcaaccacaaccgcatgggtaaaaggggaaggtgttattatctggttgcttgctattatctacttcatatctggtgtacctggtgcttatgtgttatggtaccgccctctttataatgcaatgagaactgagagtgctttgaagtttgggtggttttttctgttttacctgattcatataatcttctgtgtgtgggcagctgtggctcctccttttcctttcaaaggaaaatctttggctgggattttgcctgccattgatgtcataggcaggagtgctatagtggggatattttactttgtcgggtttggattattctgccttgagtcactgctgagcattggtgtcattcagcaagtatacatgtacttccgtggaagtggaaaagccgcagagatgaaacgtgaggcggcacgtggtgctctgagctccgcattctgatgaaacatgccttgagcaaaactgtagccagatgatatgagtgggaggaaacacgaaacatgagttgccaatctagcattcgcatagtgtacatccctgacggctgaacagcgtgcggatttggaatcaccgaaagcacccagccattattatcttttttgctcttctgtaatatataagcagcgttcttgtatggacgcgttcaggtgtttgtttccatttgttgacaaagattttagatgtggacgtgtgttgatagggaatagacatacatacgcgtgcgcgagtgggatcacctgttttttattacttcctttgcagcatagttgcagcacgttgtgtttatctgttgacacgattttcgtgagttataagatgattgatgtcctctaaaaattctctgttctgctggtcattatttattgggtacc

SEQ ID NO: 2252 - DNA, 1237 bp, Leymus cinereus x Leymus triticoides
gagggagggggcgagcacgccgcacgcagttggtcggtcgccaccacgtcgtccatcgccgccgtcgggagaagcagcccggacctatggcgggccgcaacggcttcgaggacgacgacgtcaaccccttcgccggagggagtgttccccctgcctccaattctcgactctcacctctctcccatgagccagcgggtttttataatgtggacattcctatggattcaactaaggatgtgaagaaaaaggaaaaggaactccaggcgatggaagccgagctaaacaaaagagaaagggaattgaaaaggaaggaagaggctgcgtcgcgagctggcattgtcatagaagagaaaaactggccaccctttttccctctcattcaccacaatatttcaaatgagatacccatccatctacaaaaaatgcagtaccttgcattttcatcatttttgggaattgctctctgcctcttctttaatatcatagcgactacaacagcatggattaaaggagaaggtgtcatgatttggttgcttgctattatctacttcatatctggggtccctggggcttatgtgttatggtatcgccctctttataatgcgatgagaactgagagtgctttgaagtttgggtggttttttctattttacatgattcacataatcttctgcgtgtggtcagctgtgtctcccccattccctttcaaaggaaattctttgactgggattttgcctgccattgatgtcataaccaagagtcttattgtcgggatattttactttgttggatttggactgttctgccttgaatcactgctgagcataggtgtcattcagcaagtgtacatgtacttccgtggaagtggaaaagcccaggagatgaaacaacaggcagcacgcggtgccctgagttctgcattctgatgaagaaaaccagcagccagagttataatcagggtgagtggaaggagacaggatgtgtgccgattgggcatggtagtcttgcgcatcgctgcactgtgcggatttggatcatccgaagcatacaactatatctttttgctcttctgttaatacaaatataaggagccttcttgtgtggatacttttaaggtggtgttgtttccattcgttgacatgattttagatgtgattgatagtgaggaccgactaatattcttggtggaatatatttgcatatgtttgcgtgggagtaaattaaaattacttgttca

SEQ ID NO: 2253 - DNA, 1172 bp, Festuca arundinacea
  misc_feature (703)..(703): n is a, c, g, or t
  misc_feature (856)..(856): n is a, c, g, or t
ggcacgagggccaccacgtcccactgccgccgtcggagaaggaaaccggccgcacctgcgcaccatggcggggaggggtcgcaacggcttcgaggacgacgacgtcaaccccttcgcgggtgggagcgttccccctgcctccaattctcgactgtcacctctctcccacgaaccagcaggtttttataatgtggacatacctatggattcaactaaggataagaaaaaagagaaagaactccaggcgatggaagctgagctcaacaaaagagaaaaggaattgcaaaggagggaagaggctgcatcacgagctggaattgtcattgaagagaaaaactggccaccccttttccctctgattcaccacaatatttcaaatgagatacccatccatctacaaaaaatgcagtaccttgcattttcatcatttttgggaattgctgcctgcctcttcttcaatatcatagcgactacaacagcatggattaaaggggaaggtgttatgatttggctgcttgcaattatctacttcatatctggtgtccctggggcttatgtgttgtggtatcgccctctttataacgcaatgagaactgagagtgctttgaagtttgggtggttttttctgttttacatgattcatataatcttctgcgtgtggtcagcagtgtctcccccatttcctttcaaaggaaattctttnactgggattttgcctgccattgatgtcataaccaagagtgctattgttgggatattttactttgttggatttggactgttctgccttgaatcactgctgagcatagctgtcattcagcaagtatacatgtacttccgtggaagtggaaaagcncaggagatgaaacaacaggcagcacgtggtgccctgagttctgcgttctgatgaagaaaaccagcagccagagtaataggcaaggtagtgagtgggaaggaagacatgatgtctgccgattgggcatggtagtcttgtacatcgctgcaccgtgcggatttggatcgtcaaaagcatacagctatacctttttgctcttctgttcatacaaatataacgagccttcttgcgtggatacttttaacatgttgtgttgtttccatctgttgacatggttttagatgtagcgagaattgattaatatccttggtggaat

SEQ ID NO: 2254 - DNA, 1310 bp, Hordeum vulgare
gagtagagagggaggaggcgaagcacgccgcacgcagttggccgccaccacgtcgcctgccgccgccgtcggagaaggaggccggacccatggcgggccgcaacggcttcgaggacgacgacgtcaaccccttcgccggagggagtgttccccctgcctccaattctcgactctcacctctctcccacgagccagcgggtttctataatgtggacattcctatggattcaactaaggatgtgaagaaaaaggaaaaagaactccaggcgatggaagccgagctaaacaaaagagaaaaggaattgaaaaggaaggaagaggctgcgtcgcgagctggcattgtcatagaagacaaaaactggccaccctttttccctctcattcaccacaacatttcaaatgagatacccatccatctacaaaaaatgcagtaccttgcattttcatcatttttgggaattgctctctgcctcttctttaatatcatagcgactacaacagcatggattaaaggagaaggtgtcatggtttggttgcttgccattatctacttcatatctggtgtccctggggcttatgtgttatggtatcgccctctttataacgcgatgagaactgagagtgctttgaagtttgggtggttttttctattttacatgattcacataatcttctgcgtgtggtcagctgtgtctcccccattccctttcaaaggaaattctttgactgggattttgcctgccattgatgtcataaccaagagtcttattgttgggatattctacttcgttggatttggattgttctgccttgaatcattgctgagcataggtgtcattcagcaagtgtacatgtacttccgtggaagtggaaaagcccaggagatgaaacagcaggcagcacgcggtgccctgagttctgcgttctgatgaagaaaaccgcccgccagacttatagccagggtagtgagtggaaggagacaagatgtccgctgactgggcattgtagtcttgtgcatcgctgcaccatgcggatttggatcatcgaaagcagacagctatatctttttgctcttctgttaatacaaatataaggagccttgttgtgtggatactttaaggtggtgttatttccatttgttgacatggttttagatgtggttggtagcgaggatcgattaaccttgtcggaggaatatatctgcatatgtttgcgtgggagtaaaattacttgttcattttcatgacaatgttgatgcggccttctgtttctgttagcaaagacgatttacttgcttgattactgaagca

SEQ ID NO: 2255 - DNA, 1416 bp, Brachypodium distachyon
gagggacgcgcacagccaccttaatttctctcccccgtactttactcctccagaaagcaacgcaagtaggaggagatacagcagcggttggtcgccaccacgttccaccgccgctgccggagaaggaggaggaggaaggcggccggaccatggcggggaagcacggccgcaacggcttcgaggacgacgacgtcaaccccttcgcgggagggagcgttcctgctgcatccaacgctcgactctcacccctctcccatgaaccagccggtttttataatgtggacatccctatggattcagctaaggatgtgaagaaaaaggagaaagaactccaggctatggaagctgagctaaacaaaagagaaaaggaattgaaaaggaaggaagaggctgcatctcgagctggcattgtcatcgaagagaaaaactggccgccgcttttccctctcattcaccacaatatttcaaatgagatacccatccatctacagagaatgcagtaccttgcattttcatcatttttgggattgactgcctgcctcttctggaatatcatagcgaccacaacagcatgggttaagggagaaggtgttatgatttggctgcttgccattatttacttcatatctggtgttcctggggcttatgtgttatggtaccgtcctctttataatgcaatgagaactgagagtgctttgaagtttgggtggtttttcatgttttacatgattcatataatcttctgtgtgtggtcagccgtgtctcctccatttcctttcaaaggaaattctttgactgggattttgcctgccattgatgtcataaccaagagtgctatcgtggggatattttactttgttggatttggattgttctgccttgaatcactgctgagcataggtgtcattcagcaagtatacatgtacttccgtgggagtgggaaagcggcagagatgaaacaacaggcagcacgcagtgccctgagctccgcgttctgatgaagaaaaccagcagccatattatagacaggcggtgtgtgtgtggaaggagacagggtgtgccgattgggcatggtagtcttgtacatctctgaaagtgagcggatttggaccatcgaaagcatacagcttttatctttttgctcttctgttaatacaaatgtaaggagccttcctgtatggataacttaaggtgtttccatttgttgccatggttttagatgcaggtctgatagcgagaatagattactgttcgtggtggaatatatttgcatatgcttgcgttggggtaaatttgcttggtttattcttggcaacattgattcggtccgctgtgtttgtcagctaagacggattcgcttgcatgatactcctacatgggcacttctgatttccctttgggactttgattggtctg

SEQ ID NO: 2256 - DNA, 1218 bp, Avena sativa
ggaggcagcaaagcaccggttggtcgccaccacgtccttcgccccgccgtcggagaaagaggaggaaggcggccggcaccatggcggggaggggccgcaacggcttcgaggacgacgacgtcaaccccttcgcgggaggaagtgttccccctgcctccaattctcgactgtcacccctctcccacgagccagcaggtttctataatgtggacattcccatggattcaactaaggataagaaaaaggagaaagaactccaggcattggaagctgagctcaacaaaagagaaaaggaattgaaaaggagggaagaggctgcatcacgagctggaattgtcattgaagagaaaaactggccaccccttttccctctcattcaccacaacatttcaaatgagatacccatccatctacaaaaaatgcagtaccttgcattttcatcatttttgggaattgctacctgcctcttcttcaatatcatagcgactacaacagcatggattaaaggggaaggtgttatgatttggctgcttgcaattatctacttcatatctggtgtccctggggcttatgtgttatggtatcgccctctttataacgcaatgagaactgagagtgctttgaagtttgggtggttttttctgttttacatgcttcatattatcttctgcgtgtggtcagcagtgtcgccaccatttcctttcaaaggaaactctttgactgggattttgcctgccattgatgtcataaccaagagtgctattgttgggatattttactttgttggatttggactgttctgccttgaatcactgctgagcatagctgtcattcagcaagtatacatgtacttccgtggaagtggaaaagcccaggaaatgaaacaacaggcggcacgcagtgccctgagtaatgcgttctgatgaagaaaaccagcagccagagttataggcaaggtagtgtgagtggaaggaagacaggatgtgtgccgattgggcatggtagtcttgtacattgctgcaccgtgcggatttgtatcatcaaaagcatatagctatatcatcttgctcttctgttaatacaaacataacgagcctttcttgttttggtacgtgttgtgttgtttccattggttgacatggttttagatgtggttgatagcgagaattgattgatactcttggtggaatatatcgaggcaatgcctgttcatttcct

SEQ ID NO: 2257 - DNA, 1376 bp, Secale cereale
cgtgctagacgactagactagaaagcaacgcgactagagaggagaggagaggagagggaggcacgccgcacgcacctggtcggtcgccaccacgccgtcgcccatcgccgccgcccgtcggagaaggggcccggagacccatggcgggccgcaatggcttcgaggacgacgacgtcaaccccttcgccggagggagtgtcccccctgcctccaattctcgactctcacctctctcccatgagccagcgggtttttataatgtggacattcctatggattcaactaaggatgtgaagaaaaaggaaaaagaactccaggcgatggaagccgagctaaacaaaagagaaaaggaattgaaaaggaaggaagaggctgcgtcgcgagctggtattgtcatagaagagaaaaactggccaccctttttccctctcattcaccacaatatttcaaacgagatacccattcatctgcaaaaaatgcagtaccttgcattttcatcatttttgggaattgctctctgcctcttctttaatatcatagcgactacaactgcatgggttaagggagaaggtgtcatggtttggttgcttgccattatctacttcatatctggcgtccctggggcttatgtgctatggtatcgccctctttataacgcgatgagaactgagagtgctttgaagtttgggtggtttttcctattttacatgattcacatagtcttctgcgtgtggtcagccgtctctcccccattccctttcaaaggaaattctttgactgggattttgcctgccattgatgtcataaccaagagccttattgttgggatattttacttcgttggatttggattgttctgccttgaatcactgctgagcatagctgtcattcagcaagtgtacatgtacttccgtggaagtggaaaatcccaggagttgaaacaacaggcagcacgtggtgccctgagctctgcgttctgatgaagaaaaccagcagccagagttgtagccagggtagtgagtggaaggagaggatgtgtgtgtgccgattggaaatggtagtcttgggcatcgctgcaccgtgcggatttggatcgctgaaagcatacagctatatctttttgctcttctgttaatacaaatataaggagccttctcgtgtggatactttaaggtggtgttgtttccattcgttgacatggttttagatgtggttgatagcgaggaccgactaatattgttggtggaatatatttgcatatgtttgtgtgggagtaaaattacttgttcattttggtggcagtgttgatgcagcctgctatgcttgtctggtaaggcgattggcttgctcgattacaagagcatttctgaaaagtc

SEQ ID NO: 2258 - DNA, 1281 bp, Triticum aestivum
ggagagggaggcacgccgcacgcacttggtcggtcgccaccaccacgccgcccatcgccgccgcccgtcggagaaggggcccggagacccatggcgggccgcaacggcttcgaggacgacgacgtcaaccccttcgccggagggagtgtcccccctgcctccaattctcgactctcacctctctcccacgagcctgcgggtttttataatgtggacattcctatggattcaactaaggatgtgaagaaaaaggaaaaagaactccaagcgatggaagccgagctaaacaaaagagaaaaggaactgaaaaggaaggaagaggctgcgtcgcgagctggcattgtcatagaagacaaaaactggccaccctttttccctctcattcatcacaatatttcaaatgagatacccatccatctacaaaaaatgcagtaccttgcattttcatcatttttgggaattgctctctgcctcttctttaatatcatagcgactacaactgcatggattaagggagaaggtgtcatggtttggttgcttgccattatctacttcatttctggtgtccctggggcttatgtgttatggtatcgccctctttataatgcgatgagaactgagagtgctttgaagtttgggtggtttttcctattttacatgattcacataatcttctgcgtgtggtcagctgtgtctcccccattccctttcaaaggaaattctttgactgggattttgcctgccattgatgtcataaccaagagccttattgttgggatattttactttgttggatttggattgttctgccttgaatcactgctgagcataggtgtcattcagcaagtgtacatgtacttccgtggaagtggaaaatcccaggagttgaaacaacaggcagcacgtggtgccctgagctctgcgttctgatgaagaaaaccagcagccagagttgtagccagggtagtgagtggaaggagacaggatgtgtgccgattggaaatggtagtcttgcgcatcgctgcaccatgcggatttggatcgctgaaatcatacagctatatctttttgctcttctgttaatacaaatataaggagccttctcgtgtggatactttaaggtggtgttgtttccattcgttgacatggttttagatgtggttgatagcgaggaccgactaatattcttggtggaatatatttgcatatgtttgtgcgggagtaaattaaaattacttgttcatttcctggcaatgttgatgcgacctgctgtgttcgtca

SEQ ID NO: 2259 - DNA, 2138 bp, Triticum aestivum
tgcatcaggggctgcagagttcaccacacggccagacttaacaggctataggcagctcgctccaacaccacccatatgcaaaataagtatatttgccatggcacgggggcacagatcatcaccaatagaaacagccggctgcaggagcttgaacacctgagctggcttaggcatgcttgctacgaggcactaactactggaagttaagagtgctaaacagcagtaacgcttagacatgtttgcaatgcgctactcgaacgggatacatatattgtcagaggatttctcagagcgtgcgacaacagctgcagcgatcacaataagcaacaacacatgcacgccgaagcattcccacggacgccacagctccaaaccaaaatacataacaaagccagtttgtgtgctaaaaaaaaaaaacttgcaaacaacaggggtgaataatgatagttgtgattgttttttattagcagagacttgcgtcgaaacatgcgacgcgtcagggtctctgtcagccgctttcagcgttgagctcaatgggacggcgatgacgacgatgaagcctcatgctcgtgtgcatgtccatgaccatgcgcgtgatcatcatggccatcccaaggatgacgcatacccaagagcacagcgccgtcctgcttagccctgtagaaaatccaaaaccacatggtggcgcagaggcccttgccggcgatggtgtgccagcgcttgttgtgggggatggtgtagcccttgtacgtcgtgccgccgtgcgcgcctccgccgcccatcgccgccgcccgtcggagaaggcgcccggagacccatggcgggccgcaacggcttcgaggacgacgacgtcaaccccttcgccggagggagtgtcccccctgcctccaattctcgactctcacctctctcccacgagcctgcgggtttttataatgtggacattcctatggattcaactaaggatgtgaagaaaaaggaaaaagaactccaagcgatggaagccgagctaaacaaaagagaaaaggaactgaaaaggaaggaagaggctgcgtcgcgagctggcattgtcatagaagacaaaaactggccaccctttttccctctcattcatcacaatatttcaaatgagatacccatccatctacaaaaaatgcagtaccttgcattttcatcatttttgggaattgctctctgcctcttctttaatatcatagcgactacaactgcatggattaagggagaaggtgtcatggtttggttgcttgccattatctacttcatttctggtgtccctggggcttatgtgttatggtatcgccctctttataatgcgatgagaactgagagtgctttgaagtttgggtggtttttcctattttacatgattcacataatcttctgcgtgtggtcagctgtgtctcccccattccctttcaaaggaaattctttgactgggattttgcctgccattgatgtcataaccaagagccttattgttgggatattttactttgttggatttggattgttctgccttgaatcactgctgagcataggtgtcattcagcaagtgtacatgtacttccgtggaagtggaaaatcccaggagttgaaacaacaggcagcacgtggtgccctgagctctgcgttctgatgaagaaaaccagcagccagagttgtagccagggtagtgagtggaaggagacaggatgtgtgccgattggaaatggtagtcttgcgcatcgctgcaccgtgcggatttggatcgctgaaatcatacagctatatctttttgctcttctgttaatacaaatataaggagccttctcgtgtggatactttaaggtggtgttgtttccattcgttgacatggttttagatgtggttgatagcgaggaccgactaatattcttggtggaatatatttgcatatgtttgtgagggagtaaatttacttgttcattttggtcgcagtgttgatgcagcctgctatgattgtcaggtaaggcgactcgcatgctcgattacaaagagcatttctgatttcctttcccctttgattgttcagtggctacctgttaatttcagacagttggattttttgtcattcttattagtaatgatatatctagtat

SEQ ID NO: 2260 - DNA, 1242 bp, Pseudoroegneria spicata
gccgcacgcacttggtcggtcgccaccaccacgccgtccatcgccgccgcccgtcggagaaggggcccggagacccatggcgggccgcaacggcttcgaggacgacgacgtcaaccccttcgccggagggagtgtcccccctgcctccaattctcgactctcacctctctcccacgagccagcgggtttttataatgtggacattcctatggattcaactaaggatgtgaagaaaaaggaaaaagaactccaggcgatggaagccgagctaaacaaaagagaaaaggaattgaaaaggaaggaagaggctgcatcgcgagctggcattgtcatagaagacaaaaactggccacccttttttccctctcattcaccacaatatttcaaatgagatacccatccatctgcaaaaaatgcagtaccttgcattttcatcatttttgggaattgctctctgcctcttctttaatatcatagcgactacaactgcatggattaagggagaaggtgtcatggtttggttgcttgccattatctacttcatatctggtgtccctggggcttatgtgttatggtatcgccctctttataacgcgatgagaactgagagtgctttgaagtttgggtggttttttctgttttacatgattcacataatcttctgtgtgtggtcagctgtgtctcccccattccctttcaaaggaaattctttgactgggattttgcctgccattgatgtcataaccaagagtctgattgtcgggatattttactttgttggatttggattgttctgccttgaatcactgctgagcataggtgtcattcagcaagtgtacatgtacttccgtggaagtggaaaatcccaggagttgaaacaacaggcagcacgtggtgctctgagctctgcgttctgatgaagaaaaccagcagccagagttatagccagggtagtgagcggaaggagacaggatgtgtgccgattggtcatggtagtcttgtgcatcgctgcaccgtgcggatttggatcgtcggaagcatacatctatatctttttgcacttctgttaatacaaatataagcagccttctcgtgtggatactttttaaggttgtgttgtttccattggttgacatggttttagatgtggttgatagcgaggaccgactgatattgttggtggaatatatttgcatatgtttgtgcgggagtaaattaaaattacttgttcatttcctggca

SEQ ID NO: 2261 - DNA, 1357 bp, Secale cereale
tcaggtgctagacgactagaccagaaagcaacgcgactagagaggagaggagaggagagggaggcacgccgcacgcacctggtcggtcgccaccacgccgtcgcccatcgccgccgcccgtcggagaaggggcccggagacccatggcgggccgcaacggcttcgaggacgacgacgtcaaccccttcgccggagggagtgtcccccctgcctccaattctcgactctcacctctctcccatgagccagcgggtttttataatgtggacattcctatggattcaactaaggatgtgaagaaaaaggaaaagaactccaggcgatggaagccgagctaacaaaagagaaaaggaattgaaaaggaaggaagaggctgcgtcgcgagctggcattgtcatagaagagaaaaactggccaccctttttccctctcattcaccacaatatttcaaacgagatacccatccatctgcaaaaaatgcagtaccttgcattttcatcatttttgggaattgctctctgcctcttctttaatatcatagcgactacaactgcatgggttaagggagaaggtgtcatggtttggttgcttgccattatctacttcatatctggcgtccctggggcttatgtgttatggtatcgccctctttataacgcgatgagaactgagagtgctttgaagtttgggtggtttttcctattttacatgattcacatagtcttctgcgtgtggtcagctgtctctcccccattccctttcaaaggaaattctttgactgggattttgcctgccattgatgtcataaccaagagccttattgttgggatattttactttgttggatttggattgttctgccttgaatcactgctgagcatagctgtcattcagcaagtgtacatgtacttccgtggaagtggaaaatcccaggagttgaaacaacaggcagcacgtggtgccctgagctctgcgttctgatgaagaaaaccagcagccagagttgtagccagggtagtgagtggaaggagagaggatgtgtgccgattggaaatggtagtcttgggcatggctgcaccgtgcggatttggatcgctgaaagcatacagctatatctttttgctcttctgttaatacaaatataaggagccttctcgtgtggatactttaaggtggtgttgtttccattcgttgacatggtttttagatgtggttgatagcgaggaccgactaatattgttggtggaatatatttgcatatgtttatgtgggagtaaaattacttgttcattttggtggcagtgttgatgcagcctgctatgtttgtcaggtaaggcgattcgcttgctcgattaca

SEQ ID NO: 2262 - DNA, 1088 bp, Eragrostis curvula
  misc_feature (6)..(6): n is a, c, g, or t
  misc_feature (471)..(471): n is a, c, g, or t
  misc_feature (493)..(493): n is a, c, g, or t
ggccgnaacggctcgacgagacacgtcaaccattcgcgggaggaagtttccacctgccaccaattctcggctttcacctctatcacatgaaccagctgatttctacaatgtggacattcctcttgattcaacaaaggatctcaagaaaaaggagaaagaactgcaggctatggaggctgagctaaacaaaagggaaagggaattgaaaaggaaggaagaggccgcatcccgagctggcattgtgatagaagagaagaattggccaccctttttccctctcattcatcacaatatttcaaatgagatacctatccatctacaaaggatgcaataccttgcattttcttcattcctgggactcgtaggatgcctcttttggaatatcattgcaactacgacagcatggattaaaggggatggtgttatgatctggctgcttgccattatctacttcatatctggtgtgcctgnggcttatgtgctatggtatcgncctctttataatgcaatgagaactgagagtgctttgaagtttgggtggtttttttctgttttacattcttcatataatcttctgtgtgtggtcagctgtgtctcctccgtttccttttaaaggaaattctttcactggaattttgcctgcaattgatgccataggcaaaagcgctatcgtggggatattttactttgttggatttggtttgttctgccttgaatcacttctgaacattggtgtcattcagcaagtatatatgtactttccgtggaaatggaaaagccccggaaaagaaacaagaggccacccgcagtgctctaagttctgcattctgatgaaaatccggcaccctgattgagcccactaaatcaaaggaagaaaaaagaaagggtcaatttgagggctcggggttcttgaaatccctccattacaaaacttttgaaccgttgaaaacgcccacctgaaccaccctttatgccctctggtaaaataaaaaaaacccctttgatgggaaatgtaagggggcgggttttcctttcttgccacccgtgtggtttaaaaaaaaagcattttaaaattttttttggggggg

SEQ ID NO: 2263 - DNA, 1388 bp, Setaria italica
caacaaatccgaaattccaaacccacttcgtcaagtaaacaaccccggctaaaagtgaaagcggcagccgcgtagcagttggtcgccaccgccacgttgggaggttggactcctcccgcccccgccccgtgctgctcttccccttcccttacctcgccggagaccccgccgccgcagcaggaggaggcggccatggcggggaggtacgaccgcaacccgttcgatgaggacgacgtcaacccctttgcgggaggaagtgtacctcctgcttccaattctcggatgccacctcttcctcatgaaccagcgggcttctacaatgatcgtggtgccacagtagacatacctcttgattcaactaaggacatgaataaaaaggagaaagaactgcaggcaaaggaggctgagctaaacaaacgggaaagggaactgaaaagaaaggaggaagctgcagccagagctggtattgtcattgaagataagaactggccaccctttatgcccattattcatcatgacatttcgaatgagataccagttcacctacaaaggatgcagtacctggcattttcttcactgctgggattgacagcctgtcttttttggaacatcattgcaaccacagcagcatggattaaaggagaaggtgtgatgatctggttgctagccatcatttacttcatctctggtgtccctggggcctatgtgctatggtatcgtccactttataatgcgatgaggactgaaagtgctttgaagtttgggtggtttttcttgttttacttgctccatatactattttgtgtctggtctgctgtggctcctccatttcctttcaaaggaaaatctttggctggaattttgccggcaattgatgtcataggcaggagtgctattgtggggatattttacttcattggatttggattgttctgccttgaatcactgctcagcattgctgtcattcagcaagtatacatgtacttccgtggaagtggaaaagaagcagagatgaaacgcgaggcggcccgtggtgcactgcgaaatgccttttgatagagctgccttgctgagtggaagagaaacagggtgtggcagttggtaccgctgtcttgtacatcgctatacatatgcagtgcgtctctgagattacttatagcttatagccttcttgccttccatgtaatatataccgcatacattaccagagctttatctcttacctaggttcagatgtagctttatctcttacctaggttcagatgtgcttataggtaactattaagtttctaggggaatacgtttgcctgcctgatatgtactcttaactacttgcgtgaccatcattgttcattttatcttgatgagtgattctttgtcccactgga

SEQ ID NO: 2264 - DNA, 1277 bp, Pennisetum glaucum
cgatcattgtagaagcccgctggttcatgaggaagaggtggcatccgagaattggaagcaggaggcggccatggcggggaggtacgaccgcaacccgttcgatgaggacgacgtcaaccccttcgcgggaggaagtgtacctcctgcttccaattctcggatgccacctcttcctcatgaaccagcgggcttctacaatgatcgtggtgccacagtagacatacctcttgattcatctaaggacatgagtaaaaaggagaaagaactgcaggcaaaggaggctgagctaaacaaacgggaaagggaactgaaaagaaaggaggaagctgcagccagagctggtattgtcattgaagataagaactggccacccttcatgccgattattcatcatgacatttcaaatgagataccagttcacctacaaaggatgcagtacctggcattttcttcactgttgggattgacagcctgtcttttttggaacatcattgcaaccacagcagcatggattaaaggagaaggtgtgattatctggttgctagccatcatttacttcatctctggtgtccctggggcctatgtgctatggtatcgcccactttataatgcaatgaggactgaaagtgctttgaagtttgggtggtttttcctgttttacttgctccatatactattttgtgtctggtctgctgtggctcctccatttcctttcaaaggaaaatctttggctggaattttgccagcaattgatgtcattggcaggagtgctattgtggggatattttacttcattggatttggattgttctgccttgaatcactgctcagcatcgctgtcattcagcaagtctacatgtacttccgtggaagtggaaaagaagcagagatgaaacgcgaggcggcccgtggtgcactgcgaaatgccttttgagttttgatagagcggccttgctgactggaagagaaacagggtttggcagttggtacctccgtcttgtacatccctatgcatatggagtgcgcctgagattacttatagccttctgcccttcttgcctccatgtaatatataccgtcaacattaccagagctttatctcttacctaggttcagatctgcttataggtaacttatcaagtttttaggggaatacgtttgcctgcctgatatgtactcttaactacttgcgtgaccatcattgttatgtttatcttgatgagtagaaaaaaaaaaaagaaaaaaaaaaaaaaataaattaggaggtaatagaagtt

SEQ ID NO: 2265 - DNA, 1575 bp, Oryza sativa
caccccgtccgttcctctttgccggccgactagtctcaactctcaagtctcaaccgcccaccggtcacctggccccacctgtcggccggtgagcaagtacgcgaagaatcccacaggtcagagattagcaccagcggagacaggaagtaccactaaaataagcccctcctgaacaaatcccaaattccaaacccactaggttacgtaaaagcggaagcccggaggccggagcagttggtcgccaccgtcacgcgcgttccccttccctcgccggagagagaaaccaccgacgcggccgcttccggaggaggaggaggagttggggtggaggggagctatggcggggaggtacgaccggaaccccttcgacgaggacgacgtcaaccccttcgcgggtggaagtgtacctccagcttccaactctcggatgccacctcttcctcacgaacctgggttctataatgatcgtggtgccacagtggacatacctcttgattcaaccaaggacatgaagaaaaaggagaaagaactgcaggcaaaggaggctgagctaaacaaacgggaaagcgaattgagaagaagagaagaagctgcatccagagctgggattgtcattgaagagaaaaactggccacccttcttccctattattcatcatgacatttcaaatgagataccaatccacctacaaaggatgcaataccttgcattttcttcattgttgggattggcggcatgtcttttctggaacataattgcaactacagcagcatggattaaaggggcaggtgttatgatctggttgctagccattatctactttatatctggtgtacctggagcctatgtgttatggtatcgccccctttacaatgcgatgaggactgagagtgctttgaagtttggatggtttttcctgttttacttgatccatatactgttctgcatctggtctgctgtggctcccccatttcctttcaaaggaaagtctctggctgggattttgccggctattgatgtcataggaaacaatgctattgtggggatattttacttcattggatttggactgttctgccttgaatcactactcagcgttgttgtcatccagcaagtatacatgtatttccgtggaagtgggaaggctgctgagatgaaacgtgaggcagctcgtggtgctatgagatcggccttttgatagagctgcttcgatggacgggagagaataggatgtgtcgttctgtggtggcgccttgtacatccctacacctatgttgttcgtatctaagttattccattttacagcagcatatagctaaaggattttcctgccttaatgtaatatatgttcactggggccttttatggatacctcaagagctttttacctaggttcagatgtgcctatagttaatgttttccttttgaaatcctgcatgatcacaatggttcctagggccgtattgattctttgtggcaggaaacagtttggtttactaactatttttcttctttgttaatatataaatattaagaataaatccctgaaatacatcagaaatgcgacatattgaa

SEQ ID NO: 2266 - DNA, 1715 bp, Panicum virgatum
accgaaactttggattcgtccgaacaattgttaatcctgcaagtgctcgccgataatcgctgacagttctcttgtcctgcacaattcaagagacgcaactgcgttcgccattctgctctccacacctcgcgttgccgcgccgggcgacccggttgccgaaacgaccccacatgtcggccgcatcaccagcaggcgcagaatcgcactggtcaaccaggcaccacgcggacgcaaccaaaatcagaggcccccagacaaatccgaaattccaaacccacttcgtcaagtaaacaacaccggctaaagtgaaagcggccgccgcgtagcagttggtcgccaccgtcacgttggaggttggactcctcccgcccccgcgtcgtgctgctgctcttccccttcccttccctcgccggagaccccgccgcctcagcaggaggaggcggccatggcggggaggtacgaccgcaacccgttcgacgaggacgacgtcaacccctttgcgggaggaagtgtacctcctgcttccaattctcggatgccacctcttcctcatgaaccagcaggcttctacaatgatcgtggcgccacagtagacatacctcttgattcagctaaggacctgagtaaaaaggagaaagaactgcaggcaaaggaggctgagctaaacaaacgggaaagggaactgaaaagaaaggaggaagctgcagccagagctggtattgtcattgaagataagaactggccaccttttatgcccattattcatcatgatatttcaaatgagataccagttcacctacaaaggatgcagtatctggcattttcttcactattgggattgacagcctgtcttttttggaacatcattgcaactacagcagcatggattaaaggagaaggtgtcatgatctggttgctagccatcatctacttcatctctggtgtccctggggcctatgtgctatggtatcgcccactttataatgcgatgaggactgaaagtgctttgaagtttgggtggtttttcttgttttacttgctccatatactattctgtgtctggtctgctgtggctcctccatttcctttcaaaggaaaatctttggctgggattttaccggccattgatgtcataggcaggagtgttattgtggggatattttacttcattggatttggaatgttctgccttgaatcactgctcagcattgctgtcattcagcaagtatacatgtatttccgtggaagtggaaaagaagcagagatgaaacgcgaggcggcccgtggtgcaatgcgaaacgccttttgatagagtggccttgctgagtggaagacaaacaggttgtgacgattggtgccggcgtcttctacatccctatacatgtgcagtgcgtctctgagattacttgtagcttatagccttcttgccctcatgtaatatatactgcctacgctaccagagctttatctcttacctaggttcagatgtgtttataggtaacttaactaagattttaggggaatacgttttcctacctgatttgtactcttaactacttgcgaccatcgttcttttttatcttgagtgattatttgcaccactgagaatgtggctttgatcttgtcaaaatcatacagaaatatatactccatatgatttttgttgtctttgtttttgctgcacttgccaggtccagataataaagtattcctaa

SEQ ID NO: 2267 - DNA, 1551 bp, Zea mays
cgcaaatgcaacgcaacaagcacacctgcaccgcatgagcagcacccgaaattccaaacccacttcgtcaagcaacaacaccggctaaaaattaaaggaggcagcgcgtagcagttggtcgccaccgtcacgtacacacgctcacgttggaggctggactccgcccccgtgctgctcttcgccttgcctttctccgccggagaccccgccgcctcagctgccacaggaggaggaggcaaccatggcggggaggtacgaccgcaatccgttcgaggaggatgacgtcaacccctttgcgggaggaagtgtacctcctgcttctaattctcggatgtcagcacttcctcatgaaccagctggcttctacaatgatcgtggtgcaacagtggacatacctcttgattcaacgaaggacctaagtaaaaaggagaaagaactgcaggcaaaggaagctgagctaaacaaacgggaaagggagctgaaaagaaaggaggaagctgcagccagagctggtattgtcattgaagataagaattggccaccctttatgcccattattcatcatgacatttcgaacgagataccaattcacctgcaaaggatgcagtacctggcgttttcttcactattgggattgacagcttgcctcttttggaacatcattgcaactacagcagcatggattaaatcagaaggtgtcatgatctggttgctagcaatcatctacttcatctctggtgtccctggggcctatgtgctttggtatcgcccgctttacaatgcgatgaggactgaaagtgctttgaagtttgggtggtttttcttgttttaccttctccatatcttattctgtgtctggtcagctgtggctcctccatttccattcaaaggaaaatccttggctgggattttgccggctattgatatcataggcaggagtgctattgtggggatattttacttcattggatttggaatgttctgccttgaatcactgctcagcatcgttgtcattcagcaagtatacatgtacttccgtggaagtggaaaagctgcagagatgaagcgagaggcggcccgtggtgctatgaggaatgccttttgatagagcgacctaggcgactggaagagacacggtgtgacaatgggtaactacgttatgtacatatgctgttcgtctctgagattacttatactagcttatagccttcttgccttcatgcaatgtataccacctaccaccggagcttgatctcttacctaggttcagatgtgcttataggtaactagttttttttatacatttcctacatgatttgtactcttaactcgcgagacaattgttgttgttctttggatctcgagtgattctttgcacggcctgaaaccacttggtcttgaactttgtcagattcttgctgaagtggatattcaggtcatctttttttttctgtctttgcttactatctctttctatcaaggtttggttcagatatggtgttaggcaacagaaattctagtaacagcagaaacatgagaagatattgatgg

SEQ ID NO: 2268 - DNA, 2244 bp, Panicum virgatum
cgtcctgcacaattcaagagacgccactgcgttcggcctggctgctacacctcgccggcttgccgggcgacccggctgccgaaatgaccccacctgtcggctaccgaatcgcactggtcaagcaggcaccccggcccacggggacgcaaccaaagccgtaggagtataaaatcagaggcccccagacaaatccgaaattccaaacccacttcgtcaagtaaacaacaccggctaaagtgaaagcgttggccgccgcgtagcagttggtcgccaccgtcccgttggaggttggactcctcccgcccccgccccgtgctgctcttccccttcccttacctcgcaggagaccccgccgcagcagcagcaggaggaggccatggcggggaggtacgaccgcaacccgttcgacgaggacgacgtcaacccctttgcgggaggacgtgtacctcctgcttccaattctcggatgccacctcttcctcatgaaccagcaggcttctacaatgatcgtggtgccacagtagatatacctcttgattcaactaaggatctgagtaaaaaggagaaagaactgcaggcaaaggaggctgagctaaacaaacgggaaagggaactgaaaagaaaggaggaagctgcagccagagctggtattgtcattgaagataagaactggccaccttttatgcccattattcatcatgatatttcaaatgagataccagttcacctacaaaggatgcagtatctggcattttcttcactgttgggattgacagcctgtcttttttggaacataattgcaactacagcagcatggattaaaggagaaggtgtcatgatctggttgctagccatcatttacttcatctctggtgtccctggggcctatgtgctatggtatcgcccactttataatgcgatgaggactgcaagtgctttgaagtttgggtggtttttcttgttttacttgctccacatactattctgcgtctggtctgctgtggctcctccatttcctttcaaaggaaaatctttggctggaattttaccggccattgatgtcataggcaggagtgttatagtggggatattttacttcattggatttggaatgttctgccttgaatcgctgctcagcattgctgtcattcagcaagtatacatgtatttccgtggaagtggaaaggaagcagagatgaaacgcgaggcggcccgtggtgcaatgcgaaatgccttttgatggagtggccttgctgagtggaagacaaacagggttgtgacgattggtgccggcgtcttgtacatccctatacatacgcagtgcgtctctgagagtaacttatagccttcttgcccccatgtaatatagaccacctacgctaccagagctttatctcttacctaggttcagatgtgcttataggtaacttaagtttttaggggaatacgttttcctacctgatttgtactcttaactacttgtgtgaccatccctgttcttttttatcttgagtgattatttgcaccactgggaatgtgacttcgatcttgtcaaaatcataccgaaatatatactccatatgatttttgttctttgttttgctgcacttgctgtccaggtccagataaaatactcctaaagaaacagatttctcgggttccacgagtaaacaacagaaacataagaaggtattgctcactgtgctcaagttacgttattaaatccatgcaaagcataagaacataattattgcataatactagagctagctagctcgaaaactacaggtaaacggaagataaggcctgggaatgaaagcgaggatactgcctaaacaaactgaagaggtgaaggttctatttgctgctcggcagggcgggctttccttgttgcaccttggccccgaagccgcacttcctggtgagcaggctccacgacctccggggcttcccaagccgccggatctcctgcttcatgctcttacactccttctccagctccgacacccgcgccttcacgtcggtgatggtctccttaccctcgggcgcgtcgtcctccgcgtcggtgtccgcctctgcttgcgtgctggctgcgacggcggcgccgcccttggggaccatggcgccaccatggtgcgggcgcgcgccgtcaacccccgccgcgttttccgacacgaagaaccacccggcgatggacgtgcgcaggcggagctgctcgaagaagagcacctgcaccaccacccg

SEQ ID NO: 2269 - DNA, 1148 bp, Cenchrus ciliaris
  misc_feature (68)..(68): n is a, c, g, or t
  misc_feature (79)..(79): n is a, c, g, or t
  misc_feature (91)..(91): n is a, c, g, or t
  misc_feature (103)..(104): n is a, c, g, or t
  misc_feature (106)..(107): n is a, c, g, or t
  misc_feature (118)..(118): n is a, c, g, or t
  misc_feature (146)..(146): n is a, c, g, or t
  misc_feature (251)..(251): n is a, c, g, or t
  misc_feature (322)..(322): n is a, c, g, or t
  misc_feature (358)..(358): n is a, c, g, or t
  misc_feature (383)..(383): n is a, c, g, or t
  misc_feature (389)..(389): n is a, c, g, or t
  misc_feature (833)..(833): n is a, c, g, or t
  misc_feature (845)..(845): n is a, c, g, or t
  misc_feature (861)..(861): n is a, c, g, or t
  misc_feature (882)..(882): n is a, c, g, or t
  misc_feature (887)..(887): n is a, c, g, or t
  misc_feature (893)..(893): n is a, c, g, or t
  misc_feature (897)..(897): n is a, c, g, or t
  misc_feature (911)..(911): n is a, c, g, or t
  misc_feature (927)..(927): n is a, c, g, or t
  misc_feature (934)..(934): n is a, c, g, or t
  misc_feature (938)..(938): n is a, c, g, or t
  misc_feature (960)..(960): n is a, c, g, or t
  misc_feature (968)..(968): n is a, c, g, or t
  misc_feature (985)..(985): n is a, c, g, or t
  misc_feature (989)..(989): n is a, c, g, or t
  misc_feature (992)..(992): n is a, c, g, or t
  misc_feature (997)..(997): n is a, c, g, or t
  misc_feature (1003)..(1003): n is a, c, g, or t
  misc_feature (1006)..(1007): n is a, c, g, or t
  misc_feature (1010)..(1010): n is a, c, g, or t
  misc_feature (1012)..(1012): n is a, c, g, or t
  misc_feature (1015)..(1015): n is a, c, g, or t
  misc_feature (1024)..(1025): n is a, c, g, or t
  misc_feature (1041)..(1042): n is a, c, g, or t
  misc_feature (1050)..(1050): n is a, c, g, or t
  misc_feature (1052)..(1052): n is a, c, g, or t
  misc_feature (1071)..(1071): n is a, c, g, or t
  misc_feature (1075)..(1075): n is a, c, g, or t
gtacgaccgcaacccgttcgatgaggacgacgtcaaccccttcgcgggaggaagtgtacctcctgctnccaattctcgnatgccacctctncctcatgaaccnncnngcttctacaangatcgtggtgccacagtagacatacctnttgattcatctaaggacttgagtaaaaaggagaaagaactgcaggcaaaggaggctgagctaaacaaacgggaaagggaactgaaaagaaaggaggaagctgcanccagagctggtattgtcattgaagataagaactggccaccctttatgcccattattcatcatgacatttcnaatgagataccggttcacctacaaaggatgcaatanctggcattttcttcactgttgggantgacancctgtcttttttggaacatcattgcaaccacagcagcatggattaaaggtgaaggtgtgattatctggttgctagccatcatttacttcatctctggtgtccctggggcctatgtgctatggtatcgcccactttataatgcgatgaggactgaaagtgctttgaagtttgggtggtttttcttgttctacttgctccatatactattttgtgtctggtctgctgtggctcctccatttcctttcaaaggaaaatctttggctggaattttgccagcgattgatgtcataagcaggagtgctattgtggggatattctacttcattggatttggaatgttctgccttgaatcactgctcagcattgctgtcattcagcaagtatacatgtacttccgtggaagtggaaaagaagcagagatgaaacgcgaggcggcccgtggtncactgagaaatnccttctgatagagcgnccttgctgagtggaagagaancaggntgtganggtnccggcgttcttgtncatccctatacttatncagtgcntttntgagattacttatagcttatanccttcttnccttcatgtaatatatnccgnctncattnccaganctnnatntnttncctaggttnngatctgcttataggtnncttattangnttttaggggaatacgtttncctncctgatacgtatttttaactacttgcgtgcccatcattgttctttttattttcatgagggattttttccccca

SEQ ID NO: 2270 - DNA, 1336 bp, Triticum aestivum
ccccccgtctgtcgaaaaagccgaagtccaaagcagttggtcgctcgctccctcgcccgccaccgccgcgttggacttttccctcgccggagaaaccgccgcgaccacagccgcaaccgccgccaccgcctccggaggaggaggaggaggaggagtagtactaccagggagggaggaggccatggcggggaggtacgaccgcaaccccttcgacgaggatgacgtcaaccccttcgcgggaggaggtgtaccccctgcttctaattctcggatgccaccccttcctcacgaacctgctggattctataatgatcgcgctaccgtggacatacctcttggttcatcgaaggacttaaagcaaaaggagaaagaactgcagtcgaaggaggctgagcttaacaaacgggaaagagaacttaaaagaagggaagaagctgcagctagagctggtattgtcattgaaacgaaaaactggccaccatttatgcccatcattcatcatgacatttcaaatgagataccaatccacctacaaaggatgcagtaccttgcattttgttcattgttgggattgacgttatgcctcttttggaacatcattgcaactaccgcagcatggattaaaggggcaggtgttgtcatctggttgctagcaattatctacttcatctctggtgtccctggggcctatgtgctatggtatcggccgctttataatgcaatgaggactgaaagcgctctgaagtttggatggttttttctgctgtacttgatccatataatattctgcatctggtcagctgtgtctcccccatttcctttcaaaggaaaatctatcgctgggtttttgccggcaattgacgtcataggcagcaacgctattgtggggatattttactttgttggattcggactgttctgccttgaagcactgctcagcattgtggtcatccagcaagtatacatgtacttccgtggaagtggaaaggctgctcagatgaggcaagaggcagcacgtggtgctatgagatctgccttctgatagagcggtctcgctgatgaatggatgagaataggatgtgccagtcggtgatggcgtcttgtctttgtacatccctatacatatctgtgggtggctgagagagaatacctgtagctatagatcttcttgcattcttgtaatatataggagtgcttcattccttttctaggccccagatccatgtgctttatatgtagcttaatcttttgggagatacaacttccaccatcactattctgacgagcttgattgcaatgtcactatattatggttaatgtatgtgaagtgctaaaa

SEQ ID NO: 2271 - DNA, 949 bp, Cenchrus ciliaris
  misc_feature (941)..(942): n is a, c, g, or t
tccatttgtgatccagccagacccttcgcctgcgcccgggtcgattcgaccaaaatccaccggcttctgccccgccgccaccgcgccgcctccggcaaccgccggagccctactaggaagaggagatcttgttggaggcggaggaggagaagatggtgagctcttcgtcgccggtggtgaacgtgtacccgctcgccaactacaccttcggcaccaaggagcccaagatggagaaggacacctccgtcgccgaccgcctcgcccgcatgaaggtcaactacatgaaagaaggaatgcgcacaagtgtcgaagcaatcctattggttcaagagcacaaccacccccacatactgctcctgcaaattggaaatacattttgcaaactccctggtggacggttgaagcctggagaaaatgaaattgagggtctgaaaagaaaactgtgcagcaaacttgcagtgaactcgccctcctttccacctaactggcaggttggagagtgtgttgctgtgtggtggaggccaaactttgagactgttatgtatccttactgccctccacatatcaccaaacccaaggagtgcaagaagcttttcattgttcacctttctgaaagagagtatttcgctgttccgaggaatttgaagctgcttgctgttccactctttgaactctacgacaatgttcagcgatacgggcctgtcatctccaccatcccacaacagctttctaggttccagttcaacatggttagctcttagggcaacaagacaggaagattagagacaggaagacttacgttgagatggatcttgatgtgctgagccagctgatcgacgtatgattgattttatttcaccatgctggaatttttatctagactacaacaatgtagacatgcatttctgactgtattttgtgggtctgttctgttatcgtgnntcaaaga

SEQ ID NO: 2272 - DNA, 1127 bp, Eragrostis curvula
gggggcagaacattctcacgccctctcccttgctccgggcccgacccaacggcccagcaacctcgtctccgccgccaccctgccgcctccggcgaccgccggagctcgacaaggaaggaggaagctcgctgacgctggggacaaggaggaggagaagatggtgagctcctcgtcgcctgtggtgaacgtgtacccgctcgccaactacacgttcggcaccaaggagcccaagatggagaaggacacctccgtcgccgaccgcctcgcccgcatgaaggtcaactacatgaaagaaggaatgcgcacaagtgttgaagcaatcctattggtgcaagagcacaaccaccctcacatacttcttctgcaaattggaaacacgttttgcaaacttcctggtggaaggttgaagcctggagaaaatgaaattgaaggtctgaaaagaaagttgtgcagcaaacttgcagtgaactcgccttcctttccccctaactggcaggttggagagtgtgttgctgtgtggtggaggccaaactttgagactgtgatgtatccttactgccctccacatattaccaagcccaaggagtgcaagaagcttttcatcgttcacctgtcagaaagagagtattttgctgttccaaggaatttgaagctgcttgctgttccactgtttgaactctatgacaatgttcagcgatacgggcctgtcatctccaccatccctcagcagttgtccaggttccagttcaacatggttagctcttgaggtgacggtctggaagatagtgtgtgcaagattctcttggtgacttatgttcaaatggaccttttatgagatggaccagctgatctgcctagtacgattttatttcatactggattttatcatttctgagtatgagactggcatctaaagttctagacatgcatttcaacactttgtggaatggttcatttattgaaccccagcttgaatgtttggtgtgattgttgaaggtgccgcttctaattttttgtacctggatgtcctgtatgcttatgaagccttcggaataggttgtaatttcccggcattctttagggctgaaattttccgggaaaaatattgctggggttgtttgtagggg

SEQ ID NO: 2273 - DNA, 2240 bp, Zea mays
gagtgacactccatttaactgtctcctcaaatatttgagaatttttggtgatagatattttagtccaaaatctctcacctcttaaaatagatctacggagacgaaaataaaaaaaaactgaaattaattaatagaggtagccttgttcattccacggcatgtcgatgatggcaagggttctgctgctgtcggtccagtaaaatacagtaacaacaagaaggatgctagggcaccctgtgaaaacaaaaatagattggtccgtcgcgccatcaaggtcagcgacacggcccacgcggaccctactcttctccttgttccgtgagatccgcggtcgcgctctacaacggcatgatccggggttgcgcttaccatggggccgcacgagcgcgcgctggagctgctcgccgaaatgccgcgccgccgccgtgtccgttttgtttttccccataagaaatagaatatccaatcgaattgtcaagtgctacctgatttgaaaatgtttttccctctaggatgatctgatttcagatctcaccagaagaagcactacctggttattggaatccaaaaatttttatgtactgttttgatcagtgaaattcacacttcgctagtccaacaagctgacaggaacgggttctagacggatcggacggcacacgataacagctgccggtgtcccggaccatcctgtccatccctctataaacggagccctgtccagttgtgatcgagacccctcgcaaccgccggccgattcgagcagcgccccagcagcctctgctccgctgcctctggcgaccgccggagcccgaggaggaggaggagggaagatctcgctcgatccaaggaggtgagtacaagatggtgagctcctcgtcgccggtggtcaacgtgtacccgctcgccaactacacgttcggcaccaaggagcccaagatggagaaggacacctccgtcgccgaccgcctcgcccgtatgaaggtcaactacatgaaagaaggaatgcgtacaagtgttgaagcaatcctattggtgcaagagcacaaccatcctcacatactgctcctgcaaatcggtaatacattctgcaaacttcctggtggacggttgaagcctggagaaaatgaaatcgagggtttgaaaagaaagttatgcagcaaacttgctgtgaactcgccttcctttccacctaactggcaggttggagagtgcgttgctgtgtggtggaggccgaactttgagactgtgatgtatccttactgtcctccacatatcactaagcccaaggagtgcaagaaacttttcattgttcacctatccgaaagagagtattttgctgttccaaggaatctgaaactgcttgctgttccactgtttgaactctacgacaatgttcagaggtacgggcctgtcatctctaccatcccgcagcagctttctaggttccagttcaacatggttagctcttagggtgatgatacaagaaaaccaatgtggccaaggcagctcttcggttgctgagctagctgatcaacgtaccctgactgattttatttcattgtgctggatttttttatatagactactactatctagacatgcatttctgattgtattgttgttgaattatcctgttatgtcgcatcccatgggcagatccagtctaggatatgtacacctgataacttagttaaaaaaaagaaaagaaaaccgaaggtagtgtgtgtatagatcgtactgtagtatgcatgtaaccggatcagatccgttttcaggtagattgctctaggttgggttatttattgcattaattgcacaagctagatgccatgtgtactattgtcgaaaaggggttgcaggtcaaccttgcgtagatgttaaatgcagtctcaaatattttatccgaaggtgtgttctagtactggcatgccattgattacgtcatccaagcatatgttgttgcatcttatatgtgaatagccacatggtctgaacttaaagtttctagaggaacaagttcttcagatgatgctgcatcttacccgttggagttcttaactgttccagttgcatttgagctcgttattttcatcatcctcttcccatattgccatgtttccccttgagaatgaagtgcgctccgcattttccaagtactccacaagagagctaaagaacattctcaacaaagcatttttacccaaaaaacaaacaaacaaaccagattttggctacaa

SEQ ID NO: 2274 - DNA, 1164 bp, Pennisetum glaucum
cctcctcctgtccatttgtgatccagccagagacccttcgccaagcccacccaccaccggcctctctctgccccgccgccgcctccggcctcaccgccggagcccgaccaggaggaggagatcccgttggagccggggcggaggcggaggaggaggaggagatggtgagctcttcgtcgccggtggtgaacgtgtacccgctcgccaactacacgttcggcaccaaggagcccaagatggagaaggacacctccgtcgccgaccgcctcgcccgcatgaaggtcaactacatgaaagaaggaatgcgcacaagtgtcgaagcaatcctattggttcaagagcacaaccacccccacatactgctcctgcaaatcggaaatacattttgcaagctccctggtggacggttgaagcctggagaaaatgaaatagagggtctgaaaagaaaactgtgcagcaaacttgcagtgaactcgccctcctttccacctaactggcaggttggagagtgtgttgctgtgtggtggaggccaaactttgagactgttatgtatccttactgccctccacatatcaccaagcccaaggagtgcaagaagcttttcattgttcacctttctgaaagagagtatttcgctgttccgaggaatttgaagctgcttgctgttccactctttgaactctacgacaatgttcagcgatacgggcctgtcatctccaccatcccacagcagctttctaggttccagttcaacatggttagctcttagggcaacaaaggcaggaaagattagtgtggttggggctgctctttttttcagacttgtgttgagatggatcttgatgtgctgagccagctggtcgacgtatgatgactgattttatttcaccatgctggaactttttatctagactacagcaatctagacgtgcgtttctgactgtattttgtgggtctgttctgttaccgtcgctcaagatggcgtgtgtgtgtgtgtgtgatgtattctgtggtgctaatcgtttgtgtagttgtactgttatgccgctttaggttatgcttgtaactcgcaccagcactccatgctgtcatgtttttggttttagagcttgtaatgtttttattttacatggagcaaccactgtaagctgtaaacaggaaca

SEQ ID NO: 2275 - DNA, 1335 bp, Oryza sativa
caaaagcgaccgaaccaaaacccaaacgcgagccgagcctggtcgagacgcttctcaacgccacgccccctcacctaaccgggccgacgacccaagggcccaagcaccagccaccctctctctctctctctctctctctctctctctctcctctccgccgccgccaccccgccgcctccctcctccggcgaccgccgcgggcagagcgcgacaagagggagggaggagagctcgcccgaggtgggggcagggagcgcgaggagagggtgaggggaagatggtgagctcttcgtcgccggtggtgaacgtgtacccgctcgccaactacacgttcggcaccaaggagcccaagatggagaaggacacctccgtcgccgaccgcctcgcccgcatgaaggtcaactacatgaaagaaggaatgcggaccagtgttgaagcaatcctattggtgcaagaacacaaccatccccacatactgctgttgcaaattggtaatacattttgcaagcttcctggtggacgtttgaagcctggagaaaatgaaattgagggtctgaaaagaaagttatgcagtaagcttgcagtgaactcgccttcctttccacctaactggcaggttggagagtgtgttgctgtatggtggaggccaaactttgagactgtgatgtatccttactgccctccacatataaccaagcccaaggagtgcaagaagcttttcattgttcacctatctgaaagagagtattttgctgttccgaggaacctgaagctgcttgctgttccactgtttgaactctatgacaacgttcagcgatatgggccagtcatttccaccattccgcagcagctgtctaggttccagttcaacatggttagctcgtgaaggtgatgagagatggagattagtgtgcactaggctctatttgatgggatcttcaacgggctgaactacctaatcgacttggcatgactaatttgttctatcacagagaatttccatgaattagcttgggaaaaatattctggatccatcgttggactgttagctggacatgcatttcgactgtattttgttggattgttttgtatcacatcgcaaagctggtgcctggtgtatttttagatgatcttttgttggctctgcacgctaattgttggtgtacatggctctgtatgcttactgccttgatgttgtatgctgtagctgtaactcttcaggctgcctagcttttttttctagccaggaactccccctcttaactgtaaaaatgctttggatttaagacaacatagagaggattaagctttttacagtgttccatcacatgcaaa

SEQ ID NO: 2276 - DNA, 1070 bp, Saccharum officinarum
ctaaccgccggccaattcgactagcgctcagcagcatctgctccgccgccaccccgccgcctccggcgaccgccggagcccgagaaggaggaggagaggggagatctcgctcgatccaaggaggtgggtacaagatggtgagctcctcgtcgccggtggtgaacgtgtacccgctcgccaactacacgttcggcaccaaggagcccaagatggagaaggacacctccgtcgccgaccgcctcgcccgtatgaaggtcaactacatgaaagaaggaatgcgtacaagtgttgaagcaatcctattggtgcaagagcacaaccaccctcacatactgctcctgcaaatcggaaatacattttgcaaacttcctggtggacggttgaagcctggagaaaatgaaattgagggtttgaaaagaaagttgtgcagcaaacttgctgtgaactcgccttcctttccacctaactggcaggtcggagagtgtgttgctgtgtggtggaggccgaactttgagactgtgatgtatccttactgccctccacatatcaccaagcccaaggagtgcaagaaacttttcattgttcacctatccgaaagagagtattttgctgttccaaggaatttgaagctgcttgctgttccactgtttgaactctacgacaatgttcagcgatatgggcctgtcatctccaccatcccgcagcagctttctaggttccagttcaacatggtgagctcttagggtgtgacgcaagaaattagtgtggccaaggcagctcttctgttgacttctgttgagaacttgagatggatcattgacatgctgagctagctgatgaacgtaccctgactgattttatttcattgggctggattttttttatgtagactactactatctagacatgtatttctgattgtatttttgttgaattattctgttatatgtcgcatccgaggagcagatccagtgtaggacatatatgtacacctgaaaaaagatcgaagtagtgggtgtaaaacatatgcgtaattgctcaaaaattaccgtattaaaatactgttttat

SEQ ID NO: 2277 - DNA, 1694 bp, Panicum virgatum
aaagcccaccaccagcctgtccagactccagagtccttagttgtgatcgagcccgagacccttcactgcgcttccccaacccgagtcgatccgaccaaagcccaccagcctctgcccgccgccaccccgtcggccccgccggagccccgcagcaagaggagatctctttggagcggaggagcagggagagggggagaagatggtgagctcttcgtcgcctgtggtgaacgtgtacccgctcgccaactacacgttcggcaccaaggagcccaagatggagaaggacacctccgtcgccgaccgcctcgcccgcatgaaggttaactacatgaaagaaggaatgcgcacaagtgttgaagcaatcctattggtgcaagagcacaaccacccccacatactgctcctgcaaatcggaaatacattttgcaaacttcctggtggacggttgaagcctggagaaaatgaaattgagggtctcaaaagaaagctgtgcagcaaacttgcagtgaactcaccttcctttccacctaactggcaggtcggagagtgtgttgctgtgtggtggaggccaaactttgagactgtgatgtatccttactgccctccgcatatcaccaaacccaaggagtgcaagaagcttttcattgttcacctttctgaaagagagtatttcgctgttccaaggaatttgaagctgctggctgttccactgtttgaactctacgacaatgttcagcggtacgggcctgtcatctccaccatcccccagcagctttctaggttccagttcaacatggttagttcttagggcagcaagacaggaagattagtttggcggaggctgctcttttgtcagacttatgttgagatggatctttgacatgtgctgagccagcggatcgacgtattatgactgattttatttcaccatgccggaattttatctagactacaacaatctagacatgcatttctgactgtattttgttggcatattctgttacaagctggtgcgtgatgtactgtatgttagattgttgttgcttgttctgtcatgctaactggttgtgtagatgttcgtctgtatgcttgttctgccgcattggattatgttgtaacttcaccagctcttcgggctgccatgttttttttttggtcttggagcttgtaatgtttatctgcacggagcaacccgtgtcccgtgtaagctgtaaacatgcacattggcacatcttgtcttaggaagttaggatagatgataagagtacacatgattggatatttgaaaacatctcgttccatcgttatcatcatgattcactaatccttgtgtaatgatgagtgcaaatggttttattactgggtacgaacataatgtgattttgagccctttggttttagcttgtcaggcgaaactaacacttaccaccggagacccagtcgagaacagagcatactaggaagcgtaagcgtaagaacccaccacagacatggacaagcagctacaggtacgggtacggggacgctggaactctggaagaggttgtgggcatatacggagtatatgaccagatgcattcaaaactggggcatatgcctgccatctcgtatagaccggtgatttggagatgagagctcttgtttatccttctagtatcggcgcaccgcgcacgaacttgcattgctcattaaat

SEQ ID NO: 2278 - DNA, 1312 bp, Panicum virgatum
cccaacccgagtcgatccgaccaaagcccaccagcctctgcccgccgccaccccgtcgcctcggcgaccgccggagccccgcagcaagaggagatctctttggagcggaggagcagggagagggggagaagatggtgagctcttcgtcgcctgtggtgaacgtgtacccgctcgccaactacacgttcggcaccaaggagcccaagatggagaaggacacctccgtcgccgaccgcctcgcccgcatgaaggtcaactacatgaaagaaggaatgcgcacaagtgttgaagcaatcctattggtgcaagagcacaaccacccccacatactgctcctgcaaatcggaaatacattttgcaaacttcctggtggacggttgaagcctggagaaaatgaaattgagggtctcaaaagaaagctgtgcagcaaacttgcagtgaactcaccttcctttccacctaactggcaggtcggagagtgtgttgctgtgtggtggaggccaaactttgagactgtgatgtatccttactgccctccgcatatcaccaaacccaaggagtgcaagaagcttttcattgttcacctttctgaaagagagtatttcgctgttccaaggaatttgaagctgctggctgttccactgtttgaactctacgacaatgttcagcggtacgggcctgtcatctccaccatcccccagcagctttctaggttccagttcaacatggttagttcttagggcagcaagacaggaagattagtttggcggaggctgctcttttgtcagacttatgttgagatggatctttgacatgtgctgagccagcggatcgacgtattatgactgattttatttcaccatgccggaattttatctagactacaacaatctagacatgcatttctgactgtattttgttggcatattctgttacaagctggtgcgtgatgtactgtatgttagattgttgttgcttgttctgtcattgctaactggttgtgtagatgttcgtctgtatgcttgttctgccgcattggattatgttgtaacttcaccagctcttcgggctgccatgttttttttttgggtcttggagcttgtaatgtttatctgcacggagcaacccgtgtcccgtgtaagctgtaaacatgcacattggcacatcttgtcttaggaagttaggatagatgatagagtacacatgattggatatttgaaaacatctcgttccatcgttatcatcatgattcactaatccttgtgtaatgatgagtgcaaatggttttattactgggtacgaacataatgtg

SEQ ID NO: 2279 - DNA, 1071 bp, Panicum virgatum
tatcaacgcagagtggccattacggccgtgatcgagactgagacccttcgcagcgcctccccaaacccgagtcgattcgaccaaagcccaccagcctctgtgcccgccgccacaccgccgcctccggcgaccgccggagccccacaacaagagatctcgttggagcggaggagcaggaagagggggagaagatggtgagctcttcgtcgccggtggtgaacgtgtacccgctcgccaactacacgttcggcaccaaggagcccaagatggagaaggacacctccgtcgccgaccgccttgcccgcatgaaggtcaactacatgaaagaaggaatgcgcacaagtgttgaagcaatcctattggtgcaagagcacaaccacccccacatactgctcctgcaaatcggaaatacattttgcaaacttcctggtggacggttgaagcctggagaaaatgaaattgagggtctcaaaagaaagctgtgcagcaaacttgcagtgaactcgccttcctttccacctaactggcaggttggagagtgtgtcgctgtgtggtggaggccgaactttgagactgtgatgtatccttactgccctccgcatatcaccaagcccaaggagtgcaagaagcttttcattgttcacctttctgaaagagagtatttcgctgttccaaggaatttgaagctgctggctgttccactgtttgaactctacgacaatgtccagcgctacgggcctgtcatctccaccatcccccaacagctttctaggttccagttcaacatggttagctcttagggcaacaagacaggaagattagtttggtggaggctgctcttttgccagacttatgttgagatggatctttgacgtgctgagccagcggattgacgtatcatgactgattttatttcaccatgccggatttttctagactgcaacaatttagacatgcatttctgactgtattttgttggtttattctgttacaagctggtgcgtgatgtatgttagattattgttgttttatctgtcatgctaatttatgtagatgcacgtctgtatgctt

SEQ ID NO: 2280 - DNA, 1000 bp, Panicum virgatum
ccaaacccgagtcgattcgaccaaagcccaccagcctctgtgcccgccgccacaccgccgcctccggcgaccgccggagccccacaacaagagatctcgttggagcggaggagcaggaagagggggagaagatggtgagctcttcgtcgccggtggtgaacgtgtacccgctcgccaactacacgttcggcaccaaggagcccaagatggagaaggacacctccgtcgccgaccgccttgcccgcatgaaggtcaactacatgaaagaaggaatgcgcacaagtgttgaagcaatcctattggtgcaagagcacaaccaccccccacatactgctcctgcaaatcggaaatacattttgcaaacttcctggtggacggttgaagcctggagaaaatgaaattgagggtctcaaaagaaagctgtgcagcaaacttgcagtgaactcgccttcctttccacctaactggcaggttggagagtgtgtcgctgtgtggtggaggccgaactttgagactgtgatgtatccttactgccctccgcatatcaccaagcccaaggagtgcaagaagcttttcattgttcacctttctgaaagagagtatttcgctgttccaaggaatttgaagctgctggctgttccactgtttgaactctacgacaatgtccagcgctacgggcctgtcatctccaccatcccccaacagctttctaggttccagttcaacatggttagctcttagggcaacaagacaggaagattagtttggtggaggctgctcttttgccagacttatgttgagatggatctttgacgtgctgagccagcggattgacgtatcatgactgattttatttccccatgccggatttttctagactgcaacaatttagacatgcatttctgactgtattttgttggtttattttgttacaagctggtgcgtgatgtatgttagattattgttgttttatttgtcatgctaattgtttatgtagatg

SEQ ID NO: 2281 - DNA, 1484 bp, Sorghum bicolor
aaaagtttaattcctgcagtcctgctaggctactacgactacgagacaccaccggcaatcgaacaagttgactggaacggcttcgagatggatcggacggttcacgttaacagctgccggtgtctcggaccatcctgtccatccctctatagaggaagccgtgtccagttgtgatcgagacccttcgcaacgcctcccctaaccgccggccaattcgaccagagcccagcagccactgctccgccgccaccccgccgcctccggcgaccgccggaccccgaggaggagtaggagaggggagatctcgctcgctcgatccaaggaggtggggacaagatggtgagctcctcgtcgccggtggtgaatgtgtacccgctcgccaactacacgttcggcaccaaggagcccaagatggagaaggacacctccgtcgccgaccgcctcgcccgtatgaaggtcaactacatgaaagaaggaatgcgcacaagtgttgaagcaatcctattggtgcaagagcacaaccaccctcacatactgctcctgcaaattggaaatacattttgcaaacttcctggtggacggttgaagcctggagaaaatgaaattgagggtttgaaaagaaagttgtgcagcaaacttgctgtgaactcgccttcctttccacctaactggcagattggagagtgtgttgctgtgtggtggagaccgaactttgagactgtgatgtatccttactgccctccacatatcaccaagcccaaggaatgcaagaaacttttcattgttcacctgtccgaaagagagtattttgctgttccaaggaatttgaaactgcttgctgtcccactgtttgaactctacgacaatgttcagcgatatgggcctgtcatctccaccatcccgcagcagctttctaggtttcagttcaacatggtgagctcttagggtgatgacatgacagcttatgtggccaaggcagctcttctgttgacctctgttgagaacttgagatggatcattgacatgctgagctagctgatgaacgtaccctgactgattttatttcattgtgctggatttttttaatctagattactactatctagacatgtatttctgattgtatttttgttgaatattctgttatatgttgcatccgaggagcagatccagtgtaggacatatatgtacacacctgatagctttttatttttattttttttaatatcgaagttagtaagcatatgcatgtaactggatcagatccggatgggaggggcgtaccacgtagtgactgacgtagatgctcgtcgccggcgaagggcctgacgaagtgggaaataggtaaaaaagacacgatagaggatgtgaacgcaacgacgccaatggaccatgttttctccaatttcctctttttttttttctgttttcattgttataataatctttgtggttagtttataacaatcctcatctttccctgt

SEQ ID NO: 2282 - DNA, 1367 bp, Zea mays
ttgaaacggctgcgagatggatcgtacggttcacgttaacagctgcccggtgtcccggaccatcctgtccatccctaaacgaagccctgccccgttctgaattgtgatcgagacgagacccttcgaccttcgcaacgcctccccagcaacctctgctccgccgcctccggcgaccgccggaacccgtggtggaggaggacgtggagagggaagatctcgccagatccaaggaggtggggacaagatggtgagctcctcgtcgtcggtggttaacgtgtacccgctcgccaactacacgttcggcaccaaggagcccaagatggagaaggacacctccgtcgccgaccgcctcgctcgcatgaaggtcaactacatgaaagaaggaatgcgtacaagtgttgaagcaatcctattggtgcaagagcacaaccaccctcacatactgctcctgcaaatcggaaatacattctgcaaacttcctggtggacggttgaagcctggagaaaatgaaatcgaaggtttgaaaagaaagctgtgcagcaaacttgctgtgaactcgccttcctttccacctaactggcaggttggagagtgtgttgctgtgtggtggaggccgaattttgagactgtgatgtatccttactgccctccacatatcaccaagcccaaggagtgcaagaaacttttcatcgttcacctatccgaaagagagtattttgctgttccaaggaatttgaagctgcttgctgttccgctctttgaactctacgataatattcagcgatatgggcctgtcatctccaccatcccgcagcagctttctaggttccagttcaacatggtgagctcttagacggtgtccagcagtttacccatatagtcatccaaaacattgtttttgtactatagactgcactgttcgcagagtggagtttaaatataggtatgtggatgagtaagctgctgagatagacttagggtgatgacacaagaagatagtgtggccaagacagctgttttgttgacttccgttgagatggatcttcaacatgctgagctagctgatcaacgtgccttgactggtttcatttcattgtgctggattttttttatctagacatgtatttcttattgtatttttgttgaattactgtgttacgtatcatcccaggggcagatccactttaggtcacatgtacacctggtagcttttgttttttctttttccatttaaaaaagcgaagttagtgtgtataaagcatatgcatgtaactggatcaaatcctcatgcaaatagcctgcctttgggagggtttgaggtactcggtttaggcgtttaggccctctccaactgattttccgtatac

SEQ ID NO: 2283 - DNA, 1345 bp, Brachypodium distachyon
agcggcccgcacgcgcctctgtatgccgcaaaaccggccgagcccaaagacgcctttgcccctcgcgcgatcgagacaagagacgggacccttctccccaaacctggcccgacccgaaagcccaccagccgctttcttctcctcgccgccgccgcctccgcctccggcgacccccggagcccgagaaggagcaagagcgagagttcagcgaggcgaaggaaggaggaggagatggtgagcggctcgtcgtcgtcggtggtgaacgtgtacccgctcgccaactacacgttcggcaccaaggagcccaagatggagaaggacacctccgtcgccgaccgcctcgcccgcatgaaggtcaactacatgaaagaaggaatgcggacaagtgttgaagcaatcctgctggtgcaagagcacaaccatcctcacatactcctgttgcaaattgggaatacattttgcaaacttcctggtggacggttgaagcctggagagaatgaaattgatggcctgaaaagaaagctgtgcagcaaacttgcagtgaactcaccttcctttccacctaactggcaggttggggagtgtgttgctgtctggtggaggccaaactttgagactgtgatgtatccttactgccctccacatattaccaagcccaaggagtgcaagaagcttttcattgttcacctaactgaaagggagtatttcgccgttccaaggaacttgaagctacttgctgttccactgtttgaactatatgacaatgttcagcggtacggacctgtcatttccactatccctcaacagctgtctaggttccagttcaatatggtgagctcgtaagggtgatgagatatgaagagaagcatgtgttaaggcctctttcgtcaacacattggcagatggactgtcgacgtgttgaactagctgatcaacttagcatgacccatttgttttatcataccgattttctctgaattatgcatcgttagactgtaatctagacatgcatttcgacaatttgtttggcgattctcttattactcgttatgtgccggtgcaaggtgtattatttagataattatatgttgctgtccggcgctaattattcgtgtatgtatcgacgtatgtttgtattcttctgatgctgtctgtagttagaactctatgctcttgttttcattctgcagaatgatctgtggtgcgcaaggagctatacctaacaccttcggatcataataagttctagttttgtttttttagtgcaaataaatttgtaatcttaaattgatgtcgttgttttagtacaagtttgaactaaaacaacaacaagaatttaagatcg

SEQ ID NO: 2284 - DNA, 1189 bp, Avena sativa
ggacttcgatccagacgagacgagacccttctcaacgccttcccctccaaaccggcccgatccgaaccaaagcccaccaccagcctcctctcttctccgccgccgccacctccggcgaccaccggaaccccgagaaagaagagcgagtgcccggcgaagcggaggaggaggagatggtgggcgcctcgtcgtcgtcggtggtcaacgtgtacccgctcgccaactacacgttcggcaccaaggagcccaagatggagaaggacacctccgtcgccgaccgcctcgcccgcatgaaggtcaactacatgaaagaaggaatgcggacaagtgttgaagcaatcctgttggtgcaagagcacaatcacccccacatactgctattgcaaattgggaacacattctgcaagcttcctggtggacggttgaagcctggagaaaatgagattgagggcctgaaaaggaagttgtgcagcaaacttgcagtgaactctccttcatttccacccaactggcaggttggtgagtgtgttgctgtctggtggaggccaaactttgagaccgtgatgtatccttactgccctccacatataaccaagcccaaggagtgcaagaagcttttcattgttcacctgactgaaagggagtatttcgctgttccaaggaacctgaagctactcgctgttccactgtttgaactctatgacaatgttcagcggtacgggcctgtcatttccaccatcccacagcagctgtccaggttccagttcaacatggtgagctcgtaagggcgatgatggcacaaggcctctctcggcgacgcgttcagatagctcttcgaaatcaaactggctgatcaacttagcatgacttttattcagtgaccgaatttaatgaattatatacaccaccgttagtctccataaactagacgtgcactctgacttctgtttatttatgtggcgcttcggttatacaaactcaatactgggtacgtggtggtgtactttcagataatcatttgtagttctgctgagctaatatgtttgtgcgtatatgtactgatgtatgtttgtatgatttgggtggtctgttgtagtgaactctttaggcctcctttcttctggcgaagaacctcctgccgatgttttgcaaagagctaccgtctgttcaaatcgtaagcttttttaag

SEQ ID NO: 2285 - DNA, 1056 bp, Pseudoroegneria spicata
cagccccaagcctcacaaaaaaaaaaaaaaacccccgcacaacctctcctccgccgccgccgccaccaccggcgaccaccggagcccgagaagaaagcgcgagcgccccgcgaatcgaagcggaggagatggtgggcgcctcctcgtcgtcggtggtgaacgtgtacccgctcgccaactacacgttcggcaccaaggagcccaagatggagaaggacacctccgtcgccgaccgcctcgcccgcatgaaggtcaactacatgaaagaaggaatgcggacaagtgttgaagcaatcctactggtgcaagagcacaatcacccccacatactgttattgcaaattgggaacacgttttgcaaacttcctggtggacgtttgaagcctggagaaaatgaaattgagggcctgaaaagaaagttgtgcagcaaacttgcagtgaactcaccttcttttccacctaactggcaggttggtgagtgtgttgctgtctggtggaggccaaactttgagactgtgatgtatccttattgccctccacatataaccaagcccaaggaatgcaagaagcttttcattgttcatctaactgaaagagagtatttcgctgttccaaggaacttgaagctacttgctgttccactgtttgaactctatgacaatgttcagcggtatggacctgtaatttccaccatcccgcagcagctgtctaggttccagttcaacatggtgagctcgtaagggtgatgacatggtgtccccaaggcctctttcggcaacccactccgagcgtctcttcgacatcgaactggctaatcgacttagcatgactcgttttctcagtaaccatgtttccatgaattatgcggcactattagtctaaaaactagacatgtacttatgtttgtcgttcattttgtgattccgttattacatctcaaatgtgttgtatgtgtggtgtattttgtggttgttgttccgtgttctaatatatttgtgtatatgtaccaatgtatgtatatttataatttgcatgatctgctgtagtaactcttca

SEQ ID NO: 2286 - DNA, 1124 bp, Triticum aestivum
cccaccatcagcctctcctcccccgccgccgccaccaccggcgaccaccggagcccgagaagaaaaccgcgagcgccccgcgaatcgaagcggaggagatggtgggcgcctcgacgtcgtcggtggtgaacgtgtacccgctcgccaactacacgttcggcaccaaggagcccaagatggagaaggacacctccgtcgccgaccgcctcgcccgcatgaaggtcaactacatgaaagaaggaatgcggacaagtgttgaagcaatcctactggtgcaagagcacaatcacccccacatactgttattgcaaattggaaacacattttgcaaacttcctggtggacgtttgaagcctggagaaaatgaaattgagggcctgaaaagaaagttgtgcagcaaacttgcagtgaactcaccttcctttccacctaactggcaggttggtgagtgtgttgctgtttggtggaggccaaactttgaaaccgtgatgtatccttattgccctccacatataaccaagcccaaggagtgcaagaagcttttcattgttcatctaactgaaagagagtatttcgctgttccaaggaacttgaagctacttgctgttccactgtttgaactctatgacaatgttcagcggtatggacctgtaatttccaccatcccgcagcagctgtctaggttccaattcaacatggtgagctcgtaatcagtagtggtgatgagatgtgaagattagtccagtaagatgtattgagatggatcttggacgaagcaccaaactagatgctgatcaacttagcatgactccttatttaggcgccaattttcataaactagatgctcattccgactgtcttttatttggcgatgcatgctgttcatgcagctcaggctggttagatacgtggtgtattattatttggatggtaatcggttgttgctccggcgcgctaatctgttcatgtgtatgtacgtacgtacgtagcaatgcacgtatgtctgtatgattgctatggtctcctgtagtagtaactacggtgcatcggttcttcgtcactgacgctatgcattttatacagttgctggcttgtctacgtctgtagtatcactatatacttat

SEQ ID NO: 2287 - DNA, 1131 bp, Secale cereale
tcggaaaggaggaaggggcctgtctgtatatcgcgaaaccgacccgaggcccaagcagcgaccgagacgcccaccctgacccgaccccgaccccacccccgccaccacccagcctcaccgcctcccgcgccgccaccgccaccggcgaccaccggagcccgagaaggaaagcgcgagcgccccgcgaatcgaagcggcggagatggtgggcgcctcgacgtcgtcggtggtgaacgtgtacccgctcgccaactacacgttcggcaccaaggagcccaagatggagaaggacacctccgtcgccgaccgcctcgcccgcatgaaggtcaactacatgaaagaaggaatgcggacaagtgttgaagcaatcctactggtgcaagagcacaatcacccccacatactgttattgcaaattgggaacacgttttgcaaacttcctggtggacgtttgaagcctggagaaaatgaaattgagggcctgaaaagaaagttgtgcagcaaacttgcagtgaactcaccttcctttccacctaactggcaggttggtgagtgtgttgctgtttggtggaggccaaactttgagaccgtgatgtatccttattgccctccgcatataaccaagcccaaggaatgcaagaagcttttcattgttcatctaactgaaagagagtatttcgctgttccaaggaacttgaagctacttgctgttccactgtttgaactctatgacaatgttcagcggtatggacctgtaatttccaccatcccgcagcagctgtctaggttccagttcaacatggtgagctcgtaagggtgatgagatagtgttcccaaggcctctttcggcagcccactctgagcgtctcttcgacatcgaactggctaatcgacttagcatgactcgttctctgagtaaccatctttccatgaattatgcggcactattagtctaaaaaccagacatgtacctatgtttatcgttcattttcagattcggttagtacatctcaactgtgttgtttgtgtggtgtattttgtggttgttgttccgtgttctaatttatttgtgtatatgtaccaatatatgtatttataatttgcataatctgctgtagtaactcttcatac

SEQ ID NO: 2288 - DNA, 1318 bp, Secale cereale
tctaggttccagttcaacatggtgagctcgtaagggtgatgagatagcgtccccaaggcctcttttggcaacccacccgaccccgaccccaccccgcaccaccagcctcacctcccccgccgccaccgccaccggcgaccaccggagcccgagagaaagcgcgagcgccccgcggatcgaagcggcggagatggtgggcgcctcgacgtcgtcggtggtgaacgtgtacccgctcgccaactacacgttcggcaccaaggagcccaagatggagaaggacacctccgtcgccgaccgcctcgcccgcatgaaggtcaactacatgaaagaaggaatgcggacaagtgttgaagcaatcctactggtgcaagagcacaatcacccccacatactgttattgcaaattgggaacacgttttgcaaacttcctggtggacgtttgaagcctggagaaaatgaaattgagggcctgaaaagaaagttgtgcagcaaacttgcagtgaactcaccttcctttccacctaactggcaggttggtgagtgtgttgctgtttggtggaggccaaactttgagaccgtgatgtatccttattgccctccgcatataaccaagcccaaggaatgcaagaagcttttcattgttcatctaactgaaagagagtatttcgctgttccaaggaacttgaagctacttgctgttccactgtttgaactctatgacaatgttcagcggtatggacctgtaatttccaccatcccgcagcagctgtctaggttccagttcaacatggtgagctcgtaagggtgatgagatagtgtccccaaggcctcttttggcaacacaccccgagcgtctcttcgacatcaagctggctaatcgacttagcatgactcgttttctcagtaaccaagttaccatgaattatgcggcactattagtctaaaaactagacatgtacctatgtttatcgttcattttcagattcggttagtacatctcaactgtgttgtttgtgtggtgtattttgtggttgttgttccgtgttctaatttatttgtgtatatgtaccaatatatgtatttataatttgcataatccgctgtagtaactaaacttaaaaaaaaaaaaaaaaaaaacaaaaaaaaaaaaaaacaaaaaaaaaaaaaaaaacaaaaaaaaaaaaaacaaaaaaaaaaaacaaaaaaaaaacaaaaaaaacaaaaacaaaaacaacaaacaacaacaatacaacataacatacacatacacacacacgactacataacgtagacgtacacgacgtagagtagagacgag

SEQ ID NO: 2289 - DNA, 1182 bp, Triticum aestivum
gaattcggcacgaggcacctgacccgacccgacctttaccccccaccaccagcctcgcctcccccgccgccgccaccaccggcgaccaccggagcccgagaagaaaagcgcgagcgccccgcgaatcgaagcggaggagatggtgggcgcctcgacgtcgtcggtggtgaacgtgtacccgctcgccaactacacgttcggcaccaaggagcccaagatggagaaggacacctccgtcgccgaccgcctcgcccgcatgaaggtcaactacatgaaagaaggaatgcggacaagtgttgaagcaatcctactggtgcaagagcacaatcacccccacatactgttattgcaaattgggaatacattttgcaaacttcctggtggacgtttgaagcctggagaaaatgaaattgagggcctgaaaagaaagttgtgcagcaaacttgcagtgaactcaccttcctttccacctaactggcaggttggtgagtgtgttgctgtttggtggaggccaaactttgaaaccgtgatgtatccttattgccctccacatataaccaagcccaaggaatgcaagaagcttttcattgttcatctaactgaaagagagtatttcgctgttccaaggaacttgaagctacttgctgttccactgtttgaactctatgacaatgttcagcggtatggacctgtaatttccaccatcccgcagcagctgtctaggttccagttcaacatggtgagctcgtaagggtgatgggattgtgtccccaaggcctctttcggcagcccactccgagcatctcttcgacatcaaactggctaatcaacttagcatgacttgttttctcagtaaccatgtttccatgaattatgcggcattcgcactattagtctaaaaactagacatgtacctatgtttgttctttcattttgcgattccgttagtacatctcaactgtgttgtatgtgtggtgtattttgtggttgttgttccgtgttctaatttatttgtgtatatgtaccaatgtatgtatttataatttgcatgatctgctgtagtaacttgtcagactcgctttctattgtccgccgagaattgggaatgttttgtaaggagctaccccttcaaattacaagcttccttattattttcggcagtgtaccataatcttttaagct

SEQ ID NO: 2290 - DNA, 1238 bp, Hordeum vulgare
tgaggacgcccaaccccgacaaacaggaacagtcctgaccctcgcagcaaaagcccgcaccaccctcctccgccgccaccgccaccgccaccgccaccgccggcaaccaccggatccggagaagaaagaggcagcgcccggccaagcgaagcgggggaggagatggtgggcgccccgacgtcgtcggtggtgaacgtgtacccgctcgccaactacacgttcggcaccaaggagcccaagatggagaaggacacctccgtcgccgaccgcctcgcccgcatgaaggtcaactacatgaaagaaggaatgcggacaagtgttgaagctatcctactggtgcaagagcacaatcacccccacatactgttattgcaaattggaaacacattttgcaaacttcctggtggacgtttgaagcctggagaaaatgaaattgagggcctgaaaagaaagctgtgcagcaaacttgcagtgaactcaccttcctttccacctaactggcaggttggtgagtgtgttgctgtttggtggaggccaaactttgagaccgtgatgtatccttattgccctccacatataaccaagcccaaggaatgcaagaagcttttcattgttcatctaactgaaagagagtatttcgctgttccaaggaacttgaagctacttgctgttccactgtttgaactctatgacaatgttcagcggtatggacctgtaatttccaccatcccacagcagctgtctaggttccagttcaacatggtgagctcgtaatcaatggtggtgatgagatgtgaggatatctccattaagatttattcagatagatcttggacgaaacaccaaaatagacgctgatcaacttagcatgactcccttcttaaatgagatcaccgatttccatagttcgactataaacagatgtgcattcctactgtgttttcatttggcgatgttgttaattcagctcatgctggttagttgcatggtgtatcgttagatgatactccctctgtaaactaatataagaatgtttagatcactaaagtagtgatccaaacgcttttatattagtttacggagggagtaatatgttgttgctccggagcgctaattcattgttgtgtacgctgcttaccagtgtatgtttgtatgattgctgtgatctgctgtagtagcaactgtgtagaagccaccccttcaaatcatatatcataggactatgactattgaccttt

SEQ ID NO: 2291 - DNA, 1205 bp, Triticum aestivum
cggcacgaggggagagacgcccaacccacccccacaaacccccactgccaagaacggccccgaacctcaccaaaaaaaaagcccgcaccacctctcctcccccgccgccaccgccggcaaccaccggatccggagaagaaagaggcagcgcccggcgaagcgaagcgggggaagagatggtgggcactccgtcctcgccggtggtgaacgtgtacccgctcgccaactacacgttcggcaccaaggagcccaagatggagaaggacacctccgtcgccgaccgcctcgcccgcatgaaggtcaactacatgaaagaaggaatgcgaacaagtgttgaagcaatcctattggtgcaagagcacaaccacccccacatactgttgttgcaaattggaaacacattttgcaaacttcctggtggacggttgaagcctggagaaagtgaaattgagggcctgaaaaggaagctgtgcagcaagcttgcagttaactcaccttcctttccacctaactggcaggttggtgagtgtgttgctgaatggtggaggccaaactttgaaaccgtgatgtatccttactgccctccacatataacaaagcccaaggagtgcaagaagcttttcattgttcacctaactgaaagggagtatttcgctgttccaaggaacttgaagctacttgctgttccactgtttgaactatatgacaatgttcagcggtatggaccagtgatttccaccatcccgcagcagctgtccaggttccagttcaacatggtgagctcgtaatcaatggtggcgatgagatgcgaggattagtcgagtataagatgtactgagatggatcttggacgaagcaccaactactagatgctgatcaacttagcatgactccttatttagtcgccaattttcataaactagatgctcattccgactgccttttatttggcgatgcgtgctgttaatgaagctcaggctggttagatacgtggtgtattattgtttggatggtaatcggttgttcctccggtgcggtgcggtgcgctaatctgttcctgtgtacgtactgtaggcgatggccggagatgtatgcctgtaacgtacgtacgtaggcgatgtatgcctgtaattgctatggtctgctgtagtactagtggctacggtgcatgggttcgtcgtcactgacgctatgcattttatgaa

SEQ ID NO: 2292 - DNA, 1204 bp, Triticum aestivum
cggcacgaggggagagacgcccaacccacccccacaaacccccactgccaagaacggccccgaacctcaccaaaaaaaaagcccgcaccacctctcctcccccgccgccaccgccggcaaccaccggatccggagaagaaagaggcagcgcccggcgaagcgaagcgggggaagagatggtgggcactccgtcctcgccggtggtgaacgtgtacccgctcgccaactacacgttcggcaccaaggaggccaagatggagaaggacacctccgtcgccgaccgcctcgctcgcatgaaggtcaactacatgaaagaaggaatgcgaacaagtgttgaagcaatcctattggtgcaagagcacaaccacccccacatactgttgttgcaaattggaaacacattttgcaaacttcccggtggacggttgaagcctggagaaagtgaaattgagggcctgaaaaggaagctgtgcagcaagcttgcagttaactcaccttcctttccacctaactggcaggttggagagtgtgttgctgaatggtggaggccaaactttgaaaccgtgatgtatccttactgccctccacatataacaaagcccaaggagtgcaagaagcttttcattgttcacctaactgaaagggagtatttcgctgttccaaggaacttgaagctacttgctgttccactgtttgaactatatgacaatgttcagcggtacggaccagtgatttccaccatcccgcagcagctgtccaggttccagttcaacatggtgagctcgtaatcaatggtggcgatgagatgcgaggattagtcgagtataagatgtactgagatggatcttggacgaagcaccaaactactagatgctgatcaacttagcatgactcgttatttagtcgccgattttcataaactagatgctcattccgactgccttttatttggcgacgcgtgctgttaatgaagctcaggctggttagatacgtggtgtattattgtttggatggtaatcggttgttcctccggtgcggtgcggtgcgctaatctgttcctgtgtacgtactgtaggcgatggccggagatgtatgcctgtaacgtacgtacgtaggcgatgtatgcctgtaattgctatggtctgctgtagtactagtggctacggtgcatgggttcgtcgtcactgacgctatgcattttatg

SEQ ID NO: 2293 - DNA, 1284 bp, Hordeum vulgare
aggcccagatgggtcttggtcaaggacgcccaaccccgacaaacaggaacagtcctgaccctcgcagcaaaagcccgcaccaccctcctccgccgccaccgccaccgccaccgccaccgccggcaaccaccggatccggagaagaaagaggcagcgcccggccaagcgaagcgggggaggagatggtgggcgctccgtcctcgccggtggtgaacgtgtacccgctcgccaactacaccttcggcaccaaggaggccaagatggagaaggacacctccgtcgccgaccgcctcgcccgcatgaaggtcaactacatgaaagaaggaatgcgaacaagtgttgaagcaatcctattggtgcaagagcacaaccacccccacatactgttgttgcaaattggaaatacattttgcaaacttcctggtggacggttgaagcctggagaaagtgaaattgagggcctgaaaaggaagctctgcagcaagcttgcagttaactcaccttcctttccgcctaactggcaggttggagagtgtgttgctgaatggtggaggccaaactttgaaaccgtgatgtatccttactgccctccacatataagcaagcccaaggagtgcaagaagcttttcattgttcacctaactgaaagggagtatttcgctgttccaaggaacttgaagctgcttgctgttccactgtttgaactctatgacaatgttcagcggtatggaccagtgatttccaccatcccgcagcagctgtctcggttccagttcaacatggtgagctcgtaatcaatggtggtgatgagatgtgaggatatctccattaagatttattcagatagatcttggacgaaacaccaaaatagacgctgatcaacttagcatgactcccttcttaaatgagatcaccgatttccatagttcgactataaacagatgtgtattcctactgtgttttcatttggcgatgttgttaattcagctcatgctggttagttgcatggtgtatcgttagatgatactccctctgtaaactaatataagaatgtttagatcactaaagtagtgatccaaacgcttttatattagtttacggagggagtaatatgttgttgctctggagcgctaattcattgttgtgtacgctgcttaccagtgtatgtttgtatgattgctgtgatctgctgtagtagcaactgtgtagaagccaccccttcaaatcatatatcataggaccatgactattgaccttttctttctttgctctgttgactctgct

SEQ ID NO: 2294 - DNA, 1247 bp, Secale cereale
gactgcacacaccaaaaaaccgcacccatctaaaaaaaacccgcaccacctctcctccccccgccgccaccgccggcaaccaccggatccggagaagaaagaggcagcgcccggcgaagcgaaagcggaggaagagatggtgggcgctccgtcctcgccggtggtgaacgtgtacccgctcgccaactacaccttcggcaccaaggaggccaagatggagaaggacacctccgtcgccgaccgcctcgctcgcatgaaggtcaactacatgaaagaaggaatgcgaacaagtgttgaagcaatcctattggtgcaagagcacaaccacccccacatactgttgttgcaaattggaaacacattttgcaaacttcctggtggacggttgaagcctggagaaagtgaaattgagggcctgaaaaggaagctgtgcagcaagcttgcagttaactcaccttcctttccacctaactggcaggttggagagtgtgttgctgaatggtggaggccaaactttgaaaccgtgatgtatccttactgccctccacatataacaaaggccaaggagtgcaagaagcttttcattgttcacctaactgaaagggagtattttgctgttccaaggaacttgaagctgcttgctgttccactgtttgaactgtatgacaatgttcagcggtatggaccagtgatttccaccatcccgcagcagctgtccaggttccagttcaacatggtgagctcgtaatcaaatggtggtgtgatgagatgtgaagattagtccagtaagatgtattgagacggatcttggacgaagcgccaaactagatgctgatcaacttagcatgactccttatttagtcgccaattttcataaactagatgctcattccgactgccttttatttggcgatgcgtgctgttaatgaagctcaggctggttagatacgtggtgtattattatttggatggtataatcggttgttcctccggtgcggtgcgctaatctgttcctgtgtacgtatgtacgtagcgatgtatgcctgtacgattgctatggtatgctgtagtactagtgactacggtgcatgggttcgtcgtcactgatgctatgcattttatacagttgctggcttgtctatggctgtattatcactatatacttttaattttaaacaaaaaaaaaaaaaaacaaaaagaaaaaaaaaaaacaacaacaacacacacacacacacacacacacacac

SEQ ID NO: 2295 - DNA, 835 bp, Festuca arundinacea
  misc_feature (12)..(12): n is a, c, g, or t
  misc_feature (47)..(47): n is a, c, g, or t
  misc_feature (84)..(84): n is a, c, g, or t
  misc_feature (146)..(146): n is a, c, g, or t
  misc_feature (159)..(159): n is a, c, g, or t
  misc_feature (177)..(177): n is a, c, g, or t
  misc_feature (222)..(222): n is a, c, g, or t
  misc_feature (226)..(226): n is a, c, g, or t
  misc_feature (229)..(229): n is a, c, g, or t
  misc_feature (255)..(255): n is a, c, g, or t
  misc_feature (270)..(271): n is a, c, g, or t
  misc_feature (787)..(787): n is a, c, g, or t
ggcggagcggcngaggaggagatggtgagcgcctcgtcgtcggcggnggtgaacgtgtacccgctcgccaactacacgttcggnaccaaggagcccaagatggagaaggacacctccgtcgccgaccgcctcgcccgcatgaaggncaactacatgaangaaggaatgaggacaagngttgaagcaatcctgttggtgcaagagcacaatcacccccacatnctgntgntgcaaattgggaatacattttgcaancttcctggtggacgnntgaagcctggagaaaatgaaattgagggcctgaaaagaaagctgtccagcaaacttgcagtgaattctcctacttttccacctaactggcaggttggtgagtgtgttgctgtctggtggaggccaaactttgagactgtgatgtatccttactgccctccgcatatagccaagcccaaggagtgcaagaagcttttcattgttcacctgactgaaaaggagtatttcgctgttccaaggaacctgaagctacttgctgttccactgtttgagctctatgacaatgttcagcggtatgggcctgtcatttccaccatcccgcagcagctgtccaagttccagttcaacatggtgagctcgtaagggtcatgggacggcaacacatgaagatggacctttgacaccaaactggctaatcaacttagcatgacttgtttattcagtgaccaagttttcatgaattatgcaccaccgttagtctacaaactaggcatgcactccgactgtcttttattgngcgatttctgttattgttagaaaatttctcgctgttctgctgcgctga

SEQ ID NO: 2296 - DNA, 943 bp, Musa acuminata
gttcgggttcgcctggtactttcggccgccggtcaagcgtagagccagagagcgacgcaggcgaggaggaagaggagggatggtgacctcgtcggtggtgaacacgtaccccctctcgaactacacgttcgggacgaaggagcccaagatggagaaggacacctccgtcgccgatcgcctcgcccgcatgaaggtcaactatatgaaagaaggtatgcggacaagtgttgaaggaattttactggtccaggagcacaatcatccgcacatactgttactgcaaataggcaatactttctgtaagcttcctggtggacgtctaaagcctggggagaatgaattagagggtctgaaacgaaagctttgtagcaaacttgctgcaaattcaccttcctttctgccgaattggcagatcggtgaatgtgttgctacctggtggaggccgaactttgaaacagtaatgtacccatactgccctcctcatataactaagcccaaggaatgtaagaaacttttccttgtgcacctgtcagaaagagaatattttgctgttcccaaaaacttgaagttgcttgcggttccattatttgaactatatgacaatgttcagagatatgggcccgttatatctacaattccacaacagttgtcgaggttccagttcaacatggttacatcatgaaactgatgaagctaatattgatgacctccaaggaaattcaatggtaggaacttgcttagctactaatttgaagcattcgatcttgttggatactcggctatctaagttagtacttcaaaattgtatggtcctaataagttaccagcaactcctattttttcatattaactgggttgcagaatcaagaaaaggttttttccttgctgctgctcaaagtatttggtatttggggaagatatacaaaataaaataaaaacttag

SEQ ID NO: 2297 - DNA, 1079 bp, Musa acuminata
atccaagttgaactcaacagggacgtgttacctattacgctgcaatttatcggtttctttcagacgctgccggcggccgatcacctgagagacccagcggaggcgaggagggagaaaaggggaggggagaagaggagaggagagagagagatggtaaactcatcggtggtgaacatgtacccactatcgaactacacgttcggcacgaaggaggcgaagatggagaaggacacgtccgtcgctgatcgcttggcccggatgaaggtcaactatatgaaggaaggaatgcggacaagtgttgagggtattctactggttcaggagcacaatcatccccatatactgttactgcaaataggaaatacattttgtaagctccctggtggacgtttaaagcctggagagaacgagattgaaggtctgaggcgaaagctttgtagcaaacttgctgcaaattcaccttcatttcaaccgaactggcagattggtgagtgtgttgccatttggtggagacccaattttgaaactgttatgtatccatattgtcctcctcatattaccaagcccaaggagtgtaagaagcttttcctcgttcatctgtcagaaagagaatattttgctgttccaaaaaatttgaagttgcttgctgttcccttatttgaactctatgacaatgttcagagatatggtcctgttatctcgaccatcccacaacagttgtcgagattccagttcaacatggtctcctcatgaagctgatgcgaacaaattatgaaacataattcttcagcaatggagtcaaattgatgttaatgcagtcgcaaaattctgaagtgaacccatcccgaccctgccctttacataagactctgaatcatcatgtatatttgacatttactcatatgaacacgaaacacgagtcatctataattaacttctaactcatgttttctgtattgatgtcctgaggcttggtacaagtgggagaaaacaagaggttttatttgaatgctgagaaaattgtacatgttggaatggagctgcttgatcatgatcctggtgctcatctcaaaaacaag

SEQ ID NO: 2298 - DNA, 622 bp, Musa acuminata
gcgacgcaggcgaggaggaagaggagggatggtgacctcgtcggtggtgaacacgtaccccctctcgaactacacgttcgggacgaaggagcccaagatggagaaggacacctccgtcgccgatcgcctcgcccgcatgaaggtcaactatatgaaagaaggtatgcggacaagtgttgaaggaattttactggtccaggagcacaatcatccgcacatactgctactgcaaataggcaatactttctgtaagcttcctggtggacgtctaaagcctggggagaatgaaatagagggtctgaaacgaaagctttgtagcaaacttgctgcaaattcaccttcctttctgccgaattggcagatcggcgaatgtgttgctacctggtggaggccgaactttgaaacagtaatgtacccatactgccctcctcacataactaagcccaaggaatgtaagaaacttttccttgtgcacctgtcagaaagagaatattttgctgttcccaaaaactttaagttgcttgcggttccattatttgaactatatgacaatgttcagagatatgggcccgttatatctacaattccacaacagttgtcgaggttccagttcaacatggtt

SEQ ID NO: 2299 - DNA, 836 bp, Musa acuminata
aagttgaactcaacagggacgtgttacctattacgctgcaatttatcggtttctttcagacgctgccggcggccgatcacctgagagacccagcggaggcgaggagggagaaaaggggaggggagaagaggagaggagagagagagagatggtaaactcatcggtggtgaacatgtacccactatcgaactacacgttcggcacgaaggaggcgaagatggagaaggacacgtccgtcgctgatcgcttggcccggatgaaggtcaactatatgaaggaaggaatgcggacaagtgttgagggtattctactggttcaggagcacaatcatccccatatactgttactgcaaataggaaatacattttgtaagctccctggtggacgtttaaagcctggagagaacgagattgaaggtctgaggcgaaagctttgtagcaaacttgctgcaaattcaccttcatttcaaccgaactggcagattggtgagtgtgttgccatttggtggagacccaattttgaaactgttatgtatccatattgtcctcctcatattaccaagcccaaggagtgtaagaagcttttcctcgttcatctgtcagaaagagaatattttgctgttccaaaaaatttggagttgcttgctgttcccttatttgaactctatgacaatgttcagagatatggtcctgttatctcgaccatcccacaacagttgtcgagattccagttcaacatggtctcctcatgaagctgatgcgaacaaattatgaaacataattcttcagcaatggagtcaaattgatgttaatgcagtcgcaaaattctgaagtgaa

SEQ ID NO: 2300 - DNA, 961 bp, Phalaenopsis aphrodite
ccattcttttccggcggcggagacgcaagcacgggctaaaggagagaggaggaaagcaggcgaaaaaatggtgtcgccggtggtaaacacgtatcctctctctaactacactttcggaatgaaggaaccgaagatggagaaggacacttccgtcgccgaccgtctagctcgtatgaaggttaactatatgaaagaaggtatgcggctgagcgttgaggcaattttactggttcaggagcacaatcatcctcacatactgctgctgcaaattggtaatactttctgcaaacttcccggtggtcgtttgaaacctggtgagaatgaggttgaaggcttaaaacgaaagctgtgcagcaaacttgctgttaactcacctgcctttcagccaaattggcaggttggtgaatgtgttgctatctggtggagaccaaactttgaaacagtcatgtatccttattgtcctccacacatcaccaaacccaaggagtgcaagaagcttttcattgttcacttgtctgaaagggaatattttgccgttccaaaaacttaaattacttgctgttccattattcgagctttatgataatgttcagaggtacgggccagtgatctccacaatcccacagcagttatcgaggttccacttcaacatggtgcgtcaatgaaaccggcgagccaagtctcatcatcatttgttacttctcagagagattggctgtgtattttcatcatagcgagctagccttttagaaagtatgtggcttcctcaaggcttggaagctgataggagttcagcatgtttaggattttaataattctacttgaaatatttgcttgctcaagtttctgtgtatcttcaatcaaaggttttgaaaaccggatccagccggtttggttggtacgaccgcgggtgtggttcgattggttaattgttgacacggttcttggttttgtgtgagtt

SEQ ID NO: 2301 - DNA, 1028 bp, Elaeis guineensis
gagagagagggaaggagggagggaggggcgaagagcgggcgaaagatgggagtgttgccggtggtgaacacatacccgctgtcgagctatacgttcgggacgaaggagccgaagatggagaaggacacctccgtcgccgatcgcctcgctcgtatgaaagtcaattacatgaaagaaggtatgcgtacaagtgtggaagcaattttgctggtgcaggagcacaatcatcctcatatattgttactgcaaattgggaatacattttgtaaactccctggtggacgtctgaagccgggagagaatgaaattgagggcttgaaacgaaagttgtctagtaagcttgctgctaactcaccatcccatcagccaaattggcaggttggagagtgtgttgctgtctggtggaggccaaactttgaaacagtaatgtacccatactgtcctccccacatcaccaagccaaaggagtgtaagaagctcttccttgttcacttgtccgaaagggaatactttgctgtacccaaaaacttgaaattgcttgctgttccattgtttgagctctatgacaatgttcagagatatgggcctgttatttccacaattccacaacaattgtctaggttccagttcaacatggttaatgcctgaaactggggacagtgaagaggaaattttgcaaggatatttgataaatatatcaaagtttgactgtcaggatgatgcaaataccggagcttctcaaacaagtgtagtgtttgcttggtattgtatgttgtattcacctacaattgcagatttatttctagttggttcatacctcttgtttatcctccacattccatgtattggaaggttgcttatttagtgaacaaaattcgcatgatggttgcctaagaaggcttgcatttgtgatggtgtttgtaagaaccattaagtgcgaatcattgacttctttaccattggttcgctgctccttgttgagctataatcaaggttttaaatatcatgggatagaattgtcccgcttt

SEQ ID NO: 2302 - DNA, 908 bp, Elaeis guineensis
gtttgagagccgaggagggggaagagatggtaacgtcaccggttgtgaatatgtaccctctctcgaactacacgttcgggacgaaggagccgaagatggagaaggacacttccgtcgctgatcgccttgctcgcatgaaggtcaactatatgaaggaaggcatgcggatgagtgctgaggcaattttactggtgcaggagcacaaccatccccatatattgctattacaaattggaaatacattttgtaaacttcctggtggacgtttgaagcctggagagaacgaaattgagggtttgaaacggaagctgtctagcaaacttggggccaactcaccttcctttcagcaaaattggcagattggggagtgcgttgctgtgtggtggagaccaaactttgaaacaataatgtacccatattgtcctcctcatatcaccaagcccaaggagtgtaagaagctttttcttgttcacttgccggaaagagaatactttgctgttcccagaaacttaaagttgcttgctgttccattgtttgaactgtatgacaatgttacgagatatggacctgttatctcaaccattccacaacaattatcaagatttcagttcaacatggttagttcgtgaagatggtaggctgttttacagcaaagttcatcgattgactgatccacccagaccttcaaaatgtgcatgccgcagcaagatgaatgaaacttacccaatctaacttgaactccttagcttacgtgatatattgcctgcttaaactttttgtgtgcacctatagaatttgttgatctgtgtatggggttttcttcgtttcaaatgtaaggttgacatcaacagttggacttccgagtgatcatagtgtgtagtttagaaaaaaatatagactaatctcta

SEQ ID NO: 2303 - DNA, 967 bp, Ambrosia trifida
acttaaattttggtaagttacattgaaagtctcctccatccctctttaactcaaaatcaaagactttggaacaaatatatcatttgatcttcagtctatcgatacccacattaagattcatcgatagatcacaaagatggtgagttcatcagtggtaaacacataccctttatccagctactcttttggcaccaaagaacctaaaatggagaaagatacatccgttgctgatcgtcttgctcgtatgaaactcaactatatgaaggaaggtatgaggaccagtgtcgaggcaatcttactggtgcaagagcataatcatccccacattcttcttctgcaaattggcaacacattctgtaagcttcctggtggtcggctgaagcctggagaaaacgaagttgaaggcttgaaaagaaagttgtcaagcaaacttgctgctaattcgcctaacatgcaacctaattggcagattggtgagtgcgtggctgtatggtggaggccaaactttgaaactatcatgtacccatattgtcctccacacatcacaaaacccaaggaatgcaagaagctatatgttgtacacctatcggaaagagagtacttcgcagtgcccaaaaatctgaaacttcttgctgtaccactgtttgagctttacgataatgttcagagatatggaccagtgatttcaaccattcctcaacagctctccagatttcagttcaacatgatttcctcatgaatatgcatcagatttgagcacttgcattcagagatttagacttgatatcaaactttcttcagaagttatcgtattaacagaacccgacctatagattaaattcagtgtaactttggcagtgtgttgtacttgtttgtggtaactagagatggttcagttcagtccgtttaggtgggataaagactctataattttgcttattttgactttttatttaattaaaaaaag

SEQ ID NO: 2304 - DNA, 1011 bp, Euonymus alatus
gatcggatctagcattccctcacagaggcagagtcaccggattcatcgtctccttgctgaacagtgaacactccataccgagattcacctaaatggttcgtgtgtgacaactgacaagtgcgatagggtttcgaagttaagtcggagaagaaaagagagaccgtgatacagagagatggtgtcgtcgccggtggtgaacacttatcctttgtcgagctacaccttcggcaccaaggagcctaagatggagaaggatacttccgttgccgatcgccttgctcgcatgaaagtcaactatatgaaagagggtatgaggaccagtgtggaagcaatcctcttggtccaggaacataatcatcctcacatacttctactgcaaattgggaacacattctgcaagcttcctggtggccgtctgaagccgggagaaaatgaaattgagggcttgaagagaaagctgaccagcaaactaggtgccaattcacctgccatggtaccagattggcagattggcgagtgtgttgctatttggtggagaccaaactttgaaactataatgtatccatattgcccaccacacataacgaagcccaaggagtgcaagaagcttttcattgttcacttgtccgaaagagagtactttgcagtgcccaagaatctgaaactgttggctgttccgttgtttgaactctatgataatgttcagcggtatgggccagtcatatcaaccattcctcagcaactttcaagatttcagttcaatatgattaccatgtgacttcttctctttgtggatttcatgaccctattaatggatggtagtgctgatatgttgtgcggcctaacagacctttttttccccgttctttaatattagatcgagtgtcctaggataggataggataggatatgaaggtgattagctggaacttatcttgacttgctctatatctgttgacatacaagtgtctagattctttgtttgagtgttgaaaatggttagtatcttag

SEQ ID NO: 2305 - DNA, 994 bp, Flaveria ramosissima
ctattcttttgtcataattttgtgatttaaatttggggaaattacaacaaagtctctagccctacctgcaaatcaaagtggatttgtatttcatctttgattttgatctccatttttgtatctgtgcgagagatcgacaaagatggtgggttcttcagtcgtaaacacataccctttatccagctactccttcggcaccaaagaacctaaaatggagaaagatacttctgttgcggatcgtcttgctcgtatgaaactcaactatatgaaggaaggaatgaggaccagtgttgaagcaatcttactggtgcaagagcataatcatcctcacattcttcttctgcaaattggcaacacattctgtaaacttcctggtggtcgactgaagcccggagaaaatgaaattgagggcttgaaaagaaaattatctagcaaacttgcagctaattcccctaatatgcaacctaattggcagatcggcgagtgtgtagctgtatggtggaggccaaactttgaaactattatgtacccatattgtcctccacacatcacaaaacccaaggaatgcaagaaactttatgttgtacacttgtcggaaagagagtactttgcagtgcccaaaaatctgaaacttcttgctgtaccactgtttgagctttacgataatgttcagagatatggacctgtaatttcaaccattcctcagcagctttccagatttcagttcaacatgatatcatcatgaacatgcatcagattcaagcatttgcattcagaaatctagatttggtgacaaacattcttcaaaagttatcgtatttacagaactcgatctaaggattaatttcagtctaactttgcagtttgttgtacctgtttgtgagtttgtggtagactatatctttactattttgacttgtatcttattcatagtagattgctttggttagacaattcagttgttgtttggtagtttatctttcttgtgctgata

SEQ ID NO: 2306 - DNA, 866 bp, Flaveria ramosissima
atttgattttgatctccatttttgatctgtgcgagagatcgatagagatggtgggttcttcagtcgtaaacacataccctttatccagctactccttcggcaccaaagaacctaaaatggagaaagatacttctgttgcggatcgtcttgctcgtatgaaactcaattatatgaaggaaggaatgaggaccagtgttgaagcaatcttactggtgcaagagcataatcatcctcacattcttctcctgcaaatcggcaacacattctgtaaacttcctggtggtcgactgaagcccggagaaaatgaaattgagggcttgaaaagaaaattgtccagcaaacttgctgctaattcccctaacatgcaacctaattggcagatcggcgagtgtgtggctgtatggtggaggccaaactttgaaactattatgtacccatattgtcctccacacatcacaaaacccaaggaatgcaagaaactttatgttgtacacttgtcggaaagagagtactttgcagtgcccaaaaatctgaagcttcttgctgtaccactgtttgagctttacgataatgttcagagatatggacctgtaatttcaaccattcctcagcagctttccagatttcagttcaacatgatatcctcatgaacatgcatcagattcaagcatttgcattcagaaatttagatttggtgacaaacattcttcaaaagttatcgtgtttacaaaactcgatctaaggattaatttcagtctaactttggcagtttgttgtacctgtttgtgactttgtggtagactatatctttactattttgacttgtatcttattcatagtagattgctttggttagacaattcagt

SEQ ID NO: 2307 - DNA, 1063 bp, Elaeis guineensis
atttatctgccttcacgcggagagagacttcgacgaggcaaagcagcttcctcctctttctcttctcctagttccttgggccgccgtcggaccaagaggaccccaagatggtaacgtctacggcggtgaacatgtacccgctcgcgaactacactttcgggacgaaggagcccaagatggagaaggacacctccgtcgccgatcgcctcgctcgcatgaaggtcaactatatgaaagaaggtatgcggacgagtgttgaggcgattttactggtacaggagcacaaccatccccatatattgctactgcaaattggaaatacgttttgtaaacttcctggtggacgtctgaagcctggagagaatgaaattgagggtttgaaacggaagctgtctagcaaacttggtgccaactcaccttccttccagcaaaattggcagattggagagtgtgttgctgtgtggtggaggccaaactttgaaacagcaatgtacccatattgtcctcctcatattaccaagcccaaggagtgtaagaagctttttcttgttcacctgccagaaagagaattctttgctgttcccaaaaacttgaagttgcttgctgttccattgtttgaactgtatgacaatgtttcgagatatggacctattatctcaaccattccacaacagttatcaaggttccagttcaacatggtcagttcgtgaagatggtaggcgggtttcatgatagagttcttgattaactgatcctcaggaccttcaaaatgtgcatgcagcagcaagataaatgaagctagtccaacgtaacttgagcgcctttggttactcaatttattgtttatttttctgtgcaaacatatagaactggttgatccatgcatgggattttcttcttttatatgtaagcttgacatgggcagttggacttacaagctgtcatcatgtagtctataaaaaagattggctcatctatagttccgatgttaggttagagaatacgtaagagggctgaaacagatgagagaccgatagctattgcatgttgaagcttacgtgtg

SEQ ID NO: 2308 - DNA, 1159 bp, Phalaenopsis aphrodite
cgtaactaccgacccccggtttggttcgaataaaactttacccttacgtacgacttagtaatttaagttttagtactttccgttagtactacgacgacgaagtaactaacctagttcgttcctacgaagtacttgttacccgttaccctgggaagagttttcgtttacgtaaggtcccgacccctaattactacttacttacgtaattaccctaaccctaacactttaatttaaggttaggtagactttcccgttacgtactacgaagtagtagtaattaactaactactacaaaattaagcgcgacgctggcagaagtttcttcaggcggcggcggcgctcttctccctgattggcgtcccaagactcccaactcgaaactgtggaattctgcgcgcgagtgcgcgtgaagcagcagagcagtgcgaagaagggaagatgttgtccccgacctcgccagtggtgaacgtataccccctctcgagctacaccttcggcgtgaaggaaccgaagatggagaaggacacctccgtcgccgatcgcctcgctcgaatgaaagtgaattatatgaaggagggaatgaggacaagtgttgaagcaatccttctggtacaagaacacaaccatccccatatactgctacttcaaattggaaacacgttttgtaaacttcctggtgggcgcttgaagcctggagaaaatgaaattgagggcttaaagaggaagttgtctagcaaacttgcagcgaattcatcggttcaccagccaaactggcaaattggagaatgtgctgcagtctggtggaggccaaattttgaaactgtgatgtacccatactgtcctccacatatcaccaaaccgaaggagtgcaagaaacttttcgttgttcacttgtcggagagggaatactttgctgtaccgaaaaacttgaagctgcttgctgttccactgtttgaactttatgacaatgtccagagatatggcccagttatatccaccataccccagcagttatctagatttcagttcaagatggtaaatccttgaaagtttaagggcttaactgcattgctcactgatacttctgcagtgggagttcaagaggaacattgttgccttcaattttggataattttgattgattttatcatagtttttt

SEQ ID NO: 2309 - DNA, 915 bp, Helianthus annuus
tctctcaacttcgattacaaaactttcgatccccacttgatagatcgagaaagatggtgagttcatcagtcgttaacacataccctttatcgagctactctttcggcacaaaagaacccaaaatggagaaagatacctctgttgcagaccgtcttgctcgtatgaaactcaactatatgaaggaaggtatgaggaccagcgtcgaagcaatcttactggtgcaagagcataatcatccccacattcttcttctgcaaatcggcaacacattctgtaaacttcctggtggtcgactgaagcctggagaaaacgaagttgaaggcttgaaaagaaaattgtcaagcaaacttgctgctaattccccgaatatgcaacctaattggcagattggtgagtgtgtggctgtatggtggaggccaaactttgaaactattatgtacccatattgccctccgcacatcacaaaacccaaggaatgcaagaagctttacgttgttcacttatcggaaagagagtactttgcagtgcccaaaaatctgaaacttctcgctgtaccactctttgagctttacgataatgttcagagatatggaccagtaatttcaactattcctcaacagctctccagattccagttcaacatgatttcttcatgagcgtgcatcagattcgagcatttgcattcagaaatttagatcctatatcaaactttcttcaaaagtatcgtattaatagaacccgacctatagattaaattcagtctttaactttggcagtttgttgtacttgtttgtgataaagattgttcagttcagtttgctgattaatttgtgacgcggataaagacgatatgttgactattttgacttgtatgttgttcatcgaagtcgcccttttctttggtcaatacagtcg

SEQ ID NO: 2310 - DNA, 915 bp, Helianthus annuus
ctctcaacttcgattacaaaactttcgatccccacttgatagatcgagaaagatggtgagttcatcagtcgttaacacataccctttatcgagctactctttcggcacaaaagaacccaaaatggagaaagatacctctgttgctgaccgtcttgctcgtatgaaactcaactatatgaaggaaggtatgaggaccagcgtcgaagcaatcttactggtgcaagagcataatcatccccacattcttcttctgcaaatcggcaacacattctgtaaacttcctggtggtcgactgaagcctggagaaaacgaagttgaaggcttgaaaagaaaattgtcaagcaaacttgctgctaattcccctaatatgcaacctaattggcagattggtgagtgtgtggcggtatggtggaggccaaactttgaaactattatgtacccgtattgccctccgcacatcacaaaacccaaggaatgcaagaagctttatgttgttcacttatcggaaagagagtactttgccgtgcccaaaaatctgaaacttctcgctgtaccactctttgagctttacgataacgttcagagatatggaccagtaatttcaactattcctcaacagctctccagattccagttcaacatgatttcttcatgaacgtgcgtcagattcgagcatttgcattcagaaatttagatccgatatcaaactttcttcaaaagtatcgtattaatagaaccccccgacctatagattaaattcagtcttttaactttggcagtttgttgtacttgtttgtcatagagattgttcacttcagtttgctgcttaagacgatatattgactattttgacttgtatgttgttcatcgaagtcgcccttttctttggtcaatacagtcggttggacttggaag

SEQ ID NO: 2311 - DNA, 659 bp, Capsicum annuum
ggcgacatctaatccctcgtcattttcacagcgaatcacacaaagaggaagcaaaaatggtaacgtcttcggttgtgaacacatatccactgtccagctatacctttggtactaaggaacctaaaatggagaaggacacctccgttgccgatcgccttgctcgtatgaaagtcaactatatgaaggagggcatgaggactagtgtcgaaggaattctcttggtacaagaacacaatcatcctcacatcctccttctgcaaattgggaacacattctgcaaacttccaggtggacgcttgaaaccaggagagaacgaaatcgagggtttgaaaaggaaactctctagtaaacttgcagctaattctcctggccttcagccaaattggcagataggtgagtgtgtggccatctggtggaggccaaattttgaaactataatgtatccatactgccctccacacataacaaaacccaaggagtgtaagaagctcttcgttgttcatctatctgaaagagagtactttgctgtcccaaaaaatctgaagcttctcgcagtgccattgtttgaactttatgacaatgttcagagatatggacctgtgatatccacgattcctcaacagctttccagattccagttcaacatgatccacccatag

SEQ ID NO: 2312 - DNA, 849 bp, Zostera marina
acgagtgataaataggggcagggcaataaagaaaaacggagagggggcgaagctgatagtcggaagggatggtgacatcggctgtggtaaacgcgtacccattatcgagctacacgtttggacagaaagagcctaagatggagaaggatacctctgtcgccgatcgccttgccaggatgaaagtcaactacatgaaagagggtatgcggacaagtgtggaggcgattctattggtgcaggaacataatcatcctcatatactattattacaaattggaaatacattctgcaaactccctggtggacgcctgaagcctggagagaatgaaattgagggtttaaaaagaaagctatctagtaaacttgctgcaaatgtgcctactcttcaacctaattggcagatcggagagtgtgttgccacttggtggagaccaaactttgagacagtcatgtatccatattgtccacctcacatcacgaaacctaaggaatgcaagaaactcttccttgtccatctttcagaacgtgaatattttgcagttccaaagaacttgaagttgcttgctgttccattattcgaactctatgataatgttcagagatatggacctgtcatctccaccataccacaacaactatccaggtttcagtttaacatggtgaacccttgaatttgatcatcaagtttgtagtgacaactgacaacaatggaaacataactatcgaatttagctcttagggcattgtttatctattgaaaatttataatctcatctgtcattattgaagctctcataattatttaactttcatcattcatgtacttgttatttctttatcttttttatt

SEQ ID NO: 2313 - DNA, 1091 bp, Amorphophallus konjac
ggagccaaggcggcgtcagtctattccgcggcctcttccgggagaacgaggggagctcaaagaggtgacggcgccggagagctatcgaggcgagacgggagtggagggatggtgaactcgtcggtgaacatctaccccctatcgagctacaccttcgggacgaaggagccgaagatggagaaggacacatcagtggccgatcggctcgcccggatgaaggtcaactatatgaaagaaggcatgcgtacaagcgtcgaagcaattctactggtgcatgagcataaccatccccacatactgctgctgcagattgggaataccttttgcaaacttccaggtgggcgcttgaagcccggggaaaatgaaattgagggtctgaagaggaaactttctagtaaacttgctgctagttcttttcaaccaaattggcagattggagaatgcgttgctacttggtggagaccaaactttgaaactataatgtatccatattgcccacctcacatcactaagcccaaggagtgtaagaaacttttccttgtgcacttatctgaaagagagtactttgctgtgccgaagaacttgaagttgcttgctgttccattgtttgaactttatgacaatgttcagagatatgggccagtcatctccactataccacagcaattgtcacggttccagttcaacatggtcagtccatgaatggagataaaatcacagcctaattcaccaacttatctgtttggagaggcacttcttgagaccagaagccgtcattaacaccagtcagaagctagtctgcttaactttgtgttttgagataaatttatttagttccagtttgctatataatgatataaatttgccatgtttttgtctcccccacctgacgggcactatgttcttcccctcgtgctaagtaccgttcctcattagtttatagatgtcaatcttgtcacaatatacaataaacattttttttcatttatggaccatgctttgacattaccctgagcttgtttcctgattacctgtttaacatggacttcctaagctgaaggaactgcatgtaaccttggctggcgtttgaa

SEQ ID NO: 2314 - DNA, 1102 bp, Malus domestica
tctctccccgtctcggctctctcccacctccatttcttccgatcagtcgccctcgaaattaaaatccggttgggattttcagacagagagagaatttgagagagaaggagtagagagagaaatggtgatgtcggcggtggtgaacacgtacccactgtcgagctacacgttcgggaccaaagagccgaagatggagaaggacacttccgtcgccgatcgcctcgcccgcatgaaagtcaattacatgaaagagggaatgcggaccagcgtcgaagcgattttactggtacaggagcataatcatccccacatacttctcctgcagattggaaacacattctgcaaacttcctggtggacgactgaagccaggggagaatgaaattgaggggttgaaaagaaagctgaccagcaagcttggtgctaattcacctgcccttgtaccagactggcagataggagagtgcgtggctatctggtggaggccaaactttgaaaccataatgtacccatattgccctcctcacataacaaaacccaaggagtgtaagaagcttttccttgttcacttatctgagagggagtactttgctgtccccaaaaacctaaaacttcttgctgttccattgtttgagctctatgataacgttcagagatatgggcctgttatatctacaatcccacagcagctttccagattccagtttaacatgatcagttcatgaagagaggaattttgaagtatatcactatccagtatactaaagatcacatcttgatatatcattgcgtggatagctagaactcaagacaagatgttatttttataactgaacttaagttggttagtgtgagatccgtcagtttatacagatgaccgaagcatatcttgtggtatgatttgtccatctatatttggttagtgattgtctttgctaaatgcgttttacgttactcttgaaactttgtctgaacagtggttatgttgtgcaagttcttgtttcttatcaagaaggtctgtcagttactttagacacgggagtgatacaatgttgtctcagttctgttttccgattctcaaaatttgagattttgtacgttaa

SEQ ID NO: 2315 - DNA, 1168 bp, Cucumis sativus
gcctgacatttaaacaaattaacccgcaaagctcgcaaggaactgatcgcaggtcgtcaccaaggtttcttcttctttacttcttcccggctttgctcggcagctgcagagtgaacacagccatggtgacgtcgccggtggtgaacacgtatccactttccagctataccttcggtaccaaagagccgaagctcgagaaggacacctctgtcgctgatcgtcttgctcgcatgaaagtcaactatatgaaggaaggcatgaggacaagtgttgaagcaattctgctggtgcaagaacataaacatccccatattctactattgcaaataggcaacaccttctgcaagctccctggaggacggttgaagccaggagaaaacgaaattgaaggtttaaagaggaagctcacaagcaaactgggtgcaaattcgccctcactccagcctgattggcagattggtgaatgtgtggcgatttggtggagaccaaactttgaaaccgtcatgtatccttattgcccccctcatattacgaaacccaaggaatgcaaaaagctcttcattgttcacttgtctgaaagagagtacttcgccgttcctaaaaatttgaagctgcttgcagttccgttgtttgagctctatgacaatgtgcagagatatggaccagttatctcgacgataccgcagcagctttccaggtttcagttcaacatgatcaccacatgagaggttacagtacaagagcccttaaatttgtagcaggaattgacttcaatttgcttgagatagttagaacttagaggacattatcatcaaccttgcttgagatagattagcatacttgtgatagactttcttgttctcgaccttttcgtcgttgatgtgtttgcaaggcaaaattatgttgttgcttctaacaagattcaactgagtttgtgtatcattttagtgtgataaaagttttagaagtgtaatgtatgtctattgaatcaattcttaaagccaaaatcagcatcgctaaatggttattggcatgatctttttgaggtgtgggaggatcgaacccgtatcctcactattttgttgtgcactcgtgctaaaaacaaggttacttggacgttttggtttcgagcttccaagacaatgatagtattggctctttgtatatc

SEQ ID NO: 2316 - DNA, 783 bp, Curcuma longa
gaggtgaagacgagaaagatggtgtcgtctccggtggtaaacacttaccctctttccaactacaccttcggggcgaaggagcccaagatggagaaggacacgtccgtggccgatcgtctcgcccgcatgaaactcaactatatgaaagaaggcatgcggacaagtgttgaagggatattgttggtgcaggagcacaaccacccacatatacttctactgcaaataggaaatactttctgtaaactccctggtggacgtctgaaacctggagaaaatgaaattgagggcctgaagcggaaactttcaagcaaacttgctccaagttcagcttctttccagcctaattggcagatcggggagtgtgttgcgacgtggtggaggccaaactttgagacagtaaggtacccatactgccctcctcacattagtaagccaaaggaatgcaagaaacttttcatcgttcacctctcagaaagagagtattttgctgttcccaaaaactagaagttgcttgctgttccattatttgaactgtatgacaatgttcagaggtagggacctgttatctctacaattcctcaacagctctcaaggttccagttcaacatggtcacatcatgaaactactggatttaagtggatcatattgaagttgctttaagtagaaaaccagtgaccctgatttaactagatgttgtttgatgcatgatacttttgagggtttaattatgcttgtatgggaatttgcacgtcttcaattttcattaagttgtaagttctaac

SEQ ID NO: 2317 - DNA, 1349 bp, Euonymus alatus
cggccgggggaacactttaattacccgagccagaactgaacccgtagatcggatctagcattccctcacagagtcacagtggccggattcatcgtctccttgctgaacagtgaacactccataccgagattcacctaaacggttcgtgtgtgacaactgacaagtgcgatagggtttcgaagttaagtcggagaagaaaagagagaccgtgatacagagagatggtgacgtcgccggtggtgaacacttatcctttgtcgagctacaccttcggcaccaaggagcctaagatggagaaggatacttccgttgccgatcgccttgctcgcatgaaagtcaactatatgaaagagggtatgaggaccagtgtggaagcaatcctcttggtccaggaacataatcatcctcacatacttctactgcaaattgggaacacattctgcaagcttcctggtggccgtctgaagccaggagaaaatgaaattgagggcttgaagagaaagctgaccagcaaactaggtgccaattcacctgccatggtaccagattggcagattggtgagtgtgttgctatttggtggagaccaaactttgaaaccataatgtatccatattgcccaccacacataacgaagcccaaggagtgcaagaagcttttcattgttcacttgtccgaaagagagtactttgcagtgcccaagaatctgaaactgttggctgttccgttgtttgaactctatgataatgttcagcggtatgggccagtcatttcaaccattcctcagcaactttcaagatttcagttcaatatgattaccatgtgacttcttctctttgtggatttcatgaccctattaatggatggtagtgctgatgtgttgtgcggcctaacagaccaccttttttccccgttctttaatattagatcgagtgtcctaggataggataggataggatatgaaggtgattagctggaacttattttgatttgctctatatctgttgacatacaagtgtctagattccttgtttgagtgttgacaatggttagtatcttagtatgtttgtaagatttagtggtttacaatgccattgtccgtaatttcttctcagaaatcccaaccagatcctgtgaggcaaaatccaaaattgccggactattttcgtggttgaaacaactggaccagattttgcaacttcttagaggccgaagttgggccattggcatttggtacttggtagtaactagtcgattcttcggctggtcttgaattgagaaatggcatttggtaactcgcaggtcgcacttcgcatgctactaagttgctaacaaagtccggagaatatta

SEQ ID NO: 2318 - DNA, 1387 bp, Vitis vinifera
atgtattttcattggcgcaatacatatttcttgtccgaaggagaaaacgacggtggctgccaatcggaatcagactctacagaagaagtagaagcaaggagagagatggtgacttcgccggtggtgaacacatacccattgtcgagctacaccttcggtaccaaggagccgaagatggaaaaggatacatccgtggccgatcgtcttgctcgcatgaaagtgaattacatgaaagaaggcatgaggactagtgttgaagcaatcctgctggtgcaagagcataaccatccacacattctgcttctgcaaattggaaacacattttgcaagctccctggtggccgtttgaagcctggagaaaatgaaattgaaggtttgaaaaggaaactgtcaagcaaactagctgctaattcgcttgcacttcaacctgattggcagattggagagtgtgtggctatttggtggaggccaaattttgagactataatgtacccatactgccctccccatatcacgaaacccaaggagtgtaagaagcttttcattgtccatttatctgaacgagagtattttgctgtaccgaaaaatttgaaactgctagctgttcccctgtttgagctatatgataatgttcagaggtacgggccggttatttcaacaatcccacagcagctgtccaggtttcagttcaacatgatgacagtataaaagtctaaaagcatattgataacaacattccatccatcagaaactcaatttagtggttagttaatatctcctaggtaatagatagacttgtgactaaagcaaattcagtttaggttttatggtctgctttgttgtcctgttgttgggtctatgttgtatggtttaattcatgtgtcttctgggacgcttctgggtggtgccttgtggcttgggttccccatgagtgtttgggtggaaactgcggcagcccagctggtgatgcccccattgtgctttgttagcaaaaccagagaaactgagttgagactaatcggagattacttgaacatgggttgcctgtttcagtgttgagtttttttttttttttttcactgggattctcctagctggacaattttttggaggacagcccaggttgtattgcagggattttgttgctcacttgttgtttgccagactttacatgaaaaatggattgtatatatcactagacttgttaactggaaaaatgtattaacgggaagggttcttcctgtttttcctgttcccagatctcagctcataagcagctgaggagtagaaagaataattgcagaatgttgggaagatggtgacttcaactatggcattacaaaatagcaggtatacttgattctgtgatcatcaggtgggtgggaaa

SEQ ID NO: 2319 - DNA, 1236 bp, Cucumis melo
atcgcctgacatttaaacaaattaacccgcaaagctcgcaagaactgatcgcgggtcatcaccaaggtttcttcttctttacttcttcccggccttgctcggcaggtgcagagtgaacacagccatggtgacgtcgccggtggtgaacacgtatccactttccagctataccttcggtaccaaagagccgaagctcgagaaggacacctctgtcgctgatcgtcttgctcgcatgaaagtcaactatatgaaggaaggcatgagaacaagtgttgaagcaattctgctggtgcaagaacataaacatccccacattctactattgcaaataggcaataccttttgcaagctccctggaggacggttgaagccaggagaaaatgaaattgaaggtttaaagaggaagctcacaagcaaactgggtgcaaactcgccctcactccagcctgattggcagattggtgaatgtgtggcgatttggtggagaccaaactttgaaactgtcatgtatccttattgcccccctcatattacgaaacccaaggaatgcaaaaagcttttcattgttcacttgtctgaaagagagtacttcgccgttcccaaaaatttgaagctgcttgcagttcccttgtttgagctctatgacaatgtgcagagatatggaccagttatctcgacgataccgcagcagctttccaggtttcagttcaacatgatcaccacatgaggttacagtacaagagccccttaaatttgtagcaggaattgacttcgatttgcttgagatagttagaaaagaaacttagaggacattatcaaccttgcttgagatagattagcatacttgtgatagactttcttgttcttgacctttttgtcgatgtgtttgcgaggcaaaattatgttgcttgtaacaagattcaactgagtttgtgtatcattttagcacaattaaagttttagaagtgtaatgtatgtctattgaatcaattcttaaaagccaaaggcaggattgctaaatggttattggcatgatcttcttgagatgtaggaggttcgaacccgcgtccccagacgttttggtttccagcttccgagacgatgatagtattagctctttgtatctctagtttaatgctatttcagtcattcttgtgggataacattgcttcctgtttctatctcccttttcttttctttgttaatgtgaaaacctgagtaaatgagagggaacta

SEQ ID NO: 2320 - DNA, 1256 bp, Tropaeolum majus
gtaaaactatatcaattcctttttaacaaaaataccacacataggcgcctaattcagtttacataattcgaagctacgagtttagccagcacatgggctgaaagcctcgacccgcaaccctccgaaagactaaattgaacgctggtgtataatttgcagtgaactcccgcagcttgttgctttcttcatacttaaaaaatattttacggattgaaatcttgcaactccagataaagcttagagatcatcgggagtgatagctaaaagatggtgatgtcatctgtggtgaacacatacccgttgtcgagctacactttcggcactaaagagcccaagatggagaaggacacctccgttgccgatcgccttgctcggatgaaagtcaactatatgaaggagggcatgaggactagcgttgaagcaattctactggtgcaggaacataatcatcctcacatacttctgctacaaattgggaatactttctgcaagcttcctggtggacgtttgaagccaggagaaaatgaaattgagggtttgaaaagaaagctgaccagcaagcttggagctaattcacacgctcttgtgccagagtggcagattggtgagtgtgtggctgtttggtggcgcccaaactttgaaaccataatgtatccctattgtcctccccacataacaaaacccaaggagtgtaagaagctattcattgttcagctctcggaaaaagagtactttgcagttcctaagaatttgaaactcctagctgtaccactgtttgagctctatgataatgttcagagatatggaccagttatatcaaccattcctcaacagctttctagattccagttcaacatgattagttcataagtttattgtggatctaaagaattcacttgatagtgatattattaaaatgcaagagctgcaacctcgaatcttacacactcaatagtaatacctggataatatggatgcttctctacataacctctcaggccggttagtagttcgacaacgaatcaaaggatatctattatagtagttcttaaacatgttttctatttgaatcctgtgtgtgtgggtgtccagattaatgttttaaaaatagatgtttagtctcggaattatttcagtgcacgaatgttgaagagtgcaaatgttgattctcaagagtctaatgtttttgtcttccagatgagttttgtattttgactcttggcaaaaagtagaatatttatgatagatctgtcttg

SEQ ID NO: 2321 - DNA, 685 bp, Capsicum annuum
cccccacctcgcccactcctctcatcggcgacatctaatccctcgtcattttcacagcgaatcacacaaagaggaagcaaaaatggtaacgtcttcggttgtgaacacatatccactgtccagctatacctttggtactaaggaacctaaaatggagaaggacacctccgttgccgatcgccttgctcgtatgaaagtcaactatatgaaggagggcatgaggactagtgtcgaaggaattctcttggtacaagaacacaatcatcctcacatcctccttctgcaaattgggaacacattctgcaaacttccaggtggacgcttgaaaccaggagagaacgaaatcgagggtttgaaaaggaaactctctagtaaacttgcagctaattctcctggccttcagccaaattggcagataggtgagtgtgtggccatctggtggaggccaaattttgaaactataatgtatccatactgccctccacacataacaaaacccaaggagtgtaagaagctcttcgttgttcatctatctgaaagagagtactttgctgtcccaaaaaatctgaagcttctcgcagtgccattgtttgaactttatgacaatgttcagagatatggacctgtgatatccacgattcctcaacagctttccagattccagttcaacatgatccacccatag

SEQ ID NO: 2322 - DNA, 1119 bp, Solanum phureja
attttctctccaatcttctaagtagtccgtcaaagtccagaagcatcccatcaacggcaagagggaaaatctgaaaatacaaatattcttccggtgaacacccacccaccgtctctccttcagtcctcctgccggcgatatctaattcctgagaggaaggtagggtgaaaacctcgttatttgcatagaaagaaaatggtaacgtcttcggttgtcaacacatacccactgtccagctatacatttggtactaaggagcccaaaatggagaaggacacctccgtcgccgatcgccttgctcgtatgaaagtcaactatacgaaggagggcatgaggactagcgtcgaaggaattctattggtacaagaacacaatcatcctcacattcttctattgcaaattgggaacacattctgcaaacttccaggtggacgcttgaaaccaggagagaatgaaatcgagggtttgaaaaggaaactgtctagtaaacttgcagctaattctcctggcattcagccaaattggcagataggtgagtgtgtggccatctggtggaggccaaattttgaaaccataatgtatccatattgccctccacacataacaaaacccaaggagtgtaagaagctcttcgtagttcatctatctgaaagagagtactttgctgtcccaaaaaatctgaagcttcttgcagtgccattgtttgaactttatgacaatgttcagagatatggacctgtgatatccacgattcctcaacagctttccagattccagttcaacatgatccactcgtagattaggttaggtggacattcagaacctccttctggcatacaatcccaaaaatacattaagctttttacttgaggtcctatattttcagaatgataaccttattttctgacgtgattctttcttttccaataggcatatctaccgactttcgtggatatttgttttcaacttagcttattcatgatagacataaattataggtgtattgttgtaagctttgatggcctgtctgttgtaatgtaccatagttatacgttgccatgtatttctttgtttgtttttgaatgttgacatgttagatggaataccgctgctatgttt

SEQ ID NO: 2323 - DNA, 1094 bp, Citrullus lanatus
gacatttataccaattaacctgcgaaacttgcaaggactgatcgcaggtcatcaccaaggtttttcaacttccttccggctttgctcggcagctgcagagtgaacacagccatggtgacgtcgccggtggtgaacacctatccactttccagctacaccttcggtaccaaagagccgaagctcgagaaggacacctccgtcgctgatcgtcttgctcgcatgaaagtcaactatatgaaggaaggcatgaggacaagtgttgaagcaattctgctggtgcaagaacataaacatccccatattctacttttgcaaataggcaataccttttgcaagctccctgggggacggttgaagccaggagaaaatgaaattgaaggtttaaagaggaagctcacgagcaaactgggtgcaaattcaccgtctctccagcctgattggcagattggtgaatgtgtggctatttggtggagaccaaactttgaaactgttatgtatccttattgcccccctcatattacgaaacccaaggaatgcaaaaagcttttcattgttcacttgtctgaaagagagtacttcgccgttcctaaaaatttgaagctgcttgcagttcctttgtttgagctctatgacaatgtgcagagatatggaccagttatatcgacaatcccgcagcagctttccaggtttcagttcaacatgatcaccacatgaggttgcaaatcaagaacccttaaaatttgtagcaggcgtggtctccaatttgcttgagatagttagaactcagaggacattatcaaccttgcttgagatagattagcatacttaattgactttcttgttctcgacctttttgtcaatgtgtttgcaaggcaaatcccgaggaaaaaaaatatatgttgcttcaaactagagcggaaaatgaaaaatcgactgagtttgtgtaacaatttaacttgatgaaagttttaagagtgtaatgtacgtctattgaatcaattattaaagtggttaatttgtggaaattagacatttttggttccaacttccaagtcaaaatgatagtcttagctctttgcttctctagtttaatg

SEQ ID NO: 2324 - DNA, 932 bp, Zostera marina
aaagtaaaaaaagtacgagtgataaataggggcagggcaataaagaaaaacggagagggggcgaagctgatagtcggaagggatggtgacatcggctgtggtaaacgcgtacccattatcgagctacacgtttggacagaaagagcctaagatggagaaggatacctctgtcgccgatcgccttgccaggatgaaagtcaactacatgaaagagggtatgcggacaagtgtggaggcgattctattggtgcaggaacataatcatcctcatatactattattacaaattggaaatacattctgcaaactccctggtggacgcctgaagcctggagagaatgaaattgagggtttaaaaagaaagctatctagtaaacttgctgcaaatgtgcctactcttcaacctaattggcagatcggagagtgtgttgccacttggtggagaccaaactttgagacagtcatgtatccatattgtccacctcacatcacgaaacctaaggaatgcaagaaactcttccttgtccatctttcagaacgtgaatattttgcagttccaaagaacttgaagttgcttgctgttccattattcgaactctatgataatgttcagagatatggacctgtcatctccaccataccacaacaactatccaggtttcagtttaacatggtgaacccttgaatttgatcatcaagtttgtagtgacaactgacaacaatggaaacataactatcgaatttagcttttagggcattgtttatctattgaaaatttataatctcatctgtcattattgaagctctcataattatttaactttcatcattcatgtacttgttatttctttatctttttttatctagatgaggcccatgattcaaggtccatataaaacagattagtcaatagtataaatatcaattttgtg

SEQ ID NO: 2325 - DNA, 1353 bp, Nicotiana benthamiana
acaaatattcccccggtgaacagccaccccagtctcccgtcggcgacatctaattccatagagccgaaagcagcgcaaaagaatagtcatttgtgtcacaaaacacctaaagagagagaaaatggtaacgtcatcggttgtcaacacatacccactgtccagttatacatttggtactaaggagcccaaaatggagaaggacacctccgtcgctgatcgccttgctcgtatgaaagtcaactattttaaggaaggcatgaggacaagcgtcgaaggaattctgttggtacaagaacataatcatcctcatattcttcttctgcaaattgggaacacattctgcaaacttccaggtggacgcctgaaaccaggagagaatgaaattgagggtttgaaaaggaaactctccagtaaacttgcagctaattctcctggtcttcagccaaattggcagatcggtgagtgtgtggccacctggtggaggccaaactttgaaactataatgtatccatactgccctccacacataacaaaacccaaggagtgtaagaagctctttgttgttcatctatctgaaagagagtactttgcagtcccaaaaaatctgaagcttcttgctgtgccattgtttgaactttacgacaatgttcagagatatggacccgtgatatccacaattcctcaacagctttccagattccagttcaacatgatccacccatagattagttttatggacattcaggagctccttctggcatacaattgcacaatacataagatttttacttgaggtcccatattttgagaatgataaccctattttctgacatgattctctcatttctagtaggcgtatggactgatttttgtggacttttattaattttctattgacttatttctgatgaacatcctaggtgtattgtcgaaagcttggttgcttgcctgttgtaatgtacaatatttactcattgctgtgtatttttggtttttgaatgttcacatgtaagatggaatagcactgctatgtttcatctgttcaccgaggctgtacatagctgtacttagtgatctccaaggatatcaccttttgagtttgtactttgggcatcaaacttgtgctactttcatttcattattactcagtatgggtccttcacatcattccattgaagaactcttttgtgttggcattaataggaaaaggtttggaagtataatttttttgcatcaagttccaatggagctcgacttgtaatttaattttttcttttcatgtaaaggctttatcattctgtccactatcccccaaatgagtgagaaatgcttgcacggatttgtcgacgcttg

SEQ ID NO: 2326 - DNA, 1108 bp, Nicotiana benthamiana
tccaatctaagcaggcccgtgtttagtccagaagcatctacagggggaaaatctgaaaatacaaatattcccccggtgaacagccaccccagtctcccgtcggcgacatctaattccatagagccgaaagcagcgcaaaagaatagtcatttgtgtcacaaaacacctaaagagagagaaaatggtaacgtcatcggttgtcaacacatacccactgtccagttatacatttggtactaaggagcccaaaatggagaaggacacctccgtcgctgatcgccttgctcgtatgaaagtgaactattttaaggagggcatgaggactagcgtcgaaggaattctgttggtacaagaacataatcatcctcatattcttcttctgcaaattgggaacacattctgcaaacttccaggtggacgcctgaaaccaggagagaatgaaattgagggtttgaaaaggaaactctccagtaaacttgcagctaattctcctggccttcagccaaattggcagatcggtgagtgtgtggccatctggtggaggccaaactttgaaactataatgtatccatactgccctccacacataacaaaacccaaggagtgtaagaagctctttgttgttcatctatctgaaagagagtactttgcagtcccaaaaaatctgaagcttcttgctgtgccattgtttgaactttacgacaatgttcagcgatatggacccgtgatatccacaattcctcaacaactttccagattccagttcaacatgatccacccatagattagttttatggacattcaggagctccttctggcatacaattgcacatgacataagatttttacttgaggtcccatattttgagaatgataaccctattttctgacatgattctctcatttccagtaggcatatggactgattttcgtggacttctgttaattttctattgacttatttctgatggacatcctaggtgtactgttgaaagcttgtttgcttgcctgttgtaatgtacaatatttactcattgctgtctcttttttgtctttgaatgttcacatgtaagatgtactagcactgctatgtttcatctggtcacca

SEQ ID NO: 2327 - DNA, 1056 bp, Olea europaea
attggactgcctctctgctctcccgctttgccggttgaagaattacagataagcgaaaatggtgtcgtcagcagtggtaaatacgtatccactgccaagctacactttcggcgccaaagagcccaaaatggagaaagacacctccgtcgccgatcgccttgcccgcatgaaagtcaattacatgaaggaggggatgaggactagcgtcgaaggaattttgttggtagaagagcataatcatccccatattcttcttctgcaaattggaaatactttctgtaaactcccaggtggccgactgaagccgggagagaacgaaattgaaggcttgaaaaggaaactttccagcaaacttgctgtgaattcacctggtcttgagccagattggcagataggtgaatgtgtggcaacatggtggagaccaaattttgaaaccacaatgtacccttactgccctccacatatagcaaaacccaaagagtgcaagaagcttttcattgttcacctgtcagagagagagtactttgctgttccgaagaacttgaaacttcttgctgttccattatttgaactctatgacaatgttcagagatacggacctgtaatttccaccattccgcagcagctatcccgtttccagttcaacatgatccactcatagattcttcctagaaactcatatgaagatagatgcacccagagaattcaaattttcatttaagagcctggtttcttcccgcagccttcgtttgtggaagatgtcgcattatgattgaagtcttctcttgtttctaaaacttgttgagcattttgctgaacacagaaacgtaatttgacgtctagattgctgtaggggattcaatgtaagaatttttgatggttcttttgacatatttggtaagttgaattagattccagtattgcgcacgaaatatgcctcgtaggcgtgggttaggattagaatggtggtactgggcttattaatgttgtccctgcaaatgtgttctagccaagatgtaacactgatgaagtaatgttcaatctttggattgagct

SEQ ID NO: 2328 - DNA, 1468 bp, Prunus mume
cacagatttagagtgttaaaatgagggcgccagggtagaagtaaactgtagaatcctccttgtcgttatcgtttccaattaaactaaaccctgcctttgatttgggttttgggtagctccatttcttccgagcagcctagaaactgaaaggagggttgggattttcagacagagagagagagagagagagagagagagagaggagaaaaaaatggtgacgtcggcggtggtgaacacgtacccactgtcgagctacacgttcgggaccaaagagcccaagatggagaaggatacctccgtcgctgatcgcctcgctcgaatgaaaatcaactatatgaaagagggaatgaggaccagcgtcgaagcgattttactggtacaggaacataatcatccccacatacttctcctgcagattgggaacacgttctgcaaacttcctggtggacgactcaagccaggagagaatgaaattgaggggctgaaaagaaagctgactagcaagcttggcgctaattcacctgcccttgtgccagactggcagatcggagagtgtgtggctatctggtggaggccaaactttgaaaccataatgtatccatattgccctcctcacataacaaaacctaaggagtgtaagaagctttttcttgttcacttatctgagagagagtactttgcagtcccaaaaaacctgaaacttcttgcagttccattgttcgaactctatgataatgttcagagatatgggcctgtcatatctacaattccccagcagctttcaagattccaattcaacatgatcagttcatgaagcgaggaattttgaaattaccctgaaatccatcatactgaagatcatatcttgatatcatcacatggatgactaaaactcaagacctggatgttattttgttactgaacttaagttggttagtatgagatccttcagtttatccagatgacttatcttaggatattgaccgtccatctatgtttggccattaatcgtatttgctaatgcattttgcattgcacttgggactttgttgaaaccgtgtttgtattgttcaagttcttgtagtagctagtggtaaaaatcgagatattcttatttctcagaaagaagatatgttagtttcttaagaccggggagcaatacaattagttgcctcagctcagtgctgtgttgagattcttttaatataagatttcgtagctgcattggtgtaatgatgggtaggaggagatgtatgtttttagagtgtactgacagcttcttaactttgtgtattgatgggtagcatgcagatgcgttcacagcattcttatcagcttcattttgttgaagccctcatgtaatcatctttgtagaattcgccttgcatcagtaaaattctttctattgtcaaggagttttcttaaaagatgtggtttgatgaatgctgcctggtgctttttgttctcc

SEQ ID NO: 2329 - DNA, 820 bp, Ambrosia trifida
aagaaagtctcctcctcccctcgttaactcaaaaatcaaatagttggaacaaccattttatttgatcttcagtctattatcgatacccacatagtattcattcattcgatagatcaacaaacatggttagttcatcagtcgttaacacataccctttatccagctactctttcggtacaaaagaacctaaaatggagaaagatacatccgttgctgatcgtcttgctcgtatgaaattaaactatatgaaggaaggtatgaggaccagtgtcgaggcaatcttactggtgcaagagcataatcatccccacattcttcttctgcaaattggcaacacattctgtaagcttcctggtggtcgactgaagcctggagaaaacgaagttgaaggcttgaaaagaaagttgtcaagcaaacttgctgctaattcccctaacatgcaacctaattggcagattggtgagtgcgtggctgtatggtggaggccaaactttgaaactatcatgtacccatattgccctccacacatcacaaagccaaaggaatgcaagaagctttatgttgtacacctatcggaaagagagtactttgcagtgcccaaaaatctgaaacttcttgctgtaccactctttgagctttacgataatgttcagagatatggaccgatgatttcaaccattcctcaacagctctcaagatttcagttcaacatgattttatcatgaatatgcatcagattcgagcatttgcattcagagatttagatttgatatcaaactttcttcagacgttatcgtattaacagaaccggacctataga

SEQ ID NO: 2330 - DNA, 1296 bp, Amsonia hubrichtii
aaaattctggagaggggaagaagaaggaaaattgaggagaaaatacggagagcagagcagggtggttaagggagaaagagcaacaatggtgacatcgccggtagtgaacacatacccgctttcaagctacaccttcgggactaaggagcccaagatggagaaagacacttccgtcgccgaccgtctcgctcgcatgaaagtcaattatatgaaggagggtatgaggactagcgttgaaggaattttattggtacaagagcataatcatccccacattcttcttctgcaaatcggcaacactttctgcaagcttcctggtgggcgtctgaagccaggagagaatgaaattgagggcttgaaaaggaaactttctagcaagcttgctgctaattcgcccggtctgcagccagattggcagattggcgagtgtgtagctatttggtggagacccaattttgaaaccataatgtacccatactgccccccacacataacaaagccaaaggagtgcaagaagctattccttgttcacctttctgagagagaatactttgcagttccaaagaacttgaagcttctggctgttccattgtttgaactctatgacaatgttcagagatatgggcctgtgatatccacaataccacagcagctgtctagattccagttcaacatgatccatccttagattaaacatggtgcatcctagatagcaccttactggagaattaagttggctggcgtgcaggtctcaacgtttcacatgcttcaagcatgtcctatgaaatcgtacgatccatctttctacagctcggttatctgtttggctggaactctattctcacattgattttaatatacttttgcaattaagatattcttgacctgcatagatgtaatgcaatgtcaattagaagagcagttagttataatgacattgtgagatggcagatagtggacatgtaaactctcttgcggttggggtttgtgtttttcactctggtctttgattgtattataatttgcttaattgagtcgatgggttgtaactgaggagctgtagtgaaatatgtatttgtctgctgcagcaaagatagttcagactaagctttggtgacaaagatctgcacatgagaagttgtgtgctggtcccaatcagaatcaacctttggcctctagagttgctttgaagggtcgtttaactgtattctgtaactttgaaaacgtttaggattgtgatttcaatattgtagaagagaaaagagaaaatttgtttaggttctttattctccctgc

SEQ ID NO: 2331 - DNA, 1321 bp, Malus domestica
attgcaacgagaaattataattaaatctctccccgtctccgctctctcccacctctatttccaccgatcgccgtcgaagattacagacggtagggattttcagagagagagagtgagagagagatggttacgtcggcggtggtgaacacgtacccactgtcgagctacacgttcgggaccaaagagccgaagatggagaaggacacctccgtcgccgatcgcctcgcccgtatgaaagtcaactatatgaaagagggaatgcggaccagtgtcgaagcgattttactggtacaggaacataatcatccccacatacttctcctgcagattggaaacacattctgcaaacttcctggtggacgactgaagccaggggagaatgaaattgaggggttgaaaagaaagctgaccagcaagcttggcgctaattcacctacccttgtgccagattggcagataggagagtgcgtggctatctggtggaggccaaactttgaaaccataatgtacccatattgccctcctcacataacaaaacccaaggagtgtaagaagcttttccttgttcacttatctgagagggagtacttcgctgtgcccaaaaacctaaaacttcttgctgtcccattgtttgagctctatgataacgttcagagatatggacctgttatatcaacaatcccacagcagctttcccgattccagttcaacatgatcagttaatgaagaaggaattatgaagttaccgtgatatcactattcagtatactgaagatcacgtctggacatcattgcgtggatacctaaactcaagaccggatattattcttataactgaacttaagttggttagtatgagatccttcagtttatccagatgaacgaagcatatcttgtggtctgttttgttcatctatgtttgtttatgatcgtatttgctaatgcgttttgcattactcttgaaactttgtctgaacagtggttgcgctgtgcaagttcttgtttcttagctagaaggtttgttagttactttagacaccgggagtcgtacaatgttgtctgagttatgttttcagattctcaatatttgagattttgtacgataacttgttctgcttttctgtaacgatgggtaggagatgtatgtgcttacttcttagaatgtacctaactactgtcttaactttgtgtaatggtgggtaggcgatggacgcgttcccataggattcttatcggtttcattctgttgggagccatgtggcatgtaatcatcgttgtagaattcgtctttgatcagtaaaattcttccttttttcaagaa

SEQ ID NO: 2332 - DNA, 1753 bp, Aristolochia fimbriata
tagtcttttagacctctttctttctttcattccttgatactaaaagccattttctcctcttgccttcccttctccgtggcagttttgctcgactctgagatttttagggaaggagaaatggtggctacgtcgccgttggtgaacatataccctctttcaagctatacttttggaacgaaggagccgaagatggaaaaggacacttcggtggcggatcgtctcgctcgaatgaaagtcaactatatgaaggagggtatgcggacaagtgtggaagcaattctactggtgcaagagcataatcatccccacatcctgcttcttcaaataggaaatacattttgcaaactccctggtggtcgtttaaaacccggagagaatgaaattgagggcttgaagcgaaaactttctagcaaactggcagctaaccaacctagcctccagccagattggcagattggagaatgtgtggcaatctggtggaggccaaactttgaaactattatgtacccatactgccctcctcatatcataaagccgaacgaatgcaagaagctttttattgttcacttatcagaacgagagtattttgccgtcccaaagaacttgaaactgcttgctgttccgttatttgaactttatgataacgtccagagatatgggccagtaatctccactattccccagcagctatccagattccagttcaacatgatcaactcatgaacgaaactccgaaatcatcccatggatacacatttagccatctgactgaggttttaaatttttgaggcagatattaaaatgaaatacaactaatctcccggaatttagtgtaatcacatctatcttcctgtgtacttgtatgtagtagtaggatgaggattcattttgtattcagcttcatgactttagaaaactagtgacagattagctagctgaggctgatagaattgtgggttatgttaccagaatggctgaggccgatagaaaccagaacagctgttgccgatagaattgtgggttatgttaccagaacggctgaggccgatagaattgtggtttatgttaccagaacggctgaggcctataggattataggtttcataaaaactgctgaggctgatggagtggtgagtcctgttgcaagaattgctgaggccgacagaattgtgggttctgttaccaaaatgctgaggccgacagaattgtgggttctgttaccaaaaatgctgaggcggacagaattgtgggttctgttaccaaaaatgctgaggcggacagaattgtgggttctgttaccagaaatgctgaggccgactggtttatggttctttatcagaattcctgaggccgatagaactgtgtgttctgttatctgatttgaatcatgtgttagtatgttgccctgatttgtgaatgtcattgttaacgtctcttaagattgctgtaatacttgtatttgggtgtattgtatctccatgtaagcttcaacaaatcttagaggatttgccacggtctttcctgttgtaggagtctgattcggcaactcgttgcctaacgcagctgactgaaatagcttgaaaagaaatgttctgtaaatactgtgcagctcttaaaacctttttatcaacttgtaacgaggatttaccggaacttggcaggtgctcgcagtggttcatgttgcatctgttttggtatatgcactgaccaagtgactagcatgaatagcatttgcgtcaaattaccattcaag

SEQ ID NO: 2333 - DNA, 725 bp, Vaccinium corymbosum
ggagcgagagagagagagagagagagcgcgaagatggtgacctcgccagtggtgaacacttaccctctgtcgagttacactttcgggacgaaggaaccgaagatggagaaagacacttcagtcgcagatcgtctcgctcgcatgaaactcaactatatgaaagaaggcatgaggaccagcgttgaagcaattctactggtgcaagaacataatcatccccatattcttcttttgcaaatcggaaacaccttttgcaagctccctggtggccgtttgaagcctggagaaaatgaaattgaaggcttgcaaaggaaattgtcaagcaaacttggtgctaattctccttcattgcagcctaattggcagattggcgagtgtgtggctatctggtggaggccaaactttgaaactataatgtacccctattgccctccacatatcacaaagcctaaggagtgtaagaagcttttcgttgttcacttgtctgaaagagaatactttgcagtacccaaaaatttgaaactcctggctgttcccctgtttgaactctatgataatgttcagagatatggtccggttatatcaacaattccgcagcagctgtcccggttccatttcaatatgatgcaatcgtgaaacaaagatgccttctagtctttggctaaggaaagtgtagaacatatgttttcgaatatgggactatcctggttagtagacagacaaat

SEQ ID NO: 2334 - DNA, 916 bp, Vaccinium corymbosum
cgaagatggtgacctcgccagtggtgaacacttaccctctgtcgagttacactttcgggacgaaggaaccgaagatggagaaagacacttcagtcgcagatcgtctcgctcgcatgaaactcaactatatgaaagaaggcatgaggaccagcgttgaagcaattctactggtgcaagaacataatcatcctcatattcttcttttgcaaatcggaaacaccttttgcaagctccctggtggccgtttgaagcctggagaaaatgaaattgaaggcttgcaaaggaaattgtcaagcaaacttggtgctaattctccttcattgcagcctaattggcagattggcgagtgtgtggctatctggtggaggccaaactttgaaactataatgtacccctattgccctccacatatcacaaagcctaaggagtgtaagaagcttttcgttgttcacttgtctgaaagagaatactttgcagtacccaaaaatttgaaactcctggctgttcccctgtttgaactctatgataatgttcagagatatggtccggttatatcaacaattccgcagcagctgtcccggttccatttcaatatgatgcaatcgtgaaacaagatgctttctagtctttggctatggaaagtgtagaacatcatgttttcgaatatggactatcctggttagtagacagacaaattaggtggcctcacagagttttagtttcaattcacatggcgtaacagaccatagtagacctccgtatttttccgttcttgatgttggattgtggtgaatggatttcgcgtttgacgatggtttcaggtattcctgttttttgggattgtgtttgcttctatgggagaggcatagtttgaaaactgaaccgtattttatttgtggtggatgttttaggtatt

SEQ ID NO: 2335 - DNA, 1242 bp, Cannabis sativa
attctcgaactcttttttttgcctttggggggttttgaatctttcatactcggtttcctttggcctccttccctcccagtcccagtcccaaccccagttccttcgaactggtaaaaacgcaaatccaagtccagaaagagagagacgctaagatggtgacgtctcccgtagtgaacacctatccactttcgagctacaccttcgggaccaaagagccaaaaatggagaaggacacttctgtagctgatcgccttgctcgcatgaaagtcaactatatgaaggaagggatgaggacgagcgtggaagcgattttactggttcaggaacacaatcatccccacattcttttgctgcaaataggaaacacattttgcaaacttccgggtggacgactgaagcctggcgagaatgaaatagagggcttgaaaaggaagctgaccagtaagctcggtgcaaattcacctacccttgtgccggactggcagataggtgagtgtgtggctatctggtggaggccaaacttcgagaccataatgtatccatactgccctccgcatataacgaaacctaaggagtgtaagaagctttttcttgttcacttatctgagagagaatactttgcagttccaaagaacttaaaacttcttgctgttccattatttgaactgtatgataatgttcagagatatggaccagttatatccaccattccacagcagctttcaagattccaattcaatatgattactacataaatttgcatgtcatcgaaagtccctcgacagcacaaagcttatacagctttataccttgatataagtttgcggattacgggagctcatacttggactttgattcataaattaaactctagttaggtttttgtgagggttctattatgcagatgactgaaaagcttatctctgctacagctagattgaccatgcgtggcccttcttatctccattgacaaagtctcttctccatatcttaattcctatattgcattacactatatttgccattgctacatgaatcattatgaatataaaataagaacaatttctgctggcaccaaataaaagaaaatatcctaaatggtcaaaaatgttaaatattatgtgtaaatgtatgtaataatattttatattaggttgtagagtacattattgtaatgttcttgcaccattttggatatttagtattttactatactatcagtgataaattcgaaagattctg

SEQ ID NO: 2336 - DNA, 1446 bp, Ricinus communis
tatcaacgtagatgcaaacacagacctttggtgatttagatcgaacggtcataaaagaagcagttgctgagacattcgcagtcacagtcacattaacaaagatcaaaatacgagtatcgggctcatttgagtcccactcccgagagtcgcagttgctcgctattccctccctgttttcttcttcgcagctccggctgcacattctagacaaacggaggccaactcaccttcaatctatagaggaaccgagtagataaaattcaatttatccttaatttagaggcggagacatagagcataaaatatggtaaactcatcggtagttaatacgtatcctttatcgagctacacatttggcaccaaagagcccaaaatggagaaagatacctccgtcgccgatcgtctcgctcgcatgaaagtcaactatatgaaggaggggatgaggacaagcgtggaagctattttgctggtacaggagcataatcatccccatatacttctcctgcaaatagggaacacattctgcaaactgcctggtgggcgcctaaagccaggggagaatgaaattgaaggattgaaaagaaaactgaccagcaagcttggtgctaattcacctgctttggtgccagactggcagattggtgagtgtgtggccatctggtggaggccaaactttgaaaccatcatgtatccatattgtcctccccacattacaaagccaaaggagtgcaagaagcttttccttgttcacttgtctgaaagagagtattttgcagtacccaaaaatttgaagcttcttgctgtcccattgtttgaactctatgataatgtgcagagatatgggccagttatatcaactattcctcaacagctttccagattccagttcaacatgattactacatgaatttagcctgttttgaagagcttacagctttagtgtagtacctggatttcaagaggctgcagagaatatagcatggataggagagtttataccctggtagtacttcataacagaatttttaagctgatacttcttaacatacctttttaagttggttgactaggtattcaaagttgtcgatgattgtgacatgctccatctccttacagtggatggtactcaacttctactacatggagtctttgtattagtttaggttccttgttcatgagatctgtgcctcgcaattttttttagggtttacatggttgcaacttagtgttctagtgtaagaatgttcgcatgctatctgcttgcttttcctggcagaaatatccttgtcgaatgggtaatgctgaaattgtatgtgtagtgaaaaaaaaaattgaggcttgttatgtctactgaatttgttatcttatccatttggaaatatcaaactttggtgtgtgcaattgtgtttacaataatgagagtatgcattccttagctggtaagaa

SEQ ID NO: 2337 - DNA, 1336 bp, Catharanthus roseus
ctgagaaaaggaagagaagctctgttctcgacataaacccgcaaaattctggacagggaaaattttgaagagtgaagaaagagaatcagagcagagatttctagagggagaaagaaagagccagaatggtaacgtcgccggtggtgaacacttacccgctatcgagctataccttcgggactaaggagccgaagatggagaaagacacctccgtcgccgatcgtcttgctcgcatgaaagtcaattatatgaaggagggtatgaggactagcgttgaaggaattttattggtgcaagagcacaatcatccccacattcttcttttgcaaatcggaaacactttctgcaagcttcctggtgggcgtctgaagccgggagagaatgaaattgagggtttgaaaagaaaactttcaagcaagcttgcagctaattcacctggtctgcagccagattggcagattggtgaatgtgtagctatttggtggagacccaattttgaaaccatcatgtacccgtactgccctccacacatcacaaaaccaaaggagtgcaaaaagcttttccttgttcatctttctgagagagaatactttgcagttccgaagaacttgaagcttctggctgttccattgtttgaactctatgacaatgttcagagatatgggcctgtgatatcgacaattccacagcagctgtctagattccagttcaacatgatccatccttagatcatatggtcctttccgagctatcatcttactagaaattgcatttggctggtcggcaggtcccaaagctttcacaggattgatgcatgtccaatgaagtcgtatgatctatctttctccaactggtttcagtttagctggcactctattctcacatggatattaatttattttgcaattaagatattcttgaaatgcatagattcaatctagaacacctataagagcagccagtggacaatgagaacatcagatggtggatagtggagtttcaaaacccttgcttgttgggatttatgtgtttcactgtatctggtctttgaacgtaaatttttttatgtaatttgatgttatggcaaattgcatgaaccgagttagtgagttgtaaaaattgtttgttgtagtagatctgtattgtacccatccgaggtagttcagactaagcttcagtgacaagatctacacatgacaagttggcaggtgttccgaggaaggttcctatttgtgacaatcttttaccttgagagttgctttctttttgataggtgttttgactgtattctagtctagtccatggaaaaagttttgatattaatgttggaaaatag

SEQ ID NO: 2338 - DNA, 1236 bp, Unknown
  Sequence found in Organisms: Citrus clementina, Citrus sinensis
caaaacaaaacaccactcgagactcgactgttaactaaagaacaattaagatttaagggggagaaacagaggccggttgattcgttgtttctcaatagagagagagagagagagagagagaaagagtcgaagatggtgacgtcaccggtggtgaacacgtacccgctgtcgagttacacattcggcaccaaagagccgaagatggagaaggacacctccgtcgccgatcgccttgcccgcatgaaagtcaactatatgaaagagggcatgaggacgagtgttgaagcaattttactggttcaggaacataatcatcctcacatactacttctgcaaattggaaacacgttctgcaaacttcctggtggacgtttaaagcctggagagaacgaaattgaggggttgaaaaggaagctgaccagcaagcttggggcgaattctcctgctcttgtgcctgactggcagattggtgaatgtgttgcaatctggtggaggccaaactttgaaaccataatgtatccttactgccctccccacatcacaaagccaaaggagtgtaagaagcttttccttgttcacttgtccgagagagagtactttgctgtgcccaaaaatttgaaactccttgctgtaccgctgtttgaactctatgataacgtccagagatatgggccagttatttcaaccattcctcaacagctttccagattccagttcaatatgattaccgcttgactttagcatggatttcaagagcacactcctggatgatactacttagattcttagagctttaccaagaatatatggtgcgtcgattccttgtgctgatacctgatggtacttcatgacaaacttttgagttggttagggtggatttcccaatttatgcggaagactgacgcatttgacattgtgacaaactaatctatgtttgttcatttagtactattttatttattatgtgctatgcttgagtttgtgaatcgatattggtctgtgttcaagtttttatagccacataatgtttgctgacatcatgtcagaatgttgaaaggtgtcaccattgtgggatttgacagattgtggaggcttgatctctttgcaaaattttcctggcagagctgatcatgctgctactgtaacctgtatgagcttgttgctcattgtaacatttctgtatgactagtagttaatcagaagaaaatcacatgtgctggttttattgatgcctta

SEQ ID NO: 2339 - DNA, 1283 bp, Gossypium hirsutum
agcttttgcctcgctccgtatttcctccttttttctgtaccaaatataattattaagaaaccgttttagttttaccgccggaaagagaaaggtttcgataattttatagagagttacgatttaggaaaatcctgggagaggagaaagatggtatcgtcaccggtcgtgaacacgtatccactgtccagctacaccttcggcaccaaagagccgaagatggagaaggacacgtccgttgccgatcgccttgctcgcatgaaagtcaattatatgaaagagggcatgagaacaagtgttgaagcgattttactggtccaagaacataatcatcctcacattcttcttctgcaaattgggaacacattctgcaaacttcctggtggacgcctgaagcctggagaaaatgagatcgagggtctgaagaggaagctgaccagcaagcttggagctaattcacctgctcttgtgccagattggcagattggtgagtctgtggccatctggtggaggcccaattttgagacaatgatgtatccatattgccctccccacattacaaaacccaaggagtgcaagaagcttttcctcgtccacttgtctgagaaagagtattttgcagtaccgaagaatctgaaacttcttgctgtaccattgtttgagctctacgataatgtgcagagatatgggccagtcatatcaaccattcctcagcagctttctagattccagttcaacatgatcagtatatgactttggcatgggatgccaagattgtgaatctttctgctcgctttctgacagctacatcatgagagtatcgctttggttccaagagctgttgcctgtacgcaacggtatataatgagagacttgtgttatttacttttcctaatttgcttgaccgaaaatttgatgtatggcaaactctagtactttaatttggttacgaaccatttggcattactagtcacagcccatcatgtctgcgtccgtaaccaccctagtctccctacttggatggtttatattaacggttttatacgctatcagacctgttaagatgccattgttttgaggtttaatgtcatgtatcttggtcatggatgtgtgaatgttttcatacagaactgcttggctttgcttccatagtaattagttatgtatgtcctgcaagcatgatgctaaatgtgagcagaactttctatttttggtttttcaaacgctctaatccaaactttaaatatatatatattaattgaacaaaaagaaaaataccgactgcg

SEQ ID NO: 2340 - DNA, 1026 bp, Cucurbita pepo
atcgcaggttttttctacatcttcccgcctttgaccggcagctgcagagtgaacacagccatggtgacgtcgccggtggtgaacacctatccactttccagctacactttcggtaccaaagagccgaagctcgagaaggacacctccgtcgccgatcgtcttgctcgcatgaaagtcaactatatgaaggaaggcatgaggacaagtgttgaagcaattctgctggtgcaagaacataaccatccccatattctacttctgcaaataggcaataccttttgcaagctccctgggggccggttgaagccaggagaaaatgaaattgaaggtttaaagaggaagctgacgagcaaactgggtgcaaattcacccgctctccagcctgattggcagattggtgaatgtgtggctacttggtggagaccaaactttgaaactgttatgtatccttactgcccccctcatattactaaagccaaggaatgcaaaaagctcttcattgttcacttgtctgaaagagagtacttcgcagttcctaaaaatttgaagctgcttgcagttcctttgtttgagctctacgacaacgtgcagagatacggacctgttatatcgacgatcccgcagcagctttccaggttccagttcaacatgatcaccacatgaggtatcaatacaagaaccctgaaatttgtagcatgcatcatggactccaatttgcttgagagatagtttgaacttagaggacattatcaaccttgcttgagatagattagtgtactcgatagacttgttgttctcgacgtttttcaccgatgtgtttgtgaagaaaaccccgagaaaaagttcatgtttattctaacaatagcggaaaaagaatcgaccgagttcgtgtatcgatttaacttgatgaaagtcctaaaagtgtaatgtatgtctattgaatcaattgtaaagtggttaaattgtggaaacttggacatcctcggttctaactttcaagtgagaatcatagccttggctctctgc

SEQ ID NO: 2341 - DNA, 780 bp, Eschscholzia californica
tttagagagagaacgagtataagcttagagagagaaagtaatggtgacatcgccggtagtaaatacatacccactctcaagctacacgttcggtaccaaagaaccgaagatggagaaagatacatctgttgcagatcgtctcgctcgtatgaaagtcaattatatgaaagaggggatgagaacaagcgttgatgcaattttactggtacaagagcataaccatcctcacatactgcttctccaaataggaaacacattctgcaaacttcctggtggccggttgaagcctggagaaaatgaaatcgagggtttgaaaagaaagttgtcaagcaaacttgctgctaactcaactacaatgcagccagattggcagattggcgagtgtgtagctgtctggtggagaccaaactttgaaacgacaatgtacccatattgccctcctcacatcactaaacctaaggagtgtaagaagctttaccttgttcatctgtctgagagggagtacttcgcagtaccaaagaacttgaaactacttgccgtgccattgttcgaattgtacgataacgttcagagatacggaccagttatttctaccattccacaacaactatccagatttcagttcaacatgattagcggataaaaaagttagcaaattcaactgaagcaaatccaacaaatgaaaagctcctagcagcaacttgtgagggtcttaagttagataactgattggtattaaaaagagataatcaagttttgcagatactcattcaactgaag

SEQ ID NO: 2342 - DNA, 1616 bp, Gossypium raimondii
cttttgcctcgctccgtatttcctcctccttttttctgtaccaaatataattattaagaaaccgttttagttttaccgccggaaagagaaaggtttcgataattttatagagagttacgatttaggaaaatcctgggagaggagaaagatggtatcgtcaccggtcgtgaacacgtatccactgtccagctacaccttcggcaccaaagagccgaagatggagaaggacacgtccgttgccgatcgccttgctcgcatgaaagtcaattatatgaaagagggcatgagaacaagtgttgaagcgattttactggtccaagaacataatcatcctcacattcttcttctgcaaattgggaacacattctgcaaacttcctggtggacgcctgaagcctggagaaaatgagatcgagggtctgaagaggaagctgaccagcaagcttggagctaattcacctgctcttgtgccagattggcagattggtgagtctgtggccatctggtggaggcccaattttgagacaatgatgtatccatattgccctccccacattacaaaacccaaggagtgcaagaagcttttcctcgtccacttgtctgagaaagagtattttgcagtaccgaagaatctgaaacttcttgctgtaccattgtttgagctctacgataatgtgcagagatatgggccagtcatatcaaccattcctcagcagctttctagattccagttcaacatgatcagtatatgactttggcatgggatgccaagattgtgaatctttctgctcgctttctgacagctacatcatgagagtatcgctttggttccaagagctgttgcctgtacgcaacggtatataatgagagacttgtgttatttacgtttcctaatttgattgaccgaaaatttgatgtatggcaaactctagtactttaatttggttacgaaccatttggcattactagtcacagcctatcatgtctgggtccgtaaccacactagtctccctacttggatggtttaaattaacggttttatacgctatcagacctgttaagatgccattgttttgaggtttaatgtcatgtatcttggtcatggatgtgtgaatgttttcatacagaactgctttgctttgcttccatagtaattagttatgtatgtcctgcaagcatgatgctaaatgtgagcagaactttcattttaggtttttcaaaacgctctaatccaaactttaaaagaaaaatattaattggacaatgtgattgaaattgtacccgattgagatataaaccaccttgctaatattgttttttttttttttaaaagtttcactaataaatagatcatttacaactctggccaattacaatatagaattcaatcaacataacgcatagtgaatgaagaactggacaaaatctggatcaatcaacataatgtatagtgaataaagaaccggacataaactagattactctgaagagaatttaacaaaattcacatgttgcaattaaatttaaatttgggccatcgaggtctaaaacttcagcctttattaatagtgccaaggtctcttagctattaattcttgattttgaacaaaagctggc

SEQ ID NO: 2343 - DNA, 1251 bp, Lippia dulcis
cattacttcgagcatttgcagagcggggagctaagttttccacattccggctgcaaattcttcacagagtagaagaaatccattgccgcaaatctgcaataattcacgacgagaagcagtataaacacgtaatcggagaaagaggggcgaaatggttacttcgcaggtggtaaatacgtatcctctttcgagctacactttcggcaccaaagagccgaagatggagaaagacacctccgtcgccgatcgccttgctcgcatgaaagtcaactacatgaaggaaggtatgaggactagcgtcgagggtattttgctggtccaagaacataatcatccccatattctccttctgcaaatcggaaatacattttgtaaacttccagggggtagattgaagccaggcgagaatgaaattgacggtctgaagcggaagctctctagcaaacttgcagctaattcaccttctctacagccagattggcaggttggagagtgtgtggcaatttggtggagaccaaactttgaaactatcatgtatccttactgccccccacatataacaaagcctaaggaatgcaaaaagctcttcgttgtccacttgtctgaacgagagtattttgctgtgccgaagaacttgaaacttctggctgttccattgtttgaactatatgacaatgttcagagatatggacctgttatatctaccatcccacagcagctatccaggtttcagttcaacatgattcatccatagagtactgggcttctaaaagctctaacaactaaagacagaaagtgattgatgatcatgaattggtaagtgtatccagtcccaggtttggaggaggaggagaattcgagccctatttcatatctagatacattccaagaaaattcagaacgttctacttgttttccatgttgaccctattagactctagatctccctctcaattgggcacctgactgagccttccttctattggggatttatcttattgtttatctatgaagtcattttcctattttcttcgatttccatgtattacttatttcttagtatgttgtcatgtgttaattgttggctaaccacgtaccatatggcatgaagccatcagattttgtaacctaacctacctcaaacatgtatagaatgacattagccgaagagttcgatacttctttgatgatgatggcatcatcatctcatttttatctgaatccaaatttgcatcaagtttcaaaaatgaa

SEQ ID NO: 2344 - DNA, 1332 bp, Prunus persica
gtttccagttaaactaaaccctgcctttgatttgggttttgggtagctccatttcttccgagcagcctagaaactgaaaggagggttgggattttcgcagagagagagagagagagagaagaaaaaaatggtgacgtcggcggtggtgaacacgtacccactgtcgagctacacgttcgggaccaaagagcccaagatggagaaggatacctccgtcgctgatcgcctcgctcgaatgaaaatcaactatatgaaagagggaatgaggaccagcgtcgaagcgattttactggtacaggaacataatcatccccacatacttctcctgcagattgggaacacgttctgcaaacttcctggtggacgactcaagccaggagagaatgaaattgaggggctgaaaagaaagctgactagcaagcttggcgctaattcacctgcccttgtgccagactggcagataggagagtgtgtggctatctggtggaggccaaactttgaaaccataatgtatccatattgccctcctcacataacaaaacccaaggagtgtaagaagctttttcttgttcacttatctgagagagagtactttgcagtccccaaaaacctgaaacttcttgcagttccattgtttgaactctatgataatgttcagagatatggacctgtcatatctacaattccccagcagctttcgagattccaattcaacatgatcagttcatgaagcgaggaattttgaaattaccctgatagcactatccatcgtactgaagatcatatcttgatatcatcacatggatgactaaaactcaagacctggatattattttgttactgaacttaagttggttagtatgagatccttcagtttatccagatgacttatcttaggatattgaccgtccatctatgtttggccattaatcatatttgctaatgcgttttgcattgcacttggaactttgttgaaaccgtgtttgtattgttcaagttcttataggagctagtggtaaaatcgatatattcatgttctcagaaagaagatattttagtttcttaagaccggggagcgatacaattagttgtctcagctcagtgctgttttgagattcttttaatataagatttcgtagccgctttggtgtaatgattgggtaggaggagatgtatgtttttagagtgtcctgacagcttcttaactttgtgtaatgatgggtagcagatggatgcgttcacagcattcttatcagcttcattttgttgaagccctcatgtaatcatctttgtcgaattcgccttgcatcagtaaaattctttctattgtca

SEQ ID NO: 2345 - DNA, 887 bp, Rosa hybrid cultivar
aaacccagggttttgtttcttctgggtttgaatctctctccctctctcgctctctctcgaagtctcacactcctcgcagatcaaaaattctctgagccaaaacagagagaccggagatctcctcggagctgtaaaaatggtgacgtcggcggtggtcaacacctatccactgtccagctacaccttcgggaccaaagagcccaagatggagaaggacacctccgtcgccgatcgcctcgctcgcatgaaagtcaactatatgaaagaggggatgaggacaagcgtcgaagctattttactggtacaggaacataatcatccccacatactgcttctgcagattggaaacacgttctgcaaacttcctggtggacgactgaagcctggggagaatgagattgaggggctgaaaagaaagctcaccagcaaacttggtgctaattcagcaaaccttgtccctgattggcagataggagaatgcgtcgctatctggtggaggccaaactttgaaaccataatgtatccatattgccctcctcacataacaaaaccaaaggagtgcaagaagcttttccttgttcacttatctgagagggagtactttgctgtgccaaagaacctaaaactccttgctgttccgttgtttgaactctatgacaatgttcagagatatgggcctgttatatctacaattcctcagcagctttccagattccaattcaacatgatcagttcatgagtggaggatggaactttgaagttactgggatagaactctccaatataatgacgatcatatcttaatatcattgcatggactgatagagctgaagatctggacattatttcgttgcttaacttgagttggttagttttggatacagcta

SEQ ID NO: 2346 - DNA, 1224 bp, Tabernaemontana elegans
gcccgcaatattctggagagggaagttgataccgagaacctgagcagagatttgtagacggaggaagagccagaatggtgacgtcgccggtggttaacacatacccgctgtcgagctacaccttcggtaccaaggagccgaagatggagaaagacacttccgtcgccgaccgccttgctcgcatgaaagtcaattatatgaaggagggcatgaggactagcgtcgaaggaattttattggtgcaagagcataatcatccccacattcttcttctgcaaattgggaatactttctgcaagcttcctggtgggcgcctgaagcctggagagaatgaaattgagggtttgaaaaggaagctatctagcaagcttgctgctaattcacctggtctgcagccggactggcagatcggtgagtgtgtagctatttggtggagacccaattttgaaaccataatgtacccatactgtcctccacacataacaaaacctaaggagtgcaagaagcttttccttgttcacctttctgagagagagtactttgcagttccaaagaacttgaagcttctggctgttccattatttgaactctatgataatgttcagagatatgggcctgtgatatccacaattccacagcagctgtcgagattccagttcaacatgatccatccataaataaaaaatggtccttatctggagagcatcttactggagaattggagttgggggtctgcaggtcacaaagtttcacatgcaacagacgtcatatgatcctcctttctacaacctgactttcagtttagcaggcattctattctcacatggatattaatttgttttgcaattaagatattcttgacctacatggatgtagtgtagaacaattgtaagagcagctggttgataatgatatttgtgaggtggtggataagtggatgttgttgggtgtttcaactatcacaccgttgtcgggctttatgttttctaccttttctggttttcacgtaaatcatatgtcattttattgtatggtgactttcaattgagtcaatagttgtaaaaggtagtagttgtagtggtctatagctcccgtgcaaagatagttcagactaagctttggtgacaaaggtctgcacatgacaaattgtgggcagatggccattctgaaggccccatcgggaaacaaccttgtgcatccgcaggtgctttagaaaggtcgttt

SEQ ID NO: 2347 - DNA, 961 bp, Nicotiana tabacum
  misc_feature (7)..(7): n is a, c, g, or t
ggccgcngcacaatattcccccggtgacagccaccccctttctcccgtcggcgacatctaagagccgaaagccgcgtaaaagacatcgtcatttgcgtagcgaaacacagaaagagagagaaaatggtaacttcatcggttgtgaacacatacccactgtccagttatacatttggtactaaggagcccaaaatggagaaggatacctccgtcgccgatcgccttgctcgtatgaaagtcaactattttaaggagggcatgaggactagtgtcgaaggaattctgttggtacaagaacataatcatcctcatattcttcttctgcaaattgggaacacattctgcaaacttccaggtggacgcctgaaaccaggagagaacgaaatcgagggtttgaaaaggaaactctccagcaaacttgcagctaattctcctggtcttcagccaaattggcagattggtgagtgtgtggccatctggtggaggccaaactttgagactataatgtatccatattgccctccacacataacaaaacccaaggagtgtaagaagctctttgttgttcatctatctgaaagagagtactttgcagtcccaaaaaatctgaagcttcttgctgtgccattgtttgaactttacgacaatgttcagagatatggtcccgtgatatccacaattccccaacagctttccagattccagttcaacatgatccatccgtagattagttttatggacattcaggagctccttctggcatacaattgcacaagacataagatttttagttgaggtcccatattttgagaatgataaccctattttctgacatgaatctctcatttccagtaggcatatggactgattttcgtggatgtttatttgttttcgattggcttatttctgatggacatcctaggtgaattgttgaaagcttgtttgcttgcctgttgtaatg

SEQ ID NO: 2348 - DNA, 893 bp, Tripterygium wilfordii
atgatgttcgcgagttcgagctgaacccgtagatcggttttatcggatctagcattccctccctcaccgtatttgaattgaaatcgggaagctcaggaattcggattcgtcattcgtcgtctccttacattatatacagagtcacctaaacagtttgcgtgtggcaagtgcgagcgagttgaaattaagtcggagaagaaaaagagagacggagatacagagagatggtgacgtcttcggtggtgaacacttatcctttgtcgagctacaccttcggaaccaaggagccgaagatggagaaggatacttccgttgccgatcgcctcgctcgcatgaaagtgaactatatgaaagagggtatgaggacaagtgtggaagcaatcctcttggtccaggaacataatcatccacacatacttctactgcaaattggaaacacattctgcaagcttcctggtggccgtctgaagccaggcgaaaatgaaattgagggcttgaagagaaagctgaccagcaaactaggtgccaattcatctgctttggtaccaaattggcagattggtgagtgtgtggctatttggtggagaccaaactttgaaactataatgtatccatactgccctccacacataacgaagcccaaggagtgcaagaagcttttccttgttcacttgtccgaaagagagtacttcgcagtgcccaagaatctgaaactgttggctgttccgttgtttgaactctatgataatgttcagcggtatgggccagtcatatcaactattcctcagcaactttccagatttcagttcaatatgattaccatataacttctctccgtggatttcaagaccctatttctggatggtagtgctgatatgttgtgcatcctaaca

SEQ ID NO: 2349 - DNA, 1341 bp, Abies balsamea
gaacccaaaagtagatgtttctttgacaccgctcgtgttacggccaaaaatataatatgagaagttttgaacgcaacgttttttccccgggccctgaaagttggtttgaaagttagtttctagagagcgaagctatcgattcccacgtcattattccactgcgaaaataaaaggaaggagaaacagaaccgacgtccgattcttctactgctgtcaggtttttgttctctcacgtataattcttaacctagagaagatgttgtcggggccggttgtaaatgcctaccctctgtcaagctacacctttgggacgaaagagcccaagatggagaaggacacctctgttgcagacaggctcgccagaatgaaagtaaattatatgaaagaaggcatgcggacaagcgtggaagctatccttctggtgcaggagcacaaccatccccatatactgttactgcagattggaaacaccttttgtaagctgcctggaggacgcttaaagcctggtgaaaatgaaattgaaggcttgaagcgcaaactgtcaagcaaacttgctgcaaattcaagtgctcttcaaccagactggcagattggagagtgtgttgctgtatggtggagacctaattttgagacattgatgtatccctattgcccaccccacattacaaaaccgaaggaatgcaagaagcttttcctggttcatctatccgaaagagaatattttgctgtccccaaaaatctgaaactgctcgctgttccactgtttgagctttatgataatgtgcagagatatggtccggttatctcaactattccgcagcagctgtcaaggttcacttttaacatggttaatgcatgaactccttgagggatggttttccgtcaataaaatattgtggaatgctttcttcagggaaacaaatctttgtagtatggtcgaattacaaagggttcataaaacttggcccattaatagagctgggacctttgcaacgatccttggctgtgaacatatagtttggcctgcttgttactaatggtgtttgtcgattagaggtacaaattattttctaacttagaattgtgacgtgtaaacagctagctatctacaaattgtcctgtaaaaattaaggttggaaaaacatgcatactaagctccgagaacaagtaatctataaagatatgattctgctggttagcagcattgttaattattggaccttgttctgcctattcaaggtcatacagctcacttgtgttattcactatggctcttaccatacatttctttttagtaaaacaaacttgaagcattataactaattataaattataatgttg

SEQ ID NO: 2350 - DNA, 1533 bp, Theobroma cacao
ataatgccagtactgttggtagtaccaaaatgttgcactgtctcagcttcttttaaaccatttctttttgtccatttgcctccctcccaattttcttctctctcccttccccgtactctgttagtctgtacccaaagactataaagaaacaatttgccgccggaaagagaaacggttcaacgatacgatagtttgaaactgtaaagcttatacaatttcggtgggtaattttgggagaggagagagatggtaacgtcaccggtggtgaacacgtatccactgtcgagctacaccttcggcaccaaagagccgaagatggagaaggacacgtccgtcgcggatcgccttgctcgcatgaaagtcaattatatgaaagagggtatgaggacaagcgttgaagcaattttactggtccaagaacataatcatcctcacattcttcttctgcaaattgggaacacattctgcaaacttcctggtgggcgcctgaagcctggagagaatgagattgagggtttgaaaaggaagctgaccagcaagcttggagctaattcacccgctcttgtgccagactggcagattggtgaatgtgtggccatctggtggaggcccaactttgagaccataatgtatccatattgtcctccccacatcacaaaacccaaggagtgcaagaagcttttccttgttcacttgtctgagaaagagtactttgcagtaccaaaaaatctgaaacttcttgctgtaccgttgtttgagctatatgataatgttcagagatatggaccagtcatatcaaccattcctcagcagctttccagattccagttcaacatgattactacttgactttggcatggatgtcaagagtgaaccttcctgcttgcatcctgactgctacatcctgagaatattgcttgggcatcaagagttgatggcctgatggtatttagtgagagaattctggtacttgggtatcctaagttgattaaggtgactgaaacattgacactatggcaaacttttgcaccctaatttggtcacaaaccatttttttagtgttcgcttttattatagtttaggtcactgctgatcatggtctgtcttgtctgagtcccttgtcacattggtctcccaacttagatggtttatggttttatacactttaagaatgatttaaccagctattgttttggggtataatgggctgtcatatcctggctatggaatatgtctgctttgttttcatgtaaagctgattgtgctcccagtgtaatgtgtaaggtggataattggctttgaatcttggtggatggttgttcattaaacaagcttacaatgctatcatgtctttgagcatgcaccaaatcaaaattttagggtacttgtattatttctactttgacagaatgaaattatggccaactggactgcagctgtggatggttcgtttgtgatggaatgaaaaaaaactacaagctcctattatttggattccattttttatttaatatataaatgtacatggaagtg

SEQ ID NO: 2351 - DNA, 1024 bp, Cichorium intybus
gcggggacctaatttcttttccaccaagtagcgctccacccccaaatcaaagagacgaccaacaattttgcttttgatcttcatctccactgcgtgattttgctaaagatcgagagcgatggtgacttcatcagtcgtaaacacataccctctttcgagttactcgttcggcacaaaagaacccaaaatggagaaagacacttctgttgctgatcgtcttgctcgcatgaaactcaactatatgaaggaaggtatgaggactagtgttgaagcaatcttactggtgcaagagcataatcatccccacattcttttactacaaattggtaacacattttgtaaacttcctggtggtcgattgaagcctggagaaaatgaaattgaagggttgaaaaggaaattgtcaagcaaacttgctgctaattcacctaacatgcaacctaattggcagattggcgagtgtgtagctgtatggtggaggccaaattttgaaaccattatgtacccatattgccctccacacatttcaaaacccaaggaatgcaagaaactttatgttgtacacttgtcagaaagagagtactttgcagtgcccaaaaatctgaaacttcttgctgttccactctttgagctttacgataatgttcagagatatggaccggtcatttcaactataccacaacagctttcaagatttcagttcaacatgatccctgcataaatccacacaggatttgacccttttacttctatcaattaaaaatttagtaacaaactttcttgaaagattttcatgcaatacttagttttatccgtggggattttgttgtacttagggattcgattttgtaccgaattgtttttctctttgtttgtggttctgtctaatttggtagagataggtaagactgttggcattatttatgagggatagagaccatcgacttatgtgacgtgtattgtatgcattttaagttgtacatcttttgtctactccggtgtcgttgatatttgtactttatgc

SEQ ID NO: 2352 - DNA, 778 bp, Cichorium intybus
tgattgctgttcagagaactcctgaatagtgaatacctcaaaggatttgcttcttgggaaaaccccgatccatctaaaaaatcttcgcatctgtctgtgctacctcaggcgatctaagaattcacctgaaaattctagcgagggaggaaaagtcaggtcaagatggttatgtcgtcggtggtgaatacgtatccactgtcgagctacactttcggcaccaaggagccgaagatggagaaggacacttccgttgctgaccgcctcgctcgtatgaaagtcaactatatgaaggaaggcatgaggacaagcgttgaaggaatcttgctggtacaggagcataatcatcctcatattctgcttttgcaaattgggaacactttctgtaaacttcctggtggtcgtttgaagccaggagaaaatgaagttgaggggttgaaaaggaaattatccagcaaacttgcagctaattctactggacttcagcccgattggcagataggagagtgtgttgctgtttggtggaggcctaattttgagaccataatgtacccatattgccctccacacataaccaaacccaaggagtgtaagaaactttttcttgttcatttgtcggaaagagagtactttgcagtgccaaaaaatttaaaacttcttgctgttcctttgtttgagctttatgacaacgttcagagatatggacctgtgatatctaccattccacaacagctgtctagatttcaattcaacatgatccacacataaactccatgagcta

SEQ ID NO: 2353 - DNA, 999 bp, Cirsium arvense
caaacagcaatcgattcgatctttgaatctgtgtttgtggaagaaatcgagtgcaaaatggtgacttcatcagtggtaaacacataccctctttcgagctactcgttcggcaccaaagagcctaaaatggagaaagacacctccgttgctgatcgtcttgctcgtatgaagcttaactatatgaaggaaggtatgaggaccagtgttgaagcaatcttactggtgcaagagcataatcatccccacattcttcttctgcaaatcggcaacacattttgtaaacttcctggtggtcgattgaagcctggagaaaatgaaattgaaggcttaaaaaggaaattgtcgagcaaacttgctgctaattcaccgaatatgcaacctaattggcagattggtgagtgtgtggctgtttggtggaggccaaacttcgaaactattatgtacccatattgccctccacatatctcgaaacccaaggaatgcaagaagctttatgttgtacatctgtcagaaagggagtactttgcagtgcctaaaaatctgaaacttcttgcggttccactgtttgagctctatgataacgttcagagatatggaccagtgatttcaactattccacagcagctttcgagatttcaattcaacatgattccggcataaatatgcatcatccagttcaagccattttaacttcgagaaacttaaattagtaacaaccgttcttcaaaagttatcgcatttatagaacccgattccaaagtttaagtcgagtccattgatactttgttgtagtttgtatcttgaaattgaatagttagcttgcaacttcgaagccttttcttgaagcggaaatggtcgaatgaggcaatcgtgctttattaacttgtaccttgtccagtaaaagttgtattttgcttcgggatcttattgttttttgtttcgggaaatggcttcattgttttgtgtttgtttgtagtaccctctattttggtagagaga

SEQ ID NO: 2354 - DNA, 1154 bp, Cirsium arvense
aacagcaatcacttcgatctttcaaatttttgtgtttgtgcgatcgatcgagagaaaaagatggtgacttcatcagttgtaaacacataccctctttcaagctattcgttcggcacgaaagaacctaaaatggagaaagacacttctgttgctgatcgtcttgctcgtatgaaactcaactatatgaaggaaggtatgaggaccagtgttgaagctatcttactggtgcaagagcataatcatccacacattcttcttctgcaaattggcaacacattctgtaaacttcctggtggtcgactgaagcctggagaaaacgaaattgaaggcttaaaaaggaaattgtcaagcaaacttgctgccaattcaccgaatatgcaacccaattggcagattggtgagtgtgtggctgtatggtggaggccaaacttcgaaactattatgtacccatattgccctccacacatctcaaaacccaaggaatgcaagaagctttatgttgtacacttgtcggaaagagagtactttgcagtgcctaaaaatctgaaacttcttgccgttccactgtttgaactctacgataatgttcagagatacggacccgtgatttcaactatcccgcagcagctttcaagatttcagttcaacatgattcccgcataaatatgcacccaattcacgccattttacttcaagaaacttaaattagtaacaaccgttcttcaaaagttatcttttcacataacctattccaaagattaagtcgaacccattggtagtttgttgtagtttgtatcttgaaatgctagagttaacttgcaacttcaaagccttttcctgaagcggaaaacggtcaaatgaggcaatcgtgctttagtaacttgtaccgtgtgcttttaaagttgtattttgctttgggttttactgttttttgtttgggaaagggtttatcgttttgtgtttgtttgtagtttcctctattttggtagaagagatagttgagaccatttgctttatttatgagggatagagattattaactattgtgacttgtactttgtgcattgaagttgtacattgcttgcttttaggtatttcgtgtttattacaagtatattatttcggaaccaaaaaagaaaaaaataccgactgcg

SEQ ID NO: 2355 - DNA, 1039 bp, Cirsium arvense
tagccttcgaaaccccaagatcaaaagagatcgatctcacaaacagcaatcgattcgatctttgaatctgtgtttgtggaagaaatcgaggtgcaaaatggtgacttcatcagtggtaaacacataccctctttcgagctactcgttcggcaccaaagaacctaaaatggagaaagacacctccgttgctgatcgtcttgctcgaatgaagcttaactatatgaaggaaggtatgaggaccagtgttgaagcaatcttactggtgcaagagcataatcatccccacattcttcttctgcaaatcggcaacacattttgtaaacttcctggtggtcgattgaagcctggagaaaatgaaattgaaggcttaaaaaggaaattgtcgagcaaacttgctgctaattcaccgaatatgcaacctaattggcagattggtgagtgtgtggctgtttggtggaggccaaacttcgaaactattatgtacccatattgccctccacatatctcgaaacccaaggaatgcaagaagctttatgttgtacatctgtcagaaagggagtactttgcagtgcctaaaaatctgaaacttcttgcggttccactgtttgagctctatgataacgttcagagatatggaccagtgatttcaactattccacagcagctttcaagatttcaattcaacatgattcctgcataaatatgcatcaccctattcaagccattttaacttcgagaaacttaaattagtaactacctttcttcaaaagtgattgcatttacagaacccggttccaaagattaagtcgagtccattgatactttgttgtagtttgtatcttgaaattcaatagttagcttgcaacttcgaagccttctcttgaagcggaaatggtcgaatgaggcaatcatgctttattaacttataccttgtccagtaaaagttgtattttgctttgggatcttattgttttctgttttgggaaatggcttcattgttttgtgtttgtttgtagtaccctttattttggtagagaga

SEQ ID NO: 2356 - DNA, 1151 bp, Coffea canephora
cggccggggaccgcctgcaaattccggagagggaaaagattttgtgatatgtcctaagcagtagaagtggactcgttataatctctgcagagccaaaagagaagaggaaaaagcagggcaagggctgtcagccgggggacggggagagagagacagagatagagggagatcgagagaaaatggtgacgtcatcggtggtgaacacgtacccgctttctagttacaccttcgggacaaaggagccgaagatggagaaagacacctccgttgccgatcgccttgctcgcatgaaagtcaattatatgaaggagggcatgaggactagcgtagaaggaattttactggtacaagagcacaatcatccacacattcttcttcttcaaattggtaatactttctgcaaacttcctggtgggcggttgaagcctggagagaatgaaatcgagggcttgaagcggaaactgtcaagcaaacttgctgctaattcagcagctcttcagccagattggcagattggtgaatgtgtggccatatggtggagaccgaattttgaaacgataatgtatccatactgccctccccacataacaaaacctaaggaatgtaaaaagcttttccttgttcacctttccgaaagagagtattttgctgttccaaagaacttgaaacttcttgcagttccattgttcgaactctacgacaatgttcagagatatgggcctgtgatctccactatcccacaacagctgtctagattccagttcaacatgatccatccttgatatacatgttgatatgcaggttgccggtttgctgtgactgaagcatgtccaacttgatggtatgacccatcctcagttgggcccaaactctattattctctcatggatatttaagtcatttcccgttttaagatactctggacctgcttcttagatgtaatgtaggagcatttgatcaaatcataacatggtgaatcaaagactatccggttaagaggccgtttcctttgggcttcatttgacaatttccagacatcattttttatgttttgtattttcactgtgtttgcctattgatatttgttattgtgctggatggatgtaagtggacccattatggtggaggttcacggtagttccctctggtgt

SEQ ID NO: 2357 - DNA, 1092 bp, Gossypium hirsutum
agcggaaatagcagataatgagtaatgtgacatatcgacaaatgcaatgagcctaataaacctatgcccattttacaacaatggttaggccctttcctgattattatcaatgggcttaactccttaataagacaatatttattgacctttcccacccttctctctccgtacccacaatcgaatttgccgccggggaaacaaacgtttcgactcggagagggagagatggtaatgtcacctgtggttaacacgtaccctttgtccagctacacctttggtaccaaagagccgaagatggagaaggacacgtccgtcgccgatcgccttgctcgcatgaaagtcaattacatgaaagagggcatgagaactagcgttgaagcaattttattggtccaagaacataatcatcctcacattcttcttctgcaaattgggaacacattctgcaaacttcctggtggacgactgaagcctggagagaatgagattgagggtttgaaaaggaagctgaccagcaagcttggcgctaattcacctgctcttgtgccagactggcagattggtgagtgtgtggccatctggtggaggcccaactttgagaccataatgtatccatattgtcctccccacatcacaaaacctaaggaatgcaagaagcttttccttgtccatttgtctgagaaagagtactttgcagtaccaaaaaatttgaaacttcttgctgtaccattgtttgagctttatgacaatgttcagagatacggacctgtaatatcaaccattccgcagcagctctctagattccagttcaacatgattactacataactgtggcgtggatgtgaagagggaaccttatccttacctcctgagagaacttgtaaggctgtagggtgatggtattgaatgagagatttttttgtgttccttggggggtacctaagttgatttgtacgcgacacttaaccttattcctaatatctagttaggtcatgtaggtctttcattaacaaatataaaataacattatttattattattattattaagttcaatacaaaaatggattaaaataataaattaaacacctgt

SEQ ID NO: 2358 - DNA, 978 bp, Euonymus alatus
ttaaagtcggagaaggaaagggatagtgcaatacagagagatggtaacgtcgccggtggtgaacacttatcctttgtctagctacaccttcggcaccaaggagccgaagatggagaaggatacttccgttgccgatcgcctcgctcgcatgaaagtcaactatatgaaagagggtatgaagacaagtgttgaagcaatcctcttggtccaggaacataatcatccacacattcttctactgcaaattggaaacacattttgcaagcttcccggtggacgtctcaagcccggtgaaaatgaaattgagggcttgaagagaaagctgaccagcaaactaggtgccaattcacctgctatggtaccagattggcagattggtgagtgcgtggctatgtggtggagaccaaactttgaaactataatgtatccatactgccctccacacataacgaagcccaaggaatgcaagaagcttttccttgttcacttgtccgaaagagagtactttgcagtgcccaagaatctgaaactgttggctgttccgttgtttgaactctacgataatgttcagcgttatgggccagtcatatcaactattcctcagcaactttcaagatttcagttcaatatgattaccatgtgactcactctctgtggatttcaagaccctattcctggacgctagtgctgatatgttgtgcgccctagcagaccttttccccctccctttattataagactgaatgtcctattataggaaggtggttggctgaaacaaacttttgacttgctccatatctgctgacacccaagtgtctctagattatttattcaagagtgatcgacatattgttagattccttgttgctcttattgacatatatcttgctatagtctagatgtttcagatgatgtatcatttgagtagtgttgaaaatgttttgtatcttattatgtttatgagatgtagtggtttac

SEQ ID NO: 2359 - DNA, 614 bp, Euphorbia peplus
aaaatggtgaactcatcagtggtgaacacgtatcctctttccagctacaccttcggcaccaaagaacctaagatggagaaagatacctccgttgctgatcgtcttgctcgcatgaaagtcaactatatgaaggaggggatgaggacgagcgttgaagctattttactggtacaggagcataatcatcctcatatacttcttctgcaaatagggaacacattttgcaaattgcctggtggacgactaaagccaggagagaatgaaatagagggtttgaaaagaaagcttacaagcaaacttggtgctaattcacctgctttggtgccagactggcagattggtgagtgtgtggcaatctggtggaggccaaattttgagaccatcatgtatccgtattgccctccccacataaccaagcctaaggaatgcaagaagctttaccttgttcacttgtctgaaagagagtactttgctgtccccaaaaatttgaaacttcttgctgtcccactgtttgaactctatgataatgtgcagagatatggacctgttatatcaaccattccccaacagctttccagattccagttcaacatgattactacgtgaattaaggc

SEQ ID NO: 2360 - DNA, 1105 bp, Gossypium raimondii
ggagcggaaatagcagctaatgagtaatgtgacaaatcgacaaatgctatgagcctaataacataagcccattttacaacaatggttagaccctttcctgattattttcaatgggcttaactcattaataagaccattttcattaaccttttcacacccttccctctccctacccacaatcgaatttgccgccggggaaacaaacgtttcgactcggagagggagagatggtaatgtcacctgtggttaacacgtaccctttgtccagctacacctttggtaccaaagagccgaagatggagaaggacacgtccgtcgccgatcgccttgctcgcatgaaagtcaattacatgaaagagggcatgagaactagcgttgaagcaattttattggtccaagaacataatcatcctcacattcttcttctgcaaattgggaacacattctgcaaacttcctggtggacgactgaagcctggagagaatgagattgagggtttgaaaaggaagctgaccagcaagcttggcgctaattcacctgctcttgtgccagactggcagattggtgagtgtgtggccatctggtggaggcccaactttgagaccataatgtatccatattgtcctccccacatcacaaaacctaaggaatgcaagaagcttttccttgtccatttgtctgagaaagagtactttgcagtaccaaaaaatttgaaacttcttgctgtaccattgtttgagctttatgacaatgttcagagatacggacccgtaatatcaaccattccgcagcagctctctagattccagttcaacatgattactacataactgtggcgtggatgtgaagagtgaaccttatccttacctcccgagagaacttggaaggctgtagggtgatggtattgaatgagagattttttgtgttacttgggggataccaaagttgacttgtacgtgacacttacttaaaccttattcctaatatctagttagctcatgtaggtctttcattaacagtgcatttacaaatataaaataacattatattttttttattaagttcaatatataaatggctaaaatgataattaaacacctgtaaa

SEQ ID NO: 2361 - DNA, 1359 bp, Pinus pinaster
atataataccataacgatttgaacccttgcatgtgccttaggtaaatcccacgtcgattcaacttcttttcattttacaccgattgtgttacggcccaaaaggaacatgaaaagatttgaatgcaggtttcgttggcggttttcctgaagtttccggagagagctgctattccattcgcagtcgtaaatagcccatagaaggaagaaataagaaagctcgctgctgctgaattcttgatctctgacgcataatacatcggcaagagaagatgttgtcgggaccggttgtaaatgcctaccctctgtcaagctacacatttgggaccaaagagcccaagatggagaaagacacctctgttgcagacaggcttgcaagaatgaaagtcaattatatgaaagaaggcatgcggacaagtgtggaagctatcctcctggtacaggagcacaaccatccccatatactgttattgcaaattggaaacaccttttgtaagttgcctggaggacgcttaaagcctggtgaaaatgaaattgaaggcttgaagcgcaaactgtcaagcaaacttgctgcaaattcaagtactcttcaaccagactggcagattggagagtgtgttgctgtatggtggagacctaattttgagacattgatgtatccttattgtccaccccacattacaaaaccaaaggaatgcaagaagctttttcttgttcatctatccgagagagaatattttgcagtccccaaaaatctgaaactgcttgctgttccactgtttgagctctacgataatgtgcagagatacggtccggttatctcaactattccacagcagctgtcaaggttcacttttaacatggttaatgcatgaacttcattgagggccggttctgtcaataaattattgaggacctgctttcttcaggaaaaacatactttgtaatatggttgaattatcaagggtccataaaatttggcacatcaatagagccgggacctttgcaattgtttgggaacataaggtttggcctgcgtgttatttataacttatggtgtttatcgtttagagatacaaactatttccttattgaattgtgacgtgtatgcttgctacctacagttgtcttgtaaaattaggttggaaagacatacttactaagcttagggaacaaataaactataaatacatcattctgttggccatcagcattgttaattttggaccgtgttctgcttattcaatgttatgaagctcatttttgtattgattatggctcttactggagagattgctagtggagcaatgtttaaacattttaactacagtataaatagtgagcacattatttgtacaaacg

SEQ ID NO: 2362 - DNA, 1529 bp, Quercus alba
atggggaatttggaatatggtcgttggcccgttgccctgctgatctccattctgcaatatttagagtttagagcgtgtctcgaaactttgattgacagagaattcaattcctttgtagagttttgcatagtagactcagttcggctgagctcctcctctcgatttccatagatttagagagagagagagagagagacacacacagagtgtagaagagaaacagagagagagagagagagagggacagagatggtgacttcatcggtggtgaacacgtacccactgtcaagctacaccttcggcaccaaagagcccaagatggaaaaagatacctccgtcgctgatcgcctcgctcgcatgaaagtcaactatatgaaggagggaatgaggacgagtgtcgaagggattttgctggtacaggaacataaccatcctcacatacttcttctgcaaattggaaacactttctgcaaacttcctggtgggcgtttgaagccaggagagaatgaaattgagggcttgaaaagaaagctgaccagcaagcttggtgctactgtaccagctcttgtgccagactggcagataggtgaatgtgtggctgtttggtggaggccaaactttgaaaccataatgtatccttattgccctccccacataacaaaacccaaggagtgtaagaagcttttcattgttcacttgtctgagagggagtactttgcagtccccaaaaatttgaaacttcttgctgttccattgtttgaactctatgataacgttcagagatatggaccagttatatccaccattcctcagcaactctccagattccagttcaacatgattgctaaatgagcattagtttctaaagctcacatcctgatagcctgcttataattatctgaagttcgtacctttgatttaattgcatggactactagggctcagacctgattattacttcatagctgaatttaagttggtttagaaggggtttctccagttatgctgataattgaagcttatctattgacatggtctctttgtttggtcctttagaatatctaatgatgcgttctgtgtaagtgtagaattcttgttccaacaaggtttctgttgagttcttggagtcatttactgtagtttaagtccaatgggtttacttttcagtgggatggaatgagttataacgttctgctttgcgatttccgacaatttttttgtaatttaattgattatgcttgtaatattataggtgaaattagggtacaaacagaggagatatgtagcatgtattgtccaaagccttgtagcttagtcacattgcttggtctcctttataaggagaatcagggtctgaatcccccatcccccacttgtaacaattgaattatcaaaaaagatacatagcatgtatcggttgcttatgcttatcttggtgtagtttctttgacagctacttggtctcattttggacatgggatcatccttcgtgtaactgtctttattaatgaagttgttgcttttgcatg

SEQ ID NO: 2363 - DNA, 1526 bp, Pinus taeda
gggggataccataacgatttgaaccccttgcatgtgactaattaggtaaatcccacgtcgattcaacttcttttcattttacaccgattgtgttacggtccaaaaggaacacgaaaagatttgaatgtgggtttcgttggcggttttcctgaagtttccagagagagctgctataccattcgcagtagtaaacagcccatagaaggaagaaataagaaagctcgctgctgctgaattcttgatctctgacgcataatacatcggcaagagaagatgttgtcgggaccggttgtaaatgcctaccctctgtcaagctacacatttgggaccaaagagcccaagatggagaaagacacctctgttgcagacaggctcgcaagaatgaaagtcaattatatgaaagaaggcatgcggacaagtgtggaagctatcctcctggtacaggagcacaaccatccccatatactgttactgcaaattggaaacaccttttgtaagttgcctggaggacgcttaaagcctggtgaaaatgaaattgaaggcttgaagcgtaaactgtcaagcaaacttgctgcaaattcaagtactcttcaaccggactggcagattggagagtgtgttgctgtatggtggagacctaattttgagacattgatgtatccttattgtccaccccacattacaaaaccgaaggaatgcaagaagctttttcttgttcatctatccgagagagaatattttgcagtccccaaaaatctgaaactgctcgctgttccactgtttgagctctacgataatgtgcagagatacgggccggttatctcaactattccacagcagctgtcaaggtttacttttaacatggttaatgcatgaacttcattgagggccggttctgtcgataaattattgaggacctgctttcttcaggaaaaacatactttgtaatacactaatacggttgaattaccaagggtccataaaatttggcacatcaatagagccgggacctttgcaattgtttgggaacataaggtttggcctgcatgttgtttataacttatggtgtttatcgtttagagatacaaactgcttccttattgaattgtgacgtgtatgcttgctacctacagttgtcttgtaaaaattaggttggaaagacatgcttactaagcttagagaacaaataaactataaatacatgattctgttggccatcaacattgttaatttttggaccatgttctgcttattcaatgttgtgaagctcatttttgttattgattatggctcttactggagagatttctagtggagcaatgtttaaacattataactacagtataaaggtgagcacattatttgtcacaaatggggaaatgtaatggtatttttctattggctacctttccaatgtttttgtggctcttgccataaattttcatcatatactaggaacaggggaaattttaggggcttattcaagctcatttttttgttctactatggcttattatcagaaagat

SEQ ID NO: 2364 - DNA, 886 bp, Platanus occidentalis
aaaccggcgggagagaggatggttacgacgccggtagtgaacacataccctctctcgagctacaccttcggaaccaaggagccgaagatggagaaggacacttcagtcgcagatcgtctcgctcgaatgaaagtcaattatatgaaagaaggcatgcggacaagtgtcgaagctattttattggtacaggagcataaccatccgcatatactgcttctgcaaattgggaacaccttttgcaaacttccgggtgggcgtttgaagcctggagagaacgaaattgagggtttgaagcggaaactctctagcaaacttgccgctaattcaactgcccttcagccagattggcagataggagaatgtgtagctatctggtggaggccaaattttgaaactataatgtacccttactgccctcctcatattacgaaaccgaaggaatgtaagaagcttttccttgttcacctgtctgaaagggagtactttgccgtaccaaaaaacttgaaattgcttgctgtcccactatttgagctctatgataatgttcagagatatgggccagtcatctccactatcccgcagcagctgtctaggtttcagttcaacatgatcaatgcatgaaacatgtagagatccccagatctcatccttgtggggagtctaaatttttgcggattgacatttctactgaagctaatccaacctaaccttattgcctgtttagatagtgtatatttggtactgtagactttattcttctgcacctataaactggttgatcttgtttgagttcgtgttcttctatgaaattgggtcctgcaagtctttggcgttgaactcagatataagttatttacgtggctgttggaggtggttagaaatagtc

SEQ ID NO: 2365 - DNA, 988 bp, Pseudotsuga menziesii
gctgaaacaaaagaaaggaagaagaaaaccaacttttgcttctactgctgtcgggtccttgatttctgacgtataattcatccgcaagagaagatgttgtcgggaccggttgtaaatgcctaccctctgtcaagctacacatttgggaccaaagagcccaagatggagaaggacacttctgttgcagacaggcttgctagaatgaaagtcaattatatgaaagaaggcatgcggacaagtgtggaagctatccttctggtgcaggagcacaaccatccccatatactgttactgcaaattggaaacaccttttgtaagttgcctggaggacgcttaaagcctggtgaaaatgaaattgaaggtttgaagcgcaaactatcaagcaaacttgctgccaattcaagtgctcttcaaccagactggcagattggagagtgtgttgctgtatggtggagacctaattttgagacattgatgtatccttattgtccaccccacattacaaaaccaaaggagtgcaagaagcttttccttgttcatctatccgagagagaatattttgcagttcccaaaaatctgaaactgctcgctgttccactgtttgagctctatgataatgtgcagagatatggtccagttatctcaactattccacaacagctgtcaaggttcacttttaatatggttaatgcatgaactcctttgaggggtggttttctgttgataaaatattgactcttgaggactgttttcttcagggaaaacagactttgtaatatggttgaattacattattataaatggtccataaaacttggcccattatagagatgggatttgcaattggctgtgaacatgaagtttggccgctggcatgcgtgttagtttatggtgtttgtcatttagagttacaaactgtttcctaacttgtagaattgtgacttgtaaaatgctacctatccacaaaattgttttgtaaaaattaggt

SEQ ID NO: 2366 - DNA, 928 bp, Carthamus tinctorius
  misc_feature (9)..(9): n is a, c, g, or t
  misc_feature (805)..(805): n is a, c, g, or t
  misc_feature (807)..(807): n is a, c, g, or t
  misc_feature (828)..(828): n is a, c, g, or t
cggggattnatttctccaatagccttcgaaccccaagatcaaagaagacccacaaacagcaatcgactcgatctctcaatctgcgtctggggaagaaatcgaggtgcagaaatggtgacttcatcagtcgtaaacacataccctctttcgagctactcgttcggcaccaaagaacctaaaatggagaaagacacctctgttgctgatcgtcttgctcgtatgaagcttaactatatgaaggaaggtatgaggaccagtgttgaagcaatcttactggtgcaagagcataatcatccccacattcttcttctgcaaatcggcaacacattttgtaaacttcctggtggtcgattgaagcccggagaaaacgaaattgaaggcttaaaaaggaaattgtcgagcaaacttgctgctaattcaccgaatatgcaacctaattggcagattggtgagtgtgtggctgtatggtggaggccaaactttgaaacaattatgtacccatattgccctccacatatctcgaaacccaaggaatgcaagaagctttatgttgtacatttgtcagaaagggagtactttgcagtgcctaaaaatctgaaacttcttgcggttccgctgtttgagctctatgataacgttcagagatatggaccagtgatttcaactattccacagcagctttcgagatttcaattcaacatgattcccgcataaatatgcatcatcccgattcaagccattttaacttcgagaaaatttagtaactacctttcttcaaaagttatcgcatttacagaacccgatncnaaagattaagttgagtccatngatactttgttgtagtttgtatcttgaaaatgaatagttagcttgcaacttcgaagccgttttctgaagcggaaatgatcgaatgaggcaatcgtgcttt

SEQ ID NO: 2367 - DNA, 708 bp, Scabiosa columbaria
gatataagaaagttgacccggttgatttatttgagggaaggaagaagagcgagagagggaagaaaaatggtgatggcgccggtggtaaacacgtatcctctttccagctataccttcggaaccaaagaacccaagatggagaaagatacttctgttgcagatcgtctcgctcgtatgaaaaccaactatatgaaagaaggtatgaggaccagcgttgaagccattctattggtccaagagcataaccatccacatattctacttctgcaaattgggaacactttctgtaaacttcctggtggccgtctgaaacctggagaaaatgaaattgaaggcttgaaaagaaaattgtcaagcaaacttgctgctaatacgccttctcttcaacctaattggcaggttggcgagtgtgtagctacatggtggaggccgaactttgaaaccattatgtacccatactgccctccccatattacgaaacctaaggaatgcaaaaagctttaccttgtttacttgtctgaaagagagtattttgctgtgcccaaaaatctcaaactgctggctgttcctttatttgagctgtatgataatgttcagagatacggacctgtaatttcgacaatccctcagcagctttcaagatttcagttcaacatgattaatacatgaaggaatcaatgctccttaacttgtgcctttatttggggt

SEQ ID NO: 2368 - DNA, 1357 bp, Fragaria vesca
gggttttattcgttcctggggtttgaatctctcccactcccaaatcgaaatccccagaaacaaaaaccagaggccggagatctcaccggagctgtagaaatggtgacgtcggcgatggtcaacacctatccactgtcgagctacacgttcgggaccaaagagcccaagatggagaaggacacctccgtcgcagatcgcctcgctcgcatgaaagtcaactatatgaaagaggggatgaggactagcgtcgaagctattttactggtgcaggaacataatcatccgcacatacttcttctgcagattggaaacacgttctgcaaacttcctggtggacgactgaagccaggagagaatgagatcgaggggctgaaaagaaagctcaccagcaaacttggtgccaattcagcaaaccttgtccctgattggcagataggagaatgcgttgctatctggtggaggccaaactttgaaaccataatgtatccatattgccctcctcacataacaaaacctaaggagtgtaagaagctttttcttgttcacttatctgagagggagtattttgctgtgcccaagaacctaaaactccttgctgttccattgtttgaactctatgacaatgttcagagatatgggcctgttatatctacaattccacagcagctttccagattccaattcaacatgatcagttcatgaactgagcatggaacttagaaacccggatggaacttccaatataatgacgatcctatctttattatcattgcatggactgatagagctgaagatctggacattttttcgttgcttaacttgagttggttagtttggaattcagctatccagatggctgaagcataacttgtgatatggtctatctatctatattggtcattacgtttatttgctaatgggtttgcattactcttgaaactttctttgaactatgtattctgtgatgtgctagttcttgtagttttagtcttaacagcaaggatactgttgtttcttcctggcaaggaacattccttaagtttctgttagaactggggagtgatatagttagttgtaatagtgttattccaagattattgtggttataatgtcgtagcagaacttacttgtgcttcagtgtatttgtaatgttgggtaggacaaggatgtatgtagggtgtacgcggcagcttgtaacattttgcatcttgcatttcacagcattctcatagatttcatcttgagaagctgtctgacatgtattgatctttgtagaattcgcctttgatcaaatgaaagtttttctaggtgttttctttaagatacaaggctgataaatgtaggattgtgctttgtg

SEQ ID NO: 2369 - DNA, 1047 bp, Nicotiana tabacum
  misc_feature (784)..(784): n is a, c, g, or t
  misc_feature (831)..(831): n is a, c, g, or t
  misc_feature (837)..(837): n is a, c, g, or t
ggagtctcccgtcggcgacatctaattccatagagccgaaagcagcgcaaaaaagaaaaaaaaatatagtcatttgtgtaacgaaacacctaaagagagagaaaatggtaacgtcatcggttgtcaacacatacccactgtccagttatacatttggtactaaggagcccaaaatggagaaggacacctccgtcgccgatcgccttgctcgtatgaaagtcaactattttaaggagggcatgaggactagcgtcgaaggaattctgttggtacaagaacataatcatcctcatattcttcttctgcaaattgggaacacattctgcaaacttccaggtggacgtctgaaaccaggagagaatgaaattgagggtttgaaaaggaaactctccagtaaacttgcagctaattctcctggtcttcagccagattggcagatcggtgagtgtgtggccatctggtggaggccaaactttgaaactataatgtatccatactgccctccacacataacaaaacccaaggagtgtaagaagctctttgttgttcatctatctgaaagagagtactttgcagtcccaaaaaatctgaagcttcttgctgtgccattgtttgaactttacgacaatgttcagagatatggacccgtgatatccacaattcctcaacagctttccagattccagttcaacatgatccacccatagattagttttatggacattcaggagctccttctggcatacaattgcacaagacataagatttttacttgaggtcccanattttcagaatgataaccctattttctgacatgattctctcatttcnagtagncatatggactgatttttgtggacttctattaattttctattgacttatttctgatggacatcctaggtgtattgtcgaaagcttgtttgcttgcctgttgtaatgtacaatttactcattgctgtgtatttttggtttttgaatgcttcacatgtaagatggaatagcactgctatgtttcatctgttcaccagcggccgcatgagggta

SEQ ID NO: 2370 - DNA, 1186 bp, Solanum lycopersicum
aattttctttccaatcttctaagtagtccgtcaaagtacagaagcatcccatcaacggcaagagggaaaatctgaaaatacaaatattcttccggtgaacacccacccatcatctctgcttcagttctcccgccggcgatatctaattcccgtgaggaaggttgggtgaatcctcgtcatttgcatagaaagaaaatggtaacgacttcagttgtcaacacgtacccactgtccagctatacatttggtaccaaggagaccaaaatggaaaaggacacctccgtcgccgatcgccttgctcgtatgaaagtcaactatacgaaggagggcatgaggactagcgttgaaggaattctattggtacaagaacacaatcatcctcacattcttctattgcaaattgggaacacattctgcaaacttccaggtggacgtttgaaaccaggagagaacgaaatcgaaggtttaaaaaggaaactgtctagtaaacttgcagctaattctcctggcattcagccaaattggcaggtaggtgagtgtgtggccatctggtggaggccaaattttgaaaccataatgtatccatattgtcctccacacataacaaaacccaaggagtgtaagaagctcttcgttgttcatctatctgaaagagagtacttcgctgtcccaaaaaatctgaagcttcttgcggtgccattgtttgaactttatgacaatgttcagagatatggacctgtgatatccacgattcctcaacagctttccaggttccagttcaacatgatccacccgtagattaggttaggtggacattcagaacctcctcctggcatacaatcccaaaaatacatcaatatttttacttttccagtaggcatatctaccgactttcgtggatatttgttttcaactagcttattcatgatagacataaattataggtgtactgtttaaagctttgattgcctgtctgttgtaatgtaccataagttacaagttgccatgtatttctttcttcgtttttgaatgttgacatgttagatggaataccgctgcgatgtttcatttgttcactgaggctctcgtacagaattgtacttagtgatctccacaatggtaccgcctctctgcctcttgagttttgagtttatactcagcatgagatatagttcatttacatcgc

SEQ ID NO: 2371 - DNA, 892 bp, Tragopogon dubius
tcaaagagacccacgaacaatttcccttcaatcttcgatctcgactgcgcgtttgtgcgaaagatcgagagagatggtggcttcatcagtcgtaaacacctaccctctttcgagttactccttcggtacaaaagaacccaaaatggagaaagacacttctgttgctgatcgtcttgctcgtatgaaactcaactatatgaaggaaggtatgaggaccagtgttgaagcaatcttactggtgcaagagcataatcatccacacattcttttactacaaattggtaacacattttgtaaacttccgggtggacgattgaagcctggagaaaatgaaattgaagggttgaaaaggaaattgtcaagcaaacttgctgctaattcgcctaatatgcaacctaattggcagattggtgagtgtgtggctgtatggtggaggccaaactttgaaaccattatgtacccatattgccctccacacatctcaaaacctaaggaatgcaagaaactttatgttgtacacttgtcagaaagagagtactttgcagtacctaaaaacctcaaacttcttgcggttccactgtttgaactctatgataatgttcagagatatggaccggtcatttctactataccacagcagctttcaagatttcagttcaacatgattcctgcataaattactcacttcaatttaaatctagtaagagacattatcgaatttatataaacttgttgtactgttagtgagcaacttcaaaaactttgttttctgtttgtttggggttagagatagatcagaccgttgactattgtgacttgtactgtatgcatttcgagttgtacttttttttcgtatatttgttatggttttatttacatgggtttggataac

SEQ ID NO: 2372 - DNA, 903 bp, Tripterygium wilfordii
gaaatcaggatttgtctccctcgtctccttgccgaacattccatacagagaaccaccgaaacggtttgcttgtgaaaaagtgcgagagagttttgaaattaattctgggaagcaaagagagactgccatacagagagatggtgacgtcgccggtggtgaacacttatcctttgtccagctacaccttcggcaccaaggagccgaagatggagaaggatacttccgttgcagatcgcctcgctcgcatgaaagtcaactatatgaaagagggtatgagaacaagcgtggaagctatcctcttggtccaggaacataatcatccacacatacttctactgcaaattggaaacacattctgcaagcttcctggtgggcgtctgaagccgggagaaaatgaaattgagggcttgaagagaaagctgaccagcaaactaggtgccaattcacctgctttggtaccagattggcagattggtgagtgtgtggctatttggtggagaccaaactttgaaactataatgtatccatattgccctccacacataatgaaacccaaggaatgcaagaagattttccttgttcacttgtctgaaagagagtactttgcggtgcccaagaatctgaaactgttggctgttccgttgtttgaactctatgataatgttcagcggtatgggccagtcatatcaactattcctcagcaactttcaagatttcagttcaatatgattagttgattgccatatgacttctatctgtggatttcaagaccctatttctggatggtagtgccgaatgccgatatgttgtgggccctaacagaccttttttttctcctttccttattataagactgagtgtcctaggataggaaggattagctgaaacttactttgacttgct

SEQ ID NO: 2373 - DNA, 1145 bp, Olea europaea
atggtgacgtcaccgctagtgaacacatatcctctcgcaagctacactttcggcaccaaagagcccaagatggagaaagacacctccgttgccgatcgactagcccgtatgaaagtcaattacatgaaagaaggcatgaggacaagcgttgatgggattttattggttcaagaacataatcatccccacattcttcttttgcaaattggaaatactttctgtaaactccccggtggcagattgaagccaggagagaatgagattgaaggcttgaaaaggaagctctctagcaaacttgctgctaattcatctctgcagccagattggcagataggtgagtgtgtggctatctggtggagaccgaattttgaaaccacaatgtatccttactgccctccacacataacaaagcctaaggagtgcaagaagcttttccttgttcacttgtctgaaagagagtactttgctgtgcctaagaacttgaaacttctagctgtcccattgtttgaactatacgacaatgttcagagatatggaccagtcatatccactattccacagcagctatccaggtttcagttcaacatgatccaccagtaggattagtcatggactccgaactcagctgaggagttcaattggttagtgtaccacctcccgggatgactctgaaaattctatttcataccacgatcaatcttcctacgactgacttgacacttaaaattcggtacttgtttcagttattttagttttgttcaactcgcggtgagaaatttttctgctttagtacttgatatattataatgtcatgtaaactcatgtacaataatttaagagcggttgatgagacgattagatatgaaaacaagatttcttcctcatattgctgtctgggattcggtacaagaattgttcaagagttgtttgtcatcgacggatgaatttagaagacagatgaaagaaagatgtcactgtttgatctgatattgacaatatacatataaatatagaaatatagaggctgaatggaactctttaccatcctgtactactcaacaatataagggaaaaccgggatatgtgaaggatatttgttgctcgacatttagccatttttatacaaaatttcgcatgcaattgac

SEQ ID NO: 2374 - DNA, 790 bp, Allium cepa
  misc_feature (763)..(763): n is a, c, g, or t
ctctgttttcttgaagcagaaaacctaattatcccgaaatccataatcagacgaggacaagacgaatttcgaagaacgaaatggttgtaagctgcaataacatggaggtggtgaacacctacccgttgtcgaattacactttcggagtcaaggaacccaaaatggagaaagatacttctgttgccgatcgtctcgctcgaatgaaacaaaactattataaagaagggatgcggacaagcgttgaggctattttgttggtacaagagcacaatcatccccatatactgcttttgcagattggaaacaccttctgtaaacttcccggggggcgattgaaacccggagaaaatgaaatcgaaggtttaaagcgtaaattaagcagcaaacttgctgttagctcatcttcatttcaaccgaattggcagattggagaatgtgttggtgtctggtacagaccaaactttgagaccataatgtacccgtactgtcctcctcacatcactaagccaaaggagtgcaagaagcttttccttgtccacctgtcagaaaaggaatacttcgctgtcccaaaaaaacctgaaattgcttgctgttccattatttgaactctatgataatgttcagagatacggccctgtgatttcgaccatcccacaacaactttcaaggttccagttcaatatggttcaatcctaaattttttcagaaatgcagctctcatagtttggaaaatggcattgtcctataatgctaaaatagtagnttgtacttctgaagtatgtctaggaga

SEQ ID NO: 2375 - DNA, 667 bp, Fraxinus spp
agagagagaatggtgacgtcaccgctagtaaacacatatcctctggcgagctacactttcggcaccaaagagcccaagatggaaaaagacacctccgtcgccgatcgactagcccgtatgaaagtcaattacatgaaggaaggcatgaggacaagcgttgaggggattttattggttcaagaacataatcatccccacattcttcttttgcaaattggaaatactttctgtaaactcccaggtggcagattgaagccaggagagaatgagattgaaggcttgaaaaggaaactctctagcaaacttgctgctaattcatcttctctacagccagattggcagataggtgagtgtgtggctatatggtggagatcaaattttgaaaccacaatgtatccttactgccctccacacataacaaagcctaaggagtgcaagaagcttttccttgttcacttgtctgaaagagagtactttgctgtgcctaagaacttgaaacttcttgctgtcccattgtttagaactatatgacaatgttcagagatatggaccagtacatatccactattccactagcagctatccaggtttcagttcaacatgatccatcaataagattagtcatggactacgagatcagctgcggagttgaactggttagtgtgac

SEQ ID NO: 2376 - DNA, 925 bp, Olea europaea
cccgcgagagagagagagagaatggtgacgtcaccgctagtgaacacatatcctctcgcaagctacactttcggcaccaaagagcccaagatggagaagacacctccgttgccgatcgactagcccgtatgaaagtcaattacatgaaagaaggcatgaggacaagcgttgatgggattttattggttcaagaacataatcatccccacattcttcttttgcaaattggaaatactttctgtaaactccccggtggcagattgaagccaggagagaatgagattgaaggcttgaaaaggaagctctctagcaaacttgctgctaattcatctctgcagccagattggcagataggtgagtgtgtggctatctggtggagaccgaattttgaaaccacaatgtatccttactgccctccacacataacaaagcctaaggagtgcaagaagcttttccttgttcacttgtctgaaagagagtactttgctgtgcctaagaacttgaaacttctagctgtcccattgtttgaactatacgacaatgttcagagatatggaccagtcatatccactattccacagcagctatccaggtttcagttcaacatgatccaccagtaggattagtcatggactccgaactcagctgaggagttcaattggttagtgtaccacctcccgggatgactctgaaaattctatttcataccacgatcaatcttcctacgactgacttgacacttaaaattcggtacttgtttcagttattttagttgtgttcaactcgcagtgagaaattcttctgctttagtacttgacatattataatgtcatgtaaactcatgtacaattatttgagggctgatggatgagacgataggatgtgaaacaagatttcctccctcattttggctggctggggatcc

SEQ ID NO: 2377 - DNA, 1117 bp, Lactuca sativa
caagtttcacttttgctttgtgtacaaaaatattcaaatatttggtctttcaccctaatttcgtttctcaacaagtagccctccatccccaaatcaaatagacccgctaccaatttccttttgatcttcaatctccactgcgtgtttttgcgaaagatctagggagatggtgacttcatcagttgtaaacacataccctctttcgagttactccttcggcacaaaagaacccaaaatggagaaagacacttctgttgctgatcgtcttgctcgcatgaaactcaactatatgaaggaaggtatgaggaccagtgttgaagcaatcttactggtgcaagagcataatcatcctcacattcttctactacaaattggcaacacattttgtaaacttcctggtggacgacttaagcctggtgaaaatgaagttgaagggttgaaaaggaaattgtcaagcaaacttgctgctaattcgcctaatatgcaacctaattggcagattggtgagtgtgttgctgtatggtggaggccaaactttgaaactatcatgtacccatattgccctccacacatctcaaaaccaaaggaatgcaagaaactttatgttgtacacttgtcagaaagagagtactttgcagtgcccaaaaatctcaaacttcttgctgtcccactgtttgagctttatgataatgttcagagatatggaccagtcatatcaactataccacagcagctgtcaagatttcagtttaacatgatccctgcgtaagcgcacaccggattccagccattttatataacgtaatattaaatttagtaaaatcgttctctcgaatattttattggcatttatagaacctcatttaaagatttagtttaattcatcggctttatttaggagggaaagactattgtgacttgtattgtatgcatttcaagatgtacatcgttgttgtctattttcattattccatatcgttttatgtataagagtttagaaatcgttggtatgtggtatttgtactttatgcatttaagcttgtactctgtcttaggtatcgatagtatatgtatttgtgctttcttgtcactctttttttgctttgatgatccaagc

SEQ ID NO: 2378 - DNA, 823 bp, Beta vulgaris
gtaaaaatgagttgaaattgatcaaattgaaactaacctacgacgccacaaaacaaactcacacagccaaaatttttaagcagtggctgaagagagagagagtcgtcttcttcccgcgtcaccggctgaggagagagaaagtgagaggtcataaaaatggtggcgtcgtcgtcggtggttgcagtatatccattatcaagctacacttttggcaccaaagaacctaagcttgaaaaagacacttctgttgccgatcgtcttgctcgtatgaaagtcaattactttaaagaaggcatgaggaccagcgtggaaggaattttactagtccaagaacataatcatccacacattcttctgctacaaatcggaaacactttctgcaaacttcctggtggtcgtctgaagcctggtgaaaatgaaattgatgggttgaagagaaagctgtccagcaaacttggtgctaactcaactgctcatcaacctaattggcagattggtgagtgtgttgctaactggtggaggccaaatttcgaaacagtgatgtacccctactgtcctccccacatcacaaaacccaaggaatgtaaaaagcttttcatggttcacttgccagagcgagagtactttgctgtaccaaagaatctcaagttgttggctgttcccctctttgaactttatgacaatgtccagagatatggacccgtgatatccacaatacctcagcagttgtcgagattccaattcaacatgatctctccttgatttccactaatctatggcttcactatcaatttggatgggtagcaggtgttgttttattggt

SEQ ID NO: 2379 - DNA, 1343 bp, Manihot esculenta
agtttcgaaaagtttacggaagtcctggtacttgagaaacatcccaattagaagtaattggcagatcactgggtttatttaaatccctagttcctccgttctccccgcccttcttccgttttggctcttgctgctgagcattttacaggactttccttcaatttagacaggaagaagatagaccagtccttccttgatctcgtttaggggcggaggtcgagtaggagaaaaatatggtgaactcagcggtggtgaacacctatcctctgtcgagctacacattcggcaccaaagagccgaaaatggagaaagatacctccgtcgctgatcgtcttgctcgcatgaaagtcaactacatgaaagaagggatgaggacaagtgtcgaagcaattttgctggtacaagagcataatcatcctcacatacttcttctgcaaattgggaacacgttctgcaaactgccaggcggacgtctaaagccaggagagaatgaaattgagggtttgaaaagaaaattgactagcaagcttggtgctaattcagccgctctggtgccagattggcagattggtgaatgtgtggccatatggtggaggcctaactttgagaccatcatgtacccatattgcccacctcacataacaaagcctaaggagtgcaagaagcttttccttgttcacttgtctgaaagagagtactttgcagtacccaaaaatttgaaacttcttgctgtcccattgtttgaactctatgacaatgtgcagagatatgggccagtcatatccaccattcctcaacagctttccagattccagttcaatatgatcacgacatgattttagccgggatttctggagttacaccttctatcttttgcttggattcatggaggcaactgacaatgtcacggatctgaatgctgatactaagatgcacttcgtcactgatttttcaagttattggtattcaacttagctagattgagttatgtatgtgtatcaactaatttagtatctttatagtttcaaactcagtgtgctagtgtaaggatgttgtgatgcttttgtgctttgcatttcctggtggaaatgtctctacggatatgatgctgctgccgctgttatctatagagaaaaagacataggattgtttttgtctacctagtttgttttcatttttttgtctggaacataaattttggttaaatagggtccatgtgcttggattttagggaaaagtatactgtgcatttgttggtaagaaaaatgatgtattctaagaaggtggactggtacaatttgtgttgcacttgaaagtgagtaaagattgtgtgattgaacggc

SEQ ID NO: 2380 - DNA, 830 bp, Centaurea maculosa
  misc_feature (43)..(44): n is a, c, g, or t
  misc_feature (70)..(70): n is a, c, g, or t
  misc_feature (111)..(111): n is a, c, g, or t
cggggggatttgaattatcgtcggtgttcgagaacttccgatnnatcctacctacctccggcgatcgganaattcaccttcaccgttcaaattctagagatcggagctttnttccggtgaagatggtgacgtcggcggtggtgaacacgtatccattgtcgagctacaccttcggcaccaaggaaccgaagatggagaaggatacttccgttgctgatcgtctcgctcgtatgaaagtcaactatatgaaggaagggatgaggacgagcgttgaaggaattttgctggtacaggagcataaccatcctcatattttgcttttgcaaattgggaacactttctgcaaacttcctggtggtcgtctgaagcccggagaaaatgaaattgagggcttgaaaaggaaattgtccagcaaacttgcagctaattctactggacttcagcccgattggcagataggagagtgtgttgctatatggtggaggcctaattttgaaaccataatgtacccgtattgccctccgcacataaccaaaccgaaggagtgtaagaaacttttccttgttcacttatcagaaagagagtactttgcagtgcccaaaaacttaaaacttcttgcggttccattgtttgagctttatgacaatgttcagagatacgggcctgtgatatccaccattccgcagcagctttctagatttcagttcaacatgatccatgcataaactttgtgagcctaagccgagcaaaagaagaagaatgcgatgatatatttaaaacgacagtttactgcattgtgatgatcaaaatgggtgtcccttaaggttcat

SEQ ID NO: 2381 - DNA, 1129 bp, Centaurea maculosa
  misc_feature (10)..(10): n is a, c, g, or t
  misc_feature (48)..(48): n is a, c, g, or t
  misc_feature (54)..(54): n is a, c, g, or t
  misc_feature (69)..(69): n is a, c, g, or t
  misc_feature (73)..(73): n is a, c, g, or t
  misc_feature (85)..(85): n is a, c, g, or t
  misc_feature (89)..(89): n is a, c, g, or t
  misc_feature (201)..(201): n is a, c, g, or t
  misc_feature (205)..(205): n is a, c, g, or t
  misc_feature (214)..(214): n is a, c, g, or t
  misc_feature (394)..(394): n is a, c, g, or t
  misc_feature (418)..(418): n is a, c, g, or t
  misc_feature (430)..(430): n is a, c, g, or t
  misc_feature (451)..(451): n is a, c, g, or t
  misc_feature (460)..(460): n is a, c, g, or t
  misc_feature (484)..(484): n is a, c, g, or t
  misc_feature (554)..(554): n is a, c, g, or t
  misc_feature (559)..(559): n is a, c, g, or t
  misc_feature (565)..(565): n is a, c, g, or t
  misc_feature (667)..(667): n is a, c, g, or t
  misc_feature (679)..(679): n is a, c, g, or t
  misc_feature (703)..(703): n is a, c, g, or t
  misc_feature (723)..(723): n is a, c, g, or t
  misc_feature (792)..(792): n is a, c, g, or t
  misc_feature (794)..(794): n is a, c, g, or t
  misc_feature (823)..(823): n is a, c, g, or t
  misc_feature (841)..(841): n is a, c, g, or t
  misc_feature (861)..(861): n is a, c, g, or t
  misc_feature (904)..(904): n is a, c, g, or t
  misc_feature (907)..(907): n is a, c, g, or t
  misc_feature (910)..(910): n is a, c, g, or t
  misc_feature (939)..(939): n is a, c, g, or t
  misc_feature (945)..(945): n is a, c, g, or t
  misc_feature (988)..(988): n is a, c, g, or t
  misc_feature (1009)..(1009): n is a, c, g, or t
  misc_feature (1021)..(1021): n is a, c, g, or t
  misc_feature (1024)..(1024): n is a, c, g, or t
  misc_feature (1029)..(1029): n is a, c, g, or t
  misc_feature (1035)..(1035): n is a, c, g, or t
ttggcggggncctaatttattcatttctccaatagatcaagagacccncaaacngcaatcgattcgatntttnaatctgtgtttntggnagaaatcgaggtgcaaaatggtgacttcatcagtggtaaacacataccctctttcgagctactcgttcggcaccaaagaacctaaaatggagaaagacacctccgttgctgntcgncttgctcgnatgaagcttaactatatgaaggaaggtatgaggaccagtgttgaagcaatcttactggtgcaagagcataatcatccccacattcttcttctgcaaatcggcaacacattttgtaaacttcctggtggtcgattgaagcctggagaaaatgaaattgaaggcttaaaaaggaaattgtcnagcaaacttgctgctaattcaccnaatatgcaaccnaattggcagattggtgagtgngtggctgtntggtggaggccaaacttcgaaacnattatgtacccatattgccctccacatatctcgaaacccaaggaatgcaagaagctttatgttgtacatntgtcngaaagngagtactttgcagtgcctaaaaatctgaaacttcttgcggttccactgtttgagctctatgataacgttcagagatatggaccagtgatttcaactattccncagcagctttcnagatttcaattcaacatgattccngcataaatatgcatcacccnattcaagccattttaacttcgagaaacttaaattagtaacgactgttcttcaaaagttatcgcatttananaacccgtttccaaagattaagccgagtcnattgatactttgttgtantttgtatcttgaaattgaanagttagcttgcaacttcaaagccttttcttgaagcggaaacgntcnaangaggcaatcgtgctttagtaacttgtacnatgtgnaatgagagttgtattttgcttcggattttgccgttttcgcttngggaaatggcttcattgtttngtgtttgattgnagntcccnctattntggtagagagatagttgagacaactgctttatttatgggggatagagaccatcaactaatgtgacttgtactttatgcattaaagttgtacatt

SEQ ID NO: 2382 - DNA, 1622 bp, Cephalotaxus harringtonia
cgcaacttacacagcaaccctagtaaattacttgtaagatatttacacttaatgactgaaacgatactgaaaaaatttcttaatgtacagattccgattaatcttccacaaggttcttcacccgaacacaggttattttctccattaaataaacagcgtagaagcagcggagcttctggaatttttgaaggcgggcaatatttggctagctttcacttttcttatatcttcttctcctagaagtatcagtgggatttgacacagagcgcgagtattgagaagcattttcagtaatatttgtgccattatttattgactaggacaaggcacacaacataccctctcctcttcattttatttttgatttcaacaagagagaagcgaagatgttgtcgggaccagtggtgaatgcttaccctctgtcaagctacacgtttggcaccaaagagcccaagatggagaaggacacttctgttgctgacaggctcgccagaatgaaagtcaattacatgaaagaaggcatgcggacaagcgttgaggctatccttctggtgcaggagcacaatcatccccatatactgctattgcagattggaaacactttctgtaagcttcctggaggacgattgaagcctggtgaaaatgaaattgaagggttgaagcggaaactgtcaagcaaacttgctgcaaattcaagtgcccttcagccagactggcagattggggagtgtgttgctgtatggtggagacctaattttgagacattgatgtatccttattgtccaccgcacataacaaaaccgaaggaatgcaagaaacttttcctagtgcatctatctgaaagggaatattttgcagttcccaaaaacttaaaacttcttgctgttccgctgtttgagctctatgacaatgtccagagatatggtccagttatctcaactattccacagcagctgtcaagattcacctttaacatgattaatgcctgatttccattgggaggttgtttgtccatcgttggaatcttgagcactgctttcttcaggcaatggacttcaatatagcattttaatttttttagtgtcttctggaaagaatgaattgtaagattcaggaaattttggctcatatattagactgggacctttgcacttacccttcattatcgaacatgttttggcatgtatgttacatacggtggttgttgattgtaggtataaaatattaactagtgtctaggatttgttcttggaaggcctgcaaggtttctttggtgagaattggactgaaaagacatgcatatcaagagcatatcaatctgcttcctataagagtattactaattttagaagattgttttcatcatcaaatgttttattatgtgagtcctacctatattattaattgtgaaactcaatgacagaagtcagtttagaaacgaatattgttaggagaaatggtgatgtcctttgattgaatttcgtggttaatttgggccacatattagggacctgtgacattttgttcggctggaatttgttttttttgtaatttatgttgagtcaagtcattgctaatatttgcaatactatttatgttgagccaagatctttaatatctac

SEQ ID NO: 2383 - DNA, 871 bp, Cirsium arvense
gtcggtgttcgagaacttccgatctctcctacctacctccggcgatcggagaattcaccgtcaaattctaagagatcgaagctttcttccggtgaagatggtgacgtcggcggtggtgaacacgtatccattgtcgagctacaccttcggcaccaaggagccgaagatggagaaggatacttccgtcgccgatcgtctcgctcgtatgaaagtcaactatatgaaggagggcatgaggacgagtgttgaaggaattttgctggtacaggagcataaccatcctcatattttgcttttgcaaattgggaacactttctgcaaacttcctggtggtcgtctgaagccaggagaaaatgaaattgagggtttgaaaaggaaattgtccagcaaacttgcagctaattctactggacttcagcccgattggcagataggagagtgtgtcgctatctggtggaggcctaattttgaaaccataatgtacccgtattgccctccacacataaccaaacccaaggagtgtaagaaacttttccttgttcacttgtcagaaagagagtactttgcagtgcccaaaaatttaaaacttcttgctgttccattgtttgagctttatgacaatgttcagagatacgggcctgtgatatccaccattccgcagcagctttctagatttcagttcaacatgatccatgcataaacttcatgagccgaagctgagcaaaagaagaagagtccgatgatatatctaaatcgacagtttactgcattgtgattattaaaatgggtgtcccttaaggttcatccatcagtatttagtagctttaaaacatccattagtatcgagtagtttaaaagcaaacataatatc

SEQ ID NO: 2384 - DNA, 874 bp, Cirsium arvense
ggtggtcggtgggtggccggttcgaaataatcgtcggtgttcgagaacttccgatccatcctacctacctccggcgatcggagaattcaccgttttaattctagagaccgaaaagctttcttccggtgaagaagatggtgatgtcggcggtggtgaacacgtatccattgtcgagctacaccttcggcaccaaggaaccgaagatggagaaggatacttccgtcgctgatcgtctcgctcgtatgaaagtcaactatatgaaggaaggcatgaggacgagcgttgaaggaattttgctggtacaggagcataaccatcctcatattttgcttttgcaaattgggaacactttctgcaaacttcctggtggtcgtttgaagccaggagaaaatgaaattgagggtttgaaaaggaaattgtccagcaaacttgcagctaattctactggacttcatcccgactggcagataggagagtgtgtcgctatctggtggaggcctaattttgaaaccataatgtacccgtattgccctccacacataactaaaccgaaggagtgtaagaaacttttccttgttcacttgtcagaaagagagtactttgcagtgcctaaaaatttaaaacttcttgctgttccattgtttgagctttatgacaatgttcagagatatgggcctgtgatatccaccattccgcagcagctttctagatttcagttcaacatgatccatgcataaacttcatgagccgaagctaagcaaaagaagaagaatccgatgatatattcagaacgacaatttactgcattgtgatgatcaaaatgggtgtcccttaaggttcatccatcaggattcagtagttttaaacattcatt

SEQ ID NO: 2385 - DNA, 1028 bp, Cirsium arvense
atatgaaaaataatagaaaaaagagtaatgaattgatctgggccggaaataggccaaaaatcatttatggattaataagcccaaatatttcccttttacaacggcgatcgtccggcggtttgagatcaccgttgcaggtctagaaaagttcctatttatcctacctccgtcgatcggaaaattcaccttcaaattctagagaagaaaactttcttccggtaaatatggttacgtcggtggtggtgaatacgtatccattgtcgagctacaccttcggtaccaaggagcccaagatggagaaggacacttccgtcgctgatcgtctcgctcgtatgaaagtcaactatatgaaggaaggcatgaggaccagtgttgaaggaattttgctggtacaggagcataatcatcctcatattttgcttttgcaaattgggaacactttctgcaaacttcctggtggtcgtctgaagccaggagaaaatgaaattgagggcttgaaaaggaaattgtctagcaaacttgcagctaattctactggacttcagcccgattggcagataggggagtgtgttgccatctggtggaggcctaattttgagaccataatgtacccgtattgccctccacacataaccaaacccaaggagtgtaagaaacttttccttgttcacttgtcagaaagagagtactttgcagtgcccaaaaatttaaaacttcttgctgttccattgttcgagctttatgacaatgttcagagatatgggcctgtcatatccaccattccgcaacagctgtctagatttcagttcaacatgatccatgcataaactcgatgagttgacactgagttaaagaagaagtgtctgatgatatatagctagaacgacagtttgctgcatcgcaatgatcaaattgggtgtcccttaaggttcattcattagtatttaaatttaaactaccattagtatcaagtagtttaagcaaacacaatgtctgtatcttctataacaattccttttacttctatc

SEQ ID NO: 2386 - DNA, 888 bp, Cirsium arvense
tccgatctatcctacctacctccggcgtcggagaattcaccttcatcgttcaaattctagagatcggagctttcttccggtgaagatggtgacgtcggcggtggtgaacacgtatccattgtcgagctacaccttcggcaccaaggagccgaagatggagaaggatacttccgtcgctgatcgtctcgctcgtatgaaagtcaactatatgaaggagggcatgaggacgagtgttgaaggaattttgctggtacaggagcataaccatcctcatattttgcttttgcaaattgggaacactttctgcaaacttcctggtggtcgtctgaagccaggagaaaatgaaattgagggtttgaaaaggaaattgtccagcaaacttgcagctaattctactggacttcagcccgattggcagataggagagtgtgtcgctatctggtggaggcctaattttgaaaccataatgtacccgtattgccctccacatataaccaaacccaaggagtgtaagaaacttttccttgttcacttgtcagaaagagagtactttgcagtgcccaaaaatttaaaacttcttgctgttccattgtttgagctttatgacaatgttcagagatacgggcctgtgatatccaccattccgcagcagctttctagatttcagttcaacatgatccatgcataaacttcatgagccgaagctgagcaaaagaagaagagtccgatgatatatctaaatcgacagtttactgcattgtgattattaaaatgggtgtcccataaggttcatccatcagtatttagtagctttaaacatccattagtatcgagtagtttaaaagcaaacataatatctgtattctctataaaaactccctttatcat

SEQ ID NO: 2387 - DNA, 1291 bp, Vigna unguiculata
ggaattaagatgtgtttggcaacgtgagagcgtggggctagtggcccatgacccggtgttgagatttatcagtatgagacttgaaaagagcagaaagaacatccaaatccgaatctgaaaaatattacagacctaattcaaaagcactctagtgaagtgctgtgtcgtgtctttttttcttttcgtgaatctgtgtcttctcaccattcaattcaaatcgaaaagaaaagagaagaagaaatggtgtcgtcccaagttgtgaatacatacccgttgtcgagctacacgtttggcacaaaggagccgaagatggagaaggacacctccgtcgcggatcgtcttgctcgcatgaaagtcaactatatgaaggagggaatgaggaccagtgtggaagggattttactggttcaagaacataatcatccacatatacttcttctgcaaattggaaacacattttgcaaactcccgggtggtcgtctcaaaccaggagagaatgaaattgagggcttgaagagaaagttgactagcaagcttggtgctaattcaccagctcttgtgcctgactggcagataggtgagtgtgttgcgatctggtggaggccaaattttgaaaccataatgtatccatactgccctcctcatatcacaaaacccaaggaatgcaaaaaacttttccttgttcacttatctgaaagggaatactttgcagtgcccaaaaatttaaaactactagctgttccattgtttgaactctatgacaatgttcagagatacggtccagttatatcgaccattcctcagcagctatccagattccagtttaaaatgatcactaattgaacgtaaattactagtctcatttttatttccgtaactaggactggcattatcattgttgcgtagactggccagagaactgagtttctgagtagagtagttatttcgtgacatgctttgtctgtgtatttattccttgcactatgggtagatctcgattatcaaccatcaaccgaaaacatggaattaagtattcaacttgtaggttatatacctgataccccagtagaaatcaaggtgataaagaagtgcccttcagttcatgtctgttgcttctgccctcctcaggttgccaatatcggagggcaaaggggcattggttttcgttgcaagtttttcttctgaaaggcattgaatgacaaaaagtatgcatttgaaattcaaatatgatccagcaggcaaaatgtatacaacaacaatgactaaaatttaaatgcttatttgacatatt

SEQ ID NO: 2388 - DNA, 1307 bp, Vigna unguiculata
ggaattaagatgtgtttggcaacgtgagagcgtggggctagtggcccatgacccggtgttgagatttatcagtatgagacttgaaaagagcagaaagaacatccaaatccgaatctgaaaaatattacagacctaattcaaaagcactctagtgaagtgctgtgtcgtgtctttttttcttttcgtgaatctgtgtcttctcaccattcaattcaaatcgaaaagaaaagagaagaagaaatggtgtcgtcccaagttgtgaatacatacccgttgtcgagctacacgtttggcacaaaggagccgaagatggagaaggacacctccgtcgcggatcgtcttgctcgcatgaaagtcaactatatgaaggagggaatgaggaccagtgtggaagggattttactggttcaagaacataatcatccacatatacttcttctgcaaattggaaacacattttgcaaactcccgggtggtcgtctcaaaccaggagagaatgaaattgagggcttgaagagaaagttgactagcaagcttggtgctaattcaccagctcttgtgcctgactggcagataggtgagtgtgttgcgatctggtggaggccaaattttgaaaccataatgtatccatactgccctcctcatatcacaaaacccaaggaatgcaaaaaacttttccttgttcacttatctgaaagggaatactttgcagtgcccaaaaatttaaaactactagctgttccattgtttgaactctatgacaatgttcagagatacggtccagttatatcgaccattcctcagcagctatccagattccagtttaaaatgatcactaattgaacgtaaattactagtctcatttttatttccgtaactaggactggcattatcattgttgcgtagactggccagagaactgagtttctgagtagagtagttatttcgtgacatgctttgtctgtgtatttattccttgcactatgggtagatctcgattatcaaccatcaaccgaaaacatggaattaagtattcaacttgtaggttatatacctgataccccagtagaaatcaaggtgataaagaagtgcccttcagttcatgtctgttgcttctgccctcctcaggttgccaatatcggagggcaaaggggcattggttttcgttgcaagtttttcttctgaaaggcattgaatgacaaaaagtatgcatttgaaattcaaatatgatccagcaggcaaaatgtatacaacaacaatgactaaaatttaaatgcttatttgacatattatagacagttttagca

SEQ ID NO: 2389 - DNA, 750 bp, Cynara scolymus
aggccggcggttcgagagcatcgagaagttcctatttcccctacctcaggcggtcggaaaattcaccttcaattctagagagggaaactttcttcaggtaaagatggtaacgtcggcggtggtgaatacgtatccattgtcgagctataccttcggcaccaaggagccgaagatggagaaggacacttccgtcgctgatcgtctcgctcgtatgaaagttaactatatgaaggaaggcatgaggaccagcgttgaaggaattttgctggtacaggagcataatcatcctcacattttgcttttacaaatcgggaacactttctgcaaacttcctggtggtcgtctgaagccaggagaaaatgaaattgagggcttgaaaaggaaattgtctagcaaacttgcagctaattctactggtctccagtccgattggcagataggagagtgtgtcgccatctggtggaggcctaattttgagaccataatgtacccgtattgccctccacacataaccaaacccaaggagtgtaagaaacttttccttgtccacttgtcagaaagagagtactttgcagtgcccaaaaatttaaaacttcttgctgttccattgttcgagctctatgacaatgttcagagatatgggcctgtcatatccaccattccgcagcagctgtctagatttcagttcaacatgatccattcataaactcgatgaagttgaccaccagctaagaagaagagtctgatgat

SEQ ID NO: 2390 - DNA, 1055 bp, Distylium racemosum
cgaagctggtagcggcgactgtgaacgcctagaattttaggagtcggcaagtttagaacccctgttgttgtttaagctttaccactctctctcgacgacatcattccagcgaggccagttgaagtgtaagtgctagtggaagtgaaagagggttttaagagggagattctgttgcatactaatttcagcgatcagatatctacaattttcactccattcccataagagaagagcgaaaaaaaagatgttgtccggaccagtggtgaatgcataccctctgtcaagctacacatttgggacaaaggagcccaagatggaaaaggacacttctgttgccgacaggcttgccagaatgaaagtcaattacatgaaagaaggcatgcgaacaagcgttgaggcaattcttctggtgcaggaacacaaccatccccatatactgctattgcaaattgggaacacattctgtaagcttcctggaggacgattgaagcctggtgaaaatgaaattgaagggttgaagaggaaattgtcaagcaaacttgctgcaaattcgagtgcccttcaaccagactggcagattggagagtgtgttgcagtatggtggagacctaattttgagacattgatgtatccgtattgtcccccacacataacaaaaccgaaggaatgcaagaaactcttcctagttcacctatctgaaagggaatattttgcagttcctaaaaacttgaagcttcttgctgttccactgtttgagctctatgacaatgtccagagatatggtccagttatctcaactattccgcagcagctgtcaagattcacttttaacatgatcaatgcctgaatcctgctcagaggtggctgcttagcattggagttttgatgatttcctttcttcaggcaatggagttggaaatttgctaactttttcagtgaccggtgtaaagtgcatatatggactcatatattggttgggactgttgttacatattgtgtttgctgattcgagttataaaatactaattaataaaatctaggatcacaacttttct

SEQ ID NO: 2391 - DNA, 1160 bp, Eucalyptus grandis
gggcggggccaatcaccatcggggggggagggggcattttcgtccacccggtcccctctgcagagctctcttcagagctttctccatcactggcagtggcagcttcgctgatcacagcgaagaagaaggaaggagaagaagggaggagaagatggtgggctcgccggtggtcaacatgtacccgctgtccagctacaccttcggcacgaaggagccgaagatggagaaggacacctccgtcgccgatcgcctcgcccgcatgaaggtcaactacatgaaagaggggatgaggaccagtgttgaaggcattctgctggtgcaggagcacaggcatccccatattctcctcctgcaaattgggaacacattttgtaaacttccaggaggacgcttgaaaccaggagaaaatgagattgagggtttgaaaaggaaactatcaagcaaattaggagcaaattcactatcactgcaacctgattggcagattggtgagtgtgctgctatctggtggagaccaaactttgaaactgttatgtatccatactgtcctccccacataacaaagccaaaggagtgcaagaagcttttcatcgtccatttatctgaaagagagtactttgctgtaccgaagaacttgaaattgctagctgttccattgttcgaactctacgacaatgtgcatagatatggaccagttatctccaccataccgcagcagctctcaaggtttcagttcaacatgatgaccacatgaaagcatagagtgggaaagcagctcctgattaatgctttctaacatttctcaggttcactaggtagcagatggacctcgacaacttagctagtgtagcaagagtcctgcccaacactttattcagttgcagtgatctgtagttgaactcgtcttctagagcagttgtctcctttctttgttgttgattatgtattcgaactgaccaaggtttgatagttggttctcgtctcacttgattatttgtttgcccgccctaatcagtgggttctggcctctaaaacggggtctggagttgctggttcttgagattgctcctgggacatgtgttactgtcagattaaagagagccgtaaccagtattattaatagtagatgcttatatataatcaaagaggatttggatggg

SEQ ID NO: 2392 - DNA, 917 bp, Euonymus alatus
ggcaatacagagagatggtaacgtcgccggtggtgaacacttatcctttgtctagctacaccttcggcaccaaggagccgaagatggagaaggatacttccgttgccgatcgcctcgctcgcatgaaagtcaactatatgaaagagggtatgaagacaagtgttgaagcaatcctcttggtccaggaacataatcatccacacattcttctactgcaaattgggaacacattttgcaagcttcctggtggacgtctcaagcccggtgaaaatgaaattgagggcttgaaaagaaagctgaccagcaaactaggtgccaattcacctgctatggtaccagattggcagattggtgagtgcgtggctatgtggtggagaccaaactttgaaactataatgtatccatactgccctccacacataacgaagcccaaggaatgcaagaagcttttccttgttcacttgtccgaaaaagagtactttgcagtgcccaagaatctgaaactattggctgttccgttgtttgaactctacgataatgttcagcggtatgggccagtcatatcaactattcctcagcaactttcaagatttcagttcaatatgattaccatgtgactcactctctctggatttcaagaccctattcctggatgctagtgctgatatgttgtgcgccctagcagaccttttccccctccctttattataagactgaatatcctgttataggaaggtggttggctgaaacttacttttggctccatatctgctgacacccaagtgtctctacattatttgttcaagagtgatcgacatattgttagattccttgttgctcttattgacatatatcttgctatagtctaggtgtttcagatgatgtatcatttgagtagtgttgaaaatgttttgtat

SEQ ID NO: 2393 - DNA, 996 bp, Guizotia abyssinica
aaatcaaagcaacaaaattccgttcgatcttcagtctcaacatcgatttcgaattttcgatctccactttgtaatcaattgtgcgagagatggtggcgtcgccagccgtaaacacgtaccctctgtcgagctactccttcggcacaaaagaacctaaaatggagaaagatacttctgtcgctgaccgtcttgctcgtatgaaactcaattatatgaaggaaggcatgaggactagtgttgaagcaattttactggtgcaagagcataatcatccccacattcttcttttgcaaatcggcaacacattctgtaaacttcctggtggtcgactaaagcctggagaaaacgaagttgaaggcttgaaaagaaaattgtcaagcaaacttgctgctaattcctccaatatgcaacctaactggcagattggcgagtgtgtggctgtgtggtggaggccaaactttgaaactatcatgtacccatattgccctccacacatctcaaaacccaaggaatgcaagaaactttatgttgtacacttatcggaaagagagtactttgcagtgcccaaaaatctgaaacttcttgctgtaccattgtttgagctttacgacaatgttcagagatacggaccggtgatctcaaccattcctcagcagctttctagatttcaattcaacatgatttcctcatgaatatgcatcagattcgagtgtttgcattcagaagtttagatttggtaaatgaactttcatcaaaagttatcgtatttacagaactcgactggaagattaaattaaattcggtctaatttggcagtttgttgtgcttgtttgtagtagagatggttcggtttggtatgtttggtagaattggtttatgtgggataaagactatgtattgattatcttttacttgtaccatcttcatttgatgcaagactattatgactgggaattatgaaaattttctcatagaaatgatctagaattatgtgac

SEQ ID NO: 2394 - DNA, 997 bp, Lactuca sativa
gatacaaaaaatattcaaatatttggtctttcaccctaatttcttttctcaacaagtagccctccatccccaaatcaaatagacccgctcccaatttccttttgatcttcaatccccactgcgtgtttttgcgaaagatctagggagatggtgacttcatcagttgtaaacacataccctctttcgagttactccttcggcacaaaagaacccaaaatggagaaagacacttctgttgctgatcgtcttgctcgcatgaaactcaactatatgaaggaaggtatgaggaccagtgttgaagcaatcttactggtgcaagagcataatcatcctcacattcttctactacaaattggcaacacattttgtaaacttcctggtggacgacttaagcctggtgaaaatgaagttgaagggttgaaaaggaaattgtcaagcaaacttgctgctaattcgcctaatatgcaacctaattggcagattggtgagtgtgttgctgtatggtggaggccaaactttgaaactatcatgtacccatattgccctccacacatctcaaaaccaaaggaatgcaagaaactttatgttgtacacttgtcagaaagagagtactttgcagtgcccaaaaatctcaaacttcttgctgttccactgtttgagctttacgataatgttcagagatatggaccagtcatatcaactataccgcagcagctatcaagatttcagttcaacatgatccctgcgtaagcgcacaccggattccagcctttttatataacgtaatattaaatttagtaaaatcgttctcgaatattttatcgcatttatagaacctcatttaaagatttagtttaatccatcggctttatttaggagggaaagagaccattgactattgtgacttgtattgtatgcatttcaagatgtacattgttgttgtctatttccatatcgttttatgtaaaagagtttagaaattgttggtatgtggtat

SEQ ID NO: 2395 - DNA, 1107 bp, Lotus japonicus
ggatgattaattgacaaaacgatgcgagcccgctggaacttggaaacttgaaacttcgattcagcgagcgagcgcaacctctctgatctctctcttcttccattcttcgttcaattctcagcacaacagaagaagaagaagaagaagctcgagaagaagaagaaaatggtgtcatctcaggtggtaaacacataccctctttccagctacaccttcggtaccaaggagcccaagatggagaaagacacctccgtcgccgatcgtctcgctcgcatgaaagtcaactatatgaaggaaggaatgaggaccagcgttgaaggaattttactggtccaagaacataatcatcctcatatacttctcctgcaaattggaaacacattttgcaaactccctggtggtcgtctcaagccaggagagaatgaaattgagggcttgaagagaaagttgaccagcaagcttggtgctaattcaccggctcttgtgcctgactggcagattggtgaatgtgttgcaatctggtggaggccaaattttgaaaccataatgtacccatactgccctcctcatataacaaaacccaaggagtgcaagaagctcttccttgttcacttgtctgagagggaatactttgccgtgcccaaaaacttgaaactgcttgctgttccattgtttgaactctatgacaatgttcagagatacgggccagttatatccaccattcctcagcagctttccagattccagtttaaaatgatcactaattgaacgtaatttcaattagtttcttccttttgttatcttaagaactaggattgagttagtacctgattatcattgcattagactggctagagaactgagtctttttaagagagatttatttgatagagtagttacctttttaaatagagtagttacatgattattatttgttattttcgtggtctattttttaacggatttgtatcctgcttgtcaagcttgagttatgccccctaactccatctgtattaatttgttgggctatgggttggtatattgagattatcaacccaagatcatcaactacgtaggcaaaattattgatgaaaggaatttagtgcc

SEQ ID NO: 2396 - DNA, 1221 bp, Podocarpus macrophillus
ggcggtagtgagactcgcgccaacgactacaattctcttgctgtgctttgatctttgatccactctgagctcctgtgttgggaaaatccttcctttgtaggtcgagcttgctaacctatttcttcttattccataaaacaacagaagtagaagtaatagaaggagaagaaaaaggcaaaaggaaaagatgttgagtggaccagtggtgaatgcataccctctttcaagctacacatttggcacaaaggagcccaaaatggagaaggatacttctgttgctgataggcttgccagaatgaaagtaaactacatgaaagagggcatgcgaacaagtgtggaagctatccttctggtgcaagagcacaaccatccccatatattgttgttgcagatcggaaacactttctgtaagcttcctgggggacggttgaagcctggtgaaaatgaaattgaaggcttgaagcggaaattgtcgagcaaacttgctgcaaattcaagtgcccttcagccagactggcagattggagagtgtgttgcagtatggtggagacctaattttgagacattaatgtatccgtactgccctccacacataacaaaaccaaaggaatgcaagaaactctttctagttcatctatccgaaagggagtattttgctgttccaaaaaacctgaaacttctcgctgttccactctttgaactctatgacaatgtccagagatatggtccagttatttcgactattccgcagcagctgtcgaggttcaccttcaacatgattaatgcttgaattctgctagatctttatcaccggtatcttcaggcagtgaactttgaaagtgataaatttgttagtgattgctgaatagagtggctccttaagggtcaggaaaacatgaccgatatatacatctgggtgtttgttacatgggcttttgttcctacaggtataaaatcctaactactacactagaagatcgcactgtagaagtagttgtctataaatattgttgtgtgagaattgggatgaaaagacttacgtctgaagctgtaaaaaagaggaaatttagactttattactctattagtggggtcgtaagttcttaattatgttatacactatagaagtaatgtttacaaatctgatatcataaagagtcaaaatgttatctcattcctctttgtaagtcgatcttgattaatacaaaatttgtcattgac

SEQ ID NO: 2397 - DNA, 1257 bp, Populus trichocarpa
cccccccctctgctttcttttttggtttgctaagctgaacgatctacaaagagggaaacacagcttcaactcacagagaaacaccaaagccagaagcttttggcaatataaagggagaagaagttgggttataaacagagggagagatggttggggcagggtcagcggtggtgaacacgtaccctttatcgagctacacattcggtactaaagaacccaagatggagaaagacacttctgtggcggatcgccttgctcgcatgaaagtcaattatatgaaagaggggatgaggaccagtgttgaagctattttgctggtacaggaacacaatcatcctcacatacttcttctgcaaattggaaacacattctgcaaacttccaggtgggcgtttgaagcctggagagaatgaaattgagggtttgaaaagaaagctgacgagcaagcttggagctaattcacctgctcttgtgccagactggcagattggtgaatgtgtggctacctggtggaggccaaactttgaaaccattatgtatccatattgccctccccacataacaaagcccaaggagtgcaagaaactttatcttgttcacttatctgaaagggagtactttgcagtgccaaaaaatttgaaactgcttgctgtgccattgtttgaactctatgataatgtgcagagatatggaccagttatatcaaccattcctcaacaactctcaagattccagttcaacatgattactacttgaactttgtgaggatttgagaagttgtgatggtacttgatttgaggaggctattggcaacatacagcatgagtatcaacattactttagaacagacttttaatttggtttagactggatgtccagaagttgtgctgtgtggatctcataaccgtttgatgttaagatttattttggacccttgtcttcatgggtttaggttatttgctaattagatctctgtcttatgatttacaagttaaatagtcacgatccagaatgatagggtgctatgtggctggaagtgctcagcagaattttcccagcagcattgagtatacagccattgtatggggtagtaagatgggaaatgatggtcctattttgtctttgaaaccttcattttggtgtaatgtttgtgatttcttgtacgtggttgtaacctgtaagcccaagattttttgattgaatcaagaagggtcttgcatttctcaaactctaaatcacctaaattagaacattgctg

SEQ ID NO: 2398 - DNA, 1054 bp, Rhizophora mangle
actcgcactgtgcttacttcattagactctcgctctcggttgtcgcgtcggtttcccaggctctcgttgtttcttctattcttttttgggaattcttctttttgactgagcattcaacagaaggagggggaagatggtgaactcgtcggtcgtgaacacgtaccccctgtccagttacaccttcggcaccaaagagccgaagatggaaaaagatacctctgtcgcggatcgccttgctcgcatgaaaatcaactatatgaaagaagggatgaggacaagtgtggaagcgattttactggtacaggaacataatcatccccacatactacttctgcagattggaaacacattctgcaaactccctgggggccgtttgaagccgggagagaatgaaattgagggtttgaaaagaaagctgaccagcaagcttggtgctaattcacctgctcttgtcccagactggcagatcggtgaatgtgtggccatctggtggaggccgaactttgagaccattatgtatccatatcgcccccctcacataacaaagcctaaggagtgcaagaagcttttccttgttcacttgtctgaaagagagtactttgctgtgcccaaaaacttgaaacttcttgctgtcccattgtttgaactttacgataatgtgcagagatatggtcctgttatatcgaccattcctcagcagctttcaagattccagttcaatatgatcacaacctgagatagtttgcagccggcagtttcatcgttaagttattgcttggattctatacagaggcatagcatggaatgttatttctgataccatggatggtgtacttacttgaagttgactactctgggaatccaaggttgttcatgatcatgacatactctttcttagtgtttggcagtagatgacttatattataccatgtgtgccatgcaattggaatacaattttaatggttagacttaagttgctggtttaagaatgttgggaagccgcttaattgtttttgtggcagaaacggtttttatccaagtatcggatatccaa

SEQ ID NO: 2399 - DNA, 1359 bp, Picea glauca
agcggcggcaaaccaaaaatgcatcgattcattttacaccgatcgtgttacgggccaaaaataatatgaaatgatttgcatgcaaggtttgttggcgggccctgaagtttccagaccctgaagtttccagagagacgagctgtcgattcccactcctaaacagtccattgcggaaataaaaggagggaataagaaaaccaacttcttcttcttcaaccgctgtcagattcttgatctccgacgtataattcatcagcaagagaagatgttgtcgggacccgttgtaaatgcctaccctctgtcaagctacacatttgggaccaaagagcccaagatggagaaggacacttctgttgcagacaggcttgccagaatgaaagtcaattacatgaaagaaggaatgcggacaagtgtggaagctatccttctggtacaggaacacaaccatccccatatactgttactgcaaattggaaacaccttttgtaagctgcctggaggacgcttaaagcctggtgaaaatgaagttgaaggcttgaagcgcaaactatcaagcaaacttgctgcaaattcaactactcttcaaccagactggcagattggagagtgtgttgctgtatggtggagacctaattttgagacattgatgtatccttattgtccaccccacattacaaaaccaaaggaatgcaagaagcttttccttgttcatctatccgagagagaatattttgcagtccccaaaaatctgaaactgctcgctgttccattgtttgagctctatgataatgttcagagatatggtccagttatctcaactattccgcagcaactatcaaggttcacttttaacatggtcaatgcatgaactccattgaggggtggttctgtccataaaatattgaggactgctttcttcagtgaaaacagactttgtaatatggtcgaattacgaagggtccataaaacatggcccatcaatagagctgggactgttgcaattggttatgaacataaagtttggtctgcatcttagttataatttatggtgtttgttgtttagaggtacaaactatttccttgtagatttgtgatgtgtaaactgctagctatctacaagctgtcttgtaaaaattaggttggaaagacatgcttactaagctttaggaacaaataaactataaatacatgattctgccggtcaacagcattgttaatttttggaccgtgttctgtttattcaaggttataaagctcacttctgttatccactatggttcttaccagagagatttctaggggaacagttttgaaacgttataactacattataaaggtcttgacattatctgtcacaaa

SEQ ID NO: 2400 - DNA, 1010 bp, Allium cepa
gaaaacctaattatcccgaaatccataatcagacgaggacaagacgaatttcgaagaacgaaatggttgtaagctgcaataacatggaggtggtgaacacctacccgttgtcgaattacactttcggagtcaaggaacccaaaatggagaaagatacttctgttgccgatcgtctcgctcgaatgaaacaaaactattataaagaagggatgcggacaagcgttgaggctattttgttggtacaagagcacaatcatccccatatactgcttttgcagattggaaacaccttctgtaaacttcccggggggcgattgaaacccggagaaaatgaaatcgaaggtttaaagcgtaaattaagcagcaaacttgctgttagctcatcttcatttcaaccgaattggcagattggagaatgtgttggtgtctggtacagaccaaactttgagaccataatgtacccgtactgtcctcctcacatcactaagccaaaggagtgcaagaagcttttccttgtccacctgtcagaaaaggaatacttcgctgtcccaaaaaacctgaaattgcttgctgttccattatttgaactctatgataatgttcagagatacggccctgtgatttcgaccatcccacaacaactttcaaggttccagttcaatatggttcaatcctaaattttttcagaaatgcagctctcaatagtttggaaaatggcattgtcctataaatgctaaaatagtagtttgtaacttctgaagttatgtctaggagactgaaaatgtttatggtcatgtttctattagtttcttttagcttttttgcacgtgctttatgtatttaaacaaaccagtaacgcacatgtcaattgctatatgaagtttatttgtttgcgtgtgcaatatttgcgtctacgttaatgcatgtgttggtggttatacatatacgtatatacctatctatctgtgagaatacatgttatgaatgatatggatgtagaaaaggctagt

SEQ ID NO: 2401 - DNA, 1295 bp, Populus trichocarpa
gcactctctaatctcatactactactgccccccccccccccccctctgctttcttttttggtttgctaagctgaacgatctacaaagagggaaacacagcttcaactcacagagaaacaccaaagccagaagcttttggcaatataaagggagaagaagttgggttataaacagagggagagatggtaggggcagggtcagcggtggtgaacacgtaccctttatcgagctacacattcggtactaaagaacccaagatggagaaagacacttctgtggcggatcgccttgctcgcatgaaagtcaattatatgaaagaggggatgaggaccagtgttgaagctattttgctggtacaggaacacaatcatcctcacatacttcttctgcaaattggaaacacattctgcaaacttccaggtgggcgtttgaagcctggagagaatgaaattgagggtttgaaaagaaagctgacgagcaagcttggagctaattcacctgctcttgtgccagactggcagattggtgaatgtgtggctacctggtggaggccaaactttgaaaccattatgtatccatattgccctccccacataacaaagcccaaggagtgcaagaaactttatcttgttcacttatctgaaagggagtactttgcagtgccaaaaaatttgaaactgcttgctgtgccattgtttgaactctatgataatgtgcagagatatggaccagttatatcaaccattcctcaacaactctcaagattccagttcaacatgattactactgcttgaactttgcgaggatttgagaagttgtgatagtacttgattcgaggaggctattggcaacatacagcatgagtatcaacattactttagaacagacttttaatttggtttagactggatgtccagaagttgtgctgtgtggatctcataaccgttgatgttaagatttattttggacccttatcttcatgggtttaggttatttgctaattagatctctgtcttatgatttacaagttaaatagtcacgatccagaatgatagggtgctatgtggctggaagtgctcagcagaattttcccagcagcattgaggatacagccattgtatggggtagtaagatgggaaacgatggtcctattttgtcttcgaaaccttcattttggtgtaatgtttgtgatttcttgtacgtggttgtaacttgtaagcccaagattttttgattgaatcaagaagggtcttgcatttctcaaactctaaatcacctaaattagaacattgctg

SEQ ID NO: 2402 - DNA, 1161 bp, Papaver somniferum
attaaaatcacacttcagtttcagagggttttgttttctcagagagaaaactcccctcactcgaccgaccgactctgtaatcgggtagatcgtcaacatcaccatcaagagaggagaccgagcgagcgagcgagcgagttgaaaatggtgacatctccagtagtgaatacatacccactttcaagctatactttggtactaaagaaccaaagatggagaaagatacttctgtttcagatcgtcttgctcgtatgaaagtcaattatatgaaggaagggatgagaactagtgttgaagctattctactagtacaggagcataaccatccccatatattgcttttgcaaattgggaacacgttttgcaaacttcctggtgggcgtttaaagcccggagagaatgaaattgacggtttgaaaagaaagctgtcaagcaaacttgctgctaactcaactgctcttcagcccgattggcagattggtgagtgtgttgctatctggtggaggcccaactttgagactataatgtacccatactgccctcctcatatcacaaaacccaaggagtgtaaaaagcttttccttgttcatctgtctgagagggagtactttgctgttccaaagaacttgaagctgctcgctgtgccattgtttgaactatacgataacgtacagaggtatgggccagttatctccaccatcccgcagcaactttcaagatttcagttcaacatgatcaatgggtgaaaatgcaagggtttcaagagctcccacttgggagaggtcttgagtaggaattgattggtctacaatggggattatgaagtttttgcaaataggtatggcgcgtgaagctagtccaacttaacctctgatttgcttagcagtcgatatacctggtcttaatacagactttggaattgtgtgattttctatacatttgtttttccaaatatacttgtacttgtatggtttcttatctcgtgttgtgtttaaattttatgccaagattatattagaatgttagttatccatacaatgtaaagggaagtatttgtaaaaccccttctgctgtggttggggttctccttgtttcacaaatcagcaggtgaatcattgtaatatgaggtaaattagtttccagttgcacatcactagacaa

SEQ ID NO: 2403 - DNA, 1602 bp, Phaseolus coccineus
gaggttggggctagtggccattacggccgggtgttgagatttaacagtatgagagttgacgagacgagaatgaagatccaaatcgaatctgaacaatattacagacctaaattgaaaagcgcactctagtgaagtgttgtgttgagttcgtcttttctcactggtcaattcaatttaatctgtgttttctcagcattcaattcaaatcgaaaagagaagagaagaaaaaatggtgtcgtcccaagttgtgaatacatacccgttgtcgagctacacgtttggcacaaaggagcccaagatggagaaagacacctccgtcgcggatcgtctcgctcgcatgaaagtcaactatatgaaggagggaatgaggaccagtgtcgaaggaattttactggtacaagaacataatcatccacatatacttcttctgcaaattggaaacacattttgcaaactccccggtgggcgtctcaaaccaggagagaatgaaatggagggcttgaagagaaagttgactagcaagcttggtgccaattcaccggctcttgtgcctgactggcagataggtgagtgtgttgcaatttggtggaggccaaattttgaaaccataatgtatccatactgcccccctcatatcacaaaacccaaggagtgcaaaaaacttttccttgttcacttatctgaaagggaatactttgcagtgcccaaaaatttaaaactacttgctgttccattgtttgaactctatgacaatgttcagagatacggtccagttatatccaccattcctcagcagctatccagattccagtttaaaatgatcactaattgaacgtaaatttgaagcttacatgctgataaattaatactgtcatttttatttacgtaactaggactggcattattgcgtagactggccagaggactgagttttgaagtgagtttctaagtagaatagttatttcctgacatggattgtctgtatttatcccttgcactattgctagatctcgattatcaaccatcaacccaaaagatggaatcaagtattcaacttgtaggttatatacctaataccccagtagaaatcaaggtgttgaaaaggtgtcttcatttcatgtctgttgcttctgtcctcctcaggttgccaatatcgtagtggacagggttaaaggaatgggcattggttttcgttgcaagcttttctggtgaaaggcaattgaatggaaaaaattatgcatttgaaattcaaatatattcctcgtggcaaaatgtatacaacaatgactaaaatttaaatgctctcgacatattaaatacagttttagcatatccaatttccggaagttgctgcttgtgcacgcttggtgcagtagcacttgatccaaacattgaaagttcatattctttcttattatagtttgcttcaccaatataaagtgcaagggcttggtgtgacttcttctattgatagtaatgagaaaacgtcaagtaaaaatagttttggaggtggaagcaattacaatgtacataatagtagtgcttgattttggaaaagggttgtaataatatttaaatgaattgtttcattttggctcccca

SEQ ID NO: 2404 - DNA, 1289 bp, Amborella trichopoda
tccttttggggggaagctggggcggtcatataaatagccctttagcggtatttatttcctgcttttctctctcctctggagtccgagtttagagagagaaaatggtgacttcttcagttgtgaatgcttaccctctctcaagctacaccttcggcacaaaggagccaaagatggagaaggatacctccgttgctgagcgccttgccagaatgagggtcaactatatgaaagagggcatgagaacaagtgtggaagcgattctactggtacaggaacataaccatccacatatactactacttcaaattggaaataccttctgtaagctccctggtgggcgtctgaagcctggggagaatgaaattgagggcctaaaacgcaaattgtcaagtaaattggctgccaatgctgctgccctccagcctgattggcagattggagaatgtgtggccatatggtggaggccgaactttgaaaccataatgtacccatactgccctccgcacatcaccaaacctaaggaatgtaagaagcttttccttgttcacttgtctgagagggagtactttgcagtgcccaaaaacttgaaactgcttgctgttcccctatttgagctttatgacaatgttcagagatatgggcctgtcatctccaccatcccgcaacaattatcaaggtttcagttcaacatgatcaatgcatgaaaacttcagagctttcagctattgatttccttgactgcttgacttttgtggccatcagatgctccccaaactaaagctaaattataacagcaattggtctctctctgatgcacgatgaaccaagtgttgtgtttgattaattgacattgataaccacgaagccagacacgatactttggctgtattcctgatagacatgttatgcaaggatgcataattatgtggtgagggcatcaagtatatatatatatatagagagagagggatttaaggcaaagtgctcacgaaagctaaagtgggtacgagaccacaaacatccgttgcaagaatgcgttcctgtagccttgaaccctacttttaggacaaagttggtttatgaacttcgtctgttgactatatttttggggcttgttaatggtttcttgattgaaatgtatgattgaatttcattaaaagtttgtgtaatatcttcctcaagatttgtttgatgattcgtcttttttcatgtcattgagagtgagagggagaaaggggcagagaattttgtaattactattattattattattgttgttattattatta

SEQ ID NO: 2405 - DNA, 1629 bp, Phaseolus coccineus
aattaatataagtgtttggcaatgtgagaggttggggctagtggccattacggccgggtgttgagatttaacagtatgagagttgacgagacgagaatgaagatccaaatcgaatctgaacaatattacagacctaaattgaaaagcgcactctagtgaagtgttgtgttgagttcgtcttttctcactggtcaattcaatttaatctgtgttttctcagcattcaattcaaatcgaaaagagaagagaagaaaaaatggtgtcgtcccaagttgtgaatacatacccgttgtcgagctacacgtttggcacaaaggagcccaagatggagaaagacacctccgtcgcggatcgtctcgctcgcatgaaagtcaactatatgaaggagggaatgaggaccagtgtcgaaggaattttactggtacaagaacataatcatccacatatacttcttctgcaaattggaaacacattttgcaaactccccggtgggcgtctcaaaccaggagagaatgaaatggagggcttgaagagaaagttgactagcaagcttggtgccaattcaccggctcttgtgcctgactggcagataggtgagtgtgttgcaatttggtggaggccaaattttgaaaccataatgtatccatactgcccccctcatatcacaaaacccaaggagtgcaaaaaacttttccttgttcacttatctgaaagggaatactttgcagtgcccaaaaatttaaaactacttgctgttccattgtttgaactctatgacaatgttcagagatacggtccagttatatccaccattcctcagcagctatccagattccagtttaaaatgatcactaattgaacgtaaatttgaagcttacatgctgataaattaatactgtcatttttatttacgtaactaggactggcattattgcgtagactggccagaggactgagttttgaagtgagtttctaagtagaatagttatttcctgacatggattgtctgtatttatcccttgcactattgctagatctcgattatcaaccatcaacccaaaagatggaatcaagtattcaacttgtaggttatatacctaataccccagtagaaatcaaggtgttgaaaaggtgtcttcatttcatgtctgttgcttctgtcctcctcaggttgccaatatcgtagtggacagggttaaaggaatgggcattggttttcgttgcaagcttttctggtgaaaggcaattgaatggaaaaaattatgcatttgaaattcaaatatattcctcgtggcaaaatgtatacaacaatgactaaaatttaaatgctctcgacatattaaatacagttttagcatatccaatttccggaagttgctgcttgtgcacgcttggtgcagtagcacttgatccaaacattgaaagttcatattctttcttattatagtttgcttcaccaatataaagtgcaagggcttggtgtgacttcttctattgatagtaatgagaaaacgtcaagtaaaaatagttttggaggtggaagcaattacaatgtacataatagtagtgcttgattttggaaaagggttgtaataatatttaaatgaattgtttcattttggctcccca

SEQ ID NO: 2406 - DNA, 1169 bp, Castanea mollissima
ccgttcgtccgtctccctccgttcgtcgtggtctcactctctctctctctctctctctctctctctctctgctcagctagcctttgtcttggatcagtgtgtgaaaatcaatcaatcaatcaatcaatggaggatatggtgagctcaacggtggtgaacacgtacccactctcaagctacaccttcggtaccaaagagcccaagattgagaaagactcctccgtcgccgatcgtctcgctcgcatgaaactcaactattttaaagaaggcatgaggactagtgttgaagcaatcctactggtgcaagaacataagcatcctcacattcttcttttgcaaattggaaacacattctgcaaacttcccgggggacgtttgaagcccggagaaaatgaaattgaaggcttgaagaggaaactgactagcaaattgggtgctaatcaaccttcacttcaacctaattggcagattggtgagtgcgtggcaatctggtggagaccaaactttgaaacggtgatgtatccttactgccctccccacatcacaaaacccaaggagtgtaagaagctttatattgttcatttgtctgaaagagagtattttgctgtaccaaaaaatctgaaactgcttgctgttcccctttttgagctctatgataatgttcagagatatggacctgttatttcgacaatcccacagcagctgtccagattccagttcaacatgatcaccacctgaaaggcttataaaggaatccgtgccatcagaactaatcattctttaggagaacatatatgacatctacttaccaaaattaggattctcctaatcagcaaataggcttgttactcaagctaatgtagcttagctttatggtctactccggtggtctttcatatgagactgtaatgtgtacctccaattcaaaggcctttgcatggttgaaattttgtttgttttgtgctgacaaaaagaagaaaggtccactgttattttcatgtttcaagagtattgtgtggggctatggaaattgtagcttgtgcttctcgagaaaattttttaggtggaaactagaaccaagctgatgataccaacattgtacttgttaacctagaaattgtggcactttctgaaagcctgggagagttaagggtaaaaaaagaaagggg

SEQ ID NO: 2407 - DNA, 946 bp, Taraxacum officinale
tattcaattcttggcctttacaccctaatttcatttttcaacaaagtagcgctccacccccaaaatcaacgagaccaccagcaatttccttttgatcctcaatctccactcagcgttctcgtgcgaaagatcgagagagatgttgacttcgtctgtcgtaaacacataccctctttcgagctactccttcggcacaaaagaacccaaaatggagaaagacacttctgttgctgatcgtcttgctcgcatgaaactaaactatatgaaggaaggtatgaggaccagtgttgaagcaatcttactggtccaagagcataatcatccccacattcttttactacaaattggcaacacattctgtaaacttcctggaggtcgactgaagcctggagaaaacgaagttgaagggctgaaaaggaaattgtcaagcaaacttgctgctaattctcctaatatgcaacccaattggcagattggtgagtgtgtggctgtatggtggaggccaaactttgaaaccataatgtacccatattgccctccacacatctcaaaacctaaggaatgcaagaaactttatgttgtacacttgtcagaaagagagtactttgcagtacccaaaaatctcaaacttcttgctgttccactatttgaactttacgataatgttcagagatatggacctgtgatttcaaccataccccagcagctttcgagattccagttcaacatgatccctgcataatttgtttggcaaaactaaatttagtaatatttatcgcatttacaggaccccaaattttaaagatttagtttaatttaccggctttatttaccagggatagaggccattgactattttgacttgtattgtatgcatttgaagttgtacattgttgttgtgtattttggtattggtttatttacaagagtttagagattgttagtg

SEQ ID NO: 2408 - DNA, 1172 bp, Mimulus guttatus
atatttatttattctacagaaaaaaccgactccctcagttctgcaatttcctcccggtcggcaagtggcaacctgcaaatttgcaatcgccggcgactccgttcacgtcgatcggcactgaattacaccggagataaattgaatacaaataaagaaagagggagtaatggtgacatcgtcggtggtaaatacgtatcctctgtcaagctacactttcggcaccaaagagccgaagatggagaaagacacctccgttgccgatcgccttgctcgcatgaaaatcaactacatgaaggaaggcatgaggactagcgttgagggtattttactggtacaagagcataatcatccccatattctgcttttgcaaattggaaatacattctgtaaacttccaggtggtagattgaagccaggagagaatgaaattgaaggcttgaagaggaaactctctagcaaacttgctgctaattcaccttctctgcagccagattggcagattggtgattgtgtggcaacctggtggagaccgaactttgaaacaaccatgtacccttactgccctccacacataaccaaggctaaggaatgcaagaagctataccttgttcacctatccgagcgagagtattttgctgtgccaaaaaacttgaaacttcttgctgttccgttgttcgaactgtatgacaacgttcagagatacggtcctgttatatcgacaatccctcagcaactatccaggtttcagttcaacatgattcatcagtagatgtgtccgagattgacgatcccaaattttgaggatgagagtttcgatctctggttcaccatatcattgactgcgctttcttcaacttgttttctgttttaaaaccttgttacgctcaccacctttgacttagctttagtttcgactttcgtcttatgcttttttttttatacttattttcttgtattattattattattaagaagtctctttttattatcttactttttgagtagatagcatcaatgttattttttctcctttgaatcagacctaggattaattgtctattgtcttattgaggcatcaatgttgtattaaaagcatatgccttttagtatttgcttttaaaacattaattatttagatacagtacttggtgtggaaaaaattagatgctgcc

SEQ ID NO: 2409 - DNA, 1356 bp, Mimulus guttatus
atatttatttattctacagaaaaaaccgactccctcagttctgcaatttcctcccggtcggcaagtggcaacctgcaaatttgcaatcgccggcgactccgttcacgtcgatcggcactgaattacaccggagataaattgaatacaaataaagaaagagggagtaatggtgacatcgtcggtggtaaatacgtatcctctgtcaagctacactttcggcaccaaagagccgaagatggagaaagacacctccgttgccgatcgccttgctcgcatgaaaatcaactacatgaaggaaggcatgaggactagcgttgagggtattttactggtacaagagcataatcatccccatattctgcttttgcaaattggaaatacattctgtaaacttccaggtggtagattgaagccaggagagaatgaaattgaaggcttgaagaggaaactctctagcaaacttgctgctaattcaccttctctgcagccagattggcagattggtgattgtgtggcaacctggtggagaccgaactttgaaacaaccatgtacccttactgccctccacacataaccaaggctaaggaatgcaagaagctataccttgttcacctatccgagcgagagtattttgctgtgccaaaaaacttgaaacttcttgctgttccgttgttcgaactgtatgacaacgttcagagatacggtcctgttatatcgacaatccctcagcaactatccaggtttcagttcaacatgattcatcagtagatgtgtccgagattgacgatcccaaattttgaggatgagagtttcgatctctggttcaccatatcattgactgcgctttcttcaacttgttttctgttttaaaaccttgttacgctcaccacctttgacttagctttagtttcgactttcgtcttatgcttttttttttatacttattttcttgtattattattattattaagaagtctctttttattatcttactttttgagtagatagcatcaatgttattttttctcctttgaatcagacctaggattaattgtctattgtcttattgaggcatcaatgttgtattaaaagcatatgccttttagtatttgcttttaaaacattaattatttagatacagtacttggtgtggaaaaaattagatgctgccagattatttttctttcttttcaatatctgacagtataggcttttttctttctctattgacagtcctttattaagaaatggggtaaaaaataaatattttaggaattttgggtcaaccaaaacagaggtgttctcttggccggtaaacccaccgttcggtatagggtattgatgtcctgtaccgg

SEQ ID NO: 2410 - DNA, 1219 bp, Quercus alba
catggggactgcttgctcaagcacggtctgtttttcttcgttttaatactcagctggctcagctaggcttgtctttggatcagtgtgggaaaatcaatcaatcaatggaggatatggtgagctcaacggtggtgaacacgtacccactctccagctacaccttcggtaccaaagagcccaagattgagaaagactcctccgtcgccgatcgtcttgctcgcatgaaactcaactattttaaagaaggcatgaggactagtgttgaagcaatcctactggtgcaagaacataagcatcctcacattcttcttttgcaaattggaaacacattctgcaaacttcccgggggacgtttgaagcctggagaaaatgaaattgaaggcttgaagaggaaactgacgagcaaattgggcgctaatcaaccttcacttcaacctaattggcagattggtgagtgcgtggcaatctggtggagaccaaactttgaaacggtgatgtatccttactgccctccccacatcacaaaacccaaggagtgtaagaagctttacattgttcatttgtctgaaagagagtattttgctgtaccgaaaaatctgaaattgcttgctgttcccctttttgagctctatgataatgttcagagatatggacctgttatttcgacaatcccacagcagctgtccagattccagttcaacatgatcaccacctgaaaggcttataaaggaatccatgccatcagaactaatcattctttaggagaacatatatgacatctacttaccaaaattaggattctcctaatcagcaaatagacttgttactcaagctaatgtagcttagctttatggtctactccggtggtctttcatatgaaactgtaatgtgtacctccaattcgaaggcctttgcatggttgaaattttgtttgttttgtgctgacaaaaagaagataggtccactgttattttcatgtttcaagagtattgtgtggggctatggagattgtagcttgtgcttctccagaaatatttttaggtggaaactataagaaccaagctaatgataccaacattgtacttgttaaccaagaaattatggcactttctgaaagcttgggagaggaagggtaaaaagagaagggggactttcatgatggatcatgtatggaaaacttacacaaaggtttgcaggtcatgtgatgtgcttttgctat

SEQ ID NO: 2411 - DNA, 1263 bp, Carica papaya
caatcgcttcgcttgtgttgtggcgaaccaaccaaggaaaatactccataaatttgttgaaaaggaacctgcatacggttctaaacttgcaggtgaacaaagacaatagcgagtatggtcttcgggagagaaatggtagcgtcaacggtggtcaacacgtatccactctctagctataccttcgggacgaaggagccaaagatggagaaggacacctctgtggccgatcgtcttgctcgaatgaaagtcaactatatgaaggagggtatgaggaccagtgttgaagggattttactggtccaggaacataatcatcctcacatacttcttcttcaaattgggaatacattctgcaaacttcctgggggacgactgaagccaggagaaaatgaaattgagggcttgagaagaaagctaactagcaagcttggagctaattctccaggtcttgtgccagactggcagattggtgaatgtgtggccatctggtggcgaccaaactttgagacaatcatgtatccttattgccctccccacatcacaaaacccaaggagtgtaagaagctttttgtagttcatctggctgagaaggagtactttgcggtgcccaaaaatttgaaactccttgctgtaccattgtttgaactctatgataatgttcagagatatggacctgttatatcaaccattcctcagcaactttctagattccagttcaacatgattagttcatgagcttccagtgtggatttcaagagcacactaatggacgatattctgattgattccaagaactataccgtaatatgtttcaacaacttatacctggatggtggtgcttcctagctgatatctttaagtttggtcagtatgacttcattgcacatgactgaaaaaattttgaatgcaacattaagtcatcatgttggaattaattggatctagattctttactgttcaaagcctatgattatcgtgtatcgtagctgtattaattctgtcttagatgcttaaattcagaagttgcgaagcacaagtattgcaaaggctatttttgtgagaattaatcacttgaaatatgttatatcttcccccagaattctaggcgatattctttatgcccagttagagtggtgcttgtatggtactcccttgctttttttttctttaattcctgtaatgcctgtggtacttgaagcttgtaatcctggccatggttgtaaacttggtttctcaaggaaatagcagattcaagttttcaaa

SEQ ID NO: 2412 - DNA, 1235 bp, Petunia hybrida
gttgtaggattttgcctaaagaaacatgaattaagggcaaatcaaggcatgcaccaatttaattaaagggaaaaaaagaacaaacaagttagcatccccagtgaagtgggagcaagttgtggccgtttggtgggagtgagaaaagatggtaacatctggtatagtgaatacatacccactctctagctacacctttggaactaaagaacccaaaatggaaaaagacacttccgttgcagatcgccttgctcgcatgaaactcaactatatgaaggagggcatgaggacgagtgttgaaggaattctattggtacaagaacataatcatcctcatattcttcttctgcaaattgggaacacattttgcaaacttccaggtggacgcctaaagccaggagaaaatgaaatcgagggtttgaaaaggaaactatccagcaaacttgcagctaattctcctggccttcagccagattggcagataggtgagtgcgtagccctatggtggcggccgaactttgaaaccataatgtatccatactgccctccacacataacaaaacccaaggagtgtaaaaagctctttcttgttcacctatctgaaagagagtactttgcggtccccaaaaatctaaaacttcttgctgtgccattgtttgaactttacgacaatgttcagaggtacggacctgtaatatccacaattcctcagcagctttccagattccagttcaacatgatccatccatagaatagtagatggatgttcaaaagctccttccgggatagaaatggaatcaaatcggttaagttcccatattttgagaatgactgaggcctactccatgacttttgattcacctttttactataggcagatagatctagcatctgatgatgtttctttaaatcggcttattcccaatgggtgtagatgagtatggtatgaaagcctgttaacttgcaataacttatttgtgtgtagctcgtcaaatattgacatagtgttgctaggtttctttggtttagtgaggctcttggaagtagccattctaagtgatctttcttcggttggtgattgatgaatgtgatgctgacctcttttgtcagattgtcttgatagagctttgtgctcttttatgtgaaaaaactagaagcgtagtattccagtctcttctagtcccctgtaatcgacaattttgtttctggactgtgattttcaaatatttaactatggc

SEQ ID NO: 2413 - DNA, 1024 bp, Lippia dulcis
cgttccaatttgctgcaaatcaaacaaaaaaaacagggaatttatactgagtgaaagagagaatggtagcatcgcaggtggtaaacacgtatccactttcaagctacactttcggcacgaaagagcccaaaatggagaaagatacatccgtagccgatcgccttgcccgcatgaaagtcaactacatgaaggaaggtatgaggaccagcgtggaggggattttgttggtgcaagagcataatcatccccatattcttttgttgcaaattggaaatactttctgtaaacttccaggcggcaggttaaagccaggggagaatgaaattgagggcttgaaaaggaaactatctagcaaacttgctgccaattcacctactcttcagccagattggcagattggtgagtgtgtggcaatgtggtatagaccaaatttcgaaaccatcatgtacccttactgtcccccacacatagcaaagcctaaggaatgcaagaaacttttccttgttcacctatctgagcgcgaatattttgctgtgccaaaaaacttgaagcttcttgctgttccattgtttgagctatacgacaatgttcagaggtatggacctgttatatcaaccatccctcagcagctatcgaggtttcagttcaacatgatacaaccatagattctttgggaactatgtagaacactggtggaacatagaaagtcgcaggttttgaggacgagcaattgaattttctcatatagtgataccatctcatcgcgtgcacagacttttaactgttcttgttttgaacttattaaaccccctgatcatctaatgtgaaatgggtccgtggtgtaactggagtttttatcgaacaatttatttatgtttgttttatcttctttttctatgtcaaaaatctgttctagacttgtcagttccatgtaaagtttgttgagagtaaaatagatagcagattagcatccaatgcagaagctgtatggtgactgcctgtgatctatacaatggtgttttta

SEQ ID NO: 2414 - DNA, 1149 bp, Sciadopitys verticillata
tccagtaagggaggtggaagtgggtattaagaactattagcacaggctctgtgtgcgcattgtgtatcatacggttgttgtggaagaagttagtaagcaacctttacataacatatcttttcctcactttactggaatttacgtttccacaagagaaaaaaaaggaagatgttgtctgggccagtggtgaatgcgtaccctctctcaagctacacctttgggacgaaggagcccaagatggaaaaagacacttctgttgctgacaggctcgccagaatgaaagtcaattacatgaaagaaggcattcgcacaagcgtcgaggctatccttctggtgcaggagcacaaccatccacatatactactattgcagattggaaacactttctgtaaacttcctggaggacgattgaagcctggtgaaaatgaaattgaagggttgaagaggaagttgtcaagcaaacttgctgcgaattcaagtgcccttcagccagactggcagattggagagtgtgttgcagtatggtggagacctaattttgaaacattgatgtatccttattgtccgccccacataaccaaacccaaggaatgcaagaaacttttccttgttcatctgtctgaaagggaatattttgcagttcccaaaaacctgaaacttcttgctgtgccgttgtttgagctctatgacaatgtccagagatatggtccagttatctcaactattccacagcagctgtcaagattcacctttaacatgattaatgcctgattaatttctgatttccatcgggaggttgctttccagtgttggaatgttgaggattgctttcttcaggcaatggatttagaaatagtatttaaatttttcagttagtgcgggaagagtgaattacaaggtctaagaaatcttggtccatatataatgttaaggcctgcatgttagatatggtgtttgttgtttggagatataaattactaattactgaagtctaggttatacttcaaattgctgcctgcctgcaaattttccctggcaagaaatgtgccaaaggggaaagtatatgaagctgcattaacaaagaaaattcatatcactctgccgcctaacagttttactagttttatgtgttttatttatagaaagtct

SEQ ID NO: 2415 - DNA, 1233 bp, Glycine max
attgaaattgaaataacatttacagaatacaaattcacacacactctctctggtgttgttgagttttgaaaatggtgtcgtcgcaggttgtgaatacttacccgttgtccagctacacgttcggcacgaaggagcccaagatggagaaggatacctccgtcgcggatcgtctcgctcgcatgaaagtcaactatatgaaggagggaatgaggaccagtgtggaaggaattttactggtacaagagcacaatcatcctcatatacttcttctccaaattggaaacacattctgcaaactcccaggcggtcgtctcaaaccaggagagaatgaaattgagggcttgaagaggaagttgactagcaagcttggtgctaattcaccagctcttgtgcctgactggcagataagtgagtgtgtagcaatctggtggaggccaaattttgaaaccataatgtatccatactgccctcctcatataacaaaacccaaggagtgcaaaaagcttttccttgttcatttatctgagagggaatactttgcagtgcccaaaaatttaaaacttcttgctgttccattgtttgaactctatgataatgttcagagatacgggccagttatatccactattcctcagcagctatccagattccagtttaaaatgatcactaattgaacggaaatttgaagcttacatgctgataaattacgactttcatttgttattttcgtaactaggactaagatttatcattgcatagactggctagaaaactgagttttgaagtgagtttctgacagagtagctgtgttgggacatggtttgtctgtatttattcattgcactatgggttgatgtcggttatgaacaatcaacccaagatggaatcaagtaatcaactcttaggctatacacctaatgccctagtagaaatcaaggtgatcaggtagtgtctttatctcatgtctgttgcttctgccttgctcaggttgccatattgcattggaaagggtcaaggaatggacattggttttcattgctagttattttggtgaaaggcattgaatgtcaaaaattatatataatcccatattagaggcaaaaattcaaacataatcctcgtggcaaaatgtataaaacaatgacaaatgtaattttttttttaacatattaaagacagttttagcgcatgagctacttctggaagttggtgaagttgtgtaccaccaaattc

SEQ ID NO: 2416 - DNA, 1636 bp, Glycine max
ctggaaacaaaaaagcttacttacaaagagtgttatcaaagagtaaaaaaattgagaataatgagttccaatataataaactagaggggataaaatacaaaaaattgaaaacaaataagcctaacctatcaaaattcaggtggaaaaggttccggcctcaagtcttccgaccaccactcttgtctttttggcatatcaaaaaagtctgacacataacatttagtaagtgtttttcttttttttttttaaaaaagttatgaaatagaagcgggccagcggcccatgatccagcgtgattgagatctagcagtatgagacatgagacgcggacattgaaattgaaataacatttacagaatacaaattcacacacactctctctggtgttgttgagttttgaaaatggtgtcgtcgcaggttgtgaatacttacccgttgtccagctacacgttcggcacgaaggagcccaagatggagaaggatacctccgtcgcggatcgtctcgctcgcatgaaagtcaactatatgaaggagggaatgaggaccagtgtggaaggaattttactggtacaagagcacaatcatcctcatatacttcttctccaaattggaaacacattctgcaaactcccaggcggtcgtctcaaaccaggagagaatgaaattgagggcttgaagaggaagttgactagcaagcttggtgctaattcaccagctcttgtgcctgactggcagataagtgagtgtgtagcaatctggtggaggccaaattttgaaaccataatgtatccatactgccctcctcatataacaaaacccaaggagtgcaaaaagcttttccttgttcatttatctgagagggaatactttgcagtgcccaaaaatttaaaacttcttgctgttccattgtttgaactctatgataatgttcagagatacgggccagttatatccactattcctcagcagctatccagattccagtttaaaatgatcactaattgaacggaaatttgaagcttacatgctgataaattacgactttcatttgttattttcgtaactaggactaagatttatcattgcatagactggctagaaaactgagttttgaagtgagtttctgacagagtagctgtgttgggacatggtttgtctgtatttattcattgcactatgggttgatgtcggttatgaacaatcaacccaagatggaatcaagtaatcaactcttaggctatacacctaatgccctagtagaaatcaaggtgatcaggtagtgtctttatctcatgtctgttgcttctgccttgctcaggttgccatattgcattggaaagggtcaaggaatggacattggttttcattgctagttattttggtgaaaggcattgaatgtcaaaaattatatataatcccatattagaggcaaaaattcaaacataatcctcgtggcaaaatgtataaaacaatgacaaatgtaattttttttttaacatattaaagacagttttagcgcatgagctacttctggaagttggtgaagttgtgtaccaccaaattcaaatatttgtaagctcactatctttcttacgttttgcgtcacctatataaagtccaaggccttttgtgattt

SEQ ID NO: 2417 - DNA, 1236 bp, Glycine max
agcatggttgagatctagcagtggcagcgccagtatgagagacgggcattgaaattgaaacaacataacagacctaatcaatcagtcatacgaatttccagaatacaaattcacactctctttggctctggtgttgtgttgtgttgaggtacttgagaagagaaaatggtgtcgtcgcaggttgtgaatacgtacccgttgtcgagctacacgttcggcacgaaggagcccaagatggagaaggatacctccgtcgcggatcgtctcgctcgcatgaaagtcaactatatgaaggagggaatgaggaccagtgtggaaggaattttactggtacaagagcacaatcatcctcatatacttcttctgcaaattggaaacacattctgcaaactcccaggtggtcgtctcaaaccaggagagaatgaaaatgagggcttgaagagaaagttgactagcaagcttggtgctaattcaccagctcttgtgcctgactggcagataggtgagtgtgtagcaatctggtggaggccaaattttgaaaccataatgtatccatactgccctcctcatataacaaaacccaaggagtgcaaaaagcttttccttgttcatttatctgagagggaatactttgcagtgcccaaaaatttaaaactactagctgttccattgtttgaactctatgacaatgttcagagatacgggccagttatatccaccattcctcagcagctatccagattccagtttaaaatgatcactaattgaacataaatttgaagcttacatgctgataattactactttcatttgtaattttcgtaactaggaattatcattgcatagactggctagaaaactgagttttgaagtgagttgctgagtagagtagttatgttgtgacatggtttgtctgtatttcattcattgtactgtgggttgatgtcggttatcaacaatcaacccaagagggaatcaagtaatcaactagtaggctatatgcatctaatgcctagtagaaatgaaggtgatcaggtagtgtttgatctcatgtctgttgcttctgccctgctcaggttgccaatattacaataggaaagggtaaaggaatgggcattggttttcattactagtttttctggtgaaaggcattgaatggaaaaaattatacatttgaaattcaaacataatcctcgtggcaaaatgtataaaacaatgactaaaatttaaaatgta

SEQ ID NO: 2418 - DNA, 1469 bp, Glycine max
ccatgatccagcatggttgagatctagcagtggcagcgccagtatgagagacgggcattgaaattgaaacaacataacagacctaatcaatcagtcatacgaatttccagaatacaaattcacactctctttggctctggtgttgtgttgtgttgaggtacttgagaagagaaaatggtgtcgtcgcaggttgtgaatacgtacccgttgtcgagctacacgttcggcacgaaggagcccaagatggagaaggatacctccgtcgcggatcgtctcgctcgcatgaaagtcaactatatgaaggagggaatgaggaccagtgtggaaggaattttactggtacaagagcacaatcatcctcatatacttcttctgcaaattggaaacacattctgcaaactcccaggtggtcgtctcaaaccaggagagaatgaaaatgagggcttgaagagaaagttgactagcaagcttggtgctaattcaccagctcttgtgcctgactggcagataggtgagtgtgtagcaatctggtggaggccaaattttgaaaccataatgtatccatactgccctcctcatataacaaaacccaaggagtgcaaaaagcttttccttgttcatttatctgagagggaatactttgcagtgcccaaaaatttaaaactactagctgttccattgtttgaactctatgacaatgttcagagatacgggccagttatatccaccattcctcagcagctatccagattccagtttaaaatgatcactaattgaacataaatttgaagcttacatgctgataattactactttcatttgtaattttcgtaactaggaattatcattgcatagactggctagaaaactgagttttgaagtgagttgctgagtagagtagttatgttgtgacatggtttgtctgtatttcattcattgtactgtgggttgatgtcggttatcaacaatcaacccaagagggaatcaagtaatcaactagtaggctatatgcatctaatgcctagtagaaatgaaggtgatcaggtagtgtttgatctcatgtctgttgcttctgccctgctcaggttgccaatattacaataggaaagggtaaaggaatgggcattggttttcattactagtttttctggtgaaaggcattgaatggaaaaaattatacatttgaaattcaaacataatcctcgtggcaaaatgtataaaacaatgactaaaatttaaaatgtatttttacatattaaagacagttttaacatatccactacttctggaagttgttgctagtagtgcacgcttggtgaagttgtgtgccaacaaattcaaataaggtcactttctttattactttttgcgtcaccaaagtccaaaggcattgtgtgatttcttttattgatactagtgagaaaacgccaataagacaaatatgaaaaatagttttgggatggaaggaa

SEQ ID NO: 2419 - DNA, 1494 bp, Taxus baccata
catttaaaatttatgaatggaacgtgtcaagaaaaatctcttccttacctagtgttccaaataatcttcgacaatgttcgcgacccgagcgctgatttctttcgattgaaataaacgtcctagaaacatcggagccgctgcaagttttaatttaatttcttcttcctagaagtgcttactgggatttaactcagagttcgttttgagcaagagagaagcgaaaatgttgtcgggaccagtggtgaatgcgtaccctctgtcaagctacacatttggtaccaaggagcccaagatggagaaggacacttctgttgctgacaggctcgccagaatgaaagtcaattacttgaaagaaggaatgcggacaagcgttgaggccatccttttggtgcaggagcacaaccatccccatatactgctattacaaattggaaacactttctgtaagcttcctggaggacgattgaagcctggtgaaaatgaaatcgaagggttgaagcggaaactgtcaagcaaacttgctgcaaattcaagtgcccttcagccagactggcagataggagagtgtgttgctgtatggtggagacctaattttgagacattgatgtatccttattgtccgccacacataacaaaaccaaaggaatgcaagaaacttttcctagtccatctgtctgaaagggaatattttgcagttcccaaaaacctaaaacttcttgctgttccgctgtttgagctctatgacaatgtccagagatatggtccggttatctcaactattccacagcagctgtcaagattctcctttaacatgatcaatgcctgaatttcattgggacctttattgaccatcgttggaatcttgaacattgctttcttcaggcattggacttgaaaatattgctttaattgtttaaatgtcttttggaaagagtcaattgtaaaaggttcaggaaattttggcttatataaaaggttgggaccattgtacttacccttcattactggacatgctttggcatgtgtgttgcattaacatatagtctctgttgattgtaggcataaaatattaacaatgtctaggattgcctttgaaaagcctgcaaggttttttcctgtgagaattggactggaaggacatgcatatcaagagtatatcactctgcttcatatgagtattcctagttttagaaggttgttttcaccatcaaatggtatatttctttgagtgccactgctacctatgtcattaatttgaaacttaatgactgaagtcggatgaaaaaacagatattataagggtaaagggagatgtccttgattgacgtttgtagttaatttgggttatgttttagggacctcctttgtcattttgttcggctagagttctttttttaatttgtgttgggccaagtcattgttaatatttgcaataccatgtatgttgagcaaagatctttaatgtctataaatagtgttaaaacgttcttacct

SEQ ID NO: 2420 - DNA, 1254 bp, Triphysaria pusilla
tccctcaagttattcacttctctctcccggtcggccatttccgaattttgcaggcagcacaaattgatttcactccaatacaacaaattaaggagatacaagatagagataataagattgagtaaaaaaaccggaatgaaaatggtagcatcacaggttgtaaatacataccctctttcgagttacactttcggcaccaaagagccgaagatggagaaagatacctccgtccacgaccgccttgcccgcatgaaagtcaactacatgaaggaaggtgtgaggaccagcgtagaagcgattttattggtacaagagcataatcatccccacattcttcttttgcaaatcggaaatacgttttgtaaacttccaggcggcaggttaaaaccaggagagaatgaaattgaggggttgaaaaggaaattatcaagcaaacttgctgctaattcacctggtctccagccagattggcagatcggcgagtgtgtggcgatgtggtggagacctaattttgaaaccatcatgtatccttactgcccaccacacataacaaagcctaaggaatgcaagaagctttatcttgttcacctgtctgaaagagagtattttgctgtgccaaagaacttgaagctccttgctgttccattgtttgaactatatgacaatgttcagagatatgggcctgttatatctactatcccgcagcagctatcgaggtttcagttcaatatgatccagcaataatttcatcggagaccaactctgtaaggctcagatgaaaaatggagagtgactgatgatatcctctatttggttagtccgccaggacccaggttttgagggtaacttgtcaaactatggttcctaatttcctatcgcaatatttcatcctagacttggaaaatctttgttactcgttttctgttttgaagttgttttaactatttgatcatcccaactgaattggggtccttggcagacaactagagtttgatggaactaatctggaatgttattgtgtttacttagaagtctctttgttaatgtctgttgtattatatatagtgtcatgtagaacttgtttacttggaggtgaactaagttgagaaagtgactcaaagcaaaacttgtattggattatgtgctcatatgtaacaccgtttagggctgttttaggtctcaggatcgtagctgtattgttaatggctggaaatattgtaagtgtgtaatatagacaacaaagagtattcattg

SEQ ID NO: 2421 - DNA, 1101 bp, Artemisia annua
tactccgacggggacatattcaaatcacttaaaagcacatttcaccaaaagtctttcttccaaaacccccaaatcagacaaacccatacatcacaaaatcaaaaccctaaatccaatcaagatggtgagttcatcaattgtgaacacatacccattatcaagctactcattcggtacaaaagaacccaagatggaaaaagatacctctgttgctgatcgtcttgctcgtatgaaactcaactatatgaaggagggtatgaggacaagtgttgaagcaatcctactggtgcaagagcataatcatcctcacattcttcttctacaaattggaaacactttctgtaaacttccaggtggtcgactgaagccaggagagaatgaaattgaaggcttgaaaaggaaattgtcaagcaaacttgctgctaattcacctaacatgcaacctaattggcagattggcgagtgtgtggctgtatggtggaggccaaactttgaaacaattatgtacccgtattgccctccacacatctcgaaacccaaaagctttatgttgtacacctgtcagaaagagagtactttgcggtgcccaaaaatctgaaactccttgctgttccattgtttgagctttatgataatgttcagagatatggaccagtcatttcaactatacctcagcagctttcgagattccagttcaacatgatagcctcataaattcgcaccagattcaagctgtttgctttcagagacaagtttagtaacaaatgttcttcaaaaatcatgctttcagaaactcaagcttagtaacaaacgttcttcaaaagctatcttattttacaaaacctgatccaaagacggagagaccattaactattatgacttgttctttatgtattcgactttttgggttgtaaaatttctttccatttgctaattgtttgtttgtagctttttatttatagagatagccatgccattgtagaagtgttatgtatctgatgtatcgatagtcatactttgctttagtttatggtgtagaattgttggtttagcttcgactaagtcgacctgaaaatcagtggttaagcaaagacacgcgag

SEQ ID NO: 2422 - DNA, 979 bp, Papaver somniferum
cgaccgaccgactctgtaatcggctagatcatcatcatcaccatcaagagaggagactgagcgagcgagtgagtgaaaatggtgacatctccagtagtgaatacatacccactctcaagctatactttggtactaaagaccaaagatggagaaagatacttctgtttcagatcgtcttgctcgtatgaaagtcaattatatgaaggaaggaatgagaactagtgttgaagctattctactagtacaggagcataaccatccccatatattgcttttgcaaattgggaacacgttttgcaaacttcctggtgggcgtttaaaacctggagagaatgaaattgacggtttgaaaagaaagctgtcaagcaaacttgctgctaactcaaccgctcttcagcccgattggcagattggcgagtgtgttgctatctggtggaggcccaacttcgagactataatgtacccatactgccctcctcatatcacaaaacccaaggagtgtaaaaagcttttccttgttcatctgtctgagagggagtactttgctgttccaaagaacttgaagctgctcgctgtgccattgtttgaactttacgataatgtacagaggtatgggccagttatctccaccatcccgcagcaactttcaagatttcagttcaacatgatcaatgggtgaaaatgcaagggtttcaagagcgcccacttgggaggggtcttaagtaggaaatgattggtctacaatggggattatgaagtttttgcagataggtatgcccgtgaagctagtccaacttaaagtcgaaatcttggtctttaatacattggaattgtgtgatttctatacatttgtttcccaaatatacttgtacttgtatggtttcttatctcgtgttgtgtttaaattttatgccaagataatgttagaatgttagttatctagacaatgtaaagggaagtattgtaaaaccccgtctgt

SEQ ID NO: 2423 - DNA, 1357 bp, Aquilegia formosa
tgtttactttacttcgccgtctctctttctcttctgcgctcgtgctttcaaaggctttcgatacagagagagaactagctgcttttgttgctttagtaacagagagagagagagagagagagagagagagagagagaacgatggtgccggttgtaaacacttatccactttcaagctatacctttggaacgaaggagccgaagatggagaaagacacttctgttgcagatcgtctcgctcgtatgaaagtcaactacatgaaagaaggaatgcggacaagtgtagaggctattttactggtacaagagcataatcatcctcacatactacttctgcaaattggtaacactttctgcaagcttcctggcgggcgcttgaagcctggagagaatgaaattgaggggttgaaaagaaaactgtctagcaaacttgctgcaaatgcaactgctcttcagccagattggcagattggtgagtgtgtggctatttggtggaggccaaactttgaaacaataatgtatccctattgccctccccacatcacaaaaccaaaggagtgtaagaagctcttccttgttcacttgtcggaaagggagtactttgcagtacccaaaaatctgaaattattagctgttcccttgtttgagctctatgacaatgttcagagatatggaccagtaatctctaccattccgcagcagctctccagattccagttcaacatgatcaatggatgagttaaaatggagctaccatggtctcacatcgagctgagacttaaattattgattactttgttaggacggggtcacgagttttgcagatcaaaggactaaggctaattaaacatgtcatatggtcttattagacagtctagcaggatacatcatagtaaacttatgatctggttgttctagtttttatttgtgcccttagtagtgtgtgtgcctggatcaggtgtggctcagggtataagattcgttttagagggtttattttgctgaccaatcctagtattaagtaccaatcatttgtcggtcaagatatcacattcacattggtttcctgttatctttggggaagctattgaacttttgcaagcagtattgtgctgtagtttaacttggtatgtggtaagagcagttgtatattagaccctcatggggtgtgcatgtatttgttctgttgattgtttgaggtcttttactgtaggatgaaaaccactgtaaccaacccaccatgaccacatgcctttttttatttgtacatgtcattatttccccagtgaaatgatgtaactatctccaaatgtagtactgaatgatgtatgtgaagtcaatcaagtttttcatgtagc

SEQ ID NO: 2424 - DNA, 1192 bp, Aquilegia formosa
gtgccggttgtaaacacttatccactttcaagctatacctttggaacgaaggagccgaagatggagaaagacacttctgttgcagatcgtctcgctcgtatgaaagtcaactacatgaaagaaggaatgcggacaagtgtagaggctattttactggtacaagagcataatcatcctcacatactacttctgcaaattggtaacactttctgcaagcttcctggcgggcgcttgaagcctggagagaatgaaattgaggggttgaaaagaaaactgtctagcaaacttgctgcaaatgcaactgctcttcagccagattggcagattggtgagtgtgtggctatttggtggaggccaaactttgaaacaataatgtatccctattgccctccccacatcacaaaaccaaaggagtgtaagaagctcttccttgttcacttgtcggaaagggagtactttgcagtacccaaaaatctgaaattattagctgttcccttgtttgagctctatgacaatgttcagagatatggaccagtaatctctaccattccgcagcagctctccagattccagttcaacatgatcaatggatgagttaaaatggagctaccatggtctcacatcgagctgagacttaaattattgattactttgttaggacagggtcacgagttttgcagatcaaaggactaaggctaattaaacatgtcatatggtcttattagacagtctagcaggatacatcatagtaaacttatgaactggttgttctagtttttatttgtgcccttagtagtgtgtgtgcctggatcaggtgtggctcagggtataagattcgttttaaagggtttattttgctgaccaatcctagtattaagtaccaatcatttgtcggtcaagatatcacattcacattggtttcctgttatctttggggaagctattgaacttttgcaagcagtattgtgctgtagtttaacttggtatgtggtaagagcagttgtatattagaccctcatggggtgtgcatgtatttgtactgttgattgtttgaggtcttttactgtaggatgaaaaccactgtaaccaacccaccatgaccacatgcctttttttatttgtacatgtcattatttcccctgtgaaatgatgtaactatctccaaatgtagtactgaatgatgtatgttaag

SEQ ID NO: 2425 - DNA, 1201 bp, Eucalyptus grandis
ggtacgataacgcccgaccggctttgaacttccggttctggagagcaaggagcgcccgacaacgagcgattcctcccgaccgcattctcggattcgctccgtcgttcgctcttgcccgacccggaatcgagtctccgtccccgacggccgaaagagaccgggctccttgacccgagaagagatcggaaaatggtgacttcgtcggcggcagccaacatttacccgctgtcgagctacacgttcgggaccaaagagccgaagatggagaaagacacctccgtcgccgatcgcctcgctcgcatgaaagtcaattatatgaaggaggggatgagaacgagcgtagaagcaattttgctggtacaagagcataatcacccgcacattcttcttctccaaattgggaatacattctgcaagcttcctggagggcgtctaaaaccaggggagaatgaaattgagggattgaaaaggaagttaacgagcaagcttggtgcaaattctccagctcttgtgccagactggcagataggagagtgtgttgctatctggtggagaccaaactttgaaaccataatgtatccatattgccctccgcacataacaaaaccaaaggaatgtaaaaagcttttcctggttcatttgtctgaaagggaatactttgctgtgcccaaaaacttgaaacttcttgcagttccattgtttgaactctatgacaatgtccagagatatgggcctgtcatatcaaccatcccgcagcagctatctagatttcactttaagatgataactcagtgattgtgcattcagcagcattttgcttgtgggagttgacattatcagtcattcttagctcatgcacacagcactaacttatcagagaagaagtacgggatgctctatctatgctggtaactgcgaggtgacctaatgccaccagaggttatatgttggaactcatgcctgcacttcctgtaggtgttccagttctgatcttccatttctacttatgctgatctgttaagactttttggatattgctgtagttttttctaggttataattgcgttactcttgctaaattttacagacacattatgctgtcattttaactccatgattggttaaagccaagtacagtcacttcagtgtgatgattctttgatgacttaatggtgttttgtatgctagttgggcagcatct

SEQ ID NO: 2426 - DNA, 993 bp, Fagopyrum esculentum
agggggggttttttcaggttatgaaactcccagtcccacttccagccgcctatctcacgccggatcttcaccgccgctgattaaggagtgatcgccttttcacaatcctcatccattcccggaaagagtaagcagagatgatggtgccttcctcatcggtcgtgaacatccacccgcttgcaagctactcctttggcaccaaggagcccaagatggagaaggatacttccgttgccgatcggctcgctcgcatgaaagtcaattatatgaaagaaggcatgagaaccagtgtagaaggaattttattggtacaagagcataatcatcctcacattcttcttctacaaattggaaacaccttctgcaagctaccaggtggtcgtttgaagcctggagaaaatgaagttgaagggctgaagaggaaattgtcaagcaagctaggtgctaattcacttaatcttcaacctaactggcaggtcggtgaatgtgtggctaactggtggaggccaaatttcgaaacaatgttgtacccatactgcccacctcacattacaaaaccaaaggagtgtaagaagctctatatcgttcatctgccagagcgagagtattttgctgtaccaaagaatctaaagcttttggctgtccctctttttgagctttatgacaatgttcagaggtatggaccagtaatctcgacaattccgcagcaactatcccgattcaatttcaagatggtaacccaatgagattggatctgcactttttttttcctgctccgttcatgtatggcatcgtgttacgaatcacttagactaagtaattccttttcccggattattatgctgactatatctgtgatatactcagaatctaaattaacctatttaaagatgaaccatgtttgtagtgataaatgatcgtcaactgagtgatagatttgttgagttcaccagtttgtatcattcaagcatgcaatgctgaagttgagggaga

SEQ ID NO: 2427 - DNA, 1161 bp, Ipomoea nil
cttgggtcctctccggccacatcggaattatagaaagagaaatcagctgaaaatctcgccggtctacggagaaaaaggggagagttagcagagatgataacgtcgccggtggtgaacacatatcctctagccagctacagcttcggcaccaaagagccgaagatggaaaaggacacctccgtcgccgatcgccttgctcgcatgaaagtcaattacatgaaggagggaatgaggactagtgttgaaggaattttgttggtacaagagcataatcatcctcatattcttcttcttcaaattgggaacactttttgcaaacttcctggtgggcgcttgaagcctggagagaatgaaattgaggggttgaaaaggagactctccagcaaacttgcagctaataattccgctgttcagccagattggcagattggagaatgtgtggccatctggtggaggccaaattttgaaacaatcatgtatccatattgccccccacacataacaaaacctaaggagtgcaaaaagctcttcctggttcatctgtctgagagagagtactttgctgtccccaaaaacttgaaacttcttgctgtgccattgtttgaactctatgacaatgttcagagatatggacctgtcatatccacaattccacagcagctgtctcggttccagttcaacatgatccatccatagtttcatgacatccaagaactcatgcccatgcagaacatagaggacatcaaattaaccgggtataggtccaatttgaagatactagaacaaacactcgagacacaaaacccctcttttctacttagacattgaagtgaaaccgcaaaacatgcatgaatttaggtctttttatgttttatttatgatggatgatattgctgctgatatttggatggtgtaattttgaagacagggttcatctgttgtagacatgtaacttattttatttgtattttttttggggcacatcatactagatgggggtagaagtcttaacacatgtagtcgtcgtgattaaattgcaaaatatctgtaggttttgaatgactcttgcggctgagttggtgaaatgcttgacatgtttaggatgtaagtttccaaaagacagcaatttgtgtatttagcagtgatttatcaattcaagaa

SEQ ID NO: 2428 - DNA, 1123 bp, Medicago truncatula
agacattgattcgttttcattcacttcaactcaaatcaacctctcctccctcctctttcttcttcttgttctcttctttgttcacttccctcaaaaacaacactatagaatagaacagaagagaagagaaagatgataccctctcaggtagtaaacacatacccattatcgagctacaccttcggtactaaggagcctaagatggagaaagacacctctgtcgctgatcgtcttgctcgtatgaaagtcaattatatgaaagaaggaatgaggaccagcgtggaaggaattttactggtacaagaacacaatcatcctcatatccttcttctgcaaattgggaacacattttgcaaactcccaggcggccgtctcaagccaggggagaatgaaattgagggcttgaagagaaaattgactagcaagcttggtgctaattcacccggccttgtacctgactggcagataggtgaatgtgttgcaatctggtggaggccaaattttgaaactataatgtatccatactgtcctccgcatataacaaaacccaaggagtgcaagaagcttttcctcgttcacttatctgaaagggaatactttgctgtacccaaaaacttgaaactgcttgctgttccattgttcgaactctatgacaatgtccagagatatggaccagtcatatccactattcctcagcaactttccagattccagttcaaaatgatcactaactgacctgaccgtaattggaagcgtagatgctgatagaatactactacttccatttgttattttaagaattaggactgatttgatgcattatcctaaaccctatttatcattgcatagactggttagagaactgaattttgaagtgtgttcctaaaaagatttgtaatttgtgacactgtttgtattaattcattggattatgggtttgatttgttgcggttatcaaccctagatgggaaacaacttgtaggctagatctgaaaaggctgaagttgaaaccaatacgatggatgagtatagcgatcccatggtctgtttctctgccccgctcaagttgccaaatactccatcagaattgtaagatgaagaaatgaacatggattaatcatga

SEQ ID NO: 2429 - DNA, 1360 bp, Cajanus cajan
gagttgaagcggtgtgtttttacatgaaggtggataaagggagcgggctaaggctaaggcccatgatccggtgcgggtgagatctaacagtaaggaacggacattgaaatatgaaaacacacagacctaatcaatcggtcatcccaatttccaaaagacaaaacaaactcactctcttctgttcgattcatccatagcagggaacacaaaatggtgtcgtcgaaggtggtgaatacgtatcccttgtccagctacaccttcggcaccaaggagcccaagatggagaaggacacctccgtcgccgatcgtctcgctcgtatgaaagtcaactacatgaaggaagggatgaggaccagtgtcgaaggaattttactggtacaagaacacaatcatcctcatatacttcttctgcaaataggaaacacattctgcaaactaccaggtggtcgtctcaaaccaggagagaatgaaactgagggcttgaagagaaagttgactagcaagcttggtgctaattcaccagctcttgtgcctgactgggagattggcgagtgtgttgcaatttggtggaggccaaattttgaaactataatgtatccatactgccctcctcatataactaaacccaaggagtgcaaaaagcttttccttgttcatctgtctgagagagaatactttgcagtgcccaaaaatttaaaactgcttgctgttccgttgtttgaactctatgacaatgtccagagatacgggccagttatatccaccattccccagcaactgtccagattccagtttaaaatgatcaccaattaaacgtaaattgaagcttgcatgctgataaatcactatttttatttgttattttcgtaactaggactgacattatcattgagagactagttagagaactgagttttgaagtgggtttctgaatagagtaagcttgtgacatggtttctctgtttttatttactgtactcgattatcaacccaagatattatcatgtaatcaattcgtaggctgtatacctaagccgtaggagaaatcaatgtgattaagaagtatctcgatcctatgtatgttgcctctgccctgctcaggatgccaaaatattggaatggaaggggtaaggaatggatgacattggtttttagtgtaagtttttgtggtgaaaggaattgagtgacaaaattatacgcatgaattccaacataatcctcatggggcaaaatgtataaaacaacggctaagtttaaactgtacttttacttattaaatacagagttttagtgtatgtgtatccactactacttcccgaagttgttgctagtgcacgcgtggtaaagtatcacctgattc

SEQ ID NO: 2430 - DNA, 1298 bp, Thalictrum flavum
tcgagtcgagtgggtacatcgtcgtctatttcgctcctaagctcgtcttgtcaaggctttcgaacagagaagagaagtagctgtttttgttgttgagagaaaaggagagagaacgatggtgccggttgtaaacacatatccactttcgagctacacctttggaacgaaggagccgaagatggagaaagatacttctgtagcagatcgtttggctcgaatgaaagtcaattacatgaaagaaggaatgcggacaagcgtagaggctattctactggtacaagagcataatcaccctcacatactacttctgcaaattggtaacactttctgcaagcttcctggcgggcgcttgaagcctggagagaatgaaattgaggggttgaaaaggaaactgtctagcaaacttgctgcaaatgcaactgctcttcagccagactggcagattggtgagtgtgtggctatttggtggaggccaaactttgaaacaataatgtatccttattgccctccccacatcacaaaaccaaaggagtgtaagaagctcttccttgttcacttgtcagaaagggagtactttgctgtacccaaaaatctgaaattattagctgttcccttatttgaactctatgacaacgttcagaggtatggaccagtaatctctaccattccgcagcagctgtccagattccagttcaacatgatcaatgcatgagttaacatggagctaccatgatctcacatcgagccgagacttgcattgttgcttaatttgttaggatgggatctcgagttttgcagatcaaaggactaaggctaattaaacttgtcatatggtctttttagcgagtctagcaggatacttcacagtgaacttataatcaggctattctagtttttatttgtgccttagtgtgtgtctaggtcagggtgtgacttagagcagaagattcgttttactgacctatcgtagtattaagtgccaattatttgtgaagttgaaccgttggttttctgctatcttgggggaagtttactgaacttttgcaagcagtatccataacttattctgtaggttttaatttggcatgtggtaagagcagttgtatattagaacccacatggggtgtgcatgtaattttcaattgtattttttgaggtcctttactgtttggatgatggcaacattgacaatccaaacagagggccattaccccatgcctcttttgatttgtacgtgccattatttctcttgtgaaaggcggtaactatttccgaatgtagaagtgtagaactaaatg

SEQ ID NO: 2431 - DNA, 1254 bp, Trigonella foenum-graecum
gacattgattcacttcaactacaaaccttccctctctttcttcctcttccttttcttcatatctcctcaaaatcaatagaagaagaagactgagagaaaatgataccgtctcaggtggtaaacacataccctttgtccagttacaccttcggtactaaggagcctaagatggagaaagacacctccgtcgcagatcgtcttgctcgtatgaaagtcaattatatgaaagaaggaatgaggaccagcgtggaaggaattttactggtacaagaacacaaccatcctcatattcttcttttgcaaattggaaacacattttgcaaactcccaggtggtcgtctcaagccaggggagaatgaaattgagggcttgaagagaaaattgactagcaagcttggcgctaattcacctggtcttgtacctgactggcagataggtgaatgtgttgcaatctggtggaggccaaattttgaaaccataatgtatccatactgtcctcctcatataacaaaacccaaggagtgcaagaagcttttccttgttcacttatctgagagggaatactttgctgtacccaaaaacttgaaactgcttgctgttccattgtttgaactctatgacaatgttcagagatatggaccagtcatatccaccattcctcagcaactttcccgattccagtttaaaatgatcactaactgactgtaattggaagcttagatgccggcagtatactacttccatttgttattttaagaagaactaggactgatttgatacattatcctaaaccctattatcatcgcatagactggttagagaactgaattttgaagtgtttttctaaatagatttgtaatttgtgatactgtttgtattaattcatttggattatgggttgatttgtcgcgaccccaagatgggaaaaaacttgtaggctagacctgaaaaagccgagtgtcgtgataccatggtctgtttctctaccctgctcaagttgccaatatcagaatggaaaggcaaaggaagggacagcattggtttttcactttaagttttcagtcatgaaaggatttgagaagctaaaattattatacattagaaatacaacataaccctcatgtcacagaatgtataaagcaaatgtactacacaatactttggaagctgttgctcatccaaagacattgtatgaatccccatcaacaattttaaggggtaataatggcacatacacatatacaattcacttat

SEQ ID NO: 2432 - DNA, 897 bp, Tripterygium wilfordii
caaactaaaacggtatccgtgtgacgagtgcgagagagttttgaaattaagtcggagaagaaaagagagagtgcgatacagagagatggtgacgtcgccggtggtgaacacttatcctttgtctagctacaccttcggcaccaaggagccgaagatggagaaagattcttccgttgccgatcgcctcgctcgcatgaaagtcaactatacgaaagagggtatgaagacaagtgtggaagcaatcctcttggtccaggaacataatcatccacacattcttctacttcaaattggaaacacattctgcaagcttcccggtgggcgtctgaagcccggagaaaatgaaattgagggcttgaagagaaagctgactagcaaactaggtgccaattcacctgctatggtaccagattggcagattggtgagtgcgttgctatgtggtggagaccaaactttgaaactataatgtatccatattgccctccacacataatgaaacccaaggaatgcaagaagattttccttgttcacttgtctgaaagagagtactttgcggtgcccaagaatctgaaactgttggctgttccgttgtttgaactctatgataatgttcagcggtatgggccagtcatatcaactattcctcagcaactttcaagatttcagttcaatatgattagttgattgccatatgacttctatctgtggatttcaagaccctatttctggatggtagtgccgaatgccgatatgttgtgggccctaacagaccttttttttctcctttccttattataagactgagtgtcctaggataggaaggattagctgaaacttactttgacttgctccatatcaactgacacccatgtgtctctaaattctttgtttaagag

SEQ ID NO: 2433 - DNA, 796 bp, Allium cepa
cataccttcaaagttcaaacaatgctagtgattatcagattttgagggagaaagagacctagttttgtttcttaactcagaatcaatctccaaagaagaaaaataaaatagaagatggtggtaagctgtaataacatggaggtggtgaacacatacccattatcaaactacactttcggcgtcaaagaagccaaaatggagaaagatacttctgttgctgatcgtctcgctcgaatgaagcaaaactactttaaagaaggcatgcgaacaagcgtcgaggcgattctgctggtgcaagaacacagtcatccacacatattgctcttgcaaatcgggaacaccttttgtaaacttcctggaggacgattaaagcctggagaaaacgaagttgagggtttaaagcgtaaattaagcagcaaacttgctgtcagttcacctgcctttcagccaaattggcagattggagaatgtgttgcagtctggtaccgaccaaactttgaaacaataatgtacccatattgccctcctcatatcactaagccaaaagaatgcaagaagcttttccttgtccacttgtctgaaaaggaatactttgctgtgccaaaaaacttaaaattgcttgctgttccattatttgaactctatgataacgttcagagatacggacctgtgatctcaactatcccccagcaactttcaaggttccaattcaatatggtccattcctaatttttacaaaagcccatttctttgacgtttgtggtgttgctgcatgtctgatgctcatgtataaaat

SEQ ID NO: 2434 - DNA, 1272 bp, Fagus grandifolia
gttttttcataggttggctctgccttctcaaaataatagtccaagtccaatactccaacaactaaaaactggtttcgatttcgaagctttgaatccaattcctgtttcactcagctcatttcctcctctcgctgaacattctggagagagcgagagagtctgagacagttttgatagacttcgaaacaaacacacagaccataaagaaacggagacaaagagagagatggtgacgtcaccggtggtgaacacgtacccactctcaagctacaccttcgggaccaaagacccaagatggagaaagacacatccgtcgctgatcgtctcgctcgcatgaaaatcaactatatgaaggagggaatgaggactagcgtcgaagggattctactggtacaggaacataatcatcctcacatacttcttctgcaaattggaaacactttctgcaaacttcctggtgggcgtttgaagccaggagagaatgaaattgagggcttgaaaagaaagctgaccagcaagcttggtgctactgtaccagctcttgtgccagactggcagataggtgaatgcgtggctgtctggtggaggccaaactttgaaaccataatgtatccatattgccctcctcacataacaaaacccaaggagtgtaagaagcttttccttgttcacttgtctgagagggagtactttgcagtaccaaaaaatttgaaacttcttgctgttccattgtttgaactctatgataacgttcagagatatggaccagttatatccaccattcctcagcaactctccagattcgagttcaacatgatcactaaatgagcatgggtttctagagctcacatcctgatagtctgcttaaagttatctgctagggctcagacctggttattacataactgaattttaagttggtttagtaggggtttctccagttatgctgataattgaagattatcttttgacatggtctctctgtgtttggtcctttggaatatctattgatgtgttctgcgttagcctaggattcttgttccaacaaggtttctgttgagttcttggtgtcatgtactgtagtttaagtccagtggatatacctttcagtaggatggaatgagttataacatgctgtttgggatttcctaaattttttttgtaatttaactgattatgcttgtagcattataggtgaaattagggtacaaacagaggagatatgtaacatgtatcagctgtttctgcttatcttggtgtagtgtcttaggc

SEQ ID NO: 2435 - DNA, 603 bp, Vinca minor
gacgtcgcctgtagtaaacacatacccattgtcgagctacaccttcggaactaaggagccgaagatggagaaagacacttccgtcgccgatcgtcttgctcgtatgaaggtcaattatacgaaggagggtatgaggacaagcgttgaaggaattttattggtacaagagcataatcatccccacattcttcttctgcaaattgggaatactttctgcaagcttcctggggggcgtctgaagccaggagagaatgaaattgagggtttgaagagaaaacttctagcaagcttgcagctaattcacccggtctgcagccagattggcagatcggcgaatgtgtagctatttggtggagacccaattttgaaaccattatgtacccatactgtcctccacacattacaaaaccaaaggagtgcaagaagattttccttgttcatctttctgagagagagtactttgcagtcccaaagaatttgaagcttctggctgttccattgtttgaactctatgacaatgttcagagatatgggcctgtaatatccacaattccgcagcagttgtctagattccagtacaacatgatccatccttagatcaaa

SEQ ID NO: 2436 - DNA, 1391 bp, Cicer arietinum
cagtgattcatttcacctcaaatcaaatcaaatcaactcaacacaaccaaactctttctgcttctcttccgttccccatttcttcttcacttgggtttggttagttccctcaaattaatacaaccctaaagaagagaagagaagagagttccctaaaaaatggtatcggctcagtctcaggttgtaaatacatatccgttgtcaagctacactttcggtactaaggagcccaagatggagaaggatacctccgttgctgaccgtctcgcccgcatgaaactcaattacatgaaagaaggaatgaggaccagtgtcgaaggaattttactggtacaagaacacaatcatcctcatattcttcttctgcaaattgggaacacattttgcaaactcccaggtggccgtctcaagcccggggagaatgaagttgaaggcttgaagagaaagttgactagcaagcttggggctaattcagctgctcttgtgcctgactggcagataggtgaatgtgttgcaatctggtggaggccaaattttgaaaccataatgtatccctactgtcctcctcatataacaaaacccaaggagtgcaagaagcttttcctcgttcacttgtctgagagggaatattttgctgtacctaaaaacttgaaactgcttgctgttccattgtttgaactctatgacaatgttcagagatatgggccagttatatccaccattcctcagcaactttccagattccagtttaaaatgatcactaactgaccgtaattggaagcttagctgctgatagaatactacttccatttgtcattttaagagctaggactgatttgatgcacgattatcattttgcatagacttgttagagaactgaattttgaagtgtgtttctaaatagatttgtaattcgtgacactgtttgtctgtattaattcatccaaagattggaaacaacttgtaatatatttgcggttatcaaccaagatgggaaacaaccagtaggctatagaccagaaaaagccaaagttgaaatcaaaatgatggtcatggtctgttttgccgccccgctcaagttgctaatatcagaataggaaggcaaaggaatgtggcaatattggtttttcattgcaaatttttcggaggattaatcatgaaaggaattgagaggctaaaatcatactagtacattggaaacacaacataaccctcatgtgacaaaatgtacaaatcaaatgtaagacccaaagttgagatgtaagacacttcggaagctgttgctagtacaaatacattgtatgattccttgtatcgacagttttatgtgtagtggcacatacaccattctacctttttaattttgtaaaacccggttctattacgtaggt

SEQ ID NO: 2437 - DNA, 1616 bp, Cicer arietinum
cgactgtgtgggacggacagacagtgattcatttcacctcaaatcaaatcaactcaacacaaccaaactctttctgcttctcttccgttccccatttcttcttcacttgggtttggttagttccctcaaattaatacaaccctaaagaagagaagagaagagagttccctaaaaaatggtatcggctcagtctcaggttgtaaatacatatccgttgtcaagctacactttcggtactaaggagcccaagatggagaaggatacctccgttgctgaccgtctcgcccgcatgaaactcaattacatgaaagaaggaatgaggaccagtgtcgaaggaattttactggtacaagaacacaatcatcctcatattcttcttctgcaaattgggaacacattttgcaaactcccaggtggccgtctcaagcccggggagaatgaagttgaaggcttgaagagaaagttgactagcaagcttggggctaattcagctgctcttgtgcctgactggcagataggtgaatgtgttgcaatctggtggaggccaaattttgaaaccataatgtatccctactgtcctcctcatataacaaaacccaaggagtgcaagaagcttttcctcgttcacttgtctgagagggaatattttgctgtacctaaaaacttgaaactgcttgctgttccattgtttgaactctatgacaatgttcagagatatgggccagttatatccaccattcctcagcaactttccagattccagtttaaaatgatcactaactgaccgtaattggaagcttagctgctgatagaatactacttccatttgtcattttaagagctaggactgatttgatgcacgattatcattttgcatagacttgttagagaactgaattttgaagtgtgtttctaaatagatttgtaattcgtgacactgtttgtctgtattaattcatccaaagattggaaacaacttgtaatatatttgcggttatcaaccaagatgggaaacaaccagtaggctatagaccagaaaaagccaaagttgaaatcaaaatgatggtcatggtctgttttgccgccccgctcaagttgctaatatcagaataggaaggcaaaggaatgtggcaatattggtttttcattgcaaatttttcggaggattaatcatgaaaggaattgagaggctaaaatcatactagtacattggaaacacaacataaccctcatgtgacaaaatgtacaaatcaaatgtaagacccaaagttgagatgtaagacacttcggaagctgttgctagtacaaatacattgtatgattccttgtatcgacagttttatgtgtagtggcgcatacaccattcacttttaactttttgtaaaacacgtctttctaaatctatttgattattctccaaattaccgttactcacccaacaaacacaccccttcacacacccatcagatcatctccttcctgcgatttttgtgaccaccattctccgatggttatctgcgaatacaagcattctccataactcctccattaggaacgtaacttctttgttaatattcagttgaagcgaaacatgatttatgcaaaagtttccggat

SEQ ID NO: 2438 - DNA, 917 bp, Cleome spinosa
gtctgatttgtcggtgataaaagtttggtcacaggcagtaattctataaaacatcacagtaattcgtttgtttctccgcctccgtcactttctgtcgtctccgccgccgagcgaaatagagaaagacggtgagattcaaacattgttcttccgagagagagagatggtgttttctccggtggtaaacacgtaccctttgtcgaattacagcctcggaaccaaggagccgaaactggagaaggacacttccgtcgccgatcgactcgctcgtatgaaagtcaactacatgaaggagggcatgaggacgagcgttgaagggattctactggtacaagagcacaaccatcctcatatacttctcctgcaaatcggtaacacattctgtaaacttcccggtggacgattgaagccaggagaaaatgaaatcgagggcttgaaaagaaagctgaccagtaagcttggagctaactctcccactcttgcgcctgattggaagataggtgaatgtgtggcgacatggtggcgtccaaattttgagacgatgatgtacccttattgtcctcctcacatcacaaaaccgaaggaatgcaagagactgttcatagtttacttgtctgagaaagagtactttgctgtgcccaaaaacttgaaactcttggccgttccgctgttcgaactctacgacaacattcagagatatggaccggttatttcaactattccgcagcagctatcgagattccatttcaacatggtcagttcttaaagctccacaaccatttagagaacaaaactcctcgagactgtaaggctgcttttgaatcttggaatcagggggtgggcatttcggttttcgctttgattcggttcggtttaaatgttagatttggttcgtttcattttcggtttggacttgg

SEQ ID NO: 2439 - DNA, 1149 bp, Fagopyrum esculentum
tcgggggtagatcgatatgttttgagtcggttgagggattcgagggaaggaggtttggttttttcaggttatgaaaccccttagtcccagccgccttactcacgccatatcttcaccgccgctgatttaggtctggtcgccttttcacactcctcacccattccctcaaagaccaagcagagatgatggtgccttcctcgccggtcgtcaacatccacccgctttcaaactactcctttggcaccaaggagcccaagatggagaaggatacatccgttgccgatcgtcttgctcgcatgaaagtcaattatatgaaagaaggcatgcgaaccagtgtagaaggaattttattggtacaagagcataatcatcctcacattcttcttctacaaattggaaacactttctgcaagctaccaggcggtcgtttgaagcctggagaaaatgaagttgaagggctgaagaggaaattgtcaagcaagctaggtgccaattcacttaatcttcaacctaactggcaggtcggtgaatgtgtggctaactggtggaggccaaattttgaaacgatgttgtatccttactgccctcctcacattacaaaaccaaaggagtgtaagaagctctatatcgttcatctgccagagcgagagtattttgctgtaccaaaaaatctaaagcttttggctgtccctctttttgagctttatgacaatgttcagaggtatggaccagtaatctcaacaattccgcagcaactatcccgattcaatttcaagatgataacccaatgagactggatccgcactctttcttttgctccgttcttttatggcatcgcattacgaatcacttggaccgagtaattcctttccccggatgattgtgctgactatatctgtgatatactcagaatctaaatcaacctaaaagatgaagtatgtttgtagtgataaatgattcgtcaactgagtgatagatttgtttagttcaccaattattttagaatttgaattgtgagtgaagcttctctccccttgaaagcttcaagtcaatgttgaggtgcagttgggtggtttgttgatgaagttttggggattgtgttgcggagggtctagcggttctcataattgttaacacaaccaaagatta

SEQ ID NO: 2440 - DNA, 1026 bp, Linum usitatissimum
acgacggagcagtccattattccccaatttttgccggctgacttttcctgttcccggcggcctaatcctctcatttgacgacgaagatggtggtgggatttgcggtggtgaatacgtacccactgtcgagctacacgttcggcaccaaggagcccaagatggagaaggacacctccgtcgccgatcgcctcgctcgcatgaaactcaactatatgaaagaagggatgaggaccagcgtggaagcgatttttttggttcaagaacacaatcatcctcacatactttttctccaaatcggaaacacattttgcaagcttccaggcggccgcttgaagccaggggaaaacgaaattgaaggtctgaaaagaaaattaacgagcaaactcggagctaattcgcctactcttgttcctgattggcagattggagagtgtgtagctacctggtggaggccaaactttgaaaccactatgtacccttattgtccaccgcacataactaagcccaaggaatgtaagaagctatatatagttcacttgtccgaaagagagtactttgcagtcccgaaaaacttgaagctccttgctgtcccgttattcgaactctacgacaacgtgcagaggtatggtcctgtgatttcaaccattcctcaacaactctcgaggttccagttcaacatgatcaccacctgaaattatgcctgagactcgggcatcgtttgatttctcgcacaacatgatcaacaacaacctcagtgatgatactattctcagacaagtgttttgaagttcatgttggatgttgtatactttcgggattcagtttgatcctctgattttgttgtgtgcccggtttcggatttcgttgctgtttcttttataagcttatagagatgtacttgttgagatagcaccatgtatttaggtactctcatgtcttagagaactaacctgctgtattctcactctttgaaactgctgaccttagtatctaaaaatcttaggccactgatgctacattttgcag

SEQ ID NO: 2441 - DNA, 1239 bp, Vitis vinifera
tttagttacctatcccagtaacccttttaagatttcttcaataacaaaaattgaaaagcacaattgaaaccaaacataccggcgaggtttggtcatcgccgccgctctcctccaccacccgccgctgcaatttcgagagagggagaacgaaagagatgttgacgtcgccggtggtgaacacgtaccctctgtcgagctacaccttcggaacgaaggagcccaagatggagaaggacacttccgttgccgatcgcctcgctcgcatgagagtcaattatatgaaagaggggatgaggacaactgtcgatgcaattttactggtgcaggaacatactcatccccacatccttcttctccaaattggaaacacattctgtaaacttcctggtggacgcctcaagccaggagagaatgaaattgagggtttgaaaagaaagctgtctagcaaacttgctgctaattcacctggtcttcaaccagattggcagataggtgaatgtgtggctatctggtggaggccaaattttgaaactgtaatgtacccatactgccctccccacataacaaaaccaaaggagtgcaagaagctttttattgttcatttatctgaaagagagtactttgccgtgcctaaaaatttgaaacttcttgctgttccattgtttgaactctatgataatgttcagagatatggaccagttatatccactattccactgcacctgtctaggttccagttcaacatgatcgctgcatgacttttgcatggttcagatgagtattttgaatttgcaagtatagaagtcacaccatgcacagctttgaagtaaactaccttatgctctattcatcaaccttggttatcaaataaaatgcatgagtcgggtctttttccaaagatggtctgcttttcatgtccttcttggagtcccctttttttcttttctggtaggatgaggatgggttgaaattttgctgacacagttctgcgcaaaattttctcaacagagataatgctgccaatgtaatttgatgaattgactgggggtaaaaaaaaatgagatatacagtgtgcactgggcattttcctttttattccagggcaagctgtttaacattttgggagcatactatgcaagattctatttattttcttcattttctcttgaattccagagagtgtaaatgagtatttggtgggatgttgccgactctgcttctagaattgccatagatttc

SEQ ID NO: 2442 - DNA, 855 bp, Carthamus tinctorius
  misc_feature (262)..(262): n is a, c, g, or t
  misc_feature (297)..(297): n is a, c, g, or t
  misc_feature (424)..(424): n is a, c, g, or t
  misc_feature (644)..(644): n is a, c, g, or t
  misc_feature (805)..(805): n is a, c, g, or t
agaacttccgatctttactacctacctcaggcgatcggagaattcccgtcaagttctagagagcgaaactttcttcccggtaaagaagatggtgacgtcagcagtggtgaatacgtatccattgtcgagctacaccttcggcaccaaggagccgaagatggagaaggacacctccgtcgccgatcgtctcgctcgtatgaaagtcaactatatgaaggagggcatgaggaccagcgttgaaggaattttgctggtacaggancataaccatcctcatattttgcttttgcaaattgngaacactttctgcaaacttcctggtggtcgtctgaagccaggagaaaatgaagttgagggcttgaaaaggaaattatccagcaaacttgcagctaattctactggacttcagcccgattggcagatnggagagtgtgtcgctatctggtggaggcctaattttgaaaccataatgtacccatattgccctccgcacataaccaaacccaaggagtgtaagaaacttttccttgtccacttgtcagaaagagagtactttgcagtgcccaaaaatctaaaacttcttgctgttccattgtttgagctttatgacaatgttcagagatatgggcctgtgatatccaccnttccacagcagctttctagatttcagttcaacatgatccatgcataaacttcaagagccaatgctgagcaaaagaagaagaatctgatgatatagctaataggaaagtttactgcattgtgatgatcaaagtgggtgtcccttaaggttcatccatcagtntttggtagttttaaatatccattagcatgaaaaactagtttaagcaaaac

SEQ ID NO: 2443 - DNA, 1314 bp, Fagus grandifolia
ctgttctggattttcccttcttcctccagctccgcccctgctaactccaagcacagtgactgtttttcgtttcgttttatacatttttgggggctaaagaagctactgcctaaaccttgcagagaatcctagagagatagagagagaaaatgttgacgtcaacggtggtgaacacgtacccactgtcgagctacaccttcggtaccaaagagcccaagatagagaaagactcctcagtcgccgatcgtctcgctcgcatgaaactcaactattttaaagaaggcatgcggactagtgttgaagcaatcctactggtgcaagaacataagcatcctcacattcttcttttgcaaatcggaaacacattctgcaaacttcctggaggacgtttgaagcctggagaaaatgaaattgaaggcttgaagaggaaactgacgagcaaattgggtgctaatcaaccttctttacaacctgattggcagattggcgagtgtgtggcgatctggtggaggccaaactttgaaacagtgatgtacccttactgccctccccacatcacaaaacccaaggaggttaagaagcttttcattgttcatttgtctgaaagagagtattttgctgtaccgaaaatttgaaactgcttgctgttcccctttttgagctctatgataatgttcagagatatggccctgttatttccacaatcccacagcagctgtccagattccagttcaacatgatcaccacatgaaaggcttacagagtaaaggaatccgtgccattcaggaactaatgattttttaggaaacaaatcggacacctccttaccaaaattcggaatctcctattagcaaatagacttgttactcaaactaatgtagcttagctttatggtcgactccagtggtctatcatgtgagcctgtaatgtgttcctccaattcaaaggccttggcgtggttgaaattgtgtttgttttatgtttacgaaaagacaagaggaaagttttaccataattttcgtgtttcagattgttgtgtgggcatcaggtcttgttatgatgattatagattctgattctccagaaaagaatttaggtggaagctataagagccaagctgataaatacggtgataatatgtacttgttaaccaagaaagggaaaccaattatatgatagtgatggcactttgtgaagcttgggagaggaagatgaagaaagtttcatgactgatgatcatgcacgggaaacttacacagtggcttgcaggtcatgccctctaattttgtttgtatatatttttcttgtacttat

SEQ ID NO: 2444 - DNA, 1039 bp, Sarracenia psittacina
cagggtctggaactgttcggaactctcgaaactccattttccccctccacctccctcctcgtctgcccacctgcaagaagagacagatggtgacgtcgacggtggtgaacacatatccactatcgagttacactttcggaaccaaggagccgaagatggagaaagatacttccgtcgctgatcgtcttgctcgtatgaaaatcaactatatgaaagaaggcatgaggactagcgttgaagcaattttactggtgcaggagcataatcatcctcatattcttcttttgcaaattggaaacacattttgcaaacttcctggtggccgtctgaagcctggggagaatgagattgaaggtttgaaaagaaactaaatagcaaacttggtgcaaattcacatgctcttcagccagattggcagataggtgagtgtgtagccatctggtggagaccaaattttgaaacaataatgtacccatactgccctccccacataacaaaacccaaggaatgtaagaagctttccttgtgcacctttctgaaagagagtactttgccgtgccaaaaaatttgaacttcttgctgttccattgtttgaactctatgataatgttcagagatatgggcctgttatatccaccattcctcagcagttgtctcggtttcagttcaacatgatccatgcataaaattcatggattccaggggatttttactggagctggacctcaggagaatttaaattggttagtttttagtcctaaattttgtagactaatcttgagcattgttgtttcggatttggaatatgaatttatgcagattaggtaatattgttatctttgtacactcggttgttctaaattatgataaatttatgtatcaaatgcttttaattcttggcgactttcgtttcttctttatccatattttaagaatatgtggtatgtccgatgcggttgaaagagagaaagctgaataagagaaggtataaggatgctaataactccccagtccctatgacaactgagaactgcataaa

SEQ ID NO: 2445 - DNA, 1202 bp, Solanum melongena
aggagataccaatttcagggaaaaaaacgaaaaccgaagaaagaagaaactagtatcaccggcgagccgtcgtcggaatctccgtctcgccgtttgctataagaagcggctgaacagataaaaatggtcacatcagctatggtgaacacgtacccactatctagctatacatttggtacaaaagaacctaaaatggagaaggactcatccgttgccgatcgccttgctcgtatgaaagtcaactacatgaaggagggtgtaaggactagtgttgaagggattctcttggtacaagaacataatcatcctcatattcttcttctgcaaattgggaacacattttgcaagcttccaggtggacgcctaaagccaggagaaaatgaaatcgagggtttgaaaaggaaactctccagcaaacttgcagccaattctcctacccatcagccagattggcagataggtgagtgcgtggccacctggtggaggccgaactttgaaaccatgatgtatccatactgtcctccacacataacaaaacctaaggagtgtaggaagctctaccttgttcacctatctgaaagagagtactttgcagtccccaaaaatctaaaacttcttgctgtgccattgtttgaactttatgacaatgttcagagatatggacctgtaatatctacaattcctcaacaactttccagattccagttcaacatgatccatcagtagatagtggattcaagtgctcctccaggataaaaatgacatccaattgatttggttggttcgcatagttgagggtgactgagccctactcgatgacttgattcacttttctacaataggcagatagatgacactcatctgattgtttgtgttaaattggcttattttggatggccacaaagacaggttcagcatgaaagcctgtttcaaatttgcagtgtacaatatagacatatttgtgtacttgcttgttgaatattgacatagggttgctagtttttttctttttttcattccgagaagctcttaaagtgatctttttttcgatgaagtggtggtgctgctctcgtcttattgtcttgataagagtttgtgttcatgcaggaaaagaaacaaaaagtaggtattctagtttcctctgatctcctgtgcgagacaattttgtttgtgagcaatgattttcagatgtttcatcatgg

SEQ ID NO: 2446 - DNA, 1009 bp, Solanum tuberosum
agaaagaagaaaccagtatcatcagcgagccgtcgccggagtgtcattctcgccgtcgccggagtttcattctcgccggttggcccaaaagaagcgattgaacagatcaaaatggtctcgtcggctatagtgaacacatacccactctctagctatacatttggcacaaaagagcataaaatggagaaggattcatccgttgccgatcgccttgctcgtatgaaagtcaactacatgaaggagggaatgaggacaagtgttgaaggaattctcttggtgcaagaacataatcatcctcatattcttcttctgcaaattgggaacacattttgcaagctccccggtggacgcctaaagccaggagaaaatgaaatcgagggtttgaaaaggaaactctccagcaaacttgcagctaatcctcctgccaatcagccaaattggaagataggtgagtgcgtggccacctggtggaggccgaactttgaaaccataatgtatccatactgtcctccacacataacaaaacctaaggagtgtaagaagctctacctcgttcacttatctgaaagagagtactttgctgtccccaaaaatctaaaacttcttgctgtgccattgtttgaactttatgacaatgttcagagatatggacctgtaatatctacaattcctcaacagctttccagattgcagttcaacatgatccatcaatagatagtagatggacattcaagttctcctccgggataaaaatggcatcaaaatgatttggtttggttcccatagtttgagggtgactgaggcctactccatgacttgattcacttttctacaataggcagatagatgacactcatctgattgtttgtgttaaattggcttcgtttggacggccacaacgatggatacagtatgatagcctgttaatatgcaactttgcagttacaatattgacatatttttgcgtacttgcttgttgaatattgacatagtgctgctaagtttcttg

SEQ ID NO: 2447 - DNA, 1165 bp, Solanum tuberosum
gcgagccgtagccggagtttcactctcgccgtttccccaaaagaagcggttgaacagatcaaaatggtctcgtcggctatagtgaacacatacccactctctagctatacatttggtacaaaagagcataaaatggagaaggatacatccgttgccgatcgccttgctcgtatgaaagtcaactacatgaaggagggagtaaggacaagtgttgaaggaattctcttggtacaagaacataaccatcctcatattcttcttctgcaaattgggaacacattttgcaagctcccaggtggacgcctaaagccaggagaaaatgaaatcgagggtttgaaaaggaaactctccagcaaacttgctgctaatcctcctgccaatcagccaaattggaagataggtgagtgcgtggccacctggtggaggccaaactttgaaaccataatgtatccatactgtcctccacacataacaaaacctaaggagtgtaagaagctctaccttgttcacttatctgaaagagagtactttgctgtccccaaaaatcttaaacttcttgctgtgccattgtttgagctttatgacaatgttcagagatatggacctgtaatatctacaattcctcaacagctttccagattgcagttcaacatgatccatcaatagatagtagatggacattcaagttctcctccaggataaaaatggcatcaaaatgatttggtttggttcccatagtttgagggtgactgaggcctactccatgtaatcttatagcataaacttatacatgtatatgtgtatttaaaaattctaattgcccatacatatatagcttctgctttgaaaacacatagatacatacacatacagttgactacaaataaaattacactctgatacttcattcgtgggattttagccactgcatccctattccagagttagagatcaatgaaagctcattcaacagaatcataagctttctgtaggtccatcttaatcatacttgtgagagcacaagtgccattattgtataatctccaattctcttctctgggatgaaccctgtatgtgaataatttctgatctgaggtgtaatgctctttattctagatgttttaacacctttgagatcaactaatatatcctaattgaccaaaaa

SEQ ID NO: 2448 - DNA, 1078 bp, Solanum phureja
aaaagtccggaagcatgtattaatagtaaaaatcaatttcagtaggagggaaaaagaggaaaaccaagaaagaagaaaccagtatcatcagctcgccgtcgccggtgtgtcattctcgccgtcgccggagtttcattctcgccggttggcccaaaagaagcggttgaacagatcaaaatggtctcgtcggctatagtgaacacatacccactctctagctatacatttggcacaaaagagcataaaatggagaaggattcatccgttgccgatcgccttgctcgtatgaaagtcaactacatgaaggagggaatgaggacaagtgttgaaggaattctcttggtacaagaacataatcatcctcatattcttcttctgcaaattgggaacacattttgcaagctccccggtggacgcctaaagccaggagaaaatgaaatcgagggtttgaaaaggaaactctccagcaaacttgcagctaatcctcctgccaatcagccaaactggaagataggtgagtgcgtggccacctggtggaggccgaactttgaaaccataatgtatccatactgtcctccacacataacaaaacctaaggagtgtaagaagctctacctcgttcacttatctgaaagagagtactttgctgtccccaaaaatctaaaacttcttgctgtgccattgtttgaactttatgacaatgttcagagatatggacctgtaatatctacaattcctcaacagctttccagattgcagttcaacatgatccatcaatagatagtagatggacattcaagttctcctccgggataaaaatggcatcaaaatgatttggtttggttcccatagtttgagggtgattgattcacttttctacaataggcagatagatgacactcatctgattgtttgtgttaaattggcttcgtttggacggccacaacgatggatacagtatgatagcctgttaatatgcaactttgcagttacaatattgacatatttttgcgtacttgcttgttgaatattgacatagtgctgctaagtttctttcgttccgagaggcttttagaag

SEQ ID NO: 2449 - DNA, 1489 bp, Nicotiana tabacum
  misc_feature (48)..(51): n is a, c, g, or t
  misc_feature (60)..(60): n is a, c, g, or t
  misc_feature (67)..(67): n is a, c, g, or t
  misc_feature (86)..(86): n is a, c, g, or t
  misc_feature (89)..(89): n is a, c, g, or t
  misc_feature (94)..(94): n is a, c, g, or t
  misc_feature (110)..(111): n is a, c, g, or t
  misc_feature (115)..(115): n is a, c, g, or t
  misc_feature (123)..(123): n is a, c, g, or t
  misc_feature (129)..(129): n is a, c, g, or t
  misc_feature (162)..(162): n is a, c, g, or t
  misc_feature (175)..(175): n is a, c, g, or t
  misc_feature (186)..(186): n is a, c, g, or t
  misc_feature (222)..(222): n is a, c, g, or t
  misc_feature (254)..(254): n is a, c, g, or t
  misc_feature (261)..(261): n is a, c, g, or t
  misc_feature (264)..(264): n is a, c, g, or t
  misc_feature (282)..(282): n is a, c, g, or t
  misc_feature (303)..(303): n is a, c, g, or t
  misc_feature (321)..(321): n is a, c, g, or t
  misc_feature (327)..(327): n is a, c, g, or t
  misc_feature (336)..(336): n is a, c, g, or t
  misc_feature (369)..(369): n is a, c, g, or t
  misc_feature (417)..(417): n is a, c, g, or t
  misc_feature (420)..(420): n is a, c, g, or t
  misc_feature (1283)..(1283): n is a, c, g, or t
  misc_feature (1306)..(1306): n is a, c, g, or t
  misc_feature (1309)..(1309): n is a, c, g, or t
  misc_feature (1329)..(1329): n is a, c, g, or t
  misc_feature (1342)..(1342): n is a, c, g, or t
  misc_feature (1349)..(1349): n is a, c, g, or t
cattacggccggggaagcacaattttaatagcaaatcaagggatgatnnnncattttcantagaaangaaaacggaagaaacaacnctngagtnttcttcctcgccgttnnctgnaagaagcnataaanatggtgacgtcagctatagtgaacacatacccnctctctagctatncctttggcacnaaagagcctaaaatggagaaggacacttccgttgcngatcgccttgctcgcatgaaactcaactacangaagganggnatgaggacaagtgttganggaattctcttggtacaagancataatcatcctcatatncttctnctgcaaatngggaacacattttgcaaacttccaggtggacgnctaaagcctggagaaaatgaaatcgagggtttgaaaaggaaactctcnagnaaacttgcagctaattctcctggccttcagccagattggcagataggtgaatgcgtggccacctggtggaggccgaactttgaaaccataatgtatccatactgccctccacacatatcaaagccaaaggagtgtaagaagctcttcattgttcacctctccgaaagagagtacttcgcggtccccaaaaatctaaaactccttgctgtgccattgtttgaactttacgacaatgttcagagatatggacccgtgatatccacaatccctcaacagctttccagattccagttcaacatgatccagccatagattagtagatggacattcaagagctccttctgggataaaaatagcatcatatcagtttggttgggttctgatattatgaggatcgctgaagccttcttcatgacttaattcacttttccacagtaggcagatagatgacttgattcacttttctacaataggctgattgatgacttacaccagattatttgtgttagtcagcttctttcctatggatatgaagatgagtacggtatgggagcctgttaacctgagcggccgctcacgtaaatatacaagtatatcctcctaagtttggacatgcatccccaaacttagtaacatctcttcctcactgactactctaaggataatagttgagtttttgtaaactattcctcaattactatgactatggcctatacaatgaatatctctaactatttgtctagtaatatcttcactgcttcttttagtcttctgaaagatccttctatttctttccagccatatgttatacactgctccaatcatactcaacctgtacaacatggttttggatccattgcttntcacctgttctattgctcatttnatntcctcgtcccatctttttgnttctcgactgatntccatcngctttaataatcttctccaaacatcttctaagaaagagcaagtaaagaagatatggttgtggctttccatctcatgctcacataatggacattctgaacttacttgcatccctcagcggccgcatgaggggatcctctag

SEQ ID NO: 2450 - DNA, 1338 bp, Arachis hypogaea
ctagcacttagctgcggcccatgaaaatatatatagtgctcaaaagcccattaagaaagtccaataaaataaaaagtaggagggtaggagtaggcggtggttcgagcaaattgaggtttccagttttgaaatcgtgggcgatctgagcgaaggaataaagatggtggtggtttcatctcagaacacggtggttaacacctaccctctctccagctacactttcggcaccaaggagcccaagatggagaaggacacctccgtcgctgatcgtctcgctcgcatgaaaatcaactatatgaaggaaggaatgaggaccagcgtcgaaggaattttattggtgcaagaacacaatcatccgcacatacttcttctacaaattggaaataccttctgcaaactcccaggtggtcgcctcaagccaggagagaatgaagttgaaggcttgaagagaaagttgactagcaaactcggtgctaattcacccactcttgtgcctgactggcagataggggagtgcgtggccaactggtggaggcctaattttgagaccataatgtatccatactgccctcctcacataacaaaacccaaggagtgcaagaagcttttccttgttcacttgtctgagcgcgaatactttgcagtgcccaaaaacctaaaactgctagctgttccattgtttgaactctatgataatgttcagagatatggaccagttatatcaaccattcctcagcagctttccagattccagtttaaaatgatcactaattaatcgtaaattatgatcaaccatttctacaaaattctcttccatttttcttactttagtttttagaactaggatcaagttaatgcattattatcactgcatagactgggtagaatattgagttaagtgcactttctgaaaatggtagatacttgcgagttgtgacatggattttatgtgtaaatttagtggattatgttctatcgtctatggaattagggaaatggatcctctccaatttttttaacacttgaggaaatgaagtgtgatctctcaccattaactttataagtggaaccaaaaataaatatgagagagaaagcaatgaagggtgagagatcacaattgacaccatccagttttttctttactcgagaggatccactcccatggattggtgtatgtgcatgagattatcaagctttagatgagatttgacttgtgtagcgtggaaggctcccaaggcctaaccacgatgctccattgctccttaatatcatgtattaatgataatgactatgtaacatatattatcatgtattgaacaaagcaatttcaatatctgt

SEQ ID NO: 2451 - DNA, 856 bp, Utricularia gibba
cggtggtgaacacatacccgctatcaaactacagtttcggaagcaaagaaccgaaaatggagaaagacacctccgtcgctgatcgccttgcgcgtatgagggtcaactatatgaaagaaggaatgaggactagcgttgaggggattctattggtgcaagagcataaccatcctcacattcttctcttgcaaattgggaacactttctgtaaactacctggtggaagactgaagccaggggagaatgaggttgagggcttgaaaaggaaactgtccagcaaacttggtgccaattcacctaacctgcagccgaattggcaggtgggtgagtgtgttgctacctggtggagaccaaattttgagacgacaatgtacccttattgtccacctcacataaccaagcctaaggagtgcaagaaacttttcgttgttcacctctccgaacgtgagtattttgctgtgccaaagaacctgaagcttctggctgttccgctttttgtaactatatgacaatgttcagagatatggaccagttatatcaaccataccacaacagctctccaggtttcagttcaacatgatccagccatagattcctcagcaccctgcacctttcacatccatgatagattcatggtgccccttgtgatcttgcgtgccggtgttagatcctcggcagttcctagattacagttagcctgagacagtggatgctatacttcttcctacgttgtgtgttcactattctcctttgcagactttaagtcgtgttggcctccttttttatcccgaaatctgctcttcactgatgtacttgagaactaattgttctgaatcatgacatgaaattaacttaa

SEQ ID NO: 2452 - DNA, 1263 bp, Tropaeolum majus
cggccgggggtggcagaaatacttcgttctcgttccagttcgagagagctctgtagagaaaacaaaaacaaaaagaagaagaagcggaggaaggaggaggagaagagaagatgttgacgtcaccagttgtgaacacttatcctctttcaagctacacgttcggtaccaaagaaccgaagatggagaaagacacctccgttgctgatcgacttgctcgcatgaaagtcaattatttcaaagaaggcatgagaactagtgttgaagcgattttaattgttcaggagcacaaacatccccatattcttcttctgcagattggaaacaccttttgcaaactccctggaggtcgtctgaagcctggagagaatgaaattgatggtttgaagcggaaactttcaagcaaactgggacctaactcgcctgcacatcaacctgattggcagattggtgaatgtgtgggcatctggtggagaccaaatttcgaaacaataatgtatccatattgccctccgcacatcacaaaaccaaaggagtgcaagaagctttttattgttcacttgtccgaaaaggagtattttgctgtaccaagaaatttgaaacttcttgcggttcccctgttcgagctctatgataatgtgcagagatatggaccggttatttccacaataccacagcagctctccagatttcacttcaacatgatgacaatatgaaacaactatcatgaacataggagtcatccgttacttgggtcttcagtaataaaaataagttatatttagtcggtagtcaggaaatcagacgatcaacgtgtaaactgaacctcgtttagtgtctgcgccattcttcaattctagagtcagcgatctttgtagttttccttggctagcaaggaaaagaataacgtaaacacttttagtttagacatcaaattttaagatgaagagactatacaaaactttagaaatatgaatggtggggttgtttaacttagtagctgtagagtgtagcttttacttgcgagaaaatgttcaatacatggcttgtgtcgatctggtgatgctgttgaccacgaaatgaccgaagatttcttcgattgatcgtgttctgtttgatgttttctagtgatggatgatacaattggtgtacgagaagagaaacaagtttatgtaacttctaagaatgtaagaagatagaatcgaaatgaggttggattttatgtaatttaacatcttttacctgaaattgttttaatcatcttca

SEQ ID NO: 2453 - DNA, 932 bp, Platanus occidentalis
gtagtgaacacataccctctctcgagctacaccttcggaacgaaggagccgaagatggagaaagacacttctgtggccgatcgtctcgctcgaatgaaagtcaactatatgaaagaaggcatgcggtcaagtgtcgatgcgattctactggtacaggaacataaccatccacacatactccttctgcaaattggaaacaccttttgcaaacttccgggtgggcggttgaagcctggagagaatgaaattgagggtttgaaacgaaaactctctagcaaacttgccgctaattcaactgcccttcaaccagattggcagattggagaatgtgtagctatctggtggaggccaaactttgaaacgataatgtatccctactgtcctccccatattacaaaaccaaaggaatgtaagaagctttaccttgttcacttgtctgagagggagtactttgcagtaccaaaaaacttgaaactgctagctgttccactgtttgagctctatgataacgttcagagatatggaccagtcatatccaccatcccacagcagctgtccagattccagttcaacatgattaatacttgaaacaggttgagcattaataggctgggacatcatatattgattgagttcgggtctatagattggcagatagacatacaattgaagctaatccaagctaacctatcatgcagagtatatttggtccttaaaagattttattcttctgcacctataaactggttgatcttgtttgagtttgtgtagttgtatgaaattgggtcctggatatctttggagtttcaactcagatgtaagttaattatgcagctgtttgtggtgggatagaaatagtttgtggttgacactgccctggaacttattctttggaagttgtaacaacccaactggttattccaccattataa

SEQ ID NO: 2454 - DNA, 1048 bp, Raphanus sativus
ggatagaaggcgactctagaagttgtagttgatacggcgtcgtattaacctctccgtcgagattactccggtccattactactccgtcgccgccgagatcaatacagatcgatacagagagggagatggcgatgtctcaggtggtgaacacgtaccctctctcgaactacagcttcggaactaaagaaccgaagctggagaaggacacctccgtcgccgaccgactcgctcgtatgaaagtcaactatatgaaagagggcatgaggactagcgttgaagggattcttctggtacaagaacacaaccatcctcatatacttctcctgcaaattggtaacacattctgcaaacttccaggtggacgcctaaagcctggagaaaatgaagtcgaaggactgaagagaaagttgaccagtaagcttggaggcaattcggctggttttgtacccgactggaaggtaggagaatgtgttgcgacatggtggcgtccaaactttgaaaccatgatgtacccgtattgccctcctcacatcaccaaaccaaaggaatgcaagagactctacattgttcacttgtctgagaaagagtactttgcagtgcccaaaaacttgaaactcttggccgtccctttgtttgaactctatgacaatgttcagagatatggaccagttatatcgaccattcctcaacagctatccagattccatttcaacatgattagttcgtgattctactcactgttcaagaataagaaacctgtcagatgatcaaggtcaattaggcacggtagagagatgtagctaccagttttagagaaccgagttttggatgatgcgtgtgggtttgttacattagacttgttgggattatgaggaaccgtttcattcaagtttcaggacaaaaagtttttcattatttgactaatgtcttgtctagccgtgaaacatgtgtttgactttttttttactttagtgcttgaatatatgaaacacaaactgggacatgttaaaactacattgttgaatcattacgcttagctatatgtttg

SEQ ID NO: 2455 - DNA, 1188 bp, Solanum phureja
caagaaaaaagaaaccagtatcatcagcgagccgtagccggagtttcactctcgccgtttccccaaaagaagcggttgaacagatcaaaatggtctcgtcggctatagtgaacacatacccactctctagctatacatttggcacaaaagagcataaaatggagaaggattcatccgttgccgatcgccttgctcgtatgaaagtcaactacatgaaggagggagtaaggacaagtgttgaaggaattctcttggtacaagaacataaccatcctcatattcttcttctgcaaattgggaacacattttgcaagctcccaggtggacgcctaaagccaggagaaaatgaaatcgagggtttgaaaaggaaactctccagcaaacttgctgctaatcctcctgccaatcagccaaattggaagataggtgagtgcgtggccacctggtggaggccgaactttgaaaccataatgtatccatactgtcctccacacataacaaaacctaaggagtgtaagaagctctaccttgttcacttatctgaaagagagtactttgctgtccccaaaaatcttaaacttcttgctgtgccattgtttgagctttatgacaatgttcagagatatggacctgtaatatctacaattcctcaacagctttccagattgcagttcaacatgatccatcaatagatagtagatggacattcaagttctcctccaggataaaaatggcatcaaaatgatttggtttggttcccatagtttgagggtgactgaggcctactccatgtaatcttatagcataaacttatacatgtatatgtgtatttaaaaattctaattgcccatacatatatagcttctgctttgaaaacacatagatacatacacatacagttgactacaaataaaattacactctgatacttcattcgtgggattttagccactgcatccctattccagagttagagatcaatgaaagctcattcaacagaatcataagctttctgtaggtccatcttaatcatacttgtgagagcacaagtgccattattgtataatctccaattctcttctctgggatgaaccctgtatgtgaataatttctgatctgaggtgtaatgctctttattctagatgttttaacacctttgagatcaactaatatatcataattgaccaa

SEQ ID NO: 2456 - DNA, 1053 bp, Eutrema halophilum
ctggtgtaatattaaattctccgtcgagattactcctctctgttggcgtcgccgacgacgatctacagatcgacactcagagtgagagacggtggaaattttggattagtggattaaggagagacagagagaaagatggctatgtctcaggtggtgaacacgtacccgctttcgaactacagcttcggaactaaagaaccaaagctggaaaaggacacctccgtcgccgaccgactcgctcgtatgaaagtcaactatatgaaagagggcatgaggactagcgttgaagggatactgctggtacaagaacacaaccatcctcatatacttctcctgcaaattggtaacacattctgcaaacttccaggtggacgcctgaagcctggagaaaatgaagttgaaggcctgaaaagaaagttgaccagtaagcttggaggcaattcggctgcgcttgtacctgactggaaggtaggagaatgtgttgcgacatggtggcgtccaaactttgaaaccatgatgtacccgtattgccctcctcacataacgaaaccaaaggaatgcaagagactcttcattgttcacttgtctgagaaagagtactttgcagtgcccaaaaacttgaaactcttggccgtccctttgtttgaactctatgacaatgttcagagatatggaccggttatatcgaccattccgcagcagctatcgagattccatttcaacatgattagttcgtgatgcaactcggtgtccaagaacaagaaacctgtctggtgataagttaaggctgtagctaccggtttagagatgatgatggcgtgtggatttttacattatagacttttatgtagaactggtttaagtttcagcacaaacaagatcattgatttcatttctaaacaaagcattcgtcattattttactaacgtctgtcttgtctaaccgtgaaccggttcaagttttatgtagtgtttcacttgttatctttattttggtgcgatgaatgagaaacgcaaactaaggccatgttaaaaactattttgttgtatcagt

SEQ ID NO: 2457 - DNA, 1119 bp, Eutrema parvulum
agaacgcgactctagaagttgtaatagagagtgtttatattaaattctctccgtcgtgatttctcgtgttgctgtcgccgccgagatcaatagatcgatactcggagagatatagagagagggacgtgggaagaaaattccgacatatttggcttagtggatccgacatagacaaagagagagagagatggctatgtctcaggtggtgaacacgtacccactttcgaactacagcttcggaactaaagaaccgaagctggaaaaggacacctccgtcgcagaccgactcgctcgtatgaaagtcaactatatgaaagagggcatgaggactagcgttgaagggattctgctggtacaagaacacaaccatcctcacatacttctcctgcaaattggtaacacattctgcaaacttccaggtggacgactgaagcctggagaaaatgaagttgaaggcctgaaaagaaagttgaccagtaagcttggaggcaattcggctgctcttgtacctgactggaaggtaggagaatgtgttgcgacatggtggcgtccaaactttgaaaccatgatgtacccctattgccctcctcacatcacgaaaccaaaggaatgcaagcgactcttcattgttcacttgtctgaaaaagagtactttgccgtgccaaaaaacttgaaactcttggccgtccctttgttcgaactctatgacaacgttcagagatatggaccagttatatcgaccatacctcaacagctatccagattccatttcaacatgattagttcgtgattctactcggtgttgaaaaacaagaaacgtgtctgattgtaagttaattaggcacggtagagcgctgtagctaccgatttagagacccgagttttagatgatgcgtgtgggtttttacattatagacttcttgatattatgtagaaccgtttcaagtttcagcgcaaaaaaaaaggtcattgaatctcatttctaaaaccattcgtcactatttgactaacggctgtcttgtctaaccgtgagacatgtgtttcacccagtgtgagaatctttttattttggtgctatgtatgaaacgcaaactagcctttgtttaaactacatttggt

SEQ ID NO: 2458 - DNA, 800 bp, Capsicum annuum
agaatacataaacaaaatacggaaaatggtgacatcaagtatagttaatacatatccactatctagctatacatttggtacaaaagaacccaacatggaaaaggattcatccgtcgttgatcgccttgctcgtatgaaagtcaactacatgaaggagggtgtaaggtctagtgttgaaggaattctcttggtacaagaacataatcatcctcatattcttcttctgcaaattgggaacacattttgcaaacttccgggtggacgcctaaagcctggagaaaatgaaattgagggtttgaaaaggaaactctccagcaaacttgcagctaattctcctgcccttcagcctgattggcagataggtgagtgcgtggccacctggtggaggccgaactttgaaacctcgatgtatccatactgtcctccacacataacaaaacctaaggagtgtaagaagctctaccttgttcacttatctgaaaaagagtactttgcagtacccaaaaatctgaaacttcttgctgtgccattgtttgaactttacgacaatgttcagagatatggacctgtaatatctacaattcctcagcagctttccagattccagttcaacatgatccatcaataggatagtagatggacattaaagtgctcctccgggataaaaatgacatccaatagatttaattgggttcccatattttgaggatgaccaagacctactccatgactcgattcacttttatacaatacacagatatatgacattcatctgattatttgtgttaaatggcttcttt

SEQ ID NO: 2459 - DNA, 913 bp, Brassica napus
gagtggatacggtgtcgtattaacttctccgtcgagattacttctctgtcgccgtcgccgccgagatcaatagatcgattacccagagagtagagagagatggctatgtctcaggtggtgaacacataccctctttcgaattacagcttcggaactaaagaaccgaagctggagaaggacacctccgtcgccgaccgactcgctcgtatgaaagtcaactatatgaaagagggcatgaggactagcgttgaagggattcttctggtgcaagaacacaaccatcctcatatacttctcctgcaaatcggtaacacattctgcaaacttccaggtggacgcctgaagcctggagaaaatgaagtcgaaggtctgaagagaaagttgaccagtaagcttggaggcaattcggctggtattgtacccgactggaaggtaggagaatgtgttgcgacatggtggcgtccaaactttgaaaccatgatgtacccgtattgccctcctcacatcacgaaaccaaaggaatgcaagagactctacattgttcacttgtctgagaaagagtactttgctgtgcccaaaaacttgaaactcttggccgtccctttgtttgaactctatgacaatgttcagagatatggaccggttatatcgaccattcctcaacagctatccagattccatttcaacatgattagttcgtgattctactcggtgttcaagaagaagaaacctgtcagattaggcacgatagagagatgtagctaccagttttagagatccgagttctggatgatgcatgttggtttctttacattatagacttgttggcattatgaagaacaggttcgttcatgtatcagcacaagaagattattcatctaatttctaaaagcattcgtcattatttgactaa

SEQ ID NO: 2460 - DNA, 801 bp, Capsicum annuum
tagaatacataaacaaaatacggaaaatggtgacatcaagtatagttaatacatatccactatctagctatacatttggtacaaaagaacccaacatggaaaaggattcatccgtcgttgatcgccttgctcgtatgaaagtcaactacatgaaggagggtgtaaggtctagtgttgaaggaattctcttggtacaagaacataatcatcctcatattcttcttctgcaaattgggaacacattttgcaaacttccgggtggacgcctaaagcctggagaaaatgaaattgagggtttgaaaaggaaactctccagcaaacttgcagctaattctcctgcccttcagcctgattggcagataggtgagtgcgtggccacctggtggaggccgaactttgaaacctcgatgtatccatactgtcctccacacataacaaaacctaaggagtgtaagaagctctaccttgttcacttatctgaaaaagagtactttgcagtacccaaaaatctgaaacttcttgctgtgccattgtttgaactttacgacaatgttcagagatatggacctgtaatatctacaattcctcagcagctttccagattccagttcaacatgatccatcaataggatagtagatggacattaaagtgctcctccgggataaaaatgacatccaatagatttaattgggttcccatattttgaggatgaccaagacctactccatgactcgattcacttttatacaatacacagatatatgacattcatctgattatttgtgttaaatggcttcttt

SEQ ID NO: 2461 - DNA, 1135 bp, Primula obconica
tagagagagaaagctccatctgagaagaactactaataaagatggtgacttcgccgccggtgaatatatacccactttcaagctacagcttcggagctaaagagccaaagatggagaaagatacctcagtcgccgatcgtctcgctcgaatgaaactcaactatacaaaggagggaatgaggaccagtgtcgaagcgattttactggttcaagagcataatcatccccacattcttctcctacaaataggaaacacattctgcaaacttcccggtggccgtctcaaacccggggagaatgagattgaaggtttgaaacgtaagttaaacagcaaacttggcgcgaacacacctggttttcagcaagattggaagataggtgagtgcgttgctacttggtggaggccaaattttgaaaccatcatgtacccatattgccctcctcacataaccaaacccaaggaatgcaagaagctgtatattgttcacctttccgaaagagagtactttgcggttccaaaaaatttgaagctccttgctgttccgttgtttgaactctatgataatatgcagagatatgggcctgtgatatcgaccatccctcagcagctgtcaaggtttcaattcaagatgatccaatcttaaatttcatgatggctagggaacttcaatccaacaaacttcgtcagaactcttcatccttttaaaacttcaaatatgcagatggcaaggacgattaaaaaattatgtgaaacttttaatatttaacttcttatgtgatgaaaatgatttgcaaacataattatattgcggaataaagaggtttcagtactacaatgctaatgaggatccaggtgcagcttagttcattgcttgttgcctctttttctctcgttaaacggcgctataccaaggttttcgcaatatatctcgtagggtgacgaacttggttgtgttaaagttatgttttccatatagcacagattgtatttagttcatgttttttgtttcataagctttttgttactttctttgtttgtgttaccttgtacttgttgaggtgtaaccctgtgtgaagtttttttgcttgtcattgcaagcccttgaaagttatgataacaagtgatgtaatcggt

SEQ ID NO: 2462 - DNA, 936 bp, Raphanus sativus
  misc_feature (79)..(79): n is a, c, g, or t
  misc_feature (413)..(413): n is a, c, g, or t
agatggcgatgtctcaggtggtgaacacgtaccctctttcgaactacagcttcggaactaaagaaccgaagctggaganggacacctccgtcgccgacagactcgctcgtatgaaagtcaactatatgaaagagggcatgaggactagcgttgaagggattcttctggtacaagaacacaaccatcctcatatacttctcctgcaaattggtaacacattctgcaaacttccaggtggacgcctaaagcctggagaaaacgaagtcgaaggactgaagagaaagttgaccagtaagcttggaggcaattcggctggttttgtacctgactggaaggtaggagaatgtgttgcgacatggtggcgtccaaactttgaaaccatgatgtacccgtattgccctccacacatcacnaaaccaaaggaatgcaagagactctacattgttcacttgtctgagaaagagtactttgcagtgcccaaaaacttgaaactcttggccgtccctttgtttgaactctatgacaatgttcagagatatggaccagttatatcgaccattcctcaacagctatccagattccatttcaacatgattagttcgtgattctactcactgttcaagaacaagaaacctatcagatgatcaaggtcaattaggcacggtagagagatatagctaccagttttagagaaccgacttctggatgatgcgtgtgggtttgttacattagacttgttgggattatgaggaaccgtttcattcaagtttcaggacaaaaagttcttccttatttggctaatgtcttgtctacccgtgaaacatgtgtttgactttttttttactttagtgctatgaatatatgaaacacaaactaggacatgttaaaactacattgttggatcattacgcttagctatatgtttgttaatcatca

SEQ ID NO: 2463 - DNA, 811 bp, Silene vulgaris
acaacaatggtggctcaatcatcatcaatagtagcagttcatccactttcaagttatagttttggtactaaagaacctaagcttgagaaagacacttctgttgctgatcgtctttctcgcatgagagtcaattatatgaaagaaggcatgaggactagtgtagaaggaattttactggttcaggagcataatcatccgcacattcttcttctacaaattgggaacacgttctgcaaactccctggtggtcgtttaaaacctggtgaaaatgaaattgacgggcttaagagaaaactttcaagcaaacttggtgctaactcttctattcagcctaattggcagattggggagtgtgttgctacttggtggaggccaaactttgaaacagtcatgtacccatactgccctcctcacataacaaaaccaaaggagtgtaaaaagctttacatggttcatttgcctgagagagaatacttcgctgtaccaaagaatctgaagttgttggctgtgcctctgtttgaactttatgataatatccagagatacgggcccgtcatctccacaatccctcagcagctatcaagatttcaattcaacatgatttctcagtgaggccgcaccagttggactagttgataggattgcgccgagatttcacaatagtgaaaaccaaaaacccagcaatgggttttcctgttcgtgctctcgctttcttgtggtttctatgtcttattagcgttcttgtaccaaaaaaatgtcttactttattagctttgattatgttacgtttacccccctttaccttcgattt

SEQ ID NO: 2464 - DNA, 996 bp, Silene vulgaris
agaattcccacatcgcaaatctaaattaaatcaattacaaaccctagactagaaattcaaagaaaccaacaaggaagatgatgcaaacttgtccagtagtgaacacatacccattatcaagctacagttttggaactaaagaacctaaaatggagaaagatacttctgttgctgatcgtcttgctcgcatgaaactcaattacatgaaggagggaatgaggactagtgtggaagctattctgctggttcaggagcacaatcatccacatatacttcttctccaaatcggaaacacgttttccaaacttcctggcggcaggttaaagccaggcgagaatgagattgagggcctgaaaaggaaattgtctagcaaacttgctgctaatcaacctggaatgcagccagagtggcagatcggggagtgcgttgctatgtggtggcgtccaaactttgagactattatgtatccttactgtcctccacatataatgaagccaaaggagtgcaaaaaattatatattgtgcacctgtctgagagggaatactttgctgtgccaaaaaacttgaaactcctcgctgtaccattgtttgaactttatgacaatgtccagaggtatggacctgttttatcctcgattccacagcagctatcaagatttcagttcaaaatgatctcgagctgagattagcctagctccctgaagcttccgcttttaatttggcgtctcctaagaaaaactaattcactcagagaacacgttttatcagcaagttatcagaggttattgagattttctgttcattgagttaactagttgtgtttcgcaagcatttggcatcttatcgtctactggtgtggggggttattctaattcgataacaagcgactttttagcagtcaatacaggattgctatttggtaggactgtaggattattcattattggtagtgctatggtatatgtactttttatcgacttttgctgtagttaattt

SEQ ID NO: 2465 - DNA, 1010 bp, Triphysaria pusilla
aattgatttcactccaatctaccacaaatcaaggagaaacaagagagatataattggattgaggcaaaaaaaggaatgaaaatggtagcaccacagattgtaaatacgtaccctctttcgagctacactttcggaaccaaagagccgaagatggagaaagattcctccgtttccgaacgccttgctcgcatgaaagtcaactacatgaaggaaggtgtgaggaccagcgtcgaggggattctattggttcaagagcataatcatccacacattcttcttttgcaaattggaaatacattttgtaaacttccaggcggcaggttaaaaccaggagagaatgaaatcgagggcttgaagaggaaattatcaagcaaacttgctgctaattcacctggtctccagccagattggcagatcggcgagtgtgtggcgcagtggtggagaccaaatttcgaaactatcatgtacccttactgccccccacacataacaaagcctaaggaatgcaagaagctgtatcttgttcacctgtctgaaagagagtattttgctgtgccgaagaacttgaagctccttgctgttccattgtttgaactatatgacaatgtccagagatatggacctgttatatcaactatcccgcaacagctatcgaggtttcagttcaacatgatccagcaataatttcgtcggggactggcactgttaaacttggatggaaggcgagggatgatccagtgattagttagtccgccaggacacctagttttcgaggataagcggtcaaactatggtttctataacaatattgattcttagacttggacaaattcttaactcttgttctgttttgaaattgttttaaccatttgatcatcccatgtgaattggggtctttgccacataactagagtctgatggaacaaacctggaatcaaactaccgatattattgttcttgctagtgtgtaatatggacaacgtagagcagttcttgaaatatattttcac

SEQ ID NO: 2466 - DNA, 897 bp, Carpinus betulus
ccgtagagaaagggagagatggtgacgtcgccggttgtcaacacgtacccgctgtcgagctacaccttcgggaccaaagagccgaagatggagaaggatacctccgtcgctgatcgctcgctcgcatgaaagtcaactatatgaaggagggaatgaggacaagtgttgaagggattttacgggtgcaggaacataatcatcctcacatacttcttctgcaaattgggaacactttctgtaaacttcctggtgggctttgaagccaggagagaatgaaattgagggtttgaaaaggagctgaccagcaagcttggtgctactgtgcctgctcttgtgcctgactggcagataggtgagtgtgtagcaatctggtgaaggccaaacttttgaaaccataatgtacccatattgtcctccccacataacaaaacccaaggagtgtaagaagctttaccttgttcacttgtctgaaagggagtactttgcagtcccaaaaaatttgaaacttctcgctgttccattgtttgaactctacgataatgttcagagatatggaccagttatatccaccattcctcaacaactctccagatttcagttcaacatgatcgctaaatgagagtagcatggatttctagagctcacatcccttatagctagctacctctgctttataattttatgaagttcggacctttatttgatcgattaattgggctgctaggactcagacatcatcataattgaattttaagttggttagatggggtttctccacttaagtcttatgcggataactgaagcttatctttttgacatggcctctgtgtctatgtttggaatatctattattgtgttatgagtgagcctagggttcttgtactgtagcgttggatc

SEQ ID NO: 2467 - DNA, 959 bp, Brassica juncea
agttgtagtgaatacggtgtcgtattaacctctccgtcgtcgatattactccgtcgccgccgagatcaatacagatcgatacccagagagagagatggctatgtctcaggtggtgaacacgtaccctctctcgaactacagcttcggaactaaagaaccgaagctcgaaaaggacacctccgtcgccgaccgactcgctcgcatgaaagtcaactatatgaaagagggcatgaggactagcgttgatgcgattctgctggtacaagaacacaaccatcctcacatacttctcctgcaaattggtaacacattctgcaaacttccaggtggacgcctgaagcctggagagaatgaagttgaaggcctgaagagaaagttgaccagtaagcttggaggcaattcagctgctcttgtacctgactggaaggtaggagaatgtgttgcgacgtggtggcgtccaaactttgaaaccatgatgtacccttactgccctcctcacatcacgaaaccaaaggaatgtaagagactctatgtggttcacttgtctgagaaagagtactttgcagtgcccaaaaacttgaagctcttggccgtccctttgtttgaactctatgacaacgttcagagatatgggccagttatatcgaccattcctcaacagctgtccagattccatttcaacatgattagttcgtgattctacttacttggtgttgaagaacaagaaacctgtttgatggtaagttactttggcagggttttggagatgagtgtgtggttttttccattatagactttctcggttaatgaagaaccggttcattaaagtttcagcacaagcagattatttgatctcatttctatctaatagcattcgtcattatgtgactaacagcggtcttgtctaaccgtggaacatgtattttcgcgtagtgttcaatgatatttctattttggtt

SEQ ID NO: 2468 - DNA, 1017 bp, Brassica juncea
tagagagagtagagacggtatcatattaaattcattctccgtcgagattagtcctctgtctccgtcgccgtggagatcagtagatcgatacacagagagggacaggggagagaaaattccgacaatcattgtcttattcgatctgggagagacataacagagacagaacagagatggctatgtctcaggtggtgaacacgtacccgctttcgaactacagcttcggaacaaaagaaccgaagctcgaaaaagacacctccgtcgcggatcgactcgctcgtatgaagatcaactatatgaaagagggcatgaggactagcgttgacgccattctgctggtacaagaacacaaccatcctcacatacttctcctgcaaattggtaacacattctgcaaacttccaggtggacgcctgaagcctggagaaaacgaagttgaaggcctgaaaagaaagttgaccagtaagcttggaggcaactcagctgctcttgtacctgactggaaggtaggagaatgtgttgcgacgtggtggcgtccaaactttgagaccatgatgtacccatattgccctcctcacataacgaagccaaaggaatgcaagagactctacattgttcacttgtctgagaaagagtactttgcagtgcccaaaaacttgaagctcttggccgtccctttgttcgaactctacgacaatgttcagagatatggacccgttatatcaaccattcctcaacagttatccagattccatttcaatatgattagttcgtgattcgactcggtgttcaaggaataaagaaacctgtctgatggtgacgcaccgtagagagctgtcgctactttacatcatagacttgttcggttcattccaagtttcagaacaagaagattattgatcttatatttcttaacttgtttgttggatcaatcattcttccttcatacaaataaatctgtagaacgaaaaataccatcatataactctctcattctcattaatgaagcattacaac

SEQ ID NO: 2469 - DNA, 1021 bp, Arabidopsis lyrata
taattctccgtcgagattacttctctcctccgttgccgtcgaacgccgccgctgagcgatagatcgaaacagagagacacacacgggggaagaagatttcaccatttttcgagagagagatggctatgtctcaggtggtgaacacgtacccgctttccaactacagcttcggaactaaggaacccaagctggaaaaggacacctccgtcgccgaccggctcgctcgtatgaaaatcaactatatgaaagagggcatgaggactagcgttgaagggattctactggtgcaagaacacaaccatcctcatatacttctgctgcaaattggtaacacattctgcaaacttccaggtggacgcctgaagcctggagaaaatgaagttgatggtctgaaaagaaagttgaccagtaagcttggaggcaattcggctgctcttgtacctgactggaaggtaggagaatgtgttgcgacatggtggcgtccaaactttgaaaccatgatgtacccgtattgccctcctcacatcacgaaaccaaaggaatgcaagagacttttcattgttcacttgtctgagaaagagtactttgctgtgcccaaaaacttgaaactcttggccgtccctttgttcgaactctatgacaatgttcagagatatggaccggttatatcgaccatacctcaacagctatccagattccatttcaacatgattagttcgtgattctactcggtgtgttcaagaacaagaagcctgtcaggatggcaagttatttaggtacggtagagagctgtagctaccggtttagagatgagattttccgatgatgcgtcttggttttttctttttgacattatagacttgttggcttttatgtagaaccggttcagtttcagcacaaaaaaaaaagattgttgtatctcatttctaaaagcattcgtcattgtttgaccagcgcctgtctagtcttaaccgtaaaacatgtgtttccttcaatcttgaatgaatttttattttggtgc

SEQ ID NO: 2470 - DNA, 728 bp, Brassica oleracea
  misc_feature (23)..(23): n is a, c, g, or t
  misc_feature (713)..(714): n is a, c, g, or t
  misc_feature (716)..(716): n is a, c, g, or t
  misc_feature (720)..(720): n is a, c, g, or t
gctgtttcctcgagattagtagntcgatacacagggagggacaggggaaagaaaattccgacaatcattgtcttattcgatctgggagagacagaacataaacagagagatggctatgtctcaggtggtgaacacgtacccgctttcgaactacagcttcggaactaaagaaccgaagctcgaaaaggacacttccgtcgccgaccgtctcgctcgtatgaaaatcaactatatgaaagagggcatgaggactagcgttgatgcgattctgctggtacaagaacacaaccatcctcacatacttctcctgcaaattggtaacacattctgcaagcttccaggtggacgcctgaagcctggagaaaacgaagttgaaggcttgaaaagaaagttgactagtaagcttggaggcaattctgctgctcttgtacctgactggaaggtaggagaatgtgttgcgacgtggtggcgtccaaactttgaaaccatgatgtacccgtattgccctcctcacataaccaagcccaaggaatgcaagagactttatattgttcacttgtctgagaaagagtactttgcagtgcccaaaaacttgaagctcttggccgtccctttgttcgaactctacgacaatgttcagagatatggacccgttatatccaccatccctcaacagctatccagattccatttcaacatgattagttcgtganncnactnggtgttca

SEQ ID NO: 2471 - DNA, 1129 bp, Brassica rapa
agaacaggactctagaagctgtagtagagagagtagagacggtatcatattaaattcattctccgtcgagattagtcctctgtctccgtcgccgtcgagatcagtagatcgatacacagagagggacaggggagagaaaattccgacaatcattgtcttattcgatctgggagagacagaagagagacagaacagagatggctatgtctcaggtggtgaacacgtacccgctttcgaactacagcttcggaactaaagaaccgaagctggaaaaggacacctccgtcgccgaccgtctcgctcgtatgaaaatcaactatatgaaagagggtatgaggactagcgttgatgcgattctgctggtacaagaacacaaccatcctcacatacttctcctgcaaattggtaacacattctgcaagcttccaggtggacgcctgaagcctggagaaaacgaagttgaaggcttgaaaagaaaattgactagtaagcttggaggcaactcagctgctcttgtacctgactggaaggtaggagaatgtgttgcgacgtggtggcgtccaaactttgagaccatgatgtacccatattgccctcctcacataactaagcccaaggaatgcaagagactctacattgttcacttgtctgagaaagagtactttgcagtgcccaaaaacttgaagctcttggccgtccctttgttcgaactctacgacaatgttcagagatatggacccgttatatcaaccattcctcaacagctatccagattccatttcaacatgattagttcgtgatccgacttggtgttaaagaacaaagaaacctgtctgatggtaaggcaccgtagagaggtgtcgctactttacattattgacttgttcggttcattttcagcacaagaagattattgatcttatatttctaaaacgattcgtcttcatttgactaaccgctgtcttgtcgaatgaatgatactttctatgtttgtgctatgtatgaaatgaaacagaacaaactaggccaatcctaaaactgaattgtaggatcatttcatttttccttctttgtttcagtctgtgatacaaataaatatctatagaatgaaaaatattatcttcgcact

SEQ ID NO: 2472 - DNA, 1100 bp, Brassica rapa
ccctaatgggccatcgatggttatgatttgatacgacgtcgtattaagaacgcgactctagaagttgtagtgggtacggtgtcgtattaacttctccgtcgagataacttctctgtcgccgtcgccgtcgccgctgagatcaatagatcgattacccagggagtagagagagatggctatgtctcaggtggtgaacacataccctctttcgaattacagcttcggaactaaagaaccgaagctggagaaggacacctccgtcgccgaccgactcgctcgtatgaaagtcaactatatgaaagagggcatgaggactagcgttgaagggattcttctggtgcaagaacacaaccatcctcatatacttctcctgcaaatcggtaacacattctgcaaacttccaggtggacgcctgaagcctggagaaagtgaagtcgaaggtctgaagagaaagttgactagtaagcttggaggcaattcggctggtattgtacctgactggaaggtaggagaatgtgttgcgacatggtggcgtccaaactttgaaaccatgatgtacccgtattgccctcctcacatcacgaaaccaaaggaatgcaagagactctacattgttcacttatctgagaaagagtacttcgcagtgcccaaaaacttgaaactcttggccgtccctttgtttgaactctatgacaatgttcagagatatggaccggttatatcgaccattcctcaacagctatccagattccatttcaacatgattagttcgtgattctactcggtgttcaagaagaagaaacctgtcagattaggcacgatagagagatgtagctaccagttttagagatccgagttctggatgatgcatgttggtttctttacattatagacttgttggcattatgaagaacaggttcgttcatgtatcagcacaagaagattattcatctaatttctaaaagcattcgtcattatttgactaacggctgtcttctctaaccatgaaacatgtgttttgactaatgatattttcattgacgtgctatcaatatatgaaacacaaactaggccatgttaaatctacattgtctcagtcg

SEQ ID NO: 2473 - DNA, 989 bp, Brassica napus
atattaaattcattctccgtcgagattagtcctctgtctccgtcgccgtggagatcagtagatcgatacacagagagggacaggggagagaaaattccgacaatcatattgtcttattcgatctgggagagacagaacagagatggctatgtctcaggtggtgaacacgtacccgctttcgaactacagcttcggaactaaagaaccgaagctggaaaaggacacatccgtcgccgaccgtctcgctcgtatgaaaatcaactatatgaaagagggtatgaggactagcgttgatgcgattctgctggtacaagaacacaaccatcctcacatacttctcctgcaaattggtaacacattctgcaagcttccaggtggacgcctgaagcctggagaaaacgaagttgaaggcttgaaaagaaaattgactagtaagcttggaggcaactcggctgctcttgtacctgactggaaggtaggagaatgtgttgcgacgtggtggcgtccaaactttgagaccatgatgtacccatattgccctcctcacataacgaagccaaaggaatgcaagagactttacattgttcacttgtctgagaaagagtactttgcagtgcccaaaaacttgaagctcttggccgtccctttgttcgaactctacgacaatgttcagagatatggtcccgtgatatcgaccattcctcaacagctatccagattccatttcaacatgattagttcgtgatccgactcggtgttaaagaacaaagaaccctgcctgatggtaaggcaccgtagagagctgtcgctactttacattatagacttgttcggttcattcaaagtttcagcacaagaatattattgattttatatttctaaaaggattcgtcttcatttgactaacggctgtcttgtcgaatgaatgatactttctatgtgtgtgctatgtatgaaacagaacaaactaggccatcctaaaactgatt

SEQ ID NO: 2474 - DNA, 940 bp, Raphanus sativus
  misc_feature (466)..(466): n is a, c, g, or t
  misc_feature (508)..(508): n is a, c, g, or t
  misc_feature (816)..(816): n is a, c, g, or t
gggactctagaagctgtagtaaaataaaagtagagacggtatcatattattaaattctccgtctgagattactcctctgtgtccgtcgccgccgagatcagtagatcgatacacagagatggctatgtctcaggtggtgaacacgtacccgctttcgaactacagcttcggaactaaagaaccgaagctcgaaaaggacacctccgtcgccgaccgtctcgctcgtatgaaaatcaactatatgaaagagggcatgaggactagcgttgatgcgattctgctggtacaagaacacaaccatcctcacatacttctcctgcaaattgggaacacattctgcaaacttcctggtggtcgcctgaagcctggagaaaatgaagttgaaggcctgaaaagaaagttgactagtaagcttggaggcaattcggctggtcttgtacctgactggaaggtaggagaatgtgtngcgacatggtggcgtccaaactttgaaaccatgatgtacccntattgccctcctcacatcacgaagccaaaggaatgcaagagactctacattgttcacttgtctgagaaagagtactttgcagtgcccaaaaacttgaagctcttggccgtccctttgttcgaactctatgacaatgttcagagatatggacctgttatatcaaccattcctcaacagctatccagattccatttcaacatgattagttcataatccgacttggtattcaagaacaaagaaacctatccgatggtaaagttacttagcacagtagagagctgtcgctacttgaccttatagacttgttnggttcattcgactttcagcacaagaatattattgatcttacatttttgaaaagcattcgtcattatttgactaacgcctttcttgttgaatgatactttctatgtttgtgctatgtatgaaaca

SEQ ID NO: 2475 - DNA, 1182 bp, Solanum lycopersicum
caaattaacgaatacctaatcgattatatatttcataattatctcaaaaatcaagatgaagataccatggcgaatatgtatttaatgaaatcctaatataatttcaaaatctttttctcaagtccagaagcatctaaaaccaagaaagaagaaaccatatcaccggcgaactgtcgccggaaaatcattctcgccgttcttgcccaaaagaagcgattgaactgatcaaaatggcctcgtccgctatagtgaatacatacccactctctagctatacatttggtacaaaagagcataaaatggagaaggatacatccgttgccgatcgccttgctcgtatgaaagtcaactacatgaaggagggtgtaaggacaagtgttgaaggaattctattggtacaagaacataaccatcctcatattcttcttctgcaaattgggaacacattttgcaagctcccaggtggacgcctaaagccaggagaaaatgaaatcgagggtttgaaaaggaaactttccagcaaacttgctgctaatcctcctgccaatcagccaaattggaagataggtgagtgcatagccacctggtggaggcctaactttgaaaccataatgtatccatactgtcctccacatataacaaaacctaaggagtgtaagaagctctaccttgttcacttatctgaaagagaatactttgctgtccccaaaaatcttaaacttcttgctgtgccattgtttgagctttatgacaatgttcagagatatggacctgtaatatctacaattcctcaacagctttccagattgcagttcaacatgatcaatcaatagatagtagatggagattcaaattctcctccgcgataaaaatgatttgttttggttcccatagtttgagggcgacttgattcacttttctacaataggcagatagatgactctcatctgatcgtttgtcttaaattggtttcttttggacggccacagcgatgggtacagtatgatagcctgttaatatgcaactttgcagttacagtattgacatatttttgcgtacttgcttgttgaatattgacatagtgctgctaagtttctttcgttcggagaggcttttagaagaagcaattctaactgatctttcttctgtgaatcactttcttctaaaccaatgttttgggat

SEQ ID NO: 2476 - DNA, 1047 bp, Arabidopsis thaliana
gtcattaattctccgtcgagatcgcttctctccccgttgccgtccgtccccaccgctgagtgatagatcgaaacagagaaacacacacggcgaagaagatttcaccatattttgtctaagtggattctgttgagagagagagatggctatgtctcaggtggtgaacacgtacccgctttcgaactacagcttcggaactaaggaacccaagctggaaaaggacacctccgtcgccgaccggctcgctcgtatgaaaatcaactatatgaaagagggcatgaggactagcgttgaagggattctactggtgcaagaacacaaccatcctcatatacttctgctacaaattggtaacacattctgcaaacttccaggtggacgcctgaagcctggtgaaaatgaagctgatggtctgaaaagaaagctgaccagtaaacttggaggcaattcggctgctcttgtacctgactggacggtaggagaatgtgttgcgacatggtggcgtccaaactttgaaaccatgatgtacccgtattgccctcctcacatcacgaaaccaaaggaatgcaagagactctacattgttcacttgtctgagaaagagtactttgctgtgcccaaaaatttgaagctcttggccgtccctttgttcgaactctatgacaatgttcagagatatggaccggttatatcaaccattccgcagcagctatccagattccatttcaacatgattagttcgtgatttcgactcggtgtgttcaagaacaaggaacctatcagatgggtaagttacttaggtacggtagagagctgtagctaccggattagagatggggttttccaatgatgcgagttgggttttttgcattatagacttgttggcttttatgtagaaccggttcaaagtgtcagcacaaaaaacaaagattattgtatctcatttttaaaagcatttgtcattgtttgactaacgcctgtcttctctaaccgtaaaacatgtgtttcattcaatgttgaatgatgtttttattttggtgcataaaa

SEQ ID NO: 2477 - DNA, 756 bp, Brassica juncea
ggggagagaaagttccgacaatcattgtcttattcgatctgggagagacataacagagacagaacagagatggctatgtctcaggtggtgaacacgtacccgctttcgaactacagcttcggaactaaagaaccgaagctggaaaaggacacctccgtcgccgaccgactcgctcgtatgaaaatcaactatatgaaagagggcatgaggactagcgttgacgccattctgctggtacaagaacacaaccatcctcacatacttctcctgcaaattggtaacacattctgcaagcttccaggtggacgcctgaagcctggagaaaacgaagttgaaggcctgaaaagaaagttgaccagtaagcttggaggcaattccgctggtcttgtacctgattggaaggtaggagaatgtgttgctacttggtggcgtccaaactttgaaaccatgatgtacccttactgccctcctcacatcacgaaaccaaaggaatgtaagagactctatgtggttcacttgtctgagaaagagtactttgcagtgcccaaaaacttgaagctcttggccgtccctttgtttgaactctatgacaacgttcagagatatgggccagttatatcgaccattcctcaacagctgtccagattccatttcaacatgattagttcgtgattctacttacttggtgttgaagaacaagaaacctgtttgatggtaagttactttggcagggttttggagatgagtgtgtggttt

SEQ ID NO: 2478 - DNA, 1147 bp, Gnetum gnemon
caaggttagataatttcgaacaccgtccctaattcctgttgttgcaacctaatgatacctttaaatccccactaaggtttgaaacggagcagcatatatctgtccgaggtctctgtgttttgctgctacgcagagcttgtttcgaaaagctttcgttggcgggagagaagatcggttgtcggagaacatcagaaacgaaagtaaaagatctgaagcgacgaagaagaagcaaatagaagaaaaatgtactcctctggtccggttgttaatgcttaccctttgtccagctacactttcggcaccaaagagccgaaaatggagaaagatacttctgttgccgacaggcttgcccgaatgaaagtcaattatatgaaagaaggcatgagaacaagcgtcgaagctattcttctggttcaagaacacaatcatcctcatatattgcttcttcaaataggaaacacattctgtaagcttccagggggacgcttaaagcctggagaaaatgagattgagggcctgaagcgtaagttgtctagcaaacttgctgcaaattcagttgctcttcagcctgattggaagattggcgagtgtgttgctgtttggtggaggcctaatttcgagactctaatgtatccttactgtccaccacacatcacaaaaccgaaggaatgcaaaaagctgtttctggtgcagttatctgagagagagtattttgctgttcccaaaaatctgaaattgcttgccgttccattgtttgagctttacgataatgtgcagagatatggtccagttatctccactattcctcagcaactgtcaagatttactgtcaagatggttaacaatgaacaccgaaaagatgtattctagatggatagatagacgactggatgaatccctaaattccttgttaggggtagttggtttagttagttgcatatgcataggtgtggttgtttgttaaccctgcttcctccattttgatgactaatgatattagacagaccagtacactgacatcatatatcattatgaatttaaaggctttatgattggtttaaccaatttactttctggtcaggcttcttatttattgaagctgacatactatgggtgctaatttatatgaaataatatcttccaagtc

SEQ ID NO: 2479 - DNA, 826 bp, Solanum tuberosum
cagaagcatcccatcaacggcaagagggaaaatctgaaaatacaaatattcttccggtgaacacccacccaccgtctctccttcagtcctcctgccggcgatatctaattcctgagaggaaggtagggtgaaaacctcgttatttgcatagaaagaaaatggtaacgtcttcggttgtcaacacatacccactgtccagctatacatttggtactaaggagcccaaaatggagaaggacacctccgtcgccgatcgccttgctcgtatgaaagtcaactatacgaaggagggcatgaggactagcgtcgaaggaattctattggtacaagaacacaatcatcctcacattcttctattgcaaattgggaacacattctgcaaacttccaggtggacgcttgaaaccaggagagaatgaaatcgagggtttgaaaaggaaactgtctagtaaacttgcagctaattctcctggcattcagccaaattggcagataggtgagtgtgtggccatctggtggaggccaaattttgaaaccataatgtatccatattgccctccacacataacaaaacccaaggagtgtaagaagctcttcgtagttcatctatctgaaagagagtactttgctgtcccaaaaaatctgaagcttcttgcagtgccattgtttgaactttatgacaatgttcagagatatggacctgtgatatccacgattcctcacagctttccagattccagttccacatgatccactcgtagattaggttaggtggacattcagaacctccttctggcatacaatcccaaaatacattaagcttttta

SEQ ID NO: 2480 - DNA, 1104 bp, Raphanus sativus
gggtcgtcgtattaaattaaatccccgtcgagattaaaatcctctatcgccgtcgccgccgctgctgatcaattagtagatcgatacagagagagagagggagcggggggcggggaagaagattccgacattatttggttgagcggatccgggagagagacagaacagaaacataaaagataaaagatggctatgtcacagatagtgaacacgtacccgctgtcgaactacagcttcggtactaaagaaccgaagctggaaaaggacacctccgtcgccgaccgactcgctcgtatgaaaatcaactatatgaaagagggcatgaggactagcgttgacgccattctgctggtacaagaacacaaccatcctcacatacttctcctgcaaattggtaacaccttctgcaaacttccaggtggacgcctcaagcctggagaaaatgaagttgaaggcttgaaaagaaagctgaccagtaagcttggaggcaattccgctggtcttgtacctgactggaaggtaggagaatgtgttgcgacatggtggcgtccaaactttgaaaccatgatgtacccttactgccctcctcacatcacgaaaccaaaggaatgcaagagactcttcgttgtccacttgtctgagaaagagtactttgcagtgcccaaaaacttgaagctcttggccgtccctttgtttgaactctatgacaatgttcagagatatggaccagttatatcgaccattcctcaacagctatccagattccatttcaacatgattagttcgtgattctactttacttggtgttcaagaacaagaaacatgtttgatggtaagttactaaggcaggtttcagagatgatgcgtttgggttttttacattatagacttgatgatctgtttatgaagaaccggttcattcaagtttcagcacaaacagattattggatctcgtttctatcgaaaagcattcgttatcatatgactaacggtggtcttgtctaaccgtggaacatgtattcactcattgttaaatgatatttcccttctggtatctatgacagaaacaaggccatgttaaaagaaactttttttattggatcg

SEQ ID NO: 2481 - DNA, 756 bp, Brassica juncea
attatattcgccgtcgagattaaatcctctattgccgtcgccgccgccactgatcaaatagatcgatatagagagagggacgtgggaagaagattccgacattattgagtaagtggatccgggagaaagagagagagagagagatggccatgtctcagattgtgaacacgtacccgctttcgaattacagcttcggaactaaagaaccgaagctggaaaaggacacctccgtcgccgacagactcgctcgcatgaaaatcaactatatgaaagagggcatgaggactagcgttgacgccattctgctggtacaagaacacaaccatccacacatacttcttctgcaaattggtaacacattctgcaaacttccaggtggacgcctgaagcctggagaaaacgaagttgaaggcctgaaaagaaagttgaccagtaagcttggaggcaattccgctggtcttgtacctgattggaaggtaggagaatgtgttgctacttggtggcgtccaaactttgaaaccatgatgtacccttactgccctcctcacatcacgaaaccaaaggaatgcaagagactctacgtggttcacttgtctgagaaagagtactttgcagtgcccaaaaacttgaagctcttggccgtccctttgtttgaactctatgacaacgttcagagatatggaccagttatatcgaccattcctcaacagctatccagattccatttcaacatgattagttcgtgattctacttgg

SEQ ID NO: 2482 - DNA, 1122 bp, Brassica rapa
ggtgtcatattatattcgccgtcgagattaaatcctctattgccgtcgccgccgccattgatcaaatagatcgatatagagagagggacgtgggaagaagattccgacattactgagtaagtggatccgggagagagtaaacagaaagagagagagatggccatgtctcagattgtgaacacgtacccgctttcgaactacagcttcggaacaaaagaaccgaagctcgaaaaagacacctccgtcgcggatcgactcgctcgtatgaagatcaactatatgaaagagggcatgaggactagcgttgacgccattctgctggtacaagaacacaaccatcctcacatacttctcttgcaaattggtaacacattctgcaaacttccaggtggacgcctgaagcctggagagaatgaagttgaaggcctgaagagaaagttgaccagtaagcttggaggcaattccgctggtcttgtacctgattggaaggtaggagaatgtgttgctacttggtggcgtccaaactttgaaaccatgatgtacccttactgccctcctcacatcacgaaaccaaaggaatgtaagagactctatgtggttcacttgtctgagaaagagtactttgcagtgcccaaaaacttgaagctcttggccgtccctttgtttgaactctatgacaacgttcagagatatgggccagttatatcgaccattcctcaacagctgtccagattccatttcaacatgattagttcgtgattctacttacttggtgttgaagaacaagaaacctgtttgatggtaagttactttggcagggttttggagatgagtgtgtggttttttccattatagactttctcggttaatgaagaaccggttcattaaagtttcagcacaagcagattatttgatctcatttctatctaatagcattcgtcattatgtgactaacagcggtcttgtctaaccgtggaacatgtattttcgcgtagtgttcaatgatatttctattttggttgctatttacgtgtgtacagcatttccaatgtacactttacttttcctcttaagatctctattatatagacgaaaatgctctaatgtatacttctattttag

SEQ ID NO: 2483 - DNA, 994 bp, Brassica napus
ggggaagaagattccgacattgttgacttagtggatccgggagagagtaaacagaaagagagagagatggccatgtctcagattgtgaacacgtacccgctttcgaactacagcttcggaacaaaagaaccgaagctcgaaaaagacacctccgtcgcggatcgactcgctcgtatgaaaataaactatatgaaagagggcatgaggactagcgttgacgccattctgctggtacaagaacacaaccatcctcacatacttctcctgcaaattggtaacaccttctgcaaacttccaggtggacgcctgaagcctggagagaatgaagttgaaggcctgaagagaaagttgaccagtaagcttggaggcaattccgctggtcttgtacctgattggaaggtaggagaatgtgttgcgacatggtggcgtccaaacttcgaaaccatgatgtacccttactgccctcctcacatcacgaaaccaaaggaatgtaagagactctatgtggttcacttgtctgagaaagagtactttgcagtgcccaaaaacttgaagctcttggccgtccctttgtttgaactctatgacaacgttcagagatatggaccagttatatcgaccattccgcaacagctatccagattccatttcaacatgattagttcgtgattctacttacttggtgttgaagaacaagaaacctgtttgatggtaagttactttggcagggttttggagatgagtgtgtggttttttccattatagactttctcggttaatgaagaaccggttcattaaagtttcagcacaagcagattatttgatctcatttctatctaatagcattcgtcattatgtgactaacagcggtcttgtctaaccgtggaacatgtattttcgcgtagtgttcaatgatatttctattttggttgctatttacgtgtgtacagcatttccaatgtacactttacttttcctctaaaatagatagaga

SEQ ID NO: 2484 - DNA, 1118 bp, Cynara scolymus
  misc_feature (53)..(53): n is a, c, g, or t
  misc_feature (62)..(62): n is a, c, g, or t
  misc_feature (77)..(77): n is a, c, g, or t
  misc_feature (80)..(80): n is a, c, g, or t
  misc_feature (83)..(83): n is a, c, g, or t
  misc_feature (85)..(85): n is a, c, g, or t
  misc_feature (87)..(88): n is a, c, g, or t
  misc_feature (92)..(93): n is a, c, g, or t
  misc_feature (106)..(106): n is a, c, g, or t
  misc_feature (109)..(109): n is a, c, g, or t
  misc_feature (116)..(116): n is a, c, g, or t
  misc_feature (123)..(123): n is a, c, g, or t
  misc_feature (125)..(125): n is a, c, g, or t
  misc_feature (130)..(130): n is a, c, g, or t
  misc_feature (139)..(139): n is a, c, g, or t
  misc_feature (142)..(142): n is a, c, g, or t
  misc_feature (155)..(155): n is a, c, g, or t
  misc_feature (157)..(157): n is a, c, g, or t
  misc_feature (160)..(160): n is a, c, g, or t
  misc_feature (184)..(185): n is a, c, g, or t
  misc_feature (767)..(767): n is a, c, g, or t
  misc_feature (847)..(847): n is a, c, g, or t
  misc_feature (852)..(852): n is a, c, g, or t
cagctaatcccttcgatcattgaatgtgggtttttgcaatcgagcgagagaanagatggtgncttcatcagtcgtanacncanancnncttnnaagctactcgttnggnacgaaanaacctanantgganaaagacacntcngttgctgatcgtntngcncgtatgaaactcaactatatgaannaaggtatgaggaccagtgttgaagcaatcttactggtgcaagagcataatcatccccacattctactgctgcaaatcggcaacacgttctgtaaacttcctggtggtcgactgaagccgggagaaaacgaaattgaaggcttaaaaaggaaactgtcaagcaaacttgctgctaattcacctaatatgcaacctaattggcagattggtgagtgtgtggctgtatggtggaggccaaacttcgaaactattatgtacccatattgccctccacacatctcaaaacctaaggaatgcaagaagctttatgttgtacacttgtcagaaagagagtactttgcagtgcctaaaaatttgaaacttcttgctgttccactgtttgaactctacgataatgttcagagatatggaccagtgatttcaactattccgcagcagctttcgagatttcagttcaacatgattcccgcataaataagcatccgattcacgccattttacttcgagaaaacttaaattagtaacgagcgttcttcaaaagttatcgcatttacagaaccccatccagagattaagtcgagtncattgatagtttgttgtagtttgtatcttaccgcagagttagcccgcaacattaaagccttttcctgaagcagaaaatgntgagngaagcgattatgcttcagtaacttgtacattgtgcagtgaaagttgtactttgcttcgggttctaccgtttttgtttcgggaaaaggcttcagtgttttgtgtttgtttgtagttccctctgttttggtagagagatagttgagaccattgctttatttatgagggatagagattatcatctattatgacttgtaccttatgcattgaagttgtacattgcttgattttctgtatttcatgtttatgcaaaaatatcatttcggag

SEQ ID NO: 2485 - DNA, 819 bp, Raphanus sativus
  misc_feature (35)..(35): n is a, c, g, or t
  misc_feature (303)..(303): n is a, c, g, or t
  misc_feature (673)..(673): n is a, c, g, or t
tattaaattctccgtctgagattactcctctgttnccgtcgccgccgagatcagtagatcgatacacagagacgtaacagagatggctatgtctcaggtggtgaacacgtacccgctttcgaactacagcttcggaactaaagaaccgaagctcgaaaaggacacctccgtcgccgaccgtcttgctcgtatgaaaatcaactatatgaaagagggcatgaggactagcgttgatgcgattctgttggtacaagaacacaaccatcctcacatacttctcctgcaaattgggaacacattctncaaactccctggtggacgcctgaagcctggagaaaatgaagttgaaggcctgaaaagaaagttgactagtaagcttggaggcaattcggctggtcttgtacctgactggaaggtaggagaatgtgttgcgacatggtggcgtccaaactttgaaaccatgatgtacccgtattgccctcctcacataaccaagccaaaggaatgcaagaggctctacattgttcacttgtccgagaaagagtactttgcagtgcccaaaaacttgaagctcttggccgtccctttgttcgaactctatgacaatgttcagagatacggacccgttatatcaaccattcctcaacagctatccagattccatttcaacatnattagttcatgatccgacttggtgttcaagaacaaagaaaacctatctgatggtaaagttacttagcacagtagagagctgtccctacttgacatataaacttgtttggttcattcagtttcgcacagagatatgatcttatattt

SEQ ID NO: 2486 - DNA, 761 bp, Cycas rumphii
gctggagttcaactaaaactcaccaccctcgttgccatcgatttctccgtacacgatccctcaaaggcaggcaggcagaggcagggaagattgaaaagcttttctgctgctggccgcttggtaccgtttccattgtttttggcgaagataaatctatagtcatacacagcaagtttattcaagggcgagatgctgtcagcgcccgttgtaaatgccttccctttgtcaagctacacattcgggacaaaggagccgaagatggaaaaggacacttctgttgctgacaggctggccaggatgaaagtcaactatatgagagaaggtatgcggacgagcgtggaagctattcttctggtacacgagcgcaaccacccgcatatactgctattgcaaataggaaatactttctgtaagcttcctggtggacgtttaaaacctggtgaaaatgaaattgaaggcttgaaacgcaaactgtcgagcaaacttgctgctaattcaactgctctacagcctgattggcagattggagagtgtgttgcagtatggtggagacctaatttcgagaccttgatgtatccctattgtccaccacacattacaaaacctaaggaatgcaagaaacttttccttgttcatctatctgagagggaatactttgcagtccccaaaaacctgaaactgcttgctgtgccattgttcgagctctatgacaatgtccagagatatggtcctgttatctcaactattccgcagcagctatc

SEQ ID NO: 2487 - DNA, 673 bp, Ambrosia trifida
tggtgaatacgtatccactgtcggggtacagtttcggcaccaaggaccccaagctggagaaggacacttccgtcgctgaccgcctcgctcgtatgaaacataactatatgaaggaaggcatgaggactagcgttgaaggaattttgctggtacaagagcataatcacccacatatactgcttttgcaaattgggaacactttctgtaaacttcctggtggtcgtctaaagccaggagaaaatgaaattgagggattgaaaagaaaattatccagcaaacttgcagctgattctactggacttcagcctgattggcagataggagagtgtgttgctatatggtggaggcctaattttgagacaatgatgtacccgtactgccctccgcatataactaaaccaaaggagtgtaagaaacttttcgttgttcacttgtcagaaagagaatactttgcagtgcccaaaaaatctaaaacttcttgccgttccattgtttgagctttatgacaatgttcagagatacgggcatgtcatttccaccattccacagcagctgtctagatttcagttcaacatgatccatgcataaacttcatgagtttattctgaaccaaagaaaaagaatctgatattatggctagaattctggttccgtacattgcttatgattagtc

SEQ ID NO: 2488 - DNA, 925 bp, Triticum aestivum
aaaaaaatacaagaacagccccgagcgctcacacaaaaaaagcccgcaccacctctcctcccccgtcgacaccgacatcgccgggaaccaccggatcccgagtaagaaagagccagcgcccggcgaagcgaagcggaggaagagatggtgggcgctccgtcctcgccggtggtgaacgtgtacccgttcgtcaactacacgtatggcaccaaggaggccaagatggataaggatatctccgttgacgaccgcctcgttcgcatgaaggtcaactacatgaaagaaggaatgcggacgagtgttgaagcaattctattggtgcaagagcacaagcacccccacatactgttgtagcaaattggaaacacattatgcaaacttcctggtgtgcggttgaagcctgtagaaagtgaaattgagggtctgaaaaggaagctatgcagcatgcttgcagttaactcaccttcctttccacctaactggcaggttggagagtgtgttgctgaatggtggaggccaaactttgaaaccgtgatgtatccttactgccctccacatataacaaagtcgcaggagtgcaagaatgcttccattgttcacctaagtgaaagggagtatcttgctgttccaaggcacttgaagctacttgctgtaccactgtgtgaactgtatgacaatgttcagcggtatggatcagagatctccaccatcccgcagtagatgtccaggttgcacttcaggatggtgagctcgtgattagtagtggtgataaaatgtgatgatgaggtcagtaagatgtattgacatggatcttgcacgaagcacgaactagatgctggtcaaattagcatgaccccttattgaggccccaattttcataaaagtagatgtctcatccgaatgggttttatttggggatgaatgc

SEQ ID NO: 2489 - DNA, 779 bp, Trifolium pratense
gtcaagctacaccttcggcaccaaggagccaaagatggagaaagatacctccgtcgctgatcgtctcgctcgtatgaaagtaaattatatgaaagaaggaatgaggaccagcgtggaaggaattttactggttcaagaacacaatcatcctcatattcttcttctgcaaattgggaacacattttgcaaactcccaggtggtcgtctcaagccaggggagaatgaaattgacggcttgaagagaaaattgaccagcaagcttggcgctaattcacctgctcttgtacctgactggcagatcggtgaatgtgttgcaatctggtggaggccaaattttgaaaccataatgtatccatactgtcctcctcatataaccaaacccaaggaatgcaagaagcttttccttgtccacttatctgagagagaatactttgccgtacccaaaaacttgaagctgcttgctgttccattgtttgaactctatgacaatgttcagagatatggaccagtcatatcgaccattcctcagcaactttccagattccagtttaaaatgatcactaactgaccataattggaagcttctagctgatagaattctacttccatttcttattttgagaactaggacttatttgttgcattatcctaaacccttaattttattatcattgcataatctggctagagaactgatttttgaagtgtgtttctaaatagatttgtaatttgtatcactgtttgtaactttgtattaattcattggattgttggttgat

SEQ ID NO: 2490 - DNA, 579 bp, Arnica chamissonis
ttcggcacaaaagaacctaaaatggagaaagacacttcggttgctgaccgtcttgctcgtatgaagctcaactacatgaaggaaggtatgaggaccagtgttgatgcgatcttactggtgcaagagcataatcatccccacattcttcttctgcaaattggcaacacattctgcaaacttcctggtggtcgactgaagcctggagaaaacgaaattgaaggcttgaaaaggaaattgtctagcaaacttgctgctaactcacctaatatgcaacctaattggcagattggcgagtgtgtggctgtatggtggcggccaaactttgaaactattatgtacccatattgccctccacacatctcaaaacccaaggaatgcaagaaactttatgttgtacacttgtctgaaagagagtactttgcagtgcccaaaaatttgaaacttcttgctgttccactgtttgagctctacgataatgttcagagatatggaccagtaatttcaactattcctcagcaactgtctagatttcagttcaacatgatccctgcataaatctggcattatattgcgtgttta

SEQ ID NO: 2491 - DNA, 1081 bp, Vinca minor
ttcgggactaaggagcccaagatggagaaagacacttccgtcgccgatcgtcttgctcgcatgaaagtcaattatatgaaggagggtatgaggacgagtgttgaaggaattttattggtacaagagcataatcatccccacattcttcttctgcaaatcgggaacactttctgcaagcttcctggggggcgtttgaagccaggagagaatgaaatcgagggtttgaaaagaaaactttctagcaagcttgcagctaattcacctggattgcagccagattggcagattggtgagtctgtagctatttggtggagacctaattttgaaaccattatgtacccttactgccctccacacattacaaaaccaaaggagtgcaagaagcttttccttgttcacctttctgagagagagtactttgcagttccaaagaacttgaagcttctggctgtcccattgtttgaactctatgacaatgttcagagatatgggcctgtgatatcgacaattccacagcagctgtctagattccagttcaacatgatccatccttagatcaaatatggtcccttcctgaatagcaccttactggagaatttgcttttggctggtctatcaggtctctaagtttcacatgattagcgcatgtccaatgaagtcgtatgatatctttctgcaactgggtttttcgtttcagctggcacaccaaactgacatggatattaatttatttttcatgaaagatattcttgacctgcgtaagtacgacgtagaacaattattagagcagccaatagttaatgatgatattgtgagatggtggatgtttcaactctgtttgccgttagtctttgtattttcacctatattttgagatggtggatagtggatgtttctaactctgtttgctattagtcgttgtattctcacccatctgggtagatggtccatgtttcatgtaatttgattgtatgataacttgcatatttgagtcaataggttgtagctgctgtagttgtggttgtgtgtatttgtcaaccagcaacaatagccttggtgtattgaccgtattctagtccat

SEQ ID NO: 2492 - DNA, 794 bp, Centaurea maculosa
gggggattcatttctccaatagccttcgaaaccccaagatcaaagacaacctaaaaaacagcaatcgattcgatctttcaatctgcgttttgtggaagaaatcataggtgcaaaaatggtgacttcatcagtcgtaaacacataccctctttcgagctactcgtttggcacgaaagaaccttaaatggagaaagacacctctgttgctgatcggcttgctcgaatgaagcttaactatatgaaggaaggtatgaggactagtgttgaagcaatcttactggtccaagagcataaccatccacacattcttcttctgcaaattggcaacacattctgtaaacttcctggtggtcatattgaagcctggagaaaacgaaattgaaggtttaaaaaggaaattgtcaagcaaacttgctgctaattcaccaaatatgcaaccaaattgccatattggagagtgcttggctgtatggtgaaagccaaacttcgaaacaattatgtacccatattgccctccacatatctcgaaacccaaagaatgcaagaagctttatgttgtaccatttgtcggaaagagagtaccttgcagtgcctaaaaatttgaaacttcttgcggacccactgtttgagctctatgataacgcttcaagataaggaccagtgatttcaactattcctcagcagctttcaagatttcaattcatcatgattcccgcataaatgcgcatcaatcgattcaagccttttaatcttctagaaacttaaattattaactactgttcttcaaaaattta

SEQ ID NO: 2493 - DNA, 1186 bp, Ceratodon purpureus
tttttccaacccatcggggttctataccttgtgagcggcgatggtgtctgggccggtggtcaatgtgtacccgctgtcgagctacacgtttggcagcaaggaggccaagatggagaaggacacctccgtcgccgatcgtctcgcgcgtatgaagcagaattacatgaaggaaggcatgcggactagtgtggaaggaattttgctggttcaagagcacaatcatcctcatgtgttgttgttgcaaattggcaacactttttttaagcttccaggtggacgtctgaagactggggaaaacgaaatcgaggggctcaaacggaagctcacgagcaagcttgccccaacagcttcttccatccaaccggagtggcagataggagaatgtgctgctatgtggtggcgtccgaattttgagactttgttgtacccctatcaacctccccatatcaccaagcccaaggaatgcaagaagttgtttgtggtttgcctgtccgagaggcaatattttgctgttccgaagaacctgaaactcttagcagttcctttgttcgagctctacgacaatgtccagagatatggtcctgtgatttctgccatcccccagcagttatcgaggtttaattttaacgctatcaacaactaatttgtgaggcgtccttttccatcttaaatggaactgcgaagtaagaatgtggtacagcctcagctcgaccgacattttggccatttctagtcttcacaagtctttcaaccgccgctgtggaaggaactcacattccacgtgagcaaagtggaatgtggaagcaacatcgtgggatcctttaaccttccagcggcatcagcattcagcatccagcacggcggtagaaacgatggaagtgtagattcttccctgaagtgctctcacgggtaaagtaatgtgcacatgttacagatgagttgataaacttgtgtggcacagtaatggtgggtcatttatattacacgctttgagctcccactcccttctccgagttgttcaattaggttatggtgaagctgttggggacgtgatagattacgccgagagttgttcaaagcactaaatctgttccacaacaatgttgagcccgcataaaacgcactggtttttccataccgttttggattgtctgtgtaccttgctttctttttaatatgtgcagca

SEQ ID NO: 2494 - DNA, 1082 bp, Marchantia polymorpha
cgagggtttgaaaaatcttcgatcgcgctcgcggaccggcgctgtctcgaaacgtgcagtgtgcagaaatcttgcgtgcttccacgagctcgtcgagtccagcgtcggactcgattctgaagaaggcacgcgaaggagcggcgcagccccattttcatgaacagaaatcagtaagatggtgagcgggccagtggtgaacgtttatcctctgtcgagctacacgttcggcagcaaggaggcgaaaatggagaaggatacgtctgtagccgaccggcttgcgcgcatgaagcaaaattacatgaaggagggaatgcgcaccagtgtggaagggatcctccttgtacaggaacacaatcatcctcatgtgcttcttcttcaaataggaaatacttttttcaagctacctggaggacgcctcaaaactggtgaaaatgaaatcgagggactcaagcggaagctgacaagcaagctagcacccacagcctcgtctatacaaccagactggcagataggtgaatgtgctggtgtatggtggcggccaaattttgaaacattattgtacccatattgtccacctcacataacgaaaccgaaggaatgtaagaagctgtttgttgtaccactagcagaaaggcagtattttgccgttcctaaaaacttgaagttgctagctgtcccattgttcgagctttacgacaacgtgcagagatatggaccagtgatatctgcaatacctcaacaactctcaaggttcaacttcaacgcgatcaacaattaagaccttcatattgccttgtgatagcagtagagtgctactggatgtgatcgacaaacttgactttctctggattcttctgtcaactttggcgcgaggttctcacgattgagaatacaagtatttgtttcaatgtacggatgatagtcgttgcacataggttcgaaatacaaacttccaagccgacttatatcaatgtttggtggttacttccgattaccatatatttctcctggtattggagaaatatttatgtatccactttttttctatcaatgtacacgtggaagtttgctcaaaaaaaaaa

SEQ ID NO: 2495 - DNA, 1238 bp, Physcomitrella patens
gggttttttcagggttttcgtcgttgagggaccagctgagcgtgtgtatgagcgctggatttggtgttaccaggctcatagcctctctacagcttcggagttgcctgtctgtctgtctgtctgcactactgttgagttggggtttcgaagctgaggccaacatggtgtctgggcccgtggtaaatgtgtatccgctgtcgagttatacgtttggcagcaaggaagccaagatggagaaggacacctctgtcgccgatcgtcttgctcgcatgaaacagaattacatgaaggaaggtatgcggacaagtgtggaggggattttgctggttcaagagcacaatcatcctcatgtcttattgttgcaaattggtaacactttcttcaagcttcctggtgggcgcctaaagactggggaaaatgaaattgagggtctcaaacggaagcttacaagcaagcttgctccaacagcctcttctatacaaccagagtggcagataggagaatgtgccgctatgtggtggcgcccaaattttgagactttgctatacccttatcaacctccccatatcaccaaacccaaggaatgcaaaaagttgtttgtagtctgcctatccgagagacagtatttcgctgttcccaagaacttgaaacttctagcagttcctttgtttgagctctacgacaacgttcagagatacggtcctgtgatttctgctattcctcagcagttatccaggtttaacttcaacgccatcaacaactgatttgtgggctatcttccatctttgcttggaatttgcaaaatcgcaatgttgtacagattctcactagattgtcctctgaccaattctctcaaaggaatacagattccacgttaacaatgtggaatgtggagggtatcgctttggttactccaagctttaacggacaataacagcatagcggttgaactgtttaaattatgaagtattgagaaactggtacggacattgttttgactcacgctggagaagagcagtattgtgattttcgcaccttggggtggaataatcgcgcttaaaaagagcatcattgtgatttttacaaacttgtagttcccctttctctccctttgagtccaccgaaagcagctggcctgtcgccgatttggcaacaggaagtatgtatgattataccaatatcgcttcaagagactggtcaggtgtgtacacttgcactctggacttcgtgagttgtgt

SEQ ID NO: 2496 - DNA, 553 bp, Eschscholzia californica
gacaccgccggcagtgaatgtataccctctctccagctacaccttcggaactaaagaaccgaagatggagaaagatacttctgttgctgatcgtctcgctcgtatgaaactcaattatatgaaagaaggaatgagaaccagcgttgaagcgattttactggtgcaagagcataatcatcctcatatactgcttctccaaattggaaacactttctgcaagcttcccggtgggcgtttaaagccaggagaaaatgaaatcgatggcttgaaaagaaagttgtcaagcaaacttgctgctaactcgcccggtatgcagccagattggcagattggtgagtgtgtagccatgtggtggagaccaaacttcgaaacgatcttatacccatactgtcctcctcacattgctaaaccgaaggagtgtaagaagcttttccttgttcatctgtcggaaagggagtactttgctgtccccaagaacttaaaactacttgctgtgcctctctttgaactatatgacaatgttcagagatatgggccagttatctccacaatt

SEQ ID NO: 2497 - DNA, 955 bp, Olea europaea
cacgatatcgagaaacgaagagacacagagagagagggagggagaaatggtgacgtcgccggtggtaaatacataccctctgtcgagctatactttggtaccaaagagccaaagatggagaaagatacctcagttgctgatcgtcttgcgcgaatgaaagtcaattacatgaaggaaggcatgagaactagcgttgaagggattctattggtacaagaacacaatcatccccatatacttcttctgcaaatcggaaataccttctgtaaactcccaggcggcaggctgaagccaggagagaatgagattgagggcttgaaaaggaaactctctagcaaacttgctgctaattcgccttctcttcagccagattggcagataggtgagtgcgtggctatatggtggagaccaaattttgagactataatgtacccttattgccccccacatattacaaaacctaaggagtgcaagaagcttttcatggttcacctatctgaaagagagtacttcgctgtgccaaaaaacttgaaacttcttgctgttccattgtttgaactctacgacaatgttcagagatatggacctgttatatccaccatcccacagcagctgtccaggttccacttcaacatgatccattcatgaatagtcatggacctcctagagctcatgcaaggataaagtattgctggatggttagaattgagtcctgtccaggtccaaagtttcactgacgactgagcaaatactgcatattattgttgatcatttttcctagagtagacaatttgagcgtaaagtttcttactttaacttatgatatttctttctccttactgtaactgtagtagctgtagcttattaaattcgtccctttttcacttactttgctttatgaagtctatgttttactacttgtgggcttcttccgacgtcatattaggaacatgat

SEQ ID NO: 2498 - DNA, 698 bp, Selaginella moellendorffii
gcgagcgatggtttccggccccgtcgtgaatgtctacccgctgtcgagctatacgtttggcagcaaggaggtgaagatggagaaggacacgtcggtgtcggatcggctcgcgcggatgaaaaccaactatatgaaggagggaatgcgaacgagcgtggagggaattttgctggtccaagaacacaatcatccacacttgctactcctgcaaatcgggaatacgtttttcaagcttcccggaggaagactcaagactggagaaaacgaggtggaaggattgaagaggaagctcacgagcaagcttgctccaacggcggcttcgatccagcccgactggcagattggagagtgcgccgcgatttggtggagaccaaactttgagacgctgctatatccttactgccctcctcacatcaccaaaccaaaggagtgtaagaagctcttcgtggttctcctccccgagaaacaatacttcgctgttccaaagaatctcaagctactggcagttccattgtttgagctctacgacaatgtacagagatatggcccagtgatctccgccatcccccagcagctttcaaggttcaccttcaatgccattaacggctgaactccgccaaactgggtgaattttttcttcttttttctccgttttgtaaaactattaacttactatatgagtggctatttttgtctca

SEQ ID NO: 2499 - DNA, 679 bp, Ambrosia trifida
gaatacgtatccactgtcggggtacgagtttcggcgaccaaggaccccaacgactggagaaggactcttctgtcgctgaccgcctcgctcgtatgaaacataactatatgaaggaaggcatgaggactagcgttgtaaggaattttgtctggtacaagagcataatcaccacatatactgcttttgcaaattgggaacactttctgtaaacttccaggtggtcgtctaaagccaggagaaaatgaaattgagggattgaaagaaaattatccagcaaacttgcagctaattctactgaacttcagcctgattggcagataggagagtgtgttgctatatggtggaggcctaattttgagacaatgatgtacccgtactgccctccgcatataactaaaccaaaggagtgtaagaagcttttcgttgttcacttgtcagaaagagaatactttgcagtgcccaaaaatctaaaacttcttgctgttccattgtttgagctttatgacaatgttcagagatacgggcctgtcatttccaccattccacagcagctgtctagatttcagttcaacatgatccatacataaacttcacgagtctattctgaaccacagaaaaagatatgatattatgactagaattctggttccgtacattgcttatgattagtcaattagta

SEQ ID NO: 2500 - DNA, 1378 bp, Cedrus atlantica
gtaatccatccatcgccgaataaaaggaatacgaaaccaacgtatctctactgctgtgggtttttgatctctcacgtataattcatcagcaagagaagatgtgtctggaccggttgtaaatgcctaccctctgtcaagctacacatttgggaccaaagagccgaagatggagaaggacacctctgttgcagacaggcttgccagaatgaaagtcaattatatgaaagaaggcatacgaacaagcgtggaagctattctactggtgcaggagcacaaccatccccatatactgttactgcagattggaaacaccttttgtaagctgcctggaggacgcttaaagcctggtgaaaatgaaattgagggcttgaagcgcaaactatcaagcaaacttgctgcaaattcaagtgctcttcaaccagactggcagattggagagtgtgttgctgtatggtggagacctaattttgagacattgatgtatccctattgtccaccccacattacaaaaccaaaggaatgcaaaaagcttttccttgttcatctatcagagagagaatattttgctgtccccaaaaatctgaaactgctcgctgttccactgtttgagctctatgataatgtgcagagatatgggccggttatatcaactattccacagcagctgtcaaggttcacttttaacatggttaatgcatgaactccattgagggtggtctttctggagaaaatattgagaactgctttactgagggaaaaatactttgtaatattgttgaattacaaactgttaatcaaatttgacccactaatagagctgggacctttgcaaccatccatggttgcgagcataaagtttggtctgcatgttacttacgttgtttgccaattagaggtgcaaactattccaaacttatagaatcgtggcatgtaaactgctagctatttacaaattgtcttgtaaaaattaggttggaaagacatgcactaagctctgagaacaaataaactctaaagatatgattctgctggtcaacggcattgttaatttttggagcgtgttctgcttattggaggttataaagcttatttgtgttattcactacggcttttaccagagtgatttctagtggaacaaacttgaagcattaaaactacattataaatgtgaggacattatctgatatcgatctttcagcttggcagccattctcccactcgatcgagaagcaacacgctagccaaggtgtcacatccaagaacaggccacaaggccaagcgtcctatgaaggagggtgtgcaccgttccgtgtgctagaagcacttgatgactagtatggagcaagactctagggcacgaaaagcaatctgggcagaa

SEQ ID NO: 2501 - DNA, 1195 bp, Pennisetum glaucum
atctcgaagtacggcgggtggtgcggcccggcggcccgatgttcctttccccgcaactcttggttttgccacgaccagatccgcctcctccattccaatcctcactcctcctcctcctcctctcttccttccatctccccccgtcgtccgcccatcgccggaggcaccaccctccgccgattcctgcttggtccacgggtgctttcgattccggaggcgccctcagctgaacgtgaacagggaaggggccggggggaacaggggatgcccccagcttaatcgaggctatacccctgaatcgcatggggtctcttctcaccaggaccggcgtcctgccatggctccagagcaagattgttgaccccgtgatgcaggtcatcagaaggggagcggaacccaagcaactggccttctctgctgcccttggactcaccattggaatctttccaatatgtgggaccactgttattcttggtggcgttgctgtagcaatgttgggaagccgttgcaatgcggttactgttatggttctaaatttggccgccacacctattgagctaagtttgatcgtccctttcctacgtttgggagaagcagtcacgggcagtgggcacttccccttgacggccgacgcattgaagaacgtcctcaccggccatgcctcaacggaagtgctgatgagcatcgtccatgctatgctaggttggctgatcgccgcaccatttgttctgggcgcgctgtacatcgtctcggtcccgtgtttcaagatcctggtggataggtttggcggcatcccttcaagccccaggacgccgataaaggcggtgtagctagtgtggcatgctcagtgctcctgaagctgtgtgtacaaccaattctttgctatgccagcgggttgagatgggttacggccccatgttgctcggccacccattccagaaactggcgaataattagaccttgagctgatgggcatatattataggataccccctctgtaattctgtgtgctggcatcacgaatcatgatcatatagtgagatgtgtatttctgaattcgcaaagtctctgcatgaataaatttggaagcactagggccatggagcactgtgatgtactgcagcggtgggccgtgtgggccatagcccaagctaaaaaaaccagccaaaatttcagctgatggaaaacaagtcag

SEQ ID NO: 2502 - DNA, 1327 bp, Panicum virgatum
atgatttgtttgcaggatcttcactccacccgatgttcctttccccgcaactattggttgccacgaccagatccattccggacgcccgcccttcattccactcctccctcatcctctcttccttccatctcccgtcccgtccgtccgtcgccggaggcgtccgccgccggtttcttttgcgattcattgttggttgttgccgcagattttggtgcgtggtggagtgctttcgattcgagccgtctcggccatctctggggctgctcgcctccctcaactgagcctgaacccccacagagcaggggaacaggggatgcccgcagcttaataaaatggggtcttttctcaccaggactggcgtcctgccgtggctccagagcaagattgttgatccggtcctgcaggtcatcagaaggggagcagaacccaagcaactggccttctctgctgcccttggaatcaccattggaatctttccaatatgcgggaccactgttatccttggcggtgttgctgtagcaatgttgggaagccgttgcaatgccgttactgttatggttctaaatttggccgccactcctcttgagctaagcttgatcatccctttcctccgtttgggagaagcaatcacgggcagcgggcactttcccttgactgctgatgcgttgaagaacgttctcaccggccatgcctcaaaggatgtgctgctgagcatcgtccatgcaatgctaggatggctgattgctgcaccatttgcactgggcatattgtacacggtctcgctcccatgtttcaaagtcctggtggataggttcggcggcattccttcaagccccaggacaccgataaaagcggtgtaaccagcacggcgtgcccaatgctcctgaagctgtgtgtacaattaattctttgttatgccagcaggttgagatgggttccggcatcatgttgcccggccatccatcccaggcactggcgaataattagacgttgagctgataggcatatgttatatcctctgtaattctgtatgctggcttgatgatcatatagtgagatctgagatgtgtatttctgaatttgcaaagtctggataaataaagtttggaagcactagggccatggaagcactgtgatggagtccgcaatatgtactgcagccgtggccgagtcagctaaattttccgtaggcactgtacatgttttgttggtaggaattcaggtgtgtttagttttttttctggtgtaaagtttttggagtatatggacacacatttgaagtattaaacgtagactaatgataaaaaagttacagattttgtcttta

SEQ ID NO: 2503 - DNA, 1086 bp, Panicum virgatum
cgcaactattggttgccacgaccagatccattccggacgcccgcccttcattccactcctccctcatcctctcttccttccatctcccgtcccgtccgtccgtcgccggaggcgtccgccgccggtttcttttgcgattcattgttggttgttgccgcagattttggtgcgtggtggagtgctttcgattcgagccgtctcggccatctctggggctgctcgcctccctcaactgagcctgaacccccacagagcaggggaacaggggatgcccgcagcttaataaaatggggtcttttctcaccaggactggcgtcctgccgtggctccagagcaagattgttgatccggtcctgcaggtcatcagaaggggagcagaacccaagcaactggccttctctgctgcccttggaatcaccattggaatctttccaatatgcgggaccactgttatccttggcggtgttgctgtagcaatgttgggaagccgttgcaatgccgttactgttatggttctaaatttggccgccactcctcttgagctaagcttgatcatccctttcctccgtttgggagaagcaatcacgggcagcgggcactttcccttgactgctgatgcgttgaagaacgttctcaccggccatgcctcaaaggatgtgctgctgagcatcgtccatgcgatgctaggatggctgattgctgcaccatttgccctgggcatattgtacacggtctcgctcccatgtttcaaggtcctggtggataggttcggcggcattccttcaagccccaggacaccgataaaagcggtgtaaccagcacggcgtgcccaatgctcctgaagctgtgtgtacaattaattctttgttatgccagcgggttgagatgggttccggcatcatgttgcccggccatccatcccaggcactggcgaataattagacgttgagctgataggcatatgttatatcctctgtaattctgtatgctggcttgatgatcatatagtgagatctgagatgtgtatttctgaatttgcaaagtctggataaataaagtttggaagcactagggccatggaagcac

SEQ ID NO: 2504 - DNA, 1585 bp, Panicum virgatum
tcctcgtttcattagtaaacccaaagccttgatgaacatgacgtcctcgttcagacacggctgggtacacgtgtcgtctgctgattgtctggaaagagtggacggtggtggggatcttccaaagtccaaactgcagaacccaatttttcgtttttcgttttataatttgtttgcgggatctccactccacccgacgttcctttccccgcaacttttggttgccacgaccagatccattccggacgccctcccttcattccactcctccctcatcctctccactcctccttccatctcccgttccgtccgtcagtcgccggaggcgtccgccgccggtttttgcgattcattgttggttgttgccgcagattttggtgcgtggtggagggctttcgattcgagccgtctcgcccatctctggggctgctgctcgcctccctcgactgagcctgaacccccacagagcaggggaacagggtatgcccccggcttaatcaaatggggtcttttttcaccaggactggcgtcctgccgtggctccagagcaagattgttgatcccgtcctgcaggtcatcagaaggggagcagaacccaagcaactggccttctctgctgcccttggaatcaccattggaatctttccaatatgtgggaccactgttattcttggcggtgttgctgtagcaatgttgggaagccgttgcaatgccgttactgttatggttctaaatttggccgccactcctcttgagctaagcttgatcatccctttcctgcgtttgggagaagcaatcacaggcagcgggcactttcccttgactgccgatgcgttgaagaatgtcctcaccggccatgcctcaaaggatgtgctgctgagcatcgtccatgcgatgctaggatggctgattgctgcaccatttgtactgggcgtattgtacatggtttcgctcccatgtttcaaggtcctggtggataggttcggcggcattccttcaagccccaggacaccgataaaggcagtgtaactagcatggcgtgcccaatgctcctgaagctgtgtgtacaattaattctttgtgatgccagcaggttgagatgggtttcctgcatcatgttgctcggccatccatcccaggcactggcgaataattagaccttgagctgataggcatatgttgtatcctctgtagtctgtaattctgtatgctggcttcatgatcatatagtgagatctgagatgtgtatttctgaatttgcaaagtctggataaataaagattggaagcactagggccatggaagcaccacaatatgaactgcagccgtggcgggtcagctaaattttccgtaggcactgtactgtacatgctcgttgttaggaattcaggagaaataagaaacatctcattgaaagttctagcgctccagtccggagttatcatttatatttaatgtttaagtattctttctagagtttgagttcgacttttttttttatgtaatatccgctctgtaagaccttgagcattcttcttctctcttaaataacattgcagtgctcctgcaaactttttttttaaaaaaa

SEQ ID NO: 2505 - DNA, 1321 bp, Panicum virgatum
caattttccatttttcgttttataatttgtttgcaggatctccactccacccgacgttcctttccccgcaacttttggttgccacgaccagatccattccggacgccctcccttcattccactcctccctcatcctctccactcctccttccatctcccgttccgtccgtcagtcgccggaggcgtccgccgccggtttttgcgattcattgttggttgttgccgcagattttggtgcgtggtggagggctttcgattcgagccgtctcgcccatctctggggctgctgctcgcctccctcgactgagcctgaacccccacagagcaggggaacagggtatgcccccggcttaatcaaatggggtcttttttcaccaggactggcgtcctgccgtggctccagagcaagattgttgatcccgtcctgcaggtcatcagaaggggagcagaacccaagcaactggccttctctgctgcccttggaatcaccattggaatctttccaatatgtgggaccactgttattcttggcggtgttgctgtagcaatgttgggaagccgttgcaatgccgttactgttatggttctaaatttggccgccactcctcttgagctaagcttgatcatccctttcctgcgtttgggagaagcaatcacaggcagcgggcactttcccttgactgccgatgcgttgaagaatgtcctcaccggccatgcctcaaaggatgtgctgctgagcatcgtccatgcgatgctaggatggctgattgctgcaccatttgtactgggcgtattgtacatggtttcgctcccatgtttcaaggtcctggtggataggttcggcggcattccttcaagccccaggacaccgataaaggcagtgtaactagcatggcgtgcccaatgctcctgaagctgtgtgtacaattaattctttgtgatgccagcaggttgagatgggtttcctgcatcatgttgctcggccatccatcccaggcactggcgaataattagaccttgagctgataggcatatgttgtatcctctgtagtctgtaattctgtatgctggcttcatgatcatatagtgagatctgagatgtgtatttctgaatttgcaaagtctggataaataaagattggaagcactagggccatggaagcaccacaatatgaactgcagccgtggcgggtcagctaaattttccgtaggcactgtactgtacatgctcgttgttaggaattcaggagaaataagaaacatctcattgaaagttctagcgctccagtccggagttatcatttatatttaatgtttaagt

SEQ ID NO: 2506 - DNA, 1402 bp, Sorghum bicolor
ggaaggatggccggtggggggtggtggtgtccagagtccaaagcccattttttgtttcttgtttggctgcaggctgcaggatttggcgatttgcactccacctgacgttgctttgcccgcaacttttgcttgccattgccacgacggaggccaagatccagctcctgggcgtccgtcctccagtccccctcctccattccggtcctctcatccttccatctcccgtccgtccctcgtcggagcacgagcaccaaaggtccccggactgggttcacctctgctctccttttcttctcctgttcacccccctcgtcaactcgtgcggtatctgggcgaccgccgctgccgtgccgccctacgccaggtgcccaggtcttcgtcgggtccttcgccggcgaggcgacgagcacccaccaccagctcccttcaactccaccaccaggggatgatgccccgggcttaattgaatgggctctcttctcgccaggactggcgtcctgccatggctccaggccaagattgttgatcccgtgctgcaggtcattagaaggggagcagaacccaagcagctggccttctctgctgcccttggtgtcacgattgggatctttccaatatgtgggaccactgttattcttggtgctgttgctgtagcaatgttgggaagtcgttgcaatgctgttactgttatggttctaaatttggccgccactccaattgagctaagcttgatcatccctttcttgcgtttgggggaaaccatcactggcagtgggcacttccctttgactgccgacgcattgaagaatgttctcactggtcatgcatcaaaggatgtgctactgagcatcgtccatgcgatgctgggttggcttattgctgcaccatttgtactggccgtgctgtacgctgtttcgttcccttgtttcaaggtcctggtcaacaggtttggcggcattccttcgagccccaggaccccgatcaaggcagtgtagctagtgtggcatgccgaatgctcctgaaattgtgtacaccaaattctttgtgatgccattgggttgagaatttgagatgggttccggcatcatgttgctcggtcatcccaggcactgacgaataaatacgacttcagaggcatgtgtcctctgtaattctgtatgctgacttggtaatcatagagatgtgtatttatgagtttacgaagtcttataaataaagctaggaagcacaagggcacggaccactgtgccgttcttcccgttgtacggcgtgggctgtgttcaggtgaatttctgtaggcactgtacatgcttgtaggaattcagagccagctctttccaatttgaatcataggttttcagtggcaaggtaacctagtgcttaagaatcctactaaaatgtg

SEQ ID NO: 2507 - DNA, 1782 bp, Zea mays
acacgtgtcgcccgtcggttgtcgaagcaagcaaaaaggatggccggtggtggcgtccaaagtccaaagccagttttttatttatttctttcttttttttactaaccagagagggaatcagtttggctgcagctgcacggatttggcggtttgcaccccacccgacgttgctttgcccgcaacctctgcttgccacgaccacgacccacgatgcagtgcagtggggcagccagatccagttcctgggcgtcctcctcctcctccattccggccctctcgcccgtccgtctcctgcccccgtccctggtcggaccacgagagccccggactgcgttcacctctgccttttgttcacccctcttgtctcgtgcgtgcgacaacaactgggcgaccgccgccgccgccctacgccaggtgcgcaggtcttcgtcggatccttcgccggcgaggcgacgagcacccaccaggtgatgcccccggcttaattgaatgggctctcttctcaccaggactggcatcctgccatggctccaggccaagatcgttgatcccgtgctgcaggtcatcagaaggggagcagaacccaagcaactggccttctctgctgccctcggtgtcacgattgggatctttccgatatgtgggaccactgttattcttggtgctgttgttgtagcaatgttgggaagtcgttgcaatgctgttactcttatggttctaaatttggccgccactccaattgaactaagcttgatcgtccctttcttgcgtttgggtgaagccgtcactggcagcgggcacttccccttgacagccgacgcattgaagaatgttctcaccggtcatgcctcaaaggatgtgctaatgagcatcgtccatgcgatgctgggttggcttattgctgcaccaattgtactggtcgtgctgtacgccgtttcgttcccttgtttcaaggtcctggtcaacaggtttggtggtattccttcgagccccaggaccccaatcaaagcggtgtagccagtgcctggccggatcctctgcagttacatccgtggacatagctgcagatgtgtcgctgacatccggggccggccgtggcgtggccccaaacgtcagtgactcgacgtaattgcagaggaaacggtttcagccagtgaggcatgctgaatgcccctggaattgtgtgcaccaagttctttgtgatgccgtcggattgagatgggttccggcatcatgttgctcggccatcccaggcactggcgaataaatatgatgacttgagaggcatgtgtcctctgtgattgtgtatgctggtttcacaaccatatatagcgagatgcgtatttatgaatttatgaagtcttgataaataaagctaggaagcacaggggtcacggaccattgtgccattcttcccgatgtaggcgtgggttgtgttcagctaaattttctgtgggcgttgtacatgcttgcaggaattcagtgccagctgtttgaaatttgaatcataggttcagtggcaaggcaacttggtgcttaagaatcctactaaaatgcactcactacgtttcaattataagatttttctagatgtatgccaatatatcggtgatattagatgttttcatcttattcccatcgaggaatgttgtctttacaaccatccgatgtaactctaagttgtaatgagcagtaagcgtcatattattctagaggaattttttgttgaaacaggtgaggaagtttttattataaccaattccttctctgaagtttttggcc

SEQ ID NO: 2508 - DNA, 739 bp, Cynodon dactylon
cgtccactgattgctgagtgattattctccccattcgtttccttttctggggttccaatccttcagctgagcctgaaccccctcatgcgcccgagttgaatggcgtctcttctgacgaggattggcgtcctgccatggctccaaagcaagattgttgatcccctgcttctggttatcagaaggggagcagaaccaaagcaactagccttctctgccgcacttggtatcaccattggaatctttccaatatgcgggaccaccgttattcttggcggtattgctgttgcaatgttgggaagtcgctgcaatgctgttactgttatggttctaaatttggccgccactcctcttgaactgagcttgatcatccctttcttgcgcttgggagaagctgtcacgggcagtggccacttccccttgacgtccgacgcattgaagaatgtcctcaccggccatgcctcaaaggaagtgctaatgagcatcgtccatgcgatgctgggctggctgattgctgcaccatttgtaatgggtgcattgtacaccgtctcgctcccatgctttaagattctcgttgacagatttggcggcacgccttcgagccccaggacaccgatcaagctggtctagagtggctcattcgctcgagtgacatgtctgatactgttgaagctgtgtatacaaattctttgtagtatggccaggttgagaagggtccggtataatttggctcatccaacca

SEQ ID NO: 2509 - DNA, 970 bp, Saccharum officinarum
cagctgcaggattcagcgatttgcattccacttgacattgctttgcccgcaacttttgcttgccacgacggaggccccgccagatccaggttcctgggcgtcctcctccattccggtcttctcatccttccatctcccgcccgtccctcgtcgcagcacgagcacgagcaccaaagggccccggactgcgttcgtctctgctctccctttcttctgctgttgttcatcctcctgcgacaactgggccaccgccgctgacgccataaaacaggtgcccaggtcttcgccggtgacgagcacccaccactccaccaggggatgccccgggcttaattgaatgggctctcttctcaccagggctggcgcatggctccaggccaagattgttgatcccgtgctgcaggtcataagaaggggagcggaaccgaagcaactggccttctctgctgcccttggtgtcacgattgggatctttccaatatgtgggaccactgttattcttggtgctgttgctgtagcaatgttgggaagtcgttgcaatgctgttactgttatggttctaaatttggctgccactccaattgagctaagcttgatcatccctttcttgcgtttgggggaaaccatcactggcagtgggcacttccccttgacgaccgacgcattgaagaatgtcctcactggtcatgcctcaaaggatgtgctactgagcatcgtccgtgcgatgctgggttggctcattgctgcaccatttgtactggccgtgctgtacgctgtttcgatcccttgtttcaaggtcctggtcaacaggtttggcggcattccatcgagccccaggaccccaatcaaggcggtgtaactagtgtggcaggttgaatgctcctgaaattgtgtacaacaaattctttgtgatgccgtcgggttgagatgggttccagcatcatgttgctcggccatccaggcactggcg

SEQ ID NO: 2510 - DNA, 1262 bp, Sorghum bicolor
gttttttttattaaaaacttttcctgcagctgcaggattcaacgatttgcactccacctgacgttgctttgcccgcaacttttgcttgtcacgacggaggcccgccagatccaggttcctgggcgacctcctccattccggccctctcgtccttccatctccggcccgttcctcgtcggcgcacgagcacccaaggtccccggactgcgttcacctctgctctcctttttcttctcctgttcgacaactgtggcgtccgccgctgacgccgtaagctaggtgcccaggtcttcgccggcgacgagcacccgccactccaccaggggatgccccgggcttaattgaatgggctctcttctcaccaggactggcgcatggctccaggccaagatttttgatcccgtgctgcaggtcatcagaaggggagcagaacccaaggaactggccttctctgctgcccttggtgtcacgattgggatctttccaatatgtgggaccactgttattcttggcgctgttgctgtagcaatgttgggaagtcgttgcaatgctgttactgttatggttctaaatttggccgccactccaattgagctaagcttgatcatccctttcttgcgcttgggggaaaccatcactggcagtggccacttcgccttgacggccgacgcattgaagaatgtcctcactggtcatgcctcaaaggatgtgctactgagcatcgtccgtgcgatgctgggttggctcgttgctgcaccatttgtactggccgtgctatacgttatttcgttcccttgtttcaaggttctggtcaacaggtttggcggcattccttcgagccccaggaccccaatcaaggcggtgtagctagtgtggcatgctgaatgctcctgaaattgtgtacaccaaattctttgtgatgccgtcgggttgagatgggttccagcatcatgttgctcggccatcccaggcactggcgaataaatacgacttgagaggcatgtgtcctctgtaattctgtatgctgacttgataatcatatagtgggatgtgtatttatgaatttatttacagtcttcaaataaagctacgaagtacaaagggcacggaccactgtgccggccttcccattgtacggcatgggctgtgttcagctaaattttcggtgggcactgtacatgcgtgtaggaattcagaggcagctgtttgaaatttaaatcatatgttttcagtggccaggtaacctattgcttaagaatcct

SEQ ID NO: 2511 - DNA, 957 bp, Zea mays
tgttgctttgcccgcaacttttgcttgccacgacggaggccagatccagctcctgctcttgggcgtccgtcatccttccatatcccgccctccctcgtcggagcacgagcaccaaaggtgcccagatcttcgtcggccctgcccctgcttccttcaactccaccaccaggcgatgccctagacttaattgaatgggctctcttctcaccaggactggcgtcctgccatggctccacgccaagattgttgatcccatgctgcaggtcatcagaaggggagcagaacccaagcaactagccttctctgctgcccttggtatcacgattgggatctttccgggacaactgttattcttggtgctgttgctgtagcagtgttgggaagtcgttgcaatgctgttactgttatggttttaaatttggccgccactccaattgagctaagcttgatcgtccctttcttgcgtttgggggaaaccatcactggcagtgggcacttccccttgacagccaacgcattgaagaatgttctcactggtcatgcatcaaaggatgtgctgctgagcatcgtcaatgcgatgctgggttggcttattgctgcaccatttgtacttgccgtgctgtacgctgtttcgttcccttgtttcaaggtcctggttaacaggtttggcagcattccttcgagccccaggaccccactcaaggcggtgtaggtagtgtgtagcatgctgaatgctcctgaaattgtgtacaccaaattctttgtgatgccgttgggttgagatgggttccggcgtcatgttgctcggccatcccaggcactggcgaataaatccgacttgagaggcacgtgtcctctataattctgtatgctggcttggtaatcatatagtgagatgtgtatttatgaatttacaaactcttcatgaataaagccatgtttggataaaggattaaa

SEQ ID NO: 2512 - DNA, 3331 bp, Panicum virgatum
acaacacagtgcgcgaacggagtaaagaaagcgcaccagcgcggcactcgccctcgagctccgaaaaggaggagaaaaaaattctccatttccccactcgctcgctcgctcgtcagtgagagtgtgcgtgctggggctacgctagggtttccgcgagcgcgaggccgagcgccggcgatccggagcccgatccggcgcgggcgaaccgggtcccccggggcgcggagcggagatgaagtcgtcgctgcggaagctgcggggcttcgcgctgcagcggcacgagcagcgggtggacagcgaccgcggccggggccactccaccgccgccgtggctgcggcggacgagctcctcttggctgcccaggatatggcagatatgaggagctgttatgataacttactttctgttgccgcagcaattgcaaatagtgcatatgagttctctgaagcccttcaagaaatgggaacttgtttgattaaaagggttacgccaaataaggatggcataaatgataaggttttactgttgctcgggaaatcacaatttgaacttcggaaacttgtagatagttatcgtgtgcatgttcttaataccatcaccactccatcacagtcccttctgaatgagcttcaaaccgtggaggtaatgaagcgtcagtgtgatgaaaagagagaattgtacgagttcatgctaaatgcgcagaaagaaaggggaagatctaagggtgctaaaggtgatacaggagcatcagagcaactgaaacaagctcaggaagattatcaagaggaagcaactctttttctattccggttaaaatcattgaagcaagggcagttccgaagtcttttcactcaagctgccaggcatcatgctgcacagctaaatttgttcagaaaggggctcaagtcccttgaggctgtagagccacatgttaggcttgctgctgagcagcaacacattgaccatcagttcagtgcacttgaggaggaggattactttgttgaggatgaaaatgatgatgattacaatgacagtcatgatggagagctgtcttttgattatggagaaaataaagaagtcgaggaatctgttaatgcttccaggagtcatacagaggatttttttaatagaaccaaagaagagtattcttctattccacgtgaaagacaaagaattgtcagtcagtcagcaccactttttcctgagaaaaagctcgaaacagaagataaaataaaagatttgcggcgttccgcaacaaggaagttaaacacttatgttttgcctactccaaatgatgttcgagctacttctcagatagtttcaggaaatcctacttctgggcctctcgacagcagaggtgcctttccatctcctccccacccatctgcagaaatgggagatttgagagacaataaactacatagtcctgcaagattatctaatgcacagtctgtgctgaaagagagcaatatcaatactgcagaaacaaggaaactactcccagtgggtgatatggccttacctggctattatgacttgaagacttctgataataaaaaggttaagagagggtcattttccggcccaatagcttccagaccacggtccacagagaacattgatgttctttctgcagcgcccaggcacagctctgcgcatcagccaattcatgttagagtatcccccggcaactcaccgccgcctatttcctcaccgaaaataaaggagcttcatgagcttcctcgaccgcctgttaattcatcaaaacatacagcttttcccagtttggttgctcactctgccccgttggtaccaaattctgcctcattggtgcccaaagtccaagaccattttagggcaagacaaacaccaccaagtaccgcatcgcctttaccaactccaccaacaccacctgggcctatagcccgtagtttctctataccttctcggggcatgagaacagatagtaaagagacagaagagcatcaggataagggagctgccagaatgagcctttcttctcttccttcaacgcaaacattcttggaagatcgtcagccattgtcagcagctgcagaatcagttagcaaaacatagggtatttggtgctgaggtggattattacttattatcaagtggctcgctggaggaatgttgtacatattagcatgtgaactcagccagaatcgggaagtagttggtatttcgtgtgccctttggttaagatgtagtctgtgcaaataacgggtttgcgttaataaatccccatttttctcaccgattgattgattgattgacgcgagatttgttgtcgttgccctcattatttgcaatgaagcaagttctgagcgccatctgttttctgcagcttatgtaattatcacctggtttcctctgcttatgtaattatcatcagtttccccactgatcaacattcgaacaatctctggatgtttagggaaatcctggttccctctctataggatattggctgagaaaaaaacggacagaagggctttgttgttgttgcattggctcaaaattgaaggctagtttggctccacatttacctccacaggacattatcttgactaccagcacattctatcttttggccttgtgaaccatgtgaagctaaacaaacaagagtagtgttcattgctcaataaatggtttacttcccagttctatgagatgctgtgctaaatccacccggagctttggttggggaattgtccaagatgcaccaaacgttagtcagcagaggaggtttttttttttatttttttggaaaagcacaccagagaagattttgaacgggccaagggaaggcacggaattcatgctgcctagtaacctgcaagtccaaaacgccagcaggaaaggcgccgaacatccacattcgatgcccaccaaactagtagaagttacagcacgagcacgaccctgggtgcggttctgccacaactccatcagatacgactctgaaagtcgtgagattccacgacgacccggcgattctgacacaaccacgacccaccacggctgcgcgaccccggcgagtcagtatcacggatcctcagcgcagctcgcgaccgtgcgagctgcgcaagacgacgacaccggcggcgcccaccggccgccgcacctcgtcaccgtcgcgccagacgacggccatgcgactcgcgcgccttgatcacacgcctcctcgatcatgaacagcagcagacgacgctgggcctgccacggttcgggttcaggtaccgtaccactcggcactaccagaagtgcaagctttcccaccatcctgaagctggtgccctaattagt

SEQ ID NO: 2513 - DNA, 2345 bp, Panicum virgatum
gagctccgaaaaggaggaaaaaaggaattctccatttccccactcgctcgtcagtgagagtgtgcgtgctgggctagccgctagggtttccgcgagcgcgagcccgagcgccggcgacccggggctcgatccggcgcgggcgaaccgggtccccgtgggggcggagcggagatgaagtcgtcgctgcggaagctgcggggcttcgcgctgcagcggcacgagcagcgggtggaccgcgaccgcggccggggccactccaccgccgccgtggcggcggcggacgagctcctcttggcttcccaggatatggcagatatgaggagctgttatgataacttactttctgttgccgcagcaattgcaaatagtgcatatgagttctctgaagcccttcaagaaatgggaacttgtttacttaaacgggttacaccaaataaggatggaataaatgataaggttttgctgttgctcgggaaatcacaatttgaacttcggaaacttgtagatagttatcgtgtgcatgttcttaataccatcaccactccatcacagtcccttctgaatgagcttcaaaccgtggaggcaatgaagagtcagtgtgatgaaaagagagaattgtacgaattcatgttaaatgcacagaaagaaaggggaagatctaagggtgctaaaggtgatacaggagcatcagagcaactgaaacaagctcaggaagattatcaagaggaagcaactctttttctattccggttaaagtcattgaagcaagggcagttccgaagtcttttcactcaagctgctaggcatcatgctgcacagctaaatttgttcagaaaggggctcaagtcccttgaggctgtagagccacatgttaggcttgctgctgagcagcaacacattgatcatcagttcagtgcacttgaggaggaggattactttgttgaggatgaaaatgatgatgattacaatgacagtcatgatggagagctgtcttttgattatggagaaaataaagaagtcgaggaatctgttaatgcttccaggagtcatacagaggatttttttaatagaaccaaagaagagtattcttctattccacgtgaaagacaaagaattgtcagtcagtcagcaccactttttcctgagaaaaagctcgaaacagaagataaaataaaagatttgcggcgttccgcaacaaggaagttaaacacttatgttttgcctactccaaatgatgttcgagctacttctcagatagtttcaggaaatcctacttctgggcctctcgacagcagaggtgcctttccatctccgccccacccatctgcagaaatgggagatttgagagacaataaactacatagtcctgcaagattatctaatgcacagtctgtgctgaaagagagcaatatcaatactgcagaaacaaggaaactactcccagtgggtgatatggccttacctggctattatgacttgaagacttctgataataaaaaggttaagagagggtcattttccggcccaatagcttccagaccacggtccacagagaacattgatgttctttctgcagcgcccaggcacagctctgcgcatcagccaattcatgttagagtatcccccggcaactcaccgccgcctatttcctcaccgaaaataaaggagcttcatgagcttcctcgaccgcctgttaattcatcaaaacatacagcttttcccagtttggttgctcactctgccccgttggtaccaaattctgcctcattggtgcccaaagtccaagaccattttagggcaagacaaacaccaccaagtaccgcatcacctttaccaactccaccaacaccacctgggcctatagcccgtagtttctctataccttctcggggcatgagaacagatagtaaagagacagaagagcatcaggataagggagctgccagaatgagcctttcttctcttccttcaacgcaaacattcttggaagatcgtcagccgttgtcagcagctgcagaatcagttagcaaaacatagggtatttggtgctgaggtggattattacttattatcaagtggctcgctggaggaatgttgtacatattagcatgtgaactcagccagaatcgggaagtagttggtatttcgtgtgccctttggttaagatgtagtctgtgcaaataacgggtttgcgttaataaatccccatttttctcactgattgattgattgattgacgcaagatttgttgtcgttgccctcatttgcaatgaagcaagttctgagcgccatctgttttctgcagcttatgtaattatcacctggtttcctctgcttatgtaatt

SEQ ID NO: 2514 - DNA, 2871 bp, Panicum virgatum
cgaacgaagtaaagaaagcgcaccagggcggcactcgccctcgagctccgaaaaggaggaaaaaaggaattctccatttccccactcgctcgtcagtgagagtgtgcgtgctgggctagccgctagggtttccgcgcgcgcgagcccgagcgccggcgacccggggctcgatccggcgcgggcgaaccgggtccccgtgggggcggagcggagatgaagtcgtcgctgcggaagctgcggggcttcgcgctgcagcggcacgagcagcgggtggaccgcgaccgcggccggggccactccaccgccgccgtggcggcggcggacgagctcctcttggcttcccaggatatggcagatatgaggagctgttatgataacttactttctgttgccgcagcaattgcaaatagtgcatatgagttctctgaagcccttcaagaaatgggaacttgtttacttaaacgggttacaccaaataaggatggaataaatgataaggttttgctgttgctcgggaaatcacaatttgaacttcggaaacttgtagatagttatcgtgtgcatgttcttaataccatcaccactccatcacagtcccttctgaatgagcttcaaaccgtggaggcaatgaagagtcagtgtgatgaaaagagagaattgtacgaattcatgttaaatgcacagaaagaaaggggaagatctaagggtgctaaaggtgatacaggagcatcagagcaactgaaacaagctcaggaagattatcaagaggaagcaactctttttctattccggttaaagtcattgaagcaagggcagttccgaagtcttttcactcaagctgctaggcatcatgctgcacagctaaatttgttcagaaaggggctcaagtcccttgaggctgtagagccacatgttaggcttgctgctgagcagcaacacattgatcatcagttcagtgcacttgaggaggaggattactttgttgaggatgaaaatgatgatgattacaatgacagtcatgatggagagctatcttttgattatggagaaaataaagaagtcgaggaatctgttaatgcttccaggagtcatacagaggaattttttaatagagccaaagaagagtattcttctattccacatgaaaggcaaagaattgtcagtcagtcagcaccactttttcctgagaaaaagctcgaaacagaagataaaataaaagatttgcggcgttcggcaatgaggaagttaaatacttatgttttgcctactccaaatgatgttcgagctacttctcagatagtttcaggaaatcctacttctgggcctctcgacagcagaggtgcctttccatctccgccccacccatctgcagaaatgggagatttgagagacaataaactacctagtccggcaagattatctaatgcacagtctgtgctgaaagagagcaatatcaataccgcagaaacaaggaaactactcccagtgggtgatatggccttacctggctatcatgacttgaagacttctgataataaaaaggtgaagagagggtcattttccggcccaatagcttccagaccacggtccacagagaacattgatgttctttctgcagcacccaggcacagctctgcacatcagccaattcatgtcagagtatcccctggcaattcaccgccacctatttcctcaccgaaaataaaggagcttcatgagcttcctcgaccgcctgttaattcatcaaaacatacagcttttcccagtttggttgctcactctgccccgttggtaccaaattctgcctcattggtgcccaaagttcaagaccattttagggcgagacaaacaccaccaagtaccgcatcacctttaccaacaccacctgggcctatagcccgtagtttctctataccttctagaggcatgagaacatcaagtatttcagatagtaaagagacagaagagcatcaggataagggagctgctagaatgagcctttcttctcttccttcaacgcaaacattcttggaagatggtcagctgttgtcagcagctgcagaatcagttagcaaaacatagggtatttggtgctgaggtggattattacattatcaagtggctcactggaggaatgttgtacatattagaatgtcaactcagccagaatcgtgaagtagttggtatttcgtgtgccctatggttaagatgtagtctgtgcaaataacgggtttgcggaaataaatccccatttttctcaccggttgattgattgacgcgagatttgctgttgctgccctcattatttgctctgaagcaagttctgagcgccatctgttttctgcagcttatgtaattatcacctggtttcctctgcttatgtaattatcatcagttttcccctgatcaacattcgaacaatcactgtggaagggtagggaaatcctggttccctctctataggattttgcctgaggggcaaaaaaaagagagaaggcctttgttgttgttgctgcattggctcaaaattgaaggctagtttggttccacatttacctccccaggacagaatcttgactaccagctggttctctcttttggccttgtgaatcatgtgaagctgttttggaactatagcattttcgttgttatttgccaattaatattcaatcatgaactaattaggtttaaaagatgtctcgtcatttacagttaaattgtgtaattagttatttttttcaactgtatttaatgttctatgcatgtgtctgaagatttgattcgatagatactgtagaaatttttttggaaactaaacaccgagtaatgttcattgctcaataaatggtttgcttcccagttctggataga

SEQ ID NO: 2515 - DNA, 2586 bp, Sorghum bicolor
cagcacccgcactcgagctcggaaaaggaggaaaaaagaattctccatttccccactcgctccctctctcccgctcgtcagtgggagtgtgcgtgcggggctagcgccgctagggtttcttccgcgagcccaccatcgccggccggccgcgggcgatctgggtctcgatccggcgcccgccctaactcgggttcgcggggcgcaaggccaagggcgcgaggacatgaagtcgtcgctgcggaagctgcggggcttcgcgctgcagcgccacgagcagcgggtggaccgggaccgcggtggccggggccactccaccgccgccgccgccacggcggcggacgagctcctcgcggctgcccaggatatggctgatatgaggagctgttatgataacttgctttctgttgctgcagcaattgcaaatagtgcatatgagttctctgaagcacttcaagaaatgggaacttgtttgcttaaaagagttacgccaaataaggatggaataaatgataaagttttgctgttgcttgggaaatcacaatttgaacttcggaaacttgtagatagttatcgtgtgcatgttcttaataccatcaccactccatcgctgtcgcttcttaatgagcttcaaactgtggaggaaatgaagcgccaatgtgatgaaaaaagagaattgtacgaattcatgctaaatgcgcagaaagaaaaggggaggtctaagaatgctaaaggtgataatggagcatcagagcaattgaaacaagctcaggaagattatcaagaggaagcaactctttttctattccggttgaagtcattgaagcaaggacagttccgaagtcttttcacacaagctgctcgccatcatgctgcacagctaaatttgttcagaaagggtgtcaagtcccttgaggctgtagagccacatgttaggcttgctgctgagcagcaacacattgatcatcagttcagcgcacttgaggaagaagattaccttgttgaggatgagaatgatgatgattacaatgacagtcatgatggagagttgtcttttgattatggagaaaataaggaagctgaggaatctggcaatgtttctaggaatcatacagaggaattttttaataggagcaaagaagagtattcttctgttccacatgaaagacaaagaatcgtaagtcagtcagcaccactttttcctgagaaaaagctcaatacagaagagagaataaaagatttgcggcgttctgcgacaaggaagttaaatacttatgttttgcctactccaaatgacgttcgagctacttctcagatagcatcaggaaatcctacttctggaccactcgagagcaaaggtgccttccactcatctccactccacccatctgcagacaataaactacctagtcctacaagattgtctaatgtacagtctgtgctgaaagagagcaacaccaatacagcagaaacaaggaaagtactcccagtgtctgatctggctttacctgggtattatgacttgaagacttctgacaacaaaaaagtgaaaagagggtcattttctggcccaatagcttccagacctcggtcaacagagaacattgatgttatttctgcagcgcctaggcatagctctgcacatcagccagtgcacatgagagtatcccccggcaactcgccaccacccatttcctcaccgaagatcaaggaacttcatgagcttcctcggccacctgttaatgcatcaaaaaatacaacatttcccagtttagttgcccactctgccccattggtaccaaatcctgcatctttgacacccaaagttcaagatcattttagggcaaggcaaacactgccaagtactgcttcacctttaccaactccaccgcctggatctatagcccgcagtttctctataccttctagggggagaacatcaggtatttcagacagtaaagagacagatgatcagcaagacaagggagctgccagaatgagcctttcttctcttccttcagcagaaacattcttggaagatcgtcagccgttgtcagcagctgccgaatcggttagcaaaacataggagtattaagtgtgaaggtggattattatcattatcaaaatggcttgctgagccctcttcctggaagaatgttgtacatattagcatgtgaactctggccagtatcgcggaagtagttggtgtttcgcgtgccctttggttaagatgtagtctttgcaaataatgggtttgcggaaataaaatccccatttttcccaccgattgattggcgcgagatttgttgttgtgcccttgaacttgtttgccttgaagcgagttcagagtgcctgccatctgttttccgcagtagacctgggtttcttgtgcttatgtaattatcacctggtttcctgtgcttatgtaattatcatctgtttcaccacccccaagggctgtgttgccgtattggctctacatagacctgggttcggtttggctccacaattgctacttcatgactcggcgaacagcaacgttttgtcaattatgttgtctcctttttgacctcgtacagagatacgctg

SEQ ID NO: 2516 - DNA, 2386 bp, Saccharum officinarum
ttccccactcgctctctcgctccctctccctctctcccgctcgtcagtgggagtgtgtgtgcggggctactagcgccgctagggtttccgcgagcccatcgccggacgccggccggccgcgggcgatctggggctcgatctcgcgcccgccctgactcgggttcgcggggcgaggacatgaagtcgtcgctgcggaagctgcggggcttcgcgctgcagcgccacgagcagcgggtggaccgggaccgcggtggccggggccactccgccgccgccgccgccacggcggcggacgagctcctcgcggctgcccaggatatggcagatatgaggagctgttacgataacttgctttctgttgctgcagcaattgcaaatagtgcatatgagttctctgaagcacttcaagaaatgggaacttgtttgcttaaaagagttacaccaaataaggatggaataaatgataaagttttgctgttgcttgggaaatcacaatttgaacttcggaaacttgtagatagttatcgggtgcatgttcttaataccatcaccactccatcgctgtcgcttcttaatgagcttcaaactgtggaggaaatgaagcgccaatgtgatgaaaaaagagaattgtacgaattcatgctaaatgcgcagaaagaaaagggaaggtctaagaatgctaaaggtgataatggagcatcagagcaattgaaacaagctcaggaagattatcaagaggaagcaactctttttctattccggttgaagtcattgaagcaaggacagttccgaagtcttttcacacaggctgctcgccatcatgctgcacagctaaatttgttcagaaagggggtcaagtcccttgaggctgtagagccacatgttaggctcgctgctgagcagcaacacattaatcatcagttcagcgcacttgaggaagaggattaccttgttgaggatgataatgatgacgattacaatgacagtcatgatggagagttgtcttttgattatggtgagaataaggaagctgaggaatctgacaacgcttctaggaatcatacagaggaattttttaacagaagcaaagaagagtattcttctgttccacatgaaagacagagaatcgtaagtcagtcagcaccacttcttcctgagaaaaagctcaatacagaagagagaataaaagatttgcggcgttctgcgacaaggaagtcaaatacttatgttttgcctactccaaacgacgttcgagctacttctcagatagcatcaggaaatcctacttctggacctctcgagagcaaaggtgccttccattcatctccactccacccatctgcagacaataaactacctagtcctacaagattgtctaatgtacagtctgtgctgaaagagagcaacaccaatacagcagaaacaaggaaagtactcccagtgggtgatctggctttacctggctattatgacttgaagacatctgacaacaaaaaagtgaaaagagggtcattttctggcccaatagcttccagaccacggtcaacagagaacattgatgttatttctgcagcacccaggcatagctctgcacatcagccagtgcacatgagagtatcccccggcaactcgccaccacccatttcctcaccgaagatcaaggaacttcatgagcttcctcgaccacctgttaatgcatcaaaaaatacaacatttcccagtttagttgcccactctgccccattggtaccaaatcctgcatctttggcacccaaagttcaagatcattttagggcaagacaaacactgccaagtactgcttcacctttaccaactccaccgcctggatcaatagcccgcagtttttctataccttctagggggagagcatcaggtatttcagacagtaaagagacagaagatcagcaagacaagggtgctgccagaatgagcctttcttctcttccttcagcacaaacattcttggaagattgtcagccgttgtcagcagctgccgaatcggttagcaaaacataggtattcagtgtgaaggtggacggattattatcattatcaagcggcttctgagcccgcttcctggaagaatgttgtacatattagcatgtgaactctggccagtatcgcggaagtagttggtgtttcgcgtgccctttggttaagatgtagtctgtgcaaataatgggtttgcggaaataaaatccccatttttctcaccgattgattgattgattgacgcgagatttgttgctgtgcccttgaacttgtttgccttggagcgagttcagagtgccatctgttttctgcagcttatgtaattatcacctggtttcccgtgcttatgtaattaattatcatctgtttcacc

SEQ ID NO: 2517 - DNA, 2233 bp, Zea mays
gggaggaaaaaagaattctccacttccccactctccctctcccgctcgtggctcgtcagtgggtgggagtgtgcggggctagccgctagggtttccgcgagcccatcgccggccggccacggacgatccgggactccatccggcgcctgccctgaatcggcttcgcggggcgcaaggagcgagagaatgaagtcgtcgctgcggaagctgcggggcttcgcgctgcagcgccaggagcagcgggtggaccgggaccgcggccggggccacgccaccgccgccgccaccgcggcggacgagctcctcgcggctgcccaggatatggcagatatgagaagctgttacgataacttgctttctgttgctgcagcaattgcaaatagtgcatatgagttctctgaagcacttcaagaaatgggaacttgtttgcttaaaagagttacgccaaataaggatggaataaatgataaagttttgctgttgcttgggaaatcacaatttgaacttcggaaacttttagatagttatcgtgtgcatgttcttaacaccatcaccactccatcgctgtcgcttcttaatgaacttcaaactgtggaggaaatgaagcaccaatgcgatgaaaaaaaagaattgtatgaattcatggtaaacacgcagaaagaaaagggaaggtctaagaatgctaaaggtgataatggagcatcagagcaattgaaacaagctcaggaagattatcaagaggaagcaactctttttctattccggttgaagtcattgaagcaaggacagttccgaagtctttttacacaagctgctcggcatcatgctgcacagctaaatttgttccgaaagggagtcaagtcccttgaggctgtagagccacatgttaggctcgctgctgagcagcaacacattgatcatcagttcagcgcacttgaggaagaggattaccttgttgaggatgaaaatgatgacgattacaatggcagtcatgatggagagttatcttttgattatggagaaaataaggaagttgaggaatctggtaatgcttctaggaatcatacagagggtttttttaacagaagcaaagaagagtattcttctgttccacatgaaagacaaagaatcgtaagtcagtcagcaccactttttcctgagaaaaagctcaatacagaagagagaataaaagatttgcggcgttctgcaacaaggaagttgaatacttatgttttgcctactccaaatgacgttggagctacttctcagagagcatcaggaaatcctacttctgaacctctcgagagtaaaggtgccttccattcatctccactccactcatctgcagacataagagatttgggagacagtaatctacctagtcctacaagattgtctaacgtacagtctgtgctgaaagatagcaataccaataaaacagaaacaaggaaagtactcccagtgggtgatctggctttacctagctatcatgacctgaagacttctgataacaaaaaagtgaaaagagggtcattttctggcccaatagcttccagaccacggtcaacagagaacattgatgttatttctgcagcgcctaggcatagctcagcacatcagccagtgcacatgagagtatcccccggcaactcgccgccacccatttcctcaccgaagatcaaggaacttcatgagcttcctcgaccacctgttaatacatcaaaaaatatagcattccccagtttagttgcccactccgccccattggcaccaaatcctgcatctttgactcccaaagttcaagatcattttaggacaaaacaaacgctccaaagaactgcttcacctttaccaactccaccacctggatctatagcccgcagtttttctataccttctaggggtatttcagacagtaaagagacagaagatcaacacaagggagctgccagaatgagtctttcttctcttccttcagcacaaacattcttggaagatcgtcagccattgtcatcagctgctggatcggtcagcaaaacataggagtattctctattatcattatcaagcagctcgccgagccctcttcctgaaagaatgttgtacatattagcatttgaactctggccagtatcgcggaagaagttggtgtttcgcgtgccctttggttggttaagatgtagcctgtgcaaataatgggttctgcggaaataaaatccccatttttctcacc

SEQ ID NO: 2518 - DNA, 2070 bp, Zea mays
gggttcgcgggggcgcggacatgaagtcgtcgctgcggaagctgcggggcttcgcgctgcagcgccacgagcagcgggtggaccgggaccgcggccgcggccactccaccacggcggcggaggagctcctcgctgctgcccaggatatgacagatatgaggagctgttacgataacttgctttctgttgctgcagcaattgcaaatagtgcatacgagttctctgaagcacttcaagacatgggggcttgtttgcttaaaagaattacaccaaataaagatggaatcaatgataaagttttgctgttgcttgggaaatcacaatttgaacttcggaaacttgtagatagttatcgtgtgcatgttcttaatacgatcaccactccatcactgtcgcttcttaatgagcttcaaaccgtggaggaaatgaagcgccaatgtgatgaaaaaagagaattgtacgaattcatgctaaatgctcagaaagaaaagggaagatctaagaatgctaaaggtgataatgtagcatcagaacaattgaaacaagctcaggaagattatcaagaggaagcgactcttttcctattccggttgaagtcattgaagcaaggacagttccgaagtcttttcacacaagctgctcggcatcatgctgcacagctaaatttgttcagaaagggggtcaagtcccttgaggctgtagagccacatgttaggctcgctgctgagcagcaacacattgatcatcagtttagcgcacttgaggaagaggattatgttgttgaggatgagaatgatgacgagtacaacgacagtcatgatggagagctgtcttttgattatggagaaaataaggaaactgagaaatctggtatcgcttctaggaatcatacagaggatttttttaacagcagcaaagaagattattcttctgttccacatgaaagacagagaattgaaagtcagtcagcaccgctttttcctgggaaaaaggtcaatacagaagagagaataaaagatttgcggcgttctgcgacaaggaagttaaatacttatgttttgcctaccccaaatgatgttcgagctacttctcagatagcatcaggaaatcctatttctggacctctcgagagcaaaggtgccttccattcatctccactccacccttctgcagacataagagatttgagagacaataaactacctagtcctgcaagattgtctaatgtacagtctgtgctgaaagagagcaataccaatacagcagaaacaaggaaagtactcccagtgggtgatctcgctttacctggctattatgacctgaagactctcgacaacaacaaagtgaaaagagggtcattttctggcccaatagcttctagaccacggccaacagagaacaatgatgttatttctgcagcacccaggcatagctctgcacatcagccagtgcacatgagagtatcccccggcaactcgccgccacccatttcctcaccgaagatcaaggagcttcatgagcttcctcgaccgcctgttaatacatcaaaaaacacaacatttcccagtttggttgcccactcggccccattggtagcaaatcctgcatctctgacacccaaagttcaagaccattttagggcaagacaaatgcttcccagtactgcttcacctttaccaactccaccgcctggatccatatcccgcagtttttctataccttctagggggagaacaggttcagacggtaaggagatagaagatcagcaagacaagggagctgccagaatgagcctttcttctcttccttcagctcaaacattgttggaagatcgtcagccattgtcagcagctgctggatcggttagcaaaacataggagtattcactgcgaaggtggattactatcattatcaagcggcttgctgagcccttcctggaagaatgctgtacatattagcatgtgagccctggccagtatcgcggaagtagtaggttgtttctcgtgccctttggctaaggtgtagtctgcagatagtgggtttgcggaaataaattcccccaattttctc

SEQ ID NO: 2519 - DNA, 2591 bp, Oryza sativa
ctgtgccaagcatggtttggcagtcttgcctacaattactccttaattaagtcaccataaacacggcgcgccattaggggattaaagaaagcgcaacagtacgccactcgcactcgagcccggaaagaaagaggcaaaaaaaaaaaaaagaattccccatttccttctctctctctctctcatctctctcagtgaggagtggtggtgtagctaagctagggtttcgctcggaatcagggttcggtttcctccaccggaattggcggcgatctggagctcggcacggcggcgcgcggcgtgatccggacgctcgggtaggtgagggagggagggaggagatgaagtcgtcgctgcggaagctgcggggcttcgcgctgcagcgccacgagcagcgggtggaccgccgcgggggccactccccggccgccgccgccgccgcgaacgagctcctcgccgcctcgcaggatatggcagatatgaggagctgttatgacaatctgctttctgttgcagcagcgattgcaaatagtgcatatgagttctcagaagcactgcaggaaatggggacttgtttacttaaaagagtcacaccaaacaaggacgggattaatgataaagttttgctgttgcttggaaaggcccagtttgaactgcggaagcttgtagatagttatcgtgtgcatgttcttaataccatcaccactccatcacagtcccttctcaatgaacttcaaactgtagaggaaatgaagcaccagtgtgatgaaaaaagagagttgttcgaatttctgctgaatgcacagaaagaaaagggaagatctaagaatgccaaaagtgacattggtgcgtcagagcaattgaaacaagctcaggacgattatcaagaagaagcaactctttttctattccggttaaagtcattgaagcaaggacagttcagaagtcttttcacacaagctgctcggcaccatgctgctcagctaaatttattcagaaaggggctcaaatctcttgaggctgtagagccacatgttaggcttgctgctgagcagcaacacattgaccatcagttcagtgcacttgacgaggaggattactctgtggatgaagaaaatgaggatgattacaatgacagtcatgaagatttatcctttgattatggagaaaataaggaaggcacagaagctggtcatgcttccaggagccctacagaggaacttcttgacagaagcaaagcagagtattcctcttttcctggtgaaaggcagagatctggaagtcagtcagccccactttttcctgaaaaaaaacttgaggcagcagagagaataaaagagttgcggcgttctgctacgaggaagctatatacttatgttttgcctactccaaatgatgttagagacacctctcagacagttacagcaaatcctactagtggatctcctcttggaaacaaaggtgcattctattcatctccactccagccaagtacaaatgtgggagatttgagagacaataagctaccaagtcctaccagattatctaatgcacattcagttttgaaagagagcaataccaatactacagacaccaggacaatgcttgtgctccctttgggtgatctctctttacctggttatcatgactcgaaggcttctgacaacaaaaaggtgaagagaggatccttttctggtcctattgttcccaggtcaaggtcaacagagaatattgatgttgtttctgtaccacctaggcacagctcttcacatcagccgtcaatacatgtcagagtttctcccaatacctcgccaccactgttgtcctcacctaaaatcaaggagcttcatgagcttcctcggccacctgctaatgcatcaaaacatacaacatttcccagtttagtcgcccactctgcaccgttggtgccaaattctgctcctttggcacccagaggccaggatcattttaggccgaggcaaacaccaccaagtgctccccaaactgcatcacctttaccgacaccacctgggcctatatcccgcagtttttcgataccttctaggggcatgagaacatcaggtatttcagatggtaaagagacagaagatcttcaggataaagggcctgccagaatgagcctttctagtcttccttcagcacaaacatcgttggaggatcatcggccattgtcaggagctaccgagtcagttagcaaaacataggaatatttggtgttgaggtgaaagtttatttatcaaggggctcagctatctcgccatggaagaatattgtacatattagtatgtgaactcggccaatattgcaaattagttggtgtttcgtttgtatcccccatggttaagatgtaattgtgcaaataacgagttgtggaataaaatctccatttttctctccgattaattgatgtaagatttgtttgttgtgcccttgagatgacttgaatgccacctgttttccactgctcatgtaagcatcctccatcttaatttttaacatgagggagtcaattttgccaaaaaagaaaaacactagtgctgttattcatggaatctgcatgtatcatttatcac

SEQ ID NO: 2520 - DNA, 2343 bp, Avena sativa
cggcgcggggggtctgcagctagggtttcccccctcccgcgaatccggctcggggtgccgcgatctggtctggaggctcggccggcgccgcctgatccggggcggggatgaagtcgtcgctgcggaagctgcgcgggttcgcgctgcagcggcacgagcagcgggtggaccgccaccgggaccactccacggcagccaaggcggccgacgagctcctcgccgccgcacaggatatggcagatatgaggaactgttacgataacctgctttccgttgcggcagcaatagcaaacagttcatatgagttctctgaagcactgcaagaaatgggaacttgtttagtgaagagagtcacaccaaataaagagggaattaatgataaggttttgctgttgctcgggaagtcgcagtttgaacttcggaaacttgtagatagttatcgtgttcatgttcttaataccattaccactccatcacagtcccttcttaatgagcttcaaactgtagaggaaatgaagcgccaatgtgatgaaaaaagagaattgttcgaatacatgctaaatgcgcagaaagaaaaggggagatctaagaattcgaaaggtgataatagtgcatcagagcaacaattaaaacaagcccaggatgattatcaagaggaagcaactctttttctatttctggttaaagtcattgaagcaaggacagttccgaagtcttttcacacaagctgctcggcaccatgctgcgcagctaaacttgttcagaaagggcgtcaagtctcttgaggctgtagagccacacgttaggcttgctgctgagcagcaacacattgatcaccagttcagtgcacttgaggaggaagattactctgttgaggatgaaaatgatgacgattacaatgacagtcatgatggagagctgtcttttgattatggagaaaataaggaggctacagaaggcggtcatgcttccaggagtcctacagaggaattttttgatagaagtaaaggagactattcctcttttgctagtgaaagacaaagacttgtaagtcagtcagctccacttttcctgagaaaaagcttgagacagcagaaagagtaaaagagtgcggcgttctgcaacgaggaagttaaatacttacgttttgcctacaccaaatgatgttcaagcaacctctcagacagctgcaggaaatcctactagtggatctcctgttgagagcaaaggtgcattccattcgtctccactcaacccaagtataaaagtgggagattttagagacaataagctaccaagtcctgccaggttatccaatgcacagtcagtgctgaaagaaagcaataccaataattcagaaataagaaagatgctcccagtgactgatctggctctaccaggctatcacgagctgaagatttcttccgacaacaagaaagcgaagagggggtccttttctggtccaatacctctccgtccaaggtcaactgagaatattgatgttatgtccgcagcgccaaggcacagctctgcacatcagccaacagttcatgtgagagtgtcccccagttcctcgccaccaccgttatcctcccccagaattaaggagcttcatgagctacctcgaccgcctagtagtgcatcaagaaatacagcatttcctagtctagtcgctcactctgccccgttggtaccaaattctgcccctttggcacctagaggccactcagggcaagatcattttaattttagggtcagacaaacaccaccaagtgctccacaaactgcatcgcctctaccaacaccacctgggcctatagcccgcagtttttctataccctctagaggcacgagaacaggtatttcagatggtaaagaaacagatgatcatcacgataaaggggctgccagaatgagcctctcttctcttccttcagcacaaaccgtcttagacgaccgtcaccctttgtcagcagctgccgagtcagctaacaaaacataggtgcacttggtgtgaatgtggaattttatcatatacgaagatgcttatctgaggggctcggcgacctattcgcagaagaatattgtacatactagtatgtgaagtcggcccatattgcaaagtagctggtgtttcgtgtccccctatggttgagaatgtagttgtgcaaataacgagttgtggaataaagtctccatttttcgctctgataactttatttgttctgtgcctgggcatgctgtccgtggcttcctctgttctcatggtaaaggaattttgagaaacatatgaggaagtctatactgatagtatttctcgtgctaaagaaattacgggtaaca

SEQ ID NO: 2521 - DNA, 2550 bp, Triticum aestivum
ttcctctccactctccgcctcccctccctcagtggcagacgctagtgctgtgggtgtgtgggggcgctacagctagggttccgctccgcgaatccgtcgccgtggtgctgcctgccgggatctgctgctgctgctgcttcggggctcggcggcggctgatccggcgggcgcgggatgaagtcgtcgctgcggaagctgcgcgggttcgcgctgcagcgccacgagcagcgggtggaccgccaccgcgaccactccaccgccgccaaggccgcggacgagctcctcgccgccgcccaggatatggcagatatgaggaactgctatgataacttgcttgccgttgcagcagcaatagcaaacagttcatatgaattctctgaagcactacaagaaatggggacttgtttactgaagagagttacaccaactaaagatggaattaatgataaggttttgctgttgctcgggaaatcgcagtttgagcttcggaaacttgtagatagttatcgtgttcatgttcttactaccattaccactccatcacagtccctacttaatgagcttcaaactgtagaggaaatgaagcgacagtgtgatgaaaaaagagaattgttcgaagtcttgctaaatgcgcagaaagagaaggggagatctaagaattccaaaggtgatcctgctgcatcacagcaattgaaacaagctcaggaagattatcaagaggaagcaactctttttctgttccggttaaagtcattgaagcaaggacagtttcgaagtcttttcacacaagctgctcggcaccatgccgcccagttaaatttattcagaaagggtgtcaagtctcttgaggctgtggagccacatgttaggcttgctgccgagcaacaacacatcgatcatcagttcagtgcacttgaagatgaggattactctgttgaagatgaaaatgatgacgattacaatgacagtcatgatggagaactctcttttgattatggagaaagtaaggaaactgcagaagctggtcatgcttcccgtagtcctacagaggaattttttgatagaagcaaaggagattattcctcttttcctggtgaaagacaaagacctgtaagccagtccgctccactttttcctgagaaaaagcttgagacagcagaaagagtaaaagagctgcggcgttctgcaacgaggaagttacatacttatgttttgcctactccaaatgatgttcaagccacctctcagacagtcgcgggaaatcctacgagtggatctcctatagagagcaaaagtgttttccattcatctccgctcaacccaagcacacatatgggagatttgagagacaataagctaccaagtcctgccagattatctaatgcacagtctgtgctgaaagaaagcaataccaatacagcagaaataaggacaatgctcccagctgttgatccggctttaccaggctataacaatttgaagacttcttctgacaacaaaaaagtgaagagggggtccttttctggtccgattcctctccgatcaaggtcaacagagaatattgatgctgccgccgcaaggcacagctctgcacatcagccaacaattcatgtgagagtgtcacccagttcctccccgccacccatatcctcacccagaattaaggagcttcacgagctaccacgaccgcccactggtgcgtcaagaaatacagcattttctagtttagtcgctcactctgcgccgttggtaccaaattctgccccgttggcatccagaggccacgcagggcaggaccattttaattttagggccaggcaaacaccaccaagtgctccacaaactgcatcgcctctaccaacaccgcctgggcctatatcccgtagtttctctataccctctaggggcattagaacaggtatttcagatggcaaagaaacagaagatcatcaagataaaggggccgctagaatgagtctctcttctcttccttcaacacaaacattcttggaggatcgtcaacctttgccagcagctgccgagtcagttagcagaacatagggatatttggtgttaaggtgggattttatatgatatataatatgtcatgctaatcgagaggcttggctactttttcgtggaaaaacaatgtacatactagtatgagaactaaacccatactgcaaagtagctggtggtggctggtgtcccttatggttgagtgtagttgtgcaaataacgagtttgttgaataaaattctccatttttcgctctgataattttatgcaagatttgtctgtgttgtgccacggcctgttctcaggcatcattttcgtcatcatgattgtcaagggattccggaattttgtctcgatgaagtgattttcatgaattgttgtaggattgctgtaaagaaacttgttttctgtaggataggtagatgtctaatggaatccttacatttgatctagcctcattaaacaaactttgcggagagttccagtgagtttatatctttattaatatggaacataaagacaaaaaaaaaa

SEQ ID NO: 2522 - DNA, 2086 bp, Pennisetum glaucum
tgaagcactccaagaaatgggtacttgtttgcttaaaagggttacgccaaataaggatggaatgaatgataaagttctgctgttactcgggaaatcacaatttgaacttcggaaacttgtagatagttatcgtgtgcatgttcttaataccatcaccactccatcacagtcccttcttaatgagcttcaaaccgtggaggtaatgaagcgccagtgcgatgaaaagagagaattgtacgaattcatgaggaatgcgcagaaagaaaagggaagatctaagagtgctaaaggtgatacaggagcatcagagcaattgagacaagctcaggaagattaccaagaggaagcaactctttttctgttccggctaaagtcattgaaacaaggacagttccgaagtcttttcacacaagctgctcggcatcatgctgcacagctaaatttgttcagaaaggggctcaagtcccttgaggctgtagaaccacatgttaggcttgcggctgagcaacaacacattgatcatcagttcagtgcacttgaggaggaggattactttgtcgaggatgaaaatgacgacgaatacaatgacagtcatgatggacggctgtcttttgattatggagaaaataaagaagctgaggaatctggtaatgctaccaggagtcatacagaggatttttttaatagaagcaaagaagagtattcttctataacacgtgaaagacagagaattgtcagtcaatcagctccactttttcctgagaaaaaacttgagacagaagagcgaataaaagatttgcggcgttctgcaacaaggaagttaaatacttatgttttgcctactccaaatgatgttcgagctacttctcagatagtttcaggaaatcctacttcgggacctctcgacagcagaggtcccctcccatctccgccccacacatctgcagatatgagagacaataaactacctagtcctacaagattatctaatgcacagtctgtgctgaaagagagcaacaccaataccgccgaaacaaggaaaacactcccagtgggtgatatagccttaccaggctattatgacctgaaggcttctgataataaaaaggtgaagagagggtcattttctggcccaatagcttccagaccacagtccacagagaacattgatgttctttctgcagcacctaggcacagctctgcacatcagccaattcatatcagagtatccccaggcaactcaccaccgcctatttgctcaccgaaaataaaggagcttcatgagcttcctcgaccgcctgttaatacatcaaaaaatacagcatttcccagtttggttgcccactcagccccgttggtaccaaattctgcctcatcggtgcccaaagtccaagaccattttagggcaagacaaacaccgccaagtacagcatcacctttaccaacaccaccaacaccacctgggcctatagcccgcagtttttccataccatctaggggcatgagaacatcaggtatttcagatagtaaagagacagaagagcaccaggataagggagctgcccgaatgagcctttcttctcttccttcagcgtaaacattcttggaagatcgtcagccattgtcagcagctgccgaatcagttagcaaaacatagggtatttggtatgcagaggtggattattacattatcaagtggctcgctggcgccgagctctcgtcctggaagaatgttgtacatattagcatgtgaactcagccagaatcgcgaagtagtcggtatttcgtgtgccctgtggttaagatgtagtctgtgcaaataacgggtttgcggaaataaaatccccattttcctcaccgattgattgattgacgcgagatttgttgttgtctgatttgaagcaagttctgggcgccaccagttttctgcaaggttatgtaaattatcacctggttccctcagcttatgtaattatcatcagtttcacccctgatcaaaattgaaacaatctctgtggaagggtagggaaatcatagttcccaccctgtaggaattgcctggagaaaagggaaaaatagaagggcc

SEQ ID NO: 2523 - DNA, 2240 bp, Hordeum vulgare
ccgggatctgctgctgcttcggggctcggcggttgatccggcgggcgcgagatgaagtcgtcgctgcggaagctgcggggcttcgcgctgcagcgccacgagcagcgggtggaccgccaccgcgaccactccaccgccgccaaggccgcggacgagctcctcgccgccgcccaggatatggcagatatgaggaactgctatgataacctgcttgccgttgcagcagcaatagcaaacagttcatatgaattctctgaagcactacaagaaatgggtacttgtttacttaagagagtgacaccaactaaagatggaattaatgataaggttttgctgttgctcgggaaatcgcagtttgaacttcggaaacttgtagatagttatcgtgttcatgttcttactaccattaccactccatcacagtccctacttaatgagcttcaaactgtagaggaaatgaagcgccagtgtgatgaaaaaagagaattgttcgaagtcttgctaaatgcacagaaggaaaaggggagatctaagaattccaaaggtgatcctgttgcgtcagagcagttgaaacaagctcaggaagattatcaagaggaagcgactctttttctttttcggttgaagtcattgaagcaaggacagtttcgaagtcttttcacgcaagctgctcggcaccatgccgctcagttaaatttattcaaaaaaggtgtcaagtctctcgaggctgtagagccacatgttaggcttgctgctgagcaacaacacatcgatcatcagttcagtgcacttgaagatgaggattactctgttgaagatgaaaatgatgacgattacaatgacagtcatgatggagaactttcttttgattatggagaaagtaaggaaactgcagaagctggtcatgcttcccatagtcctacagaggaattttttgatagaaacaaaggagattattcctcttttcctggtgaaagacaaagacctgtaagccagtcagctccactttttcctgagaagaagcttgaaacagcagaaagagtaaaagagttgcggcgttctgcaacgaggaagttacatacttacgttttgcctactccaaatgatgttcaagccacctctcagacaatcgcaggaaatcctacaagtggttctcctattgagagcaaaagtgtattccattcatctccgctcaacccaagtacacatatgggagctttaagagacaataagctaccaagtcccgccagattatctaatgcacagtctgtgctgaaagaaagcaataccaatacagcagaaataaggacaatgctcccagctgttgatccggctttaccaggctataacaatttgaagacttcttctgacaacaaaaaagtgaagagggggtccttttctggtccgattcctctccgatcaaggtcaacagagaatattgatgccgccgccgcaaggcacagctctgcacatcagccagcaattcatgtgagagtgtcacccagttcctccccgccacccatatcctcacccagaattaaggagcttcacgagctgccgcggccgcccactggtgcatcaagaaatacagcattttctagtttagtcgctcactccgcgccgttggtaccaaattctgccccgttggcatccagaggccactcagggcaggaccattttaattttagggccaggcaaacaccaccaagtgctccacaaactgcatcgcctctaccaacaccgcctggtcctatatcccgcagtttttctataccctctaggggcattagaacaggtatttcagatggcaaagaaacagaagatcatcaagataaaggggccgctagaatgagcctctcttctcttccttcagcgcaaacattcttggaggatcgtcaacctttgccagcagctgccgagtcagttagcagaacatagggatatttggtgttaaggtgggattttatatgatatataatatgtcatgctaattgagaggcttggctactttttcgtggaaaaacaatgtacatactagtatgagaactaaacccatattgcaaagtagctggtggggttggtgtccccctatggttgagtgtagttgtgcaaataacgagtttgttgaataaaattctccatttttcgctccgataattttatgcaagatttgtctgtgctgtgccacagcctgttctcaggcatcattttgatcatcatgaatggcaagggattccgga

SEQ ID NO: 2524 - DNA, 2231 bp, Triticum aestivum
ccacgcgtccggtgggggcgctacagctagggttccgctccgcgaatccgtcgccgtggtgctgcctgccgggatctgctgctgctgctgcttcggggctcggcggcggctgatccggcgggcgcgggatgaagtcgtcgctgcggaagctgcgcgggttcgcgctgcagcgccacgagcagcgggtggaccgccaccgcgaccactccaccgccgccaaggccgcggacgagctcctcgccgccgcccaggatatggcagatatgaggaactgctatgataacttgcttgctgttgcagcagcaatagcaaacagttcatatgaattctctgaagcactacaagaaatggggacttgtttactgaagagagttacaccaactaaagatggaattaatgataaggttttgctgttgctcgggaaatcgcagtttgagcttcggaaacttgtagatagttatcgtgttcatgttcttactaccattaccactccatcacagtccctacttaatgagcttcaaactgtagaggaaatgaagcgacagtgtgatgaaaaaagagaatgttcgaagtcttgctaaatgcgcagaaagaaaagggaagatctaagaattccaaaggcgatcctgctgcatcacagcaattgaaacaagctcaggaagattatcaagaggaagcaactctttttctgttccggttaaagtcattgaagcaaggacagtttcgaagtcttttcacacaagctgctcggcaccatgccgcccagttaaatttattcagaaagggtgtcaagtctcttgaggctgtggagccacatgttaggcttgctgccgagcaacaacacatcgatcatcagttcagtgcacttgaagatgaggattactctgttgaagatgaaaatgatgacgattacaatggcagtcatgatggagaactctcttttgattatggagaaagtaaggaaactgcagaagctggtcatgcttcccgtagtcctacagaggaattttttgatagaagcaaaggagattattcctcttttcctggtgaaagacaaagacctgtaagccagtcagctccactttttcctgaaaaaaagcttgagacagcggaaagagtaaaagagttgcggcgttctgcaacgaggaagatacatacttatgttttgcctactccaaatgatgttcaagccacctctcagacagtcacaggaaatcctacaagtggatctcctattgagagcaaaagtgttttccattcatctccgctcaacccaagcacacatatgggagatttgagagacaataagctaccaagtcctgccagattatctaatgcacagtctgtgctgaaagaaagcaataccaatacagcagaaataaggacaatgctcccagctgttgatcctgctttaccaggctataacaatttgaagacttcttctgacaacaaaaaagtgaagagggggtccttttctggtccgattcctctccgatcaaggtcaacagagaatattgatgctgccgccgcaaggcacagctctgcacatcagccaacaattcatgtgagagtgtcacccagttcctccccgccacccatatcctcacccagaattaaggagcttcacgagctaccgcgaccgcccactggtgcatcaagaaatacagcattttctagtttagtcgctcactctgcgccgttggtaccaaattctgccccgttggcatccagaggccacgcagggcaggaccattttaattttagggccaggcaaacaccaccaagtgctccacaaactgcatcgcctctaccaacaccgcctgggcctatatcccgtagtttttctataccttctaggggcattagaacaggtatttcagatggcaaagaaacagaagatcatcaagataaaggggccgctagaatgagcctctcttctcttccttcaacacaaacattcttggaggatcgtcaacctttgccagcagctgccgagtcagttagcagaacatagggatatttggtgttaaggtgggattttatatgatatataatatgtcatgctaatcgagaggcttggctactttttcgtggaaaaacaatgtacatactagtatgagaactaaacccatattgcaaagtagctggtggtggttggtgtcccctatggttgagtgtagttgtgcaaataacgagtttgttgaataaaattctccatttttcgctctgat

SEQ ID NO: 2525 - DNA, 2433 bp, Brachypodium distachyon
aaaaaacaattccccatttctcctctctctctgcctctccctctcagtggtagtggtgtgtcatagctagggttccctcgcgcgaatccgcctcggctcgtcgggctgccgccgcgatctggagcatcggttcggcggcgcctgatccggacttgcgggggcggggatgaagtcgtccctgcggaagctgcggggcttcgcgctgcagcgccaggagcagcgggtggaccgccaccgtgaccactcgaccgccgccaaagtggcggcggacgagctccttgcggctgccaaggatatggcggatatgaggagctgttacgataacttgcttgctgtcgcagcagcaatagcaaacagttcatacgagttttctgaagcattacaagaaatggggacttgtttactgaagagagtcacaccaaataaagaaggaattaatgataaggttttgctgttgctcgggaaatcgcaatttgaactccggaagcttgtagatagttatcgtgttcatgttcttagtaccattaccgctccatcacagtcccttcttaatgagcttcaaactgtagaggaaatgaagcgccagtgtgatgaaaaaagagaactgttcgaattcatgctaaatgcgcaaaaagaaaaggggagatcgaagaactcgaaaggtgatagtgcatcagagcaattgaaacaagctcaggaagattatcaagaggaagcaactctttttctattccggttaaagtcattgaagcaaggacagttccgaagtcttttcactcaagctgcccggcatcatgctgcccagctaaatttattcagaaagggtgtcaagtctcttgaggccgtcgagccacatgttaggattgctgctgagcaacaacacattgaccatcagtttagtgcacttgaggaggattgctctgttgaagacgaaaatgatgacgattacaatgacagtcatgatggagagctgtcttttgattatggagaaagtaaggaaggcacagaagctggtcatgcttccaggagtccttcagaggaattttttgacagaagtgaaaggcaaagacctgtaagtcagtcagctccactatttcctgagaaaaagcttgaggcagcagaaagagtaaaagagttgcggcgttctgcaacgaggaagttgaatacttatgttttgcctactccaaatgatgttcaagccacctctcatacagtttcagggaatcctacaagtggatctcatgtagagaccaaaggtgcattccattcatctccactcaaccagagtacaaatatgggagatttgagagacaataataagctaccaagtcctaccagattatctaatgcgcagtcagtgctgaaagaaagcaataccaatactgcagaaatcaaaacaatgctccctgtgagtgatctcgctttaccaggctatcatgagttaaagacttcttctgacaacagaaaagtgaagagagggtccttctctggaccaattcctccccgatcaaggtcaacagagaatattgatgttatttctgcaccgccaaggcacagctctgcacatcagccaacagttcatgtgagattgtcaccaagttcctccccaccacccatatcttcacccaaaattaaggagcttcatgagctaccacgacctccagccagtgcatcaaaaactacagcatttcctagtttagtcgctcactctgccccgttggtaccaaattctgcccctttggcacatagaggccacttagggcatgaccatttcaattttagggccaggcaaacaccaccaagcgctccacaaactgcatcgcctctaccaacaccacctgggcctatagctcgaagtttttctataccctctaggggcatgagaacaggtatttcagatggtaaagaaacagaagatcatcatgataaaggggctgccagaatgagcctctcttctcttccttcagcgcaaacattcttagatgatcgccagccttcctcagccgccgccgagtcagttagcaaaatatagggtatttggtgttaaccttgagttttacgatatatcacgctaggcagggaggcccagctactcttcctggaagaatattgtacatactagtatgtgaactcagctcatattgcaaaatggctgatgtttggtgtcccctatggtcaagaatgtagttgtgcaaataacgagctgtggaataaaatatccatttttctctgatctatttattcgttttgagccatggtgtgcgtccatgtctttcttctgttctcaacctgattcagggtccgttgcaacaaaggaattttggaggaaaacacaggaaattcctgctgatggtatttgggttttacgtttgtttcaaagaaacctctatgcatatgattaggagaagatcataagatttcttttacgaggtc

SEQ ID NO: 2526 - DNA, 1271 bp, Pennisetum glaucum
cccctccccaccggaatgccgggcggcctcatcctcctccctcctggcctcctcctcccacgtcctgacgccaaccgccgccccctccccaccggaatgccgggctgactgacggcggacgacagctcgacaccagggcgcgccgctagctgctctgggtggtgggtggatcccgcgcggcggagcgcggagccatggcgagcgacgtgcccatgagccccgagctcgagcaggtggacggcgagatccaggacatcttccgcgccctccaaaatgggttccagaagatggacaagatcaaggactccaacaggcagtccaagcagctggaggatctcaccggcaagatgagggaatgcaagcgactgatcaaagaattcgaccgcatactcaaagacgaggagaagaagaacactcccgatgtcaacaagcagttaaatgacaagaagcagttcatgatcaaagagttgaattcctatgtcaccttgaggaaaacgtaccaaagtagcctcggtaataagagaattgaattattcgacactggaaacgatcaagtggctgaggacaccccagttcaaatggcatcagaaatgtcaaatcaagaactcattagtgctggaaggagacaaatggaccaaactgaccaagctattgagcgttcaaaaatggttgtagcacaaactgttgaagttggagctcagactgctgcaactctgacacagcaaacagaacaaatgaaaagaatcggcaatgagcttgactctgttcacttctccctgaagaaggctagtcaaatggtgaaagagattggtcgccaggttgcaactgacaaatgcattatggcattcctgtttctgattgtctgtggcgttattgcaattattgttgttaagattgtcaacccgcacaacaagaacatcagggacatcccaggcctggcgcctcctgctatgaacaggaagctgctctccatcgaccctttcggaggactctgagcattacgaaatggctcttgcgagccacacataacacgattcattctcgcttgtatatttcctcattgtcggtgtctaacatcgatccattctttccccattggtgagtagtagcttgtgttcgttgcggcactcagtgttgtgtgtatcgctcgttatcatccccccggctttctggttgtctatgtgtatacgaggtagtgtatgtgagactgtgaatgtaaggtttcagatttttcatgggaatccactggtggtttgcgatgttaaaaaaaa

SEQ ID NO: 2527 - DNA, 1152 bp, Cenchrus ciliaris
ctgacggcggacgacagcccgacacgattttcggaggaggcgccgccgccgccgctgctctgagactgggaggtgggtggatcccgcctggcggagcgcggagccatggcgaccgacgtgcccatgagccccgagctcgagcaggtggacggcgagatccaggacatcttccgcgccctccaaaatgggttccagaagatggacaagatcaaggactccaacaggcagtccaagcagctggaggatctcaccggcaagatgagggagtgcaagcgattgatcaaagaatttgatcgcatattcaaagacgaggagaagaagaaccctcccgatgtcaacaagcagctaaatgacaagaagcagttcatgatcaaagagttgaattcctatgtcaccttgaggaaaacgtaccaaagtagccttggtaataagaggattgaattattcgatactggtaacgatcaagtggctgaggacacaccagttcaaatggcatcagaaatgtcaaatcaagaactcattagcgctggaaggaaacaaatggaccaaactgaccaagctattgagcgttcaaaaatggttgtagcacaaactgttgaagttggagctcagactgctgcaactctgacacagcaaacagaacaaatgaagagaatcggcaatgagcttgactctgttcacttctccctgaagaaggctagtcaaatggtgaaagagattggtcgccaggttgcaactgacaaatgcattatggcattcctgtttctgattgtctgcggtgtcattgcgataattgttgttaaggttgtcaacccgcacaacaagagcatcagggacatcccgggcctggcgcctcctgctatgaacaggaagctgctctccatcgaccctttcggaggactctgagcattgcgaatggctcttgtgagccacacataacacgaggccatgattcattctcgcttgtatattttctcgttgtcggtgtctacaacgatccattctttccgtattggtgagtagtagcctttttttgttcgtagcggcactcgtgttgtgtgtattgctcgtgatcaatcccccggctttctggttgtctgtgtatacgcggtagtgatgtgagattgtgaatgtgaggtttcagattcttca

SEQ ID NO: 2528 - DNA, 1401 bp, Panicum virgatum
agtcgcaacacagctcatacgcgtgggatcacagctcggcccgagcccagctcacccaacggctcgcaccaccaaacccacccctggcctcacctcctcccgacgccaaccgccgccctccaccggaatgccgggctgactgacggctgacgagcccgaccacgaggacgcgccccgcacgccgccgccgccgtcgctcttctgctctgggtgggtggaccccgcgaggcggagcgcggagccatggcgagcgacgtgcccatgagccccgagctcgagcaggtggacggcgagatccaggacatcttccgcgccctccaaaatgggttccagaagatggacaagatcaaggactccaacaggcagtccaagcagctggaagatctcaccgggaagatgagggagtgcaagcgcttaatcaaggaatttgatcgcatactcaaagatgaggagaaaaataaccctcctgacgtcaacaagcagctaaatgacaagaagcagttcatgatcaaagagttgaattcctatgtcaccttgaggaaaacgtaccaaagtagccttggtaataagaggattgagttattcgatactggtaacgatcaagtggctgaggacacaccagctcaaatggcatcagaaatgtcaaatcaagagctcattagcgctggaaggaaacaaatggaccaaactgaccaagctattgagcgttcaaaaatggttgtagcacaaactgttgaagttggagctcaaactgctgcaagtctggcacagcaaacagaacaaatgaagaggatcggcaatgagcttgactctgttcacttctccctgaagaaagctagtcaaatggtgaaagagattggtcgtcaggttgcaactgacaagtgcattatggcgttcctgtttctgattgtctgtggtgttattgcaataattgttgttaagattgtcaacccgcacaacaagagcatcagagacatcccgggcctggcacctcctgctatgaacaggaagctgctctccatcgaccctttcggaggactctgaacgttgaaaggttgcccgtgtagggcaggggggcagcacagtgctattgtgatccactcatccacttaacacgatgtcaccattctttttcgcttgtaaattgtctcgtgttggtgtttatatcgatccattctttccctattggtgagtagtagttctgtgttcctagcggcactcgtgttgtgtattgcacgtgatcccctggctttctggttgcctgtgtatacgcgcggtagtgatgtgagattgtgaatgtgaggtttcacgtttttcatgtttctttgttgcgactgtgtggtttgtgaacatgattgaaggtatctgtttgctacttgtctgcacttctgcccggggcga

SEQ ID NO: 2529 - DNA, 1374 bp, Panicum virgatum
cacagctcatacgcgtgggatcacagctcggcccgagcccagctcacccaacggctcgcaccaaaccaaacccactcccagtcccaggctccgtcctacctcccgacgccaaccgccgccctccaccggaatgccgggctgaccgacggctgacgagcccgaccagaccacgaggaggcgccgcacgccgccgctgctcttctgctctgggtgggtggaccccccccccccgaggcggagcgcggagccatggcgagcgacgtgcccatgagccccgagctcgagcaggtggacggccagatccaggacatcttccgcgccctccaaaatgggttccagaagatggataagatcaaggactccaacaggcagtccaagcagctggaagatctcaccgggaagatgagggagtgcaagcgcttaatcaaggaatttgatcgcatactcaaagatgaggagaaaaataaccctcctgacgtcaacaagcagctaaatgacaagaagcagttcatgatcaaagagttgaattcctatgtcaccttgaggaaaacgtaccaaagtagccttggtaataagaggattgagttattcgatactggtaacgatcaagtggctgaggacacaccagctcaaatggcatcagaaatgtcaaatcaagagctcattagcgctggaaggaaacaaatggaccaaactgaccaagctattgagcgttcaaaaatggttgtagcacaaactgttgaagttggagctcaaactgctgcaaatctggcacagcaaacagaacaaatgaagaggatcggcaatgagcttgactctgttcacttctccctgaagaaagctagtcaaatggtgaaagagattggtcgtcaggttgcaactgacaagtgcattatggcgttcctgtttctgattgtctgtggtgttattgcaataattgttgttaagattgtcaacccgcacaacaagagcatcagagacatcccgggcctggcacctcctgctatgaacaggaagctgctctccatcgaccctttcggaggactctgaacgttgaaaggttgcccgtgtagggcaggggggcagcacagtgctattgtgatccactcatccacttaacacgatgtcaccattctttttcgcttgtaaattgtctcgtgttggtgtttatatcgatccattctttccctattggtgagtagtagttctgtgttcctagcggcactcgtgttgtgtattgcacgtgatcccctggctttctggttgcctgtgtatacgcgcggtagtgatgtgagattgtgaatgtgaggtttcacgtttttcatgtttctttgttgcgactgtgtggtttgtgaacatgattgaaggtatctg

SEQ ID NO: 2530 - DNA, 1218 bp, Saccharum officinarum
ctttcctttcctcaacgccagccacgccgagagagaccaaccgccgccaccggaatggcggggtgacgaagcccaccggacaagacaggggaactgccgccgccgcgacgaacaagagaccgggtagaggaggggatccagccagcgagccatggcgagcgacgtgcccatgagccccgagctcgagcaggtggacggcgagatccaggacatcttccgcgcgctccagaatgggttccagaagatggacaagatcaaggactccagcaggcagtccaagcagctggaggatctcaccgccaagatgagagagtgcaagcgcttgatcaaagaatttgaccgtatactcaaggatgaggagaaaaagaacactcctgatgtcaacaagcagctcaatgacaagaagcagttcatgatcaaagaactcaactcctatgtaaccttgaggaaaacgtaccagagtagccttggtaataagaggatcgaactattcgatactggtaatgaccaagtggctgacgaaactccagttcaaatggcatcagaaatgtcaaatcaagaactcattagtgctggaaggaaacaaatggaccaaactgaccaagccattgagcgctcaaaaatggttgtagcacaaactgttgaagttggagctcagactgctgcaactctgtcacagcaaacagaacaaatgaagagaataggcaatgagctagattctgtccacttttcactgaagaaggctagtcaaatggtgaaagagattggccgtcaggttgctactgacaaatgcattatggcgttcctgtttctgattgtctgtggtgttattgcaataattgttgttaagattgtcaacccacataacaagaacatcagagatattccggggctggcacctcccgccatgaacaggaagctgctgtccatcgatgcttttggagggctctgagcgctgtgaatggctgccccctgcagtacagcgcagcacatcagagttcttttatgagccacgatacatgatttcgcgattcttttgtgcttgtatattgtctcatgttgtttacgtccgcccattctttccctattgcattggtgagtagtagcttcaggtttctagcggcactcttgttgtttatttgcttgcgagcactggctttctggttgtctgtgtatacgcggtagtgatgtgaatgtgagaaatgagattcatcatgg

SEQ ID NO: 2531 - DNA, 1403 bp, Zea mays
agcaacgtctcgccctcccagctcctcccaccaaacaaactgaaccactgtccgctgcgtgctttccttcctctcaacgccagccttgccgagagcccgagaccaatcgccgccatctcccggaatgacggggtgacgaaaccgcgccgcaccagacaagacagaggagccgccgccgcgacccacaggccaccgggtcgccgaggaggggatccagcgagccatgtcgaccgacgtgcccatgagccccgagctcgagcaggtggacggcgagatccaggacatcttccgcgcgctccagaatgggttccagaagatggacaagatcaaggactccagcaggcagtccaagcagctggaggatctcacggccaagatgagagagtgcaagcgcttgatcaaagagtttgaccgtatactcaaggatgaggagaaaaagaacacccctgatgtcaacaagcagctcaatgacaagaagcagttcatgatcaaagaactcaactcctatgtgaccttaaggaaaacgtaccagagcagccttggtaataagaggatcgaactattcgatacgggtaatgaccaggtggctgagggaactccagttcaaatggcatcagaaatgtcaaatcaagaactcattagcaccggaaggaaacaaatggaccaaactgatcaagctattgagcgctcaaaaatggttgtagcacaaactgttgaagttggagctcagactgctgcaactctgacacagcaaacggaacaaatgaagaggataggcaatgagctagattctgtccacttttcactgaagaaggctagtcaaatggtgaaagagattggccgtcaggttgctactgacaaatgcattatggcgttcctgtttctgattgtctgtggtgtcattgcaataattgttgttaagattgtcaacccgcataacaagaacatcagagacattccgggcctagcacctcccgccatgaacaggaagctgctgtccatcgacgctgcaggactctgagcgttgtgaatggctgcctcccgcagcacagcgcaacgcagcgcgtcagagttctcttatgagccacgatacatggcttcgcgattcttttgtgcttgtagtttacgtccgcccattctttccctattgcattggtgagtagtagcctcaggtttgtagcgggactcttgttgtttattgcttgcgagcccatagctttctggttgtttgtgtatatgcggtagtgatgtgaatgtgagagtcgagtggagattcttcatggttcgttcttatgagttgtgactggtttgtgagcttgtggtgaaaggttcgcagcttgcttggcatgcgtctcctctgttcctgccgtgctgctctgcagtcgatacaagaaaagataaaa

SEQ ID NO: 2532 - DNA, 1465 bp, Sorghum bicolor
cccaggcccaagcgcacgcgcgtgggtgggaacgggagcacagctcggccccggcccggcggcccggacggacccaggcacccagctcagcaacggctcgtcctcccaccaaacaaaccgaaccaccgcccgctgtttgctttcctttcctttcctctcaacgccagccacgccgagaggagagagaccaaccgccgccaccggaatggcggggtgaggaagccgcgccggacacgacagaggaacctccgccgccgccgcggcgaccaacagacaccgggtagaggaagggatccagccagccagcgagccatggggagcgacgtgcccatgagccccgagctcgagcaggtggacggcgagatccaggacatcttccgcgcgctccagaatgggttccagaagatggacaagatcaaggactccagcaggcagtccaagcagctggaggatctcaccgccaagatgagagagtgcaagcgtttgatcaaagaatttgaccgtatactcaaggatgaggagaaaaagaacactcctgatgtcaacaagcagctcaatgacaagaagcagttcatgatcaaagaactcaactcctatgtaaccttgaggaaaacgtaccagagcagcctcggtaataagaggatcgaactattcgatactggtaatgaccaagtggctgacgaaactccagttcaaatggcatcagaaatgtcaaatcaagaactcattagcgctggaaggaaacaaatggaccaaactgaccaagccattgagcgctcaaaaatggttgttgcacaaactgttgaagttggagctcagactgctgcaactctgtcacagcaaacagatcaaatgaagagaataggcaatgagctagattctgtccacttttcactgaagaaggctagccaaatggtgaaagagattggccgccaggttgctactgacaaatgcattatggcgttcctgtttcttattgtctgtggtgttattgcaataattgtcgtcaagattgtcaacccacataacaagaacatcagagacattccggggctggcacctcccgccatgaacaggaagctgctgtccgtcgatgctttcggagggctccgagcgctgtgaatggctgccccctgcagtacatcagagttctcctgtgagccacacgatacatgattttgcgattattttgtgcttgtatattgtctcatgttgtttacgcctgcccattctttccctattgcgttggtgagtagtaggttcaggtttctagcggcactcttgttgtttattgcttgcgagcactggctttctggttgtctgtgtatacgcggtagtgatgtgaatgtgagaattgaaattcttcatggttcattcttgtgagttgtgactcaggtttgtgagcttgtggtgaaggttctcacttctcagcttggcatgcgtctcctctgtttctgccgtgctg

SEQ ID NO: 2533 - DNA, 1072 bp, Cynodon dactylon
acgggagccgccgctgcttctagcgctactgcgaccaggcggaggcggagagccatggcgagcgacgtgcccatgagccccgagctggagcgggtcgacggcgagatccaggacatcttccgcgcgctccaaaatgggttccagaagatcgacaagatcaaggactccaacaggcagtccaagcagctggaagatctcactgccaaaatgagggagtgcaagcgattaatcaaggaattcgaccgtatactcaaagaggaggagaagaaaaaccctcctgatgtcaacaagcagctaaatgaaaagaagcagttcatgatcaaagagctgaactcctatgtcacattgaggaaaacgtaccagagtagccttggtaacaagaggattgaattgttcgatactggcaatgatcaagtggctgaggacacagttcaaatggcatcagaaatgtcaaatcaagaacttatacatgctggaaggaaacaaatggaccaaaccgaccaagccattgagcgttcaaagatggttgtagcacagactgttgaagttggagctcagactgctgcaaatctgacacagcaaacagaacaaatgaagagaatcggcaatgagctagactctgttcatttttcgctgaagaaggctagtcagatggtgaaagaaattggtcgtcaggttgcaactgacaaatgcattatggcgtttctgtttttgattgtctgcggtgttattgcaataattgttgttaagatcgtcaacccacataacaagaacatcccagacatccctgggttagcgcctcctgctatgaacaggagactgctgtccattgaagccttcggaggacgttgagcctgcagtgcggcgcagtatatcgtcgtctcaggcgattcaactgttctcgagcctaattcttttgtgcttgtatattgtcatctcttccgtttatccattcttttggtgttggtcatactgttagatttgtttgttgtttggcgttcgccatggcttgtgtatatacggtactgacgaggatgcgagattatttatgatcttttgtgagttgtgagct

SEQ ID NO: 2534 - DNA, 1301 bp, Zea mays
caccattccaccaaacaaaccgaccaggcgaccaccgctgccgctgctttgctttgctcccttctgatcaacggcagccacgccgagaccaactgccgccaccggaatggcggggtgccttggcgacccactggacaccgggtagaggaggaggggggggggggggggggggggggggggggatccggccagccatggcgagcgacgtgcccatgagccccgagctcgagcaggtggacggcgagatccaggacatcttccgcgcgctccagaacgggttccagaagatggacaagatcaaggactccagcaggcagtccaagcagctggaggatctcaccgccaagatgagagagtgcaaacgcttgatcaaagaatttgaccgtatactcaaggatgaggagaaaaaggacactcctgaggccaacaagcagctcaatgacaagaaacagttcatgatcaaagaactcaactcctacgtaaccctgaggaaaacgtaccagagcagcctaggtaacaagaggatcgaactattcgatactggtaccgaccaagtggccgacaaatctccagttcaaatggcatcagaaatgtcaaatcaagagctcattagcgccggaaggaaacaaatggaccaaactgaccaagccattgagcgctcaaagatggttgtagcacaaactgttgaagttggagctcagactgctgcaactctgtcacaacaaacagagcaaatgaagagaatcggcaatgagttagattctgttcacttctcactgaagaaggccagtcaaatggtgaaagagattggccgtcaggttgctactgacaaatgcattatggcgttcctgtttctgattgtctgtggcgttattgcaataattgttgttaagatcgtcaacccacataacaagaacatcagagatattccggggctggcacctcccgccatgaacaggaggctgctgtccatcgacgccttaggactatgagcgctgtgaatggctgctcccctgcagcacagcgctgcgcagcgcatcagagttctcttaacgagccacgatatatgatttcacgattcttttgtgcctgtatattgtgtttatgttgtttgcgtccgcccattccttccctattgcattggtaagtagtagcttcaggttcctagcaccggcgttctgattgtctgtgtatacgcggtactggttgtggatgtgagatattcttcatggttgttagtaaaaatagaaacggctgtgggagaagaaacagtaaatgaatccatgtttctttattcttta

SEQ ID NO: 2535 - DNA, 1972 bp, Oryza sativa
cggatcccgactccaccccacccgaacccgctacccgcacccgcacccgcaccaacccatctccttctcctcctaactcaactcgactccaaccgccgctcaccggaatgcggcggtgacgagacgaccaaccacctcctgcgactgctcggatctcgcgacgcggcggcggcggcgagatacggagatccggcagcttgaggcaagagagagagaaagccatggcgagcgacgtgcccatgagccccgagctggagcaggtggacggcgagatccaggacatcttccgcgcgctccagaatgggttccagaagatggacaagatcaaggactccaacaggcagtccaagcagctggaagatctcaccgggaagatgagggagtgcaagcgcttaatcaaagaatttgatcgtattctcaaagaggatgagaaaaagaactcggctgatgtcaacaagcagctaaatgataagaagcagctgatgatcaaagaattgaattcctatgtcacattgaggaaaacgtaccaaagcagcctgggtaataagaggattgaactatttgatactggtaatgatcaggtggccgaggacaacactgttcaaatggcatcagaaatgtcaaatcaacaactcatggatgccggaaggaaacagatggaccaaacagatcaagttattgagcgttcgaaaaaggttgttgcacaaaccgttgaagttggatctcaaactgctgcagctctatcacaacaaacagaacaaatgaagagaattggcaatgagctagactcggttcacttttcactgaagaaggctagccaaatggtgaaagagattggtcgccaggttgcaactgacaaatgcatcatggcattcctatttctgatagtctgtggtgtgattgcaatcattgttgttaagattgtcaaccctcacaacaagaacatcagagacatcccaggactggcaccacctgcgcagaacaggaagctcttgtccatagaatctttcggaagcctctgagcattgcgagtgggaggcaaccgagatgtttgggagaagatactatgcacgtcgtgacaattcttttgcgcttgtatatcatctcatgtcgttattcccttccactgatctattcttttcttgctgtaattggtcattagtgttggatttacgtttgatggttgcagtgcggcttcctgttggctttatgaatgtgtgtatatgtggtagtgatgaggatacaaagatatttgttgttctttttattctgcaagtaatcacgtgaaggcttcagtttgcagttgttccagttttcatatctttgtgaattgtgatttgcttcagtctcgtcagaataaaaaggtaacatattcgtacaaaatctaacgcccaacttggcagggtcagacaaaagcatctgggcaaaacaacgtcgttcaggccaaaacgtaaaataaagatgatagaaatgcaaggatcctagatggatcactggacttatgttacagtgcttgcaaaaggttaccgggcaacaagttatcttagctcttgtacgtcccaggaagaggagcttgtgttaactgattaattaacaagtaacattaaccctcccatggagaggaaggctatgtcatctctcggatcgaactaaagaagaggcagttcaggctgtagagggctgtgcatcctcgtcggacaataataggtcactgaagaaagaatcagtgagacaatctttagcggaatcatacttggctaggcgtttcttgaacgctcggagctccctgtcgtctttggaagtaaatgtctagcaacagttactgaggttagcaatggtggcaaatttgatttgtaggcaataacaaaatcagcgcaaattcaaacgttgtcaggaaagatgaactcacggagtatctcttctgcagtacgatatcgacaagataaattagccatacgacgtttgtctttgg

SEQ ID NO: 2536 - DNA, 1348 bp, Pseudoroegneria spicata
  misc_feature (1254)..(1254): n is a, c, g, or t
accgccgccctcctcgcctccaccggaagggctgctcctcccgcaaccggacggatcccgctaggcggaggcgaagatccagcagccgccatggcggcgagcgacgtgcccatgagccccgagctcgagcaggtcgacggcgagatccaggacatcttccgcgtcctacagaatgggttccagaagattgacaagatcaaggactccaacaggcagtccaagcagctggaagaactcactgggaagatgagggagtgcaagcgcttaatcaaagaatttgatcgtgtactcaaagatgaggagaaaaggaatacttctgaggtcaacaaacagctaaatgacaagaagcaatttatgatcaaggagttgaattcctatgtcaccttgaggaagacgtaccaaagtagccttggtaataagaggatcgaactattcgatgctggtaatgaccaggtagctgaagataacgttcaaatggcatcagaaatgtcaaatcaacaactgattgattctggaatgaaacaaatggaccaaacagaccaagctattgagcgttcgaaaatggttgttgcacaaactgttgaagttggagctcaaactgctacaactctaacacagcaaactgaccaaatgaagagaattggcaatgagctagattccgttcacttctcgttgaagaaggctagtcaaatggtgaaagagattggtcgtcaggttgcaactgacaaatgcatcatggcgtttctgtttttgatagtttgtggtgtgattgcgatcattgttgtcaagatcgtcaacccgcataacaaaagcatcccagacatcccgggactggcgcctcctgcacctcctgcgcagaaccggaaactgctatccgtagatcctttcagaatgctctgagcattcgggaatggaagtctcgtgccgtgcaggtctctcgctctgaagccaaaacacacgatgtcaactgttccattggtgcttgcttgtacattatccccgtatgtaattttctttgattggttcattctttccacattggttgctgttagcctcggattgttagtaacacttcggttgtgtggtgtttaaattgcctggctttcttggttgtgtacatgcgttagtggtgaccagtgagagttatgcgattaatgtttgctcgtataccttcctaaaaccagccgattctattcactatgagcatgtgaatgttgtccatccattatcctggcattgtgagcatgtttcagnaattcattttgctgctgaaatgctttgtcagatcccagttctggtggcaagatctgacgagtataagtgtaaatcgaataagaaattggggata

SEQ ID NO: 2537 - DNA, 1200 bp, Hordeum vulgare
cccatccgccgccctcctcgcctccaccggaagagctgctccccacgcaaccgggcggatcccgctaggcgtaggcggggatccagcagccgccatggcggcgagcgacgtgcccatgagccccgagctcgagcagatcgacggcgagatccaggacatcttccgcgccctacaaaatgggttccagaagattgacaagatcaaggactccaacaggcagtccaagcagctggaagaactcactgggaagatgagggagtgcaagcgcttaatcaaagaatttgatcgtgtactcaaggatgaggagaaaaggaatacctccgaggtcaacaaacagctaaatgacaagaagcaatttatgatcaaggagttgaattcatacgtcaccttgaggaagacgtaccaaagtagccttggtaataagaggattgaactatttgatgctggtaatgaccaggtagctgaagataacgttcaaatggcatcagaaatgtcaaatcaacaactgattgattctggagtgagacaaatggaccaaacagaccaagctattgagcgttcgaaaatggttgttgcacaaactgttgaagttggagctcaaactgctacaactctaacacagcaaactgaccaaatgaagagaattggcaatgagctagattctgttcacttctcattgaagaaggctagtcaaatggtgaaagagattggtcgtcaggttgcaactgacaaatgcatcatggcatttctattcttgatagtttgtggtgtgattgccatcattgttgtcaagatcgtcaacccgcataacaaaagcataccagacatcccgggactggcacctcctgcacctcctgcgcagaaccggaaactgctttccatagatgctttccgaatgctctgaacattcggaaatggaagtctcgtgcagtacaggtctctctcgcggaagccaaaacacacgatgtcaactgttccattggtgcttgcttgtacattatccccgtatgtaattttctttgattgcttttagcttcggattgttagtagcacttcggtcgtgtggtgtttaaattgcctggccttcttggttgtgtacatgcgttagtggtgaccagtgagagtaatgcgattattctttgctcgtataccttcctaaaacctgccgattctattcattatgagcatgtgaatgttgtc

SEQ ID NO: 2538 - DNA, 1151 bp, Festuca arundinacea
  misc_feature (592)..(592): n is a, c, g, or t
  misc_feature (598)..(598): n is a, c, g, or t
  misc_feature (607)..(607): n is a, c, g, or t
  misc_feature (640)..(640): n is a, c, g, or t
ggcacgaggcctgcgtgccagctcgctgctcggcagctgacagctcggatcgcacacgatcccccaacggctcccagtcgcagccgcaccaaccgccgttttccccctcctcgccccaaccgccgcccttcctcgcctccaccggaggagctgcttcccgccgcaactggtcggatcccgcgaggcgtgggcggagatcccgtagccagcatttcaacgagccaccactatggcagcgagcgacgtgcccatgagccccgagctcgagcaggtcgacggcgagatccaggacatcttccgcgccctacagaatgggttccagaaaatcgacaagatcaaggactccaacaggcagtccaagcagctggaggagctcactgggaagatgagggagtgcaagcgcttaatcaaggaatttgaccgtgtgctcaaagatgaggagaagaggaatacttctgaggttaacaagcagctaaatgacaagaagcaatttatgatcaaggagttgaattcctatgtcaccttgaggaagacgtaccaaagtagccttggtaataagaggattgaactattcgatgccggtaatgaccangtggcngaggataangttcaaatggcatcagaaatgtcaaatcaacanctcattgattctgggatgaaacaaatggaccaaacagaccaagctattgagcgttcaaaaatggttgttgcacaaactgttgaagtcggagctcaaactgctacaactctaacacagcaaactgaccaaatgaagagaattggcaatgagctagattccgttcacttttcattgaagaaggctagtcaaatggtgaaagagattggtcgccaggttgcaactgacaaatgcatcatggcgtttctgtttctgatagtttgtggtgtgattgcgattattgttgtcaagatcgtcaacccacataacaaaaacatcccagacatcccaggactggcacctcctgcacctccagcacagaaccggaaactgctatccatagatagtttcagaatgctctgagcatttgggatgtcttctgcagaagccaaaacacgcattgttaactcttccatttgagcttgtatagtgtctcctatgtaattttcttcaattggttcattcttttggcatc

SEQ ID NO: 2539 - DNA, 1217 bp, Avena sativa
cacgactctacccccaaacccaacggctcgcagccgcaccaaccacctccctcgccccgaccgccgccctcctagcctccgccggaggagctgacccctcccgcgactgggcggatcccgcgaggcgcgggcggagatccagtagccagcagtgcagggtgccgccatggcggcgagcgacgtgcccatgagccccgagcttgagcaggtcgacggcgagatccaggacatcttccgagccctacagaatgggttccagaagattgacaagatcaaggactctaacaggcagtccaagcagctggaagagctcactgggaagatgcgggagtgcaagcgcttaatcaaagaatttgatcgtgtactcaaagatgaggagaaaaggaatactgctgaggttaacaagcagctaaatgacaagaagcaatttatgatcaaggagttgaattcctatgtcaccttgaggaagacataccaaagtagccttggtaacaagaggattgaactattcgatgccggtaacgaccatgtggctgaggataacgttcaaatggcatcagcaatgtcaaatcaacaactcattgattctggaacgaaacaaatggaccaaacagaccaagctattgagcgttcaaaaatggttgttgcacaaactgttgaagtcggagctcaaactgctacaactctaacacagcaaactgaccaaatgaagagaattggcaatgagctagattccgttcacttctcattgaagaaggctagtcaaatggtgaaagagattggtcgtcaggttgcaactgacaaatgcatcatggcgtttctgtttttgatagtttgtggcgtgattgcaatcattgttgtcaagattgtcaacccgcacaacaaaaacatcccagacatcccaggactggcacctcccgcacctccagcgcagaaccggaaactgctatccatagacactttcagaatgctctgagtatttgggaatggaagtttctcctgcaaaaagcctgatcagatgctgttaacagttcaacttgtgcttgtatattgtctctatgtaattttcttcgattggttcattctttccacacctgtgttagcttcagattgtcagtagcgtgtcgttgtgtaatgtttgcaaatcgcccgactttcttggttgtgtgtatatgtgttagtgatgagaatcatgagatcattgttgtccgttcatt

SEQ ID NO: 2540 - DNA, 1372 bp, Secale cereale
caacacacagctgggcagctcacagctgggatcacacggctccagcccgcaaacccaacggctccgcagcccgcaccaacccctcctccccctcgccccaaccgccgcctgagccctcctcgcctccaccggaagagctgcccctcccgcaaccgggcggatcccgccaggcggaggcggagatccagtagccgccatggcggcgagcgacgtgcccatgagcccggagctcgagcaggtcgacggcgagatccaggacatcttccgcgccctacagaatgggttccagaagattgacaagatcaaggactccaacaggcagtccaagcagctggaagaactcaccgggaggatgagggagtgcaagcgcttaatcaaagaatttgatcgtgtactcaaggatgaggagaaaaggaatacttctgaggtcaacaaacagctaaatgacaagaagcaacttatgatcaaggagttgaattcctatgtcaccttgaggaagacgtaccaaagtaaccttggtaataagaggatcgaactattcgatgctggtaatgaccaggtagctgaagataacgttcaaatggcatcagaaatgtcaaatcaacaactgattgattctggaacgaaacaaatggaccaaacagaccaagctattgagcgttcaaaaatggttgttgcacaaaccgtcgaagttggagctcaaactgctacaactctaacacagcaaactgaccaaatgaagagaattggcaatgagctagattccgttcacttctcattgaagaaggctagtcaaatggtgaaagagattggtcgtcaggttgcaactgacaaatgcatcatggcgtttctgtttttgatagtttgtggtgtgattgcgatcattgttgtcaagatcgtcaacccgcataacaaaagcatcccagacatcccgggactggcgcctcctgcacctcctgcgcagaaccggaagctgctatccgtagatcctttcagaatgctctgagcattcgggaatggaagtctcgtgccgtgcaggtctctctgccctgaagccaaaacacacgatgtcaaccgttccattggtgcttgcttgtacattatcccgtatgtaattttctttggttggttcattctttccacagttgttgctgttagcttcggattgttagtagcacttcggttgtgtggtgtttaaattgcctggctttcttggttgtgtacatgcgttagtggtgaccagtgagagttatgcgattaatgtttgctcgtatgccttcctaaaactagcggagtctattcattatgagcatctcaatgtatccaataaccaaaaaaaaaaaaaataacagataccagcgacacacgggag

SEQ ID NO: 2541 - DNA, 1248 bp, Triticum aestivum
accgccgccctcctcgcccccaccggaagagctgcccctcccgcaaccgggcggatcccgctaggcggggccggagatccagcagccgccatggcggcgagcgacgtgcccatgagccccgagctcgagcagatcgacggcgagatccaggacatcttccgcgccctacacaatgggttccagaagattgacaagatcaaggactccaacaggcagtccaagcagctggaagaactcactgggaagatgagggagtgcaagcgcttaatcaaggaatttgatcgtgtactcaaagatgaggagaaaaggaatacttctgaggtcaacaaacagctaaatgacaagaagcaatttatgatcaaggagttgaattcgtatgtcaccatgaggaagacgtaccaaagtagcctgggtaacaagaggattgaactattcgatgctggtaatgaccaggtagctgaagataatgttcaaatggcatcagaaatgtcaaatcaacaactgattgattctggaatgaaacaaatggaccaaacagaccaagctattgagcgttcgaaaatggttgttgcacaaactgttgaagttggagctcaaactgctacaactctaacacagcaaactgaccaaatgaagagaattggcaatgagctagattccgttcacttctcattgaagaaggctagtcaaatggtgaaagagattggtcgtcaggttgcaactgacaaatgcatcatggggtttctgtttttgatagtttgtggtgtgattgcgatcattgttgtcaagatcgtcaacccacataacaaaagcatcccagacatcccgggactggcgcctcctgcccctcctgtgcagaaccggaagctgctatccgtagatcctttcagaatgctctgagcattcaggaatggaagtctcgtgccgtgcaggtctctcgccctgaagccaaaacacacgatgtcaactgttccattggtgcttgcttgtacattatccccgtatgtaattttctttgatcggttcattctttccgcattggttgctgttagcttcggattgttagtagtacgtcggttgtgtggtgtttaaattgcctggctttcttggttgtgtacatgcgttagtggtgaccagtgagagttatgtgattattgtttgctcgtataccttcctaaaaccagccgattctattcattatgagcatgtgaatgttgtccatccattatcctggccttgtgagcatgt

SEQ ID NO: 2542 - DNA, 1168 bp, Leymus cinereus x Leymus triticoides
  misc_feature (22)..(22): n is a, c, g, or t
  misc_feature (36)..(36): n is a, c, g, or t
  misc_feature (59)..(59): n is a, c, g, or t
  misc_feature (138)..(138): n is a, c, g, or t
  misc_feature (158)..(158): n is a, c, g, or t
  misc_feature (264)..(264): n is a, c, g, or t
  misc_feature (276)..(276): n is a, c, g, or t
  misc_feature (292)..(292): n is a, c, g, or t
  misc_feature (333)..(333): n is a, c, g, or t
  misc_feature (543)..(543): n is a, c, g, or t
  misc_feature (630)..(630): n is a, c, g, or t
  misc_feature (669)..(669): n is a, c, g, or t
  misc_feature (811)..(811): n is a, c, g, or t
  misc_feature (830)..(830): n is a, c, g, or t
  misc_feature (843)..(843): n is a, c, g, or t
  misc_feature (847)..(847): n is a, c, g, or t
  misc_feature (853)..(853): n is a, c, g, or t
  misc_feature (857)..(857): n is a, c, g, or t
  misc_feature (876)..(876): n is a, c, g, or t
  misc_feature (881)..(882): n is a, c, g, or t
  misc_feature (885)..(886): n is a, c, g, or t
  misc_feature (906)..(906): n is a, c, g, or t
  misc_feature (908)..(908): n is a, c, g, or t
  misc_feature (923)..(923): n is a, c, g, or t
  misc_feature (930)..(930): n is a, c, g, or t
  misc_feature (950)..(950): n is a, c, g, or t
  misc_feature (993)..(993): n is a, c, g, or t
  misc_feature (1032)..(1032): n is a, c, g, or t
  misc_feature (1034)..(1034): n is a, c, g, or t
  misc_feature (1060)..(1061): n is a, c, g, or t
  misc_feature (1075)..(1075): n is a, c, g, or t
  misc_feature (1078)..(1079): n is a, c, g, or t
  misc_feature (1094)..(1094): n is a, c, g, or t
  misc_feature (1104)..(1104): n is a, c, g, or t
  misc_feature (1122)..(1122): n is a, c, g, or t
agagttgctcctcccgcaaccnggcggatcccaggnggaggcggagatccagtagccgncatggcggcgagcgacgtgcccatgagccccgagctcgagcaggtcgacggcgagatccaggacatcttccgcgccctncagaatgggttccagaagantgacaagatcaaggactccaacaggcagtccaagcagctggaagaactcactgggaagatgagggagtgcaagcgcttaatcaaagaatttgatcgtgtactcaangatgaggagaanaggaatacttccgagntcaacaaacagctaaatgacaagaagcaatttatgatcaangagttgaattcgtatgtcaccttgaggaagacgtaccaaagtagccttggtaataagaggattgaactattcgatgctggtaatgaccaggtagctgaagataacgttcaaatggcatcagaaatgtcaaatcaacaactgattgattctggaatgaaacaaatggaccaaacagaccaagctattgagcgttcgaaaatggttgttgcncaaactgttgaagttggagctcaaactgctacaactctaacacagcaaactgaccaaatgaagagaattggcaatgagctagattcngttcacttctcattgaagaaggctagtcaaatggtgaangagattggtcgtcaggttgcaactgacaaatgcatcatggcgtttctgtttttgatagtttgtggtgtgattgccatcattgttgtcaagatcgtcaacccgcataacaaaagcatcccagacatcccgggactggcgcctnctgcacctcctgcgcaganccggaaactgctntccntagatncttncagaatgctctgagcattngggannggnngtctcgtgccgtgcaggtcncnctcgctgaagccaanacacacnatgtcaactgttccattggngcttgcttgtacattatccccgtatgtaattttctttgattgnttcattctttccacattggttgctgttagcttcggattntnagtagcacttcggttgtgtggtgttnnaatcgccggctttngtnntgtgtacatgcgttngtggtgaccngtgagagttatgagattnatgtttgctcgtataccttcctgaaaccagccgattctattcatca

SEQ ID NO: 2543 - DNA, 1306 bp, Secale cereale
acggctccgcagcccgcaccaacccctccccccctcgccccaaccgccgcctgagccctcctcgcctccaccggaagacctgcccctcccgcaacccggcggatcccgccaggcggaggcggagatccagcaggcgccatggcggcgagcgacgtgcccatgagccccgagctcgagcaggtcgacggcgagatccaggacatcttccgcgccctacagaatgggttccagaagattgacaagatcaaggactccaacaggcagtccaagcagctggaagaactcaccgggaggatgagggagtgcaagcgcttaatcaaagaatttgatcgtgtactcaaggatgaggagaaaaggaatacttctgaggtcaacaaacagctaaatgacaagaagcaacttatgatcaaggagttgaattcctatgtcaccttgaggaagacgtaccaaagtaaccttggtaataagaggatcgaactattcgatgctggtaatgaccaggtagctgaagataacgttcaaatggcatcagaaatgtcaaatcaacaactgattgattctggaacgaaacaaatggaccaaacagaccaagctattgagcgttcaaaaatggttgttgcacaaactgttgaagttggagctcaaactgctacagctctaacacagcaaactgaccaaatgaagagaattggcaatgagctagattccgttcacttctcattgaagaaggctagtcaaatggtgaaagagattggtcgtcaggttgcaactgacaaatgcatcatggcgtttctgtttttgatagtttgtggtgtgattgcgatcattgttgtcaagatcgtcaacccgcataacaaaagcatcccagacatcccgggactggcgcctcctgcacctcctgcgcagaaccggaagctgctatccgtagatcctttcagaatgctctgagcattcgggaatggaagtctcgtgctgtgcaggtctctcgccctgaagccaaaacacacgatgtcaactgttccattggtgcttgcttgtacattatccccgtatgtaattttctttggttggttcattctttccatatcggttgctgttagcttcggattgttagtagcacttcggttgtgtggtgtttaaattgcctggctttcttggttgtgtacatgcgttagtggtgaccagtgagagttatgcgattaatgtttgctcgtataccttcctaaaaccagcggagtctattcattacgagcatgtgaatgttatacatccattatcctggccttgcgagcatgtttcagtaatg

SEQ ID NO: 2544 - DNA, 1320 bp, Triticum aestivum
acagctgggcagctcacagctaggatcacacgactccagcccccaaccaaacccaacggctccgcagtccgcaccaacccctccccctcgccccaaccgccgccctcctcgcctccaccggaagagctgctccccccgcaaccgggcggatcccgctaggcggaggcggagatccggcagccgccatggcggcgagcgacgtgcccatgagccccgagctcgagcaggtcgacggcgagatccaggacatcttccgcgccctacacaatgggttccagaagattgacaagatgaaggactccaacaggcagtccaagcagctggaagaactcactgggaagatgagggagtgcaagcgcttaatcaaggaatttgatcgtgtactcaaagatgaggagaaaaggaatacttctgaggtcaacaaacagctaaatgacaagaagcaatttatgatcaaggagttgaattcgtatgtcaccatgaggaagacgtaccaaagtagccttggtaacaagaggattgaactattcgatgctggtaatgaccaggtagctgaagataatgttcaaatggcatcagaaatgtcaaatcaacaactgattgattctggaatgaaacaaatggaccaaacagaccaagctattgagcgttcgaaaatggttgttgcacaaactgttgaagttggagctcaaactgctacaactctaacacagcaaactgaccaaatgaagagaattggcaatgagctagattccgttcacttctcattgaagaaggctagtcaaatggtgaaagagattggtcgtcaggttgcaactgacaaatgcatcatggggtttctgtttttgatagtttgtggtgtgattgcgatcattgttgtcaagatcgtcaacccgcataacaagagcatcccagacatcccgggactggcgcctcctgcacctcctgcgcagaaccggaagctgctatccgtagatcctttcagaatgctctgagcattcaggaatggaagtctcgtgccgtgcaggtctctcgctctgaagccaaaacacacgatgtcaactgttccattggtgcttgcttgtacattatccccgtatgtaattttctttgattggttcattctttccacattggttgctgttagcttcggattgttagtagcacttcggttgtgtggtgtttaaattgcctggctttcttggttgtgtacatgcgttagtggtgaccagtgagagttatgcgattaatgtttgctcgtataccttcctaaaaccagccgattctattcattatgagcatgtgaatgttgtccatcca

SEQ ID NO: 2545 - DNA, 1666 bp, Triticum aestivum
acagctgggcagctcacagctaggatcacacgactccagcccccaaccaaacccaacggctccgcagtccgcaccaacccctccccctcgccccaaccgccgccctcctcgcctccaccggaagagctgctccccccgcaaccgggcggatcccgctaggcggaggcggagatccggcagccgccatggcggcgagcgacgtgcccatgagccccgagctcgagcaggtcgacggcgagatccaggacatcttccgcgccctacacaatgggttccagaagattgacaagatgaaggactccaacaggcagtccaagcagctggaagaactcactgggaagatgagggagtgcaagcgcttaatcaaggaatttgatcgtgtactcaaagatgaggagaaaagcaatacttctgaggtcaacaaacagctaaatgacaagaagcaatttatgatcaaggagttgaattcttatgtcaccatgaggaagacgtaccaaagtagccttggtaataagaggatcgaactattcgatgctggtaatgaccaggtagctgaagataacgttcaaatggcatcagaaatgtcaaatcaacaactgattgattctggaatgaaacaaatggaccaaacagaccaagctattgagcgttcgaaaatggttgttgcacaaactgttgatgttggagctcaaactgctacaactctaacacagcaaactgaccaaatgaagagaattggcaatgagctagattccgttcacttctcattgaagaaagctagtcaaatggtgaaagagattggtcgtcaggttgcaactgacaaatgcatcatggggtttctgtttttgatagtttgtggtgtgattgcgatcattgttgtcaagatcgtcaacccgcataacaagagtatcccagacatcccgggactggcgcctcctgcacctcctgcgcagaaccggaagctactatccgtagatcctttcagaatgctctgagcattcacgaatggaagtctcatgccgtgcaggtctctcgctctgaagccaaaaacacacgatgtcaactgttcaattggtgcttgcttgtacattatccccgtatgtaattttctttgattggttcattctttccacattggttgctgttagcttcggattgttagtagcacttcggttgtgtggtctttaaattgcctggctttcttggttgtgtacatgcgttagtggtgaccagtgagagttatgcgattaatgtttgctcgtataccttcctaaaaccagccgattctattcattatgagaatgtgaatgttggccatccattatcctggccttgtgagcatgtttcggtaattcattttgctgctgaaatgctttgtcagatcccagttctggtggcaagatctgacaagtataggtgtaaatcgaagaagaaatcggggataagctggctgaatcaaggtgccagatttgtattaaagtatttgtaatgtatatatgttctaggtctaggtattggggaataattctcgatacttattcaaccacaacctggctgttatataggtccaactttaacttaaggtgagagtaacgaaaattgcttttggtggccaagctccatgtaggtcggtttttaaaaagttcaaaattcatatttttacata

SEQ ID NO: 2546 - DNA, 1543 bp, Brachypodium distachyon
tttttctttttttgcgggtaagctccaataatcctctgctttcctctctggctctctctgtcccacgccagctcacagctcctccgcccccaaattaccaaaccccaacggctcgcagtcgccgtcgcagctgcccccaaccactgcctcgtcttcctcgcgccaaccgccgccgcgctactcgcctcctcaggaaccaacggcgggctgagcgagcggcccgagaggacgcctgcgaaggagctctctctctgcgactgggccgatcccgcagggcggaggcggcggcggagatccagcagccagtaggggacatggcggcgagcgacgtgcccatgagccccgagctcgagcaggtcgacggcgagatccaggacatcttccgcgcgctccagaatggcttccagaagatagacaagatcaaggactctaacaggcagtccaagcagctggaagagctcactgggaagatgagggagtgcaagcgcttaatcaaagaatttgatcgcgtacttaaagttgaggagaaaaagagcacttccgaggtcaacaagcagctaaatgacaagaagcaatttatgatcaaggagttgaattcctatgtcacactgagaaaaacgtaccaaagtagccttggtaataagaggattgagctgttcgatactggtaatgatgaccagctggctggggttaatgttcaaatggcgtcagagatgtcaaatcaacaactcattgattctggaatgaaacaaatggatgaaacagaccaagctcttgagcgttcaaaaatggttgtaaaacaaactgttgaagttggagctcaaactgctgcaactctaacacagcaaacagaccaaataaagagaattggcaacgagctagattctgttcacttttcactgaagaaggctagtcaaatggtgaaagagattggtcgtcaggttgcaactgataaatgcatcatggcatttctgtttttgatagtttgtggtgtgattgcaatcattgttgtcaaggtcgtcaacccgcacaacaaaaacatcccagacatcccgggactggcaccacctgctcagaacaggaagctgctatccatagaagcttacagaatgctctgagcattctgatctgaaatggaagtcttttgtgcagggcatctgcagcgctctttcgcacaagccagagcacacactgtttcccattgtgcttgtatattgtctccttatgtaatgttcttccattgtttaattctttccgcatcagttgttagcttttgattatttagaggcacttcggtcgcgtggtgtttgcgatcttccagctttcttggttgtgtacatgcgttagtgctgagaattacaagatctttaaagtttgttcggtatcctgaccttgtgtgcacgtgtgaatgtttcagtgattcactttgcttgtatgctatgttagtttcacgttctgtttgcttttgcattccttctgttggtgtgcagagcaaaaatgcacaatgatgattcatatcaaaatttagtttaagcgccataaa

SEQ ID NO: 2547 - DNA, 1056 bp, Secale cereale
gatccaggacatcttccgcgccctacagaatgggttccagaagattgacaagatcaaggactccaacaggcagtccaagcagctggaagaactcaccgggaggatgagggagtgcaagcgcttaatcaaagaatttgatcgtgtactcaaggatgaggagaaaaggaatacttctgaggtcaacaaacagctaaatgacaagaagcaacttatgatcaaggagttgaattcctatgtcaccttgaggaagacgtaccaaagtaaccttggtaataagaggatcgaactattcgatgctggtaatgaccaggtagctgaagataacgttcaaatggcatcagaaatgtcaaatcaacaactgattgattctggaacgaaacaaatggaccaaacagaccaagctattgagcgttcaaaaatggttgttgcacaaactgtcgaagttggagctcaaactgctacaactctaacacagcaaactgaccaaatgaagagaattggcaatgagctagattccgttcacttctcattgaagaaggctagtcaaatggtgaaagagattggtcgtcaggttgcaactgacaaatgcatcatggcgtttctgtttttgatagtttgtggtgtgattgcgatcattgttgtcaagatcgtcaacccgcataacaaaagcatcccagacatcccgggactggcgcctcctgcacctcctgcgcagaaccggaagctgctatccgtagatcctttcagaatgctctgagcattcgggaatggaagtctcgtgccgtgcaggtctctctgccctgaagccaaaacacacgatttccattggtgcttgcttgtacattatccccgtatgtaattttctttggttggttcattctttccgcagttgttgctgttagcttcggattgttagtagcacttcggttatgtggtgtttaaattgcctggctttcttggttgtgtacatgcgttagtggtgaccagtgagagttatgcgattaatgtttgctcgtataccttcctaaaaccagcggagtctattcattatgagca

SEQ ID NO: 2548 - DNA, 1387 bp, Setaria italica
aaaccccagctaatacgccagcccaggcaggagccaagccctagggcccctagtactcgtgtactctgacccgaaatccccaagaccccaagtccccaactgcccctcctctcttctttccccatcgtcttcctctccggttccccagttccccgcccccgacgctccctctccgcggccgcggccccgccctccgcctccgctcggaccccaccgggaatggcggcctgaggaggccggcgtgctagggttcttcgatccgtgagcggaacggcggggacagcgggcggagtcgggggccgcccgccatggcgaccgacttgcccatgagcccggagctcgagcagatcgacggcgagatccacgacatcttccgcgtgctacaaaatggattccaaaagatggataagattaaagattcaaataggcaagctaagcaattggaagatcttacagggaaaatgaaggagtgcaagcgcttgatcaaagagtttgatcgcgttctcaaagatgaggagtcgaataatccacctgagatcaacaagcagctaaatgacagaaaacagttcatgatcaaagagttgaattcctacgtcaccttgaggaaaacatatcaaagtagccttggtaacaccaataagagggttgagctcttcgatatgggtgctgggagtagcgagcctgctgctgaggacaatattcaaatggcatcagccatgacaaatcaacaactcattgatgctggaaggaatcaaatggatcaaacagatcaagctattgaacgttcaaaaatggttgtggcacaaactgttgagactggagctcaaactgctgcaacattaacacagcaaacggagcaaatgaagagaattggcaatgagcttgattcggtccacttttctctgaagaaagctagccaattagtgaaagagattggtcgccaggttgcaactgacaaatgtattatggcattcctctttctgattgttttaggtgtgattgctatcattgttgttaagattgtccatccaaacaacaaaaacatccgagacattccaggactggccccgcccgcacaaaattatcaaatccataacaggagattattgtgggcagaggatttcataggtctgtgatgtgcatggaggttacataaaggtgcactgtttgcgaagcagctatccacataagacataggatgtcgtaattgttctttgtgcttgtgtatttattctttcgtgttaactcctagccctaggtccgaattcctgcttttggtgtttgtacaccgctggccgtttggctctgtatatgcaacagggatgagatcttatacgagtcattaaaagtaagttcaatagtgcatgcttatgtcacttggtttttt

SEQ ID NO: 2549 - DNA, 1078 bp, Pennisetum glaucum
gtcgtggagctcgagcagatcgacggcgagatccacgacatcttccgcgccgggcatggcgaccgacttgcccatgagcccggagctcgagcagatcgacggcgagatccacgacatcttccgcgcgctgcaaaatggatttcaaaagatggataagattaaagattcaaataggcaagctaaacaattggaagaccttacaggaaaaatgaaggagtgcaagcgcttgatcaaagagttcgatcgcattctcaaagatgaggagtcaaataatccacctgagatcaacaagcagctaaatgacagaaaacagttcatgatcaaagagttgaattcctatgtcaccttgaggaaaacatatcaaagtagccttggtaacaacaataagagggttgagctcttcgatatgggtgctggaagtagtgagcctgctgctgaggacaatattcaaatggcatcagccatgacaaatcaacaacttattgctgctggaagggatcaaatggatcaaacagatcaagctattgaacgttcaaaaatggttgtagcacaaactgttgagactggagctcaaactgctgcaacattaacacagcaaacagaacaaatgaagagaatcggcaatgagctagattctgttcacttttcgctgaagaaagctagccaattagtgaaagagattggtcgccaggttgcaactgacaaatgtatcatggcattcctctttctgattgttgtaggtgtgattgctatcattgttgtcaagattgtccatccaaacaacaaaaacatccgagacattccaggactggccccgcctgcacaaaattatcaaatacacagcaggagattgttgtgggcagaggctttcgtaggtctgatgaactgatgattgtacatggaggttacataagcataggatgtcgtaactgttcttcgtgcttgtgtatttattctgtcgtgttaactcctagccctaggtctgggtttctgcttctggtgtttgaacaccgctggcggtttggtttggttctgtatatgcaacagagatgagatctatacaagtcattaacagtaa

SEQ ID NO: 2550 - DNA, 1216 bp, Pseudoroegneria spicata
  misc_feature (3)..(6): n is a, c, g, or t
  misc_feature (9)..(9): n is a, c, g, or t
  misc_feature (122)..(122): n is a, c, g, or t
acnnnnttnctctctctttcccccccttctcctcgtcgtcgtcctctctctaccccccccaatccccaatccctcctcgttctcctccgcggtttgaccggaaaggttcgtctgtagtaggntttgcgccggatagagaaggggaaaggtgaagcgtggaggcgggtgaagggagccatggcgagcgacgtgcccatgaccccggagctcgagcagatcgacggagagatccaggacatcttccgcgcactccaaaatgggttccaaaagatggacaagattaaagattctaataggcaagctaaacaattggaggatcttacagggaaaatgaaggagtgcaagcgcttgatcaaagagtttgatcgtattctgaaagatgaggagtcaaagaaccctcccgaagtcaacaagcagctaaatgacagaaaacagtatatgatcaaagagttgaactcctatgtcaccttgaggaagacataccaaagtagccttggtaacaacaagcgggttgaactctttgatatgggtgctacaagtagtgagcctgccgcagatgacaatattcaaatggcatcagctatgacgaatcaacagctcattgattctgggagaaaccaaatggatcaaacagacgaagctattgcacgttcaaaaatggttgttgcgcaaactgtcgaagttggatctcaaactgctacaacattaacacagcagacggaacaaatgaagagaattggtaatgagctcgattcggttcacttttcgttgaagaaagctagccagcttgtgaaagagattggccggcaggtagcaacagacaaatgcatcatggggttgcttgctctgatagtttttggcgttattgcaattatcgttgttaagatcgtcaacccacataacaagaacatcccagatatcccaggaatggctccacctgctcaaaattttcagacgaacaggagattgttgtcagcaaaagctttcagaggtctttgatgattgcatgcggtggtttcatgctgcagtccttttgtaacaaagctgctggcagtgcgccatgagatacgttgtaacaattcttctgctcatgtatattattttctgttgtgtgtatatgcactatgcaatatagatgagatcttctacaagtatgtaggattaccccctggcactttatgaaatttcaaatggtagaaacataatcattaccgta

SEQ ID NO: 2551 - DNA, 1386 bp, Panicum virgatum
ccccgcttccccaattccccgcctccgacgccccctcaccgctgccgcgggctccgagcctccgcctccgcccgggccccgcggggaatggcggcctgaggaggccggcgggctagggttcttcgatccgcgagccgagcgggaggggccgcccgccatggcgaccgacctgcccatgagcccggagctcgagcagatcgacggcgagatccacgacatcttccgcgcgctccaaaatggatttcaaaagatggataagattaaagattcaaataggcaagctaaacagttggaagatctcacagggaaaatgaaggaatgcaagcgcttgatcaaagagtttgatcgcattctcaaagatgaggagtcgaataatccacctgagatccacaaacagctaaacgacagaaaacagttcatgatcaaagagttgaattcctatgtcaccttgaggaaaacatatcaaagtagccttggtaacaacaataagagggttgagctcttcgatatgggtgctgcaagtagcgagcctgttgccgaggacaatattcaaatggcatcagccatgacaaatcaacaactcattgatgtgggaaggaatcaaatggatcaaacagatcaagctatcgaacgttcaaaaatggttgtagcacaaactgttgagactggaacacaaactgctgcaacattaacacagcaaacagagcaaatgaagagaattggtaatgagctagattctgttcacttttcgctgaagaaagctagccaattagtgaaagagattggtcgtcaggttgcgactgacaaatgtatcatggcattcctctttcttatcgttttgggtgtgattgctatcattgttgtcaagattgtccatccaaacaacaaaaacattcgagacattccaggactggctccgccagctcaaaattatcaaatcaataacaggagattgttgtggacagaggctttcataggtgtgtgatgattgggcacggaggtttcatgcaggtgcaccgcttgcgatgcagctacccacataagatgtaggatatgtcgtaactatttttctttgtgcttgtgtatttattttgtcgtgttaactcctagcaataggtctgtattcatgcttctggtgtttgtacaccgctggccatttgatcgtgtatatgcaacagagatgaaaccttgtacaagtcattagcacgaagccttaaaagagagctatactggtaacttcaatagttcgtcatgcttgtgtcagtttgtgtgcagagggacaaagcttatcgccatggcacttagggtgtgtttatttcattttggattttggaacgaaatctttcaacatttaaaatattaaatgtagactaatcacaaaactaa

SEQ ID NO: 2552 - DNA, 1483 bp, Panicum virgatum
ccacgcgtccggatttctaaaccccagctacgccggccaggagccaagccctaggccccaagtactgtgctctagcccggaatccccgaccacccctcctctcttcctcctccccctcggctcctcgcttcaccaattccccgcctccgacgctccttcaccgctgccgcgttctccgaacctccgcctccgcccgggccccgccgggaatggcggcctgaggaggccggcggactagggttcttcgatccgcgagccgagcgggaggggccgcccgccatggcgaccgacctgcccatgagcccggagctcgagcagatcgacggcgagatccacgacatcttccgcgcgctccaaaatggatttcaaaagatggataagattaaagattcaaataggcaagctaaacagttggaagatctcacagggaaaatgaaggaatgcaagcgcttgatcaaagagtttgatcgcattctcaaagatgaggagtcgaataatccacctgagatccacaaacagctaaacgacagaaaacagttcatgatcaaagagttgaattcttatgtcaccttgaggaaaacatatcaaagtagccttggtaacaacaataagagggttgagctcttcgatatgggtgctgcaagtagcgagcctgctgccgaggacaatattcaaatggcatcagccatgacaaatcaacaactcattgatgtgggaaggaatcaaatggatcaaacagatcaagctattgaacgttcaaaaatggttgtagcacaaactgttgagactggagcacaaactgctgcaacattaacacagcaaacagagcaaatgaagagaattggcaatgagctagattctgttcacttttcgctgaagaaagctagccaattagtgaaagagattggtcgtcaggttgcaactgacaagtgtatcatggcattcctctttctgatcgttttgggtgtgattgctatcattgttgtcaagattgtccatccaaataacaaaaacattcgagacattccaggactggccccgccagctcaaaattatcaaatcaataacaggagattgttgtggacagaggctttcataggtgtgtgatgattgtgcatggaggtttcatgcaggtgcaccgcttgggatacagctatctacataagatgtaggatatatcgtaactatttttctttgcgcttgtgtatttattttgtcgtgttaactcctagcagtaggtctgtattcatgcttctgttgtttgtacaccgctggccatttgatcgtgtatatgcaacagagatgaaatcttgtacaagtcattagcacgaagtcttaaaagagagctatacaggtaacgtcaatagttcttcatgcttgtgttcagtttgtgtgcagaggacaaagattatcaccatggcatttacttcttggctgttgcacgcagcatgccacttgttatagatttctctattgcatgagt

SEQ ID NO: 2553 - DNA, 2803 bp, Panicum virgatum
cgccgacctagtatgtctgtgcaattcccaaatataaatcgaacgacccttccagaaccaagctagggtttcgcctccccccaccctcccgctctcccacctctcctcccggccaccgcgcgaccgccgcgccgctctcgccgccgccgccgccgccatggggacggagcggaagcggaaggtgagcctcttcgacgtggtcgacgagacctccgtctccgccaagctcggccgcggcgccactaacggcgccgccgccgccgtgggcggggccaaccccaccgtcaaccggtggaacgggcggccatactcggcgcggtattttgagatcctcgagaagcgacgcacgctccccgtgtggcagcagaaggaggagttccttcgcgccctccgcgacaaccaggccctcattctcgtcggcgaaacgggaagcggaaagaccactcagatcccccaatttgtacttgagactgaaggcctgggtaaccgttcaatggttgcctgcactcagccgcggagggttgcagcaatgtcagtctccaggcgtgtggctgaggaaatggatgttactattggggaggaagtgggatacagcatccgttttgaggattgcagcagccacaaaactgttctcaaatatttgacagatggtatgcttctgagagaagcaatggcagacccacttttagagaagtacaaggtgattgttcttgatgaggctcatgagagaacattggcaacagatgttctgtttgggcttctgaaggaggttctaaaaaatagaccggatttgaagcttgtcgttatgagtgctacccttgaagcagagaaattccagggttacttcagtggtgcaccattgatgaaggtaccagggaggcttcacccggttgaaatcttctatactcaagaaccagaaagggactacctagaggctgctatcaggacagttgtgcaaatacacatgtgtgaacctgctggtgatatccttgtattccttacaggagaagaggagattgaggatgcctgtcgtaaaattaacaaggaaattaataacatgggagatcaggttggccctgttaaagttgtgcctttgtattctacgctgcctccagccatgcagcagaagatttttgaacctgctcctgccccgttgaaggaaggaggccctcctgggagaaaaattgttgtgtccacaaatattgctgagacatccttaactatagatggtatagtttatgtgatagatccagggttttccaagcagaaagtttacaacccaaggataagggtggaatccctcctggtgtcaccaatttccaaggcaagtgctcatcagagagctggtcgtgctggaagaacgcagcctggaaagtgcttcaggctatacactgagaagagttttaatgaggatttgcaaccacaaacctacccagaaattcttaggtcgaacctggcaaatacagttcttaccttgaagaaacttggaattgatgatttagtacattttgactttatggatcctccagcaccggaaactcttatgagggctttagaagttttgaactacttgggggcacttgatgatgacggtaatctaacacagttaggtgaaatgatgagcgagtttcccctggatccacaaatgtcaaagatgcttgtcatcagtccaaagtacaactgttcgaatgagatcctatcaatatctgccatgctttcagtacccaattgcttcctccggcctagggaggctcaaaaggctgctgatgaggcgaaggctcggtttggccatattgatggggaccatctcacgcttctgaatgtataccacgcatacaagcaaaacaatgaagatccccagtggtgttacgagaactttatcaatgccagagcacttaagtctgcggacaacgtcagacaacagcttgttcgcatcatgactagattcaatctcaagatgtgcagcacagacttcaatagccgtgagtactatgtcaatatcaggaaagcactgcttgcagggtatttcatgcaggttgctcacctggagcgcactggacattacctgactgtaaaagataatcaggtcgtccatcttcatccctcaaactgcatggaccataagccagagtgggtcatctacaacgaatacgtcctgacaactaggaatttcatccgcacagtcacagatatccgtggggaatggctgattgatatcgctccacactactatgatctgagcaacttcccgtcatgcgaggcgaagcgtgttcttgagaggctgtataacaagcgggagagggaaagggccacgaacagaggttgaagatgatgcttcttttttgcccggtgccagtgattgtgctgccagttaagggccagagccagaactcaagtgaagcctttgccgcgtccaccctgatacatcttgccatctaggcccccaccataagtaggcaccacatttcatcagcttggtgattattttgtaagaattatcaaatgtttgctgatgcaactgtgtaacagcgtcgaggttatatctttgtttttcttctcttagaaaggtagtgcagattgatcgggtatctgtctccgtataaatgcggagaagactttcattttcttatttttgccattttgtacccggtttcaatgagaacatgctgatatatgttcgtagttttagctcttatgcaaacatttcctggtttttcctcttttctgtgacacggtgaagtatatgtacaagtagcatgtcatctaaatatacgtgctaacaggtgctactccaaatactcaa

SEQ ID NO: 2554 - DNA, 2951 bp, Panicum virgatum
ttcggacctccaataacccgctttcgcaccgtgctatcgcgcgggcctcacgctctcgcggtctcgctggcctggtatttgtctgtgcaatttccaaatataaatcgaacgacccttccagaaccaagctagggtttcgcttccccccaccctcccgctctcccgcctcttcctcccggccaccgcgcgaccgcagcgccgctctcgccgccgccgccatggggacggagcggaagcggaaggtgagcctcttcgacgtggtcgacgagacctccatctccgccaagctcggccgcggcgccaccaacggcgccgccgccgccgcgggcggggccaaccccaccgtcaaccggtggaacgggcggccatactcggcgcggtattttgagatcctcgagaagcgacgcacgctccccgtgtggcagcagaaggaggagttcctccgcgccctccgcgacaaacagaccctcatccttgtcggcgaaacgggaagcggaaagaccactcagatcccccaattcgtacttgagactgaaggcctgggtaaccgctcaatggttgcctgcactcagccgcggagggttgcagcaatgtcagtctccaggcgtgtggctgaggaaatggatgttactattggggaggaagtgggatacagcatccgttttgaggattgcagcagccacaaaactgttctcaaatatttgacagatggtatgcttctgagagaagcaatggcagacccacttttagagaagtacaaggtgattgttcttgatgaggctcacgagagaacattggcaacagatgttctgtttgggcttctgaaggaggttctaaaaaatagaccggatttgaagcttgtcgttatgagtgctacccttgaagcagagaaattccagggttactttagtggggcaccattgatgaaggtaccagggagacttcacccggttgaaatcttctatactcaagaaccagaaagggactacctagaggctgctatcaggacagttgtgcaaatacacatgtgtgaacctgctggtgatatccttgtattccttacgggagaagaggagattgaagatgcctgtcgtaaaattaataaggaaattaataacatgggagatcaggttggcccagttaaagttgtgcctttgtattctacgctgcctccagccatgcagcagaagatttttgaacctgctcctgccccattgaaggaaggaggccctcctgggagaaaaattgttgtgtccacaaacattgctgagacgtccttaactatagatggtatagtttatgtgatagacccagggttttccaaacagaaagtttacaacccaaggataagggtggaatccctcctggtgtcaccaatttccaaggcaagtgctcatcagagagctggtcgtgctggaagaacgcagcctggaaagtgcttcaggctatacactgagaagagttttaacgaggatttgcaaccacaaacctacccagaaattcttaggtcaaacctggcaaatacagttcttaccttgaagaaacttggaattgatgatttagtacattttgactttatggaccctccagcaccggaaactcttatgagggctttagaagttttgaactacttgggggcacttgatgatgacggtaatctaacacagttaggtgaaatgatgagcgagtttcccctggatccacaaatgtcgaagatgcttgccatcagtccaaagtacaactgttcgaatgagatcctatcaatatctgccatgctttcagtacccaattgcttcctccggcctagggaggctcaaaaggctgctgatgaggcgaaggctcgatttggccatattgatggggaccatctcacgcttctgaatgtataccacgcatacaagcaaaacaatgaagatccccagtggtgttacgagaactttatcaatgccagagcacttaagtctgcggacaatgtcagacaacagcttgttcgcatcatgactagattcaatctcaagatgtgcagcacagacttcaatagccgtgagtactatgtcaatatcaggaaagcactgctcgcagggtatttcatgcaggttgctcacctggagcgcactggacattacctgactgtaaaagacaaccaggtcgtccatcttcatccctcgaactgcatggaccataagccagagtgggtcatctacaacgaatatgtcctgacgactaggaatttcatccgcacagtcacagatatccgtggggaatggctgattgatatcgctccacactactatgatctgagcaactttccatcatgcgaggcgaagcgtgttctcgagaggctgtataacaagcgggagagggaaagggccacgaacagaggttgaagttgatgcttcttttttacccggtgcccgtgattgtgctgccagttaagggccagagccagaactcaagtgaagccttggccgtccccccctgatacatcttgccatcttgggccccaaccataagcaaaggcaccacatttcatcagcagggtgattattttgtaaacaatatcaaatgtttgctgatgcaactgtgtaacagcgacgaggtcgtatctttgtttttcttcccttagaagggtagtgcagattggttgggtatcatctccgtataaatgcggagaagactttaatttttcttatttttgccattttgcaccggtttcaatgagaacgtgctgatatatgttcgtagttttagctcgtatgcttatgcttcctgttttttccctctttttctgtgacacagtgaagtatatgtacaagtagcatatctatataacctatatagatgcaatctactaagctgacacgtcatctacttttttctgcactacctcttcctgtacccaacaaaatccattgatattaccctcccactcttgagctacgagtaccaaa

SEQ ID NO: 2555 - DNA, 2378 bp, Panicum virgatum
ctccccccaccctcccgctctcccaccttttcctcccggccaccgcgcgaccgcagcgccgctctcgccgccgccgccgccgccatggggacggagcggaagcggaaggtgagcctcttcgacgtggtcgacgagacctccatctccgccaagctcggccgcggcgccactaacggcgccaccgccgccgtgggcggggccaaccccaccgtcaaccggtggaacgggcggccatactcggcgcggtattttgagatcctcgagaagcgacacacgctccctgtgtggcagcagaaggaggagttccttcgcgccctccgcgacaaccagaccctcattctcgtcggtgaaacgggaagcggaaagaccactcagatcccccaattcgtacttgagactgaaggcctgggtaaccgctcaatggttgcctgcactcagccgcggagggttgcagcaatgtcagtctccaggcgtgtggctgaggaaatggatgttactattggggaggaagtgggatacagcatccgttttgaggattgcagcagccacaaaactgttctcaaatatttgacagatggtatgcttctgagagaagcaatggcagacccacttttagagaagtacaaggtgattgttcttgatgaggctcacgagagaacattggcaacagatgttctgtttgggcttctgaaggaggttctaaaaaatagaccggatttgaagcttgtcgttatgagtgctacccttgaagcagagaaattccagggttactttagtggtgcaccattgatgaaggtaccagggagacttcacccggttgaaatcttctatactcaagaaccagaaagggactacctagaggctgctatcaggacagttgtgcaaatacacatgtgtgaacctgctggtgatatccttgtattccttacgggagaagaggagattgaagatgcctgtcgtaaaattaataaggaaattaataacatgggagatcaggttggcccagttaaagttgtgcctttgtattctacgctgcctccagccatgcagcagaagatttttgaacctgctcctgccccattgaaggaaggaggccctcctgggagaaaaattgttgtgtccacaaacattgctgagacgtccttaactatagatggtatagtttatgtgatagacccagggttttccaaacagaaagtttacaacccaaggataagggtggaatccctcctggtgtcaccaatttccaaggcaagtgctcatcagagagctggtcgtgctggaagaacacagcctggaaagtgcttcaggctatacactgagaagagttttaacgaggatttgcaaccacaaacctacccagaaattcttaggtcaaacctggcaaatacagttcttaccttgaagaaacttggaattgatgatttagtacattttgactttatggaccctccagcaccggaaactcttatgagggctttagaagttttgaactacttgggggcacttgatgatgacggtaatctaacacagttaggtgaaatgatgagcgagtttcccctggatccacaaatgtcgaagatgcttgtcatcagtccaaagtacaactgttcgaatgagatcctatcaatatctgccatgctttcagtacccaattgcttcctccggcctagggaggctcaaaaggctgctgatgaggcgaaggctcgatttggccatattgatggggaccatctcacgcttctgaatgtataccacgcatacaagcaaaacaatgaagatccccagtggtgttacgagaactttatcaatgccagagcacttaagtctgcggacaatgtcagacaacagcttgttcgcatcatgactagattcaatctcaagatgtgcagcacagacttcaatagccgtgagtactatgtcaatatcaggaaagcactgctcgcagggtatttcatgcaggttgctcacctggagcgcactggacattacctgactgtaaaagataaccaggtcgtccatcttcatccctcaaactgcatggaccataagccagagtgggtcatctacaacgaatatgtcctgacaactaggaatttcatccgcacagtcacagatatccgtggggaatggctgattgatatcgctccacactactatgatctgagcaacttcccgtcatgcgaggcgaagcgtgttcttgagaggctgtataacaagcgggagagggaaagggccacgaacagaggttgaagatgatgcttcttttttgctcggtgccagtgattgtgctgccagttaagggccagagccagaactcaagtgaagcctttgccgcgtccaccctgatacatctgcatctaggcccccaccataag

SEQ ID NO: 2556 - DNA, 2804 bp, Sorghum bicolor
gcaaaatttcccaaatataaaatcgaacgacctccagaacaaagctagggtttgcctcccccaccctcctctcctcccgctctcccgcctcctcctgggaaccgcgtgagccaaggaccgctcgtcgtctctcgcctccgccgcagccgccgccgcagccgccgctgccatggggacggagcggaagcggaaggtgagcctcttcgacgtggtcgacgagacctccgtctccgccaagctgggccgcgccgcctccaacggcgccgccgccaccgcggcggggggcaacccgtctgtcaaccggtggaacgggcggccctacacggcacggtacttcgagatcctcgagaagcgccgcacgctccccgtgtggcagcagaaggaggagttcctccgctctctccgcgacaaccagaccctcatcctcgtcggtgaaacgggaagcgggaagacaactcagatcccccaatttgttcttgaggcggaaggcttgagtaaccgttccatggttgcttgcactcagcctcggagggttgcagcaatgtcagtctccaggcgtgtggcggaggagatggatgttactattggggaagaagtgggttacagcattcggtttgaggattgcagcagccacaaaactgttctcaaatatttgacagatggtatgcttttgagagaagcaatggcagacccacttttagagaagtacaaggtgattgttcttgatgaggctcatgagaggactttggcaacagatgttctgtttgggcttctaaaggaggttctaaaaaatagaccagatttgaagcttgttgttatgagcgctacccttgaagcagagaaattccagggttacttcagtggtgcacccttgatgaaggtgcctgggagacttcatccagttgagatattttatacccaagaaccagagagggactatctagaggctgctatcaggacagttgtgcaaatacatatgtgtgaacctgctggtgatatccttgtattccttactggagaagaggagattgaggatgcatgtcggaaaatcaataaggaaattaataatatgggagatcaggttggcacagttaaagtcgtgcctttatactctacactgcctccagccatgcagcagaagatttttgaacctgctcctgccccattgaaggaaggaggtcctcctggaaggaaaattgttgtctccacaaacattgctgaaacatccttaactatagatggcatagtttatgtgatagacccagggttttccaaacagaaagtttacaacccaagaataagggtggaatccctcctggtgtcaccaatttctaaggcaagtgctcatcagagagctggtcgtgctggacgaacgcaacctgggaagtgctttaggctatacacagagaagagtttcaatgaggatttgcaaccacagacatacccagaaattcttcggtcgaacctggcaaatacagttctgaccttgaagaaacttggaattgatgatttagtacattttgactttatggatcctccagcgccagaaactctaatgagggccttagaagttttgaactatttgggtgcactagatgatgaaggtaatctaacacagttaggtgagatgatgagtgagtttcccctggatccacaaatgtcgaagatgcttgtcatcagtccaaagtacaactgttcgaacgagatcttatcaatatctgccatgctgtcagtacccattgcttcctccggcctagggaggctcaaaaggctgctgatgaggcgaaggctcgatttggccatattgatggggaccatctgacgcttctgaatgtataccatgcatacaagcaaaacaatgaagatccccagtggtgttacgagaactttatcaattccagagcacttaagtctgcagacaatgtcagacaacagcttgttcgcatcatgactagattcaacctcaagatgtgcagcacggatttcaatagccgtgagtactatgtcaatataaggaaagccatgcttgcagggtatttcatgcaggtcgctcacctggagcgaactggacattacctgactgtaaaagacaaccaggttgtccatcttcatccctccaattgtatggaccataagccagagtgggtcatctacaatgaatacgtcttgaccaccaggaatttcatccgcacagtcaccgatatcggtggggaatggctaattgatatcgcgccacattactatgatctgagcaatttcccgtcatgtgaggccaagcgtgttcttgagaggctgtataacaagcgggagagggaaagagcttcaaatagaggctgaagttgatactacaaacctggtgaatcataattccacagcaggtctatccagagcccttatacaagctttggttgtcacagatagccaccccatttggcataggcaaaggcgtcaccatgacgtcttctacaccgtattgcctattgtgtttcatcagcatgatcattatgtagacatcctcagaaatcctttagcagctcaattagttgtgatgcagattaattgtgtgccaatctccttgtttttgtatgcatcagaaatttatattttttgtttctatgtggttaactggttatcctttggttggaatgaaaattcactgattttggtttattatcttagctggggttatgtatgcctattatgcctacttccggatgcaagaggaagggttgaacgaggttggcactgaagaaaagtttctgtccccccattttttaatataatactttctgtgtgatacgtca

SEQ ID NO: 2557 - DNA, 2587 bp, Zea mays
caggcctccacaacaaagctagggtttgcctcccccaccctcctggcctcctcccgctttccctcatcctcgtgcgaacctcgcgagccaaggaccgctcgtcgtctcttgtctcgccgtcgccatgggtacggagcggaagcggaaggtgagtcttttcgacgtggtcgacgagacctccgtctccggcaagctgggccgcgccgcctccaacggcgccgccgccactgcggcggggaccaatccgtctgtcaaccggtggaacggccggccctacacggcacggtacttcgagatcctcgagaagcgccgcacactgcccgtgtggcagcagaaggaggagttcctccgccgcctccgcgacaaccagaccctcatcctcgtcggcgaaacgggaagcggaaagacaactcagattccacaatttgttcttgagactgaaggcttgggtaaccgttccatggttgcctgcactcagcctcggagggtcgcggcaatgtcagtctccaggcgtgtggcagaggagatggatgttactattggggaagaagtgggttacagtattcggtttgaagattgcagcagccacaaaactgttctcaaatatttgacagatggtatgcttctgagagaagcaatggcagacccacttttagagaagtacaaggtgattgttcttgatgaggctcatgagaggactttggcaacagatgttttgtttgggcttctgaaggaggttctaaaaaatagaccggatttgaagcttgttgttatgagtgctactctcgaagcagagaaattccagggttactttagtgatgcaccgttgatgaaggtgcctgggagacttcatccagttgagatattttacacccaagaaccagagagggactatctagaggctgctatcaggacagttgtgcaaatacatatgtgtgaacctgctggtgatatccttgtattccttactggagaagaggagattgaggacgcatgtcggaaaatcaataaggaaatcaataatatgggagatcaggttggcccagttaaagtcgtgcctttatactctacactgcccccagccatgcagcagaagatttttgaacctgctcctgccccattgaaggaacgaggtcctcctggaaggaaaattgttgtgtccaccaacattgctgaaacatccttaactatagatggcatagtttatgtgatagacccggggttttctaaacagaaagtttacaacccaagaataagggtggaatccctcctggtgtcaccaatttctaaggcaagtgctcatcagagagctggtcgtgctggacgaacgcaacctgggaagtgctttaggctatacacagagaagagctttaatgaggatttgcaaccacagacatacccagaaattcttcggtcgaacctggcaaatacagttcttaccttgaagaaacttggaattgatgatttagtgcattttgactttatggatcctccagcaccagaaactctaatgagggccttagaagttttgaactatttggctgcactagatgatgaaggtaatctaacacagttaggtgagatgatgagtgagtttcccctggatccacaaatgtcaaagatgcttgtcatcagtccaaagtacaactgttcgaatgagatcttatcaatatctgccatgctgtcagcacccaattgcttcctccggcctagggaagctcaaaaggctgctgatgaggccaaggctcgatttggccatattgatggggaccatctgacgcttctgaatgtataccatgcatacaagcaaaacaatgaagatccccagtggtgttatgagaactttatcaattccagagcactcaagtctgcagacaatgtcagacaacagcttgttcgcatcatgactagattcaacctcaagatgtgcagcacggatttcaatagccgtgagtactacgtcaatatcaggaaaaccctgcttgcagggtatttcatgcaggtcgctcacctggaacgaactggacattacctgactgtaaaagataaccaggtcgtccatcttcatccctccaattgcatggaccataagccagagtgggtcatctacaatgaatacgtcttgactaccaggaatttcatccgcacagtcaccgatatccgtggggaatggctaattgatattgcgccgcattactatgacctgagcaatttcccgtcatgtgaggccaagcgtgttcttgagaggctgtataacaagcgggagagggaaagagctgcaaatagaggctgaagttgatacttccacaaacctggtgcttcataattccacagcaggttatcacagatggcggacccgtttgtcatatgcatgatgtcttccacagcctgttgcctagtgtttcatcagcatgatcattatgcagacagcctcgagaaatcccttggcagctcaattagttatgatgcagattaattttgtgccattctccttatttttgtatgcgtaagatatttatattttgcgtttctatgtgattaactggttatccttcggttggaatgaaattccactgattttggttta

SEQ ID NO: 2558 - DNA, 2650 bp, Zea mays
gccccagaaacaaagctagggtttgcctcccaaccctcctcccgttctcccgcctcctcctgtgaaccgcgcgagccaaggaccgcccgtcgtctctcgccgccatggggacggagcggaagcggaaggtgagcctgttcgacgtggtcgacgagacgtccgtctccgccaagctgcgcgccgcctccaacggtgccgccgccaccgcgactgggggcaacccgtctgtcaaccggtggaacgggcggccctacacggcacggtacttcgatatcctcgagaagcgccgtacgctccccgtgtggcagcagaaggaggagttcctccgctccctccgcgacaaccagaccctcatcctcgtcggcgaaactggaagcgggaagacaactcagatcccccaatttgttcttgagacggaaggcttgggtaaccgttccatggttgcctgcactcagcctcggagggtcgcagcaatgtcagtctccaggcgtgtggcggaggagatggatgttactattggggaagaagtgggttatagcattcgatttgaggattgcagcagccacaaaactgttctcaaatatttgacagatggtatgcttctgagagaagcaatggcagacccacttttagagaagtacaaggtgattgttcttgatgaggctcatgagaggactttagcaacagatgttctgtttgggcttctgaaggaagttctaaaaaatagaccagatttgaagcttgttgttatgagtgctaccctcgaagcagagaaattccagggttacttcaatggtgcacccttgatgaaggtgcctgggagacttcatccagttgagatattttacacccaagaaccagagagggactacctagaggctgctatcaggacggttatgcaaatacatatgtgtgaacctgctggtgatatccttgtattccttacaggagaagaggagattgaggatgcatgccggaaaatcaacaaggaaactaataatatgggagatcaggttggcccagttaaagtcgtgcctttgtactccacactgcccccagccatgcagcagaagatttttgaacctgctcctgccccattgaaggaaggaggtcctcctggaaggaaaattgttgtgtccaccaacattgctgaaacatccttaactatagatggcatagtttatgtgatagacccggggttttccaaacagaaagtttacaacccaagaataagggtggaatcccttctggtgtcacccatttctaaggcaagtgctcatcagagagctggtcgtgctggacgaacacaacccgggaagtgttttaggctatacacggagaagagttttaatgaggatttgcaaccacagacatacccagaaattcttcggtcgaacctggcaaatacagttcttaccttgaagaaacttggaattgatgatttagtgcattttgactttatggatcctccagcaccagaaactctaatgagggccttagaagttttgaactatttgggtgcactagatgatgaaggtaatctgacacagttaggtgagatgatgagcgagtttcccctggatccacaaatgtcgaagatgctcgtcatcagtccaaaatacaactgttcgaatgaaatcttatcagtatctgccatgctgtcagcacccaattgcttcctccggcctagggatgctcaaaaggctgctgatgaggcgaaggctcgatttggccacattgacggggaccatctgacgcttctgaatgtataccatgcatacaaacaaaacaatgaagatccccagtggtgttacgagaactttgtcaattcaagagcacttaagtctgcagacaatgtcagacaacagcttgttcgcatcatgactagattcaacctcaagatgtgcagcacggatttcaatagccgtgagtactatgtcaatatcaggaaagccatgcttgcggggtatttcatgcaggtcgctcacctggaacgaactggacattacctgactgtaaaagataaccaggtcgtccatcttcatccctccaattgtatggaccataaaccagagtgggtcatctataatgaatatgtcttgaccaccaggaatttcattcgcacagtcaccgatatccgtggggactggctaattgatattgcgccacattactatgatctgagcaatttcccgtcatgtgaggccaagcgtgttcttgagaggctgtataacaagcgagagagggaaagagctgcaaatagaggctgaggttgatacttccacaaacctggtgctctgtaattccaccgcaggtctatccagagcccgtatacgagctttggttatcacagatagctgtcccatttgtcttaggcaaatgcgttagcatgatgtctcctacacaccctaatatctattgtctcatcagcatgatcattatgtacacaacctcgagaaattctttagcatctcaattagttgtgattcagattaattgtgtgacagtctgtttttgtatgcatcagacgtttatgttttgtgtttctatgtggttaattggttaccctttggaatgaaaatccactgaatttggtttattagcttacctggggctaagcctacgtcctgttgcaggaggaagttgttaa

SEQ ID NO: 2559 - DNA, 2757 bp, Secale cereale
gttcacgaaaacccaacgcgaccggggctgcaagtgcaaggtcacaaagggcgccttccaggctggtaaacgaaaatcccggaaacccgctaccacgcgagcggagtcccatctcgcagcctgacgcgacctaagaatcgcgcaattcacaaatataaaatccggcgattcttccagaaacgggagctagggtttcacctctccacccggccctctctcccgcctattcctcctccgcacaccagcgacctctctcgccgccgccatggggaccgagcggaagcgcaaggtgagtctcttcgacgtggttgacgagacctccgtatccgcgaagctcggccgcgccggcatcaatggtgccgccgccgccgccgcggccaatccgtccatcaaccggtggaacggccggccctactccgcgcggtacctagagatcctcgagaaacgccgcacgctccccgtgtggcagcagaaggacgagttcctccgcgtcctccgcgacaaccagaccctcatccttgtcggagaaaccggaagtggcaagaccactcagatcccccaatttgtgctcgaggctgaaggtttgagcaaccgctctatggttgcctgcacccagccgcggagggttgctgcaatgtcagtctctcggcgtgtcgctgaggagatggatgtcacaatcggggaggaagttggttacagtatccgattcgaagattgcagcagtcacaaaactgttctcaaatatttgacagatggtatgcttctgagagaagcaatggcagacccacttttagagaggtacaaggtgattgttcttgacgaggctcatgagcgcacgttggcaacagatgttctgtttgggcttctgaaggaagttctaaagaacaggcctgacttgaagcttgttgttatgagtgctactcttgaggcagagaagtttcagggttatttcagtggtgcaccattgatgaaggttcctggtagacttcatccggttgaaatcttctatactcaggaaccagaaagggactatctagaagctgctatcaggacagttgtgcagatacatatgtgtgaacctgctggtgatatccttgtattccttactggagaagaggagatcgaggatgcttgtcggaaaataaacaaggaagttaataacatgggtgatcaggttggcccagttaaagtcgtgccattgtactctactctaccccctgcaatgcagcagaagatttttgaccctgctccacctccattgaaagagggaggtcctgctggaaggaaaattgttgtgtccacaaacattgctgagacatccctaaccatcgatggtatagtgtatgttatagatccagggttttccaaacagaaggtttacaatccaaggataagggtggaatcccttttggtgtctccaatttccaaggcaagtgcgcatcagagagctggccgtgctggaagaacacagcctgggaagtgcttcaggttgtacacagagaagagttttaatggtgatttacagccgcagacctacccagaaattcttcggtcaaacctggcaaatacggttcttactctgaagaagcttggaattgatgatttagtgcattttgacttcatggatcctcctgcacctgaaactctaatgagggccttggaagttctgaactacttgggggcactcgatgatgaaggcaacctaacatctttaggtgaaatgatgagtgagttccccttggacccacagatgtcaaagatgcttgtcatcagtccaaggtacaactgttcaaatgagatcctctcaatatctgccatgctatcagtacccaattgctttctccggcctagggaggcacaaaaggctgctgatgaggcgaaggctcgatttgggcacatcgatggggatcatctgacactgctcaacgtataccatgcatacaagcaaaacaatgaggatcctacatggtgttatgagaattttgtcaatgcccgggcgatgaagtctgctgataatgttaggcaacaacttgtccgcatcatgaccagattcaacctcaagatgtgcagtacagacttcaacagtcgtgagtactatgtcaacatcaggaaagcaatgctttcagggtactttatgcaggttgctcatctggagcgaactgggcattacttgaccgttaaggataatcaggttgtccatcttcatccctcaaattgcatggaccataagccggagtgggtcatctacaatgaatatgttttgaccaccaggaatttcatccgcacagtcaccgatatccgtggagagtggttgatcgatatagctccacagtactatgatctgaccaatttcccatcatgtgaggccaagcgtgttcttgagaggctacacaataagagggagagggaaagagctgctagtaggaactgaattgatgtcattcttctggtcccatggaatgtgggcagcgccgccaaaggctttggacatcactgttggcctccaccattgtcatgatatcttccatgtcataattctccagtattgtggatggtgaaatcactatatacgacatatgtggcaaatgtccctctgctactgcattacgaattagatgcttgttttccctctgttttatagaaggtggtagcttatcatacattaattatgtgtcggtctccatatttttggtgtatcaaacgctgttgtttactttttacttcagcatccttttggccagttctcatggaatggct

SEQ ID NO: 2560 - DNA, 2659 bp, Triticum aestivum
tcccgcctattcctcctccgcgcaccagcgacccctctcgccgccgccatggggacggagcggaagcgcaaggtgagcctcttcgacgttgtcgacgagacctccgtatccgcgaagctcggccgcgccggcatcaatggtgccgccgccgccgccgcggccaatccgtccatcaaccggtggaacggccggccctactcggcgcggtacctagagatcctcgagaagcgccgcacgctccccgtgtggcagcagaaggacgagttcctccgcgtcctccgcgacaaccagaccctcatccttgtcggagaaaccggaagtggcaagaccactcagatcccccaatttgtgctcgaggctgaaggtttgagcaaccgctctatggttgcctgcacccagccgcggagggttgctgcaatgtcggtctctcggcgtgtcgcggaggagatggatgtcacaatcggggaggaagttggttacagtatccgattcgaagattgcagcagtcacaaaactgttctcaaatatttgacagatggtatgcttctgagagaagcaatggcagacccacttttagagaggtacaaggtgattgttcttgacgaggctcatgagcgcacgttggcaacggatgttctgtttgggcttctgaaggaagttctaaagaacaggcctgacttgaagcttgttgtcatgagtgctactcttgaggcagagaagtttcagggttatttcagtggtgcaccattgatgaaagttcctggtagacttcatccggttgagatcttctatactcaggaaccagaaagggactatctagaagctgctatcaggacagttgtgcagatacatatgtgtgaacctgctggtgatatccttgtattccttactggagaagaggagattgaggatgcgtgtcggaaaataaacaaggaagttaataacatgggtgatcaggttggcccagttaaagtcgtgccattgtactctactctcccccctgcaatgcagcagaagatttttgaccctgctccacctccattgaaagagggaggtcctgctggaaggaaaattgttgtgtccacaaacattgctgagacatccctaaccatcgatggtatagtgtatgttatagatccagggttttccaaacagaaggtttacaatccaaggataagggtggaatcccttttggtgtctccaatttccaaggcaagtgcgcatcagagagctggtcgtgctggaagaacacagcctgggaagtgcttcaggttgtacacagagaagagttttaatggtgatttacagcctcagacctacccagaaattcttcggtcaaacctggcgaatacagttcttactctgaagaagcttggaattgatgatttggtgcattttgacttcatggatcctcctgcacccgaaactctaatgagggccttggaagttctgaactacttgggggcactcgacgatgaaggcaacttaacatctttaggtgaaatgatgagtgagttccccttagacccacagatgtcaaagatgcttgtcatcagtccaaggtacaactgttcaaatgagatcctctcaatatctgccatgctatcagtacccaattgctttctccggcctagggaggcacaaaaggctgctgatgaggcgaaggctcgatttgggcacatcgatggggatcatctgacacttttgaacgtgtaccatgcatacaagcaaaacaatgaggatcctacatggtgttatgagaattttgtcaatgcccgggcgatgaagtctgctgataatgttagacaacaacttgtccgcatcatgaccagattcaacctcaagatgtgcagtacagacttcaacagtcgtgagtactatgtcaacatcaggaaagcaatgctttcagggtactttatgcaggttgctcatctggagcgaactgggcattacttgaccgttaaggataatcaggttgtccatcttcatccctcgaattgcatggaccataagccggaatgggtcatctacaatgaatatgttttgaccaccaggaatttcatccgcacagtcaccgatatccgtggagagtggctgatcgatatagctccacagtactatgatctgaccaatttcccatcatgtgaggccaagcgtgttcttgagaggctacacaataagagggagagggaaagagctgctagtaggaactgaattgatgtcattcttctggtcccttggatggcagcgccgccaaaggctttggacatcactgttggcctccaccattgtcatgatatcttccatgtcgtagttttccagtattgtggacggtgaaatcactatatacgacatatgtcaaatgtccctctgctactgcattacgaattagatgcttgttttccctctgttttagaaggtgtaggttatcatacattaattatgtgtcggtctccatatttttggtgtatcaaacgctgttgtttactttgtacttcagcatccttttggctagttttcatggaattgctgacatcgcactgtgtttactaacttctgagacaacttgtgtaactagtcaggaaattacaccccccgtcctgaattatttgtcttagatttgttttaggtttgaatacagaaaatatgacttagggtc

SEQ ID NO: 2561 - DNA, 2633 bp, Triticum aestivum
cagaaacgggagctagggtttcgcctctccacccggccctctctcccgcctattcctcctccgcgcaccagcgacctctctcgccgccgccatggggacggagcggaagcgcaaggtgagcctcttcgacgtggttgacgagacctccgtatccgctaagctcggccgcgccggcatcaatggtgccgccgccgcggccaatccgtccatcaaccggtggaacggccggccctactcggcgcggtacctagagatcctcgagaagcgccgcacgctccccgtgtggcagcagaaggacgagttcctccgcgtcctccgcgacaaccagaccctcatccttgtcggagaaaccggaagtggcaagaccactcagatcccccaatttgtgctcgaggctgaaggtttgagcaaccgctctatggttgcctgcacccagccgcggagggttgctgcaatgtcggtctctcggcgtgtcgcggaggagatggatgtcacaatcggggaggaagttggttacagtatccgattcgaagattgcagcagtcacaaaactgttctcaaatatttgacagatggtatgcttctgagagaagcaatggcagacccacttttagagaggtacaaggtgattgttcttgacgaggctcatgagcgcacgttggcaacggatgttctgtttgggcttctgaaggaagttctaaagaacaggcctgacttgaagcttgttgttatgagtgctactcttgaggcagagaagtttcagggttatttcagtggtgcaccattgatgaaggttcctggtagacttcatccggttgagatcttctatactcaggaaccagaaagggactatctagaagctgctatcaggacagttgtgcagatacatatgtgtgaacctgctggtgatatccttgtattccttactggagaagaggagattgaggatgcgtgtcggaaaataaacaaggaagttaataacatgggtgatcaggttggcccagttaaagtcgtgccattgtactctactctcccccctgcaatgcagcagaagatttttgaccctgctccacctccattgaaagagggaggtcctgctggaaggaaaattgttgtgtccacaaacattgctgagacatccctaaccatcgatggtatagtgtatgttatagatccagggttttccaaacagaaggtttacaatccaaggataagggtggaatcccttttggtgtctccaatttccaaggcaagtgcgcatcagagagctggtcgtgctggaagaacacagcctgggaagtgcttcaggttgtacacagagaagagttttaatggtgatttacagcctcagacctacccagaaattcttcggtcaaacctggcaaatacagttcttactctgaagaagcttggaattgatgatttagtgcattttgacttcatggatcctcctgcacccgaaactctaatgagggccttggaagttctgaactacttgggggcactcgacgatgaaggcaacctaacatctttaggtgaaatgatgagtgagttccccttagacccacagatgtcaaagatgcttgtcatcagtccaaggtacaactgttcaaatgagatcctctcaatatctgccatgctatcagtacccaattgctttctccggcctagggaggcacaaaaggctgctgatgaggcgaaggctcgatttgggcacatcgatggggatcatctgacacttttgaacgtgtaccatgcatacaagcaaaacaatgaggatcctacatggtgttatgagaattttgtcaatgcccgggcgatgaagtctgctgataatgttagacaacaacttgtccgcatcatgaccagattcaacctcaagatgtgcagtacagacttcaacagtcgtgagtactatgtcaacatcaggaaagcaatgctttcagggtactttatgcaggttgctcatctggagcgaactgggcattacttgaccgttaaggataatcaggttgtccatcttcatccctcgaattgcatggaccataagccggagtgggtcatctacaatgaatatgttttgaccaccaggaatttcatccgcacagtcaccgatatccgtggagagtggctgatcgatatagctccacagtactatgatctgaccaatttcccatcatgtgaggccaagcgtgttcttgagaggctacacaataagagggagagggaaagagctgctagtaggaactgaattgatgtcattcttctggtcccttggatggcagcgccgccaaaggctttggacatcactgttggcctccaccattgtcatgatatcttccatgtagtagttttccagtattgtggatggtgaaatcactatatgcgacatatgtcaaatgtccctctgctactgcattccgaattatggagtagatgcttgttttccctctgttttagaaggtgtaggttatcatacattaattatgtgtcggtctccatatttttggtgtatcaaacgctgttgtttactttgtacttcagcatccttttggctagttttcacggaattactgacatcgcactgtgtttactaacttctgagataacttgtgtaactagtcaggaaatta

SEQ ID NO: 2562 - DNA, 2751 bp, Brachypodium distachyon
ccggcgactcttcccgaaccgatagctagggtttcgcttccccacccggccccctctcccgccttgtcctccgctccccgcgacctctctcgccgccgccatggggacggagcggaagcgcaaggtgagcctcttcgacgtggtcgacgagacatccgtatccgccaagctcggccgcgccggcgtcaacggcgccgccgccgcggctaacccgtccatcaacaagtggaacgggcggccctactcggcgcggtacctagagatcctcgagaagcgccgcacgctccccgtgtggcagcagaaggaagagtttctccgcgccctccgcgacaatcagaccctcatcctcgtcggagaaaccggaagtggcaagaccactcagatcccccaatttgtgctcgaggctgaaggtttgagcaaccgctctatggttgcctgcacccagcctcggagggttgctgcgatgtcggtctctcggcgcgttgcagaggagatggatgttacaatcggggaggaagttggttacagtatccgatttgaagattgcagcagtcacaaaactgttctcaaatatttgacagatggtatgcttctgagagaagcaatggcagacccacttttagagaggtacaaggtgattgttcttgatgaggcccatgagcgcacgttggcaaccgatgttctgtttgggcttctgaaggaagttctgaagaataggcctgacttgaagcttgttgttatgagtgcaacgcttgaggcagagaaatttcagggttatttcagtagtgctccgttgatgaaggttcctggtagacttcatccggttgagattttctatacgcaggaaccagaaagggactatctagaagctgctatcaggactgttgtgcagatacatatgtgtgaacctgctggcgatatccttgtattccttacaggtgaagaagagattgaggatgcctgtcggaaaattaataaggaagttaataacatgggagatcaggtcggcccagttaaagtcgtgccattgtactctactctaccccctgcaatgcagcagaagatttttgaacctgctccagctccattgaaagaggggggtcctcctggaaggaaaattgttgtgtcaacaaacatagcagagacatcgctgaccatcgatggtatagtgtatgtgatagatccagggttttccaaacagaaggtttacaatccaaggataagggtggaatcacttctggtgtctccaatttcaaaggcaagtgcacatcagagagctggtcgtgctggaagaacacagccagggaagtgcttcaggttatacacagagaagagtttcaatgatgatttacacccgcagacttacccagaaattcttcgttcaaacctagcaaatacggttcttactttgaagaagcttgggattgatgatttagtgcattttgacttcatggatcctcctgcaccggaaactctcatgagagccttggaggttctgaactacttgggggcactcgatgatgaaggcaacctgacatctttaggtgaaatgatgagtgagttccccttagatccacaaatgtcaaagatgcttgtcatcagtccaagatacaactgttcaaatgagattctctcgatatctgccatgctgtcagtacccaattgctttctgcggcctagggaggcacaaaaggctgctgatgaggcgaaggctcggtttgggcacattgatggggatcatctgacacttctgaacgtgtaccatgcatacaagcaaaacaatgaggatcctacatggtgttatgagaattttgtcaacgcccgagcgatgaagaatgccgataatgttagacaacagcttgttcgcatcatgaccagattcaacctcaggatgtgcagtacagacttcaatagtcgtgagtactacgtcaatatcaggaaagctatgctttcagggtactttatgcaggttgctcacctggagcgaactgggcattacttgactgttaaagataatcaggttgtccatcttcacccctcaaattgtatggaccataagccagagtgggtcatctacaatgagtatgttttgaccaccaggaatttcatccgcacagtgactgatatccgtggagaatggctgatcgatatagctccacagtattatgatctgaccaatttcccaacatgtgaggcgaaacgtgtccttgagaggctgcataacaagcgggagagggaaagagctgctagtagaaactgaaattgatgccattttgccggtttcttgtgatggttgcatcaggattgggcagagcggaaagcacgatctgggcatcactgatatgcattggccccctcaccatctatcatgatatctttgctggcataaattttcaatatcatatcgtgggtggtgaattcacaatgtacaacacatgccaaatgtccccctgttactgcgttactcctacaaagtaatagccttatattagatgtttgttttctccttgtgttaggtgtaggttgttatgcagattaactgtgtatctccatatttggagggctcaaacagatcaaacgtatgttttctctgtttattatttgcatcgtttttggctagtttattaaatgtgctgctaacatgttctgtctgcgtagcttaagcctatgtatacttgtgtgcaacatcgttcaattagttaatattcagtattaatacctgttggttgaccgtccatcagggcatataag

SEQ ID NO: 2563 - DNA, 2294 bp, Festuca arundinacea
  misc_feature (1137)..(1137): n is a, c, g, or t
  misc_feature (1242)..(1242): n is a, c, g, or t
  misc_feature (1254)..(1254): n is a, c, g, or t
ggcacgaggctctctcccgcctagccctccgcacgcgcacccgcgacctctctcgccgccgccatggggacggagcggaagcgcaaggtcagcctcttcgacgtggtcgaccagacctccgtatccgccaagctcggccgcgccggaatcaacggcgccgccgccgccgcggccaatccgtccatcaacccatggaacgggcggccctattcggcgcgctactttgagatcctcgagaagcgccgcacgctccccgtgtggcagcagaaggatgacttcctccgcgtccttcgcgacaaccagaccctcatcctcgtcggagaaaccggaagtggcaagaccactcagattccccaattcgtgctcgaggctgaaggtttgagcaaccgctccatggttgcctgcacccagccgcggagggtcgccgcaatgtcggtctcccggcgtgtcgcggaggagatggatgttacaatcggggaggaagttggttacagtatccgattcgaagattgcagcagccacaaaaccgttctcaaatatttgacagatggtatgcttctgagagaagcaatggcagacccacttttagagaggtacaaggtgattgtgctcgatgaggctcatgagcgcactttggcaacagatgttctgtttgggcttctcaaggaagttttaaagaacaggcctgacttgaagcttgttgttatgagtgctacccttgaggcagagaaatttcagagttattttagtagtgcacctttgatgaaggttcctggtagacttcatcctgttgagatcttctatacacaagaaccagaaagggactatctggaagctgctatcaggactgttgtgcagatacatatgtgtgaacctcctggtgatatccttgtattccttactggcgaagaggagattgaggatgcctgtcggaaaattaacaaggaagttaataacatgggggatcaggttggcccagttaaagtcgtaccattgtactctactctaccccctgcaatgcagcagaagatttttgacgctgctccacctccattgagagagggaggccctgctggaaggaaaattgttgtgtccacaaacattgctgagacatccttgaccatcgatggtatagtntatgttatagatccagggttttccaaacagaaggtttacaatccaaggataagggtggagtcccttctggtgtccccaatttccaaggcaagtgcgcatcagagngctggtcgtgcnggtagaacgcagcctgggaagtgcttcaggttgtacacagagaagagttttagcgatgatttacaggagcagacctacccagaaattcttcggtcaaacctggcaaatacagttctgacactgaagaagcttggaattgatgatttagtgcattttgacttcatggatcctcctgcaccagaaactctaatgagggccttagaagttctgaactacttgggagcactcgatgatgaaggcaacctgacacctctaggtgaaatgatgagtgagttccccttggacccccagatgtcaaagatgcttgtcatcagtccaaagtacaactgttcaaatgagatcctctcggtatctgccatgctctcagtacccaattgctttctccggcctagggaggcacaaaaggctgctgatgaggcgaaggctcgatttgggcacattgatggggatcatctcacacttctgaatgtgtaccatgcatacaagcagaacaatgaggatcctacatggtgttacgagaattttgtcaatgcccgagcaatgaagtctgctgataatgttaggcaacagcttgttcgcatcatgaccagattcaacctcaagatgtgcagtacagacttcaacagtcgcgagtactacgtcaatatcaggaaagcaatgctttcagggtactttatgcaggttgctcatcttgagcgaactgggcattacttgactgttaaggataatcaggttgtccatcttcatccctcgaattgcatggaccacaagccggagtgggtcatctacaatgaatatgttttgaccacaaggaatttcatccgcacagtcaccgatatccgtggagaatggctggttgatatagctccacagtattatgatctgaccaatttcccatcatgtgaggcgaaacgtgtcctcgagaggctacataacaagcgcgagagggaaagagctgccaacagaagctgaatttgacgatttctcctggttgcttgtcgctttgggcaatcactgatacgcagttggcctccaccatg

SEQ ID NO: 2564 - DNA, 2522 bp, Triticum aestivum
cgccggcatcaatggtgccgccgccgccgccgcggccaatccgtccatcaaccggtggaacggccggccctactcggcgcggtacctggagatcctcgagaagcgccgcacgctccccgtgtggcagcagaaggacgagttcctccgcgtcctccgcgacaaccagaccctcatccttgtcggagaaaccggaagtggcaagaccactcagatcccccaatttgtgctcgaggctgatggtttgagcaaccgctctatggttgcctgcacccagccgcggagggttgctgcaatgtcggtctctcggcgtgtcgcggaggagatggatgtcacaatcggggaggaagttggttacagtatccgattcgaagattgcagcagtcacaaaactgttctcaaatatttgacagatggtatgcttctgagagaagcaatggcagacccacttttagagaggtacaaggtgattgttcttgacgaggctcatgagcgcacattggcaacggatgttctgtttgggcttctgaaggaagttctaaagaacaggcctgacttgaagcttgttgtcatgagtgctactcttgaggcagagaagtttcagggttatttcagtggtgcaccattgatgaaggttcctggtagacttcatccggttgagatcttctatactcaggaaccagaaagggactatctagaagctgctatcaggacagttgtgcagatacatatgtgtgaacctgctggtgatatccttgtattccttactggagaagaggagattgaggatgcgtgtcggaaaataaacaaggaagttaataacatgggtgatcaggttggcccagttaaagtcgtgccattgtactctactctcccccctgcaatgcagcagaagatttttgaccctgctccacctccattgaaagaggaaggtcctgctggaaggaaaatcgttgtgtccacaaacattgctgagacatccctaaccatcgatggtatagtgtatgttatagatccagggttttccaaacagaaggtttacaatccaaggataagggtggaatcccttttggtgtctccaatttccaaggcaagtgcgcatcagagagccggtcgtgctggaagaacacagcctgggaagtgcttcaggttgtacacagaaaagagttttaatggtgatttacagccgcagacgtacccagaaattcttcggtcaaacctggcaaatacagttcttactctgaagaagcttggaattgacgacttagtgcattttgacttcatggatcctcctgcacccgaaactctaatgagggccttggaagttctgaactatttgggggcactcgacgatgaaggcaacctaacatctttaggtgaaatgatgagtgagttccccttagacccacagatgtcaaagatgcttgtcatcagtccaaggtacaactgttcaaatgagatcctctcaatatctgccatgctatcagtacccaattgctttctccggcctagggaggcacaaaaggctgctgatgaggcgaaggctcgatttgggcacatcgatggggatcatctgacacttttgaacgtgtaccatgcatacaagcaaaacaatgaggatcctacatggtgttatgagaattttgtcaatgcccgggcgatgaagtctgctgataatgttagacaacaacttgtccgcatcatgaccagattcaacctcaagatgtgcagtacagacttcaacagtcgcgagtactatgtcaacatcaggaaagcaatgctttcagggtactttatgcaggttgctcatctggagcgaactgggcattacttgaccgttaaggataatcaggttgtccatcttcatccctcgaattgcatggaccataagccggagtgggtcatctacaatgaatatgttttgaccaccaggaatttcatccgcacagtcaccgatatccgtggagagtggctgatcgatatagctccacagtactatgatctgaccaatttcccatcatgtgaggccaagcgtgttcttgagaggctacacaataagagggagagggaaagagctgctagtaggaactgaattgatgtcattcttctggtcccttggatggcagcgccgccaaaggctttggacatcactgttgttggcctccaccattgtcatgatatcttccatgtcgtagttttccagtattgtggacggtgaaatcactatatacgacatatgtcaaatgtccctctgctactgcattatgaattagatgcttgttttccctcttttagaaggtgtaggtcatcatacattaattatgtgtcgatcttcatatttttggtgtatcaaacgctgttgtttactttgtacttcagcatccttttggctagttttcatggaattgctgacatcgtactgtgtttactgtcttttgagataacttgtgtaactagtcaggaaattaatccctccatcccgaattatttgtagatttgtctagatatggatacaggaaatgcca

SEQ ID NO: 2565 - DNA, 2950 bp, Musa acuminata
cctcaaaactagggtttcgacggaaccctatctctgtttcgccctctctttctcgatctcggggtcgaatccccttcttcgaggaggcgatcggaatcttgctcgatctttctccaagttttgattggcggagccggtgctggagatgtcgacagaaaggaagaggaaggtgagcctcttcgacgtggtggacgacacttccgtgtccgtgaagctgggcaaggcgaacggatccttatccgctaagacggcggcgcttccgccgggggtaaaccgctggagcggtcggccctactcgcagaggtaccacgagatcctggagaagaggaagaccctcccggtatggcagcagaaagaagagttcttgcacgtattgaaggccaaccagactctgatcttggtcggagagaccggcagtggtaaaacaactcagattccccagtttgtcttggaatgtgaggacttgggcaaacgcccaatggttgcttgcactcagcctcgaagagtcgctgcaatgtctgtttctcgtcgagttgctgaggagatggatgtaacaataggagaagaagttggttatagcatccgatttgaagattgcagcagccacaggactattttgaagtacttaactgatggtatgcttttaagagaagcaatggctgatccacttttggagagatataaggtgataattcttgatgaggctcatgaacgaacattagcaaccgatgtcttgtttgggctgctgaaagaagtactgagaaatagacctgatttgaagctagtggtaatgagtgcaacgctcgaggctgagaagttccagggttactttagtggggcccctttaatgaaagtacctggtagattgcatccagtggaaattttctacacacaagagcctgaaagagattacctggaagctgccattcgaactgttgtacagatacacatgtgtgaaccttcaggtgacatacttgtttttctcactggagaggaagaaatagaagatgcatgtaggaaaataacaaaggagatcaataatatgggtgaccaagttggccctgtgaaagtggtgcctttgtattcaactttgcccccagccatgcagcagaagatatttgaacctgcaccagcgccactggaggaaggtggcccaccgggacgaaaaattgtggtgtcgacaaacattgcagaaacatcattgaccatcgatggcattgtttatgttattgaccctggtttctcaaaacaaaaggtgtacaacccacgaatacgggtggaatctttgctcgtctctccaatatcaaaggcaagtgcgcatcaaagagcaggacgtgctggtagaacccaaccaggaaaatgttttagactttacacagagagaagttttaaaaatgacctgcaagagcaaacatatccagaaattctccggtctaatttggcaaatactgttcttaccttgaagaaacttgggattgatgatctagttcattttgactttatggatcctcctgctcctgaaacattgatgcgggcacttgaggtcttgaattacctaggtgcacttgatgatgatggcaacttgactaagttaggtgaacttatgagcgagtttcccctggatcctcagatggcgaagatgttggttgtgagtccagagttcaattgttccaatgagatcgtgtcaatatctgcaatgctctcagtacccaattgctttctccggcctagggaggctcagaaagctgcagatgaagctaaagctcggtttggccacatcgatggggatcacctaacactgttgaatgtatatcatgcatataaacaaaatagtgaagattcttcatggtgttatgaaaattttattaaccaaaggactttaaaggctgctgacaatgtgagacaacagctcgtgcggatcatggctagattcaacctgaaactatgcagtacagacttcaacagccgtgattattacattaacatcaggaaggcgatgcttgcagggtacttcatgcaggtagctcatcttgagagaaccggacactatttgacggtgaaggacaatcaggttgttcacctccatccatcaacctgcctggatcataagccggaatgggtcatctacaatgagtatgtcttgaccagtaggaactttattcgcacagtgacagacattcgaggagagtggttgattgatatagctcctcactattatgatctgagcaacttcccctcctgtgaggcaaaacgagtgctggaaaggctgtataataaacgtgacaaagagaagggggagagcaagactagaaataagcctttgtagctatgtactcaccaccatttggtatgccatcacggactagctcgagaacagttgagacttccatctgacaagcgggatggcttgcacatttagaaagagtgcatttcttttgggaaggacagacactataaagctcgttctcactgtgtttgatcagataagaaggcaactattttgctcccaaatagttgaggatgcttttatacttatcctaggactccacatctgcgagtgctatcagattgtttaagtgtcgtacctatttggggtttaggaagtggaaaacatgtctctctttggttccgccgtaggtgccttgtccccgtagtttgaattgtctatttatttgattgtcgcaggtgaaatatagaatctttaatcactgtctggttacaagttgagatattgcatcctctggaacaacggccttctcgtccaatgtagttgctgcattgcaagaatctctgagttatgttgatggatcttttctgtatggtttggttgtcatgagtggatttaattgatatgacatcgttagccccgatgagaccttatgctgccaaccgttgcaatacaaggggtcgacatttcggtgcgcgtctcacacgggtatcagaaacttca

SEQ ID NO: 2566 - DNA, 3196 bp, Citrus clementina
ctttcgctttaaactactcgggctgtatttaccctagcctccatctttttgttttcaaacgtaaaacttcgtcctagggtttgtattattctcgtcgtttttaataatttcttcgctcggcctctctacggtaccctgcgacgtcgtattggatgggaacggagaggaagcggaaggtgagcttgtttgacgtggtggacgagacctcggtctcagcgaagctagtcaaaacaaacggcgtcggtcccggtgcgatgatgaacaacaataacagtttgattaataggtggaatgggaagccgtactcgcagaggtactatgagatactggagaagcgcaagtctttgcctgtctggcagcaaaaagaggaatttttgcaagtcttgaaagccaatcaagttataatattggttggtgagaccggtagtggtaaaaccactcagattcctcagtttgtactggaaggtgttgatatagaaacccctgatagacgtaggaagatgatgattgcttgcactcagcctcgaagagtggctgctatgtctgtttctcgtcgagtggctgaagagatggatgtaaccattggagaagaggttggttatagcattcgttttgaagattgcagtagtgcaagaacagttttgaagtatctaacagatggtatgcttttaagagaggcaatgacagatccacttttggaaagatacaaggtaattgttcttgatgaggctcacgaaagaactctggccacagacgtgctatttggacttttgaaagaagtgttgaaaaatagaccagatctgaagttggtagtaatgagtgcaacccttgaggctgaaaagtttcagggttatttttacggtgcgcctctcatgaaggttccaggtaggcttcatccagtggaaattttttatacccaggaacctgagagggactaccttgaggcagccataaggaccgttgtgcagatacacatgtgtgaaccttctggtgatatacttgttttcctgactggagaggaggagatagaagatgcatgccgcaaaataacaaaggaaattactaacatgggtgaccaagtgggtcctgtaaaagtagtgcctttgtattcaacccttcctccagccatgcagcaaaaaatatttgaacctgctccacctccaagtaaggaaggtggcccccctggaagaaagattgtggtctctacaaacatagcagaaacttctttgaccatagatgggatagtttatgttatagacccaggttttgctaaacaaaaagtttataatccacgtgtgcgtgtggaatcgttattggtttctccaatatcgaaagcaagtgcacatcagcggtctgggcgtgctggaagaactcagccaggaaaatgtttccgactctacactgagaaaagttttaataatgatctgcagccgcagacatatccagaaatattacgttcaaaccttgcaaatacagtccttacattaaagaagctgggtattgatgatttagtgcattttgattttatggaccctcctgctcctgagacactgatgcgagcattagaagttttgaattatttgggagcactggacgatgatggaaacctgactgaaatgggggagaagatgagtgaatttccactagatcctcaaatgtcgaagatgctcgttgagagtcctaaatacaactgctcaaatgaaattctttcaatttctgccatgctttcagtacccaattgctttgtccggcctagggaggctcagaaagctgcagatgaagcaaaagccaggtttggtcacattgatggggatcaccttacactcctgaatgtataccatgcttacaagcaaaacaatgaggatccatcttggtgttatgacaattttgtcaatcatagggcattgaagtcggctgataatgttagacaacagctagttcggatcatggcacggttcaacctcaagttatgcagcaatgattttaacagtcgggactactatgtcaacatcagaaaggctatgttggcaggatatttcatgcaagtagctcacctagaacgcactggacaatatctgacagttaaagataaccaagttgtgcacttgcatccttcaaattgcctcgatcacaagccagagtgggtcatttataatgagtatgtgctaactagcaggaactttattcgtacggtgacagatgttcgtggtgaatggttaatcgatatcgcaccacattactatgacctttcgaacttccctcaatgtgaggctaaacgtgttcttgagaggctttacaggaagcgggaaaaggagagggagaacaacagaaaataaagtatatgccatctagatccttgactcatgtaatattgtttgtctcgagatgagatggagaccttgctattaaagctattctacttctgcatcagatggaaagaaaatattagcataattccatgtaccatttcctagagaagggatgtccgttactgtctttttgtatttgtagaatcggcccttggcttgttttcggatgtcatggctatgttgcttttgattgttttggcatgattatgtgttattgttgtgtttcgagatcttttgatgctggaagaaaatgttataggatttagtttatatctaaattgtgaccttattgaactcagcaattgcgagtacgaaacttatatgagctcaacaattgccgtcgctattaggggcagcaagctttagacacctaagcatttggagtgaatttgacagcaattagtatctggaaaaagacagtcttgctcgtacagagtaaaaactcagttgaccgtggctgtagtggagcctcttctaatgagtgatggcgcattgcagcattgatatagaaatgctgctatgagactgcaaatttttgaagggtttcaactcactcctctttcgtccttttcctcaacttgattaaacccatattcatcatgatgaacaaacagtcgtttggcagttgagaaatactctatgcggcaatctcctctagctccggagcagaatgccggtcgcaggctccaaattacaatatcaggctcaaatggcattcctttttatccattttctttgctttgtgtagctggccagctctaccgactgccatagaggtacgccatgcaagcataatgctcaatctcagctcggattccgtatttggg

SEQ ID NO: 2567 - DNA, 3197 bp, Citrus sinensis
ctttcgctttaaactactcgggctgtatttaccctagcctccatctttttgttttcaaacgtaaaacttcgtcctagggtttgtattattctcgtcgtttttaataatttcttcgctcggcctctctacggtaccctgcgacgtcgtattggatgggaacggagaggaagcggaaggtgagcttgtttgacgtggtggacgagacctcggtctcagcgaagctagtcaaaacaaacggcgtcggtcccggtgcgatgatgaacaacaataacagtttgattaataggtggaatgggaagccgtactcgcagaggtactatgagatactggagaagcgcaagtctttgcctgtctggcagcaaaaagaggaatttttgcaagtcttgaaagccaatcaagttataatattggttggtgagaccggtagtggtaaaaccactcagattcctcagtttgtactggaaggtgttgatatagaaacccctgatagacgtaggaagatgatgattgcttgcactcagcctcgaagagtggctgctatgtctgtttctcgtcgagtggctgaagagatggatgtaaccattggagaagaggttggttatagcattcgttttgaagattgcagtagtgcaagaacagttttgaagtatctaacagatggtatgcttttaagagaggcaatgacagatccacttttggaaagatacaaggtaattgttcttgatgaggctcacgaaagaactctggccacagacgtgctatttggacttttgaaagaagtgttgaaaaatagaccagatctgaagttggtagtaatgagtgcaacccttgaggctgaaaagtttcagggttatttttacggtgcgcctctcatgaaggttccaggtaggcttcatccagtggaaattttttatacccaggaacctgagagggactaccttgaggcagccataaggaccgttgtgcagatacacatgtgtgaaccttctggtgatatacttgttttcctgactggagaggaggagatagaagatgcatgccgcaaaataacaaaggaaattactaacatgggtgaccaagtgggtcctgtaaaagtagtgcctttgtattcaacccttcctccagccatgcagcaaaaaatatttgaacctgctccacctccaagtaaggaaggtggcccccctggaagaaagattgtggtctctacaaacatagcagaaacttctttgaccatagatgggatagtttatgttatagacccaggttttgctaaacaaaaagtttataatccacgtgtgcgtgtggaatcgttattggtttctccaatatcgaaagcaagtgcacatcagcggtctgggcgtgctggaagaactcagccaggaaaatgtttccgactctacactgagaaaagttttaataatgatctgcagccgcagacatatccagaaatattacgttcaaaccttgcaaatacagtccttacattaaagaagctgggtattgatgatttagtgcattttgattttatggaccctcctgctcctgagacactgatgcgagcattagaagttttgaattatttgggagcactggacgatgatggaaacctgactgaaatgggggagaagatgagtgaatttccactagatcctcaaatgtcgaagatgctcgttgagagtcctaaatacaactgctcaaatgaaattctttcaatttctgccatgctttcagtacccaattgctttgtccggcctagggaggctcagaaagctgcagatgaagcaaaagccaggtttggtcacattgatggggatcaccttacactcctgaatgtataccatgcttacaagcaaaacaatgaggatccatcttggtgttatgacaattttgtcaatcatagggcattgaagtcggctgataatgttagacaacagctagttcggatcatggcacggttcaacctcaagttatgcagcaatgattttaacagtcgggactactatgtcaacatcagaaaggctatgttggcaggatatttcatgcaagtagctcacctagaacgcactggacaatatctgacagttaaagataaccaagttgtgcacttgcatccttcaaattgcctcgatcacaagccagagtgggtcatttataatgagtatgtgctaactagcaggaactttattcgtacggtgacagatgttcgtggtgaatggttaatcgatatcgcaccacattactatgacctttcgaacttccctcaatgtgaggctaaacgtgttcttgagaggctttacaggaagcgggaaaaggagagggagaacaacaggaaataaagtatatgccatctagatccttgactcatgtaatattgtttgtctcgagatgagatggagaccttgctattaaagctattctactactgcatcagatggaaagaaaaatattagcataattccatgtaccatttcctagagaagggatgtccgttactgtctttttgtatttgtagaatcggcccttggcttgttttcggatgtcatggctatgttgcttttgattgttttggcatgattatgtgttattgttgtgtttcgagatcttttgatgctggaagaaaatgttataggatttagtttatatctaaattgtgaccttattaaactcagcaattgcgagtacgaaacttatatgagctcaacaattgccgtcgctattacgggcagcaagctttagacacctaagcatttggagtgaatttgacagcaattagtatctggaaaaagacagtcttgctcgtacagagtaaaaactcagttgaccgtggctgtagtggagcctcttctaatgagtgatggcgcattgcagcattgatatagaaatgctgctatgagactgcaaatttttgaagggtttcaactcactcctctttcgtccttttcctcaacttgattaaacccatattcatcatgatgaacaaacagtcgtttggcagttgagaaatactctatgcggcaatctcctctagctccggagcagaatgccggtcgcaggctccaaattacaatatcaggctcaaatggcattcctttttatccattttctttgctttgtgtagctggccagctctaccgactgccatagaggtacgccatgcaagcataatgctcaatctcagctcggattccgtatttggg

SEQ ID NO: 2568 - DNA, 2504 bp, Glycine max
ggttttgaaattgatgggtacagagagaaagaggaaggtgagcttgtttgatgtggtagacgattctgcggcgaagatggcgaaatccaatggcggcgccgctgctaataatctcaccaatcattggaccgcaaggccttactcccaaaggtacttcgagattttggagaagagaaagaccctccccgtttggcaccagaaagaagagtttttgcaagttctcaaagataaccagactttgattctcgtcggtgaaactggtagtggcaaaaccactcagattcctcagtttgttttggatgctgtcgaattagagacaccggataaacgtaggaagatgatggtagcctgcactcagcctcggagagtagctgcgatgtctgtttcgcgtcgtgtggctgaagagatggatgtaactattggggaagaggttggttacagtatcagatttgaagactgcagtagtgcgaagacggttttgaagtatcttacggatggtatgctcttaagagaagcgatgacagatccgcttttggaacggtacaaggttattattcttgatgaggcacatgagaggactttggccacggatgtgctatttggccttctgaaggaagtgcttaaaaatcgacctgacatgaagttggttgttatgagtgcgactcttgaagctgaaaagtttcagggttattttttcggtgcccctctcatgaaagttcctggaaggctacatcctgttgaaattttctatacgcaggaacctgaaagggattacttggaggccggcattaggacagtggtacagatacacatgtgtgagcctccaggagatatacttgtatttctgactggagaggaagagatagaagatgcttgccgcaaaataacaaaagaaatttctaatctgggagatcaggtggggcctgtcaaagttgtacccctgtattctactcttcctcctgctatgcagcagaagatttttgagccagctccacctccactgaaggagggtggacctcctggaaggaagattgtggtatcaactaacatagccgaaacttccttaacaattgatggtattgtttatgtcattgaccctggttttgctaagcagaaggtttataacccacgaattcgtgtggagtctttattagtgtcaccaatatcgaaagctagtgcacatcagagatcaggacgtgctggaagaactcaaccagggaaatgctttagactttacactgagaaaagtttcaataatgatcttcagccacagacctatcctgaaatattgagatcaaatcttgccaacacagttcttactttgaagaaactgggtatagacgatctagtgcattttgatttcatggaccctcctgctcccgagaccttaatgcgtgcattggaagtgttgaattacttgggtgcactggatgacgatggtaacttaactaaactgggtgagattatgagtgaatttcccttggaccctcagatgtcaaagatgctcgttgtcagtcctgaattcaactgttcaaatgagattctgtcagtttctgccatgctttcagtacccaattgctttgtccggcctagggaggcacaaaaagctgcggatgaagctaaagctaggttcgggcacattgatggagatcatctcactctgttgaatgtctatcatgcgtacaagcaaaataatgaggatccctcttggtgctacgataactttgttaatcatagggcattgaaatcagctgataatgttagacaacaattagtgcgtatcatgtcccggtttaatctgaagctatgcagcactgactttaatagccgtgactactatgtcaacataagaaaagctatgctagctgggtatttcatgcaggtagctcatctggagcgtacaggacactacttgacagtgaaagacaaccaggtggtgcatttgcatccatccaattgcctggaccacaagcctgaatgggtcatttataatgaatatgttcttaccagtcggaattttattcgtactgttacagacatacgtggtgaatggttggttgatatagcaccacattactatgatttgtctaatttcccccaatgtgaggcaaaacgtgtccttgagagactttacaagaagcgagaaaaggaaaaggaggaagccaggagccgcagatgaagtcatagctgtccacactatttttgccttcggatttggattggatattttgccttctgcagctgagactttcatgattcctcgtgacacttaccttgtaatatccttcacatccgaaaggaatactgaatgtcgatagtttagttcaaaatgagcttaagttccttgtaccattgctagagtaaagtgaacacttttttaatcaccgtccttcttctgttgtacctttagtccaaatttgtttctggattttattctcgttaaaggatagattataaatgtttggatgcctggatatactaagcagtctattatgttttagtta

SEQ ID NO: 2569 - DNA, 2710 bp, Glycine max
ggaaacttcatcttcctcagtagtcactagtcattaggtctggtcgtcgttttatagttacacacaaaagcttagccctaagctagcattttcccagcaccaatttatttgcttggatcggaactagggttttgaaattgatgggtacagagagaaagaggaaggtgagcttgtttgatgtggtagacgattctgcggcgaagatggcgaaatccaatggcggcgccgctgctaataatctcaccaatcattggaccgcaaggccttactcccaaaggtacttcgagattttggagaagagaaagaccctccccgtttggcaccagaaagaagagtttttgcaagttctcaaagataaccagactttgattctcgtcggtgaaactggtagtggcaaaaccactcagattcctcagtttgttttggatgctgtcgaattagagacaccggataaacgtaggaagatgatggtagcctgcactcagcctcggagagtagctgcgatgtctgtttcgcgtcgtgtggctgaagagatggatgtaactattggggaagaggttggttacagtatcagatttgaagactgcagtagtgcgaagacggttttgaagtatcttacggatggtatgctcttaagagaagcgatgacagatccgcttttggaacggtacaaggttattattcttgatgaggcacatgagaggactttggccacggatgtgctatttggccttctgaaggaagtgcttaaaaatcgacctgacatgaagttggttgttatgagtgcgactcttgaagctgaaaagtttcagggttattttttcggtgcccctctcatgaaagttcctggaaggctacatcctgttgaaattttctatacgcaggaacctgaaagggattacttggaggccggcattaggacagtggtacagatacacatgtgtgagcctccaggagatatacttgtatttctgactggagaggaagagatagaagatgcttgccgcaaaataacaaaagaaatttctaatctgggagatcaggtggggcctgtcaaagttgtacccctgtattctactcttcctcctgctatgcagcagaagatttttgagccagctccacctccactgaaggagggtggacctcctggaaggaagattgtggtatcaactaacatagccgaaacttccttaacaattgatggtattgtttatgtcattgaccctggttttgctaagcagaaggtttataacccacgaattcgtgtggagtctttattagtgtcaccaatatcgaaagctagtgcacatcagagatcaggacgtgctggaagaactcaaccagggaaatgctttagactttacactgagaaaagtttcaataatgatcttcagccacagacctatcctgaaatattgagatcaaatcttgccaacacagttcttactttgaagaaactgggtatagacgatctagtgcattttgatttcatggaccctcctgctcccgagaccttaatgcgtgcattggaagtgttgaattacttgggtgcactggatgacgatggtaacttaactaaactgggtgagattatgagtgaatttcccttggaccctcagatgtcaaagatgctcgttgtcagtcctgaattcaactgttcaaatgagattctgtcagtttctgccatgctttcagtacccaattgctttgtccggcctagggaggcacaaaaagctgcggatgaagctaaagctaggttcgggcacattgatggagatcatctcactctgttgaatgtctatcatgcgtacaagcaaaataatgaggatccctcttggtgctacgataactttgttaatcatagggcattgaaatcagctgataatgttagacaacaattagtgcgtatcatgtcccggtttaatctgaagctatgcagcactgactttaatagccgtgactactatgtcaacataagaaaagctatgctagctgggtatttcatgcaggtagctcatctggagcgtacaggacactacttgacagtgaaagacaaccaggtggtgcatttgcatccatccaattgcctggaccacaagcctgaatgggtcatttataatgaatatgttcttaccagtcggaattttattcgtactgttacagacatacgtggtgaatggttggttgatatagcaccacattactatgatttgtctaatttcccccaatgtgaggcaaaacgtgtccttgagagactttacaagaagcgagaaaaggaaaaggaggaagccaggagccgcagatgaagtcatagctgtccacactatttttgccttcggatttggattggatattttgccttctgcagctgagactttcatgattcctcgtgacacttaccttgtaatatccttcacatccgaaaggaatactgaatgtcgatagtttagttcaaaatgagcttaagttccttgtaccattgctagagtaaagtgaacacttttttaatcaccgtccttcttctgttgtacctttagtccaaatttgtttctggattttattctcgttaaaggatagattataaatgtttggatgcctggatatactaagcagtctattatgttttagttattctttctttcttttataactaatttattgttactcctattctcagttctcactacttggacatgtagccacttcccaa

SEQ ID NO: 2570 - DNA, 2612 bp, Cajanus cajan
gcttagctcagccctagcaccttcagccaccaatttgtttggatcgggtttgggggattagggttttgattttgatgggtacggagagaaagaggaaggtgagtttgttcgatgtggtagacgactctgtggccaagatggcgaaaaccaatggcggcgccaataacagcgttgttaacgctctcatcaatcgctggaacgcaaagccttactcccaacgctacttcgacattttggagaagaggaaaaccctccccgtttggcaccagaaagacgactttttgaaggtcctcaaagataaccagactttgattctcgtcggtgaaactggtagtggcaaaaccactcagattcctcagtttgttttggatgctgtcgaattagagacacccgataaacgtaagaagatgatgattgcgtgcactcagcctcggagagtggctgcgatgtctgtttcgcgtcgtgtggccgaggagatggatgtaactattggcgaagaggttggttacagtatcagatttgaagactgcagtagtgcaaggacggttttgaagtatcttacagatggtatgctcttaagagaagcaatgacagatccgcttttggaacgatacaaggttattattcttgatgaggctcatgagaggactttggccacggatgtgctgtttggcctactgaaggaagtgcttaaaaatagacctgacatgaagttggttgttatgagtgcgactcttgaggctgaaaagtttcagggctatttttttggtgcccctctcatgaaagttcctggaaggctacatcctgttgaaattttttatactcaggaacctgaaagggattacttggaggctggcattaggacagtggtacagatacacatgtgtgagcctcctggtgatatacttgtgtttctgaccggagaggaagagatagaagatgcttgccgcaaaataaataaagaaattgctaatctgggagatcaggtgggccctgtcaaagtggtacccctgtattctacccttcctccagctatgcagcagaagatttttgagccaccaccacctccactgaaagagggtgggccacctggaaggaagattgtggtatcaacaaacatagcagaaacttccttgacaattgatggcattgtttatgtcattgatcccggttttgctaagcagaaggtttataacccacgagttcgtgtggagtctttgttagtatcaccaatatcaaaagctagtgcacatcagagatcagggcgtgccggaagaactcaaccagggaaatgctttagactttacaccgagaaaagtttcaataatgatcttcagcctcagacctatcctgaaattttaagatcaaatcttgccaacacagttcttactttgaagaaactggggatcgatgatttagtgcattttgatttcatggaccctcctgctcctgagaccttaatgcgtgcattggaagtgttgaattacctgggtgcgctggatgacgaaggtaacctaacaaaactgggtgagattatgagtgaatttcccttggacccacagatgtcaaagatgctcgttgttagtcccgaattcaactgttcaaatgagattctgtcagtttctgccatgctctcagtacccaattgctttgtccggcctagggaggcacaaaaagctgcggatgaagctaaagctaggtttgggcacattgacggagatcatctcactctcttgaatgtctatcatgcatacaagcaaaataatgaggatccctcttggtgctatgataattttgttaatcatagggcattgaaatcagctgataatgttagacaacaattagtgcggatcatgtcccggtttaatctgaagctatgcagcactgactttaatagccgtgactactatgtcaacatacgaaaagctatgctagctgggtatttcatgcaggtagctcatctggagcgtactgggcactacttgacagtgaaagacaaccaggtggtgcatttgcatccatctaattgtctagaccacaaacctgaatgggttatttataatgaatatgttcttacaagtcggaattttattcgtactgttacagacatacgaggggaatggttggttgatatagcaccacattactatgatttgtctaattttccacaatgcgaggcaaagcgtgttcttgagaaactttacaagaagcgagagaaggaaaaggaggaagccaggagccgcagatgaagtccttgcaatccactatttttgcctttggatttggattggatatttcgtcttctgcagctgagatcatgattcctcgtggctgttgccttgtgctaccctttattattattacatctgaaaggattactgattgtcggtagtttagttaaaaatgatttagtttcttgtaccattgatagagtaatagtgaacatttttttatcaccctccatcttctgttgtacctttagtgcaaatttgtttctggtcgttagtctcgttaaacgatagatactcatataaaatgcgcgtccgccggatttcaatatttgactgatagaatgatatgatacatacttaaggtgggagtgtttattgtca

SEQ ID NO: 2571 - DNA, 2630 bp, Glycine max
tgtagcattgcatttgcaccgtaatttagccctggcctcaaacagtttctaggagcttccaccgagagctgccgatttattaattacggaatttgcgatcacgatattaatattagggttttgatgggtacggagcggaagaggaaggtgagcttgttcgacgtagtggacgacgctgccgccaagatgtccaaatcaaacggcggcgccgtcgccgccaacaacctcattaaccggtggaacgggaagccttattcgcagaggtaccacgacattttggagaagaggaaaaccctaccggtgtggcaccagaaggaggagttcttgcaggctttgaaggataaccagactctcattctcgttggcgaaaccggtagcggcaaaaccactcagattcctcagtttgttttggaagctgtggatatagaaaccactgataaacgtaggaagatgatgattgcgtgtactcagcctcgtagagtggctgcaatgtctgtttccaggcgtgtggctgaggagatggatgtgagtattggagaagaggttggctacagcatcagatttgaggattgcagtagtgccaggacagttttgaagtatctcactgatggtatgcttttgagagaggcaatgacggatccgctattggagcgatacaaagtaattattctggatgaagcacatgagaggactttggctactgatgtgctatttggccttcttaaggaagtgcttagaaatagacctgacttgaagttagttgttatgagtgcgacacttgaagctgagaagttccagggatattttagcggggcccctcttatgaaggttcctggaagactacatccggtggaaattttctatacccaggatccagaaagggattacttggaggctgctattaggacagttgtgcagatacacatgtgtgaaccttctggagatatacttgtttttctcactggagaggaagagattgaggatgcatgccgcaaaataaacaaagaaatttccaatatgggagaccaggtgggccctgtgaaagtggtgcccttgtattctactcttcctcctgcaatgcagcagaagatttttgagccagctccacctccagttaaggagggagggcctcctggaaggaagattgtggtatcaacaaacatagcagaaacgtccttgacaattgatggtatagtctatgttattgaccctggatttgctaagcagaaggtttataaccctcgagtccgtgttgagtctttgttggtgtctccaatatcaaaggctagtgcacaccagagatctggacgtgctggaagaactcaaccagggaaatgttttagactctatactgaaaaaagtttcaataacgatcttcagccgcagacctatcctgaaattttgagatctaatcttgccaacactgttcttaccttaaagaaacttggtatagatgacttagtgcattttgatttcatggaccctcctgccccggagaccttaatgcgtgcattggaagtgttgaattacttgggtgcactggatgacgatggtaacttaacaaagctgggccagattatgagtgaatttccactggaccctcagatgtcaaagatgctcgttgttagtcctgaattcaactgttcaaatgagattctttccgtttctgccatgctatcagtacccaattgctttgtccggcctagggaggcacaaaaagctgcggatgaagcaaaagctaggtttggacacattgatggggatcatctcacgctcttgaatgtataccatgcctacaagcaaaataatgaggatccttcttggtgttatgataacttcgttaatcatagggcattgaaatcagcagacaatgttagacaacaacttgtgcgaatcatggctcggtttaacctgaagttatgcagcactgatttcaatagccgggactactatgtcaacattagaaaggcaatgctagcagggtattttatgcaggtggcccatctggagcggacaggacattacttgacagtgaaagacaaccaggtggtgcacttgcatccatcaaattgcctggaccacaagccggagtgggtaatatataatgaatatgttcttactagtcggaattttattcgaactgtgacagatatacgtggagaatggttagtggatgtagccccacattactatgatttgtcgaattttccacaatgtgaagctaagcgtgttcttgagaggctttacaagaagcgagagaaggaaaaggaggaagccaggagtcgtaaatgaagtcccttaccatccatgcctttttttgcctttagattggaattggatatttagtctcctgtaatttgacatcgtaattttgtcaggagaaggtttccgaatgtgagtgttttattacctctgaagtctgaaggacctattgatagttaattttagtgagaaataggctgtgttttttttttttttccatatatataatataggctgtgtttcttgcactatttattagtgtattagtaacgttttatattcgtcgactttttgctgttataccttcggaggccttatcattgcattttctaatgagatatgttctgttctttttttcataaaaataa

SEQ ID NO: 2572 - DNA, 2673 bp, Glycine max
tttctccttcattatttttatttaatttatttcccagttataatgtagcattgcatttgcaccgtaatttagccctggcctcaaacagtttctaggagcttccaccgagagctgccgatttattaattacggaatttgcgatcacgatattaatattagggttttgatgggtacggagcggaagaggaaggtgagcttgttcgacgtagtggacgacgctgccgccaagatgtccaaatcaaacggcggcgccgtcgccgccaacaacctcattaaccggtggaacgggaagccttattcgcagaggtaccacgacattttggagaagaggaaaaccctaccggtgtggcaccagaaggaggagttcttgcaggctttgaaggataaccagactctcattctcgttggcgaaaccggtagcggcaaaaccactcagattcctcagtttgttttggaagctgtggatatagaaaccactgataaacgtaggaagatgatgattgcgtgtactcagcctcgtagagtggctgcaatgtctgtttccaggcgtgtggctgaggagatggatgtgagtattggagaagaggttggctacagcatcagatttgaggattgcagtagtgccaggacagttttgaagtatctcactgatggtatgcttttgagagaggcaatgacggatccgctattggagcgatacaaagtaattattctggatgaagcacatgagaggactttggctactgatgtgctatttggccttcttaaggaagtgcttagaaatagacctgacttgaagttagttgttatgagtgcgacacttgaagctgagaagttccagggatattttagcggggcccctcttatgaaggttcctggaagactacatccggtggaaattttctatacccaggatccagaaagggattacttggaggctgctattaggacagttgtgcagatacacatgtgtgaaccttctggagatatacttgtttttctcactggagaggaagagattgaggatgcatgccgcaaaataaacaaagaaatttccaatatgggagaccaggtgggccctgtgaaagtggtgcccttgtattctactcttcctcctgcaatgcagcagaagatttttgagccagctccacctccagttaaggagggagggcctcctggaaggaagattgtggtatcaacaaacatagcagaaacgtccttgacaattgatggtatagtctatgttattgaccctggatttgctaagcagaaggtttataaccctcgagtccgtgttgagtctttgttggtgtctccaatatcaaaggctagtgcacaccagagatctggacgtgctggaagaactcaaccagggaaatgttttagactctatactgaaaaaagtttcaataacgatcttcagccgcagacctatcctgaaattttgagatctaatcttgccaacactgttcttaccttaaagaaacttggtatagatgacttagtgcattttgatttcatggaccctcctgccccggagaccttaatgcgtgcattggaagtgttgaattacttgggtgcactggatgacgatggtaacttaacaaagctgggccagattatgagtgaatttccactggaccctcagatgtcaaagatgctcgttgttagtcctgaattcaactgttcaaatgagattctttccgtttctgccatgctatcagtacccaattgctttgtccggcctagggaggcacaaaaagctgcggatgaagcaaaagctaggtttggacacattgatggggatcatctcacgctcttgaatgtataccatgcctacaagcaaaataatgaggatccttcttggtgttatgataacttcgttaatcatagggcattgaaatcagcagacaatgttagacaacaacttgtgcgaatcatggctcggtttaacctgaagttatgcagcactgatttcaatagccgggactactatgtcaacattagaaaggcaatgctagcagggtattttatgcaggtggcccatctggagcggacaggacattacttgacagtgaaagacaaccaggtggtgcacttgcatccatcaaattgcctggaccacaagccggagtgggtaatatataatgaatatgttcttactagtcggaattttattcgaactgtgacagatatacgtggagaatggttagtggatgtagccccacattactatgatttgtcgaattttccacaatgtgaagctaagcgtgttcttgagaggctttacaagaagcgagagaaggaaaaggaggaagccaggagtcgtaaatgaagtcccttaccatccatgcctttttttgcctttagattggaattggatatttagtctcctgtaatttgacatcgtaattttgtcaggagaaggtttccgaatgtgagtgttttattacctctgaagtctgaaggacctattgatagttaattttagtgagaaataggctgtgttttttttttttttccatatatataatataggctgtgtttcttgcactatttattagtgtattagtaacgttttatattcgtcgactttttgctgttataccttcggaggccttatcattgcattttctaatgagatatgttctgttctttttttcataaaaataa

SEQ ID NO: 2573 - DNA, 2649 bp, Cajanus cajan
gtttctaggagcttccagtgagttggtaatttattagtatcagggaatttacgaaagaatattcagctttcatactcaacgtttgtgtggggattaagattagggttttttttttttttttgatgggtacggagaggaagaggaaagtgagcctgtttgacgtggtggacgaccctgccgctaagatggccaaaaccaacggcgggcgcgccgacggcggctgcgccgtcgccaacaacctcattaaccggtggaacgggaagccttattcgcagaggtaccacgagattttggagaagaggaagaccctccccgtgtggcaccagaaggaggagttcttgcaggttttgaaggataaccaaactctcattctcgttggcgaaaccggtagtggcaaaaccactcagattcctcaatttgttttggaagctgtggatattgaaacccctgataaacgtaggaagatgatggttgcgtgtactcagcctcgtagagtggctgcaatgtctgtttctaggcgtgtggctgaggagatggacgtgaatattggagaagaggttggttacagcatcagatttgaggattgcagtagtgcaaggactgttttgaagtatctcacggatggtatgcttttgagagaagcaatgacggatccacttttggaacggtataaagtcattgttcttgatgaagcgcatgagaggactttggctacagatgtgctatttggtcttcttaaggaagtgcttagaaatagacctgacttgaagttggttgttatgagtgctacacttgaagcggagaagttccagggctattttaatggagctcctcttatgaaggttcctggaagactacatccggtggaaattttctatacgcaggaaccagaaagagattacttggaggctgctattaggacagtggtgcagatacatatgtgtgaaccttctggagatatacttgtttttctcactggagaggaagagatcgaggatgcgtgccgcaaaataaacaaagaagtctcaaatatgggagaccaggtgggccctgtgaaagtggtgcctttgtattcaactcttcctcctgctatgcagcagaagatttttgagccagcgccacctccactaaaggagggagggcctcctggaaggaagattgtggtatcaacaaacatagcagaaacttccttgacaattgatggtatagtctatgttattgaccctggatttgctaagcagaaggtttataaccctcgagtccgtgttgagtcattgttggtgtctccaatatcaaaggctagtgcacaccagagatctggacgtgctggaagaacacaaccagggaaatgttttagactttatactgaaaaaagtttcaataatgatctgcagccgcagacctatcctgaaattttgagatctaatcttgccaacacagttcttatcttaaagaaactgggtatagatgatttagtccattttgatttcatggaccctcctgcccctgagaccttaatgcgcgcgttggaagtgttgaattacttgggtgcactggatgatgatggtaacttaacaaagctgggtgagattatgagtgaatttccgctggaccctcagatgtcaaagatgcttgttgtcagtccagaattcaactgttcaaatgagattctttccatttctgccatgctatcagtacccaattgctttgtccggcctagggaggcacaaaaagcagcggatgaagcaaaagctaggtttggacacattgatggagatcatctcacactcttgaatgtataccatgcctacaagcaaaataatgaggattcttcttggtgctacgataacttcgttaatcatagggcgttgaaatcagctgataatgttagacaacaactagtgcgtatcatggctcggtttaacctgaagttatgcagcactgacttcaatagccgtgagtactatgtcaacataagaaaggcaatgctggcaggatatttcatgcaggtggctcacctggagcgatcaggacattacttgacagtgaaagacaaccaggtggtgcatttgcatccgtcaaattgcctggaccataagccggagtgggtaatatataatgaatatgttcttaccagtcggaattttattcgaactgtgacagatatacgtggggaatggttagtggatatagccccacattactatgatttgtcgaattttccacaatgtgaagccaagcgtgttcttgagaggctttacaagaagcgggagaaggaaaaggaggaagcaaggagtcgtaaatgaagtcctaccattcatccacgccattttttaattgcctttggattggaattttggatgttcagtctctcctgcagtttgacatcataatttcatcacgggaaagctcccgaatgttaccgttttgttacctctattgttaattttattgagaaataggctgtgtttcatgtactatttattagtgtattagtaacatgttttatattcgtcgactctctgcagttactttgtttttttctcttctgggtttagaggtctcatcattgcccattcttaatgatatacatttggataatttttttcaataaaaatatatgctttgtattaaaagctcttaaataaa

SEQ ID NO: 2574 - DNA, 2569 bp, Glycine max
acaaaagagaagcttagccctagccagcatcttccagcaccaatttgcttggattggaattagggttttgaaattgatgggtacggagagaaagaggaaggtgagcttgttcgatgtggtagacgattccgcggcaaagatggcgaaaaccaatggcggcgctgctaataatctcatcaatcactggacctcaaggccttactcccaaaggtacttcgagattctggagaagagaaagaccctccccgtttggcaccagaaagaagagtttttgcaggttctcaaagataaccagactttgattctcgtcggtgaaactggtagtggcaaaactacgcagattcctcagtttgttttggatgctgtcgaattagagacaccggataaacgtaagaagatgatgatagcgtgcactcagcctcggagagtggctgcaatgtctgtttcgcgtcgtgtggccgaagagatggatgtaactattggggaagaggttggttacagtatcagatttgaagactgcagtagtgcaaagacggttttgaagtatctaacggatggtatgctcttaagagaagctatgacggatccacttttggaacggtacaaggttattattcttgacgaggcacatgagaggactttagccacggatgtgctatttggtcttctgaaggaagtgcttaaaaatagacctgatatgaagttggttgttatgagtgcgactcttgaagctgaaaagtttcagggctattttttcggtgcccctctcatgaaagttcctggaaggctacatcctgttgaaattttctatactcaggaacctgaaagggattacttggaggctggcattaggacagtggtacagatacacatgtgtgagcctccaggagatatacttgtatttttgactggagaggaagagatagaagatgcttgccgcaaaataacaaaagaaatttctaatctgggagatcaggtgggccctgttaaagttgtacccctgtattctacacttcctcctgctatgcagcagaagatttttgagccagctccacctccactgaaggagggtggacctcctggaaggaagattgtggtatcaacgaacatagcagaaacgtccttgacaattgatggtattgtttatgtcattgaccccggttttgctaagcagaaggtttataacccacgagttcgtgtggagtctttattagtgtcaccaatatcgaaagctagtgcacatcagagatcagggcgtgctggaagaactcaaccagggaagtgctttagactttacactgagaaaagtttcaataatgatctacagccacagacctatcctgaaattttgagatcaaatcttgccaacacagttcttactttgaagaaactgggtatagacgatttagtgcattttgatttcatggaccctcctgctcctgagaccttaatgcgtgcattggaagtgttgaattacttgggtgcactggatgacgatggtaacttaacaaaactgggtgagattatgagtgaatttcccttggacccacagatgtcaaagatgctcgttgtcagtcctgaattcaactgttcaaatgagattctgtccgtttctgccatgctttcagtacccaattgctttgtccggcctagggaggcacaaaaagctgcggatgaagctaaagctaggttcgggcacattgatggagatcatctcacactgttgaatgtctatcatgcgtacaagcaaaataatgaggatccctcttggtgctacgataactttgttaatcatagggcattgaaatcagctgataatgttagacaacaattagtgcgtatcatgtcccggtttaatctgaagctatgcagcactgactttaatagccgcgactactatgtcaacataagaaaagctatgctagctgggtatttcatgcaggtagctcatctggagcgtacaggacactacttgacagtgaaagacaaccaggtggtgcatttgcatccatccaattgcctggatcacaagcctgaatgggtcatttataatgaatatgttcttaccagtcggaattttattcgtactgttacagacatacgtggggaatggttggttgatgtagcaccacattactatgatttgtctaatttcccccaatgcgaggcaaagcgtgtcctcgagagactttacaagaagcgagaaaaggaaaaggaggaagccaggagccgcagatgaagtcagccatccacactatttttgcctttgggtttggatttggattggatattttgccttctgcagctgagacttctacatctgaaaggaatactgaatgtcgatagtttagttcaaaatgagctaagtttcttgtaccatttgctagagtaatagtgaacatttttttaatcaccgtccatcttctgttgtacctttagtccaaatttgtttctggattttattctcgttaaaggatagattataaatgtctggatgcctggatatactaagctgggaatctattatgttttagttattcatttataagtaatttatttttactcctat

SEQ ID NO: 2575 - DNA, 2667 bp, Glycine max
cttcctcactagtcattaaggtctggtggttttagtgttacacacaaaagagaagcttagccctagccagcatcttccagcaccaatttgcttggattggaattagggttttgaaattgatgggtacggagagaaagaggaaggtgagcttgttcgatgtggtagacgattccgcggcaaagatggcgaaaaccaatggcggcgctgctaataatctcatcaatcactggacctcaaggccttactcccaaaggtacttcgagattctggagaagagaaagaccctccccgtttggcaccagaaagaagagtttttgcaggttctcaaagataaccagactttgattctcgtcggtgaaactggtagtggcaaaactacgcagattcctcagtttgttttggatgctgtcgaattagagacaccggataaacgtaagaagatgatgatagcgtgcactcagcctcggagagtggctgcaatgtctgtttcgcgtcgtgtggccgaagagatggatgtaactattggggaagaggttggttacagtatcagatttgaagactgcagtagtgcaaagacggttttgaagtatctaacggatggtatgctcttaagagaagctatgacggatccacttttggaacggtacaaggttattattcttgacgaggcacatgagaggactttagccacggatgtgctatttggtcttctgaaggaagtgcttaaaaatagacctgatatgaagttggttgttatgagtgcgactcttgaagctgaaaagtttcagggctattttttcggtgcccctctcatgaaagttcctggaaggctacatcctgttgaaattttctatactcaggaacctgaaagggattacttggaggctggcattaggacagtggtacagatacacatgtgtgagcctccaggagatatacttgtatttttgactggagaggaagagatagaagatgcttgccgcaaaataacaaaagaaatttctaatctgggagatcaggtgggccctgttaaagttgtacccctgtattctacacttcctcctgctatgcagcagaagatttttgagccagctccacctccactgaaggagggtggacctcctggaaggaagattgtggtatcaacgaacatagcagaaacgtccttgacaattgatggtattgtttatgtcattgaccccggttttgctaagcagaaggtttataacccacgagttcgtgtggagtctttattagtgtcaccaatatcgaaagctagtgcacatcagagatcagggcgtgctggaagaactcaaccagggaagtgctttagactttacactgagaaaagtttcaataatgatctacagccacagacctatcctgaaattttgagatcaaatcttgccaacacagttcttactttgaagaaactgggtatagacgatttagtgcattttgatttcatggaccctcctgctcctgagaccttaatgcgtgcattggaagtgttgaattacttgggtgcactggatgacgatggtaacttaacaaaactgggtgagattatgagtgaatttcccttggacccacagatgtcaaagatgctcgttgtcagtcctgaattcaactgttcaaatgagattctgtccgtttctgccatgctttcagtacccaattgctttgtccggcctagggaggcacaaaaagctgcggatgaagctaaagctaggttcgggcacattgatggagatcatctcacactgttgaatgtctatcatgcgtacaagcaaaataatgaggatccctcttggtgctacgataactttgttaatcatagggcattgaaatcagctgataatgttagacaacaattagtgcgtatcatgtcccggtttaatctgaagctatgcagcactgactttaatagccgcgactactatgtcaacataagaaaagctatgctagctgggtatttcatgcaggtagctcatctggagcgtacaggacactacttgacagtgaaagacaaccaggtggtgcatttgcatccatccaattgcctggatcacaagcctgaatgggtcatttataatgaatatgttcttaccagtcggaattttattcgtactgttacagacatacgtggggaatggttggttgatgtagcaccacattactatgatttgtctaatttcccccaatgcgaggcaaagcgtgtcctcgagagactttacaagaagcgagaaaaggaaaaggaggaagccaggagccgcagatgaagtcagccatccacactatttttgcctttgggtttggatttggattggatattttgccttctgcagctgagacttctacatctgaaaggaatactgaatgtcgatagtttagttcaaaatgagctaagtttcttgtaccatttgctagagtaatagtgaacatttttttaatcaccgtccatcttctgttgtacctttagtccaaatttgtttctggattttattctcgttaaaggatagattataaatgtctggatgcctggatatactaagctgggaatctattatgttttagttattcatttataagtaatttatttttactcctattctcagtcctcactacttgaacatgtagcaagtttccaactatcctgcagtgtta

SEQ ID NO: 2576 - DNA, 2643 bp, Zostera marina
tcttgtagtataaatagaaaagcatcggcggagtgtttcggcgacgaaaatctgaatcggaaattcctgcgcgctccgtcatcccaataagcaaactgctacatagaaagcagattccttccgtctttctgacctttctcttcctctttcgagccatctcctcttctattcactcctctattttgtatccattccatctaggttttctttttctaggtttccaatatcttatgtcgacggagaggaagaggaaagtcagtctgttcgacgtcgtggacgatacatccttgtccacaaagctctccaagtcggtcaacggcggatctatcaagctaccttcggggattaacagatggaacgccaagcccttttcgcagaggtattacgatatcctcgaaaagaggaaaacacttccggtatggcagcagaaagatgattttctcaaggttcttaaagaaatcaaactttggtacttgtaggtgaaactggaagtgggaagaccactcagattccccagtttgtgctagaagccgaactaggtggtaaacgtccatctgttgcttgcacccaaccccgtagagttgccgcaatgtctgtttctcgtcgtgtcgctgaggaaatggatgttacaattggggaagaagttggatacagcatcagatttgaggattgcagtagcaacaagaccatgcttaaatatttaacagatggtatgcttttgagagaagctatggcagatccgttattggaaaggtacaaagtaattgttcttgatgaagctcatgagaggacattggcaactgatgttttatttggtcttcttaaagaagtattacgaaatagacctgatcttaaacttgtggtcatgagtgctactctcgaggctgagaaattccagggctacttcaacggtgccccattaatgaaggtacctggaagactccatccagtggagatattttacactcaggaacctgaaagagattacttagaagctggaatcagaacagttgtgcagattcacatgtgtgaacctgctggtgatatacttgtttttcttactggggaggaagagattgaagatgcgtgcaggaaaataacaaaagaagtcaataatttgggtgatcaagttggaccaataaaagtagtgccactttattctacattgcctccggcaatgcagcagaagatatttgacaatgctccagctccaataactgaaggaggtcctgcaggaaggaagattgttgtctcaacaaatattgctgagacttcattgaccattgacggtatagtttatgtgattgatcctggattttctaaacagaaagtatataatccacgcatacgtgttgaatctctgctggtatctccaatatcaaaggctagtgcacatcaaagatctggacgtgctggtagaacacaacctggcaaatgttttaggctgtatactgaaagaagttttaataatgatcttcaacctcaaacatatcccgaaattctccgttcaaacttagcaaacactgttttgacactgaagaagcttggaatcgatgatttagtacattttgattttatggaccctcctgctcctgagacattgatgcgagcgttggaagttctaaactacttgggtgcacttgatgacgagggtaacttaacaaaacttggagaaattatgagcgagtttccacttgatccccaattgtccaagatgcttgttgtcagttctgatttcaattgttccaatgagattttatcaatatcttccatgctttcagctcccaattgctttctccggcccagagaggcacagaaagctgcagatgaagcgaaagctcgatttggccatattgacggggatcatctgacgctgctgaatgtctaccatgcatataagcaaaatagcgaagacccatcatggtgctatgagaattttatcaaccagagagcaatgaagtctgctgacaatgtgagacaacaacttgtgcgtatcatgacaaggttcaacctgaagttatgcagcacagatttcaatagtcgcgattactacatcaatatcagaaaggccatgctatcgggttacttcatgcaggtagcccatcttgagcgcactgggcactacctgacagtaaaggacaatcaggtggtgcatctgcatccttcaaattgtctcgatcacaaaccagagtgggtgatttacaatgagtatgttctgacctccagaaatttcatcaggacagtaactgatgtccgtggcgagtggttaatcgatatcgctcctcattattatgatctgagcaatttccctccatgtgaagcaaaacgggttctggagaaattgtaccaaaagcgtgagagagagaaaagtgaaagcaagaatagaagcaaaattcaatagattgatttattgatttgccccttcttttgctagttcattgatgagtacttttattatagatgaaagaaacactcggtttttcatgtagaaaggaagccttgactcgtattttgttgcagtcttattggtattatctttaagattcggacaaatgatattataaatgtacttgattctgtcatcagatattcagatgatgttatatttaagatttaacattgttggtaatttggtaacaaaaa

SEQ ID NO: 2577 - DNA, 2782 bp, Medicago truncatula
cacaacacacaacttagccctaaccttaaaccagggcctgcgtgtgtttttctagggtcttcattttcactcacaattcccaatatattattgtggaatctgtgaaacgcatattcttcgtgtttcattgaaacggtgccgaaaaattcaagaatattattattagggttttgatgggtacagagagaaagaggaaggtgagtttattcgacgtcgtcgacgacgctgcagctaagatggtgaaaactaatggcggtttaattggtaacaatctcattaaccgttggaatggaaaaccttactcgcaaaggtatcatgagattttggaaaagaggaaaacccttcctgtttggcatcagaaagaggatttcttgaaggttttgaaggataatcagactttgattcttgttggtgaaactggtagtggaaaaaccactcagatccctcagttcgttttagaagctgttgaattagaggctccagataagcgcaagaagatgatgattgcatgcactcagcctcgtagagtggctgccatgtctgtttcacgccgtgtggctgaagaaatggatgtgagtattggggaagaggttggttatagcatcagatttgaagattgtagtagtgcaaggacagttttgaaatatctaacagatggtatgcttttgagagaagcaatgacagatccacttttggagcgatacaaagtaataattcttgatgaggcacatgaaaggactttggctacagatgtgctatttggtcttctcaaggaagttcttaaaaacagacctgacttgaagttggtggttatgagtgcaacacttgaagctgaaaagtttcagggctatttttttggtgcccctcttatgaaagttcctggcaggctgcatccagtggaaattttttatactcaggaaccagaaagagattacttggaggctgctattaggacagtggtgcagattcacatgtgtgaacctgctggagacatacttgtttttcttaccggagaggaggagatagaagatgcatgccgcaaaatatctaaagaagttgcaaacatgggggaccaggtgggccctgtgaaagccgtgccattatattctactcttcccccagctatgcaacagaagatttttgagccagctccacctccagttaaggagggaggcccccctggaaggaagattgtggtatcaacaaacatagcagaaacttccttgacaattgatggtatagtctatgttattgatcctggatttgctaagcagaaggtctataaccctcgagttcgtgttgagtctttgttggtgtctccaatatcaaaagctagtgcacaccagaggtctggacgtgctggaagaactcagccggggaaatgctttagactttataccgaaagaagtttcaataatgatcttcagccgcagacctatcctgaaattttgagatctaatcttgccaacacagttcttacattgaagaaactgggtatagatgatttagttcattttgacttcatggaccctcctgcccctgaaaccttgatgcgtgctttggaagtgttgaattacttgggtgcactggatgatgaaggtaacttaacaaagcttggtgagattatgagtgagtttccattggaccctcagatgtcaaagatgcttgttgttagtcctgagttcaactgttcgaatgagattctttcaatttctgcgatgttgtcagtacccaattgctttatccggcctagggaggcacaaaaagctgcggatgaagccaaagctaggtttggacacattgatggagatcatctcacactcttgaatgtataccatgcctacaagcaaaacaacgaggatgcttcttggtgctacgacaacttcgttaataatagggcgcttaaatcagctgataatgttcgacaacagctagtgcgtatcatggctaggtttaacctgaagttatgcagcactgacttcaatagtcgcgactactacgtcaacataagaaaggcaatgttagcaggatatttcatgcaggtggctcatcttgagcggacaggacactacttgacagttaaagacaaccaggtggtacacttgcatccatcaaattgtctggaccacaagcccgagtgggttatctacaatgaatatgttcttacgagtcggaatttcatacgtactgtgacagatattcgtggtgaatggttggttgatatagcaccacattactatgatttgtctaattttccacaatgtgaagcaaagcgtgttcttgaaaagctttacaagaaacgagagaaggaaaaggatgaagcccggaatcgtaaatgaagccttacctgatcttttctaccttaagattgggattttgatgtttcatcttctgcacgttgacattaaaatgtcgtcatgttccggcttcggattttgatgtttcatcttctgcaagttgacatcaaaatatcgtcatgggaatgttcattagtactacctcgtacctttaaaggactgctggttgtcagtaattttaatgaaagaattggcagagttccttgtactattagagtagtgacatgttttatattcctcgaccttgttctgttgtaccttacagatttatttattggcttcaaattttttttttgggatgctagtgtccgtcaaaggctaaatgccttgtcattttgcatactggtatatttagtaaacattgataattaagcatctagaattaatgcatttttgctttaaagtaatgtcaagctctgcttttg

SEQ ID NO: 2578 - DNA, 2855 bp, Eucalyptus grandis
ctgtctgtctctctctctttctgtcccctcctccctcctcctccgttctagggttttcgctccacctctagggctttaataatcccccgcacgaccgccggattccgccaatccagctccgaccaggccggcggcgccccccgccaaccatagctccgccggaggcgatcggcggctcctcctccccctcgttaagggctgtccccccggggttccgcgattgatgggaacggagaggaagaggaaggtgagcctgttcgacgtggtggacgagacgtcggtctccgccaagctcacgaagtccaacggcgtcatggccggcggcggcggcaacggcaacgcgagcagcttgataaatcgatggaatgggagggtctactcgcagcggtactacgagatactggagaagcggcggactctgcccgtctggcaccagaaagaggagttcttggaggtgctgaagaacaaccagacgttgatcctggtcggcgagacggggagcggtaaaaccactcagattccccagtttgtactggaagccattgatattgagactccagataaacgtagaaagatgatgattgcatgcacccaacctcgtagagtggctgcgatgtctgtgtctcgacgtgttgcagaggagatggatgtaactattggggaagaagttggttatagtattcgttttgaagactgcagtagtgcaagaactgttttaaagtatctgacggatggtatgcttctaagagaagcaatgacagatccacttttagaacgctataaggttataattcttgatgaagctcacgagagaactttggcgacggatgtgttatttgggctccttaaggaagttctcaggaatagacctgacttgaagcttgttgtcatgagtgctacacttgaagctgagaaatttcaaggttattttagtggtgcgcctcttatgaaagttcctggacggcttcatccagtggagattttctatactcaggaacctgagagagattatctagaggctgctatccgtacggttgtgcagattcatacgtgtgaacctccaggtgatatacttgttttcctcactggggaagaagaaatagaagatgcatgccgcaagattactaaagaaattggtaatgccggggatcaagttggtcctgttaaaccagtacctctgtattcaactcttcctccggctatgcagcagaaaatttttgaacctgctccgcctcctttgaaggagggtggtccacctggtaggaaaattgtaatcgcaacaaacattgcagaaacttcattgaccatagatggtatagtttacgttatcgaccctgggtttgccaagcaaaaagtgtataaccctcgagtgcgtgttgaatcattattggtatctcctatttctaaggcaagtgcacaccagagggcaggacgtgctggaagaactcagccaggaaaatgttttaggctttatactgaaaaaagtttccatggggatcttcagccgcagacttatccagaaattttacggtctaaccttgcaaatacagttcttaccttgaaaaaactaggcatagacgatcttgtgcattttgatttcatggatcctcctgcccctgagacattgatgcgagcattggaagtcttgaattacctgggagcattggatgatgaggggaacttgaccaaactaggggaaatcatgagtgaatttcctttggatcctcagatgtcaaagatgctggtggttagtccagagttcaactgttcaaatgaaatattgtcagtctcagctatgctttcagtaccaaattgctttgtccggcctagggaggctcaaaaggctgcagatgaagctaaagctaggtttggacacattgatggggatcaccttaccctcttgaatgtataccacgcctacaagcagaataatgaggattcatcatggtgctatgagaattttgtcaatcacagggcgttgaaggctgctgataatgtgagacagcagcttgtccgcatcatggcaaggtttaacctcaagctatgcagcacagatttcaacagccgtgattactacgtcaacataagaaaggctatgcttgctgggtacttcatgcaggtggcccatctggagaggacaggacattacctaaccgtcaaggacaatcaggttgtgcacttgcatccttcgacttgtctggatcacaagcctgagtgggttatttacaatgaatacgtcttgactagcaggaattttatacggacagttaccgatgttcgtggcgactggctggttgatatagcaccgcactattacgatttggcaaactttccgcagtgtgaggctaagagagttcttgagaagctgtacaagaagaaggaaagggaaaaggaggaaagcaagaacaggaagtgatactgtgcttcagttggctgagccatgcttcctgtagcccttatttcgagggtgcatgatcttggggttgatgatcaagagcatgctgaggttcttggaatcttctaatgcattctgggcgctggcattgctaagtggttgacagcgaaacacaagagtagtcctgtttttgtatcagtgttagtttgttatagtattgttccaatagtaatgttattgcaatttgtttcaagacttgatggcttcaaccctagtggaaagaaatgaatttcatttctacaccggcagatgtttctattttcccatcttccgcagcatctttacatttggtaatggtgacatggacagattgtgataaggagtcgcgttctctaattgtatcacaaggtaaatgaatctggacattaccagacatgtaaattgcaggaaaaggtttggc

SEQ ID NO: 2579 - DNA, 2711 bp, Amborella trichopoda
acccgatcctctctctcggatctcactttttagggtttttaattgctcgtttccactgttcttcccgcgttttctagggtttgttgaggtttactcctcttcgccctgtgttttctagggtttttaaggttcctccctcagtccgctgcgttttctaagggtctcctctctcactcggtgccactcgtagtccttttcaagggctgaggcattttctagggttatttttcgtgggctaggggggattttctagggcatttgtggagtttggccatggcgactgagaggaagaggaaagttagccttttcgatgtggtgggtgacccctctgtggctgccaaaaagctaagcgttaatggctcagctgatgtgaacaggtggaatgggagaccttattcccaaagatattttgagattcttgagaagaggaagaccttaccggtttggcaacaaaagcaagagtttcttgatacgctggagaagcaccagacgctcatattagttggagaaactggcagtggaaagaccacgcagattcctcagtttgttgttgaggctggttataccagcaaccgcaagcagattgcttgtacccagcctcgtagagtggctgcaatgtctgtctcacgtcgtgttgcagaggagatggatgttacaattggggaagaagttggttacagcatccgttttgaagactgcactggtccaaaaacaattctcaagtacttgaccgatggtatgcttcttagagaagcaatgacagatccactgctggagcgttaccgagtgatcatattggatgaggcccatgagcgaactgtagcaactgatgttctttttgggcttcttaaggaggtcctaaagaatagagcggacctaaagcttgttgttatgagtgcaacattagaggctgaaaaatttcagggttatttttatggagccccgcttatgaaagtacctggtaggcttcatcctgttgaaatcttttacacacaggatccagagagagattatctagaagcagccattagaacggttgtgcaaatacacacatgtgaaccccatggggacattttggtctttttaactggagaggaggagatagaagatgcttgtaggaaaattacaaaggagataaacaacatgggtgatcaagtagggcctgtgaaagttgttccactttattctacattgcctccatcaatgcagcagaagatattcgagcctgctccacccccatcgaaagaagatggccctcccggtagaaagattgtagtttcaaccaacattgctgaaacttctttaaccattgatggtatcgtttatgttattgaccctggttttgcaaaacaaaaggtttataatccgagggttagagttgaatctttgctggtatcgccaatttccaaagcaagtgcacaccagagatctggccgtgcagggagaacccaacctgggaaatgctttagactttacactgagaaaagttttagtgatgaccttcaaccacaaacatatcctgagatcttgaggtcaaatctggcaaatgttgttctcaccctgaaaaagcttggaattgatgacttggttcactttgattttatggatccacctgctcctgaaacccttatgcgagcattagaggttttgaactacttgggtgctctggatgatgatggaaacctgaccaagttaggagaaattatgagtgaatttcctctggatcctcagatgtcgaagatgcttgttgttagtcaagaattcaattgttctaatgagatcctctcaatttccgctatgctttcagtacccaattgctttctccggcctagggaggctcagaaagctgcagatgaagcgaaagctcgatttggacacatcgatggggatcaccttacgctcttgaatgtctaccacgcttacaagcagaataatgaagaccccacttggtgctatgagaacttcattaaccagagggctatgaaagctgctgacaatgtgagacaacagctggtgcgcatcatggcgagattcaacctcaaactatgcagtactgacttcaacagccgtgactattaccccaacataaggaaagccatgcttacaggctactttatgcaggtagctcaccttgagcgaacaggccactacttgacagtgaaagataaccaggttgttcacctgcatccttccaattgtcttgatcacaagccggaatgggtcatatacaatgagtacgtcttgacaagtagaaatttcatacgtacggttactgatgtgcggggcgagtggttgattgatattgcgccgcactactacgacctttctaacttccccaattgtgaggcaaagcgtgttcttgagagactctaccagaagcgggaaagggataggggagagagcaaaggcagaaaatgagatttcccaggactctcctgcgttgtggtctttaaaaacatgcaatccattttgtgaaaaaaatatatttatgtcgtgaaatagttgtcaaagcttctaatggatctgaaagagaagaccactgggaaagtttttattctttcgagtggtggttttgatcctttaaagtttgtgtaacacttcttttttatactttgcttatacaatacatttttttcattggtggaattttgaatttttatggttcaatttcctcaagaatctttacattaccgaaagtgattcacttgttt

SEQ ID NO: 2580 - DNA, 2681 bp, Phaseolus coccineus
gccattaccattaggtctgatcgttttataattgcacacaaaagctaagccctagcaatcgcaccttcgttccaactccattttggacggatcgaggttgggaaattagggttttcaatttcatgggtatggaaagaaagaggaaggtgagcttgtttgacgttgtagacgattcagtggcgaagattgcgaaatacaatggcggcgctaataacagcgtcgccaatgctctcatcaatcactggaacgcgaggccttacacgcaaaggtacttcgagattttggagaagagaaaaacccttcccgtttggcaccagaaagaagagttcttaaaggttctcaaagataaccagactttgattcttgtcggtgaaactggtagtggaaaaaccacacagattcctcagtttgttttggaggctgtccagttagagacaccagataagcgtaggaagatgatgattgcgtgcactcagcctcggagagtggctgcgatgtcagtttcgcgtcgtgtggctgaagagatggatgtaaccattggggaagaggttggttacagcatcagatttgaagactgcagtagtgcgaggacagttttgaagtatctaaccgatggtatgctcttaagggaagcaatgactgatccgcttttggagcggtacaaggttattattcttgacgaagctcacgagaggacattggccactgatgtgttatttggccttctgaaagaagtgcttaaaaatagacctgacttgaagttggttgttatgagtgctactcttgaagctgaaaagtttcagggctatttttttggtgcccctctcatgaaagttcctggaaggctacatcctgttgaaattttctatactcaggatcctgaaagggattacttggaggctggcattaggacagtggtacagatacacatgtgtgaaccacctggagatatacttgtatttctgactggagaggaagagatagaagatgcttgccgcaaaataacaaaagaaatttctaatctgggagatcaggtgggccctgtcaaagtggtacccctgtattctacccttcctccagctatgcagcagaggatttttgagccaccaccacctccactgaaggagggtggacctcctggaaggaagattgtggtctcaacaaacatagcagaaacttccttgacaattgatggtattgtttatgtcattgaccctggttttgctaagcagaaggtttataacccccgagttcgtgtggagtctttattagtatcaccaatatcgaaagccagtgcacatcagagatctgggcgtgctggaagaactcaaccagggaaatgctttagactttacacagagagaagtttcaataacgatcttcagccacagacctatccagaaattttaagatcaaatcttgccaatacagttcttactttgaaaaaactgggcatagatgatttagtgcattttgatttcatggacccgcctgctcctgagaccttaatgcgtgcattggaggtgttgaattacttgggtgcactggatgatgatggtaacttaactaagctaggtgaaattatgagtgaatttcctttggatccacagatgtcaaagatgctcgttgtcagtcctgaattcaactgttcaaatgagattctgtcagtttctgccatgctttcagtacccaattgctttgtccggcctagggaggcacaaaaagctgcggatgaagctaaagctaggttcgggcacattgatggagatcacctcacgctgttgaatgtctatcacgcatacaagcaaaataatgaggatccctcttggtgctatgataactttgtaaatcatagggcattaaaatcagctgataatgttagacaacaattagttcgtatcatggcccggtttaatctgaagcaatgcagcactgactttaatagccgcgactactatgtcaacataagaaaagctatgctggctgggtatttcatgcaggtagctcatttggagcgtacaggtcactacttgacggtgaaagacaaccaggtggtgcatttgcatccatcaaattgcctggaccacaagcctgaatgggtaatttataatgaatatgttcttaccagtcggaactttattcggactgttacagacatacgaggggaatggttggttgatatagcaccacattactatgatttgtctaatttcccccaatgtgaggcaaagcgtgttctagagaaactttacaagagccgagaaaaggagaaggagcaaaccaggagccgcagataaaagtcgtagccatccacactatttttggatttggattggatattatttcctcgtctgtctctgagtctgagatcatgattcctcgtagctcttgccttttaccacccaccctttattattaattctgaaaggaatactgattgtcagtagtagtttagttaaaaatgagctataagtttcttgtaccattgctagagtaatagtgaacatttttttgatcaccgtccgtcttctgttgtaccgtaagtccatatttgtttctggattttagtgtcgttaaaggatagatgcccatcataaatgcttggatcctgcgttcattatttcactgatagtatcatataatacttagccgggagtgtttattatcactctaatttatct

SEQ ID NO: 2581 - DNA, 2402 bp, Sesamum indicum
ttggcgaccgcaaaccctaaccattcttttagtttctctctctagggtttcgtcttccccatcggaccttctatattatcttccgctctccctatttgacggacaaatttattgccacggcattggaggaggaaccttaggtagatgggaacggagaggaagaggaaggtgagcctgtttgatgtagtggacgagacggctgtttccgggaagatgtccagagccaacggcgggggaacggccactgccgcggtcgcttcgacgattaacaggtggaatggaaggccttattcccagaggtattatgagattttagagaagaggaagtctctccctgtctggcaccagaaagaggagtttttgcaggcgcttagaaccaatcagaccctaattcttgtcggtgaaactggtagtggtaaaaccactcagattccccagttcgtactggatgctgtagagatagagactgcagataaacgtaggaagttcatggttggatgtacacagcctcgcagggtggctgcaatgtctgtttcaaggagggttgctgaagagatggatgtgacaattggagaggaagtaggttatagtatacgtttcgaggattgtagcagtgcacggactgtattaaagtacttaacagatggtatgcttttaagagaagccatgacagatccattgctggagagatataaagtgataattcttgatgaggctcatgagagaactttggcaacagatgttctatttgggcttctgaaggaagtgttgaaaaacagacctgacctgaaactagtagttatgagtgccactctagaggctgaaaagtttcaaggctacttttttggtgcaccactcatgaaagttcctggaaggcttcatccagtcgagatcttttatacccaggagcctgagagggattacctcgaagctgctataaagactgtatatcagatacatgcgtgtgaacctcctggtgatatacttgttttcctgaccggtgaagaggaaatcgaagatgcatgtaaaaaattagctaaggaaatagctaatgctggggatcaagtaggaccagctaaaatagtgccactgtattcaacacttcctccagcaatgcagcagaagatttttgaacccgctccacctccggctgtggaaggtggtcctccaggaagaaagattgttgtttctacaaatattgctgaaacctctttgacaattgatggcatagtttatgtcatagaccctgggtttgcaaaacaaaaagtctacaatccacgaattcgtgttgagtctctgttggtttctcctatatcaaaggctagtgcccatcaacggtcaggacgtgctggaagaacgcagcctggaaaatgtttcaggctctacactgaaaagagtttccacaatgaccttgcaccgcagacctatccagagatattaaggtcaaaccttgcgaacactgttctaactttgaaaaaactggggatagatgatctggtgcattttgattttatggatccacctgctccggagactctgatgagagcattggaggttctgaattacttaggagccctcgatgatgatgggaacttgaccaagttgggtgaaatcatgagtgagtttcccttggatcctcagatggcgaaaatgctggttgtcagtccagaatttaattgttccaacgagatcctctctatatctgctatgctttcagtacccaattgctttgtccggcctagggaggctcaaaaagctgcagatgaagcaaaagctcgttttgggcacatcgacggagatcatctcacgctgttgaatgtgtatcatgcttacaaacaaaataaggaagatccacagtggtgctatgagaattttatcaatcatagagcactgaagtctgcagacaatgtcagacagcagctagctcgcattatggccagattcaatttgaagctatgcagtacagactttaacagccgtgattactatgtgaatatcaggaaggctatgctggctggatactttatgcaggttgcccatttagagcggactgggcactatctaactgtgaaagacaaccaagttgttcacttacatccttcaaattgcctggaccataagccggagtgggttatctacaatgaatatgtcctaacaagcaggaacttcattcgtacagtaacggatattcgtggcgaatggttggttgatgtcgcaccgcattactatgacctttccaactttcccaattgtgaagcaaagcgccaactagagaaactgtataagaagcgggagaatgcgagggaagagagcaggaataagaaatgaagtgatatgcgtggaggaagacctgaagatcttcatggaagtctcctccgcattttggttgagcacaacccccc

SEQ ID NO: 2582 - DNA, 2678 bp, Phaseolus coccineus
gccattaccattaggtctgatcgttttataattgcacacaaaagctaagccctagcaatcgcaccttcgttccaactccattttggacggatcgaggttgggaaattagggttttcaatttcatgggtatggaaagaaagaggaaggtgagcttgtttgacgttgtagacgattcagtggcgaagattgcgaaatacaatggcggcgctaataacagcgtcgccaatgctctcatcaatcactggaacgcgaggccttacacgcaaaggtacttcgagattttggagaagagaaaaacccttcccgtttggcaccagaaagaagagttcttaaaggttctcaaagataaccagactttgattcttgtcggtgaaactggtagtggaaaaaccacacagattcctcagtttgttttggaggctgtccagttagagacaccagataagcgtaggaagatgatgattgcgtgcactcagcctcggagagtggctgcgatgtcagtttcgcgtcgtgtggctgaagagatggatgtaaccattggggaagaggttggttacagcatcagatttgaagactgcagtagtgcgaggacagttttgaagtatctaaccgatggtatgctcttaagggaagcaatgactgatccgcttttggagcggtacaaggttattattcttgacgaagctcacgagaggacattggccactgatgtgttatttggccttctgaaagaagtgcttaaaaatagacctgacttgaagttggttgttatgagtgctactcttgaagctgaaaagtttcagggctatttttttggtgcccctctcatgaaagttcctggaaggctacatcctgttgaaattttctatactcaggatcctgaaagggattacttggaggctggcattaggacagtggtacagatacacatgtgtgaaccacctggagatatacttgtatttctgactggagaggaagagatagaagatgcttgccgcaaaataacaaaagaaatttctaatctgggagatcaggtgggccctgtcaaagtggtacccctgtattctacccttcctccagctatgcagcagaggatttttgagccaccaccacctccactgaaggagggtggacctcctggaaggaagattgtggtctcaacaaacatagcagaaacttccttgacaattgatggtattgtttatgtcattgaccctggttttgctaagcagaaggtttataacccccgagttcgtgtggagtctttattagtatcaccaatatcgaaagccagtgcacatcagagatctgggcgtgctggaagaactcaaccagggaaatgctttagactttacacagagagaagtttcaataacgatcttcagccacagacctatccagaaattttaagatcaaatcttgccaatacagttcttactttgaaaaaactgggcatagatgatttagtgcattttgatttcatggacccgcctgctcctgagaccttaatgcgtgcattggaggtgttgaattacttgggtgcactggatgatgatggtaacttaactaagctaggtgaaattatgagtgaatttcctttggatccacagatgtcaaagatgctcgttgtcagtcctgaattcaactgttcaaatgagattctgtcagtttctgccatgctttcagtacccaattgctttgtccggcctagggaggcacaaaaagctgcggatgaagctaaagctaggttcgggcacattgatggagatcacctcacgctgttgaatgtctatcacgcatacaagcaaaataatgaggatccctcttggtgctatgataactttgtaaatcatagggcattaaaatcagctgataatgttagacaacaattagttcgtatcatggcccggtttaatctgaagcaatgcagcactgactttaatagccgcgactactatgtcaacataagaaaagctatgctggctgggtatttcatgcaggtagctcatttggagcgtacaggtcactacttgacggtgaaagacaaccaggtggtgcatttgcatccatcaaattgcctggaccacaagcctgaatgggtaatttataatgaatatgttcttaccagtcggaactttattcggactgttacagacatacgaggggaatggttggttgatatagcaccacattactatgatttgtctaatttcccccaatgtgaggcaaagcgtgttctagagaaactttacaagagccgagaaaaggagaaggagcaaaccaggagccgcagataaaagtcgtagccatccacactatttttggatttggattggatattatttcctcgtctgtctctgagtctgagatcatgattcctcgtagctcttgccttttaccacccaccctttattattaattctgaaaggaatactgattgtcagtagtagtttagttaaaaatgagctataagtttcttgtaccattgctagagtaatagtgaacatttttttgatcaccgtccgtcttctgttgtaccgtaagtccatatttgtttctggattttagtgtcgttaaaggatagatgcccatcataaatgcttggatcctgcgttcattatttcactgatagtatcatataatacttagccgggagtgtttattatcactctaattta

SEQ ID NO: 2583 - DNA, 2506 bp, Gossypium hirsutum
tttcccctctttttttaatagaggagctcttaatcaaccgacccaatcaaattcataaattgtagagttttgaatgggtacggagagaaaaaggaaggtgagcttgtttgatgtagtggacgagccatcggctaagatcgcgaaatcgaacggtttaggtttaacggagacgaacgctaacagctcgatcaacaagtggaatggacggccttattctcaaaggtattacgatattttggagaagaggaaaaccctccccgtttggcgacaaaaagaagagtttttgcaagtattgagggcgaatcaaacccttatcttggtcggtgaaaccggtagcggtaaaactactcagattcctcagtttgtattggacgccgttgatatagaaactccggataaacgtaggaaaatgatgattgcttgtacccagcctcgaagagtggctgccatgtctgtttcgcgtcgtgttgctgaagaaatggatgtgactattggagaggaggtgggttatagtattcgtttcgaggattgcagtagtgcaaggactgttttgaagtatttaacagatggtatgcttttaagggaagcgatgacagatcctcttttagaaagatataaagtgattattctcgatgaagctcatgaaagaactttggctacagatgtgctgtttgggcttctgaaagaagttttaaagaatcgacctgaccttaagcttgttgttatgagtgctacactagaggctgaaaagtttcagggttattttaatggtgcaccacttatgaaggttccaggtaggcttcaccctgtggagatattctacactcaggaacctgaaagggattacttggaggctgcgatacggactgttgtgcagatacacatgtgtgaacctcctggtgatatacttgttttcctaactggagaggaggagatcgaagatgcctgtcgcaaaataacgaaagaagtaggaaacatgggggatcaagtaggtcctgttaaagtagtgcctctatattcaactcttccaccagcaatgcagcagaagatttttgagcctgctccacctcccgtgaaggagggtggccctcctggaaggaagattgtggtgtctacaaacattgccgaaacttccttgactattgatggcattgtttatgttattgaccctgggttttctaaacaaaaagtttataacccacgagtgcgtgttgagtccttattggtatctcctatatcaaaggcaagtgcacatcaaagatctggacgtgctggaagaacacaacctgggaaatgcttcaggctctacactgagaagagttttaataatgatctgcagccgcagacctatcctgaaatattacgttcaaaccttgcaaatacagttctcatcttgaagaaactgggaatcgatgatctggtacattttgattttatggacccacctgctccggagacattgatgcgtgcattggaagtgttgaattacttgggagcattggatgatgagggtaacttaacaaagctgggtgagatcatgagtgaattccccttggatcctcaaatgtcaaagatgctcgtagttagttctgagttcaactgttcaaatgagattctttcagttgccgccatgctttcagtacccaattgctttgtacggcctagggaggcacaaaaagctgcagatgaagcaaaagctcggtttgggcatatcgatggtgatcatctcacacttttgaacgtgtaccatgcttacaaacaaaacaacgaggatcaatcttggtgctatgagaatttcatcaaccatagagcgctgaaggctgctgataatgttagacaacagctcgtgcgcattatgtccaggtttaatctcaagctgtgcagcactgatttcaacagccgtgactactatgtcaacattagaaaggccatgcttgctgggtatttcatgcaggtagctcatctggagcgcacggggcactacttgacagttaaagacaaccaggtggtgcacttgcatccatcaaattgcctggatcacaagccagagtgggtcatctacaacgagtatgtcctgacaagccggaattttattcgtactgtgacagatattcgtggtgaatggttagtcgatatagcaccacattattatgatctcgaaaacttcccacagtgtgaggctaagcgagtcctcgaaaagctttacagaaaaaaggagaaggatcgggaggagagtcgaaacaggagatgaagtgctacgaccatacaagttgcttggacatgaatttttcttcaacggtgctatttgggagttattacgtagtatgttagttgataaattggaagaaacagaaatttcttgtaacatcatgaggaacttcttcccctagctatcttgtattttgtactagcactccaaatttgttcttttaaccttctattttatcatttaaggaacacttgaaatgatctctgaagaaagaagaaacgagcatgattttggatc

SEQ ID NO: 2584 - DNA, 2372 bp, Arabidopsis lyrata
tcgtaatgggtactgagagaaagcgcaaggttagtttattcgatgtaatggaagatccttctctttcgtcgaagaacaccaaatccaatggtctcggagttgcggcggcggctggtggtggaagcaatctgatcaacaaatggaacggaaaggcttattctcagaggtattttgagattctggagaagagaagagatcttcctgtttggctccagaaagatgagtttctcaatactttgaaatctaatcagactctcatcctcgtcggtgaaactggtagtggtaaaactacacagattccacagtttgtattagatgctgtggtggctgacaaatccgataagggaaagaaatggttggttggatgtacccagcctcgtcgagttgctgcaatgtctgtgtctcgtcgtgttgctgatgaaatggatgtcaccattggagaagaagttggttatagcattcgttttgaggattgtactagctctcgtactatgcttaagtatttgactgatggtatgcttttgagagaggcaatggctgatccgcttttagagagatacaaagttattattctcgatgaagctcatgaaaggactctagccacggatgtgctctttggtcttctcaaagaggtcttgaggaatagacctgaccttaagcttgttgtcatgagtgcaaccttagaagccgaaaagtttcagcagtattttagcggtgctcctcttatgaaagtccctggtaggcttcatcctgttgagatcttttatacacaggaacctgagagggactatcttgaggctgctattaggactgttgttcagatacacatgtgcgagccacctggagatattcttgttttcttaactggggaggaggagatagaagatgcttgccgtaaaatcaataaagaggtcagtaatcttggagatcaagtgggtcctgtcaaagttgtgcctttgtattctactcttccacctgcgatgcagcagaagattttcgaccctgctccagagcccttaacagaaggtggtcctgctggacgaaagattgtcgtctcaaccaacattgctgaaacgtctcttacaattgatgggattgtttatgttattgaccctggttttgctaagcagaaagtctacaacccacggattcgtgttgagtcattgttggtgtccccaatatcaaaggcaagtgctcaccagagatcaggtcgtgctggtagaactcggcctggaaaatgttttaggctctacacagagaagagtttcaacaatgatctgcagccacagacatatcctgagattttgagatcaaaccttgcaaatacagtcctgacattgaaaaagcttggtattgatgatttggtgcactttgatttcatggatcctcctgctcctgagacactgatgcgggcattagaggttttgaattatttgggagcactggatgatgaaggtaacttgacgaagacaggtgaaataatgagtgaatttcccttggatccacaaatgtcaaagatgctcatagtcagtcctgaattcaactgttcgaacgagattctctcggtttctgcaatgttatcagtaccgaattgctttgtccggcctagagaggctcaaaaagcagcagatgaagctaaagctaggtttggacacattgatggagatcacctcacgttgctaaacgtgtaccacgcctataagcaaaacaatgaagacccaaactggtgtttcgagaactttgtcaacaacagagcaatgaagtctgcagacaatgttagacagcaactagtgcggataatgtcgaggtttaatctaaagatgtgcagcacggatttcaacagccgcgactactatgtcaacataagaaaggccatgcttgctggttatttcatgcaggtggctcacctagaacgcactggccattacttgaccgtcaaagataaccaagtggttcacttgcatccatctaattgcctggatcacaaaccagagtgggtgatttacaatgaatatgtcttgactactcggaatttcatacgcactgttacagatatccgcggtgaatggttagtagatgttgctccgcattactatgatctttccaacttccccaactgtgaagcaaaacgagtcctcgagaaactttacaagaaaagagagagggaaaaggatgggagcaagaaccgaaagtgaagagaatcactattctctctttgcttcgactagaggatcaaatcactcagagaagattgtcttagtcacaagaccactgtgctttaccctcgtgttaaattatgttgaatactttgctttgtttatgttcaatgaaagaatcttgcattacccaaagtgtgttcttttaaaacctct

SEQ ID NO: 2585 - DNA, 3306 bp, Gossypium raimondii
aacccagtatcaacgcagagtacactgggctccctcttttacccaaacctgatttccacttctagggtttcatatttcccctcttttttaatagaggagctcttaatcaaccgacccaatcaaattcataaattgtagagttttgaatgggtacggagagaaaaaggaaggtgagcttgtttgatgtaatggacgagccatcggctaagatcgcgaaatcgaacggtttaggtttaacggagacgaacgctaacagctcgatcaacaagtggaatggacggccttattctcaaaggtattacgatattttggagaagaggaaaaccctccccgtttggcaacaaaaagaagagtttttgcaagtattgagggcgaatcaaacccttatcttggtcggtgaaaccggtagcggtaaaactactcagattcctcagtttgtattggacgccgttgatatagaaactccggataaacgtaggaaaatgatgattgcttgtacccagcctcgaagagtggctgccatgtctgtttcgcgtcgtgttgctgaagaaatggatgtgactattggagaggaggtgggttatagtattcgtttcgaggattgcagtagtgcaaggactgttttgaagtatttaacagatggtatgcttttaagggaagcgatgacagatcctcttttagaaagatataaagtgattattctcgatgaagctcatgaaagaactttggctacggatgtgctgtttgggcttctgaaagaagttttaaggaatcgacctgaccttaagcttgttgttatgagtgctacactagaggctgaaaagtttcagggttattttaatggtgcaccacttatgaaggttccaggtaggcttcaccctgtggagatattctacactcaggaacctgaaagggattacttggaggctgcgatacggactgttgtgcagatacacatgtgtgaacctcctggtgatatacttgttttcctaaccggagaggaggagatcgaagatgcctgtcgcaaaataacgaaagaagtaggaaacatgggggatcaagtaggtcctgttaaagtagtgcctctatattcaactcttccaccagcaatgcaacagaagatttttgagcctgctccacctcctgtgaaagagggtggccctcctggaaggaagattgtggtgtctacaaacattgccgaaacttccttgactattgatggcattgtttatgttattgaccctgggttttctaaacaaaaagtttataacccacgagtgcgtgttgagtccttattggtatctcctatatcaaaggcaagtgcacatcaaagatctggacgtgctggaagaacacaacctgggaaatgcttcaggctctacactgaaaagagttttaataatgatctgcagccgcagacctatcctgaaatattacgttcaaaccttgcaaatacagttctcatcttgaagaaactgggaatcgatgatctggtacattttgattttatggacccacctgctccggagacattgatgcgtgcattggaagtgttgaattacttgggagcattggatgatgagggtaacttaacaaagctgggtgagatcatgagtgaattccccttggatcctcaaatgtcaaagatgctcgtagttagttctgagttcaactgttcaaatgagattctttcagttgccgccatgctttcagtacccaattgctttgtacggcctagggaggcacaaaaagctgcagatgaagcaaaagctcggtttgggcatatcgatggtgatcatctcacacttttgaacgtgtaccatgcttacaaacaaaacaacgaggatcaatcttggtgctatgagaatttcatcaaccatagagcgctgaaggctgctgataatgttagacaacagctcgtgcgcattatgtccaggtttaatctcaagctgtgcagcactgatttcaacagccgtgactactatgtcaacattagaaaggccatgcttgctgggtatttcatgcaggtagctcatctggagcgcacggggcactacttgacagttaaagacaaccaggtggtgcacttgcatccatcaaattgcctggatcacaagccagagtgggtcatctacaacgagtatgtcctgacaagccggaattttattcgtactgtgacagatattcgtggtgaatggttagtcgatatagcaccacattattatgatctcgaaaacttcccacagtgtgaggctaagcgagtcctcgaaaagctttacagaaaaaaggagaaggatcgggaggagagtcgaaacaggagatgaagtgctacgaccatacaagttgttttgacatgaatttttcttcaacggtgctatttgggagttattacgtagtatgttagttgataaattggaagaaacagaaatttcttgtaacatcatgaggaacttcttcccctagctatcttgtattttgtactagcactccaaatttgttcttttaaccttctattttatcatttaaggaacacttgaaatgatctctgaagaaagaagaaacgagcatgattttggatctttttaatactcattacccttgtgataaattttctcctgctgattcctgatctgtgaaggaaaacctgattcaatcaattcccaaatatgagtttcaattaccctgtacctaaattgattcaaaatttgaacagtttcaagtttaaatgagaagttatttgtatctggaaatgttattcaagcctgaagtaaaaatatgaaataattcgagttcgtgaggacttaatttgaagaacttaagctgcgaatgcaaaataaaagggggatgattctgaagaatttgattggatttaaattgatacaagtcaaagtccctaacccaagactggttatggatttttaggcctatatattgttgtactactttttgtatgtgcattacgaagattcccacaaatagaatgaagaggactcggccatctatatagagtgcatttatggaattggattatgggcatgggagtaaggatcttcccccaagatgtggtttaaaagttgatccaaggaaaatcctgttgattcccttagttgggagttcttcccaaagatgtttattgaatggatttgaggctgtgtttcgcattcaaagttctcaattgctttgaatggaatggatgattagttggatatttctctgcagggaaaggagctacctattcattattggcatgaatgatttatcaaccctcttgagcaaagctggaagatacaattttttattttgacc

SEQ ID NO: 2586 - DNA, 3007 bp, Vitis vinifera
gttctctctctctctcttcttctcctctgtataaaaaagtgagacgcgtgccctagcgtctattgctctctattctagggtttacacattctctcgattcgattcgggtcaagggttttttgttttaaatttgtgcattagggttagggttgggattagggttggggctggggtggtttcatggggacagagaggaagaggaaggtaagcttgttcgatgtggtggacgagacctcagtctccgccaaaatctccaaatccaacggcagtggtgccatcaacaacaacaacaataacaatctcgtcaacagatggaatggacgcccctactcgcagaggtattacgagattctggagaagaggaggactcttccagtttggcaccaaaaggaggagtttttgcaggttctcaaggccaaccaatccctaatcttggttggtgaaactggtagtggtaaaacaactcagattcctcagtttgttttggaagctgttgatatagaaactccagacaaacgcaagaagatgatgattgcctgcacccagccccgtagagttgcagcaatgtctgtgtctcgtcgtgttgctgaagagatggatgtaacgattggagaagaagttggttatagcattcgttttgaggactgcagtagtgcaagaacagttttgaagtatttaacagatggtatgcttttaagagaagccatgactgacccactgttggagcggtataaagtaataattcttgatgaggctcatgaaagaactttggcaacagatgttttgtttgggcttttgaaggaggttctgaaaaataggcctgacttgaaagtcgttgtaatgagtgctactcttgaggctgaaaagttccagggttatttcaatggtgctcctcttatgaaggttcctggcaggcttcaccctgtagaaattttctacacccaggagcctgagagagactatttggaagctgcaattcggacagttgtgcagatacacatgtgtgaaggtgctggtgacatacttgttttccttactggggaagaggagattgaagatgcttgcaaaaaaatatcaaaagaaattgcaaatttgggggatcaggtggggcctgtgaaagcagtgcctctgtactcaacacttcctcccgccatgcagcagaagatatttgaacccgctccaccaccactgacggagggtggtcctccaggaaggaaaattgttgtctcaaccaacattgcagaaacttcattgaccatagatggcatagtatttgttattgatccggggtttgctaaacaaaaagtttacaacccacgagtgcgtgttgaatctttgttagtatctccaatatcaaaggcaagtgcacaccagagatctggacgtgctggtagaactcaaccagggaaatgtttcaggctctatacagagaagagttttaacaatgatcttcagccacagacctacccagagatactgcgatcaaaccttgcaaatacggtcctcaccttgaaaaaacttgggattgatgatcttgtccattttgattttatggaccctcctgcccctgagacattgatgcgagcactagaggtgttaaattacttgggagctttggatgatgatggaaacttgaccaagttgggtgaaataatgagtgaatttcctttagatcctcagatgtccaagatgcttgttgtcagtcctgaattcaactgttccaacgaaattctgtctatttcagccatgctctcagtacccaattgctttgtccggcctagggaggctcaaaaagctgcagatgaagcgaaagctcggtttgggcacatcgatggggatcaccttacactcttgaatgtgtaccatgcatacaagcaaaacaatgaagatccatcttggtgttacgaaaattttgtcaatcagagggcattgaaggctgcagataatgtgagacaacagctagtgcgcatcatggccagattcaacctcaaattatgcagcacagatttcaacagccgggactactacatcaacataagaaaggctatgctagctggatattttatgcaggttgctcacctggagcgcactgggcactatttgacagtgaaagacaaccaagtggtacacttgcatccttcaaattgccttgatcacaagccagagtgggtgatttacaatgagtatgttttaaccagcaggaattttattcgcacagttacagatgttcgtggcgaatggctagttgatgtggcgccacattactatgatcttgcaaacttccctaattgtgaggcaaagcgtgtcctggagaagctttacaagaagcgggagaaagacagggaggagagccggaacagaaaataacagctgtactttattttatctcattttttgggggtagaaaaagaagtgcatgaagaaaaatattgaatatttacacaatggagcccaaattgtcggggaaaaatgttggaacaagtttgcgaagttaatgtaccatttgtgggagtaggtttttctttatttctatggatttgtggaagtaattgtagtacctaaagtttggtattgtattaattggccaaaattgttatttggttgtcaccttaatatttctcgtctaggtattttaacatttgtgaagataaagagttacatatgaatgcattagaatttctacctgcaagttcatttgcatgtctaatgtataaagaatctgggactggtggtgattagagttagacaacttgtttggcggcttgagtgctctgtttttgttttgattattgtactggcttttatatagactatagattggctagggggcccggatatcagagtacgttttgtttaggagtgtcaattcagacacttaaaacttgctttgttgaggtttggtgtatttagtggagtttgggggcaaaatagccttgcatgtaaggaaatgtcagttttagtccctttacaaaacttattttcaaattaatccttttattaccacata

SEQ ID NO: 2587 - DNA, 2568 bp, Trigonella foenum-graecum
cctgtgtgtttgtttcgtaggggttcgtgaaacgcatattcttcgtatttcgttagaaacggtgcaaaatccaagaagataattagggttttcatgggtacagagagaaagaggaaggtgagtctattcgacgtagtcgacgacgccgctgcaaagatggtgaaaactaacggcggtttaatcggcaacaacctcatcaaccattggaacggaaaaccttactcacaaagataccatgaaattttggagaagaggaaactcttcccgtttggcatcagaaagatgattttttgaaggttttgaaggataatcagactttgattcttgttggtgaaactggtagtggaaaaaaccacacagatccctcagtttgttttagaagctgttgatttagagactcccgataaacgcaagaagatgatgattgcatgcactcagcctcgtagagtggctgctatgtctgtttcacgccgtgtggctgaagagatggatgttagtattggggaagaggttggttatagcatcagatttgaagattgtagtagtgcaaggacagttttgaagtatctaacagatggtatgcttttgagagaagcaatgacagatccacttttggagcgatacaaagtaattattcttgatgaggcgcatgaaaggactttggctaccgatgtgctatttggccttctaaaggaagttcttaaaaacagacctgacttgaagttggtggttatgagtgcaacacttgaagctgaaaagtttcagggctatttttttggtgcccctcttatgaaagttcctggaagactacatccagtggaaattttttatactcaggaaccagaaagagattacttggaggctgctattaggacagtggtgcagattcacatgtgcgaacctgctggagacatacttgttttcttactggagaggaagagatagaagatgcatgccgcaaaatatcaaaagaagttgcaaatatgggggaccaggtgggacctgtgaaagcggtgccattgtattctactcttcccccagctatgcagcagaagatttttgagccagctccacctccagttaaggagggaggccctcctggaaggaagattgtggtatcaacaaacatagcagaaacttccttgacaattgatggtatagtctatgttattgaccctggatttgctaagcagaaggtctataaccctcgagttcgtgttgagtctttgttagtgtctccaatatcaaaggctagtgcacaccagaggtccggacgtgctggaagaactcagccagggaaatgctttagactttataccgaaagaagtttcaataatgatcttcagccgcagacctatcctgaaattttgagatctaatcttgccaacacagttcttacattgaagaaactgggtatagatgatttagttcattttgacttcatggaccctcctgcccctgaaaccttaatgcgtgctttggaagtgttgaattacttgggtgcactggatgatgaaggtaacttaacaaagcttggtgagattatgagtgagtttccattggaccctcagatgtcaaagatgcttgttgttagtcccgagttcaactgttcgaacgagattctttcaatttctgccatgctatcagtacccaattgctttatccggcctagggaggcacaaaaagctgcggatgaagcgaaagctaggtttggacacatcgatggagatcatctcacactcttgaatgtataccatgcctacaagcaaaacaatgaggatgcttcttggtgctacgacaactttgttaataatagggctctgaaatcagctgataatgttcgacaacagctagtgcgtattatggctcggtttaacctgaagttatgcagcaccgacttcaatagccgcgactactacatcaacataagaaaggcaatgctagcaggatatttcatgcaggtggctcatcttgagcggacaggacactacttgacagttaaagacaaccaggttgtacacttgcatccatcaaattgcctggaccacaagcccgagtgggttatctataatgaatatgttcttacaagtcggaatttcatacgtactgtgacggatattcgtggtgaatggttggttgatatagcaccacattactatgatttatctaattttccacaatgtgaagcaaagcgcgttcttgaaaagctttacaagaaacgagagaaggaaaaggatgaagccaggaatcgtaaatgaagccttacctcgcctattctgcctttggattgggaatttgatgtttcatcttctgcaagttgacatcaaaatatcgtcatgggaatgttcactagtactacctcgttattacctttgaaggacatgctgattgtcagtaattttaatgaaagaattggcagagttccttgtactattagagtagtaacatgttttatattcctagaccttgttctgttgtaccttacggatttatttattggcttcaaatttgttttttttcggatgctagtgtcgtcaaaggctaaatgcctcatcattttgcattatt

SEQ ID NO: 2588 - DNA, 5289 bp, Theobroma cacao
gggtgcttgttcttgggctaacccaaatcttagaaggctcaagtagggagactctggctgaacacttgggcaaatgtatttgagagtccatttctttatgatccaagtaaatgggcctagagcagctttgcagccgcctcggcctgagggtcctcgccttaaaaggagtgttaaaacaataaaataaaaattaaacatgattaaatatggaccgctaaaacttttgaggtcgtcggtttattaagcaaggtccccaagtaaataaatccaatagtagggaccgatcagtaaatctggaaagttcttctccctcccccttttcaactagtgccatactattataactgaaatgataaataacccaacccatattaccctagcctccctctcttttccccaaccctgagttcaacttctagggttttcatttttttttaaaattggaatttttctcaaccgacccaatcaaatttccttttctaaaaggtttagggttttggatgggtacggagaggaagagaaaggtgagcttgttcgatgtggtggatgagacatcggctaagatatcgaaatcgaacggcggagggatagcggcgatgaacgtcaacagctcgatcaacaagtggaatggaaggccttattcgcaaaggtattacgagattttggagaagaggaaaacgcttcctgtttggcaacagaaagaggagtttttgcaagtgttgaaagccaatcaaacgcttatcttagtcggtgaaaccggtagcggtaaaaccactcagatacctcagtttgtattggacgctgtggatatagaaactccggataagcggaggaaaatgatgattgcgtgtacacagccacgaagagtggctgctatgtctgtttcgcggcgtgttgctgaagaaatggatgtaactattggagaggaggttggttatagtattcgttttgaagattgcagtagtgcaagaactgttttaaagtatctaacagatggtatgcttttaagggaagcgatgactgatcctcttttagaaagatataaagttattattcttgatgaagcccatgaacgaactttggcgacagatgtgctatttgggcttctgaaagaagtgttgaagaatcgacctgatcttaagctagttgttatgagtgcaacacttgaggcagaaaagtttcagggttattttaatggtgcaccacttatgaaggttcctggtaggcttcaccctgtggagatattctacactcaggaacctgaaagggattacttggaggctgctattcggactgttgtgcagatacacatgtgtgaacctgctggtgacatccttgttttcctgactggagaggaggagatagaagatgcatgtcgcaaaataactaaagaagctggaaacatgggggatcaagtgggacctgttaaagtagtgcctttatattcaactcttccaccagcaatgcaacagaagatttttgaacctgctccacctcctgtgaaggaggatggtcctcctggaaggaagattgtggtgtcaacaaacattgctgaaacttccttgactatagatgggattgtttatgttattgacccagggtttgctaaacaaaaggtttataacccacgagtgcgcgttgagtccttgttggtatctccaatatcgaaggcaagtgcacaccaaagatctggtcgtgctggaagaactcaacctggaaaatgtttcaggctatacactgagaagagtttcaataatgatctgcagccacagacctatcctgaaatattaagatcaaaccttgcaaattcagttctcactttgaagaaactgggaattgatgatctggtgcattttgattttatggacccacctgcgccagagacattgatgcgggcattggaagtgttgaattacttgggagcattggatgatgatgggaacttaacaaagttgggagagatcatgagtgaattccccttggatcctcaaatgtcaaagatgctcgtagttagttccgaattcaactgttcaaatgagattctttcagttgctgccatgctttcagtacccaattgctttgtccggcctagggaggcacaaaaagctgcagatgaagcaaaagctaggtttgggcacattgatggggatcatcttacgcttttgaatgtgtaccatgcttacaaacaaaacaacgaggattcatcttggtgctatgagaattttgtcaaccatagagcactgaaggctgctgataatgttagacaacagctggtgcgcataatggccaggtttaacctcaagctctgcagcaccgatttcaacagccgtgactactacatcaacattagaaaggctatgcttgctgggtattttatgcaggtagctcatctggagcgcactgggcactacttgacagttaaagacaaccaagtggtgcacttgcatccatcaaattgcctggatcacaagccagagtgggtcatctacaatgagtatgtcctgacaagccggaattttattcgtactgtgacagacattcgtggtgaatggttagttgatatagcaccgcattattatgatcttgaaaacttcccacagtgtgaggccaagcgtgttcttgaaaagctttacaagaaaaaggagaaggatagagaggagagtaggaacagaagatgaagcttacatccatacaagttgttttgactgcaatttttctatggtgctattgcgttattacatatgttggttgacaaattggaagatagcaaaatttcttgtatcattataagcgtaggacgttcgtccctatctttagtattgtactatcaatccaaatttgtttagttgcgatttttatcatttagttgttgaacaattgaaatgatccaaattgaaaaaagagaacgattttggacctagtaaatctcggttaaccagtgcttggtctcattccctataataaattgaactctcctgcttttatctctgggacttaatcttcgctgaatgattctggatctatctccagttttttaatccgattcattcttctgtcttctgtttgatgcattgcttctttaaccttgcaagattaggaagaacattatctttagggtgtgaaacttttgattgtctctacattttctaataggctgggctcgacttggtttcgactgcctaaagcccgaaaccaattggggctggggttcggtcttaggatacacaatgggccaattaatggaaatttaaaagaaaaatgttttttggcaggagaaaggtgaggaaacttgcatcatacgcgactcttttcgttcgcgtcctgttctattttactttcaccaagtcccaagtttttccaagcaacctttaatctttacatcctctcttatcggaaaatggaggattcggccattgattttgagggagatgcttgtatcaaccagcaaccagattcaaaatggtaaacaatagtctctccggcaaatccctaaaggcttgtggtctatgaatgaagcacctgtcataaaggaattaagagtgatctttatggaattttgtttgttaatgagaaggtatctaacgaatggtatgcttgtaacttgtaagggaaggaatgagtgatccacttttagaaagatataaaatgattatttttgacgaggcccatgaacggactttggctacagatgtgctgtctgtgcttctgaaagaagtgttgaagtatcgacctgaccttaagctagctgttacgagtgcagcacttgaggcggaaaagtctcaggtttattttaatggagcactgcttatgaaggacaaaattgctgagaaggtgcaattatatgttggtaatagaacatatgatgtgttttttgttcatgaaatatttcctgaagtttcgattgaattcccctcggcttctagttcactggaatgggaaaacaagtcaaatggaagtaacgagtccattgcaaagggaggtgggattgtgttgatcactgtggtgaacggtaaagagttacaggagctcatcgacgtagaagatgaccaggctaagaccaggaaggaaggagaaacagcccgttctgtcatgggcacccaagtaatggaaaggccacctgacgctttaccgtcccaagttaagaaagggatgattgtagtttgtggtgctatggtggcggaagtgtcggattcaaaaggtgaagaaggcagaatatcattgaagagtgacaaggttgatggttactgtcaggtgaaaattggggttaagagttatgttgtttttggtgtttaatgccctttgttccatggtggtttctgttgagtgaaatttgaggttgacttctatgttgtttctagtattatgcatggtggtaattgtttgatggctcctgttctatggtggttttgtggccgattgatgatgtcttctagatgaaatccggtgatggtttctatgttgtttctaatgccgttgtgtattggatggggttgtttgctttctattggttttaggatggtctcatggagtccggtgaagatgagtaagtaatggcaagaaggttgcaattggcaaaggagagcgtaaaggccccgggtggattttgttcacaatgtagatgaaatttggtgtttcaggtgcttgaaggcaattgggatttcggtgttgaggtgttacaacttttctttcttgcgtaatgtctgtgttagtgaggactcttcgggtttttggtgctggtaggcggtacagctcttgtttaaggagtgttttgtttcaatgtccacacctgttcttatggtagcggatcaagtgtttgctggataagttttggtttgtttgaagaggattcttcgttatgtggtggtgaggctgctgtcaaaaaagattctgtgcagagaagggctggattatgtgcggcgctgtctgttttaaaaagtagatgcggattttagaattttggctctgtgcagatcgttctatatgcatcgtaggccatgtttgctgttgatttgttttgggatgttattatttccaaggaaataaaatatgaatcttattctttttaggtcattagagagggatttggatttggtgacctaactgtatatagatacatcaaatattaatcatttattttcatgtggttgtacgtagatgacaattttttttaatttgttgcatggtgctctaggcatgtctgcactatgtcatgaacattcttggtttccagtgttcaagtgctcttacgaacctctatgatcatatatataataaataaattcattgaca

SEQ ID NO: 2589 - DNA, 2614 bp, Cucumis sativus
ggttttgatgggtgcggagaggaagagaaaggtcagtttatttgatgtggtggatgaaacctcggtctccgcgaagttaaacaaagtgaatggtggagtagcgccgttgaacaatggcggtggaaatgcggggaatagtctcatcaacaggtggactgggaggcagttctcgcagaggtactatgagattttggagaagaggaagactttgcctgtttggcatcagaaagaggaatttttccaggttttgaagagcagtcagactttgattttggttggtgagactggtagtggtaaaactactcagattcctcaatttgttttagaagctgttgacctggatagtccagataaacggaagaagatgatggttgcatgcactcagcctcgcagggtggcagcaatgtcagtttctagacgtgttgctgaagagatggatgtgactataggagaagaggtgggttacagtatccgttttgaagactgcagtagtgcccgaaccgttttaaagtatttgacagatggtatgcttttgagagaagcgatgacagatcctcttttagaaaggtataaagtaattattcttgatgaggctcatgaaagaacattagcaacagatgttctttttgggcttttgaaagaagtattgaaaaataggccagacctaaagctggtggtcatgagtgctacacttgaggctgaaaagttccagggttatttttatggtgctccacttatgaaggttcctggtaggcttcatccagtcgaaatattttacacacaggaacctgaaagggactatcttgaagctgctatccggacagttgtacagattcatctgtgtgaacctccaggtgatatacttgttttcctcactggtgaggaggaaattgaagatgcatgtcgcaaaataaataaagagattggaaaccttggcgaccaggttgggcctgtgaaagtggtgcctttatattcaactcttcctccagcaatgcagcagaagatatttgaacctgctcctcctccagtaaaagaggatggacctgctggaaggaagattgtggtctccacaaacattgcagagacttctttgaccatagatggcattgtttatgttattgaccctggattttcaaaacagaaggtctataatcctcgagtacgtgtggaatcattattggtgtctcctatatcgaaggctagtgcgcatcagagatctggtcgtgctggaagaacccagcctggaaaatgttttagactttacacagaaaagagtttccaaaatgatttgcaaccacagacatatcctgaaattttaagatcaaaccttgcaaatactgttcttaccttgaagaagttgggaattgatgaccttgtgcattttgattttatggatccacctgctcccgagacattgatgcgagctttagaagttctgaattacttaggtgcattggatgatgatgggaatctaacgaagcttggggaaataatgagtgaatttccattagatcctcagatgtcaaagatgctcgttgttagtccagaattcaaatgttcaaatgaaatattatcagtttctgccatgctttcagtacccaattgctttgtccggcctagggaggctcaaaaggctgctgacgaagcaaaagctaggtttggccacattgatggagatcatcttacgctcttgaacgtgtaccatgcttacaagcaaaacaatgaggatcagtcatggtgctacgagaactttatcaatcacagggcaatgaaggctgcagataatgtgagagagcaactagtccgcatcatgtctaggtttaacctcaaattatgcagcacagatttcaacaaccgtgagtactacgtaaacataaggaaggccatgctatctgggtatttcatgcaagtagctcatttggaacggactggacactacttaacagtgaaggacaaccaggtggtacacttgcatccatcaaattgcttggatcataaaccagaatgggttatttacaatgaatacgtcctaacgagtaggaatttcatccgtacagtgacagatatccggggtgaatggttggtggacatagcatcacactattatgatctggagaacttccctcaatgtgaggccaagcgtgttctcgaaaggctgtacaagaagcgggaaaaggatcgtgaagaaagcaggaatagaaaatgaggtttttccccagctcgttctgcccttggagatttcaacttagcatcaattttcttctggggtgatgaaagtgggaggcatcccaggaccttaatcgttctttcattcttcattccaatgtcgtccatggcagataactattagctgaggagcggaagaaattggttgtatttctatactgttaaattaggccagtgttcttagggttcatatagtctcgaaacattacactcgctagattttgatttttcaacgctatggtgttttttgcttatatgttattttaatgtatgaaatctcaaaagccaatgtgaccatagccaacatttcaactcttccgcacaaacttttcataaatgtgtaatttttatgttcgttgaaacggtatatatccagacttgccaactt

SEQ ID NO: 2590 - DNA, 2968 bp, Ricinus communis
ataaaacaaatctgggcctcttgacgagatgaggttgtcggttaccaatataaatttttttcttttggtggaaaagtaaccaaagaaaaagagagaccatagggaccaatgagcaaatctggaaagttccaataagaaccgagtgataaatacggagacgacgctggcgccgtaaccttgttgcatatatgcattccattgtcgttctagggttttactaaaaataccaaaatttctcaatttttattctttcgattcggatccaggtccatccgatcgacaaagttaggtttgtgaattggaagtggatgggtacggataggaagaggaaggtcagcttgtttgacgtggtagacgagacttctgtctccgcaaagatcgcaaaatctaacggcggcggcggagcggcaatgaataataatgggagcagcaacagtttaataaatagttggaacgggaagccttattcacagagatactatgagatattagagaagaggaagactctgccagtttggcaccaaaaggaggaattcttgtcggttttgaagaaaaatcaggtccttattcttgtcggcgagactggtagcggtaaaaccactcagattcctcagtttgttttggaagcagtagacatagaaacaccagataaacgtagaaagatgatgattgcatgcacccaacctcgtagagttgctgccatgtctgtttctcgacgtgttgctgaggagatggatgttactattggtgaagaggttggttatagtatccgttttgaagactgtagcagtgcaaaaacagttttgaagtacttaactgatggtatgcttttaagagaagcaatgactgatccacttttagaacgatacaaggtaattatccttgatgaagctcatgaaagaactttggcaacagatgtgctattcgggcttcttaaagaagttttgagaaatagacctgatctgaagctagttgttatgagtgcaacactagaggctgagaagtttcagggttactttaatgatgcacctttgatgagggttcctggtaggcttcatcctgtggaaattttctacactcaagatcccgaaagggattatcttgaggcagcaattcggacagttgttcagatacacatgtgcgaacctcttggagacatacttgttttcctcacaggtgaggaggagatagaagatgcatgccgtaaaataacaaaagagatttcaaatatgggggatcaggtagggccagtgaaagttgtgcctctatattcaactcttcctcctgccatgcagcagaaaatttttgaacctgctccacctcctctgaatgagggtggccctgctggaaggaagatcgtggtgtcaacaaacatagcagaaacttctttgaccatagatggcatagtttatgttattgacccagggtttgctaagcaaaaggtttataacccaagagtgcgtgttgaatccttgttggtgtccccaatatcaaaggcaagtgctcaccagaggtcagggcgtgctggaagaactcagccaggcaaatgcttcagactttatacagagaaaagttttcatcaagatcttcagccacagacatatccagaaatactgcgatcaaaccttgcaaatacagtcctaacactaaaaaaacttggaatagatgacttggtgcattttgattttatggaccctcctgctcctgagactttgatgcgggcattagagatgctaaattatttgggagcattagatgatgatgggaacttgacaaagctgggagaaattatgagcgagtttcctttagatcctcagatggcaaagatgctggttgtcagtcctgaattcaactgttcaaatgagattctatcagtttctgcaatgctttcagtacccaattgctttgtccgccctagggaggctcaaaaggctgctgatgaagcaaaagctagatttgggcacattgatggggaccacctgacactgttgaatgtctaccacgcgtataagcagaacaatgaagatccatcttggtgctacgagaattttatcaatcatcgagctctcaaggctgctgataatgtcagacaacagcttgtacgcattatgactaggtttaacctaaagttatgcagcactgacttcaacagccgcgactactatgtcaacataaggaaggctatgctagctggatattttatgcaggttgcccatttggaacgcactggacattacctgacagtgaaggacaatcaagtggtgcacttacatccatcaaattgtctggatcacaagccggagtgggttatttatagtgaatatgtcctaacaagccggaacttcattcggacagtgacagatattcgtggtgaatggctagtagatatagcaccacattactatgacttggacaacttcccaaattgtgaggccaagcgtgttctcgagaagctttataaaaagcgggagagagagaaggaagagagcaagaacagaaagtgaaatatgttcattgtttaatgagatttcttctccgggggacaaagtgagatggtgcttgtgaaatagcatggcaaacgcctctgtgatctctcactgggttttccttcagctccttgtagttcttgacatagtaggtttagccatgccatcttcattttctattgtaccctttgtcatttcatattttttgttattggatgtggcttcaatcctattcgagttttagttgaacatttgaaaaacgaaacacagcttcattgtggacgggttacactcctctgctcgctctttctcaggaatgttgactgatctgcattgtcttgacaagcattctgtggagcattgcatgattaaattgtaaaaaacatgacaagcagtatggtgtctgctctgcatgtaactagtcaattcatagcatgtcaaaaattaggaatcagatttatggattatcgataattaagaaa

SEQ ID NO: 2591 - DNA, 3022 bp, Citrullus lanatus
ctcgaattagggtttcggaaatttgaagttccaagaccaggccccttcagtcgcttttccaagaaagcaagcttcgaccacgtcctatctttctcttgaggtagagtccagccctttttctaaggctatttctatagttctgtgccggcaagggttttgatgggtgcggagaggaagagaaaggtcagtttatttgatgtggtggacgagacctcgctatccgcaaagagccacaaagcgaacggtggagtagcggcgttgaacaatggcggtggaaatgcgggcaatagtctgatcaacaggtggactgggaggcagttctcgccgaggtactatgaaattttggagaagaggaagactctgcctgtttggcatcagaaagaggagttttttcaggctttaaagagcagtcagactttgattttggttggtgagactggtagtggtaaaactactcagattcctcaatttgtcttagaagccgttgacctggatagtccagataaacgaaagaagatgatggttgcatgcactcagcctcgtagggtggcagcaatgtcagtttctagacgtgttgctgaagagatggatgtgactattggagaagaggtgggttacagcatccgttttgaagactgcagtagtgccagaacggttttgaaatatttgaccgatggtatgcttttaagagaagcgatgacagatcctctattagaaaggtataaggtaattattcttgatgaggctcacgaaagaacattagcaacggatgttctttttgggcttttgaaagaagtattgaaaaataggcctgacctaaagctggtggtcatgagtgctacacttgaggctgaaaagttccagggttatttttatggtgctccacttatgaaggttcctggtaggcttcatccagtggaaatattttacacacaggaacctgaaagggactatcttgaagctgctattcgcacagttgtacagattcatttgtgtgaacctccaggtgatatacttgttttcctcactggtgaggaggaaattgaagatgcatgtcgcaaaataaataaagaaattgcaaatcttggcgaccaggtagggcctgtgaaagtggtgcctttatattcaactcttccaccagctatgcagcagaagatatttgaacctgctccacctccagtaaaagaggatggacctgctggaaggaagattgtggtgtccacgaacattgctgagacttcattgaccatagatggcattgtttatgttattgaccctggcttttcaaaacagaaagtttataacccccgagtacgtgtggaatcattgttggtatctcctatatcaaaggctagtgcacatcagagatctggtcgtgctggaagaactcagcccggaaaatgttttagactttacacagaaaagagtttccaaaatgatttgcagccacagacatatcctgaaattttgagatcaaaccttgcaaatactgttcttaccttgaagaagttgggaattgacgaccttgtgcattttgattttatggatccacctgctcccgagacattgatgcgagctttagaagttctgaattacttgggtgctttggatgatgacgggaacctgacgaagcttggggaaataatgagtgaatttccattagatcctcagatgtcaaagatgctcgttgttagtccagaattcaaatgttcaaatgaaatattatcaatttctgccatgctttcagtacccaattgctttgtccggcctagggaggctcaaaaggctgccgacgaagcaaaagctaggtttggccacatcgatggagatcatctaacgctcttgaacgtgtaccatgcttacaagcaaaacaatgaggatcagtcatggtgctacgaaaacttcatcaatcacagggcaatgaaggctgcagataatgtgagagagcaactagtccgcatcatgtctaggtttaacctcaaattatgcagcacagatttcaacagccgtgactactacgtaaatattagaaaggctatgctatctgggtatttcatgcaagtagctcatttggaacggactggacactacttgacagtgaaggacaaccaggtggtacacttgcatccatcgaattgcttggatcagaaaccagagtgggtcatttacaatgagtacgtcctaacgagtaggaatttcatccgtacagtgacagatatccggggtgaatggttggtggatatagcagcacactattatgatctggaaaacttccctcaatgtgaggccaagcgtgttctcgaaaggctttacaagaagcgggaaaaggatcgtgaagaaagcaggaatagaaaatgacttttttttttccagctcattccgcccttttggagatctcaattaagtatcaattttcttctgagatgagatgaggttggggggcgttcaagaagcctaattgctattcatccaaaggtcgtccgtggcagatactgtcagctgaggagcggaagaaagtggttgtatttctgtactgttgaattaggccagtgttcttaggggttcatatagtctcataaccaatacactcctagattttgattttccaacgctatggtttttgattgcttctgtgttattttattgtatgaaatctaaaaggttaaacgaccatagcccacgtttcaactcttctgcacaaacttttcataaatgtgcaattgttatgatcaaaacagtataaaagccaatatttacttatctactgcgatggcatatatttgtagacaaactaagtacatgatctgataagattataccaaacagaaactaaaccttctccaaatggtgcgttttaagcatcaatgtcgtgcaaaaggtgatgagttggttagcattaacttctggtctagaactaccattcacaaaatgatcaaagaacattagtaacttagactgagttctagtgtcatattcacacagaacttatggttcaaactggccacaaggggagggcaatctg

SEQ ID NO: 2592 - DNA, 2568 bp, Papaver somniferum
cttctggtcccttcagaccagtttcaatcaatccctttcgttgtaatcaaatcgatcccacggttttagggtttgaaggaattgttgggaatgtcgacggagagaaaaaggaaagtaagtttatttgatgtagttgatgaaacatctgtatctgctgctgctaaacttgttaagatgaatggattcggagggggtttgattcataataatccacttgtcaatcgatggaatggaagaccgtattcacagagatatatggatattttggagaaaagaaaaacacttcctgtttggcaacagaaagatgagtttttgcaggttttgaagaataatcagactttgattttggttggtgaaactggtagtggtaaaactactcagattccccagtttgtgattgatgctgtcgagttagaaaatccaggaaagcgaaagaaaatgatggttgcttgcacccaaccacgtagggttgctgctatgtctgtttctcgacgtgttgctgaggagatggatgtgacaatcggagaagaagttggttatagcatccgttttgaagactgtagtagtgcaaaaactgttctcaagtacttaacagatggtatgctgttaagagaagctatgactgatcctctcttggaaaactataaagtgataattctggacgaggctcacgaaaggactttagcgacagatgtgttgtttggtcttctgaaagaagtcttaaaaaatagaccagatcttaaattggtggttatgagtgcaaccctggaggcagaaaagtttcaggcatacttcagtggtgcccctcttatgaaggttcctggaaggcttcatccagttgagatattctacacgcaggatcctgagagagattatcttgaagcagcaattcgtacagttgtgcagatacatatatgtgagggtcctggtgacattcttgtttttctaactggagaggaagagatagaagacgcatgtcggaaaataacaaaggaaataggaaaccagggtgagcaagtgggtcctgtgaaagtagtgccactatattctactcttcctccagcgatgcagcagaagatatttgatgctgctccacctcctttgaaggagggtggtcctcctggaaggaagattgtggtgtcgaccaatattgctgaaacttctctgactatagatggtatagtttatgttattgatcctggatttgcgaaacagaaagtctacaatccacgtgtgcgagtggaatccttgttggtgtcaccaatatcaagggcaagtgctcaccagagatcaggtcgtgcaggaagaacacaacctgggaagtgtttcagactgtacacggagggaagtttcaataatgatcttcagccgcaaacatacccagaaatattgagatcaaatcttgcaaacaccgttcttaccctgaagaaacttggaattgacgatctggtgcattttgattttatggatccacctgctcctgagacattgatgcgtgcgttagaggtgttgaactatctgggtgctttggatgacgaaggaaaccttactaaattgggggagattatggctgattttcctctggatcctcaaatgtcgaagatgcttgttgttagtccaagctttaattgttccaacgaaattctctcaatttcagctatgctttcagtacccaattgctttgtccggcctagggaggctcaaaaagctgcagatgaagcgaaagctcggtttggccacattgatggggaccatctcacacttttgaacgtgtatcacgcctacaagcaaaacaatgaggacccttcgtggtgttatgataactttgtcaatgctagggcgctgaagtctgctgataatgtgaggcaacaattaatgcgcatcatgaccagattcaacctcaagctttgcagcacagatttcaacagccgtgactactacatcaacatcaggaaggctatgttgtccggttatttcatgcaagtagctcaccttgaacgtacaggacactatctaacagtgaaagataatcaggttgtccatctgcatccatcaaactgtctggatcacaaaccggagtgggtcatttacaatgagtacgtgttgactagcaggaatttcattcgtaccgttacagatgttcgcggagagtggcttgttgatatagcaccccattattatgatctggagaactttccacagtgtgaggcgaagcgcgtcctagaaaggctttaccagaaacgagagaaggataaagaaaacagcaagaacaaaaagcagtagtcaactggatttttgtaacaatcgcactggtatgttgtgcctgacacggccgcgaaacatttccctagtttgacgcccctctttatatgtaaaacctattaatggatttatttgtaatgctttatctagtaaaacgtggaaactctatatcaccctttcctgatttgaccttggatatgttttgctctcttaatttttctcctgttttacgtaccaaagtaactcttgtttaaaaaccaaatacatatcaatttctgctagttaccaaagtaacaatatgtttga

SEQ ID NO: 2593 - DNA, 2878 bp, Cicer arietinum
tatttttctagtcacaattgcatgatcaatatttagccctaactaacgttggcaggcctgtgtattttctaggggtttcgtttcacttacagttcccaatataatattattgtggaatttgtgaaaaggtatattcgtatatcgctgaaacggtgcctaacaattgaagataattagggttttgatgggtacggagaggaagaggaaggtgagtttattcgacgtcgtggacgactctgcagctaagatggtgaaaacaaacggcgtttcaatcggtaacagccttataaaccgatggaacggtaaagcttactctcaaagatactatgaaattttggagaagaggaaaaccctacctgtttggcaccagaaagaggatttcttgcaggttttgagggataaccagactttgattctcgttggtgagactggtagtggaaaaaccacacagatccctcagtttgttttggaagctgttgaattagagacagctgataaacgcaagaagatgatgattgcatgcactcagcctcgtagagtggctgcaatgtctgtttctcgccgtgtggccgaagagatggatgtgagtattggtgaagaggttggttatagcatcagatttgaagattgtagtagtgcaaggactgttttgaagtatctaacagatggtatgcttttgagagaagcaatgacagatccacttttggaacgatacaaagtaattattcttgatgaggcacatgaaaggactttggctactgatgtgctatttggccttctaaaggaagttcttaaaaacagacctgacttgaagttggttgttatgagtgcaacacttgaagctgaaaagtttcagggctatttttttggagccccgcttatgaaagttcctggaaggctacatcctgtggaaatcttttatactcaggaaccagaaagggattacttggaggctgcaattaggacagtagtgcagattcacatgtgtgaacctcctggagacatacttgtttttctcactggagaggaagagatagaagatgcgtgccgcaaaatatctaaagaagttgcaaatttgggggatcaggtgggccctgtgaaagcagtaccattgtattctactcttcccccagctatgcagcagaagatttttgagccagctccacctccagtaaaagagggaggccccgccggaaggaagattgtggtatcaacgaacatagcagaaacttccttgacaattgatggtatagtctatgttattgatcctggatttgctaagcagaaggtttataatcctcgagttcgtgttgagtcattgttggtgtctccaatatcaaaggctagtgcacaccaaagatctggacgtgctggaagaactcaaccagggaaatgctttagactgtataccgaaagaagtttcaataatgatcttcagcctcagacgtatcctgaaattttgagatctaatcttgccaacacggttcttacattgaagaaactaggtatagatgatttagtgcattttgacttcatggaccctcctgcccctgaaaccttaatgcgtgctttggaggtgttgaattacttgggtgcactggatgatgatggtaacttgacaaagcttggtgagatcatgagcgagtttccattggaccctcagatgtcgaagatgcttgttgttagtcctgagttcaactgttcaaatgagattctttcaatttccgccatgctatcagtacccaactgctttatccggcctagggaggcacaaaaagctgcggatgaagcaaaagctaggtttgggcacattgatggagatcatctcacactcttgaacgtataccatgcctacaagcaaaacaatgaggatgcttcttggtgctacgacaacttcgttaataatagggcgctgaaatcggctgataatgttcgacaacagcttgttcgtatcatggctcggtttaacttgaagttgtgcagcaccgacttcaatagtcgcgactactatatcaacataagaaaggcgatgctagcaggatattttatgcaggtggctcatcttgaacggacaggacactacttgacagtgaaagacaaccaggtggtgcacttgcatccatcaaattgcctggaccacaagcctgagtgggttatctataatgaatatgttcttaccagtcggaattttatacgtactgtgaccgacatacgcggtgaatggttagttgatatagcaccccattactatgatttgtctaattttccacaatgtgaagcgaaacgtgttcttgaaaagctatacaagaaacgtgagaaagacaaggacgaagcccggaatcgtaaatgaagcactacatctcctttccggcctttggattggaatttgatgtttcttctcctgcaagttgacatcaaaatatcgtcatgggaatgttcactaatacgtcattgttattacctttgaaggacacgctgattgtcagtaattttaacggaagaattggcagagttccttgtactattagagtagtaacatattttatattcctagaccttgttctgttgtaccttacggattatttatcgacttcatatttgttttggggatagtagtgttgtcaaaggttagattccctcagcattgcattacttgctgggtatatttagcaactttgaaagcgaagcatcccgaattataagattttgctttaaagtaatgtcaactggtaatgcattattagaaatatattctgtcttgtcgtcttttgcggatgttcttactaatagaaccaaattcattaatagagctagcataattcccaaacaattttttttatgtatgtgtatttgtatatatattatttattcaatttcc

SEQ ID NO: 2594 - DNA, 2811 bp, Cannabis sativa
caagacaaactttcctttggaaataataaaagataaattagggtttcaggtttcagtttaaacacaagcacacaaccactcttctccctctttccctcatttgttcacacaccaagcctcaagtcaagggtcactgcagagccaccgcccgacgcctgacccttcctctttaatcggttgcacaaccactcctcaagttgcaagggtttcattcgcagtgttgtgttgattgatgggtacggagaggaagaggaaggtgagtttgtttgacgtggtggatgagacctctgtctcagcgaagatcacgaaatcgaacggtggtctgatgagtaataacgccgggaatagtctgataaatatgtggaacggcaagccctactcgcagaggtactttgatatacttgagaagaggaagaccttgcctgtctggcagcagaaagaagagttcttgcaggtattgaaggctaatcagactttgattttggttggtgagactggtagtggtaaaacaacccagatcccacaatttgttttggaagctgttgatattgaaactccagataaaagaagaaagatgatgattgcatgcacccagcctcgtagagtggctgccatgtctgtttctcgacgtgttgctgaagagatggacgtaaccattggagaagaagttggttatagcattcgttttgaggactgcagcagtgcaaagacagttttgaagtatcaaactgatggtatgcttttaagagaagcaatgaccgatccactattggagcgctacaaggtaataattcttgatgaggctcatgagagaactttggcaacagatgttctttttggactgctaaaggaagtattgagaaatagacctgacctgaagctggttgtgatgagtgcaactcttgaggctgaaaagtttcagggttattttagtggtgcacctcttatgaaggttcctggtaggcttcaccctgtggaaatattttacacccaagaaccagaaagggactacgttgaggctgcaattcggacagttgtccagatacatatgtgtgagcctcctggtgatattcttgtatttcttactggagaggaggagatagaagatgcatgtcgtaaaataaacaaggaagttgcaaatcttggggatcaggtgggtcctgtgaaagcagttcctctgtattcaagtcttcctccagctatgcagcagaagatatttgaccctgctcctcctccactgaatgagggaggcccacctggaaggaagattgtagtatcaactaacattgctgaaacttctttgactatagacgggatagtttatgttatcgaccctgggtttgccaaacaaaaagtttataatccaagagtaagagttgaatccttgttggtttctcccatatcaaaggccagtgcacatcaaagatcagggcgtgctggcagaacccaaccaggaaaatgttttagactttacacagagaggagttttaataatgatcttcagccacagacctatcctgaaatattgaggtcaaatctagcaaatacagtactgactttgaagaaattgggaatagatgatctggttcactttgacttcatggacccccctgctccagagacattaatgcgagcactagaggtgttgaattatttgggagcgttggacgatgaaggaaacttgacaaagctggggcaaattatgagtgagtttccactagatcctcagatgtccaagatgctggttgttagccctgaattcaactgttcaaatgagattctatccatttctgccatgctttcagtacccaattgctttgtccggcctagggaggctcaaaaagctgcggatgaggcaaaagctaggtttggccacattgatggagatcacctcacacttctgaacgtgtatcatgcctacaagcaaaataatgaggatcagtcttggtgctacgaaaattttgtcaacgctagggcgcttaaatctgctgacaatgtcaggcaacagctagtccgcatcatggcacgatacaacctcaagctatgcagtactgatttcagcagccgtgactactacattaacataagaaaggcaatgctagctggatatttcatgcaggtggctcatctggaacgcactggacactatttaaccgtgaaagacaaccaggttgtgcatttgcatccttcaaattgccttgaccacaaaccagagtgggtcatctacaatgagtatgtgttaacaagcaggaattttatacgtacagtgacagatgttcgcggcgagtggttagttgatatagcaccacactattttgatctggagaactttcctcagtgtgaggccaagagagttcttgagaggctttacaagaagcgtgaaagggagaaggaggagagtagaaacagaaagtgaagtttttccccaacttccagactctatatatatccctagtggtgaaaatgtgggatttgatgatcccctctgattatcttttaaacatattctacctttgctgggaggatgaccactcttgatctggagatgcagccatgtttgatgtatcattttctagatagctgtaggagtagttgaccattacattatattttattttttatttgtttatttgagttggattgtgtggtttcatttaaaagaaatcattagttattgaaattttagaagatgacatacctgagtcaatcaatctgccctgctgccatatctcatttaattgcgattgcataatttcaaaacccaggttacttataaatatcttttacactacttaaaattgtattttttct

SEQ ID NO: 2595 - DNA, 2914 bp, Eutrema parvulum
gatgggtaccgaaagaaagaggaaaattagtttgttcgatgtcatggacgatccgtcggctccagcgaagacggccaacaccaacggtctcgccgacggcggaatcaacagtctgatcaataaatggaacggaaagccttattcccagaagtattatgaaatactggagaaacggaggactctacctgtctggctgcagaaagaggagtttctcagaactttaagagacaatcaaaccctaattctcgtcggtgagaccggtagtggtaaaaccacccagattccacagtttgttatagatgctgtggatgctgagacctcggataagcgtaggaagtggttggttggatgcacacagcctcgtagggttgcggcaatgtctgtgtcccgtcgtgttgctgatgagatggatgtagctattggggaagaagttggatacagcatacgttttgaagattgcagtagccccagaacggtgcttaagtatttgactgatggtatgctgctgagagaagcaatggcagaccctctcctagagagatacaaagtgattattcttgatgaggctcacgaaagaactctagccacggatgtgctttttggtcttctgaaagaggtgttgagaaatagaccggatcttaagttagttgtcatgagtgcaactctagaagctgaaaagtttcaggaatattttagcggtgcgcctcttatgaaagttcctggtagacttcatccagttgagatcttctacactcaggaacctgagagggactatctcgaggctgctattaggactgttgtccagatacacatgtgtgagccgcctggtgatattcttgttttcttaactggagaggaggaaatcgaagatgcatgccgcaaaatcaataaagaggtcggtaatcttggggatcaagtgggacctgtcaaagctgtaccattgtattccactcttccacctgcaatgcagcagaagatattcgatcctgctcctgagccggtaacagaaggtggtcctcctgggaggaaaattgttgtctcgaccaacattgctgagacttctttaacaatagatggaattgtttacgtcattgaccctggttttgctaagcaaaaagtctacaacccacgaatccgtgttgagtcattattggtgtcgccaatatcaaaggcaagtgctcaccagagatcaggtcgtgccggtagaacacggcccggaaaatgtttcaggctttacacagagaagagtttcaataatgacttgcagccacagacgtatcctgaaatattgagatcaaaccttgcaaacacggtactgactttgaagaaactgggcatagatgacttggtgcatttcgattttatggatccccctgctccagagacactgatgcgagccttggaggtgttgaattatttaggagcactggatgatgaaggtaacttgacaaggacaggtgagataatgagcgagttccccttagatccacagatggcaaagatgctcatagtcagtcccgagttcaactgctcaaacgagatcctatcagtttcagcaatgctctcagtaccaaattgctttatccggcctagagaggctcaaaaagcagcagatgaagctaaagctaggtttggacacattgatggagatcaccttacactgctaaacgtctaccacgcttttaagcaaaacaatgaagacccaaactggtgctacgaaaacttcatcaacaatagggcaatgaaatctgcggacaatgttagacagcagctagtcaggataatgtcaagatttaatctgaagatgtgtagcactgatttcaacagccgcgactactacatcaacataagaaaggccatgcttgccggttatttcatgcaagtggctcacctagaacgcactggcaattacttgaccgtcaaagataaccaagtggttcatttgcatccatccaattgcttggatcacaaaccagagtgggtgatctacaacgaatatgttttgactagccggaatttcatcagaactgtgacagatatccgcggtgaatggctcgtagatgttgctcctcattattacgatctttccaacttccccaactgtgaggccaaacgtgtcctcgagaagctttataagaagagagagagggagaaggatgatagcaagaaccgcaagtgaaagagaatcttattttcaacgtctgatgattctactttgactatctataaaccatgtcttatattataatttccttttcgtttaccaaatgattctcgaattgtcgtttttgtacgtgttgagtgaacactaatatttgcattttacccaaaactttattcctttgaagattcctattagcatactcggaatgttaacattttcaaatttgatcgacaaatctgattatttaagaaacttggcacagagactttttacttcactaatcaaaagttataacatcttctacgaacatacatagaagtcaaatagtttattacacaaacattcaggtatatggcttgcttattattattaccatggggcagtcacaattgcccgaaactcctgctccacgttctgaaccttttggtcgagaagcgctgcacgagactgcatccgagctatctccctgtccattgtcattttctcttgcttcagcaatgcttctcgtttctgcaactcaacgatcttctttgagacttcttcaatatcgtcttcacatttccttcttttattgtctttctctgtgatctctctctctgcaacatttaactcctccaatgcccatgtctggctttcttttatagacaatagctcggcgatccgagattgaggtgctgtaacatcaaacccgtgtttctctagcttgagaaagcactcgttgatcctgtttatcgcggttattggatcatc

SEQ ID NO: 2596 - DNA, 2646 bp, Lactuca sativa
gttcaagccgacgtctatcgtttctctttccccttggaactcgtattagggtttctgacttccttatatcagagactctctacacatatttaggggatttgctgcaaaccaacaggtggttattgagaaagatttgggatttcttcgataactaggattagggttagatgggtacagaaaggaaaaggaaggtgagcttgttcgacgtcgtagatgaagccacagcgaccgctaaggttaacaaagcaaacggcggaggcgccgttcatggtatcaacaatagcacgggtggtatgtctctcgtgaacagctggaatggacgcccttactcacagcgttattttgatatcttggagaagaggaagactctaccagtttggcatcagaaagaagagtttttgaaagtactcaaagagaatcagacgcttattttagtcggagaaaccggtagtggtaaaacaactcagattcctcagtttgtcttggaagctgtggaggtagagagtgctgatagacgcaagaaatacatggttggttgtacccaacctcgtagggtggctgcaatgtcagtttcccgtagagttgcagaggaaatggacgtaacaattggagaggaagtgggttacagcattcgttttgaagattgcagcagtgccaaaactgtcttgaagtacttgacagatggtatgcttttgagagaagccatgacagatccacttctggagaggtataaagtgataattcttgatgaggctcatgagagaacgttagctactgatgttttgtttgggcttctaaaggaagtccttaagaacagacctgatcttaagctggttgtaatgagtgccactcttgaagctgaaaagtttcagggttatttcttcggtgcaccattaatgaaagttcctggtagacttcaccctgttgaaatattctacactcaagaacccgaaagggactaccttgaagcagcaatccgaacagtggtgcaaatacacatgtgtgagccacctggcgacattcttgtttttctaaccggagaggaggagatagaagatgcatgtcggaaaattacaaaagaagttggaaacatgggagaccaggtgggtcccgtgaaagttgttcctttgtattcgacactccctccagcgatgcagcagaagatatttgaacctgctccacctccattgacagaaggtggtcctgctggaaggaagattgtgatttcaacaaacattgcagaaacctctttgaccatagatggcatagtttatgtgatagaccctggttttgcaaagcagaaggtttataatccgcgtgtacgtgtcgagtctttattggtttctccaatatcaaaagcaagtgctcaccagagatcaggtcgtgctggaagaacacagcctggtaaatgttttaggctctacacagagaaaagtttcaataatgatcttcaacctcagacctaccctgagatccttcgatccaatcttgcaaatacggttcttactttgaagaaactgggtatagatgatctggttcattttgattttatggaccctcctgcccctgagactttgatgcgtgctttagaggttttgaattacttgggagctttggatgatgaaggaaacctgacaaagctgggtgaaatcatgagcgagtttccattagatcctcagatggggaagatgcttgtggtgagccctgagttcaactgttccaacgaaattctttccatctcggctatgctatcagtacccaattgctttgtacggcctagagaagctcagaaggctgctgacgaggcaaaagcaaggtttggacacatcgatggggatcatctcacgctcttgaatgtgtatcatgcctacaagcagaacaatgaggatcaatcatggtgttatgagaactttgtgaatcaaagggcgctcaagtctgctgataacgtgaggcaacagctggctcggatcatggcaaggttcaacctcaagttatgcagcacagatttcaacagccgggattattacatcaacatcaggaaagccatgctggcaggctatttcatgcaggttgcacatttggagcgaactggacattatttgactgtcaaagataatcaagtggttcatttgcacccatcaaactgtctggaccacaagccagaatgggttatttacaatgaatatgtgttgacaagcaggaattttatacgcactgttacagatgttcggggtgaatggattgttgatattgctccacattactatgatcttgacaacttcccacaatgtgaagccaagcgggttctagagaagctgtacaagaaaagggaaaaagacaaggaggagagcagaagcagaagatagaaaacaacactccactcatgatttgggtttggtatgaaatattattttaaggtgaggaatgggggtgtggacgcaactgtttgtctttctcaaggttattggaggctggggcagcaaaaatattttatcgtgtatctttagtttagcaacagttggttggttttgtctgaattgaataatcttagatcagttcaatgttttgtctgctttgttctattattaaacctttttttaacatctggaaaaaaagagctgcaagtaatgctttctttctgattct

SEQ ID NO: 2597 - DNA, 2714 bp, Prunus mume
ctgaaattctcaatcttcttctatcttctagggtttgccaattttagggctaaatagtaaatacgaaaaggaagagaaaccctcgattcggatcctatccgaattcgttaggatccaactgatagccttttgggtttctgcgctgttaaggtttttgattgatgggtacggagaggaagaggaaggtgagcctgttcgacgtggtggacgagacctcagtctcatcagctaagatgagtaaatcgaacggtggtgcaggagccacagcgaatcataacgcggtgagcaatctgatcaataggtggaccggcaagccttactcgcagaggtattatgagatccttgagaagaggaagactttgcctgtttggcaccagaaagaggagttcttgcaagctctcaaggccagccagtctcttattttggttggtgagactggtagtggtaaaaccacccagatccctcaatttgttttggaagctgttgattcggaaactccagataaacgtaagaagatgatgattgcatgtacccaaccccgtagagtggctgcaatgtcagtgtcccgtcgtgttgctgaagagatggatgtaaccataggagaagaggttggttatagcatccgttttgaggactgcagcagtgccagaacagtgctgaagtatctaacggatggaatgcttttaagagaagcaatgacagatccactattagagcgatacagtgtgataattcttgatgaggctcatgaaagaactttagcaacagatgttctatttgggcttctgaaggaagtattgagaaacagacctgacttgaagctggttgtgatgagtgctacacttgaggctgaaaagtttcagggttatttcagtggtgcaccactcatgaaagttcctggaaggcttcatccagtggaaattttttacactgaggaacctgaaagggattatctggaggcagcaattcgaactgttgtgcagattcatatgtatgagaccccaggcgatatacttgtttttctaacgggagaggaagagatagaagatgcgtgccgcaaaattaacaaagaagttggaaacctgggtgaccaggttggtcctgtgaaagtggtccctctatattcaactcttcctccagctatgcaacagaaaatatttgatcctgctcctcctcccataaatgaaggcggaattcctggaaggaagattgtagtgtcaacaaacattgcagaaacttctctcactatagatggaattgtttatgttattgatccgggatttgctaaacaaaaagtttataacccacgagtgcgtgttgaatccttgttggtatctccaatttctaaggcaagtgcacatcagaggtcagggcgtgctggaagaactcagccaggaaaatgtttcagactatatactgagaaaagtttccataatgatcttcaaccacagacatatccagaaatattgagatcaaaccttgcaaatacagttcttactttgaagaaactaggaatagatgatttggttcattttgattttatggatccccctgctcctgagacattgatgagagcattagaggttttgaattatttgggcgcattggatgatgatggtaacttgacgaagctgggggagattatgagtgagttcccgttagatcctcagatgtcaaaaatgctggttgttagccccgagttcaactgctcaaatgaaattttgtcaatatctgcaatgctttcagtacccaattgctttgtccggcctagggaggctcaaaaagctgcagacgaggcaaaagctaggtttggacacattgatggggatcatctcacgcttctgaacgtgtatcatgcatacaagcaaaacaatgaggatccatcgtggtgctatgagaactttgtcaatcagagggctttgaagtctgcagacaacgtcaggcagcaactagtgcgcataatggcccggtttaacctgaagttatgtagcactgatttcaatagtcgtgactactacataaacataagaaaagccatgctagctggatatttcatgcaggtggctcacctggaacgcactggacactacctgacagtgaaagataaccaggtggtacatttgcatccgtcaaattgcttggatcataaaccagaatgggtgatttacaacgaatatgtcttgacaagcaggaattttatccgtacagtcacagatattcgtggggagtggcttgttgatatagcatcccactactatgatttggcgaattttccccagtgtgaggccaagcgtgttcttgagaagctttacaagaagcgggaggacagggatgaaaacaaaaacagaaaatgaagttgatacccatggatcttcggaatctgcagattcttgtctgagtaacaaagtgcaatcagtgagagctggtctaagattcttcatcatatttaagcattttgcgtctctcagctgctcatttgtcgttgtagctggggaaaggccttgtttctgtaacattttcttggagtattagcttccctagtctatagttttgtatcgtctccactattgttatttaatcttggatgtgatgatcttgctggtattcaagattaagaagcagtttaaaatttgacataaaggcgtacgcagcttcatattatgatttttttatcaatggaagtcttttttctccctactaccaaagtgctagca

SEQ ID NO: 2598 - DNA, 2605 bp, Lactuca sativa
actcgtattagggtttctgacttccttatatcagagactctctacacatatttaggggatttgctgcaaaccaacaggtggttattgagaaagatttgggatttcttcgataactaggattagggttagatgggtacagaaaggaaaaggaaggtgagcttgttcgacgtcgtagatgaagccacagcgaccgctaaggttaacaaagcaaacggcggaggcgccgttcatggtatcaacaatagcacgggtggtatgtctctcgtgaacagctggaatggacgcccttactcacagcgttattttgatatcttggagaagaggaagactctaccagtttggcatcagaaagaagagtttttgaaagtactcaaagagaatcagacgcttattttagtcggagaaaccggtagtggtaaaacaactcagattcctcagtttgtcttggaagctgtggaggtagagagtgctgatagacgcaagaaatacatggttggttgtacccaacctcgtagggtggctgcaatgtcagtttcccgtagagttgcagaggaaatggacgtaacaattggagaggaagtgggttacagcattcgttttgaagattgcagcagtgccaaaactgtcttgaagtacttgacagatggtatgcttttgagagaagccatgacagatccacttctggagaggtataaagtgataattcttgatgaggctcatgagagaacgttagctactgatgttttgtttgggcttctaaaggaagtccttaagaacagacctgatcttaagctggttgtaatgagtgccactcttgaagctgaaaagtttcagggttatttcttcggtgcaccattaatgaaagttcctggtagacttcaccctgttgaaatattctacactcaagaacccgaaagggactaccttgaagcagcaatccgaacagtggtgcaaatacacatgtgcgagccacctggcgacattcttgtttttctaaccggagaggaggagatagaagatgcatgtcggaaaattacaaaagaagttggaaacatgggagaccaggtgggtcccgtgaaagttgttcctttgtattcgacactccctccagcgatgcagcagaagatatttgaacctgctccacctccattgacagaaggtggtcctgctggaaggaagattgtgatttcaacaaacattgcagaaacctctttgaccatagatggcatagtttatgtgatagaccctggttttgcaaagcagaaggtttataatccgcgtgtacgtgtcgagtctttattggtttctccaatatcaaaagcaagtgctcaccagagatcaggtcgtgctggaagaacacagcctggtaaatgttttaggctctacacagagaaaagtttcaataatgatcttcaacctcagacctaccctgagatccttcgatccaatcttgcaaatacggctcttactttgaagaaactgggtatagatgatctggttcattttgattttatggaccctcctgcccccgagactttgatgcgtgctttagaggttttgaattacttgggagctttggatgatgaaggaaacctgacaaagctgggtgaaatcatgagcgagtttcattagatcctcagatggggaagatgcttgtggtgagccctgagttcaactgttccaacgaaattctttccatctcggctatgctatcagtacccaattgctttgtacggcctagagaagctcagaaggctgctgacgaggcaaaagcaaggtttggacacatcgatggggatcatctcacgctcttgaatgtgtatcatgcctacaagcagaacaatgaggatcaatcatggtgttatgagaactttgtgaatcaaagggcgctcaagtctgctgataacgtgaggcaacagctggctcggatcatggcaaggttcaacctcaagttatgcagcacagatttcaacagccgggattattacatcaacatcaggaaagccatgctggcaggctatttcatgcaggttgcacatttggagcgtactggacattatttgactgtcaaagataatcaagtggttcatttgcacccatcaaactgtctggaccacaagccagaatgggttatttacaatgaatatgtgttgacaagcaggaattttatacgcactgttacagatgttcggggtgaatggattgttgatattgctccacattactatgatcttgacaacttcccacaatgtgaagccaagcgggttctagagaagctgtacaagaaaagggaaaaagacaaggaggagagcagaagcagaagatagaaaacaacactccactcatgatttgggtttggtatgaaatattattttaaggtgaggaactgggggtgtggacgcaactgtttgtctttctcaaggttattggaggctgaggcagcaaaaatattttatcgtgtatctttagtttagcaacagttggttggttttgtctgaattgaataatcttagatcagttcaatgttttgtctgctttgttctattaacctttttttaacatctggaaaaaaagagctgcaagtaatgctttctttctgtttctc

SEQ ID NO: 2599 - DNA, 2266 bp, Amsonia hubrichtii
cagacttgcagttgccttttcctaccgtctctccaccctctggtaaatccctaccgaaaccctagaagtctctgccaccgccacaagcgaaccagctccgccaatactggaagaatccgcaggttgtcgaattgatagatgggaacggagaggaagaggaaggtaagcttgttcgacgtggtcgacgagtcttctgcatcaaagcttgcaaaggccaacggtggcccaatgaataatgccagcggcggaatgactcctctggtcaataggtggaacgggaggccctactcgcagagatactatgagattttggagaagaggaagactcttcctgtttggcagcagaaagaagagtttttgagggtattgaaagagaaccagaccctcatattggttggtgaaactggtagcggtaaaaccactcagattcctcagtttgtgctggaagcagttgagatagagagccaagataaacgcaagaagtacatgattggctgcacgcaaccccgaagggtggctgcaatgtcggtttctcggcgtgttgctgaggagatggatgtgacaattggagaggaagtcggttatagtattcgttttgaagattgcagcagcgcaagaacagttctaaagtatttgactgatggtatgcttctacgagaagccatgactgatccactattggaaagatacaaagtgataattcttgacgaagctcatgaaagaactttggcgacagacgttctatttgggcttctcaaggaagttttgaaaaacagacctgatctgaagctagttgttatgagtgctactcttgaagctgaaaagttccaaggctatttttatggtgcacctctcatgaaagtccctgggaggcttcatcctgtggaaatcttttacactcaggagcccgaaagggattacctcgaagctgcaattcgcaccgtggtgcagattcatatgtatgaacctcctggtgacatacttgtttttctcactggagaggaagagatcgaggatgcatgccgtaaaataaacaaagaaattaataacataggtgatcaggtaggtcccatcaaagtggtgcctctgtactctactcttcctccagctctgcagcagaaaatttttgaaccagctcctcccccattggttgaaggtggtcctccagggaggaaaattgttgtgtcaacaaatattgctgaaacgtcgttgaccatagatggcatagtctatgttatagacccaggttttgctaagcaaaaagtatacaacccaagagtacgtgtggagtctttattggtttctcctatatcaaaggcgagtgctcaccagagatcaggacgtgctggaagaacacagccaggaaaatgctttaggctttacaccgagagaagttttagcaatgacctccagcctcagacatatccagaaattttgcgctcaaaccttgcaaatactgttcttcaattgaagaaacttggtatagatgacctggttcattttgatttcatggatccacctgctcctgagacattgatgagggcgttggaggtattgaattacttgggagccttagatgatgatgggaacctgaccaaactgggtgaaatcatgagtgagtttcccttggacccgcagatgtccaaaatgcttgtagtcagcccagaattcaattgttccaatgaaattctatcagtatctgctatgctttcagtaccaaattgctttgtccggcctagggaggctcaaaaagctgcagatgaagcaaaagcacgttttggacacattgacggggatcatctcactctattaaatgtctatcacgcatacaagcaaaacaaggaggatccacaatggtgcttcgataattttgtcaatcaaagggcacttaaatctgcagataatgtaagacagcaactagctcgcatcatggccagattcaaccttaagctatgcagcacagacttcaacagccgggactactatgtcaacatcagaaaagccatgttagctggatattttatgcaggtggctcatttggaacgcactgggcattacttgactgttaaagacaatcaagtcgttcacttgcatccttcaaattgcctggaccataaacctgagtgggttatttacaatgaatacgtactaacaagcaggaatttcatccgcacagtaacagatgttcgtggggaatggttggttgacgttgcaccacactattatgatctcacaaacttccccaattgtgaggcaaagcgagttc

SEQ ID NO: 2600 - DNA, 2656 bp, Malus domestica
ctccaaaatcctcaatcttcttccatcttctagggtttacgaaatttagggctaaatcgtaaatcggaaaggaaagcctctctcttcggatcctatccgacctttttaggatccaagtgataggattttggggcgtttttgccgccgttagggtttttgactgatgggtacggagaggaagaggaaggtcagcttgttcgacgtggtggacgaggcttccatcacatcggcgaagatgaacaaatcgaacggcagcggaggagctgctgccaaccaaaacgctgtgaacagtcttatcaatcggtggaccgggaagccgtactctcagaggtactatgagatccttgaaaagaggaagacgttgcctgtttggcaccagaaagaggagttcttgcaagctttcaaggccagccagtctctcattttggttggtgaaacgggtagcggtaaaaccactcagattcctcaatttgttttggaagctgtccattcagaatcttccgataaacgcaagaagatgatggttgcgtgtacccaaccacgtagggtggctgcaatgtcagtatcccgtcgtgttgctgaagagatggatgtaaccattggagaagaagttggttatagcatccgttttgaagactgcagcagtgccagaactgtgttgaagtatctcaccgatggaatgcttttaagagaagcaatgactgatccacttctagaaagatacagcgtggtaattcttgatgaagctcacgaaagaactttagccacagatgttctatttgggcttttgaaggaagtgttgagaaacagacctgatttgaaggtggttgtgatgagtgctacacttgaagctgaaaagtttcagggttatttcagtggtgcgccactcatgaaagttcctggaaggcttcatccggtggaaattttttacactgaggaacctgaaagggattatctggaagcagcaattcgaacagttgtgcagattcatatgtatgagaccccaggagatatacttgtttttctaacaggagaggaggagatagaagatgcatgccgcaaaataaacaaggaagtcggaaatctgggtgaccaggttggtcctgtgaaagtggtgcctctgtattcaactctacctccagctatgcagcagaaaatatttgatcctgctcctcctcccataaaagaaggtggaattcctggaaggaagatcgtggtgtcaacaaatattgcagaaacttctctgactattgatggaattgtttatgttattgatcccggatttgctaaacaaaaagtctataacccaagagtgcgtgttgaatccttgttggtatctccaatttccaaggcaagtgcacatcagaggtcaggtcgtgctggaagaactcagccaggaaaatgtttcagactttatactgagaaaagtttcaataatgatcttcaaccgcaaacgtatccagaaattttgagatcaaaccttgcaaatacagttcttactttgaagaaactaggaatagatgatctggttcattttgattttatggatccccctgctcctgagacattgatgagagcactagaggtcttgaattatttgggagcattggatgatgaaggtaacttgaccaagctaggggagattatgagtgagttcccgttggatcctcagatgtcaaagatgctcgtagtcagccctgagttcaactgctcaaatgaaattttgtcagtatctgccatgctctcagtacccaattgctttgtccggcctagggaggctcaaaaagctgctgacgaagcaaaagctaggttcgggcacattgatggagatcatctcacacttctgaatgtgtatcatgcatacaagcaaaataatgaggatccgtcatggtgctatgagaactttgtgaatcagagggcattgaagtctgcagacaacgtcaggcagcagctagtgcgcattatggcccggtttaacctcaagctatgcagtactgaattcaatagtcgtgactactacatcaacataaggaaggccatgctagctggatatttcatgcaggtggctcatctggaacgtactggacactatctgacagtgaaagataaccaagtggtgcatttgcatccatcgaattgcttggaccacaagccagaatgggtgatctacaacgagtatgttttgacaagcaggaattttatccgtacagtgacggatgttcgtggggagtggctggtcgatatagcaccccactactatgacttggcgaattttccccagtgtgaggccaagcgtgttcttgagaagctatacaggaagcgggaggacaaggatgagaacaaaaaccgaaaatgaagctcttggccctgaatcttcggaaagtgcggaattattccgagaaacaaaggagcaagcgttgagagctggttgaaatgatcagatttcagcaatttgcttctttgagcatcccagttgtcactgtaattggggaaaggccttgcattgtctcggtaccatttttcttgaatttagttttcgtagtctatctatagttttgtatcgtactcacgattgtcatttgatcatggatgtgacggtattacacaaggttatattttgattttaatcaatgaaggtctattttccaagcgtaaa

SEQ ID NO: 2601 - DNA, 2689 bp, Cicer arietinum
cttctccttttctctaaaatcccacactttcaccatggtatctagagcctatttcgatcctccttgaacgatcccgcctctattccactgccgagttcccaacaattaggaaatataatcatagtttctcttttctaacattccaacatttggtgagatttttttttctcgataaaccgtgtcccaattccgatttacccatttttgttagcttttcgtttattttcagcagatcagttgcggcactgtttcattgtgcggtactgttcactgcgcaaaaaaaaatttaagtttctccaccggatcccttatccattccgatcaccgacgggtttatccttagtctatttaaacacataggctttcgctcgaaaccctaaaaccctaatatttagccctaactaacgttggccaagcctgtgtattttctaggggtttcgtttcacttacagttcccaatataatattattgtggaatttgtgaaaaggtatattcgtatatcgctgaaacggtgcctaacaattgaagataattagggttttgatgggtacggagaggaagaggaaggtgagtttattcgacgtcgtggacgactctgcagctaagatggtgaaaacaaacggcgtttcaatcggtaacagccttataaaccgatggaacggtaaagcttactctcaaagatactatgaaattttggagaagaggaaaaccctacctgtttggcaccagaaagaggatttcttgcaggttttgagggataaccagactttgattctcgttggtgagactggtagtggaaaaaccacacagatccctcagtttgttttggaagctgttgaattagagacagctgataaacgcaagaagatgatgattgcatgcactcagcctcgtagagtggctgcaatgtctgtttctcgccgtgtggccgaagagatggatgtgagtattggtgaagaggttggttatagcatcagatttgaagattgtagtagtgcaaggactgttttgaagtatctaacagatggtatgcttttgagagaagcaatgacagatccacttttggaacgatacaaagtaattattcttgatgaggcacatgaaaggactttggctactgatgtgctatttggccttctaaaggaagttcttaaaaacagacctgacttgaagttggttgttatgagtgcaacacttgaagctgaaaagtttcagggctatttttttggagccccgcttatgaaagttcctggaaggctacatcctgtggaaatcttttatactcaggaaccagaaagggattacttggaggctgcaattaggacagtagtgcagattcacatgtgtgaacctcctggagacatacttgtttttctcactggagaggaagagatagaagatgcgtgccgcaaaatatctaaagaagttgcaaatttgggggatcaggtgggccctgtgaaagcagtaccattgtattctactcttcccccagctatgcagcagaagatttttgagccagctccacctccagtaaaagagggaggccccgccggaaggaagattgtggtatcaacgaacatagcagaaacttccttgacaattgatggtatagtctatgttattgatcctggatttgctaagcagaaggtttataatcctcgagttcgtgttgagtcattgttggtgtctccaatatcaaaggctagtgcacaccaaagatctggacgtgctggaagaactcaaccagggaaatgctttagactgtataccgaaagaagtttcaataatgatcttcagcctcagacgtatcctgaaattttgagatctaatcttgccaacacggttcttacattgaagaaactaggtatagatgatttagtgcattttgacttcatggaccctcctgcccctgaaaccttaatgcgtgctttggaggtgttgaattacttgggtgcactggatgatgatggtaacttgacaaagcttggtgagatcatgagcgagtttccattggaccctcagatgtcgaagatgcttgttgttagtcctgagttcaactgttcaaatgagattctttcaatttccgccatgctatcagtacccaactgctttatccggcctagggaggcacaaaaagctgcggatgaagcaaaagctaggtttgggcacattgatggagatcatctcacactcttgaacgtataccatgcctacaagcaaaacaatgaggatgcttcttggtgctacgacaacttcgttaataatagggcgctgaaatcggctgataatgttcgacaacagcttgttcgtatcatggctcggtttaacttgaagttgtgcagcaccgacttcaatagtcgcgactactatatcaacataagaaaggcgatgctagcaggatattttatgcaggtggctcatcttgaacggacaggacactacttgacagtgaaagacaaccaggtggtgcacttgcatccatcaaattgcctggaccacaagcctgagtgggttatctataatgaatatgttcttaccagtcggaattttatacgtactgtgaccgacatacgcggtgaatggttagttgatatagcaccccattactatgatttgtctaattttccacaatgtgaagcgaaacgtgttcttgaaaagctatacaagaaacgtgagaaagacaaggac

SEQ ID NO: 2602 - DNA, 2802 bp, Eschscholzia californica
cccctgtctgtccttcctcccacactgtttatcgtcctggcgaacataaatccacactctgcaatctttgcagatcgtttgtggtgtttagggtactattcttcttcttctcctctcaaaccctctttcttaaacccccgatactacgccagtctaattgatcctttagggtttctaccatctgattcgaaaacatcctggaaagcctagggtttcaaagaagaagaggtacttgaatttcattcgttttgtttgaagtggaatgtcgacagagagaaagaggaaagtaagtttattcgacgtcgtggacgagacatctgtgtctgctaaactcgcaaagatgaatggtggtggattagctcagaatccgcttattaacaggtggaatgcgcgcccatactctcagaggtactttgatattctcgagaagcggaaaacccttcctgtttggcagcagaaagatgagtttttgcaggttttgaaggcgaatcagactttgatcttagtcggagaaacgggtagtggtaaaacaactcagattcctcagtttgttctcgaatccgtggagctagagaatcccgaaaaacgtaaaaagatgatggttgcctgcactcagcctcgtagagtggctgcaatgtctgtttcacgtcgtgtcgctgaggagatggatgtaacaattggggaagaagttggttatagcattcgttttgaagattgcagcagttcaaaaactgttttgaagtatttaacagatggtatgcttttaagagaagctatgactgatccacttttggagcaatataaggtgattattcttgatgaggctcacgaaaggaccttggcaacagatgtactatttggtcttctgaaggaagtacttagaaatagaccagatctgaaacttgtagttatgagtgctacccttgaggctgaaaagtttcaagcttactttagtggtgcacctcttatgaaagttcctggaagacttcatccagtcgagatattctacactcaggaacctgagagggattatctggaagcagcaattcgtacagttgtgcaaatacacctgtgtgaaggtcctggcgacatccttgtgtttcttactggagaggaagagatagaagatgcttgtcggaaaataacaaaagaaataggaaatcagggtgatcaggtgggtcccgtgaaagtagtaccactctattctacattgcctccagctatgcagcagaagatatttgatcctgccccacctccattgaaggagggtggtcctcctggaagaaagatcgtggtgtcaaccaacattgcagaaacttctctgactattgatggtatagtttatgttattgatccggggttcgctaaacaaaaagtgtataacccaagagtgcgagtagagtccttgttggtctcacctatatcaagggcaagtgctcaccagagatcaggtcgtgctggaagaacacaacctggaaaatgcttcagactgtacactgagagaagtttcaataacgatcttcagccacagacttatccggaaattcttagatcaaatcttgcaaacactgttcttaccctgaagaaactcggaattgatgatctggtacattttgattttatggatccacctgcacctgaaactcttatgcgagcactagaggtgttgaattacttgggtgcattggatgatgaaggaaacatgacgaaattgggggagataatgagtgacttccccttggatcctcaaatgtcgaagatgttagttgttagcccaagcttcaattgttcaaacgagattctttcgatcacggctatgctttcagtacccaattgctttgtccggcctagggaggcccagaaagctgcagacgaagcgaaagctcggttcgcccacattgacggggatcatctcacacttctcaacgtttaccacgcatacaaacaaaacgacgaagattcgtcatggtgttatgacaattttgtcaatcagagggcactgaagtctgctgataacgtaaggcaacagctaatgcggatcatggctagattcaacctcaagctttgcagtccagatttcaacagccgtgactattacctcaacattagaaaagctatgctggctgggtattttatgcaggttgctcaccttgagcgtactggccactatctaacagtgaaagataatcaggtggttcacttgcatccatcgaactgtctggatcacaaaccggagtgggtcatttacaacgagtacgtgttgactagcaggaacttcattcgaactgttacagatgttcgtggagagtggcttgtcgatatagcatcccattattacgatctggagaacttcccacagtgcgaggctaagcgagttctggagaagctctaccagaagaaaggaaaagataaagaggagagtaggaacaggaaataggttttgcgatatcatatactccgtacttggatatgctctcttgagttttcgtttttcactttcttctttctcatctaattactataaagatgattacagatttgtgataatgtgaggaaaagaaaaaactagcctttgaagtcgtgaaactatgttgtttagtttcatatatgttaatcagatagctgtactaagtttggtatttgttatgataactgaagttttcttgatcttcacaagtaatttataatctcatttatgccctagtttcgttttttatctagttgtaccgagttattgtgtagcacacttcattcttgctgttttgaatgtatacctaatgtattgctgcaaatttgctctac

SEQ ID NO: 2603 - DNA, 2523 bp, Gnetum gnemon
cattcagagtcgagtagagcgttttctagacttcgaattttgcgtgcggaatcacgtctcacacacacacccagatatcgatacatatatatatatatatatcgtttttgcggtgttatatttatcggcggcgattagaaatttgcgaagatgagttccgagaggaagcggaagttgagcttgttcgatgtgacggatgaaaatctggtgcagcaggccaagaagctgaattcgtcctccaacggcgtcgctgcttctgctgctggaactcccgcgatccagggcatcaacaggtggaatgcgaggccctactctaacagatatttcgagatcctggaaaagaggaaaaccctacctgtgtggcagcagaggcaggagttccttgatatgctcgaaaagagtcagaccgttattcttgttggcgagactggcagtggcaagactacacagattcctcaattcgttgtagaggccgggtacacagctaaccgcaagcaaatcgcttgtactcaacctagaagggttgcagcgatgtctgtttcccgccgcgttgcagaagaaatggatgtcacaattggagaagaagtcggttacagcatcagatttgaggattgcagcagctcaaagacaattttaaagtatttgacggatggtatgttgctaagagaagccatgacagatcctcttttggaacgttatagagtaataatcctagacgaggcccacgaaagaacattggctacagatgttcttttcgggcttctgaaggaagtgttgagaaacagacaagacctgaagctggttgtcatgagtgctactttggaagcagaaaagttccagacctatttctctggagcaccgcttatgaaagtcccgggaagattgcatccagttgaaatcttctatacccaagaaccagaaagagactatttggaagcagctatccgaacagtggtacaaatccacatgtgtgaaccggctggtgatattcttgtttttctaaccggagaggaagagattgaagatgcatgtaagaaaataaatagagagatccagaatctgggtgatcaagttgggcctgtgaaagctgttccattatactctaccctgcctcctgcaatgcagcagaagatttttgagcctgcacctgcgccaactaaagaggggggtcctcctggcagaaaaattgtggtatccactaacattgcagaaacgtctctaaccattgatggcattgtctatgtgatcgatcctggttttgcaaaacagaaagttttacaatcctcgtatacgtgtagaatcactgcagtttcacccatatcaaaggcaagtgctcatcaaaggtctggcagagcaggacgtacacagccaggaaaatgcttcagactttacacagagaagagtttccacaatgatttacaggcacagacatatcctgagatcttacgctccaatctagccaatgttgttcttcagctgaaaagttaggcattgatgatttagtgcactttgattttatggatcctcctgccccagaaacattgatgagggctttggaggcattgaattacttgggtgcattggacgatgatggaaatcttacaaaaattaggagaattaatgagtgagtttccacttgatccccaaatgtccaagatgttggtcgagagcccagatttcaactgctccaacgaaattctttccattgttgccatgctttcagtacccaattgctttctccggcctagggaagctcaaaaagctgcagatgaagcgaagagtcggttttcacacatcgatggtgatcatctgactttgctgaacgtgtaccatgcctacaagcaaaacaacgaagacccacaatggtgttatgagaacttcatcaacacacgagcattgaaatctgcagataatgtgagacagcagcttgtgcgcataatgaatagatacaatctgaagatgtgcagcaccgacttcaatagcagagattactatgtgaacattcgcaaagcaatgctagcaggctatttcatgcagacagctcatctagaacgcacggggcactatctaacggtgaaagacaatcagattgttcatttgcatccctccaactgtcttgaccataaacccgaatgggtcatatataatgagtacgtcttgacaagcagaaattttattcgtacagttacagagattcgtggagagtggttgattgatattgctccacactactatgatttgagtaatttcccacaatgtgatgctagaagagtcctggagcggctatatacgaagaaggaaagggaaagggacaaggaatgggaacgagagaaatcagaaagcaaaagtagaaaatagaaatcgattctttttgttctctgtgtaggacattacttggtattgaagtatttctcattgtataagcactaattttaaactatatcaggatctactggattgaacagtcgaagttgttatacctgaaaattttgctgggacttatacttcatacttgaattgtgt

SEQ ID NO: 2604 - DNA, 2558 bp, Nicotiana benthamiana
tgcaattgtttcatcggagactccaaaactcgttctgggttttagatattctggatgggaacggagcggaagaggaaagtaagcttgtttgatgtggtggatgagacgccagcgcagaaagtgaatgttggaagtgtcaacggcagcatgacaccgtcgattaataagtggaacgggaagccttactcacagagattctatgagatattggagaaaaggaagactcttccggtttggcatcaaaaggaggagtttttacaggctttaaaatctaatcaaaccctaattttggttggtgaaactggtagtggtaaaaccactcagattccgcagtttgttttagatgctgttgaagttgagacgactgagaagcgccggaagtatatgattggctgcactcaacctcggagggtggctgcaatgtccgtgtctcgtcgagttgctgaagagatggatgttgcaattggggaagaagttggatatagcatccgatttgaagactgcagtagtgctagaaccgttttaaaatacttaacagatggtatgcttttaagagaagcaatggcagatcctctattggaacgctacaaagtaatcattctggatgaagcccatgaaagaactttggcaacagatgtcctgtttgggcttcttaaagaggtgttgaaaaatagaccagacctaaagcttgttgttatgagtgctacacttgaggcagagaagtttcagggttacttctttggtgcgcctctcatgaaagtgcctggaaggcttcatcctgtggaaattttctacactcaggagcctgagagagattatatcgaggctgccattcggactgtggtgcagatacacacgtgtgaacctcctggtgacatacttgttttccttaccggagaagaggagattgaagatgcttgtcgcaaaatcaataaggaggttagtaatttgggggatcaagtgggcccggttaaagtggtgcctctttattctacacttcccccagctatgcagcaaaagatatttgaatcagccccacccccggtggtggagggtggtcctgctggcaggaagattgttgtgtcaaccaacattgcagaaacatctttgacaattgatggcattgtatatgtcatagatccgggatttgctaaacaaaaagtttataacccaagggtgcgtgttgaatctttgttggtgtctcctatttcaaaggccagtgcccaccagagatcaggacgtgctggaaggacgcagccagggaaatgctttagactttacacagagaaaagtttccataacgaccttcaaccacagacctatccagaaatacttcggtcaaatttggctaatacagttctaactttgaagaagttaggtattgatgacctggttcattttgattttatggatcctcctgccccagagactttgatgagagcactggaggttttgaattacttgggagctttggatgatgaagggaacttgactaggttgggtgagattatgagtgaatttcctcttgatcctcagatggcaaaaatgcttgttgtcagctcagaattcaactgctccaatgaaatcctttcaatatccgccatgctatcagtacccaattgctttgtccggcctagggaggctcagaaagctgcagatgaagcaaagaatcggttcggtcacatagatggggatcatttgacgttgctgaatgtgtatcatgcctacaagcagaacacggaagaccctcaatggtgctacgagaatttcatcaatcagagggctctcaaatcagctgacaacgtgaggcaacagctttctcgcataatggccaggttcaacctcaagttatgcagcacagacttcaacagtcgcaactactacgtaaacataagaaaggctatgttagctggatatttcatgcaggttgctcacctagagcgtactgggcactatctgactgttaaagacaatcaagtggttcacttgcatccttcaaattgcctggatcataagccagaatgggttatctataatgaatatgtcttgacaagcaggaatttcatccgtactgtaactgatattcgtggtgaatggttggttgatatagcaccacattactatgaccttgcgaactttccgcaatgtgaggcaaaacgagttcttgagcggttatacaagaagcgagagcgagaaaaagatgaaagcaaaagcaaaagatgaatgcattcacaattacagttcctctcagcatgcacgctccaggggagttctggggtcaaaattagtcaagataggctaaagattgatgtactatctactatgtactgtaattgtttgtaccattccagtccgaacgatttagtacctgtttcttgttgctggagtaatctgtttcttgttccttgcctccaatgtcctgatatatcagaccaattcttttagctttttcctctattgaagcaaatgtacgttgcgcttccactgcataaactcagctaggagtaacctattttatacaggatgctcctgcataacacctcgaaggatttcctgta

SEQ ID NO: 2605 - DNA, 2379 bp, Ambrosia trifida
gggtttctaacagcctctgcttctccaacaacaacaataataattaataataacaatctctgatgggtacagaacgtaagaggaaggtcagtctattcgacgtcgtcgaagacacatcaaccgccaaattaaacaaatccaacggcgtcgataatatgtcgacgctggtcaacagatggaatctacgcccttattcccaacgatattatgatatattggagaagaggaaaaccttacctgtatggcatcagaaagaggagtttttaaaggccttgagagataaccaaaccctaattttggttggtgagactggtagtggtaaaactactcagattcctcagtttgtgttggaggctgtggagttggagagtgcggatagacgtaagaagtttatggtgggatgtacgcagccgcgtagggtggctgcgatgtcggtttcccggagagttgcggaggaaatggatgttacgattggggaagaagtcggttacagcattcggtttgaagattgcagcagtgcaaaaactgttttgaaatacttgacagacggtatgttattaagagaagcgatgactgacccacttttagaaagatataaagtgataattcttgatgaagcccacgaaagaactttggctactgatgttttattcgggctcttaaaagaagtgctgaaaaatagacctgatcttaagctggttgttatgagtgctactcttgaagctgaaaagtttcagggttatttctttggtgcaccattaatgaaagttccggggcgacttcaccctgtggagatcttttacactcaagatcctgaacgtgactatcttgaagcagcaattcgaaccgttgtacaaattcatatgtgtgagccacctggtgatattcttgttttccttaccggtgaagaagaaattgaagatgcctgtcgaaaaataacgaaagaagtcggtaatttaggagaccaggttgggcctgtgaaagttgtcccactttattcaaccctcccaccagccatgcagcagaagatatttgagcccgctccacctccattaaccgaaggtgggcctgccggcaggaagatcgtgatttcaacaaacattgctgaaacgtctttgaccatagacgggatagtttatgttatcgacccgggttttgcaaagcagaaagtttataacccacgtgttcgagttgagtcgttgttagtgtccccaatatcgaaggcgagtgcccaccagagatcgggtcgggctggaagaacacaacccgggaagtgttttagattatacactgagaaaagttttaataatgatctacagccacagacataccctgagattcttcgatccaatttagcaaataccgttcttactttgaagaaacttggtattgatgatcttgttcattttgattttatggacccacctgctcctgaaactttgatgcgggccctagaggttttgaattatttgggagcgttggatgatgaaggaaacttgactaaattgggtgaaattatgagtgaattcccgttagatcctcagatgggaaagatgcttgttgttagccctgaatttaaatgttcaaatgaaatcctttcaatcgcggctatgctatcagtacccaattgctttgtccggccaagagaagcccagaaggctgctgacgaggcaaaagctcgatttggacacattgatggggaccatctcacgctcttgaatgtatatcacgcctacaaacagaataatgaagatcaatcatggtgttatgagaactttgtgaatcagcgggctctcaaatctgcagataacgtgaggcagcagctaagccgtattatggcccgtttcaacctcaagctatgcagcacggattttaacagccgtgattattacatcaacatcagaaaagctatgctggcagggtattttatgcaggttgcccacttggagcgcaccggacattatttgacagtaaaagacaatcaagtggttcatttgcacccgtcaaattgtttagaccataagccagaatgggtgatttacaatgaatatgtgttgactagcaggaacttcattcgcactgttacagatgttcgtggtgaatggattgttgacattgctccacactactatgatcttgaaaacttcccgaattgcgaagcaaaacgagttcttgagaagctgtacaagaaaagggaaaaagacaaagacgagagcagaaacaaaagatagaatgaaacccttgatcgatcgatcacctataatttcaacagactgttctggatgaagtgtcatgtatcttagtaatagttgatttgttccgtacggatttttgaataatcttaaaatcagatcaatgttttgtttgttaccttaatta

SEQ ID NO: 2606 - DNA, 2367 bp, Arnica chamissonis
agatctgtaattcattcgtcgcctaaaactagggttggatgggtacggagaggaaacggaaggtgagtctgttcgatgtcgtcgacgaagactcagcggcggccaaatttaaaaaagcgaacgccggagccgccgttaatggcgtcaacaacatcggcggtatatctctggtgaataggtggaacggacgcccttactcacagcgttattacgatatcttggagaagaggaaaaccctacctgtttggcatcagaaagaggaatttctcaaagcactcaaagagaatcaaaccctaattctcgtcggtgagaccggtagtggtaaaaccactcagattcctcaatttgtgttggaagctgtggagttagagagtgcagatagacgtaagaaattcatggtggcttgcacccaacctcgtagggtggctgcaatgtctgtttctaggcgagttgcagaggaaatggatgtcacaattggagaagaagttggttacagcatccgttttgaagattgcagcagtgcaagaactgttttgaaatacttgacagatggtatgctgttaagagaagccatgaccgacccacttctagaaaggtataaagtgataattcttgatgaagctcatgagagaacattggctactgatgttttatttgggcttttaaaagaagtgctgaaaaatagaccagatcttaagttagttgttatgagtgctactctcgaagccgaaaaatttcagggttattttttcggtgcaccactgatgaaagttccaggtcgacttcaccctgtggaaatattttacacccaagatcccgaacgcgactatcttgaagcagcaattcgaaccgttgtacaaattcatttgtgtgagccacctggtgatattcttgttttccttaccggtgaagaagaaatcgaagatgcatgtcgaaaaataacgaaagaagtcgggaatttaggagaccaggtggggcctgtcaaagtggttccactatattcgaccctcccgccagctatgcagcagaagatatttgagcctgctccttctccgctaaccgaagacgggcctgctggcaggaagattgtgatttcaacaaacattgctgaaacgtctttaaccatagacggtatagtttacgtcattgacccgggttttgcaaagcagaaagtgtataacccacgtgttcgagtcgagtccttactagtttccccaatatcaaaggcaagtgcccaccagagatcgggtcgtgccgggagaacacagcctggcaagtgttttagattgtacacagagaagagctttaataatgatcttcagccacagacgtaccccgagattcttcgatccaacttagcgaatacagttcttactctgaagaaacttggtattgatgatcttgtacattttgattttatggacccacctgctcctgaaactttgatgcgggcattagaggtattgaattatttgggagcgttggatgacgaagggaatttgactaaactgggcgaaataatgagtgaatttccgttagatcctcagatgtcaaagatgcttgtggttagctccgaatttaactgttcgaatgagatcctttcaatctcagctatgctatcagtacccaattgctttgtccggccccgagaagcccagaaggctgctgacgaggcaaaatctcgatttggacacattgatggggaccatctcacgctcttgaatgtatatcacgcctacaaacagaataatgaagatcagtcatggtgttatgagaactttgtgaatcatcgggcccttaaatctgcagacaacgtgaggcagcaactagcccgtattatggctcgtttcaacctcaagctatgcagcacagatttcaacagccgtgattactacatcaacatcagaaaagctatgttggcagggtattttatgcaggttgcccatttggagcgcaccggacattatttgaccgtgaaagacaatcaagtggttcatctgcacccgtcaaattgtttggaccataagccggaatgggtaatttacaatgaatatgtgttgactagcaggaatttcatacgcactgttacagatgttcgtggtgaatggattgttgatattgctccacactactatgatcttgaaaactttccgaattgtgaagcgaaacgtgttcttgagaggatgtacaggaaacgagaaaaagacaaggaggagagcagaaacaagagatagacgggaattttcgatcttctttgcttatagattcagcaaactgctctgaatgatgttatcatgtatcttagtttagtaacatctggtttgttcgttccgtacggattttgaataatcttaaaatcacttccat

SEQ ID NO: 2607 - DNA, 2414 bp, Prunus persica
atcttcttctatcttctagggtttgctaattttagggctaaatagtaaataggggaagagaaaccctcgattcggatactatccgacttcgttaggatccaactgatagccttttgggtttctgcgctgttaaggtttttgattgatgggtacggagaggaagaggaaggtgagcctgttcgacgtggtggacgagacctcagtctcatcagcgaagatgagtaaatcgaacggtggtgcaggagccacagcgaatcataacgcggtgagcaatctgatcaataggtggaccggcaagccttactcgcagaggtattatgagatccttgagaagaggaagactttgcctgtttggcaccagaaagaggagttcttgcaagctctcaaggccagccagtctcttattttggttggtgagactggtagtggtaaaaccacccagatccctcaatttgttttggaagctgttgattcggaaactccagataaacgtaggaagatgatgattgcatgtacccaaccccgtagagtggctgcaatgtcagtgtcccgtcgtgttgctgaagagatggatgtaaccataggagaagaggttggttatagcatccgttttgaagactgcagcagtgccagaacagtgctgaagtatctaacggatggaatgcttttaagagaagcaatgacagatccactattagagcgatacagtgtgataattcttgatgaggctcatgaaagaactttagcaacagatgttctatttgggcttctgaaggaagtattgagaaacagacctgacttgaagctggttgtgatgagtgctacacttgaggctgaaaagtttcagggttatttcagtggagcaccacttatgaaagttcctggaaggcttcatccagtggaaattttttacacagaggaacctgaaagggattatctggaggcggcaattcgaacagtcgtgcagattcatatgtatgagaccccaggagatatacttgtttttctaacgggagaggaagagatagaagatgcatgccgcaaaattaacaaagaagttggaaacctgggtgaccaggctggtcctgtgaaagtggtccctctatattcaactcttcctccagcaatgcaacagaaaatatttgatcctgctcctcctcccataaacgaaggcggaattcctggaaggaagattgtagtgtcaacaaacattgcagaaacttctctcactatagatggaattgtttatgttattgatccgggatttgctaaacaaaaagtttataacccacgagtgcgtgttgaatccttgttggtatctccaatttctaaggcaagtgcacatcagaggtcagggcgtgctggaagaactcagccaggaaaatgtttcagactgtatactgagaaaagtttccataatgatcttcaaccacagacatatccagaaatattgagatcaaaccttgcaaatacagttcttactttgaagaaactaggaatagatgatttggttcattttgattttatggatccccctgctcctgagacattgatgagagcattagaggttttgaattatttgggcgcattggatgatgatggtaacttgacgaagctgggggagattatgagtgagttcccgttagatcctcagatgtcaaaaatgctggttgttagccccgagttcaactgctcaaatgaaattttgtcaatatctgcaatgctttcagtacccaattgctttgtccggcctagggaggctcaaaaagctgcagacgaggcaaaagctaggtttggacacattgatggagatcatctcacgcttctgaacgtgtatcatgcatacaagcaaaacaatgaggatccatcgtggtgctacgagaactttgtcaatcagagggcattgaagtctgcagacaacgtcaggcagcaactagtgcgcataatggctcggtttagcctgaagttatgcagtactgatttcaatagtcgtgactactacataaacataagaaaagccatgctagctggatatttcatgcaggtggctcacctggaacgcactggacactacctgacagtgaaagataaccaggtggtacatttgcatccgtcaaattgcttggatcataaaccagaatgggtgatttacaacgaatatgtcttgacaagcaggaattttatccgtacagtgacagatattcgtggggagtggcttgttgatatagcaccccactactatgatttggcgaattttccccagtgtgaagccaagcgtgttcttgagaagctttacaagaagcgggaggacagggatgaaaacaaaaacagaaaatgaagttgatacccatccatcttcggaatctgcggattcttgtctgagtaacaaagcgcaatcagtgagagctggtcta

SEQ ID NO: 2608 - DNA, 2427 bp, Eutrema halophilum
tcaagacttctccgctgccgaaccctagctttcataacttcattcgttcgttctgcttccgctactcgtgcttcctcgggtatcaattgattcgcgcgatgggtaccgaaaggaagaggaaagttagtttgttcgatgtcatggacgatccatcggttccggcgaagaatgtcaaagccaatggtctcgccgacgtccacagtctcatcaataagtggaacggaaagccgtattcgcccaaatactatgaaatcctggagaagcggaggactttacctgtctggcttcaaaaagaggagtttctcagaactctaaaggacaatcaaaccctaattctggttggtgagaccgggagtggtaaaactacccagattccacagtttgttatagatgctgtggatgctgaaaccccggataagcgtaggaagtggttggtcggatgtacacagcctcgtagagttgcagccatgtctgtttccaggcgtgttgctgatgagatggatgtggctattggggaagaagttggttacagcatccgtttcgaggattgcagtggccccagaacggtgcttaagtatttgactgatggtatgctgctgagagaagccatggcggatcctcttttagagagatacaaagtgattattctcgatgaggctcacgaaagaactctagccacggatgtgctctttggtcttcttaaagaggtgttgagaaataggcctgatcttaagttagttgtgatgagtgcaactctagaagctgaaaagtttcaggaatattttagcggtgcgcctctgatgaaagttcctggtaggcttcatcccgttgagatcttctacactcaggagcctgagagggattatcttgaagctgctattaggactgttgtccagatacacatgtgtgagccacctggggatattcttgttttcttaactggagaggaggagattgaagatgcatgccgcaaaatcaacaaggaggttggtaatcttggggatcaagtcgggcctgtgaaagctgtaccattgtattccactctcccacctgcgatgcagcagaagatatttgatcctgctccagagccgttaacagagggtggtcctcctgggcgaaagattgttgtctcaaccaatattgctgagacttctttaaccatcgatgggattgtgtacgtcatcgaccctggttttgcgaagcaaaaagtctacaacccacgaatccgtgttgagtcgttgttggtgtccccaatatcaaaggctagtgctcaccagagatcaggtcgtgccggtagaacacggcctggaaaatgtttcaggctttatacagagaaaagtttcaataatgacttgcagccgcagacgtatcctgaaatattgagatcaaaccttgccaacacagttctgaccttgaagaaactgggtatagatgacttggtgcacttcgattttatggacccccctgctccggagacactgatgcgagccttggaggttttaaattatttgggagcacttgatgatgaaggtaacttgacaaagacaggtgagataatgagtgagttccccttggatccgcagatggcgaagatgctcatagtcagtcctgaattcaactgctcgaatgagatactctcggtgtcggcaatgctctcagtaccgaattgctttatccggcctagagaggctcaaaaagcagcagatgaagcaaaagctaggtttggacacattgatggagatcacctcacgctgctaaacgtctaccacgcttttaagcaaaacaatgaagacccaaactggtgctacgaaaacttcatcaacagtagagccatgaaatctgcagacaatgttagacagcagctagtgaggataatgtcgagatttaatttgaagatgtgcagcacggatttcaatagccgcgactactacatcaacataagaaaggccatgcttgccggttatttcatgcaagtggctcacctcgaacgcactggcaattacttgaccgtcaaagataaccaagtggttcatttgcatccatccaattgcttggatcacaaacctgagtgggtaatctacaacgaatatgttttgactagccggaatttcatcagaactgtgaccgatattcgcggtgaatggctggtagatgttgctcctcattattacgatctttccaactttcccaactgcgaggcgaaacgtgtcctcgagaagctttacaagaagagagagagggagaaggaagagagcaagaaccgcaagtgagaatgataatcgtatttgcatctacccaaaaagtttgttctttttaagagtttttgatccgattccccttactaaattttctttcacaattatctatatgaagacattggttttctgtatacattgaattatgacaattagcaaatgataatctcgg

SEQ ID NO: 2609 - DNA, 2536 bp, Aquilegia formosa
atgggaacagaaaggaagagaaaagtgagtttatttgatgtggtagatgaaacatctgtttctgcaaaaattgttaaattgaatggtagtggtggtggattagtttatactaattcacaaactaacaataaatggaatggaagaccttattctgcaaattactattcaattcttgagaaaaggaaaactcttcctgtttggcaacagaaagaagactttcttcaagctttgaatgctaatcaaactttgatattagttggtgaaactggtagtggtaaaactacccagatacctcagtttgttcttgatgctgttaacttagaaacaccagacaagagaaagaagatgatggtcgcctgcacccaacctcgtcgagttgctgccatgtctgtatctcgtcgagttgctgaggagatggatgtgactattggagaagaagttggttacagcatccgttttgaagattgtagtagtggaaagactgttctgaagtacttaacagatggtatgctcttgagagaagcaatgacagatcctctattggaacgctataaagtgattattcttgatgaggctcacgaaagaactcttgcaacagatgtcctatttgggcttttaaaggaagtgttaagaaataggtcggatctgaaagtagttgtgatgagtgccacccttgaggccgaaaagttccaatcttactttagtggtgctccacttatgaaagttcctgggagactgcatcctgtggagatcttctacacacaggagcctgagagggattatcttgaggcagcaattaggacagttgtgcagatacatatgtgtgagcctgttggtgatattcttgtttttctcacgggagaggaggagatagaagatgcctgccgtaaaataaacaaagaaattgccaatttgggtgatcaagtggggcctgtgaaagtagtccctctgtattctacacttcctccggctatgcagcaaaagatatttgatgctgccccacctgctttaaatgacaatggccctcctggaaggaagattgtggtatcaactaacattgcagaaacttctttgaccattgatggtatcgtttatgttatcgaccctggatttgccaagcaaaaagtttataatccacgtatacgcgtagagtctttgctagtctcaccaatatcaagggcgagtgcccaccagcgatctggtcgtgctggaagaacacaacctgggaaatgcttcagattatataccgagaggagtttcaataatgatcttcagccacaaacatatccagaaatacttcgatcaaatcttgcaaacacagttctcacattaaagaaacttggaatcgatgaccttgtccattttgattttatggaccctccagcacctgagacactgatgcgagcgcttgaagttttaaattacttgggtgctcttgatgatgaggggaatttgaccaagctgggggaaatcatgagtgagttccccttagatccacaaatgtcgaagatgcttgttgctagtactgaattcaattgttcaaacgagatcctgtcagtatcagctatgctttcagtacccaattgttttgtccggcctagagaggctcagaaagctgctgatgaagcgaaagcgcggtttggccacattgatggggaccatctcacactattgaatgtgtaccatgcgtacaaacaaaacaatgaggattctcagtggtgctacgataattttgttaattatagggctatgaagtctgctgataacgtgaggcaacagctagtccgcattatggctagattcaacctaaaactttgcagcacagatttcaacagccgtgactattatgtgaatatcaggaaagctatgttagcaggatacttcatgcaggtagctcatcttgagcgtactggccaatatttgacagtgaaagataatcaggttgtccaccttcatccctcaaactgcttggatcacaagcctgaatgggtcatatacaatgagtatgtcttgaccagtagaaatttcatccgtacagttacagatgttcgtggggattggctagttgacattgcaccccactattacgatcttgccaatttccccacatgtgaggccaagcgtgttcttgagaagctgtacaagaagcgtgagaaggagagggacgaaagcaagagcaggaaataagtttggaacaacacaatcagtatctcgccatgtgatggttttatatttcacagggacgggaaatggaaagaaagctgaaattagattgatccactaatatattttcaccatgtcatgcttttaagctttgacacgatgaaatgcttttaaatgaattcatcaaaaggactgtcctagtttgctgtcagtcttacttatgtacgaagccagtcgagacagttgggaactaagagatgaattgaggttcagtaagtttgttgcaatatttatttcccagtgtcatatattttggatctcagtatgagaagtaagcttagttccatgttttttggcgattcaagattgtatt

SEQ ID NO: 2610 - DNA, 2482 bp, Arabidopsis thaliana
tcctcgcgccgctgcttatcgttgagcctaaaatctatctgtctctcattttgttcgttcgtaatgggtacagagagaaaacggaaggttagtttgttcgatgttatggaagatccttctctttcgtcgaagaacaccaaatccaatggtctcggacttgcggcggcggctggtggtggaagcaatctgatcaacaaatggaacggaaaggcttattctcagaggtatttcgagattctggagaagaggagagatcttcccgtttggctccagaaagatgactttctcaatactttgaactctaatcaaactctcatactcgtcggtgaaactggtagtggtaaaactacacagattccacagtttgtattagatgctgtggtggctgacaactccgataagggaaggaaatggttggttggatgtacccagcctcgtagagttgctgcaatgtctgtgtctcgtcgtgttgctgatgaaatggatgtctccattggtgaagaagttggttacagtattcgttttgaggattgtactagctctcgtactatgcttaagtatttgactgatggtatgcttttgagagaggcaatggcggatccgcttttagagagatacaaagttattattctcgatgaagctcatgaaaggactctagccacggatgtgctctttggtcttctcaaagaggtcttgaggaataggcctgatcttaagctagttgtcatgagtgcaactttagaagctgaaaagtttcaggaatattttagcggtgctcctcttatgaaagtccctggtaggcttcatcctgttgagatcttctatacacaggaacctgagagggattatctcgaggctgctataaggactgttgttcagatacacatgtgcgagccacctggagatattcttgttttcttaactggagaggaggaaatagaagatgcttgccgtaaaatcaataaagaggtcagcaatcttggagatcaagtgggtcctgtcaaagttgtgcctttgtattctactcttccacctgcgatgcagcagaagattttcgaccctgctccagtgccgttaacagaaggtggtcctgctggacgaaagattgttgtctcaaccaacattgctgaaacctctctaaccattgatgggattgtttatgttattgaccctggttttgctaagcagaaagtctacaacccacggattcgagttgagtcattgttggtgtccccaatatcaaaggcaagtgctcaccagagatcaggtcgtgctggtagaactcgccctggaaaatgttttaggctctacacagagaagagtttcaacaatgacctgcagccacagacatatcctgagatattgagatcaaaccttgcaaatacagtcctgacattgaaaaaacttggcattgatgacttggtgcactttgatttcatggatcctcctgctcctgagacactgatgcgggcattagaggttctgaattatttgggagcacttgatgatgaaggtaacttgacaaagacgggtgaaataatgagtgaatttcccttggatccacaaatgtcaaagatgctcatagtcagtcctgaattcaactgttccaatgagattctctcggtttctgcaatgttatcagtaccgaattgctttgtccggcctagagaggctcaaaaagcagcagatgaagctaaagctaggtttggacacattgatggagatcacctgacgttgctaaacgtgtaccacgcctacaagcaaaacaatgaagacccaaactggtgtttcgagaactttgtcaacaacagagcaatgaaatctgcagacaatgtcagacagcagctagtgcggataatgtcgaggtttaatctgaagatgtgcagcacggatttcaacagccgcgactactatgtcaacataagaaaggccatgcttgctggttattttatgcaggtggctcacctagaacgcactggccattacttgaccgtcaaagataaccaagtggttcacttgcatccatctaattgcctggatcacaaaccagagtgggtgatttacaatgaatatgtcttgactactcggaatttcatacgcactgttacagatatccgcggtgaatggttagtcgatgttgctcagcattactatgatctttccaacttccccaactgtgaagcaaaacgagccctcgagaagctttacaagaagagagagcgggaaaagaacgagagcaagaaccggaagtgaagaaaatcactctctttgcttcgactagaggatcaaatcactcagagaagaatgtcttagtcacaagaccactatgatttaccctcgtcttaaattatgatggatactttgctttgtttatgttcaatgaaagaatcttgcattactcaaagtgtgttcttttaaaacctctgtttggcaactctatataacaatgtttctgataatctcaagtatgagcttcagtcca

SEQ ID NO: 2611 - DNA, 2604 bp, Brassica rapa
ttagggataaattcgtaaatcagaatatctcctggcgccacaaaccctagctttccctttctccgctgcacccaagttttctcgttcattcattcaccatgggtacggagaggaagcggaaggttagcttgttcgacgttatggaagatccatcggcgaagaacaacaaatccaacgttctcggagctgcttcggcggcggctggtatcaacaaatggaacgggaagccttactcgcagaggtactacgatattctcgagaagaggagagatcttcccgtttggctgcagaaagatgagtttctccgcacgttgcaatctagccagacgctgatcctcgtcggtgagactgggagtggtaaaactactcagattccacagtttgttttagatgccgttgaggctgagaacacaaataagcataagaaatggttagttggctgcacgcagcctcgtagagtcgctgcaatgtctgtttctcgtcgtgttgctgatgaaatggatgttgccattggagaagaagttggttacagcatccgttttgaggactgtagtggccctcgtactatgctcaaatatttgactgatggtatgctgttgagagaggcaatggcggatccgcttctagagagatacaaagttattattctcgacgaagctcacgaaagaactttggctactgatgttctctttggtcttctcaaagaggttttgaggaacagacctgaccttaagctagttgtgatgagtgcaaccttggaagctgaaaagtttcaggagtattttagcggtgctcctcttatgaaagtccctggtaggcttcatccggttgagatattctacacacaggagcctgagagggactatcttgaagctgcgataaggaccgttgttcagatacatatgtgcgagccgcctggagatgttcttgttttcttaactggagaggaggagattgaagatgcctgccgtaaaatcaataaagaggtcagtaaccttggagatcaagtgggacctgtcaaagttgtgccattatattctactctcccacctgcgatgcagcagaagatttttgaccctgcacccgagccattaacagaaggtggtcctgctggtagaaagatcgttgtctcaaccaacatcgctgaaacgtctttaaccattgatgggattgtttatgttattgaccctggttttgccaagcagaaagtctataacccacggatccgtgttgagtcgttgttggtgtccccaatatcaaaggcaagtgctcaccagaggtcaggtcgtgctggtagaactcgccctggaaaatgtttcaggctctacacagagaagagtttcaacaatgatctgcagccgcagacgtatcctgagattttgagatcaaatcttgctaatactgtcttgacattgaaaaagttgggtatagacgacttggtgcactttgatttcatggaccctcctgctcctgagacattgatgagagcattagaggttttgaattatctgggagcgttggatgatgaaggtaacttgacaaggactggcgagataatgagtgagtttcccttggatccacagatgtcaaagatgctcattgtcagccctgagttcaactgttcaaatgagattctctcagtttctgcaatgttatcagtaccgaattgctttgttcggcctagagaggctcaaaaagcagcagatgaagcaaaatctaaatttggacatattgatggagatcacctgacgcttctgaacgtgtaccacgcctacaagcaaaacaatgaagacccaaactggtgttttgagaactttgtgaacaatagagcaatgaagtctgcagacaatgtgaggcagcagctagtgagaataatgtcgaggtttaatctcaagatgtgtagcacggatttcaacagtcgtgactactacgtcaatatcagaaaggccatgctgtctggttatttcatgcaggtggctcacctagaacgcactggccattacttgaccgtcaaagataaccaagtggttcacttgcatccatccaattgcctggatcacaaaccggagtgggtgatttataatgaatatgtcttgactactcgcaatttcattcgcactgttacagatatccgcggtgactggttagtagatgttgcaccgcattactatgatctttccaacttccccaactgtgaagcaaaaagagtccttgagaagctttacaagaagagagagagggaaaggaacgagagcaagaaccgaaagtgaagagtcaaatcacgaaggcaagaagaatctctttgtcataagattatgttttgtgtaagctatgttggatacttggtcgtttgtttctgttacaatgaaagaatcttgcattactcaaaactttcgttctaaaatctttatgtatttgatattacaaaagctctgtttcacagcggctctattcaatccagctactagcgtcttgtttcttggctttggtcttcctcatcaatctcctcaactccataacacttgtccaatctcctttctcgccatgaactctacagagaacatcataagctgcgggatgctctcttctcagcctcgagattcc

SEQ ID NO: 2612 - DNA, 2410 bp, Helianthus annuus
aaaatccccaatttctccaacacctaaccctagggttcgaatgggcacagaacggaagagaaaggtgagtctgttcgacgtcgtggacgattcatcaacggcgaaattgaacaaagcgaacggcggagccgccgtgcacggcgtcgacggtatgccggtggtgaacaggtggaatctacgcccgtactcgcagcggtattacgatatcttggagaagaggaaaactttgccggtttggcatcagaaagaggagtttcttaaggcgttgagggagaatcaaaccctaattttggtcggtgagaccggtagtggtaaaactactcagattcctcaatttgttttggaagctgttgagttagagagtgcggataaacgtaggaagttcatggtgggatgcacgcagcctcgtagggtggctgcaatgtctgtttccaggagagttgcggaggaaatggatgttacgattggagaagaagtcggttacagcatccggtttgaagattgcagcagcgcaaaaactgtcttgaaatacttgacagacggtatgctattacgagaagcgatgaccgacccacttctagaaaggtataaagtgataattcttgacgaagcccacgaaagaacattggctactgatgttctattcgggctcttaaaagaagtgctgaaaaacaggcctgatctaaagctagttgttatgagtgctactctcgaagccgaaaagtttcagggttatttcttcggtgcaccgttaatgaaagttccgggccgacttcaccctgtggagatcttttacactcaagagcccgaacgcgactatcttgaagcagcaattcgaaccgttgtacaaattcacatgtgtgagccacctggcgatatccttgttttcctcaccggtgaagaagaaattgaagacgcctgtcgaaaaataacgaaagaagtcggtaatttaggagaccaggtggggcccgtgaaagtggttccactttattcaactctcccaccagctatgcagcagaagatatttgagccagctccagctccgttaactgaaggtgggcctgcgggccggaagattgtgatttcaacaaacattgctgaaacgtctttaaccatagacgggatagtttacgttatcgacccggggttcgcaaaacagaaagtttataacccgcgtgttcgagttgagtcgttattagtgtccccaatatcaaaggcgagtgcccaccagagatcgggtcgagctgggagaacacaacccgggaaatgttttagattatacaccgagaaaagttttaataacgatctacaaccacagacgtaccccgagattcttcgatctaatttagcgaatacggtacttacgttgaagaaacttggcattgatgatcttgttcattttgattttatggacccacctgctcctgaaactttgatgcgggctctagaggttttgaattacttgggagcgttggatgatgaaggaaatttgactaaattgggtgaaattatgagtgaattcccattagatcctcagatgggaaagatgcttgttgttagccctgaatttaaatgttcgaatgaaatcctttcaatcgccgcaatgctatcagtacccaattgctttgttcggccccgagaagcccagaaggctgctgacgaggctaaagcccgatttggacacattgacggggaccacctcacactcttgaatgtatatcatgcctacaaacagaataatgacgatcaatcatggtgttatgagaactttgtgaatcaccgggccatgaaatctgcagacaacgtgaggcagcagttagcccgtattatggcccgtttcaacctgaagctatgcagcacggattttaacagccgtgattattacatcaacatcagaaaagctatgttagcagggtattttatgcaggttgcccacctggagcgcaccggacattatttgactgttaaagataatcaagtggttcatttgcacccgtcaaattgtttggatcgtaagccggagtgggtgatttacaatgaatatgtgttgactagcaggaatttcatacgcactgtttcagaagttcgtggtgaatggattgttgacattgctccacactactatgatcttgaaaacttcccgaattgcgaagcaaaacgcgctcttgagaagctgtacaagaaacgggaaaaagacaaggacgagagcagaaacagaagatagaactaaacgaaacccttgatcgatcacctataattaaaacaaactgttctggatgaagttttcaacggactgtttatgtatcttaatttagtattagttgatttgttccctacggattttgaataatcttaaaatcagatcaatgttttggttatcttaatactatgtgacatggttcggcgtttg

SEQ ID NO: 2613 - DNA, 2485 bp, Vinca minor
gtaattccctttcttctctgagtttttcccctcagctaattcccactgaaaccctagaatttctgcaacgctacagagccaactatctcttcaaatactggaataatccgcaggttgtggaaattgatagatgggaactgagaggaagaggaaagtgagtttgtttgacgtggtggacgattcctctgtttcaaagttcggcaaggccaacggtggcctaatgaataactccggcagtggcatgaatcctctgatcaataagtgggcgaaggccttactcacagaggtactttgatattctggagaagcggaagactcttcctgtttggcagcagaaagaagagtttttgaaggtcttaagagagaaccagaccctaatattggtgggtgaaactggcagcggtaaaaccacccagatccctcagttcgtattggaagccgttgaagaagagaaccaagataaatgtaagaagtacatgattggttgcacccaacctcgacgagtggctgccatgtctgtttctcggcgtgttgcagaagagatggatgtgaatattggggatgaagttggttatagtattcgttttgaagactgtagcagcgcaaaaacagttctaaagtacttaactgatggtatgcttttacgagaagccatgaatgatccattgttggaaagatacaaagtgataattcttgatgaagctcatgaaagaactttggcaacagatgttctgttcgggcttctcaaggaagttttgaaaaacagacctgatctgaaggtagtgtcatgagtgctactcttgaagctgaaaagttccaaggctattttaacggtgcacctctgatgaaagttcctggaaggctgcatcctgtggagatcttttacactcaagaacctgaaagagattaccttgaagctgcaattcgcacagtggtgcagattcatatgtatgaacctccaggtgatattcttgtttttctcactggagaagaagagattgaggatgcatgtcgtaaaataaacaaggaagttggtaacatgggagatcaggtaggtcctgtcaaagtggtgcctctgtactctacacttccaccagctatgcagcagagaatttttgaatcagctcctcccccgttaaaggaagatggtcctgctgggcggaaaatagttgtgtcaacaaatattgcagaaacatctttgaccatagacggtatagtttatgttatagacccaggttttgctaagcaaaaagtatacaacccaagagtacgtgttgaatctttattggtttctcccatatcaaaggcaagtgcacaccaaagatcaggacgtgccggaagaacgcagcctggaaaatgctttaggctttatactgagaaaagttttaacaacgaccttcagcctcagacatatccagaaatattgaggtcaaaccttgcaaacacagttctgcagttgaagaaacttggaatagatgacttggttcattttgatttcatggatccaccggctcctgagacattgatgagggcattggaagtattgaattacttgggggccttggatgatgatgggaacctaaccaaactgggtgaaattatgagtgagtttcccctggacccgcagatgtccaaaatgcttgttgtcagcccagaattcaactgttccaatgaaattctttcaatatcggctatgctttcagcaccaaattgctttgtccggcctagggacaatcaaaaagctgcagatgaagcaaaagctcgttttggacacattgatggggatcacctcactctcctgaatgtctaccacgcttacaagcaaaacaaggacgacccaaattggtgttacgataacttcgtcaacagccgggctcttaaatctgctgataatgtgagggagcaactacagaggatcatgactagattcaacctcaagctatgcagcacagatttcaacagccgtgactactatttgaacatcagaaaagccatgttagctggatattttatgcaggttgctcacttggaacgcaccgggcattatttgaccgtgaaagacaatcaagtcgttcacttgcatccttcgaattgcctggaccataaacctgaatgggtcatatataacgagtatgtactaactagcaggaatttcattcgcacagtgacagacattcgtggggaatggcttgttgacgttgcgccacattattatgatcttacaaacttccccaattgtgaggcaaagcgagttcttgagagactgtacaagaagcgggagaaatagagagaggagagcaaaaacaggaaatgaaggcatttactccatcattgtggacttggttgctggttcacacatttaaagatgtaattttgccccacctctattaccttgtagcctttaaacagagatgactattagcatggatcctttagtataatttgctatggtacttgtatgaggatatcaatatctttatttttc

SEQ ID NO: 2614 - DNA, 2554 bp, Aquilegia formosa
atttatttcatttcattccaactccattgaatcagtcaaaattcgatcttgaaaactcaaatttagggtttagaagtagtagtagtagaagaagaaatggggacagagagaaagaggaaagtgagtttatttgatgttgtggatgaaacatctgtagctgttgctgctgctgctggtaaactttccaagatgaatggtgctgcttctttgattcaaaatcttaatctcaatagatggaatggacgcacatactcacaacgttaccatgatattttagaaaagaggaaaactcttcctgtttggcaacaaaaagatgagtttttgcaagctttacatgctaaccaaaccttgattttagtcggtgaaacgggaagtggcaaaaccacccagattcctcagtttgttcttgaagccattgaattagacgataagcgcaagaagatgatggttgcctgcacccaaccacgtagggtggctgcaatgtctgtatcccatcgagttgcagaggagatggatgtcactattggtgaagaagttggttacagcatccgttttgaagatcgcagtagtgcaaaaacaattctaaagtatcttactgatggtatgctcttaagagaagccatgacagatcctttgttagagaattataaggtgattattcttgatgaggctcacgaaaggactttggcaacagatgttttgtttgggctcttaaaagaagtattgagaaacaggccagatctgaaattggtggtgatgagtgcaaccctggaggccgaaaagtttcaagcttatttcagtggcgcaccactaatgaaagttcctggaagactgtttcctgttgaaattttctatactcaggaacctgagagggattaccttgaagctgcgattcgaacagttgtgcagatacacatgtgtgaaccacctggggacatacttgtcttccttactggggaggaggagattgaagatgcatgtcgaaaaatagccaaagaagttggtaatattggtgatcaggtggggcctgtgaaggttgtacctctttattctacactacctccagctatgcagcaaaagatatttgagcctgctcctcctccagtgaatgaaggtgggcctcctggaaggaagatagtagtgtctactaacattgctgaaacatctctgacaattgatggtatagtgtatgtgattgaccctggttttgccaaacagaaggtttacaacccccgagttcgtgtggagtctttgctggtctcaccaatatcaagagcaagtgctcaccagagatcggggcgtgctggaagaacccaacctggaaaatgctttagactttacactgagagaagttttaaaaacgatcttcagccacagacttacccagaaatactgcgatcaaatctggcgaatactgtcctcacactaaagaaactaggaattgatgatctggttcatttcgattttatggacccccctgcccctgaaacactaatgcgggcattggaggtcttgaattacctgggtgcgctggatgatgaaggaaacttaactaaattgggggagatcatgagtgagtttccattggatcctcaaatgtcgaagatgcttgttgttagtccaggcttcaactgctctaatgagatcctgtccatttctgcaatgctctcagtacccaattgctttgtccggcctagggaggctcagaaagcggcagatgaagcgaaagctcagtttggccacattgatggggatcacttgacgctcctgaatgtttatcatgcatacaagcaaaacaatgaggacccttcatggtgttatgaaaattttgtcaaccagagggcaatgaaaaatgctgataacgtgaggcaacagcttcttaggatcatggctagatttaacctgaaactatgcagcacagacttcagtagtcgggactattatgtcaatataagaaaggcgatgctggctgggtattttatgcaggtagctcaccttgagcgtattggtcattatttgactgtcaaagacaaccaggtggttcacctacatccttcaaattgtcttgatcacaaacccgaatgggtcatctacaatgaatatgtcttgaccagcagaaatttcattcgcacggttacagatgtcaggggggaatggttagttgatatagcacctcactattatgatcttgaaaattttccccaatgtgaagcaaaacgtgttcttgaaaagctctacaagaaacgggagaaggatagggaggaaaacaagaacagaaaataaagcaaaggaaagtttagaatctgcaaatgtatgcttgagcaattaattaaagagtgaagaaaatctttgtgcaagatgggaaagaggcaatttaattgtcagtgttatatgcagcaatgtctatctatatgagtgtatattctcatagttttatatgcttgtcattctattgatatctatcaatgaggtactcccattatctcccatcatgttgacactactacccaacacttttagttacaagtgaatcttttaccagacattgtgcaat

SEQ ID NO: 2615 - DNA, 2219 bp, Malus domestica
gtttgtgattgatgggtacggagaggaagaggaaggtgagcttgttcgacgtggtggacgagacctccatctcattggcgaagatgagcaaatcgaacggcggcggcggagctgctgccaaccaaaacgctgtgagcagtatcatcaatcggtggacgggaaagccgtactcgcagaggtactatgagattcttgagaagaggaagacgttgccggtttggcaccagaaagaggagttcttgcaggctctcaaagccagccagtctctcattttggtcggtgagactggtagtggtaaaaccacgcagattccccaatttgttttggaagctgtcgattcagaatcttcagataaacgcaaaaagatgatggttgcatgtacccaaccccgtagagtggctgcaatgtcagtatcccgtcgtgttgctgaagagatggatgtaaccatcggagaagaggtcggttatagcatccgttttgaagactgcagcagttccagaactgtgttgaagtatctaactgatggaatgcttttaagagaagcaatgactgatccactattagaaagatacagcgtgataattcttgatgaagctcacgaaagaactttagcaacagatgttctatttgggctgttgaaggaagtgttgagaaacagacctgacttgaaggtggtggtgatgagtgctacacttgaagctgaaaagtttcagggctatttcagcggtgcaccactcatgaaagttcctggaaggcttcatccagtggaaattttttacactgaggaacctgaaagggattatctggaagcagcgattcgaacggttgtgcagattcatatgtatgagaccccaggagatatacttgtttttctaacaggagaggaggagatagaagatgcatgccgcaaaattaacaaggaaaatggaaatctgggtgaccaggttggtcctgtgaaagtggtgcctctgtattcaactctacctccagctatgcagcagaaaatatttgatcctgctcctcctcctgtaaaagaaggtggaattcctggaaggaagattgtggtgtccacaaacattgcagaaacttctctgactattgatggaattgtttatgttattgatcctggatttgctaaacaaatagtctataacccaagagtgcgtgttgaatcattgttggtatctccaatttccaaggcaagtgcacatcagaggtcaggtcgtgctggaagaactcaaccaggaaaatgtttcagactttatactgagaaaagtttccagaatgatcttcaaccacaaacttatcctgaaatattgagatccaaccttgcaaatacagttcttactttgaagaaattaggaatagatgatctggttcattttgattttatggatccccctgctcccgagacactgatgagagcactagaggtcttgaattatttgggagcattggatgatgatggtaacttgaccaagctgggggagattatgagtgagttcccattggatcctcagatgtcaaagatgcttgtagtcagccctgagttcagctgctcaaatgaaattttgtcaatatctgccatgctttcagtacccaattgctttgtccggcctagggaggctcaaaaagctgctgatgaagcaaaagctaggttcgggcacattgatggagatcatctcacgcttctgaacgtgtatcatgcatacaagcaaaataatgaggatccgtcgtggtgctatgaaaactttgtcaatcagagggcattgaagtccgcagacaatgtcaggcagcagctagtgcgcattatgggccgatttaacctcaagctgtgcagtactgaattcaatagtcgcgactactacatcaacataagaaaggccatgctagctggatatttcatgcaggtggctcacctggaacacactggccactatctgacagtgaaagataaccaagtggtgcatttgcatccgtcgaattgcttggatcacaagccagaatgggtgatttacaatgagtatgttttgacaagcaggaattttatccgtacagtgatggatattcgtggggagtggctaatcgatatagcaccccactactatgatttggcgaattttcctcagtgtgaggccaagcgtgttcttgagaagctatacaggaagcgggaggacaaggatgagaacaaaaacagaagatgaagttcttaaccccga

SEQ ID NO: 2616 - DNA, 2398 bp, Euonymus alatus
cggccgggggttcacaatcacaatctctagccccctctttcctatcggctatagctgtttcttttctctctagggtttacgatcttctagttggatgggtacagagaggaagaggaaggtgagtttgttcgatgtggtggacgagactactgtctcgaagatttcgaagtctaatggtctggtaccggcgatcaacaacagtggcgtcaataacctggtgaatccgtggactgggcggccgtattcccagaggtactatgagatcctggagaagaggaaaactctacctgtttggcaccagaaagaggagttcttacaggtcttgagggccaaccaggtcgttgtacttgttggtgagactggtagcggcaagacaacacagattcctcagtttgtcttggatgctgtggagatagaaactcctgataggcgcaagaaaatgatgattggatgtacacaacctcgtagggtggctgcaatgtctgtttcaaggcgtgttgctgaggagatggatgtaactattggagaagaagttggttatagcatccgatttgaagattgtagcggtccaagaacagttttaaagtatcttaccgatggtatgcttctaagagaggcgatgacagatccactgttggaacgttataaagtgataattcttgatgaggctcatgaaaggactttggcaactgatgttctgtttggcttgctgaaagaagtgctgaagaatcgaccggacctgaagctagttgtaatgagtgctactcttgaagcagaaaagtttcagggatattttaatggtgcaccacttatgaaggttcctggtaggcttcacccagtggagatattctacacccaggaacccgaaagggattatctggaggctgcaattaggactattgttcagatacacctgtgtgagcctccgggagacatacttgttttccttactggagaagaggagattgaagatgcatgccgaaaaatcagtaaggaaattgcaaatttgggggaccaagtggggcctgtgaaggcagttcctctgtattcaactcttcctccggctatgcagcagaaaatatttgatcctgctcctcctccactaaccgagggtggtcccccaggaagaaagattgtggtgtcaacaaatattgcagaaacttctttgacaatagatggcattgtttatgttattgaccctggtttttctaaacaaaaagtctacaatccacgtgtgcgtgttgaatctttattggtgtctccaatatcaaaggcaagtgcacatcagagatcagggcgtgctggaagaactcagccaggcaaatgtttcagactctacactgagaaaagtttcaatgataatctccagccacagacctatccggaaatattgcgttccaaccttgctaatactgttctcactttgaaaaagcttggaattgatgatctggtgcattttgattttatggatccccctgcccctgagacattgatgagagcactagaggttttgaattacttgggagcattggatgatgatgggaatttgacaaaggtaggagaaataatgagtgaatttcctttagatcctcagttgtcaaagatgctcgttgttagtcctgaattcaactgttcaaatgagattttgtcaatttcagcgatgctttcagtacccaattgctttgtccggcctaaggaggcacaaaaagctgctgatgaagcgaaagcaagatttgggcacattgatggggatcacctcactcttctgaatgtataccatgcatacaagcagaacaatgaagatccctcctggtgctatgaaaactttgtcaatcacagggccctgaagggtgcagacaatgttaggcaacagcttgtccgtatcatggctaggtttaacctcaagttgtgcagcactgatttcaacagccgtgattactatgtcaatataaggaaagccatgcttgctggatatttcatgcaagtagctcacatggaacggacgggacactacttaaccgtgaaagacaaccaagtggtgcatttgcatccttcaaattgtctggatcataagccagagtgggtcatttataacgagtatgtcctcactagcaggaattttatccgcactgtgacagatatccgtggtgaatggttggttgatatagcaccacattactatgacctttcgaacttcccccagtgtgaagctaagcggaaacttgagaagctttacaagaagagggaggataacaagagcaaaaaatgaaccaaatttgatgtaccgtttcttaaatttgtagtgagttgaggtacttttttatcctgtaatgtaataatcgacaaatccacatttgttcttcaggtgttcttttctatatttaagaaaagggaatga

SEQ ID NO: 2617 - DNA, 2638 bp, Populus trichocarpa
aacagtactaatatataacaacacggcactaatgccctagcctcctcctcctcctatctctccatctcctgaccttttagggttctctttctccttgacaactctatttcaaatcattcaatcccaaaactgttagggtttggtcggataggatagatttggatgggtacggagaggaagaggaaggtgagtttattcgacgtggttgacgagacgtcgctttctgcaaagatcgtgaaatcgaacggggcgatgggtaacaataacaatggaggaagtagtttgataaatcggtggaatgggaagccctactcacagaggtactatgatatattagagaagaggaagaatttgcctgtttggcatcaaaaagaggatttcttacaagttttgaagaaaaatcaggctatcatccttgttggcgagactggtagtggtaaaaccactcagattcctcagtttgttttggaagctgtagacttagaatctccggataaacgtaggaagatgatgattgcatgtacccaacctcgaagggtggcggcaatgtctgtttctcgacgtgttgctgaggagatggatgttacaattggcgaagaggttggttatagcatccgttttgaagactgtagcagtgcgaaaacggttttgaagtatcttactgatggtatgcttttaagagaagcaatgaccgatccacttttggaacggtacaaagtaataattcttgatgaggcccacgaaagaactctatcaacagatgtgctattcgggcttcttaaagaagtgctgaaaaataggcctgacctgaagctagttgtaatgagtgcaacacttgaggctgagaaatttcagggttattttggtgaagcaccgcttatgaaagttcctggcaggcttcatccggttgaaattttctatacccaggaccctgagagggattacctcgaggcagcaattcgaacagttgtccagatacacttgtgtgaaccccttggagatatacttgttttcctaactggggaggaggagatagaagatgcttgccgaaaaataacaaaagaaattggaaatttgggggaccaagtggggccagtgaaagtggtgcctctatattctacgcttccaccagccatgcagcaaaaaatattcgaacctgctccacctccactgcaggagggtggcccttctggaaggaagattgtggtgtcaacaaacattgcagaaacttctttgactatagatggtattgtttatgttatcgaccctggcttctcaaaacaaaaggtttataacccacgagtgcgggttgaatctttgttagtttcccccatatcaaaggctagtgcccaccagagatcaggacgtgctggaagaactcaaccaggcaaatgttttagactctacacagagaaaagtttcaaccaggatcttcagcctcagacctatccagagatattgcggtcaaaccttgcaaatacagttctaacgttgaagaaattgggtattgatgatctggtgcactttgatttcatggatcctcctgcccctgagacattgatgcgagcattggaggtgttgaattatttgggagcattggatgatgaggggaatttgacaaagcttggggagatcatgagtgaatttcccttggatcctcagctgtcaaagatgcttgttgtgagtccagaattcaactgttcgaatgaaattctttcaatttcagccatgctttcagtacccaattgctttgtccgccctagggaggcgcaaaaggctgctgatgaagcaaaagcaaggtttgggcacattgatggggatcacctcacgctgttgaatgtgtatcacgcatataagcaaaacaatgaggatccatcttggtgctatgaaaattttgtcaatcatagagcactgaaggctgctgacaatgtaagacaacaacttgtgcgtatcatggccaggtttaacctcaagttatgcagcactgacttcaacagccgtgactactacatcaacataagaaaatctattttagccggatactttatgcaggttgctcacctggaacaaagtggacactacttgacagtgaaagacaaccaagtggtgcacctgcatccttcaaattgtttggatcacaagccggagtgggtgatttacaatgaatatgtcttgaccagccggaattatataaggactgtgctagacattcgtggggaatggttggtagacatagcaccacattactatgacttgcaaaatttcccgcaatgtgaggccaagcgggttcttgaaaagctttacaggaagcgggagagggagaaggaggagaacaggaacagaaaatgaatgtgttgactgatgagttgctggatccttccagtatttcttatccagaaactaaaagcgtggctgtccttccgaagctatccagtactaatgtgcaacacaaccacctttctggatccagttgcctggccaatctggcttgtaccatttcttcaaatagtagctttagcatttttcattttctctggacttcaagcatccacatttatttttggatgtgggattgttgccgttttaaggtttaggcgttaaacatttaaagaaaattgaaacgggtatgaatttgcta

SEQ ID NO: 2618 - DNA, 2175 bp, Ambrosia trifida
aaattagggttagggtttgtaacagcctctgctttattcaccaacaatctctaatgggtacagaacgtaaaaggaaggtaagtctgttcgacgtcgtcgacgactcatcaacggccaaattaaccaaatccaacggcgtcgataatatgtcgacggtcaacagatggaatctacgcccttattcccaacgatattacgatatattggagaagaggaaaacgttacctgtatggcatcagaaagaggagtttttaaaggccttgagagataaccaaaccctaatcttggttggtgagactggtagtggtaaaactactcagattcctcagtttgtgttggaggctgtggagttagagagtgcggataggcgtaagaagtttatggtgggatgtacgcagccgcgtagggtggctgcgatgtcggtttcccggagagttgcggaggaaatggatgttacgattggggaagaagtaggttacagcattcggtttgaagactgcagcagtgcaaaaactgttttgaaatacttgacagacggtatgttattaagagaagcgatgactgacccacttctagaaaggtataaagtgataattcttgatgaagcccacgaaagaactttggctactgatgttttattcgggctcttaaaagaagtgctgaaaaataggcctgatcttaagctggttgttatgagtgctactcttgaagctgaaaagtttcagggttatttctttggtgcaccattaatgaaagttccggggcgacttcaccctgtggaaatcttttacactcaagagcctgaacgcgactatcttgaagcagcaattcgaaccgttgtacaaattcatatgtgtgagccacctggtgatattcttgttttccttaccggcgaagaagaaattgaagacgcctgtcgaaaaataacgaaagaagtcggtaatttaggagaccaggttgggcctgtgaaagttgtcccactttattcaaccctcccaccagccatgcagcagaagatatttgagcccgctccacctccattaaccgaaggtgggcctgccggcaggaagattgtgatttcaacaaacattgctgaaacatctttaaccatagacgggatagtttatgttatcgacccgggttttgcaaagcaaaagtttataacccacgtgttcgagttgagtcgttattagtgtccccaatatcaaaggcgagtgcccaccagagatctggtcgggctgggagaacacaacccgggaagtgttttagattatacacagagaaaagttttaataatgatctacagccacagacataccctgagattcttcgatccaatttagcgaataccgttcttactttgaagaaacttggtattgatgatcttgttcattttgattttatggacccacctgctcctgaaactttgatgcgggccctagaggttttgaattatttgggagcgttggatgatgaaggaaacttgactaaattgggtgaaattatgagtgaattcccgttagatcctcagatgggaaagatgcttgttgttagccctgaatttaaatgttcaaatgaaatcctttcaatcgcggctatgctatcagtacccaattgctttgtccgcccaagagaagcccagaaggctgctgacgaggcaaaagctcgatttggacacattgatggggaccatctcacgctcttgaatgtatatcacgcctacaaacagaataatgaagatcaatcatggtgttatgagaactttgtgaatcagcgggctctcaaatctgcagataacgtgaggcagcagctaagccgcattatggcccgtttcaacctcaagctatgcagctcggattttaacagccgtgattattacatcaacatcagaaaagctatgctggcagggtattttatgcaggttgcccacttggagcgcaccggacattatttgacagtaaaagacaatcaagtggttcatttgcacccgtcaaattgtttagaccataagccagaatgggtgatttacaatgaatatgtgttgactagcaggaacttcattcgcactgttacagatgttcgtggtgaatggattgttgacattgctccacactactatgatcttgaaaacttcccgaattgcgaagcaaaacgagttcttgagaagctgtacaa

SEQ ID NO: 2619 - DNA, 2535 bp, Capsicum annuum
ggcacgaggaatctgtaaccctagttctctctttccccttttatcatcttaggttttccaccggaaacctaaaatcctagtcgccggatgggaacggagaggaagaggaaggtcagtttgtttgatgtggttgatgatacggccacaaagaaagccaatctaaccttaaatggtggaaacagtatgatggcatcttcgattaacaagtggactggaaagccttattcacagagattttatgatattttggagaagaggaagactcttcctgtttggcatcaaaaggaggagtttttacaggctttgaaatctaatcaaactcttatactcgttggtgaaactggtagtggtaaaactactcagattccacagtttgttttggatgctgttgaagtagagacagctgataagcgaaggaagtatatgattggttgtactcaacctcggagggtggctgcaatgtctgtgtctcgtcgagttgctgaagagatggatgttgtaattggggaagaagttggatatagcattcgttttgaagactgcactagtgctagaactgttttgaaatacttgacagatggtatgcttttaagagaagcaatggcagatcctctattggaacgctacaaggtaattattcttgatgaagctcatgaaagaactttggcaacagatgtcctgtttgggcttctgaaggaagttttgaaaaacagaccagacctgaagctagttgttatgagtgccacacttgaggcagagaagtttcagggttacttctatggtgcacctctcatgaaagttcctggaaggctccatccggtggaaattttctacactcaggatcctgaaagagactatcttgaggctgccattcggactgtggtgcagatacacacatgtgaacctcctggtgacattcttgtcttccttaccggagaagaggagattgaagatgcatgtcgcaaaatctcaaaagagattggtaatatgggtgatcaagtgggccccattaaagcagtgcctctttattctacacttcccccagctatgcagcaaaagatatttgaaccagccccaccaccggtggtggagggtggtcctcccggcaggaagattgttgtatcaaccaacattgcggagacatctttgacaatagatggcattgtttatgtcatagacccaggatttgctaagcaaaaggtttataacccaagggtgcgtgttgagtctttgttggtgtctcctatttcaaaggccagtgcgcaccaaagatcaggacgtgctggacgaacacagccaggaaaatgctttagactttacacggagaaaagtttccataatgatcttcaaccacagacctatccagaaatacttcggtcaaatttggctaatacagttctaactttgaagaagttaggtattgatgacctggttcattttgattttatggatcctcctgccccggagacgttgatgagagctctagaggttttaaattacttaggagcactggatgatgatggaaacatgaccaagttgggtgagataatgagtgaatttcctcttgatcctcagatggggaaaatgcttgttgtcagcccagaattcaactgctccaatgaaatcctctcaatatctgcgatgctatcagtacccaattgctttgtccggcctagggaggctcaaaaagctgctgatgaagcaaagaatcggttcggtcacatagatggggatcatttgacgttgctgaatgtgtatcacgcctataagcaaaaccaggaggatcctcaatggtgttatgagaatttcatcaatcagagggctctcaaatcagctgacaatgtgaggcaacagcttgctcgtataatggccaggttcaacctcaagttatgcagcacagacttcaacagtcgcgactactatgtgaacataaggaaggctatgttagctggttatttcatgcaggttgcacacctagagcgtactgggcattatctaactgttaaagacaatcaagtggtacacttgcatccttcaaattgcctggatcacaagccagaatgggttatatataacgaatatgtcttaacaagcaggaatttcattcgcactgtgactgatatccggggtgaatggttggttgatattgcaccacactactatgaccttgcaaattttccacaatgtgaggcaaaacgtgtgcttgaacggttatacaagaagcgggagcgagaaaaagatgaaagcaagagcaaaaaatgagtatgttcttcatgatttcagtctctctcagcatatatgtgcactcctccggagctctggggtcaaaatttgtcagataggtcaaaaattgatgtaccatcttttatgtactgtaatcatttcaatgtatcccgtctgaactatttagcaccctgtttcttgttgctggagtgatcttttttttttttcctcgtgtccagtgttctgggatattgggtcgattttttgatctctttcctctgttgaagtaaacgtacgtagcttttttgctgc

SEQ ID NO: 2620 - DNA, 2622 bp, Arabidopsis thaliana
tataattaaacttaagccgcctctctcttcttctaactcacgcagccgaaccctagctttcataaaattttcattcatcatcgttcttgcttcttgctaaaggccttgccttgtgcttcctcgtcctatctctcttacctccgtaatttgttcgtaagagaagtatcgtgatgggtactgagagaaagaggaaaattagtctgttcgatgttatggacgatccgtctgctccggcgaagaacgccaaaaccagtggtcttcccgacggcggaatcaacagtctgatcaataaatggaacgggaagccttattcacagagatattatgacattctggagaaacggaggactctacctgtctggctgcagaaagaggagtttctcaaaacgttgaacaacaatcaaaccctaattctggttggtgaaaccggtagtggtaaaactactcagattccacagtttgtgatagatgctgtggatgctgaaacatcggataagcgtaggaagtggttggttggatgcacacagcctcgtagagttgctgccatgtctgtgtcccgtcgtgttgctgaagagatggatgtaactattggggaagaagttggttacagcatccgtttcgaggactgcagtagccccagaacggttcttaagtacttgactgatggtatgctcctgagagaagcaatggcggaccctcttctagagagatacaaagtcattattcttgatgaggcccacgaaaggactctagccacagatgtgctgtttggtcttctgaaagaagtgttgaaaaatagacctgatcttaagttagttgtgatgagtgcaactctagaagctgaaaagtttcaggattattttagcggtgctcctctgatgaaagttcctggtaggcttcatccagttgagatcttttacactcaggagcctgagagggactatcttgaggctgctattagaactgttgtccagattcacatgtgtgagccacctggcgatattcttgttttcttaactggggaggaggagattgaagatgcatgccgcaaaatcaataaagaggttggtaatcttggggatcaagtggggcctattaaagtagtgccactgtattctactcttccacctgcgatgcagcagaagatatttgatcctgctccagagcctgtaacagaaggtggtcctcctgggagaaagattgttgtctccactaacattgctgagacttctctcaccatagatgggattgtctacgtcattgaccctggttttgctaagcaaaaagtctataaccctcgaatccgtgttgagtctttgttggtgtccccaatttcaaaggcaagtgctcaccagagatctggtcgtgccggtagaacacggcctggaaaatgcttcaggctttacacagagaagagttttaataatgacttgcagccgcagacgtatcctgaaatattgagatcaaaccttgcaaatacagttctgaccttgaaaaaactgggtattgatgacttggtgcactttgattttatggatccccctgctcccgaaacactgatgcgagccttagaagttttgaattacttgggagcactggatgatgatggtaacttgacaaagacaggtgagatcatgagtgagttccccttggatccacagatggcaaagatgctcatagtcagtcctgaattcaactgctcaaacgagattctctcagtttcagctatgctatcagtaccgaattgctttattcggcctagagaggctcaaaaagcagcagatgaagctaaagctaggtttggacacattgagggagatcacctcacattgttgaatgtctaccacgctttcaagcaaaacaatgaggatccaaattggtgctatgaaaacttcatcaacaatagagcgatgaaatctgcagacaatgttagacagcagctagtccggataatgtcaagattcaacctgaagatgtgcagcactgattttaacagccgcgactactacatcaacataaggaaggccatgcttgccggttatttcatgcaagtggctcacttagaacgtactggccattacttgaccgtcaaagacaaccaagtggttcatttgcatccatccaattgcttggatcacaaaccggagtgggtaatctacaacgaatatgttttgactagccggaatttcatcagaactgtgacagacattcgtggtgaatggctagttgatgttgcttctcattattacgatctttcgaactttcccaactgtgaagccaaacgtgtaatcgagaagctttataagaagagagaaagggagaaggaagagagcaagaagaaccggaaatgaaggagaatcttatcctctcatgtcggcatctgattctacttggacaagaggaccaatccgtgaagcctgtttcataattatagttacctatttgatcataagattctagcaattatcgttttcggagctgttgtgttgaaacaaatatttgcatttgacccaaatggttgtttcttttaagagctttgaagattcttattactgagttccctttcaggctttctctatgagttatgacaattagcaataataattttggaagattataatt

SEQ ID NO: 2621 - DNA, 2420 bp, Brassica napus
aagttttctcgttcgctcgttcattcattcaccatgggtacggagaggaagcggaaggttagtttgttcgacgttatggaagatccatcggcgaagaacaacaaatccaacgttctcggaggtgcggctgcgggtatcagcaatctgattaacaagtggaacgggaagccttactcgcagaggtactacgatattctcgagaagaggagagatcttcccgtttggctgcagaaagatgagtttctccggacgttgcaatctaaccagaccctgatcctcgtcggtgagactgggagtggtaaaactactcagattccacagtttgttttagatgccgttgaggctgagaacacaaataagcataagaaatggttagttggctgcacgcagcctcgtagagtcgctgcaatgtctgtttctcgtcgtgtagctgatgaaatggatgttgccattggagaagaagtcggttacagcatccgttttgaggactgtagtggccctcgtactatgctcaaatatttgactgatggtatgctgttgagagaggcaatggcggatccgcttcttgagagatacaaagttattattctcgacgaagctcacgagagaactttggctactgatgttctctttggtcttctcaaagaggttttgaggaacagacctgaccttaagctagttgtgatgagtgcaaccttggaagctgaaaagtttcaggagtattttagcggtgctcctcttatgaaagtccctggtaggcttcatccggttgagatattctacacacaggatcctgagagggactatcttgaagctgcgataaggaccgttgttcagatacatatgtgcgagccgcctggagatgttcttgttttcttaactggagaggaggagattgaagatgcctgccgtaagatcaataaagaggtcagtaaccttggagatcaagtggggcctgtcaaagttgtgcctctgtattctactctcccacctgctatgcagcagaagatttttgaccctgcaccagagccgttaacagaaggtggtcctgctggtagaaagattgttgtctcaaccaacatcgctgaaacgtctttaaccattgatgggattgtttatgttattgaccctggttttgccaagcaaaaagtctacaacccacggatccgcgttgagtcgttgttggtgtccccaatatcgaaagcaagtgctcaccagaggtcaggtcgtgctggtagaacccgccctggaaaatgtttcaggctctacacagagaagagtttcaacaatgatcttcagccgcagacgtatcccgagattttgagatcaaatcttgctaatactgtcctgacattgaaaaagttgggtatagacgacttggtgcactttgatttcatggaccctcctgctcctgagacattgatgagagcattagaggttttgaattatctgggagcattggatgatgaaggtaacttgacaaggactggtgagataatgagcgagtttcccttggatccacagatgtcaaagatgctcattgtcagccctgagttcaactgttcaaatgagattctctcagtttctgcaatgttatcagtaccgaattgctttgttcggcctagagaggctcaaaaagcagcagatgaagctaaatctaaatttggacacattgatggagatcacctgacgctgctgaacgtgtaccacgcctacaagcaaaacaatgaagacccaaactggtgttttgagaactttgtcaacaacagagcaatgaagtctgcagacaatgtgaggcagcagctagtgagaataatgtcgaggtttaatctcaagatgtgtagcacggatttcaacagtcgtgactactacgtcaatatcagaaaggccatgctgtctggttatttcatgcaggtggctcacctagaacgcactggccattacttgaccgtcaaagataaccaagtggttcacttgcatccatccaattgcctggatcacaaaccggagtgggtgatttataatgaatatgtcttgactactcgcaatttcattcgcactgttacagatgtccgcggtgactggttagtagatgttgcaccgcattactatgatctttccaacttccccaattgtgaagcaaaaagagtccttgagaagctttacaagaagagagagagggaaaggaacgagagcaagagtcgaaagtgaagagaaccagttgttggctagagaatcaaatcacgaacgcaagaagaatctctttgtcataagattatgtttcgtgtaacttatgttggaaacttggtcgtttgtttctgttacaatgaaagaatcttgcattactcaaaactttcgttctaaaatctttatgtatttgatattacaaaagctctgtttctctattcaatccagctact

SEQ ID NO: 2622 - DNA, 2349 bp, Brassica napus
tcattcaccatgggtacggagaggaagcggaaggttagcttgttcgacgttatggaagatccatcggcgaagaacaacaaatccaacgttctcggagctgcttcggcggcggctggtatcaacaaatggaacgggaagccttactcgcagaggtactacgatattctcgagaagaggagagatcttcccgtttggctgcagaaagatgagtttctccgcacgttgcaatctagccagacgctgatcctcgtcggtgagactgggagtggtaaaactactcagattccacagtttgttttagatgcggtggacgctgagaacacaaataagcataagaaatggttagttggatgcacgcagcctcgtagagtcgctgcaatgtctgtttctcgtcgtgtagctgatgaaatggatgttgccattggagaagaagttggttacagcatccgttttgaggactgtagtggccctcgtactatgctcaaatatttgactgatggtatgctgttgagagaggcaatggcggatccgcttctagagagatacaaagttgttattctcgacgaagctcacgaaagaactttggctactgatgttctctttggtcttctcaaagaggttttgaggaacagacctgaccttaagctagttgtgatgagtgcaaccttggaagctgaaaagtttcaggagtattttagcggtgctcctcttatgaaagtccctggtaggcttcatccggttgagatattctacacacaggagcctgagagggactatcttgaagctgcgataaggaccgttgttcagatacatatgtgcgagccgcctggagatgttcttgttttcttaactggagaggaggagatagaagatgcctgccgtaagatcaataaggaggtcagtaaccttggagatcaagtggggcctgtcaaagttgtgccattatattctactctcccacctgcgatgcagcagaagatttttgaccatgcacccgagccattaacagaaggtggtcctgctggtagaaagatcgttgtctcaaccaacatcgctgaaacgtctttaaccattgatgggattgtttatgttattgaccctggttttgccaagcagaaagtctacaacccacggatccgtgttgagtcgttgttggtgtccccaatatcgaaggcaagtgctcaccagaggtcaggtcgtgctggtagaactcgccctgggaaatgtttcaggctctacacagagaagagtttcaacaatgatctgcagccgcagacgtatcctgagattttgagatctaatcttgctaatactgtcctgacattgaaaaagttgggtatagacgacttggtgcactttgatttcatggaccctcctgctcctgagacattgatgagagcattagaggttttgaattatctgggagcgttggatgatgaaggtaacttgacaaggactggcgagataatgagtgagtttcccttggatccacagatgtcaaagatgctcattgtcagccctgagttcaactgttcaaatgaaattctctcagtttctgcaatgctatcagtaccgaattgctttgttcggcctagagaggctcaaaaagcagcagatgaagcaaaatctaaatttggacatattgatggagatcacctgacgcttctgaacgtgtaccacgcctacaagcaaaacaatgaagacccaaactggtgttttgagaactttgtgaacaatagagcaatgaagtctgcagacaatgtgaggcagcagctagtgagaataatgtcgaggtttaatctcaagatgtgtagcacggatttcaacagtcgtgactactacgtcaatatcagaaaggccatgctgtctggttatttcatgcaggtggctcacctagaacgcactggccattacttgaccgtcaaagataaccaagtggttcacttgcatccatccaattgcctggatcacaaaccggagtgggtgatttataatgaatatgtcttgactactcgcaatttcattcgcactgttacagatatccgcggtgactggttagtagatgttgcaccgcactactatgatctttccaacttccccaactgtgaagcaaaaagagtccttgagaagctttacaagaagagagagagggaaaggaacgagagcaagaaccgaaagtgaagagtcaaatcacgaaggcaagaagaatctctttgtcataagattatgtttgtgtaagctatgttggatacttggtcgtttgtttctgttacaatgaaagaatcttgcattactcaaaactttcgttctaaaatctttatgtatttggtattacaaaagctctgtttc

SEQ ID NO: 2623 - DNA, 2724 bp, Manihot esculenta
ggaaagttcttacacgactaatactatataagaacacgacgctcgcgccgtatcctcttcctctttttatctcttttctgcttctagggtttacggtgagcggtcccaactcccaactaccaaataccaaatctctctttcttttttctctcgattcgaatccaggtccaccgcccaatatccaatcgggttctttacagttagggtttactggatttggatgggtacggagaggaagagaaaagtgagcttgtttgatgtggtggacgagacttcgatatcggcgaagatatcgaaaatgaacggcgctggtggagcggcgatgaataacaacggaaacaataacaatttgataaatcggtggactgggaagccttattcacagaggtactatgaaatcttagaaaagaggaggactctgcctgtttggcaccaaagagaggagttcttgacggctttgaagaaaaatcaggtccttgttcttgtcggtgagactggtagtggaaaaactactcagattcctcagtttgtcttggaagctgttgacatagaaacacctgacaaacgtaggaagatgatgattggatgcacacagcctcgtagagtggctgcaatgtctgtttctcgacgtgtggcggaagagatggatgtgaatattggtgaagaagtcggttatagcatccgttttgaggattgtagcagcgcaagaacagttttgaagtatttaactgatggtatgcttttaagagaagcaatgactgatccacttttggaacgatacaaagttataattcttgatgaagctcatgaaagaactttggcaacagatgtattatttggactacttaaagaagttctaagaaatagaaatgatctgaagctagttgtgatgagtgcaacactagaggctgagaagtttcagggttattttaatgatgcacctctgatgagggttcctggtagacttcatccagtggagattttctatacccaggaacctgagagggattaccttgaggcagcaattcgtacagttgttcagatacatatgtacgaaactcctggggacatactcgttttcctcacaggtgaggaggagatagaagatgcgtgccggaaaataacaaaggaggttggaaatatgggggaccaggtgggtccagtgaaggtagtgcctctatattctactcttccacctgccatgcagcagaaaatttttgagcctgctccactcccattgactgaaggaggccctgctggaaggaagatagtagtttcaactaacatagcagaaacttctttgaccatagatggcattgtttatgttatcgacccagggtttgctaagcaaaaggtttacaatcctcgagtgcgtgttgaatccttgttggtttccccaatatcaaaagcaagtgctcatcaaaggtctggccgtgctggaagaactcagccaggcaaatgcttcagactttatacagagaaaagttttaatcaagatcttcagccacagacatatccagaaatactgcgatcgaacctagcaaatacagttctgacactgaagaaacttggaattgatgatttagtgcattttgattttatggacccgcctgctccagagacattgatgcgggcactagagatgctgaattacttgggagcattggatgatgatgggaacttgacaatgcttggagaaatcatgagtgagtttcctttggatccacaaatgggaaagatgctggtggtcagtcctgaattcaactgctcaaatgagatcttgtcaatctctgcgatgctttcagtacccaattgctttgtccgccctagggaggctcaaaaggctgctgatgaagcaaaagctaggtttgggcatattgatggggatcacctgacgctgttgaatgtgtatcatgcatacaagcagaacaatgaggattcatcttggtgctatgaaaattttgtcaaccatcgggctctcaaggctgctgataacgtgagacagcagcttgtacgcatcatggcaaggtttaaccttaagttatgcagcacagacttcaacagccgtgactactatgtcaacataagaaaggctatgctagctggatattttatgcaggtggcccacctagaacgcactgggcactacctgacagtgaaagacaatcaagtggtgcatttacatccttcgaactgtctggatcacaagccggagtgggttatttatagtgagtatgtcctgacaagccggaattttattcgaacggtgacagatattcgtggtgaatggctagtagacatagcaccacactactatgatttagccaacttcccaaattgtgaggccaagcgagttctggagaagctttatcggaagcgggagagagagaaggaagagaacaagaacagaaagtgagatgtgcacctatctgaattttttcgacttgctcgatatttcttcctcgggaacgaaattaaaacttattatgacaaaggaccctctgagcggttcccatttagccggccgagctccctgtacttgttgaaatattaggtttagattttctattgtacccttagcattccacatttatgtttggatatggctatgtggctgcattgctattcaagttcagttggacattcgaaaaaagaaccgagtttgaatgtgaacgacatctctttcccctctccctttttattttattttatttgctttttctt

SEQ ID NO: 2624 - DNA, 2735 bp, Chelidonium majus
tagaaatcgaaaccctaatttcacctcaattcatttctcgttctagggtttttattagtctctctctatagtgttagaatcgaaaccctaatttcaaattgattgcaacgaagggtttagtgttcgttctctgattgtttaagtatttgggaatttgtgttctagggtttcttcttttttggtaatctgaacttttgtttctgaaattcgaatgtcgacggagagaaagaggaaagtgagcttatttgacgtggtggacgagacctctgtctctgctaaaatccttaagatgaacggtggtggaggattggttcagaatccgcttaataacaggtggaatggaaggccttattctcaacgttactttgatattctggagaagcgtaagactcttcctgtttggcagcaaaaagaagagtttttgcaggttttgaaggctaatcagactttgattttggtgggagaaactggtagtggtaaaacaactcagattcctcaatttgttcttgaagctgttgacaatgagtatccagataaacgcaagaaaatgatgattgcatgtacccagcctcgtagagtggctgctatgtctgtttctcgtcgtgttgctgaggagatggatgtaacgattggagaagaagttggttatagcattcgttttgaagattgcagtagtgcaaaaactgttcttaagtatttaacagatggtatgcttttaagagaagctatgactgatccacttttggaacactataaggtgataattcttgatgaggctcacgaaagaactttggcaacagatgtgctatttggtcttctgaaggaagtgcttaaaaatagacccgatcttaaattggtagtgatgagtgcaactcttgaggctgaaaagtttcagaattatttcagtggtgcaccactgatgaaagttcctggaagacttcatccggtcgagatattctacacagcggaacccgagagggattatctagaagcagcaattcgaactgtggtgcagatacaccagtgtgaaggtcctggcgacatacttgttttccttactggagaggaagagatagaagatgcatgcagaaaaataaataaagaagtaggtaatctgggtgatcaagttggccctgtgaaagtagtgccactatattctacactgccgccagccatgcagcagaagatatttgaccctgcccaccccctttgaagaggggggtcctcctggaaggaagattgtggtgtcgaccaacattgcagaaacttctttgactatagacggtatagtttatgtgattgaccctgggtttgctaaacaaaaagtgtacaatcctcgagtgcgagttgaatctttgttggtctcaccaatatcaagagcaagtgctcaccagagatcagggcgtgctggaagaacacaacctgggaaatgctttagactgtacactgagaaaagttttagtaacgatcttcaaccacagacatatccagaaattcttcgatcaaatcttgcaaatactgttcttaccctgaagaaacttggaattgatgacctggttcattttgattttatggatccacctgctcctgagactttgatgcgagcattagaggtgttgaattacttgggcgcattggatgatgaaggaaacatgaccaaattgggtgagctaatgagtgacttccccttggatcctcaaatgtcgaagatgcttgttgttagtccaggcttcaactgttcaaatgagatcctctcgatttcggctatgctttcagtacccaattgctttatccggcctagggaggctcaaaaagctgcagacgaagctaaagctcggtttgcccacatcgatggggatcacctcacacttttgaacgtgtatcacgcatacaagcaaaacaatgaagatccatcatggtgttatgataattttgtcaaccagagggcaatgaagtctgctgataatgtgaggcaacaacttatgcgcatcatgaccagattcaatctcaagctatgcagcacagatttcagcagcaaagactactaccccaacataaggaaggctatgctggctgggtatttcatgcaggtcgctcaccttgaacgtactggccactatttgacagtgaaagataatcaggtggttcatcttcatccgtcgaactgtttggatcacaaacctgagtgggtcatttacaatgaatacgtgctgactagcaggaatttcattcgtacggttacagatgttcgtggagaatggcttgttgacctcgcctctcactattacgatctcgaaaactttccccaatgtgaggcgaaacgtgttttggagaggctttacaagaaaaaagacaaggatagagacgagagcaagaacaaaaaatagtgtccaacaagctcctctggtgataaccccctcctcttccttaaattacagcatggaagagggagttgctgatggatcatctttttgaatgttttcatcttaaagcatcttccaccccaaagcactcagcaagatacattcaacttaaaacgaattgaaaaagaagaaagagagttagatacttgatctcagacctgaatgacagtctatgttttcttagtttcatatgatatttaatgagataatcttattattacgtcccgtgttttattaacgattacaagtttttcttttctgaacttagaaatatgtactcttatttgaggagttggaagaaaaatgacaatt

SEQ ID NO: 2625 - DNA, 2618 bp, Fragaria vesca
ctaatttctagggtttacctatctggccaggtaaccaacaacagccccaattcatcttcgattcgggtccctgtaggatccaattgattaggttcagctgagattgatgggtactgagaggaagaggaaggtgagcttgttcgacgtggtggacgagagcacagtagcggctgcgaagatgaacaaattgaacggcggcggcggcggcgccatgaatcaaaatccgatgagcagtgtgatcaataggtggaccggaaagccatactcgcaaaggtactatgagatccttgagaagaggaagactttgcctgtttggcaccagaaggaggagttctttcaggccctcaagaaaagccagtcgctgattttggttggtgagactggtagtggtaaaaccactcagatccctcaatttgttttggaagctgttgatccgtcttcagataaaagcaggaagatggttgcttgtacccagcctcgtagggtggctgcaatgtcagtctctcgccgtgttgctgaagagatggatgttaccattggcgaagaggttggttatagcattcgttttgaagactgcagcagtgccagaacagtattgaagtatctgacagatggtatgcttttaagagaagcgatgacagatcccctgttggaacgatacagtgtaattattcttgatgaggctcatgagaggactttagcaacagatgttctgtttggtcttttgaaggaagtattgaaaaatagacctgatttgaaactggttgttatgagtgctacacttgaggctgagaagtttcagggttacttcaatggtgcaccactaatgaaggttcccggcaggcttcatcctgttgaaattttttacactgaggaacctgagagggactacctggaggcagcaattcgaactgttgtacagattcatatgtatgagactccaggagatatacttgtttttctaaccggagaagaggagatagaagatgcatgccgcaaaatcaacaaagaaatttcaaacctgggtgatcaggttggtcctgtgaaagtggtgcccttgtattcaactctccctccagctatgcagcagaaaatatttgacgctgctcctcctcccacaactgaaggaggtcctgcaggaaggaaaattgtggtgtcaactaacattgcagaaacttctcttacaatagatgggatcgtgtatgttattgatccaggtttttctaaacagaaagtttataacccacgagtgcgtgttgaatccttgttggtatctccaatttctaaggctagtgcgcatcagaggtcagggcgtgctggaagaactcagccaggcaaatgtttccgactttatactgagaagagttttcataatgatcttgtaccgcagacatatccagaaatactgagatcaaatcttgcaaatacggtgcttactttgaagaaactaggaatagatgatttggttcattttgattttatggacccccctgctccagagacattaatgagagcacttgaggttttgaattatttgggtgcattggatgacgatggtaacttgaccaagctgggtgagataatgagcgagttccctctggatcctcagatgtcaaagatgcttgttgttagccctgagttcaactgctcaaatgagattttgtcgatttctgccatgctttcagtacccaattgctttgtccggcctagggaggctcaaaaagctgctgacgaagcaaaagctaggtttggacacatcgatggagatcatctcacactgctgaacgtgtatcatgcatacaagcaaaacaatgaggatccatcgtggtgctatgagaacttcgtcaatcagagggcattgaagtctgcggacaatgttagacagcagttagtccgcattatggctcggtttaatctcaagcaatgcagtactgattttaagagtcgggactactacatcaacatcagaaaggctatgctagctgggtacttcatgcaggtggctcatctggaacgcactggtcactaccttactgtgaaggataaccaagttgtacatttgcatccatcaaattgcctggatcacaagccagagtgggtgatatacaatgagtatgtcttaacaagcaggaactttatccgcacagttacagatatccggggtgaatggctagttgatatagcaccgcactactatgatttggccaactttccccagtgtgaggctaagcgagttcttgagaagctttacaggaagcgggacgacaaggaggataacagaaacagaaaatgaagtgcttaccgttgtttctatgcctcctttccaagtaacaatggaagcagtgagaacctgtctacatactctacattacaatgctcatcaagcatttacgtctctcagcagcacaatagccgaaaggcttaccattgtttctgtaccgtcttctggagttattgagtactagtaggaagtctataatttataaaagattgaaccatgattacttttggtccttttttcatagccgagtgttcctgacttgcaaattttactctctgaagtgaaagacaatgaaaaatcgatgattaaagacttgttttaccgtacttatgagttg

SEQ ID NO: 2626 - DNA, 2444 bp, Silene vulgaris
taaattagggtaacaatcaatcaataatggggactgagagaaagaggaaggttagtttattcgacgttgttgatgagtccgccatccctggtaacaacaacaacaagcttcttaaatctaacggcaccatgttcaacgccgccgctgctaatcttaatccctccgtcaatccgtggaatctccgtccctattctgctagattcttcgagattctcgaaaagcgtaaatccttacctgtttggcagcagaagaaggatttccttgatgtcttgaagaataatcagactattatccttgttggtgaaaccggtagtggtaaaactactcagattcctcaatttgttttggaagcagttgagttagaaactgctgataaacgcaagaagatgatggtggcttgtacacagcctcgtagagttgcggcaatgtctgtctcccgtagggttgcagaggaaatggacgtaactctgggagaagaagttggttatagcatccggttcgaggactgcagcagcgcaaaaactgttttgaagtatttgacagatggtatgcttctgagagaagcaatgacagatccactcctcgagagatacaaagttatagtcctcgatgaagcgcatgagagaactttggctacagatgtgctctttggacttttgaaggaagttttgaaaaacagacctgacttgaagttggtagttatgagtgctactcttgaagccgagaagtttcaaggatattttagtgatgcacctcttatgaaagttcctggcaggctccatcccgtggagatattttacacccaagagcctgaaagagattacttagaagcagctatccggacggttgtacagatacacatgtgtgaacctgttggcgacattcttgtcttccttaccggggaggaagagatagaggatgcgtgtcgtaaaatcaataaagaagttaccaacctaggcgatcaagtcggtcctgtaaaagtagtcccgttgtactctactctccctcctgcgatgcagcagaagatatttgaagctgctccaccacctgtaaaagagggaggtcctgctggaaggaaaattgtggtgtctactaacattgcagaaacatctttgaccatcgatggtatagtttatgtcattgaccctgggttttctaaacaaaaagtatataatcctagagttcgtgtggagtcgttgttggtctctcccatatcaaaggctagtgcacatcagagagctggtcgtgcgggaagaactcaaccaggaaaatgcttcaggctttacacagagaaaagtttccacaacgacctccagcctcagacttatccagagatattacggtctaatcttgctaatacggtgcttacattgaagaaattgggcattgatgatttggtgcattttgatttcatggatcctcctgccccagagacactgatgcgagcgttggaggtcctgaattaccttggggcattggatgatgaaggtaatttgacgaagcttgggacaatcatgagtgaatttccactggaccctcagatggcgaagatgcttgttgtcagtcctgagtttaactgttccaatgaaattctttctatttcagcaatgctttcagtacccaattgctttgtgaggcctcgggaggctcagaaagctgcagatgaagcaaaagctaggtttggacacattgacggggatcacctgactctgttgaatgtatatcacgccttcaaacagaatcaggaggactcaaactggtgttacgagaattttatcaacttcagggctatgaagtcggctgaaaacgtgaggatgcagttagagcgcattatggttagatacaatctcaagtgctgcagcaccaactttaacagcagagattactatctcaacataaggaaagcgatgctagcaggatacttcatgcaagttgctcacctggaaagaacaggacactacctgaccgtgaaagataaccaagtcgttcacttgcacccttcaaattgcttggaccataagcccgagtgggtcatatacaacgaatatgtgttgaccagtcggagtttcatccgtacagttactgatattcgtggagaatggcttgttgatatagcaccacattattacgatctgataaacttccccaactgcgaggcgaaacgggttcttgagaagctgtacaaaaagcgtgagaaggatagggaagagagcaagaacaagagctaggacgattaggattgggaaacgtgtgggtgctactactcgaggaagggagctttgtttgtatggatattattacattattgaagctgcctgttccgaattttatcctatagtttgatatctattttgtaagacttggctccgtttttgaatttcgagcgtgtaatgactttaaagatatgttgaattgatttcttaacgttaagatgattgttacta

SEQ ID NO: 2627 - DNA, 2505 bp, Valeriana officinalis
tgtttggactaaaaacaactcatagattggggattcatgggttccgagagaaaacggaagatcagtttgttcgacgtggtggatgatacgtcttcactctctgccaaatccctaaagagcaacaacggtacgatgatgcctctcctcaacagatggaatggccgaccctattcgcagcgctattatgagattctcgaggtcaggaagaatctccctgtttggcaccagaaagatgagttcttgaaggtcttaaaagccaatcaaactcttattttggtcggtgaaactggaagtggtaaaactacgcagattcctcagtttgtgctggaagctatagaggtagagagtgcagataagcggaggaagttcatggttggatgtacgcagccacgaagagttgcagcaatgtctgtttctcgtcgagttgctgaagagatggatgttactatcggagaggaagtaggttatagcatccgttttgaagattgcagtagtgcaagaactgttctcaagtatttaacagacggtatgcttttaagagaagccatgacagatccgcttttggaaaggtataaagttataattcttgatgaggctcacgaaagaacgttggcaaccgatgtactgtttgggctattaaaagaagtgctaaagaacaggcctgatctgaaattagtcgtaatgagtgcaaccctagaagccgagaagttccaaggttattttaacggcgccccattgatgaaagttcctggaagacttcatccagtcgaaatattttacacccaagaaccagagagagactatcttgaagcggcgattcgaacagttgtgcaaatacatgtatctgaacctcctggcgacgtgcttgtctttctcactggtgaggaggagattgaagatgcatgtcgtaaaataacgaaagaagttggtaatatgggtgattcagtgggaccggtaaaagttgttccactatattcaacacttcctccggctatgcagcagaagatatttgacgctgctccacctccgagttttcaaggtggtccagctggaagaaagattgtggtctcgacaaacatcgccgaaacatcgttgaccatagacggtatagtctatgtgatagatccagggtttgctaaacagaaagtttataaccctcgtgtccgtgttgaatctttgctggtttcgcctatttccaaggcaagtgctcaccagaggtcgggtcgtgccggaagaacccagcctggaaaatgtttcagactttacactgagaaaagtttcaacaccgatctacagcctcagacatacccagagatacttaggtcaaatcttgcaaataccgttctcactttgaagaaactggggattgatgacctcgtccattttgatttcatggacccacccgctccagagacgctgatgagagcactggaagtgttgaattacttgggagcgttagacgatgaagggaacttgactaagttgggagagatcatgagtgaatttcctttagatcctcagatggctaagatgctcgttgtcagtgctgaattcaactgttctaatgagatcctttccatatcagctatgctatcagtacccaattgctttgtccggcctagggaggctcaaaaggcggctgatgaagctaaagcgaggtttggacacattgatggcgatcatctcacgctcttgaacgtataccacgcctacaaacagaataacgaggatcagtcgtggtgctatgagaattttgtgaaccaaagggctcttaaatctgcggacagtgtcagacagcagctagctcggatcatgtcaaggttcaacctcaagctgtgcagcacggatttcaacagcagggattactacgtcaacatcagaaaggccatgctatcaggttatttcatgcaggttgctcacttggagcgtactggccactatttgactgttaaagacaatcaggtcgttcacttgcatccatcaaattgcctggatcacaagcccgagtgggtcatatacaacgaatacgtcttaacaagtaggaatttcatccgtactgtattggatgttcgtggtgaatggttgatcgacatcgcaccacactactacgatctcgggaacttcccgaattgtgaggctaagcgtgcgattgagaagctatacaagaatcgcgaaagaaaagaggatggcaagaacaggaagtacgcttaatactgccgctccagctgaccatatactagtatttccgaagcataactagtttggagtatgaagtagcaaaagtttgtggtgtatgattactgcatttgcatttccctagttttagtatcatcatattattaaaaatcagttggtgctgtactagtatcatatgaatcctcctttttgttcctgagatcatttatttattttactgtgttcttcaacttgcaaatttcaatgaatacattaccttgttttgttgactgttctatataacgtcaatattgaattgaattacgaaaa

SEQ ID NO: 2628 - DNA, 2609 bp, Amorphophallus konjac
ccgtgtcggcgaagtgggccaaggtcaacggcgccaccgtcccgccgggcatcaaccggtggacggggcgcccctactcccagcgataccaagatatcctggagaagcggaagacgctgcccgtgtggcagcagaaggacgagttcctcagggtcgtgaaggacaaccagaccctcatcctcgttggcgagacgggaagcggcaagaccacccagattccccagtttgttttggagcttgatgaccttggcaaacgcccaatggttgcttgtactcaaccccgcagagtggctgcaatgtctgtttcccgtcgagttgcagaagaaatggatgtcacaattggggaagaagttggttacagtatccgttttgaagattgcagtagcaataaaacaattttaaagtatttaactgatggcatgcttttaagggaggcaatggcagatccacttctggaaagatacaaggtgataattcttgatgaggctcacgagcgaaccttggcaaccgatgttttgtttgggcttttaaaagaggtacttaaaaatagacctgatctgaaactagtagtaatgagtgccacacttgaagcagagaaatttcaggcttatttcagcagtgcaccactgatgaaggtacctggaaggcttcatccggtggaaattctctacacccaggatcccgagagggattacctagaagctgccattcggaccgttgtgcagatacacatgtgtgaacctcctggtgacatccttgtttttcttactggagaagaggagatagaagatgcttgcaagaaaataactaaggaagtgaataatttgggcgatcaggtgggtcttgtaaaagcagttccactgtattcaacattacctcctgcaatgcaacagaaaatatttgagcctgctccaacgccactgaaggatgatggacccccagggaggaagattgttgtgtccacaaatattgcagaaacatcattgaccattgatggtatagtatatgtgatcgaccctggattttccaagcagaaagtatataacccccggatacgtgtagaatcattgttagtctctccaatatcaaaggcaagtgctcatcaaagagcaggacgtgctggtagaacacagcctggaaaatgctttaggctctacactgagaaaagtttccataatgatcttcaaccacagacatatccagagattcttcgatcaaatttggcaaacactgttctcactttgaaaaaacttggcattgatgatctggtccattttgatttcatggatcctcctgctcctgagacattgatgcgagcattagaagtactgaactacttgggtgcactagatgatgatgggaacttgactaaattaggggaaataatgagtgaattcccattggatccgcagatgtcaaagatgcttgttgtcagtcctgagtttaattgctccaatgagatactttctgtttctgctatgctttcagtacccaattgctttctccggcctagggaggcccagaaagctgcagatgaagcgaaagctcggtttggacacattgatggggatcatcttacacttctcaatgtctatcatgcatacaagcagaacaatgaagatccttcatggtgctatgagaattttattaaccaaagaacattaaaggctgctgataatgtgaggcaacagcttgtacgcatcatggcaaggttcaacctcaaactgtgcagcacagacttcaacaaccgtgattactatgtgaacattcgcaaggctacgcttgctggttactttatgcaagtggctcatcttgagcgcacaggacattacttgacggtgaaggacaatcaggtggttcacctgcatccttcgacctgtttggatcataagccagagtgggtcatttacaatgagtttgttctgacaagtaggaatttcattcgcacggttatggatgttcgcggagaatggttggttgatatagcacctcactactttgatctgagcaatttccctccgtgtgaagcaaagcgtgttcttgaaaggctatacaataagcgtgagaaagaaaggggggacggtaagaacaggaagaccctagcttgatccgaatgccgacatgccttcttagatgccaaatcttattagaaggtgcagccgacattcctctaaattccactgttcattacgattgtattattggtgaatgatcaattgcgccacccagtgttggaccaacaccgtctgatcactgatgtgcgaatgacttggcgctgcaccgtagggacagtgatgtgcttatgccttcagagttgaaccatccggtcagcgaggtgctcatgcccgttggcttgacaagtaaaattatatgttgttcccgtgatctgtgtgctaaaaactaaacaaatgttccattaaggcactgctcctttgcttgtttttggctttaaagccatcgattttcacatttttaccaggatatgaacctgggcacttagagaagatgaggccggagtatttccctctctctctctcagccgggagctctaatgtacttttagtactgttgttacatttctccacttaattgaaattatcactgtgatt

SEQ ID NO: 2629 - DNA, 2681 bp, Pinus pinaster
ttggtaggttacggctgcaattggtaggcaggccgaaataataaaattactacagtgattcagttagggtttggtgcggtgcttgcaggacgccataaaagcagaatatttgctctgaatatttcttccattccattcggggctgtgaagatggggtcggagaggaagaggaagcttagcctgttcgatgtggtggacgaaggcgccattaccaaaaaactaaaccctaatggagtgcccggcatcaatcgctggaatgggcggccatactctcagaggtattatgagattctcgagaagagaaaaaccctccccgtatggcagcagaagcaggagtttctggatacgctggagaagaatcagaccatgattttggtcggagaaactggaagtggcaagaccacacagattcctcagtttgtggttgaggcgggatacacttcaaatcgcaaacagattgcctgtactcagcctcgtagagtggcagcaatgtctgtatctcgacgagtggctgaggaaatggatgtgacaattggggaagaagttggttacagtattcgatttgaagattgcagcagctcaaagactgttcttaagtatttgacagatggtatgcttcttagggaagcaatgactgacccattattagagcggtatagggtgatcattcttgatgaggcacatgagagaaccttggctactgatgttctttttggccttctaaaggaagttttaagaaatcgacaagatttgaagcttgttgttatgagtgctactttggaagctgaaaagttccaagcttatttcaatgttgctcctctcatgaaagtacctggcagattacatccagttgagatattctacactcaggaaccagagagggattatcttgaagcggcaattaggacagttgtacagatacatacgtgtgagacacctggggacatacttgtttttcttactggagaagaggaaatagaagatgcatgtaagaaaattacaaaagagattcagaacctgggtgatcaggttgggcctgtgaaagctgttccactctattcaaccctacccccagcaatgcagcaaaagatttttgaaccagctccaccaccattgagggaaggtggtcctcctggaagaaaagttgtggtgtcaactaacattgcagaaacttccttgacaattgatgggatagtttatgtgattgatcctggttttgcaaagcaaaaagtttacaaccctagaatacgtgtggagtctttactagtttcaccgatatcaaaggcaagtgctcatcaaagatcagggcgtgcgggtagaacacagccaggaaaatgcttcagactttatacagaaaagagtttccataatgatcttcaagcacagacataccctgagattttacgttccaatctagcaaatgtggttcttaatctgaagaagttggggattgacgacttagtacactttgactttatggacccacctgctccagaaactctgatgcgagcattggagactttgaattatttgggtgctttagatgatgagggaaatctaaccaagttgggagaattaatgagtgagtttcctttggatcctcaaatgtcaaaaatgttagttgtcagcccagaattcaactgctccaatgaaattctttccatcactgcaatgctatcagtccccaattgctttctgcggcctagggaagctcagaaagctgcagatgaagcaaaagctcggtttgcgcacattgatggagatcacctgacgctgttaaatgtgtaccacgcttataagcagaataatgaggatccaacatggtgttacgagaattttatcaatacaagagccctcaaatctgcagacaatgtgagacagcaactagtacgcataatgaacagatacaacctgaagttgtgcagcactgacttcaatagtcgtgattattatgtgaatatacggaaggcaatgctagcagggtatttcatgcatgcagcacacatggagcgtacaggccactatctaacagttaaagacaatcagatagtccatttacatccatctaattgtcttgaccacaagccagaatgggtcatatacaacgaatatgtattgacaagcaggaacttcattcgcactgtcacagatgttcgtggagagtggctgattgatatcgcaccacattattatgatttgagcaattttccgcagtgtgaggcaaggcgtgttttggagagaatctacattaagcgtgagagggagagatcagaatctaagagcaaaaacaaaagttcttaaagccgttctttctgtgaaaaggaatcagcttgagtttcagatatagtccattacagcatatgcattttaccagggtattatctgtgtatcagtgagctcaaatggtgaaaatcaaatattaaaagatattttatatctgtgaatctatttgttaagagtcttctttgacaagaatctcaattgggatatcttattgaactgaatatttcattgaaacatttgtcaaatttgactggaaagtaaatccgagatgtgttctgtatggtcttttattaaaattgttcctcagcaaatcccaaagttttcaaatgggattgtttcagcatattttctatgacaattttttgttttctggaatgacttagctgctaattgcttgc

SEQ ID NO: 2630 - DNA, 3061 bp, Pinus taeda
caattttgaagcctctcacgaccgacagaatggtacaaaatgttatcctttcaaagtgaaattcggtccaagggaaatcgaatataataactccatagtaaaacaatagaagccgggtatttatcgaagctattatggttcatctttgataaatagaagcagcacacattttcggttcctcatcggtaggttacggctgcaattggtagacagaccgaataaaattagtacagtgattcggttagggtttggtgcggtgcttgcaggacgccataaaagcagaatatttgctctgaatatttccttccattccattcggggctgtgaagatggggtcggagaggaagaggaagcttagcctgttcgatgtggtggacgaaggcgccattgccaaaaaactaaaccctaatggagtgcccggcatcaatcgctggaatgggcggccatactctcagaggtattatgagattctcgagaagagaaaaaccctccccgtatggcagcagaagcaggagtttctggatacgctggagaagaatcagaccatgattttggtcggagaaactggaagtggcaagaccacacagattcctcagtttgtggttgaggcgggatacacttcaaatcgcaaacagatcgcctgtactcagcctcgtagagtggcagcaatgtctgtatctcgacgagtggctgaggaaatggatgtgacaattggggaagaagttggttacagtattcgatttgaagattgcagcagctcaaagactgttcttaagtatttgacagatggtatgcttcttagggaagcaatgactgacccattattagagcggtatagggtgatcattcttgatgaggcacatgagagaaccttggctactgatgttctttttggccttctaaaggaagttttaagaaatcgacaagatttgaagcttgttgttatgagtgctactttggaagccgaaaagttccaagcttatttcaatgttgctccactcatgaaagtaccaggcagattacatccagttgagatattctacacccaggaaccagagagggattatcttgaagcggcaattaggacagttgtacagatacatacgtgtgagacacctggggacatacttgtttttcttactggagaagaggaaatagaagatgcatgtaagaaaattacaaaagagattcaaaacctcggtgatcaggttgggcctgtgaaagctgttccactctattcaaccctacccccagcaatgcagcaaaagatttttgaaccagctccaccaccattgagggaaggtggccctcctggaagaaaagttgtggtgtcaactaacattgcagaaacttccttgacaattgatgggatagtttatgtgattgatcctggttttgcaaagcaaaaagtttacaaccctagaatacgtgtggagtctttactagtttcaccgatatcaaaggcaagtgctcatcaaagatcagggcgtgcgggtagaacacagccaggaaaatgcttcagactttatacagaaaagagtttccataatgatcttcaagcacagacataccctgagattttacgttccaatctagcaaatgtggttcttaatctgaaaaagttggggattgacgatttagtacactttgactttatggacccacctgctccagaaactctgatgcgagcgttggagactttgaattatttgggtgctttagatgatgatggaaatctaacaaagttgggagaattaatgagtgagtttcctttggatcctcaaatgtcaaaaatgttagttgtcagcccagaattcaactgctccaatgaaattctttccatcactgcaatgctatcagtccccaattgctttctgcggcctagggaagctcagaaagctgcagatgaagcaaaagctcggtttgcgcacattgatggagatcacctgacgctgttaaatgtgtaccacgcttataagcagaataatgaggatccaacatggtgttacgagaattttatcaatacaagagccctcaaatctgcagacaatgtgagacagcaacttgtacgcataatgaacagatacaacctgaagttgtgcagcactgacttcaacagtcgtgattattatgtgaatatacggaaggcaatgctagcagggtatttcatgcatgcagcacacatggagcgtacaggccactatctaacagttaaagacaatcagatagtccatttacatccatctaattgtcttgaccacaagccagaatgggtcatatacaacgaatatgtattgacaagcaggaacttcattcgcactgtcacagatgttcgtggagagtggctgattgatatcgcaccgcattattatgatttgagcaattttccgcaatgtgaggcaaggcgtgttttggagagaatctacattaagcgtgagagggagagatcagaatctaagagcaaaaacaaaagttcttaaagccgttctttctgtgcaaaggaatcagcttgagtttcagctatagtccattacagcatatgcattttaccagggtattatctgtgtatcagtgagctcaaattgtgaaaatcaaatattaaaagatattttatatctgtgaatcgttaagagtcttctttaacaagaatctgaaatgggatatcttattgaactgaatatttcattgaaacatttgtcaaatttgactggaaagtaaatccgagatgtgttctgtatggtcttttattaaaaattgttcctcagcgaatcccaaagttttcaaatgggattgttttcagcatattttctatgacaatttttttcttttcttttctggaatgccttagctgctaatttgcttgcactctttttgcttgtattctgaaattctataagacaacacggatttcctgtacttgccattagcacaaaggatgaacacggctgtaaatatcttgtattcgccattagatgctgtaattcggatattatttggaagaactatagtggaatacatccttagcctgagagtttagctgtccaaaaaaaaaaaaaaaaaa

SEQ ID NO: 2631 - DNA, 2612 bp, Populus trichocarpa
cagtacactctcgccctagcctcctatcatctgtctctctttttaacatttaagggttttctttctttcacggtaataattcgatcccataatcgctagggttttttggatgatgggtacagagaggaagaggaaggtgagtttgtttgacgtggtagacgaggcgtcggtttctgcaaagttgttgaaatcgaacggagcgacgaacaacaataacaatgaaggaagcagctcgataaatcggtggaacgggaagccttactctcagagatactacgagatattagagaagaggaagaatttgcctgtttggcatcagaaagaggattttttacaggttttgaagaaaaatcaggttctcgtccttgttggtgagactggtagtggtaaaactactcagattcctcagtttgttttggaagctgtcgaattagaatcttcagatagacgcaggaaaatgatgattgggtgtacccagcctcgaagggttgctgcaatgtctgtttctaggcgtgttgctgaggagatggacgttactataggtgaagaggttggttatagcatccgttttgaagactgtagcggtgcaagaacggttttgaagtatctgactgatggtatgcttttaagagaggcaatgacagatccgcttttagaaaggtacaaagtaataatacttgatgaggctcatgaaagaactctagcaacagatgtgctatttggacttattaaagaagtgctgaaaaataggcctgacctgaagctagttgtaatgagtgcaacactagaggctgagaaatttcagggttatttttgtgaagcacctcttatgaaagttcctggcaggcttcatcctgttgagattttctatacccaggaacctgagagagattacctagaggcagctattcggacagttgtccagatacacttgtgtgaaccccatggggacatacttgttttcctaactggtgaggaggagatagaagatgcttgccgaaaaataacaaaagaaattggaaatttaggggaccaagtagggccagtgaaaatagtgcctctatattctacgcttccaccggccatgcagcaaaaaatatttgaacctgctccacctccactacaggagggtggcccttctggaaggaagattgtggtgtcaacaaacattgcggaaacttctttgactatagatggtattgtatatgttattgaccctggtttttctaaacaaaaggtttataacccccgagtgcgggttgaatctttgttagtttcccccatatcaaaggctagtgctcaccagagatcaggacgtgctggaagaactcaaccaggcaaatgttttagactctacacagagaggagtttcaatcaggatctccagccacagacctttccagaaatattgcggtcaaaccttgcaaatacagttctaacgttgaagaaattggggattgatgatctggtgcactttgatttcatggatcctcctgcccctgagacattgatgcgagcattggaggtgttgaattatttgggggcattggatgatgaggggaacatgacaaagcttggggagatcatgagtgaatttcccttggatcctcaactgtcaaagatgctcgttgtgagtcctgaattcaactgttcgaatgaaattctttcaatttcggccatgctttcagtacccaattgctttgtccgccctagggaggctcaaaaggctgccgatgaagcgaaggctaggtttgggcacattgatggggatcacctcacgctgttgaacgtataccatgcatttaagcaaaacaatgaggatccatcctggtgctatgaaaattttatcaatcatagggcattgaaggctgctgacaatgtaagacaacagcttgtccgtatcatggccaggtttaatctcaggttatgcagcactgacttcaacagccgcgactactacatcaacataagaaaagctatattagccggatactttatgcaggttgctcaccttgaacgatctggacactatttgacagtgaaagacaaccaagcggtgcatttgcatccatcaaattgtttggatcacaagccagagtgggtgatttacaacgagtatgtcctaaccagcaggaattatattcggaccgtgctagacattcgtggtgaatggttggtggacatagcatcacattactatgacttggataacttcccacaatgtgaggccaagcgggttcttgaaaagctttacaagaagcgggagagggagagggaggacaacaagaacagaaaatgaatgctccatgagttgctggacccttccagtttttcttgtctagaaaagaaaagtgcggttgttctttagaagctatttagtactcttctgcgatacaactgcctttatggatccagttgctttggccaagttggcctgtaccatttcttcaattagtagcttttgtatcgtcatttttattgtgttttaagcctccacatttgtttttggatgtggaatcgttgcagtctatgatatttatttactcgggaagcactcgatcaaatttgtgttacctgcttactgattaattgcaaaaccttgtgctttgatt

SEQ ID NO: 2632 - DNA, 2638 bp, Centaurea maculosa
  misc_feature (342)..(342): n is a, c, g, or t
  misc_feature (389)..(389): n is a, c, g, or t
  misc_feature (401)..(401): n is a, c, g, or t
  misc_feature (438)..(438): n is a, c, g, or t
  misc_feature (539)..(539): n is a, c, g, or t
  misc_feature (542)..(542): n is a, c, g, or t
  misc_feature (563)..(563): n is a, c, g, or t
  misc_feature (566)..(566): n is a, c, g, or t
  misc_feature (581)..(581): n is a, c, g, or t
  misc_feature (725)..(725): n is a, c, g, or t
  misc_feature (929)..(929): n is a, c, g, or t
  misc_feature (1000)..(1000): n is a, c, g, or t
  misc_feature (1016)..(1016): n is a, c, g, or t
  misc_feature (1126)..(1126): n is a, c, g, or t
  misc_feature (1231)..(1231): n is a, c, g, or t
  misc_feature (1698)..(1698): n is a, c, g, or t
  misc_feature (1779)..(1779): n is a, c, g, or t
  misc_feature (1785)..(1785): n is a, c, g, or t
  misc_feature (2209)..(2209): n is a, c, g, or t
  misc_feature (2269)..(2269): n is a, c, g, or t
  misc_feature (2330)..(2330): n is a, c, g, or t
  misc_feature (2442)..(2443): n is a, c, g, or t
  misc_feature (2449)..(2449): n is a, c, g, or t
  misc_feature (2455)..(2455): n is a, c, g, or t
  misc_feature (2457)..(2457): n is a, c, g, or t
  misc_feature (2484)..(2484): n is a, c, g, or t
  misc_feature (2486)..(2486): n is a, c, g, or t
  misc_feature (2517)..(2517): n is a, c, g, or t
  misc_feature (2537)..(2537): n is a, c, g, or t
acggattacccgggatctcaaattagggtttctgtctttcttcttcttctctccctcttaggggaatagaattcctgcaaacccccaaaaaattagggatttcctccataaccacaaagctagggttaattacaatgggcacagaaaggaaacggaaggtcagcttgttcgacgtcgtcgacgaagccaccgccaccgccaaggttaacaaagccaacggcggcgttgccgtccacggcatcaacaccaccgccgccgccgccggcgccggcatgccgttggtaaacaggtggaatggacgcccttactcgcagaggtattacgatatcttggagaagaggnaaaccctaccggtttggcatcagaaagaggagtttttgaaagcgttnaaggataatcanacgcttatcttagtcggtgaaaccggtagtggtaaanctacacagattcctcaatttgtgttggaagctgttgaggtagagagtgcggataggcgtaagaagttcatggttggttgcacgcagcctcgtagggtggcngcnatgtcggtttctcgtcgtgtngcngaggagatggatgtnacgattggtgaggaagtaggttacagcattcgttttgaagattgcagcagtgctagaaccgtattgaagtacttgacggacggtatgcttctgagagaagccatgacagatccacttctcgagaggtataaagtgataattctngacgaagctcacgaaagaacgttggctactgatgttttgtttgggcttctaaaggaagtgctgaaaaacagacctgatcttaagctagttgttatgagtgctactcttgaggctgaaaagtttcagggttatttctttggtgcaccgttaatgaaagttccaggaagacttcatcctgtcgaaattttctatacccaagagccngaaagggactaccttgaagcagctattcgaacggttgtacagatacatatgtgtgaacctcctggtgatancctcgtttttcttacnggagaggaggaaatagaagatgcatgccgtaagataacaaaagaagttgctaatatgggagaccaggtggggccggtaaaagttgttcctttgtattcacactacctccngctatgcagcagaagatatttgaacctgctccatctccgacaacagagggcggtcctgctggtcggaagattgtcatttcaaccaacattgcagaaacctctttnaccatagatggcatagtttatgtcatagaccctggttttgccaagcagaaagtctataatccacgtgtgcgtgttgagtctttgttggttagtccaatatcaaaggcaagtgctcaccagagatcaggtcgtgctggaagaacataaccgggtaaatgtttcagactgtacacagagagaagtttcaacaacgatcttcagccgcagacttacccagagattcttagatccaaccttgcaaatactgttctcactctgaagaaacttggtatagatgatctcgtccattttgatttcatggaccctcctgctccggagactttgatgcgtgcactagaggttttaaattacttgggagcattggatgatgaagggaatttgacaaagttgggtgaatttgagtgatttcccctagatccccagatggggaagatgcttgttgtgagcgctgagttcaactgttcgantgaaattctttctatctcagctatgctatcagtacccaattgctttgtccggcctagagaagctcagaaggctgcagacgnggcaanagctcgatttggacacattgatggggatcaccttacgctgttgaacgtgtatcacgcatacaagcaaaataacgaggatcaatcatggtgttacgagaactttgtaaatcatagagcacttaagtctgcagataacgtgaggcaacagctagctcgtattatggccaggttcaacctcaagttatgcagcacagattttaacagccgtgactactacatcaacattagaaaagctatgttagcaggctacttcatgcaggttgcccatttggagcgtactgggcattatttgaccgtgaaagacaatcaagtagtccatttgcacccatcaaattgtttggaccacaagccagaatgggttatctacaatgaatacgtcttaacaagcagaaatttcatacgcactgttacggatgtgcgtggngaatggattgtcgatattgccccacattactatgatcttgaaaacttcccccaatgtgangcaaaacgcgttctggagaagctctacaagaaacgagaaaaggacaaggaggagagcaganaccgaagatagaaccctcacttcactcggtcactcactcgggttctgcattttcacaaatcacttatatctacttgagatttgagatcatcaatcaaaactatgaaataccnnattcancaatgngnatgtggacaccaactgtttgttcttcnangttattggagggttgcaatactacttatcancatcatgtatctgagtttancaacagttgttggttcagtatgaatgaattgaataatcatctttaaacctcattccatgttttgtttgtttgggtttcttacaattcgcacaataaagaaa

SEQ ID NO: 2633 - DNA, 2868 bp, Brassica rapa
ccaaaccctagacttttcataatttatcccattcatcgttctgctgctacttcctcttcgacgtcatgggtaccgagagaaagaggaaagtcagcttattcgatgtcatggacaatccatcagctccgaaggtcgccaaattcaatggtctcgttgactgtgggatgaacaaatggaacggcaagccgtattcagctaaatactacgagattctcgagaaacggaggactctgccagtgtggttgcagaaagaggagtttctcaaaacgttaaaagacaatcaaacgataattcttgttggagagactggtagtggtaaaaccactcagattccacagtttgttattgatgctgtggatgctgagagttcggataggaagtggttggttgcttgcacacagcctcgtagagttgcagccatgtctgtctcccgccgtgttgctgatgagatggatgttgctattggagaagaagttggttacagcattcgtttcgaggactgtagcagccccagaacggtcctcaagtacttgactgatggtatgctactgagagaagcaatggcggacccgcttctagagagatacaaagttattattctcgacgaggctcacgagaggactctcgccacggatgtgctctttggtcttctgaaagaggtgttgaggaatagacctgatctcaagctggttgtcatgagtgcaactctggaagccgaaaagtttcaggagtattttagcggcgcgcctctgatgaaggttcccggtaggcttcaccccgtggagatcttctacactcaggagcctgagagagactacctcgaggctgctattaggactgttgtccagatacacatgtgcgagcctcctggtgatattcttgtcttcttaaccggagaggaggagatcgaagacgcatgccgcaagatcaacaaagaggtcggtaatctcggggatcaagtggggcctgtcaaggtcgtgccactgtactccactctcccaccagcgatgcagcagaagatattcgatgctgctcctgagcctgtgacaaaaggtggtcctcctgggagaaagattgttgtgtcgactaacattgccgagacttccttaactattgatgggattgtctacgtcattgaccctggcttcgctaagcagaaagtctacaacccgcgtatccgtgttgagtcgttgcttgtgtctccgatatcaaaggcgagcgctcaccagagatcaggtcgtgccggtagaacacggcccggaaagtgtttcaggctttacacggagaagagtttcaacaatgacttgcagccgcagacgtatcctgagatattgagatcgaaccttgcgaacacggtgctgacactgaagaaactggggatagacgacttggtgcactttgattttatggacccccctgcgcctgagacactgatgcgagccttggaggttttgaattatttgggagcgctggatgatgaaggaaacttgacgaggacgggtgagataatgagcgagttccccttggatccacagatggcgaagatgctcatagtgagtcctgagttcaactgctcaaacgagatcctctccgtttcagcaatgctatcagtacccaattgctttctacggcctagagagtatcaaaaagcagcagatgaagctaaagccaagtttggacacattgatggagatcacctcacgttgctaaacgtctaccatgcttttaagcaaaacaatgaagatccgaactggtgctacgagaactacatcaacaacagggcaatgaagtctgcggacaatgttagacagcagcttgtgaggataatgtcaaggttcaatctgaagatttgcagcactgatttcaacagccgcgactactacatcaacataagaaaggccatgcttgctggttatttcatgcaagtggctcacctagaacgtgctgggagttacttgaccgtcaaagataaccaagtggttaatttgcatccatccaattgcttggatcacaaaccggagtgggttatctacaacgagtatgttttgactaccaggaactacatcagaactgtgacggacattcgcggtgaatggctagtagacgttgctcctcactattacgatcttaccaacttccccaactgtgaggcgaaacgtgtcctcgagaagctttataagaagagagagagggagaaggcagacagcaagaaccgcaagtgaaaggatcatcatcatcatcccatattctctgagacatgtcaacatctgatgttttgtctttactgaaacgtttgtttacttttaaagatttctattcgcgattgattttcatatgttatcaatgaatctgattatttaagagaccagacacacaaacgtttttacttaaattagtcgaaatcattatacgaacatacagagaagtcaaatagctttattacaaaaacattttagattatattagcttattgtgtaatttattattaccatggggaagttacagtttccctaaactccttctccacattctgaaccttttggtcgagaatctctgcgtgggactgcatcagagctatctccttatcctttgtaactttctcttgcttgaccaatactagttgtctctgcaactcaacaatcttctttggcaattcttcaatatcttcttccagcttccttcttttgttatcattctctgtgatctctctctcagcaacttttaactcttccaacgcccacgtctggctttctttaacggacagcagcttgtctatccgagaacaaggtgcggtaacatcgaacccgtgttcctctagcttgagaaaacactctttgatcctgtttatctcagtcactgaatcgtcca

SEQ ID NO: 2634 - DNA, 2658 bp, Pseudotsuga menziesii
ggctgcatttcgcaggcagcacggaataactacaacaatgatagcatagagatccagttagggtttgacgcggttcttgcaggacgccataaaaaccagaatatttggtctgaacattttcttctattccatttggggttgaatattttcttccattccattttggggttttgaaaaatggggtcggagaggaagaggaagttgagcctgttcgatgtggtggacgaaagtgcccttgccaagaagatcaacctaaatggagtgcccggcatcaatcgctggaatgggcggccatactctcagaggtattatgagattctcgagaagagaaaaacccttcctgtatggcagcagaagcaggagtttctggacacgctggagaagaatcagaccatgattctggtcggagagactggaagtggcaagaccacacagattcctcagtttgtggttgaggcaggatacacttcaaaccgcaaacagattgcctgtactcagcctcgtagagtggcagcaatgtctgtttctcgacgagtggctgaagaaatggatgtgacaattggagaagaagtcggttacagtattcgatttgaagattgcagcagctcaaagactgttcttaagtacttgactgatggtatgcttcttagggaagcaatgactgacccattattagagcggtatagagtgatcattcttgacgaggcacatgagagaaccttggctactgatgttctttttggccttctaaaggaagttttaagaaatcgacaagatttgaagcttgttgttatgagtgctactttggaagctgaaaagttccaagcttatttcaatgttgctccactcatgaaagtaccagggagattacatccagttgagatattctacacccaggaaccagagagggattaccttgaagcagcaattaggacagttgtacagatacatacatgtgagacacctggggacatacttgtttttctcactggggaagaggaaatagaagatgcatgcaaaaaaattacaaaagagattcagaacctgggtgatcaggttgggcctgtgaaagcagtcccactctattcaaccttacccccagcaatgcagcaaaagatttttgaatcagctccaccaccattaaaggaaggtggtcctccgggaagaaaagttgtggtgtcaacaaacattgcagaaacatccttgacaattgatgggatagtttatgtgattgatcctggttttgccaagcaaaaggtgtacaaccctagaatacgtgtggaatctttactagtttcaccaatatcaaaggcaagtgctcatcaaagatcagggcgtgcaggtcgtacacaaccaggaaaatgctttagactttacacagagaagagtttccataatgatcttcaagctcagacatacccagagattttacgttccaatctagcaaatgtggttcttaatttgaaaaagttggggattgatgatttagtacactttgactttatggacccacctgccccagaaactctgatgcgagcattagagacattgaattatttgggtgctttagatgatgatggaaatttaacaaagttgggagaattgatgagtgagtttccattggatcctcagatgtctaagatgttggttgtcagcccagaattcaactgctccaatgaaattctttccatcactgcaatgctatcagtccccaattgctttctccggcctagagaagcccagaaagctgcagatgaagcaaaagctcggtttgcgcacatcgatggagatcatctgacgctgttaaatgtgtaccatgcttataagcagaatagtgaggatcctacatggtgttatgaaaattttatcaatacaagagccctcaaatctgcagacaatgtgagacagcaacttgtacgcataatgaacagatacaacttgaagttgtgcagcactgacttcaatagtcgtgattattatgtgaatatacggaaggcaatgctagcaggatatttcatgcatgcagctcacatggagcgtacaggccactatctaacagttaaagacaatcagatagtccatttgcatccttctaattgtcttgatcacaagccagaatgggttatatacaatgaatatgtattgacaagtaggaacttcattcgtactgtcacagatgttcgtggagagtggctcattgatattgcacctcattattatgatttgagcaatttccctcagtgtgaggcaaggcgtgttttggagaggatttacattaagcgtgagagggagaaagcagaatctaagaacaaaagcaaaagttcttaagtcagttccctctgtgcaaaggaatcagcttgagtttgagataaaatccattacagcataagcttttttccagggttttgtctgtgtgtatcattgagctctaatagccaagatcaaattttaaaagatattatatatcagtgaatctaatttgtgaagatccggattcctttgttaaaatctttctttgtgaagaatctgaaattggatatgttacttaccgaactgaaatgttctattgaaacatctctgtcaaatttggctggcaagtaaaaccgagatgtatactgtatggtcttttattgaaaacttttcatgagcgtatccccg

SEQ ID NO: 2635 - DNA, 2378 bp, Brassica napus
ccctaagacttttcataatttatcccattcatcgttctgctgctacttcctcttcgacgtcatgggtaccgagagaaagaggaaagtcagcttattcgatgtcatggacaatccatcagctccgaaggtcgccaaattcaatggtctcgttgactgtgggatgaacaaatggaacggcaagccgtattcagctaaatactacgagattctcgagaaacggaggactctgccagtgtggttgcagaaagaggagtttctcaaaacgttaaaagacaatcaaacgataattcttgttggagagactggtagtggtaaaaccactcagattccacagtttgttattgatgctgttgatgctgagagttcggataggaagtggttggttgcttgcacacagcctcgtagagttgcagccatgtctgtctcccgccgtgttgccgatgagatggatgttgctattggagaagaagttggttacagcattcgtttcgaggattgtagcagccccagaacggtcctcaagtacttgactgatggtatgcttctgagagaagcaatggcggacccgcttctagagagatacaaagtgattattctcgacgaggctcacgagaggactctcgccacggatgtgctctttggtcttctgaaagaggtgttgaggaacagacctgatctcaagctggttgtcatgagtgcaactctggaagccgaaaagtttcaggagtattttagcggcgcgcctctgatgaaggttcctggaaggcttcaccccgtggagatcttctacactcaggagcctgagagagactacctcgaggctgctattaggactgttgtccagatacacatgtgcgagcctcctggtgatattcttgtcttcttaaccggagaggaggagatcgaagacgcatgccgcaagatcaacaaagaggtcggtaatctcggggatcaagtggggcctgtcaaggtcgtgccactgtactccactctcccaccagcgatgcagcagaagatattcgatgctgctcctgagcctgtgacaaaaggtggtcctcctgggagaaagattgttgtgtcgactaacattgccgagacttccttaactattgatgggattgtctacgtcattgaccctggcttcgctaagcagaaagtctacaacccgcgtatccgtgttgagtcgttgcttgtgtctccgatatcaaaggcgagcgctcaccagagatcaggtcgtgccggtagaacacggcccggaaagtgtttcaggctttacacggagaagagtttcaacaatgacttgcagccgcagacgtatcctgagatattgagatcgaaccttgcgaacacggtgctgacactgaagaaactggggatagacgacttggtgcactttgattttatggacccccctgcgcctgagacactgatgcgagccttggaggttttgaattatttgggagcgctggatgatgaaggaaacttgacgaggacgggtgagataatgagcgagttccccttggatccacagatggcgaagatgctcatagtgagtcctgagttcaactgctcaaacgagatcctctccgtttcagcaatgctatcagtacccaattgctttctacggcctagagagtatcaaaaagcagcagatgaagctaaagccaagtttggacacattgatggagatcacctcacgttgctaaacgtctaccatgcttttaagcaaaacaatgaagacccgaactggtgctatgagaactacatcaacaacagggcaatgaagtctgcagacaacgttagacagcagctggtcaggataatgtccaggttcaatctgaagatttgcagcactgatttcaacagccgcgactactacatcaacctaagaaaggccatgcttgccggttatttcatgcaagtggcgcacctagaacgcgctgggagttacttgaccgtcaaagataaccaagtggttaatttgcatccatccaattgtttggatcacaaaccggagtgggttatctacaacgagtatgttttgactacaaggaactacatcagaactgtgacggacattcgcggtgaatggctagtagacgttgctcctcactattacgatcttaccaacttccccaactgtgaggcgaaacgtgtcctcgagaagctttataagaagagagaaagggagaagactgacagcaagaaccgcaagtgaaaggatcatcatcatcctatattctctcagacatgtcaacatctgatgttttgtctttactgaaacgcttgtttacttttaaagatttctattcgcgattgattttcaaatgttatcagtgaatctgattatttaagagaccagacacacaaacgttttt

SEQ ID NO: 2636 - DNA, 2593 bp, Mimulus guttatus
gcttctcttctgttggccaaagggagttggatattagtttccccttttccaatttgattgagaaatatttgacagatggggacggagaggaagaggaaggtgagcctgttcgacgtagttgacgatacggcgttacaggggaagatgcccagggccaatggattcggcggcgcggcacttcccgaaaacgttaatccgtggaacggaaagcagtactcccagagatattttgagattttggagaagaggaagtctctccccgtgtggcaccagaaagatgagttctttcaggccctcaaagccaatcaaaccctaattcttgtcggtgaaactggaagtggtaaaaccactcagattccccagtttgtcctggaggctataaagagtgagactatggataagggcaagaagttcatggttggatgcactcagcctagaagagtggccgcaatgtctgtttcaagaagggttgccgaagagatggatgtggcaatcggcgaggaagtaggttatagtattcgttttgaggattgtagcagtgcacgaactgttttaaagtatttaacggatggtatgcttttgagagaagccatgaccgatccactcttggagagatacaaagtgataatacttgatgaggctcatgagagaaccttggcaacagatgttctttttgggcttctgaaggaagtgttgagaaacaggcccgacatgaaagtagtcgttatgagtgccaccctggaggctgaaaagtttcaagggtattttagtggtgcaccactcatgaaagttcctgggagacttcatcccgttgaaattttctataccgagaatcctgagagggattacctagaagctgctataaagactgtttatcagatacatacttctgaacctcctggtgatatactggttttccttactggtgaagaagaaatcgaagatgcgtgtagaaagatagggaaggagatagctaaggatggggatcaagcaggaccagttaaaatagtacctttgtattccactcttcctccagcaatgcaacagaagatttttgaagctgcccccccacctgccaaggagggtggtccagcaggaaggaagattgttatttcaacaaacattgccgaaacatcattgacaattgacggtatagtttacgtcatagaccccggatttgcaaaacaaaaggtttataatccacgaattcgtgtcgagtctttattggtatctcctatttcgaaggctagtgcccaccaacgttcgggacgtgctggaagaacgcagcctgggaagtgtttcaggctctacactgaaaagagcttccataacgaccttgtacctcagacctatccagagatattgcggtcaaaccttgcaaacactgtcttaactttgaaaaagcttggaatcgatgatctcgtccattttgatttcatggatccacctgctccagagacactgatgagagcgttggaggtcttgaattacttgggagcgcttgatgatgaggggaacttaaccaagttgggtgaaatcatgagcgagtttcccttggatcctcagatgggcaaaatgctggttgtcagtccagagtttaattgttccaacgagattctctctatatctgctatgctttcagtacccaattgctttatccggcctagggatgctcaaaaagctgccgatgaagcaaaagctcggttcggtcacgttgatggggatcacctcactctactgaatgtataccatgcatacaaacaaaataaggaagatccacagtggtgctatgataattttgtcaatcatagggcaatgaaatcggcagacaatgtcaggcagcagttagctcggattatggccagattcaatctgaagctatgcagcacagatttcagtagccgtgattactatgtcaatatcaggaaggctatgctagctggatacttcatgcaggttgcccatttagagcacagcggccattatctgaccgtaaaagacaaccaagttgttcacttgcacccttcaaattgcttggaccataagccagagtgggtcatctacaatgaatatgtactaacaagcaggaatttcatccgtacagtaacggatattcgtggtgaatggttggttgacattgcaccacattactatgacctctcaaatttccccaattgtgaggcaaaacgccaactggagaaactgtacaagaagcgggaaaactccagggatgagagcaggaatcgcaagtgaagagagtgagtgagagaaagtgagagagagatgaatttaaagtttaaagaatggtgattgtgtgttcacctatccggttaattggtttgtatggattcataaattatgcttgattatctatataagcttttaagttggaagataaatcacttctctaacatgaaaattgttggtcttgtactcttgttggcaaaatgattgaatttccatcattcttacattggtttaaatacacattattgtcagcttgtagttttttacttggtatattagagtcactttgcaaattagacttctttttccaaaagtagttcgccaaatatcaatgatataatttttt

SEQ ID NO: 2637 - DNA, 2761 bp, Mimulus guttatus
cgaactcaaaccctaatcgctctttctgcttctcttctgttggccaaagggagttggatattagtttccccttttccaatttgattgagaaatatttgacagatggggacggagaggaagaggaaggtgagcctgttcgacgtagttgacgatacggcgttacaggggaagatgcccagggccaatggattcggcggcgcggcacttcccgaaaacgttaatccgtggaacggaaagcagtactcccagagatattttgagattttggagaagaggaagtctctccccgtgtggcaccagaaagatgagttctttcaggccctcaaagccaatcaaaccctaattcttgtcggtgaaactggaagtggtaaaaccactcagattccccagtttgtcctggaggctataaagagtgagactatggataagggcaagaagttcatggttggatgcactcagcctagaagagtggccgcaatgtctgtttcaagaagggttgccgaagagatggatgtggcaatcggcgaggaagtaggttatagtattcgttttgaggattgtagcagtgcacgaactgttttaaagtatttaacggatggtatgcttttgagagaagccatgaccgatccactcttggagagatacaaagtgataatacttgatgaggctcatgagagaaccttggcaacagatgttctttttgggcttctgaaggaagtgttgagaaacaggcccgacatgaaagtagtcgttatgagtgccaccctggaggctgaaaagtttcaagggtattttagtggtgcaccactcatgaaagttcctgggagacttcatcccgttgaaattttctataccgagaatcctgagagggattacctagaagctgctataaagactgtttatcagatacatacttctgaacctcctggtgatatactggttttccttactggtgaagaagaaatcgaagatgcgtgtagaaagatagggaaggagatagctaaggatggggatcaagcaggaccagttaaaatagtacctttgtattccactcttcctccagcaatgcaacagaagatttttgaagctgcccccccacctgccaaggagggtggtccagcaggaaggaagattgttatttcaacaaacattgccgaaacatcattgacaattgacggtatagtttacgtcatagaccccggatttgcaaaacaaaaggtttataatccacgaattcgtgtcgagtctttattggtatctcctatttcgaaggctagtgcccaccaacgttcgggacgtgctggaagaacgcagcctgggaagtgtttcaggctctacactgaaaagagcttccataacgaccttgtacctcagacctatccagagatattgcggtcaaaccttgcaaacactgtcttaactttgaaaaagcttggaatcgatgatctcgtccattttgatttcatggatccacctgctccagagacactgatgagagcgttggaggtcttgaattacttgggagcgcttgatgatgaggggaacttaaccaagttgggtgaaatcatgagcgagtttcccttggatcctcagatgggcaaaatgctggttgtcagtccagagtttaattgttccaacgagattctctctatatctgctatgctttcagtacccaattgctttatccggcctagggatgctcaaaaagctgccgatgaagcaaaagctcggttcggtcacgttgatggggatcacctcactctactgaatgtataccatgcatacaaacaaaataaggaagatccacagtggtgctatgataattttgtcaatcatagggcaatgaaatcggcagacaatgtcaggcagcagttagctcggattatggccagattcaatctgaagctatgcagcacagatttcagtagccgtgattactatgtcaatatcaggaaggctatgctagctggatacttcatgcaggttgcccatttagagcacagcggccattatctgaccgtaaaagacaaccaagttgttcacttgcacccttcaaattgcttggaccataagccagagtgggtcatctacaatgaatatgtactaacaagcaggaatttcatccgtacagtaacggatattcgtggtgaatggttggttgacattgcaccacattactatgacctctcaaatttccccaattgtgaggcaaaacgccaactggagaaactgtacaagaagcgggaaaactccagggatgagagcaggaatcgcaagtgaagagagtgagtgagagaaagtgagagagagatgaatttaaagtttaaagaatggtgattgtgtgttcacctatccggttaattggtttgtatggattcataaattatgcttgattatctatataagcttttaagttggaagataaatcacttctctaacatgaaaattgttggtcttgtactcttgttggcaaaatgattgaatttccatcattcttacattggtttaaatacacattattgtcagcttgtagttttttacttggtatattagagtcactttgcaaattagacttctttttccaaaagtagttcgccaaatatcaatgatataattttttatttcttaatttttatttattttttaaattttgtaatctagtttaagatgaattttttatgtattatgtgtgatcaataaaagccaatgtgtatttgcagtaaaattctgtttatgatatctagggttattttttgttttc

SEQ ID NO: 2638 - DNA, 2602 bp, Euphorbia peplus
tctcaaactccgttattctagattcggatccaagtcaacgatccgattagggttttggatgggtacggagaggaagaggaagctcagtttgttcgacgtcgttgacgagacctccgtctcgaagatcaccagagccaccggttggggagtcgcagctccgcccccgatcatgaatatcaacggaatcgccaacggtaacattaaccgctggaacgggaggccctattcccagcgctattatgatattttggagaaaaggaagactttgcctgtttggcaacaaaaggacgagtttttgaaggttttgagtgctagtcaggttgttgttcttgtcggtgagaccggtagtggcaaaactacgcagattcctcaatttgttttggaagcagcggagatagagacgcctgatagacgtaggaagatgatgattgcgtgtacccagcctcgtagagtggctgcgatgtctgtttctcgacgtgttgctgatgagatggatgtcactattggtgaagaggttggttacagtattcgttttgaagactgtagcggtccgaaaacagttttgaagtaccttactgatggtatgctcttgagagaggcaatgactgatccacttttggaacgatacaaagtaatagtccttgatgaagcccatgaaagaacgttggctacggatgtgctatttggacttcttaaagaagtgctaaggaatcgacctgatctgaagctagttgttatgagtgcaactctagaggctgagaaatttcagggttattttaataatgctcctctaatgagggttcctggtaggctacatcctgtggagattttgtatacgcaggaacctgaaagggattatcttgaagcagcaattcgtacagttgtccagatacatatgtacgaaggtcctggcgacattcttgttttccttacaggcgaggaggagattgaagatgcatgccgtaaaataaataaggaaatttcaagtcacgacggtgtggggccagtgaaagtggtgcctctttattcaactcttccacctgctatgcaacagaagatttttgaccctgctccacctccattggtggagggtgggcctgctggaaggaaaattgttgtatcaactaacatagcagaaacttctttgacaatagatggcattgtttatgttattgacccgggttttgcaaaacaaaaggtatataacccacgagttcgggttgaatccctgttggtgtccccaatatcaaaagcaagtgcacatcagaggtcgggacgtgcgggaagaactcagcctggaaaatgcttcagactttacacagagagaagttttgagcaagatcttcaaccacagacgtatccagagatattgcggtcaaatcttgcaaacacggttctaactcttaaaaaacttggaattgatgatctggtgcattttgattttatggatcctcccgctcctgagacgttgatgcgggctctggagttgttaaattatttgggggcgttggatgatgatgggaacttgactaagcttggggaaatcatgagcgagtttcccttggaccctcagatgggtaagatgctagttgtcagtccagaattcaactgttccaatgagattctgtctatatgcgctatgctctcagtacccaattgctttgtccgccctagggaggctcaaaaggctgctgatgaagcaaaagctagatttggacacatcgatggagatcatctgacgttgctaaatgtgtatcatgcctacaagcagaatggtgaggaggatccatcttggtgctatgagaattttgtcaatcaacgggctctgaggtctgctgataatgtcagacaacagcttgtacgcatcatgacgaggttcaatctcaagttatgcagcacagatttcaacagccgcgattactatgtcaacattagaaaagctatgctagctggattttttatgcaggttgcccaccttgaaagaactgggcattacctgacagtgaaagacaatcaagctgtgcacttgcatccatcaaattgtctggatcacaagccagagtgggtaatctacagcgagtacgtgctaacaagcaagaattttattcggacagtgacggatattcgtggtgaatggcttgtagacatagcaccacattactacgacttagctaacttcccaaactgcgaaggcaaacgagttcttgagaaactttataagaagcgggagagagaaaaggatgagaataagaacaaaaaatgatgtgatgctgtgctggtcaatcctgtcatttattccgatatctttcttagtggctagcgtggtgagatggtagttgtgaacgtatcaaaaatatcagtaattgtctcacttgattactgcctagctgtttagttatcttcgttttcatttgtacccttagctttaccacattaatttttggacgtggttccaatgatattgaagtgtagtgaatttgatagattgcaatgtgggaatgtgagcgagttctactcttgtcagattagttaatatgatttcatggtgaaactgccattctgttttatgaatttatgataagttattgtaatttcaattggt

SEQ ID NO: 2639 - DNA, 2609 bp, Physcomitrella patens
caatggcgggcgagaggaagaggaagttgagcctgttcgacgttgtggacgagtccgtcaatggaaccgagaagatgaaagcgaatggcggtcccgtgctgaaccctcacaccggcaggccgtactcggcgaagtatttcgagattttggagaagcggcgcacgctgccggtgtggcagcagaaggcggagtttctgaacatcctggccaagaaccagacgatgattctggtgggagagactggttccggaaagaccacgcagattccccaattcgtggtggaagcagggtatacgagcaacaggaagcaagtggcttgcacgcagccaagaagggtggcggccatgtcagtgtcgcggcgtgttgcggacgagatggacgtgaccattggagatgaggtcgggtacagcattcgtttcgaggattgcagcgggccgaagacgacgttgaagtatttgacggatggtatgctgttgcgagaggccatgacggatcctttgctggagcggtacagagtgatcatcctggacgaagcgcacgagaggacgttggcgacggatgtgctgttcgggctgctgaaggaggtgttgaagaacaggccggacctgaagctggtggtgatgagtgcgacgttggaggcagagaagttccaggcgtacttcaacggggcgccgctgatgaaagtgcccgggaggctgcacccggtggagatattctacacgcaggagccggagagggactacctggaggcggcgattcggacggtggtgcagattcacatctgcgagccggcgggagacatcctggtgtttttgacgggggaggaggagatcgaggatgcgtgcaagaagataggaagggaggtgcagaacctgggggaccaggtggggccggtgaaggcggttccgctgtactcgacgctgccgccagcgatgcagcagaagatcttcgatgcggcaccgccaccggcaaaggacgggggaccgccggggaggaagatcgtggtgtcgacaaacatcgcggagacgtcgctgacgatcgacgggatcgtgtacgtgatcgacccggggttcgcgaagcagaaggtgtacaatcctcggattcgagtggagtcgctgctggtttcgccgatctcgaaggcgagcgcgcaccagagggcggggcgtgcgggtcgaacgcagccggggaagtgcttcaggctgtacacggagaagagtttccagaacgacctgcagccgcagacgtatccggagattctgcggtcgaacctggcgaacgtggtgctgacgctgaagaagttggggatcgacgacctggtgcacttcgacttcatggaccctccggcaccggagacgctgatgagggcgctggagctgctgaactatctggcagcgctggacgacgacgggaatctgacgaagctgggagagctgatgagcgagtttccgcttgacccacagatgtcgaagatgctggtggtgagcccagagttcaactgttcgaacgagatcctgtcgatcacggcgatgttgtcagttcccaattgctttctgcgaccaagagatgctcaaaaggcagcagacgaagcgaaggctcggttttcgcacattgacggggaccacctgacgcttctgaacgtgtaccatgcgtacaagcagaacggtgaggacgccacgtggtgttacgacaatttcatcaacgtgcgtgcgatgaagtcagctgacaacgtgcggacgcagctggtgcgcatcatgaatcggtacaacctgaagatgtgcagcacagacttcaacagccgggattattatgtgagcattcggaaagcgatgcttgcggggtactttatgcaggtggctcatctggagcggacgggtcactacctgacagtgaaggacaaccagatggttcatctgcatccgtcgagttgtttggaccacaagccggagtgggtgatatacaacgagtttgtgctgactactcggaacttcattcgaatagtgacagatgtgcgtggggaatggctgatagacgttgctccgcattactacgatttgagcaactttccgcagtgcgaagctagacgcgtgctggaaagactgtacatgaagcgcgagagggagaaatctgaggctaacggtggaaagaggtagtcagcagcttggagctgaacttcagatactgctgacttgtctattcacggtgttgcttgtcagttattatattgtgttcctcttctcgttcccatttttttcaggggtctgaggatggttttgccttgaaacgactggtcctttgtagcaaatcgttgaggaaagttgagggaacataaattgagcattttggcagctgtcctcaacctaagcacgcccctaggaaatcgtaggaagtggcttataaactacgagccgactgattgaaccgcagttacaatttcggtgaaaggtggaggtggagtttttcagggcgtgatgaaatcgtaaggagttcggttgtgtagtctatgcttgatccgctctttgctttcaggcatcatagagctgaaaccagccgatgctttatgttgaaactttaatataccagctggcaacagcagcaatcttttacggaaa

SEQ ID NO: 2640 - DNA, 2709 bp, Physcomitrella patens
atcggcctcttcaacgcttccgaccaagaatcggtcctgtccccaccaaattcgtttctcctgttcatacaatcgtgccgtaatcggttaaattaggttttgagatttgggttttgggttttgccaaattttgcagacccggagaggctccgcagaagtggaattagtccaggcgtgtttgaagagtctctgcgagaggcgactctttgttgcggctattgtagattgattattgacttggaagttttggcgtggcggtcgtttgggtttggctggatcggagcggtttcttgggtttaagttgctggagtaattggaagaggcagtagcaatggcgggcgagaggaagagaaagttaagcctgttcgacgttgtggacgagtccgtcaatggaaccgagaagatgaaagcgaatggcggtcccgtgctgaaccctcacaccggcaggccgtactcggcgaagtatttcgagattttggagaagcggcgcacgctgccggtgtggcagcagaaggcggagtttctgaacatcctggccaagaaccagacgatgattctggtgggagagactggttccggaaagaccacgcagattccccaattcgtggtggaagcagggtatacgagcaacaggaagcaagtggcttgcacgcagccaagaagggtggcggccatgtcagtgtcgcggcgtgttgcggacgagatggacgtgaccattggagatgaggtcgggtacagcattcgtttcgaggattgcagcgggccgaagacgacgttgaagtatttgacggatggtatgctgttgcgagaggccatgacggatcctttgctggagcggtacagagtgatcatcctggacgaagcgcacgagaggacgttggcgacggatgtgctgttcgggctgctgaaggaggtgttgaagaacaggccggacctgaagctggtggtgatgagtgcgacgttggaggcagagaagttccaggcgtacttcaacggggcgccgctgatgaaagtgcccgggaggctgcacccggtggagatattctacacgcaggagccggagagggactacctggaggcggcgattcggacggtggtgcagattcacatctgcgagccggcgggagacatcctggtgtttttgacgggggaggaggagatcgaggatgcgtgcaagaagataggaagggaggtgcagaacctgggggaccaggtggggccggtgaaggcggttccgctgtactcgacgctgccgccagcgatgcagcagaagatcttcgatgcggcaccgccaccggcaaaggacgggggaccgccggggaggaagatcgtggtgtcgacaaacatcgcggagacgtcgctgacgatcgacgggatcgtgtacgtgatcgacccggggttcgcgaagcagaaggtgtacaatcctcggattcgagtggagtcgctgctggtttcgccgatctcgaaggcgagcgcgcaccagagggcggggcgtgcgggtcgaacgcagccggggaagtgcttcaggctgtacacggagaagagtttccagaacgacctgcagccgcagacgtatccggagattctgcggtcgaacctggcgaacgtggtgctgacgctgaagaagttggggatcgacgacctggtgcacttcgacttcatggaccctccggcaccggagacgctgatgagggcgctggagctgctgaactatctggcagcgctggacgacgacgggaatctgacgaagctgggagagctgatgagcgagtttccgcttgacccacagatgtcgaagatgctggtggtgagcccagagttcaactgttcgaacgagatcctgtcgatcacggcgatgttgtcagttcccaattgctttctgcgaccaagagatgctcaaaaggcagcagacgaagcgaaggctcggttttcgcacattgacggggaccacctgacgcttctgaacgtgtaccatgcgtacaagcagaacggtgaggacgccacgtggtgttacgacaatttcatcaacgtgcgtgcgatgaagtcagctgacaacgtgcggacgcagctggtgcgcatcatgaatcggtacaacctgaagatgtgcagcacagacttcaacagccgggattattatgtgagcattcggaaagcgatgcttgcggggtactttatgcaggtggctcatctggagcggacgggtcactacctgacagtgaaggacaaccagatggttcatctgcatccgtcgagttgtttggaccacaagccggagtgggtgatatacaacgagtttgtgctgactactcggaacttcattcgaatagtgacagatgtgcgtggggaatggctgatagacgttgctccgcattactacgatttgagcaactttccgcagtgcgaagctagacgcgtgctggaaagactgtacatgaagcgcgagagggagaaatctgaggctaacggtggaaagagatagtcggggctttcaggattggttctctgtgcttttgtgaagtgttgccgatgttggcttgatcgacagcgttttgcactcgtgttccaacccgttttttagcatagaaccttagacggtgagactgaagatgtttcgcctcaacaggtcattttaggaaatgtaaaatgggcattggaaggaaacttgatattatttagattgcagtggcaagtgattcttattcgacaatg

SEQ ID NO: 2641 - DNA, 2456 bp, Plantago ovata
ccccaatcaaagaagcctaaattagggttctcttcttcattttgtccgattcgcgcgtaatcatcatctcctcgtcaaattggatgggaacggagaggaagaggaaggtaagccttttcgacgtggtggacgagtcggctttggcggcgaaaaccatcaggatgaacaacgggacgagcaacgtgtctccgtcgatcaacaagtggaacaataagccatactcccagaggtattatgatattctcgagaagaggaagtctcttcctgtgtggcagcagaaagaggagtttctcaaggtcctcagagagaatcagacccttattcttgtcggtgaaactggtagtggtaaaactactcagattccccaatttgtcctagaggctatacaggcagagaataaagatacgggcaggaaattcatggttggctgcacacagcccaggagggtggcagcaatgtcggtttcaaggagggttgcggaagagatggatgtcaccattggcgaggaagtaggttacagtatccgttttgaggattgcagcagtgcgaaaactttattaaagtacttgacagatggtatgcttttgagagaagcaatgacagatccactactggagaggtacaaggtgatcattctagatgaggctcacgagagaactctagcaacagatgttctgtttggtctgcttaaggaagttttgaaaaataggcccgacctcaaactagtagttatgagtgctaccctcgaggctgagaagttccagggttactttggtagtgcaccgctcatgaaagtgcctggaaggctccacccagtggagattttttacacacaagagcctgagagagattatctggaagccgcgataaagactgtttaccagatacatgctttcgaaggtcctggtgatattcttgtttttcttaccggtgaagaggaaattgaagatgcctgtaaaaagttagccaaagaaatatcaaatgctggagatcaggttggcccagccaaaattgtgcctttgtattcgacactccctccagctatgcagcagaaaatttttgatcctgctcctcccccagccgtggaaggtggaccccctggaaggaagatcgttatctccacaaatattgctgaaacgtctttgactattgatgggatagtttacgttatagacccagggttcgcgaaacaaaaagtttacaatccacgaatacgtgttgaatctctgttggtctctcctatatctaaggctagtgcacaccaacgttcgggacgtgctggaagaacacaacccggaaaatgttttaggctatacactgagaagagtttccacaatgatcttgtaccacagacctatcccgagatattgcggtctaaccttgcgaatacggttctcactttgaagaagctgggaatagatgatctggtccattttgattttatggatccacctgccccagagacactgatgagagcgttagaggtcttgaattatttgggagcccttgacgatgatgggaacatgaccaaattgggtgaaatgatgagtgaatttcccctggacccacagatggcgaaaatgctggttgtcagcccagagttcaagtgttcaaacgaaatactttccatctctgcgatgctttcagtacccaactgttttatccggcctagagatgctcaaaaagctgctgatgaagcaaaagctcggtttggccacattgatggagatcacctgacattgttgaacgtataccatgcatacaaacagaacaaagaagatccccaatggtgttacgaaaattttgtcaatgctagagctatgaaatctgcagacaatgtccgacagcagctagctcgaattatgggaagattcaacttgacgatgtgcagtactgatttcaacagccgtgattactatgtgaatatcaggaaagctatgctagctgggtattttatgcaggttgcacatttagagcgaactggacactacctgactgtgaaagacaaccaaactgttcacttgcacccatcaaattgcttggaccataagccagagtgggttatctacaacgagtatgttctgactagcaggaattttattcgtacagtgacagacattcgtggtgaatggctggttgacattgcacctcattactatgatctcactaattttccaaattgtgaggcaaagcggcaacttgagaagttgtacaagaaacgtgagaattcgagggaggatagccggaacaagaagtgaaatttcacatttgactgcaatgagcaccttctctcatgtgttttaatgttaaaagaatggtgaaatttgactgtgtacccatttcgatttatcagttgtgttcacaacattttatgttatagaatacgaacgattttacattactcgattactctgtcatcaactgtctacttttcaattggatacatacaggattct

SEQ ID NO: 2642 - DNA, 2383 bp, Abies balsamea
gggactttgtgaagatcgggggtcggagaggaagaggaagcttagcctattcgacgtggtggacgaaagcaccattgccaagaagatcaaccctaatggagtgcccggcatcaatcgatggaatgggcggccatactctcaaaggtattatgagattctcgagaagagaaaaacccttcccgtatggcagcagaagcaggagtttatcgatacgctggagaagaatcagaccatgattttggtcggagagactggaagtggcaagaccacacagattcctcagtttgtggttgaggcaggatacacttcaaaccgcaaacagattgcctgtactcagcctcgtagagtggcagcgatgtctgtttctcgaagagtggctgaagaaatggatgtgaccattggagaagaagttggttacagtatccgatttgaagattgcagcagttcaaagactgttctcaaatacttgacagatggtatgcttctgagggaagcaatgacggacccattattagagcggtatagagtgataattctcgatgaggcacacgagagaaccttggctactgatgttctttttggccttctaaaggaagtattaagaaatcgaccagatttgaagcttgttgttatgagtgccactttggaagctgaaaagttccaagcttattttaatgttgccccactcatgaaagtaccaggcagattacatccagttgagatattctacacccaggaaccagaaagagattatcttgaagcggcaattaggacagttgtacagatacatacatgcgagacacctggtgacatacttgtttttcttactggagaagaggaaatagaagatgcatgcaaaaaaattaccaaagagatccagaacctgggtgatcaggttgggcctgtgaaagctgtcccactctattcaaccctacccccagcaatgcagcaaaagatttttgagtcggctccacctccattaaaggaaggtggtcctcctggaagaaaagttgttgtgtcaacaaacatagcagaaacatccttgacaattgatgggatagtttatgtgattgatcctggttttgccaagcaaaaggtgtataaccctagaatacgcgtggaatctttactagtttcaccaatatcaaaggcaagtgctcatcaaagatcagggcgtgcaggtcgaacacagcctggaaaatgcttcagactttacacagagaagagtttccataatgatcttcaagcacagacgtatcctgagattttacgttctaatctggcaaatgtggttcttaatctgaaaaaattggggattgatgatttagtacacttcgattttatggacccacctgccccggaaactctgatgcgagcattagagactttgaattatttgggtgctttagatgatgatggaaatctaacgaagttgggagagttgatgagtgagtttccattggatcctcagatgtctaagatgttggttgtcagcccagaatttaactgttccaatgaaattctttccatcactgcaatgctatcagtccccaattgctttctccggcctagggaagctcagaaagcagcagatgaagcaaaagctcggtttgcgcacatcgatggagatcatctgacgctgttgaatgtctaccatgcttataagcagaataatgaggatcctacatggtgttatgaaaattttatcaatacaagagccctaaaatctgcagacaatgtgagacagcaacttgtacgcataatgaacagatacaacctgaaattgtgtagcactgactttaatagtcgtgactattatgtgaatatacggaaggcaatgctagcagggtatttcatgcatgcagctcacatggagcgtacaggccactatctaacggttaaagacaatcagatagtccatttgcatccttctaattgtcttgaccacaagccagaatgggtcatatacaatgaatatgtattgacaagcaggaacttcattcgcactgtcacagatgttcgtggagagtggctgattgacattgcacctcattattatgatttgagcaattttccacagtgcgaggcaaggcgtgttttggagagaatctacattaagcgtgagagggagaaagccgaatctaagagcaaaatcaaaagttcttagctcagttatctcttgtgcaaaggaatcagattgagtttgagatggaaaccgttacagcatatgcattttcccagttattgtctgtgtatccgttacagcatatgcattttcccagttattgtctgtgtatcaatgagctcagcgaagatcaaatttaaaaaaatactatatatcaatgattctaatttgtgaaaagtcttcaatgggaagaacctc

SEQ ID NO: 2643 - DNA, 2810 bp, Ceratodon purpureus
gccgctgcagtgcgctcctcgctttggtcgtttagggtttcggaggatctggggtttgcaggggaattccaaggcggaagcgatggcgggtgagaggaagaggaagttgagtttgtttgatgtggtggacgaggccgccaatggagcggagaagactaaagttaatggaggtcccgtgctcaacccttacacgagcaggccgtactctgccaagtattttgagattctggagaagcggcggacactgcccgtgtggcagcagaaggctgagtttctcagtattcttgccaagaatcagaccatgattctcgtcggagaaactggttccggaaagacgactcagattccacaatttgtggttgaggccggctatactgccaataggaagcaggtggcttgtacgcagccaagaagggtcgcagctatgtcagtgtcccgacgtgtggctgacgagatggacgttacgattggagatgaagttggttacagtattcgttttgaggattgcactggtccgaagactactttgaagtatttgaccgatggtatgcttttgcgagaggccatgactgatcccttgctggagcgctacagggtcatcattctcgatgaagctcacgagaggactttggctacggatgtgttatttggtcttcttaaggaagttttgaagaacaggcctgatttgaaactcgtagtcatgagtgctaccttggaggcagagaagtttcaatcttatttcaatggagctccgctaatgaaagtacctggaagattgcaccctgtggaaatattttacacgcaggaacctgagagggattacttggaggcagctattcgaactgtggttcagattcatatctgtgaaccaccgggtgatatccttgtgtttttgactggagaagaagagattgaggatgcctgcaaaaaaataagtcgtgaggttcagaatcttggggaccaagttggacctgtaaaagcggttccgttgtattctacgctgccgccagctatgcaacaaaagattttcgatgcagctccgccaccggcaaaggagggaggtcccccaggtcggaagattgttgtttccacaaatattgcagaaacttctctgactattgacggtatcgtttatgtgatcgatcccggatttgctaagcaaaaagtgtataatcctcgaattcgagtggagtcacttttggtgtctccaatttccaaagctagtgctcatcaaagggctggacgtgccggtcgaacccaaccaggaaaatgtttcaggctttacacggagaagagtttccagaccgatctgcagccacagacctatcccgaaattttgcgatcaaatttggcgaacgtggtgcttactctcaaaaagttaggcatagacgacctggtacactttgatttcatggaccctcctgcaccggagacgctcatgagggctcttgagttactgaattatttggcagcgctggacgatgacgggaatctgacaaagctaggtcaacttatgagcgaatttcctctggatccacaaatgtcgaagatgctggtggttagccctgaattcaactgttccaatgagattctttccatcactgccatgctgtcagtacccaattgcttccttcggccaagggatgctcagaaagcagctgatgaagctaaggctcgcttttcgcacattgatggggaccatcttacgcttctcaacgtctatcatgcctacaaacaaaacggtgaggatgctacttggtgttacgacaatttcgtcaacgtgcgtgccttgaagtcagctgacaatgtgcggactcagctagtccgcatcatgaatcgctacaacctgaagatgtgcagcacagacttcaacagtcgggattattatgtcaatattcggaaagcaatgcttgctggctactttatgcaggtggcgcacttggagcgtactggccactacctcactgttaaagacaaccagatggttcatttacatccgtctagctgtttagatcacaagccagagtgggttatatataatgagtttgtgcttactactcgtaacttcattcgaatagtcacggacgtgcgtggagaatggttgatcgatattgccccacactactacgacttgagcaacttcccacaatgcgaagcaagacgagttctcgaacgactttacttgaagcgcgagagagagaaaaccgagacaaagactgggaaaaggtagtcccaatcgtcaggtcgagctgcaggtgttcctgcacaagctgttcgtacaacacctggccggattgaaaattatactcgttagttccaatattcatttaatgtcttgggactctgaagctgaatatcctggaatattctgccccaaattttttcaaagtagacgtcaggaaacatcaaggttaagacgtactgcaatgtgtggattgaagtttcggagaggacacaggcacatggtgaaagtacacgcaagatatcattacaatttatctagggttgcaccttttgtttgacttaaacctttttgttatgatcatcacggaaagctgctgaagaggtttattatgtacaggccttacatgtctactatttaacgagcatacagcttcgagtgtcactcacataaaagtcttcgtagtggttctgcttatcaatcagatcagaattgtcgagtttgttcaggtaggtactgattgcgtcgattcggcctgttatgagattcacttcatttctctgctaagttgctaacacagatgtccagatcactgctagtgtgacgatgtggaataaatgaattcttg

SEQ ID NO: 2644 - DNA, 2732 bp, Physcomitrella patens
atgcgcttgtgagcgggcgattgtcacgctccgtgctcgtgcgcgcacatccgaggggggacattgtgatcgaggtggaggagaagaagaatttctggtgtgtttgtgaattagggtttcgcgggatcgcgacgtttgtctgggtttgagggtttaagcggtcgaagactaaaactcgaggccgccgggagcgatggcgggcgagaggaagaggaaattgagcctgttcgatgtggtggacgaggctgcgaacgggagcgagaagtcgaaagggaatggcggtggtggtcccgtgctgaaccctcacaccggcaggccctactctgccaagtatttcgagattttggagaaacggcggacactgcccgtttggcaacagaaggcggagtttttgagtattttggccaagaatcagacgatgattctcgttggagagactgggtccggaaagaccacacagattccacaatttgtggttgaagcagggtacacgaccaacaggaagcaagtggcttgcactcagccaaggagggtggcagctatgtccgtgtcccgacgtgttgctgacgagatggacgtgacgattggagacgaagttggttacagcatccgtttcgaggattgcagcggtccgaagaccactctgaaatatttgaccgacggtatgcttttgcgagaggctatgaccgatcctttgctggagcggtacagagtgatcatccttgatgaagcccacgagaggaccttggccacagacgtgctattcggtcttctcaaggaggtgttgaagaacaggccagatctgaagcttgtggtgatgagtgccacattggaggcggaaaagtttcaggcgtatttcagtggggccccgcttatgaaggtccctggcaggttgcaccccgtggagatattttacacccaagagcctgagagagattacttggaggctgcgattcggacggtggtccagatccacatttgtgaaccgcccggagatatcctggtgtttctgacgggagaggaggagattgaggacgcgtgcaagaagataggtcgggaggtgcagaacttgggggaccaagtgggaccagtgaaggcggttccactgtactccacgctgccgcctgccatgcagcagaagatcttcgatgcagcgccgccaccagcaaaggaaggaggtccaccaggtcggaagattgtggtttcgacgaacatcgcggaaacgtctctgaccatagacgggatcgtgtatgtgatcgatcctgggtttgcgaagcagaaggtgtataatcccaggattcgagtggagtcgctgttggtttccccgatttcgaaggctagcgctcatcaaagggcgggacgtgcaggtcggacgcagccaggaaagtgcttcaggctgtacacggagaagagtttccagaacgatctgcaaccgcagacgtaccctgagatcttgcggtcgaatttggcgaatgtggtgctgacgctgaagaagttaggcatcgacgacctggtgcattttgacttcatggaccctcctgcaccggagacgctgatgagggcgctggagttgctgaattacttggcagccctggacgatgatgggaacctgacgaagttgggggagctgatgagcgagttcccactggatccgcagatgtcgaagatgctggtagtgagcccggagttcaactgctcgaacgagattctttcagtaactgcaatgttatcagttcccaattgcttcatgcggccaagggatgctcaaaaagcagctgacgaagctaaggctcggttttcgcacatcgacggagaccacctgacgcttctgaacgtgtatcacgcattcaaacagaacggtgaggacgccacctggtgttttgaaaatttcatcaatgcgcgagcgttgaagtctgccgacaatgttcggactcagctggtgcgcatcatgaatcggtacaacctgaagatgtgcagcacggacttcaacagccgggattattacgtgaacattcggaaagctatgctggcggggtactttatgcaggtggcgcatttggagcgcactggtcactacctgactgtgaaggacaatcagatggtccatctacatccatccagttgtttagaccacaaaccagaatgggttctatataatgagtttgtacttacaactcgaaattttattcgaatagtcacagatgtgcgcggggaatggttgattgacgttgctccgcattactatgatttaagtaactttcctcaatgcgaaggtagacgtgtgctcgagcgactatacttgaagcgcgagagagaaaaaacggagactaagagcggcaaaaggtagtcggaaaggtgtagactaagtgcaggcgtcggatctggtcttctacatattcatgcttacggcttagtgaacaggagcggcaaggtcaggttccagattgcatttttaacgaggctctggatcttgaaggcaaggatggtgtaattctccctttgcagatcgacaaggaaacatatttaaacacgtggaggtgggcgaaggaatgattagtcatctcctctggtaggtgccatcaaagagggatttctgcacaattgaatcaagggtcctaggatttgattgtcataaaattacatttttgttatgctggtatgcattgctgctaatgttcaacaacgtcaagaaatataaaactttgcgatttggtccgcgttgacttatggtt

SEQ ID NO: 2645 - DNA, 2090 bp, Flaveria ramosissima
cggtgaacaagtggaacggacgcccgtactcacagcggtattacgatatattggagaagaggaaaacgctaccagtgtggcatcagaaagaagagtttcttacagcgttaaaagagaatcaaaccctaattttggtcggtgaaactggtagtggtaaaacgactcagattcctcaatttgtgttggacgctgtggaactagagagtgcggatagacgtaagaagttcatggtgggttgcacgcaaccgcgtagggtggctgctatgtctgtttctaggcgagttgcggaggaaatggatgttacaattggagaggaggtaggttacagcattcgttttgaagactgcagcagtgcaaaaactgtcttgaaatacttgacagatggtatgctattaagagaagccatgacagacccactcttagaaaggtataaggtgataattcttgatgaagcccacgagagaacattagctactgatgttttatttgggcttttaaaagaagtgctgaaaaacaggcctgatcttaagctagttgttatgagtgctactctagaagctgaaaagtttcagggatatttttttggcgccccattaatgaaagttccaggtcgacttcacccggtagaaatattttatacccaagagcccgaacgggactatcttgaagcagcaattcgaacagttgtacaaatccacatgtgtgagccacctggtgatattcttgtttttcttaccggagaagaagaaattgaagatgcttgtcggaaaataactaaagaaattgggaacctcggagaccaggtgggccctgtgaaagtggtccccctttattcaacactccctccagctatgcaacagaagatatttgagcccgcaccatctccattaaccgaaggcgggccggctggcaggaagattgtgatttcaacaaacattgcagaaacgtctttaactatagacgggatagtttatgttattgatccaggttttgcaaagcaaaaagtttataatccacgggttcgggttgagtctttgttggtttctccaatatcgaaggcgagtgctcaccagagatcaggtcgtgctggaagaacacagcctggtaaatgttttagattgtatacagaaaaaagttttaacaacgatcttcagccacaaacctacccggaaattcttcgatcaaatttagcaaatacagttctaaccttgaagaaacttggtattgatgatcttgttcattttgattttatggacccacctgctcctgaaactctgatgcgggccctagaggttttgaattatttgggtgcgttggatgatgaaggaaatctgactaaattgggtgaaattatgagtgaatttccgttagatcctcaaatggggaaaatgcttgttgtcagccctgaatttaattgttcgaatgaaatcctttcaatctcagctatgctatcagtacccaattgctttgtccggcccagagaagcccagaaagctgctgatgaggcaaaagctcgctttggacacattgatggggaccatctaacgctcttgaatgtgtatcacgcctacaaacaaaataatgaagatcaatcgtggtgttatgagaactttgtgaatcatcgggctctcaaatctgcagataacgtgaggcaacagctagcccgtattatggcgcggttcaacctcaagttatgcagcacagatttcaatagccgtgactattacatcaacatcagaaaagctatgttggcaggttattttatgcaggttgctcatttggagcgtacgggtcactatttgactgtgaaagacaatcaggttgttcatttgcacccgtcaaattgtttagaccacaagcctgaatgggtaatctataatgaatatgtgttaacaagcaggaatttcatacgcactgttacagatgttcgtggtgaatggattgttgatattgctccgcactactatgatcttgagaacttccctaattgtgaagcgaaacgagttctcgagaagctgtacaagaaacgggaaaaagacaaagcagagagcaaaaaccgaagatagaaaccgttatggttggttttacat

SEQ ID NO: 2646 - DNA, 2883 bp, Aristolochia fimbriata
gcgagagtgcccaagccacgaaaaatcatccggagttagggttttcgtctcggggttagggttttcgtctctagggttagggttttcgttctcgggggttagggttgtcttctcggagagtagcgtttttgcggggttgtttttttcgttttgttttgcgagggtgttcgtatccagggttgtactcgagccgaatgtcgtcggagaggaagaggaaggtgagtttgtttgacgtggtggacgagactactgtgtcggcaaagctggctaacgttaacggttcgttcaccggggggaaggccaatccgtggaatggtcggccgttttcccaaaggtattttgagattctggaaaagcggaagactcttcccgtgtggcagcaaaaagaggagttcatccaaactctcagggataatcagacgttgatattggtcggggagactggaagtggtaaaacgactcagattcctcagtttgctctggaagcattcagccatgagccaaataagcggaagatgattgcttgcacccaacctcgcagagtggctgccatgtctgtttcacggcgtgtggctgaggaaatggatgtagctattggagaagaagttggttacagcattcggtttgaagattgcagcagtgcaaaaactattctgaagtatttaacagatggtatgcttctaagagaggctatgacagatccacttcttgaaagatatcgagttattattcttgatgaggctcatgagaggacattagcaacggatgtcctatttgggcttctaaaggaagtattgaaaaataggcctgacctgaagctggtagtcatgagtgcaacacttgaggcagagaaatttcgaggttattttaatgaagctcctcttatgaaagttccgggaaggttacatcctgtggagattttttatacacaggaacctgagagggattatctcgaggcagcaatccgcacagttgttcagatacacttgtgtgagcctcctggtgacatacttgttttccttactggtgaagaggagatagaagatgcatgtaggaaaataaacaaggaagttaataatcacggggatcaagtgggacctattaaagtagttccactttattctactttgcctcctactatgcagcagaagatatttgagcctgctccacctgctctgaaagaagggggtccaccaggcaggaagattgttgtttctaccaatattgcagaaacatctttgactatagatggaattgtttatgtgattgatcctggttttgccaaacagaaagtttataacccaagagttagagtggaatctttgctggtttcaccaatatcaaaggcaagtgcacatcaaagatcaggtcgagcaggtagaactcagcctggtaaatgtttcagactgtacacagagaaaagcttcagtaatgatctacagcctcagacttaccctgagatactgcggtctaacttagcaaataccgtcctcacactcaagaagcttggaattgatgatcttgtacactttgatttcatggatcctcctgctccagaaacattgatgcgggctctggaggtcttgaactatttgggtgcattggatgatgaaggaaacctgacaaaactgggagaaatcatgagtgaatttcctttggatccacaaatgtctaagatgcttgttgttagtccagagttcaactgttccaacgagatcctctccatatctgctatgctatcagatagttgcagttactcagtattctatcatgaagcaaatggtgttcgtctctcgcctctgtgcatctgctgacctaccgtgggcctcctctgtgataacaaatttctttctttagtacccaattgctttctccggcctagggaggctcagaaagctgcagatgaggcaaaagctaggtttggacacatcgatggagatcatctcacccttctgaacgtatatcacgcgtacaaggcaaacaatgaagatccatcgtggtgttatgagaatttcgtcaatcatagggcactaaagtcagctgacaatgtgagacaacaattggtgcggataatggccaggttcaacctgaagctgtgcagcacagaatttagcaaccgagattactatgtaaacataagaaaagctatgctggctgggtattttatgcaggtggcacacttggagcgtaccggccactatttgacagtcaaagacaatcaagtggttcacttgcatccgtccaactgcttggatcataagccggagtgggtgatatacaatgagtatgtcttgaccagtaggaatttcattcgcacagttacggatgtccgaggggactggttaattgatgtagcgcctcattactatgatcttgtgaattttccaaattgtgaagccaagcgggttcttgaacgcctctacaacaagcgtgagaaagaaaagggggaaagtaggaacagggccaagtgaagaccccgagcattggagaggacatgatgcggcttccgatgattgctctgctcggtcactcattttggccccacattgtttttattacgaaggctggaatgatggaatttggagaagattttctcagaatctcggaatgggaaaaagaccgagaaactggggactttatcttctgtatcatttatactaagaagacagtaattgtaacttgattgctggtagagttgcatagcgttgtattaggtattaatgtgtgctactttgatagccatcagccgttaactgccatcatttgcttgctgtagctcgtgctataagaaacaattacgaagatgttatctgatcaaaattgatatttgctttcacacatgaaatagattttatataaaacatggcaaataatgtctttcaa

SEQ ID NO: 2647 - DNA, 2073 bp, Lotus japonicus
ggtttcgaattcgatgggcaccgagagaaagaggaaggtgagcttgttcgatgtggttgacgacgctgccgctaagttagtcaaatccaatggcggcgccgccaacaacagtctcatcaatcactggaatgcaagaccttactcccagaggtactttgatattctcgagaagaggaagaccctccccgtttggcaccagaaagaagactttttgctcactttgaggaacaaccaaactttgatccttgttggtgagactggtagtggcaaaaccacccagatccctcagttcgttttggatgatgttgttttggaaagtcctgataaacgtaagaagatgatggttgcgtgcactcagcctcggagagtggctgcaatgtctgtttcgcggcgtgtggctgaagagatggatgtaactattggggaagaggttggttacagtataagatttgaagactgtagtagtgcgaagacagttttgaagtatctcactgatggtatgctcttgagagaagcaatgacagatccacttttggaacgatacaaagttattattcttgatgaggctcatgaaaggactttggctacagatgtgctatttggtcttctcaaagaagtgcttaaaaatagacctgacttgaagttggttgtcatgagtgcaacacttgaagctgaaaagtttcagggctatttttttggtgcccctctaatgaaagttcctggaaggctacaccctgttgaaattttctatacacaagaacccgagagggattacttggaggctgctattaggacagtggtacaaatacacacatgtgaacctcctggggatatactcgtatttcttactggagaagaagagatagaagatgcatgccgcaaaatatcaaaagaagtttctaatctgggagaccaggtgggcgctgtgaaagcggtacccctgtattccactcttcctccagctatgcagcagaagatttttgagccagctccacctccactgaaggagggtggcccccctggaaggaagattgtggtatcaacaaacatagcagaaacttccttaacaattgatggtattgtctatgttattgaccctggttttgctaagcagaaggtttataacccacgagtgcgtgtggagtctctattagtgtcaccaatatcgaaagccagtgcacaccagagatcagggcgtgctggaagaacacaaccagggaaatgttttagactttatactgagagaagtttcaataatgatcttcagccacagacctatcctgagattttgagatccaatcttgccaacacagttcttactttgaagaaactgggtatagatgatttggtgcattttgatttcatggaccctcctgcccctgagaccttaatgcgtgcattggaagtcttgaattatttgggcgcacttgatgacgaagggaacttaacaaaactgggtgaaattatgagtgaatttcccttggatccactgatgtcaaagatgctcgtagttagtcctgaattcaactgttcaaacgagatgctttcaattgctgccatgctttcagtacccaattgctttgtccggcctagggaggcacaaaaagctgcagacgaggctaaagctacgtttgggcacattgatggagatcatctcacgctcttgaatgtctaccatgcgtacaaacaaaataatgaggatccctcttggtgctacgataacttcgttaatcacagggcattgaaatctgctgataatgttaggcaacaactattgcgcatcatgggccgatttaacctgaagttatgcagcactgactttaatagtcgtgattactatgtcaacataagaaaggctatgctttctggatatttcatgcaggtagctcatctggagcgtacaggacactacttgacagtgaaagacaaccaggtggtgcatttgcatccttcaacttgcctggaccacaagcctgaatgggttatatataatgaatatgttcttaccagtcgaaatttcattcgtactgtgacagacatacgtggggaatggtaagatattttctctctgaa

SEQ ID NO: 2648 - DNA, 2679 bp, Quercus alba
tattgatgggaacggagaggaagaggaaggtgagcttgttcgacgtggtggacgagtcgaagatcgccaaaatcaacggcggcgccttctcgtcctcggcggcggcgatgagcaacagtgttagtattattggcggaggcaatagcagcaaccccgcgatcaatagctggacggggaggccgtactcgcagaggtactatgagattttggagaagcggagaggcttgcctgtttggcaccagaaagaagagttcttgcaagttctcaaggctaaccagactctcatcctcgtcggtgagactggtagtggcaaaaccactcagattccccagttcgttttggaagcgattgatttagaaactccagataagcgcaggaagatgatgattgcgtgcacccagcctcgtagggtggctgctatgtctgtttctcgtcgtgttgctgaagagatggatgtaactatcggagaagaggttggttatagtatccgttttgaagactgcagtagtgcaagaacagttttgaagtatttaacagatggtatgcttttaagagaagcgatgacagatccgcttttggaacgctacaaggtcataattcttgatgaggctcacgaaagaacattggcaactgatgttctgtttggacttctgaaggaagtgttgaaaaatagacctgacctgaagctagttgtaatgagtgctactcttgaggctgaaaaatttcagggttatttttttcaagcaccacttatgaaagttcctgggaggcttcatccggtggaaatattttacactgaagagcctgaaagggactacctggaggcagcaatccgaactgttgtgcaaattcatatgtgtgaaactcctggagatatacttgtgtttctcactggtgaggaggagatagaagatgcatgccgaaaaataaataaagaagttgcaaatatgggtgaccaggtgggacctgtcaaagtagtgcctttgtattctacccttcctccagctatgcagcagaagatattcgaaccagctccacctcctgtgaaagagggtggtcctgctggaaggaagattgtggtgtcaacaaacattgctgaaacttctttgaccattgatggtatagtatatgtaattgaccctgggtttgcaaaacaaaaagtttataacccacgagtgcgtgtggaatcattgttggtatctccgatctctaaggctagtgcacaccagagatcagggcgtgctggaagaactcagcctggaaaatgctttagactttacactgagaaaagtttccagaatgatcttcaaccacagacctatccagaaatattaagatcaaaccttgcaaatacggttcttactttgaagaaactgggaatagatgatctagtgcattttgattttatggatccccctgctccagagacattgatgcgggctttagaggttttgaattacctgggagcgttagatgatgatggaaatctgacaaagctgggcgaaattatgagtgaatttccattggatcctcagatgtcaaagatgctcgttgttagccctgagttcaactgttcaaatgaaattctatcagtttctgccatgctttcagtttctcagtattctctcatgaagaaaatggtatcgtctcgcctctatgcatctgctgacctccgtgggcctcctctgtgataaccaatttctttctttagtacccaattgctttgtccggcctagggaggctcagaaagctgctgatgaagcaaaagctaggtttgggcacatcgatggagatcacctcacgcttttgaacgtataccatgcatacaagcaaaacaatgaggacccatcatggtgctatgagaacttcgtcaaccaaagggcattgaaggctgctgataatgttagacaacagctcgtgcgtatcatggccaggtttaacctcaaattgtgcagcactgatttcaacagccgtgattactacatcaacataaggaaggctatgctagcaggttatttcatgcaggtagctcacctggaacgtactggacactacttgacagtgaaggacaaccaagtggtgcacttgcatccatcgaattgcttggatcacaagccggagtgggtcatctataatgaatatgttctaacaagcaggaatttcattcggacggtgacagatattcgtggtgaatggataattgatatagcaccacattattatgatctgacgaacttcccgcagtgtgaggctaagcgtgttcttgagaagctttacaagaagcgggagaaggagagggaggagagcaggaacagaaagtgataatattttcagctttggcatctttcaactccttgtttgccttttctacaacggaaaggaggagccatttcctgagatctcaattctttcattatattagccattgtgtaactctcaggaggaccagcttggcagtgaaatcggtggaaatttggcaatgtttctgtaccattaactagtgctagttttagttaactataattttctattgtattgattatcttaatttattctggatttgatggtttcatttaagaaaaacgggaattaatgttatctatgctacagggaacaggattccctcacttgggctttactttttaactgtcccaaacagccttatttgacaataaatgt

SEQ ID NO: 2649 - DNA, 2696 bp, Solanum phureja
aaaccctaattttctcttttcattgtctccctaggtttaggttttccaccggaaacctaaattcagactcgcctgttctccgattatacttgatggggaccgagcggaagaggaaggtgagcttgtttgatgtggtggatgactcggccgcgaagaagctcaatggaggcttaaatggtggaaacagcatgacggcttcgatcaacaagtggaatggaaagccttactcacagagattttatgatattttggagaagaggaagactcttccggtttggcatcaaaaggaggagttcttacaggctttgaaatctaatcaaactcttatcttggtcggtgaaactggtagtggtaaaaccactcagattccacagtttgttttggatgctgttgaagtagagacagctgataagcgcaggaaatatatgataggttgcactcaacctcggagggtggctgcgatgtctgtctctcgtcgtgttgctgaagagatggatgttgtaattggggaagaagttggatatagcattcgttttgaggactgcactagtgctagaactgttttaaaatacttaacagatggtatgcttttaagagaagcaatggcagatcctctattggaacgctacaaagtaattattcttgatgaagctcatgaaagaactttggcaacagatgtcctgtttgggcttttgaaggaggtgttgaaaaatagaccagacctaaagctagttgttatgagtgccacacttgaagcagagaagtttcagggttacttctttggtgcacctctcatgaaagttcctggaaggctccatccggtggaaattttctacactcaggatcctgagagagactatcttgaggctgccattcggactgttgtgcagatacacacatgtgaacctcctggtgacattcttgttttcctcaccggagaagaggagattgaagatgcatgtcgcaaaatcacaaaggaaattggtaatatgggtgatcaagtaggccctgttaaaccggtgcctctttattctacacttccccccgctatgcagcaaaagatatttgaaccagccccaccaccagttgtggagggtggtcctcctggcaggaagatcgttgtgtcaaccaacattgcagaaacatctttgacaatagatggcattgtttatgtcatagatccaggatttgctaagcaaaaggtttataatccaagggtgcgtgtggaatctttgttggtgtctcctatttcaaaggccagtgcacaccagagatcaggacgtgctggaagaacacagccaggaaaatgctttagactttacacagagaaaagcttccataatgaccttcaaccccagacatatccagaaatactacggtcaaatttggctaatacagttctaactctgaagaagctaggtattgatgacctggttcattttgattttatggatcctcctgcccccgagacgttgatgagagcactagaggttttaaattacttgggagcattggatgatgatggaaacatgacccggttgggtgagataatgagtgaatttcctctcgaccctcagatggggaaaatgcttgttgtcagcccagaattcaactgctccaacgagatcctctcaatatctgccatgctatcagtttctcagtattctctcatgaagcaaatggtgtcgtctcgcctgtatgcatctgctgacctacagtgggcctccgctgtgataaccaattttttctctagtacccaattgctttgtccggcctagggaggctcaaaaagctgcggatgaagcaaagaatcggttcggtcacatagatggggatcatttgacgttgctgaatgtgtatcatgcctacaaacaaaaccaggaggatcctcaatggtgttatgagaacttcatcaatcagagggcactcaaatcagctgacaatgtgaggcaacaactttctcgcataatggccaggttcaacctcaagttatgcagcacagacttcaacagtcgcgagtactatgtgaacataagaaaggctatgttagctggatatttcatgcaggttgcacacctagagcgtactgggcattatctaaccgttaaagacaatcaagtggtgcacttgcatccttcaaattgcctggatcacaagccagaatgggttatatataatgaatatgtcttaacaagcagaaatttcatccgcactgtaactgatatccgtggtgaatggttggttgatattgcaccacactactatgaccttgcaaactttccacaatgcgaggcaaaacgagtgcttgagcggttatacaagaagcgggagcgagaaaaagatgaaagcaagagcaaaaaatgattcaattcttcataatttcagttcctctaatcacaaacactccatgggaactctgcggtcagaatttgtcgtcagataggttaaagattgatgtaccatctattatgtactgtaatagtttctatggatcccatctgaactatttaataccctgtttcttgttgctggagtaatctatttttttatgttcctcgcgttcaatgttctgaattatcgaaataactttttaagttctttcatctgttgaagaaaatgtatgcagcctttccgctgcagaaacttagttaagattaatcagtaatacgggatgcggctgcgtaacatctttaaga

SEQ ID NO: 2650 - DNA, 2683 bp, Solanum lycopersicum
aaaccctaattttctcttttcattgtctccctaggtttaggctttcccccggaaacctactcgcctgttctccgattatactcgatgggaaccgagcggaagaggaaggtgagcttgttcgatgtggtggatgactcggcagcgaagaaactcaatggaggcttaaatggtggaaacagcatgacggcttcgatcaacaagtggaatgcaaagccttactcacagagattttatgacattttggagaagaggaagactcttccggtttggcatcaaaaggaggagttcttacaggcattaaaatccaatcaaactcttatcttggtcggtgaaaccggtagtggtaaaacaactcagattccacagtttgttttggatgctgttgaagtagagacagctgataagcgcaggaaatatatgattggttgcactcaacctcggagggtggctgcaatgtctgtctctcgtcgtgttgctgaagagatggatgttgtaattggggaagaagttggatatagcattcgttttgaggactgcactagtgctagaactgttttaaaatacttaacagatggtatgcttttaagagaagcaatggcggatcctctattggaacgctacaaagtaattattcttgatgaagctcatgaaagaactttggcaacagatgtcctgtttgggcttttgaaagaggtgttgaaaaatagaccagacctaaagctagttgttatgagtgccacacttgaagcagagaagtttcagggttacttctttggtgcacctctcatgaaagttcctggaaggctccatccagtggaaattttctacacgcaggatcctgagagagactatcttgaggctgccattcggactgtggtgcagattcacacatgtgaacctcctggtgacatccttgttttcctcaccggagaagaggagattgaagatgcatgtcgcaaaatcacaaaggaaattggtaatatgggtgatcaagtaggccctgttaaagcggtgcctctttattctacacttccccccgctatgcagcaaaagatttttgaaccggccccaccaccagttgtggagggtggtcctcctggcaggaagattgttgtgtcaaccaacattgcagaaacatctttgacaatagatggcattgtttatgtcatagatccaggatttgctaagcaaaaggtttataatccaagggtgcgtgtggaatctttgttggtgtctcctatttcaaaggccagtgcacaccagagatcaggacgtgctggaagaactcagccaggaaaatgctttagactttacacggagaaaagtttccataatgaccttcaacctcagacgtatccagaaatacttcggtcaaatttggctaatacagttctaactttgaagaagctaggtattgatgacctagttcattttgattttatggatcctcctgcccccgagacgttgatgagagcactagaggttttaaattacttgggagcattggatgatgatggaaacatgacccggctgggtgagataatgagtgaatttcctctcgaccctcagatggggaaaatgcttgttgtcagccccgaattcaactgctccaacgaaatcctctcaatatctgccatgttatcagtttctcagtattctctcatgaagcaaatggtgtcgtctcgcctgtatgcatctgctgacctacagtgggcctccgctgtgataaccaattttttctctagtacccaattgctttgtccggcctagggaggctcaaaaagctgcggatgaagcaaagaatcggttcggtcacatagatggggatcatttgacgttgctgaatgtgtatcatgcctacaagcaaaaccaggaggatcctcaatggtgttatgagaatttcatcaatcagagggctctcaaatcagctgacaatgtgaggcaacagctttctcgcataatggccaggttcaacctcaagttatgcagcacagacttcaacagtcgcgagtactatgtgaacataaggaaggctatgttagccggatatttcatgcaggttgcacacctagagcgtactgggcattatctaaccgttaaagacaatcaagtggtacacttgcatccttcaaattgcctggatcacaagccagaatgggttatatataatgaatatgtcttaacaagcaggaatttcatccgcactgtgactgatatccgtggtgaatggttggttgatattgcaccacactactatgaccttgcaaactttccacaatgcgaggcaaaacgagtgcttgagcggttatacaagaagcgggagcgagaaaaagatgaaagcaagagcaaaaaatgaatccattcgtcatacttttagttcctccaagcacgaacactccatgggaactctggggtcagaatttggccgataggttaaagattgatgtaccatctattatgtactgtaatagtttctatgaatcccatctgaactatttaataccctgtttcttgttgctggagtgatctattttttatctgttcctcgcgttcaatgttgtgaattatcgaaccatcattgtaagttttttcatgtgctgaagaaaatatatgcagcctttctgctatatagaaacttgatttagattaatgagcaatatgggatgcagctgcacaacatctt

SEQ ID NO: 2651 - DNA, 2350 bp, Tabernaemontana elegans
gcagaggtactatgagattctggagaagcggaagactcttcctgtttggcagcagaaagaagagtttttgaggttcttaaaggagaaccaaaccctaatattggtgggtgagactggtagcggtaaaaccactcagattcctcagtttgtactggaagccgttgagatagagtctcaagataaacgcaagaaatatatgattggctgcacgcaaccccgacgggtggctgcaatgtctgtttctcggcgtgttgctgaagagatggatgtgacaattggagaggaagtcggatatagtattcgttttgaagactgcagtggcgcaagaacagttctaaagtatttaactgatggtatgcttctgcgagaagccatgactgatcctttgttagaacgatacaaagtgataattcttgatgaagctcatgaaagaactctggcaacggatgttctatttgggcttctaaaggaagttttgaaaaacagagctgatttgaagctagttgttatgagtgctactcttgaagctgaaaagttccaaggctattttaattctgcacctctcatgaaagtccctggaaggcttcatcctgtggaaatcttttacactcaggagcccgaaagggattaccttgaagctgcaattcgcactgtggttcagattcatatgtatgaacctcctggtgacatacttgtttttcttacgggtgaagaagaaattgaggatgcatgtcgtaaaataaacaaagaaattagtaacataggagatcaggtaggacctgtcaaagcagtgcctctgtattctacacttcctccagctatgcagcaagtaaaatttttagaacctcgccccctcccccattgtttgaaggtggtcctcctgggagaaaaattgttctgtcaacaaatattgctgaaacgtctttgaccatagatggcatagtttatgttatagacccaggctttgccaaacaaaaagtttacaacccaagagtacgtgttgagtctttgttggtttctcctatatcaaaggcaagtgctcaccagagatcaggacgtgcgggaagaacacagccaggaaaatgctttaggctttataccgagaaaagtttcaacaatgacctgcagcctcagacatatccagaaatattgcgctcaaaccttgcaaatactgttcttcaattgaagaaacttggaatagatgacctggttcattttgattttatggatccacctgctcctgagacattgatgagggcgttggaagtcttgaattacttgggagcattagatgatgatgggaacctgaccaaactaggtgaaatcatgagcgagtttcccctggacccgcagatgtccaaaatgcttgttgtcagcccagaattcaactgttccaatgaaattctctccatgtctgcaatgctttcagtaccaaattgctttgtccggcctagggacgcccaaaaagaagcagatgaagcaaaagctcgttttggacacattgatggggatcatctcactctattaaatgtctatcacgcatacaagcaaaacaaggaggatccaaagtggtgttttgacaattttatcaatcagagggcacttaaatctgctgataatgtgaggcagcagctagctcggatcatggccaggttcaaccttaagctatgcagcacagacttcaacagccgggattactatgtcaatatcagaaaagccatgttagctggatattttatgcaggttgctcacttggagcgtactggtcattacttgactgtgaaagacaatcaagtcgttcacttgcacccttcaaattgccttgaccataaacctgagtgggttatttacaatgaatatgtactaacaagcaggaatttcatccgcacagtaacagatgttcggggggaatggctggttgacattgcaccgcactattatgatcttacaaacttccccaattgcgaggcaaagcgggttcttgagagactatacaagaagcgggagaaagagagggaggagagcaaaaacaggagatgaggatattcatcattgtggaccccttgtgttcagacaggaaagatcatgatgttgaaagatgttcctactgtcttgaagaagcgggggaagcagaagcatgtagttttaacaacctatattactttgtagtctttaaacagaagccatttttagcagtgatgttttactaggtttactactgttcttctgcagaatatcactcccctccatcatttgtttttgtttgcccccaaaaatgttgtgttaggctccgtgtatacgctctttaaattatttttagttggagtcaagatacctccacttcaaatta

SEQ ID NO: 2652 - DNA, 3067 bp, Hordeum vulgare
gagcggagtcccatctcgcatccccacgccgacctaagaatcgcgcaattcacaaaatataaatccggcggctcttccagaaacgggagctagggtttcgcctccccaccccgtcccctctcccgcctattcctcctccgcacaccagcgacctccctcgccgccgccatggggacggagcggaagcgcaaggtaagcctcttcgacgtggttgacaagacctccgtatcctccaagctcggccgcgccggcatcaatggtgccgccgccgccgccgcggccaatccgtccatcaaccggtggaacggccggccctactcggcgcggtacctggagatcctcgagaagcgccgcacgctccccgtgtggcagcagaaagacgagttcctccgcgttctccgcgacaaccagaccctcatccttgtcggagaaaccggaagtggcaagaccactcagatcccccaatttgtgcttgaggctgaaggtttgagcaaccgctctatggttgcctgcacccagccacggagggttgctgcaatgtcggtctctcggcgtgtcgcggaggagatggatgtcacaatcggggaggaagttggttacagtatccgattcgaagattgcagcagtcacaaaactgttctcaaatatttgacagatggtatgcttctgagagaagcaatggcagacccacttttagaaaggtacaaggtgattgttcttgacgaggctcatgagcgcacgttggcaacagatgttctgtttgggcttctgaaagaagttctaaagaacaggcctgacttgaagcttgttgttatgagtgctactcttgaggcagagaagtttcagggttatttcagtggggcaccattgatgaaggttcctggtagacttcatccggttgagatcttctatacccaggaaccagaaagggactatctagaagccgctatcaggacagttgtgcagatacatatgtgtgaacctgctggtgatatccttgtattcctcactggagaagaggagattgaggatgcatgtcgaaaaataaacaaggaagttaataacatgggtgatcaggttggcccagttaaagtcgtgccattgtactctactctcccccctgcaatgcagcagaagatttttgaccctgccccacctccattgaaagagggaggccctgctggaaggaaaattgttgtgtccacaaacattgccgagacatccttaaccattgatggtatagtgtatgttatagatccagggttttccaaacagaaggtttacaatccaaggataagggtggaatcccttttggtgtctccaatttccaaggcaagtgcgcatcaaagagctggtcgtgctggaagaacgcagcctgggaagtgcttcaggttgtacacagagaagagttttaatggtgatttacagccgcagacctacccagaaatccttcggtcaaacctcgcaaacacagttcttactctgaagaagcttggaattgatgatttagtgcattttgacttcatggatcctcctgcacctgaaactctaatgagggccttggaagttctgaactatttgggggcactcgacgatgaaggcaacctaacatctttaggtgaaatgatgagtgagttccccttagacccacagatgtcaaagatgcttgtcatcagtccaaggtacaactgttcaaatgagatcctctcaatatctgccatgctatcaggtatgtcaactaacaatttctctctctgaattccatttctacaactacattatcatgttgttatatgttgcacatgcactgttttgcttgcaccagtgtgtgcaagcaagttgccatggttctagcatacagactagtgcatgtgcagttccaacattttctcttgtttgtatattgtgtattgtcatcagcaactgtcatgcacctggcttctagagctattgatcgaaatgatcatacagtttaggctgatgcagatagttgctgtatgttgagttattctgacaaagcaaatggtatcgtctcgcctctttgcatctgctgaccaaccatgggcttcgtctgttattaccatatcctttgtctagtacccaattgctttctccggcctagggaggcacaaaaggctgctgatgaggcgaaggctcgatttgggcacatcgacggggatcatctcacacttctgaatgtgtaccatgcatacaagcaaaacaatgaggatcctacatggtgttatgagaattttgtcaatgcccgggcgatgaagtctgctgataatgttagacaacaacttgtccgcatcatgaccagattcaacctcaagatgtgcagtacagacttcaacagtcgtgagtactatgtcaatatcaggaaagcaatgctttcggggtactttatgcaggttgctcatttggagcgaactgggcattacttgaccgttaaggataatcaggttgtccatcttcatccctcgaattgtatggaccataagccggagtgggtcatctacaatgaatatgttctgaccaccaggaatttcatccgtacagtcaccgatatccgtggagagtggctgatcgatatagctccacagtactatgatctgaccaatttcccgtcatgtgaggccaagcgtgtcctggagaggctgcacaataagagggagagggaaagagctgctagtaggaactgaattaatgtcattcttctggtcccttggaatttgggcagcgctgccaaaggctttggtcatcactgttgacctccaccattgtcatgatatcttccatgtcgtagttttccagttttgtggatggtgaaagcactatatacaacatatgtcaaatgctccccagctactgcattacgaaatagatgcttgttttccctctgttttagaaggtgtaggttatcatacattaattatgtatcggtctccatatttttggtgtatcaaaagctgttgtttactttgtatatttcagcatccttttggctagttttcatggaattgctggtatcgtattgccaacgcagctgtgtttacttccttgtgag

SEQ ID NO: 2653 - DNA, 2535 bp, Pseudotsuga menziesii
agcgatctccgtgcgaaagctcggggccaccggcgtcggggaggcagggaagctcgttgtgcttgccgattttgcacagttgataccccaatcccccactacgcgttatttcctggtctcgggatcgaatctcgccgagaatcaaattgcgtcggaataaattgtgaagtgttcgatgggctattctgagcgaaaaaagaaggcgagcctgtttgatgtggtaagcgaaaacgctgacgctttcaacaaaatgaacgccaacggaatggccgctgctacgaacccctggaacaatcgaccgtattcccccaggtactatgaaatcctcgacaaaaaaaaaccctaccggtgtggcagcagcgcaatgagttcctcgacatgcttgacaaatctcagattttgatattggtcggagagaccggcagcggcaagaccacacagattccccaatttgtggtagaggctggctacactaacaatcagaaacagattgcttgcacccaacctcgtagggtggctgctatgtctgtttctcgtcgtgtagcagaggaaatggatgtgacaattggagaagaagttggatatagcattcggtttgaagattgcagtggtccaaagactattttgaagtacttgacagatggaatgcttctgagagaagcaatggctgatccacttttagagcgttacagagtgattcttctggacgaagcacatgaaaggacattagctacagatgttctttttggattactgaaggaagttgtaaagaatagacctgatttgaagcttgttgttatgagtgcaacattagaggcagaaaaatttcaagcatatttcaatggggcacctcttatgaaagtgcctggaaggttacatccagttgaaatattcttcactcaagaacctgagaaagattacttagaagcagcaattaggacggttgttcaaatacacttatgtgaaccacctggggacatgcttattttcctcaccggggaggaggaaatagaagatgcttgtagaaaaattacaagggaggtacagaatttgggtgataaggctgggcctttgaaagttgttcctttatattcaacccttcctccagccctgcagcaaaggatatttgagccagctccaccacctataaaggaaggtggtcgtccgggaagaaaagtagtggtatccactaatattgcagaaacatcactgactattgatggcatagtgtatgtgattgatcctggtttttcaaaacagaaagtgtacaaccctcgagtgcgtgttgagtcattacttgtttctcctatatcaaaagcaagtgctcaccagagagcaggtcgagctggacgtacacagcctggaaaatgtttcagactatacacagagatgagttttcagaatgaccttcaaccgcagacttatcctgagattttgcggtcaaatcttgcaaatgtagttctgaccctgaaaaactggggattgatgatcttgtgcattttgattttatggatcctcctgccccagaaactttgatgcgtgcattagagcttttgaactatttgggtgcattggatgaagatgggagtttaacaaagctgggacagctgatgagtgaatttcctctggacccacagatgtccaagatgttagtcgtcagccccaatttcaactgctctaatgagattctttccatcactgctatgctttcggtcccaaattgctttctccggccacgggaagcccagaaggctgcagatgaagcaaaggcttgctttgcacatgttgatggggatcatcttacgttgctgaatgtatatcacgcatacaagcaaaacaaggaagatccaaattggtgctacgaaaattttataaatacaagggctcttaaagttgctgataatgtgagacagcagctagttcgcatcatgacaagatacaacctaaaattgtgtagcacggattttaaaagtcatgagtactatcttaatttaaggaaggcaatgctcgcaggctatttcatgcaggtggctcatcgagagcggagtggacagtatctcacagtaaaagataatcagattgtccagttacatccttcaacctgtgttgatcataagccggagtgggtcctatacaatgagtacgtgttgactagtagtaattttattcgtgtcgtcactgatgttcgaggagagtggctgatagatatcgcttctcattattacgaccttagcaactttcctcagtgcgaggcaaagtttgtcttggagaggctttataacaagcgtgaacgagacaaatcgggtcgtaagcataagagtaaaagaacagttcataaatcagccgtatgttagcacgatctatgctctctctagtcgtttgagaaagttaaatgcatatatggtttttagaggctatattgttgactgaagttccagactaaaacatatggaattaacttgttcattgcggaaaccgtatgttattttaaaccaagttgctgttattaccagcatcatattgttttcttgaaat

SEQ ID NO: 2654 - DNA, 2243 bp, Raphanus sativus
  misc_feature (641)..(641): n is a, c, g, or t
  misc_feature (664)..(664): n is a, c, g, or t
  misc_feature (694)..(694): n is a, c, g, or t
  misc_feature (720)..(720): n is a, c, g, or t
  misc_feature (734)..(734): n is a, c, g, or t
  misc_feature (1117)..(1117): n is a, c, g, or t
  misc_feature (1666)..(1666): n is a, c, g, or t
  misc_feature (1813)..(1813): n is a, c, g, or t
  misc_feature (2002)..(2002): n is a, c, g, or t
  misc_feature (2033)..(2033): n is a, c, g, or t
  misc_feature (2103)..(2103): n is a, c, g, or t
  misc_feature (2153)..(2153): n is a, c, g, or t
  misc_feature (2210)..(2210): n is a, c, g, or t
ggaggtacttcgatattctcgagaagaggagagatcttcccgtttggctgcagaaagatgagtttctccggacgttgcaatctaaccagacgctgatcctcgtcggtgagactgggagtggtaaaactactcagattccacagtttgttttagatgcggtggaggctgggaagacagataagcataagaaatggttagttggctgcactcagcctcgtagagtcgctgctatgtctgtgtctcgccgtgttgctgatgaaatggatgtcaccattggagaggaagtcggttacagcatccgttttgaggactgtagtggccctcgtactatgttcaaatatttgactgatggtatgctgttgagagaggcaatggctgacccgcttctagagagatacaaagttattattctcgacgaagctcacgaaagaactttggctactgatgttctctttggtcttttgaaagaggttctgaggaacagacctgaccttaagctggttgtgatgagtgcaaccttagaagctgagaagtttcaggagtattttagcggtgctcctcttatgaaagtccctggtaggcttcacccggttgagatattctacacacaggagcctgagagggactatcttgaagctgcnataagactgttgttcagatacanatgtctgagccgcctggagatgttcttgtnttcttaactggagagaggagatagangatgcctgccgtanatcataaagaggtcggtaaccttggagatcaagtgggtcctgtcaaagttgtgcctttgtattctactctcccacctgcgatgcagcagaagattttcgaccctgcaccagagccagtaacagaaggtggtcctgctggtagaaagattgttgtctcgaccaacatcgctgaaacatctttgacaattgatgggattgtttatgttattgaccctggttttgccaagcagaaagtctacaacccaaggatccgtgttgagtcattgctggtgtccccgatttcaaaggcaagtgctcaccagaggtcaggtcgtgccggtagaactcgccctggaaaatgtttcaggctttacacggagaagagtttcaacgatgatctgcanccgcagacgtatcctgagatattgagatctaatcttgctaatactgtcctgacattgaaaaagctgggtatagatgacttggtgcactttgatttcatggaccctcctgctcctgagacactgatgagagcattagaggttttgaattatcttggagcattggatgatgaaggtaacttgacaaggactggtgagataatgagtgagtttcccttggatccgcagatgtcaaagatgctcatagtcagccctgaattcaactgttcaaatgagattctctcagtttctgcaatgttatcagtaccgaattgctttgttcggcctagagaggctcaaaaagcagcagatgaagctaaatctaagtttggacacattgatggagatcacctgacgctgctaaacgtgtaccacgcctacaagcagaacaatgaggacccaaactggtgttttgagaactttgtcaacaatagagcaatgaagtctgcagacaatgtgaggcagcagctagtgagaataatgtcgaggtttaatctcaagatgtgcagcacngatttcaacagccgcgactactacgtcaatatcagaaaggcaatgctttctggttatttcatgcaggtggctcacctagaacgcactggccattacttgaccgtcaaagataaccaagtggttcacttgcatccatccaattgcctngatcacaaaccagagtgggtgatttataatgaatatgtcttgactactcgcaatttcattcgcactgttacagatatccgcggtgactggttagtagatgttgcaccgcattactatgatctttccaacttccccaactgtgaggcaaaacgagtccttgagaagctttataagaagagagagagggtnaaggacgagagcaagagccgaaggtgaaganatccactctctgcatcagctagagattcaaatcacaaggcaagaagaatctctttgtcataagactatgnattgtataatttatgttggatacttggtcctttgtttctgttcaatgaangaatctttgcattactcaaaattttcgttttaaaatctttataaatttgatattacnaaagctctgttatcaagcggcactattcaacga

SEQ ID NO: 2655 - DNA, 2682 bp, Podocarpus macrophillus
agggcatcgcatagcatctctgttagggttagggtttgggaaaatggcttccgaacgaaagagaaagctgagtctgtttgatgtggtggatgaaacaacggtgtccaagaagatcgttaatgcaactgcgaacggaatgcccatggtgaaccgttggacggggcggccattctctcaaaagtattatgagattctggaaaagaggaaaactcttccagtgtggcatcagaaacaggaattccttgacatgcttcagaagcatcaaaccatgattctggttggagagacaggcagtggcaaaaccactcagattcctcaatttgtggtagaggcagggtacacttccaatcgtaagcagattgcttgcacccagcctcggagagtggcagcaatgtctgtatcgcggagagtggctgaagaaatggatgtgacaattggggaagaagttggttatagcattcgatttgaagattgcagtggctcaaaaactgttctcaagtatttgactgatggtatgctccttagagaagcaatgacagatccgttgttagagcgttatcgagttataattctggacgaggcacatgaaagaactctggctacagatgttctttttggtcttctaaaggaagttttgaaaaatcgccctgatttgaaactggttgttatgagtgctactttggaagctgaaaagtttcaagcatattttagtggtgccccacttatgaaagtaccaggaagattacaccctgtggaaattttttacacacaggaaccagaaagggattatttggaagcagcaatcaggactgttgtccaaatacatatgtgtgaaccagctggggatatccttgttttcctcactggggaggaggaaatagaggatgcttgcaaaaaataactagagagattcagaatctgggagatcaggtggggcctgttaaacctgtgcccttgtattccactctacctccaactatgcagcaaaagatttttgagccagctccaccaccttcaaaggaaggtggccctcctggaagaaaaatagtggtgtcaactaacattgcagagacatctttgacaattgatggtatagtttatgtgattgatcctgggtttgccaagcaaaaagtctacaatccacgaattagagttgaatctttattagtttcgccaatatcgaaggcaagtgctcatcagagatcaggtcgtgcaggtcgtactcagcctggaaagtgtttcagactatatacagaaaagagtttccataatgacctgcaggcacagacttatcctgagattcttcgttccaatctagcaaatgtagttctcaatctgaaaaaacttgggattgatgatttagtacattttgattttatggatccacctgcacctgagacattgatgcgagctttggaggtcctgaattatttaggtgctttagatgatgatggttatctaacgaggttgggagaaatgatgagcgactttccactagaccctcaaatgtcaaagatgttagttgttagcccagaattcaactgttctaatgaaatactttccatctctgcaatgctttcagaagtgtcatccatgaccctgtctagatagtgtatgacagtttttttaagtttagctatgatgcagatatctgcagtattcagtgtatcacttatgatgcacatggtatcatctcgcctctatgcgtctgctgacctccgtgggcctcatctgtgataataaatttctttttctttagtccccaattgctttctccggcctagggaagctcagaaagctgctgatgaagcaaaggctcgattctcgcacattgatggtgatcacttgacgctgttgaatgtttaccatgcctacaaacaaaactctgaagatcctacatggtgttatgaaaattttatcaatgcaagggcgcttaagtctgctgataatgtcagacaacaacttgttcgcataatgaacagatacaacctaaagctgtctagcaccgatttcaatagtcgagagtactatgtcaatatacgaaaggcgatgctagccgggtacttcatgcaggtagctcacttggaacgtacaggtcactacctaacggtgaaagacaaccagatggtccatttacatccgtcaaattgtctagatcataagccagaatgggtgatctacaatgaatatgtgttgactagcagaaacttcattcgaactgtaacagatatccgtggggagtggctgattgacattgcacctcactattatgatttgggcaattttccccactgtgaggcaaagcgtgttttggagaggctctatactaagcgggagagagagaaggcagattaaaaaaacaagaaataatttaatgaaatgtagttaaagctaatgccaattcatttagaaagagtgaccctagttaggatatgtttatgggatagatgattgcaaaagtcttttagtttctttatattgtgcatcaaagctgatatatatatgcagcacatatggatatatgaacagcgcatatggatattggacttgttaaactcgagattaaaaaagatctcattagattttatgttagaccagaatgtatcgcaggtatttctaattgataactgttttcagcctatatcattagtttcttgtacattcattgtactttataatggc

SEQ ID NO: 2656 - DNA, 2992 bp, Pinus taeda
cgtcgagcaggtccttgaaactggtaaccctagatagcaatctctgtgtgacagctcggggccaccggcttcgggacgcagggaagcttattgtgcttgccgatgttgtgaaactgataccccaatacccctcaacacgttatttcctgtcgtcgggatcgaatctcagagattgcgtcggaataaatagataagctcccgatgggctattctgagaacaaggagaaagtgagttttttcgaaggggtaaccgaagacgttgatactttcaaccagacgaacgccaacggaatggctgatgttatgaatccctggaacaagcgcccgttttccgccaggtactatgaaattctcgacaaaagaaaaaccctacccgtgtggcagcagcgccatgagttcctcgacatgcttgacaaatctcagacattgattttggtcggagagactggcagcggcaagaccacacagattccccaattcgtggtagaagctgggtacactaacaatcagaaacagattgcctgcactcaacctcgcagggtggctgcaatgtctgtttctcgtcgtgtagcagaggaaatggatgtgacaattggagaagaagttggttatagcattcgatttgaagattgcagtggtccaaagactattttaaagtacttgacagatggtatgcttctcagagaagcaatgactgatccacttctagagcgttacagagtaattattctggatgaagcacatgaaaggactttagctacagatgtcctttttggattactgaaggaagttttaaagaatagacctgatttaaagcttattgttatgagtgcaacattagaggcagaaaaatttcaagcatatttcaatggtgcacctgttatgaaagttccaggaaggttacatccagttgagatattcttcactcaagaacctgaaaacgattacttagaagcagcaattaaaacggttgttcaaatacatatacatgaaccacctggggacattcttattttcctcactggggaggaggaaatagaagatgcttgtagaaaaattacaagagaggtacagaatttgggcgatcagactgggcctctgaaagttgttcctttatattcaacccttcctccggccatgcagcaaaagatatttgagccagctccaccacccgcaaaggagggtggtcgtcccggaagaaaaatagtggtatccactaatattgcagaaacttcgctgactattgatggcatagtgtatgtgatcgatcctggtttttcaaaacagaaagtatataaccctcgagtgcgtgtggagtcattacttgtttctcctatatcaaaagcaagtgctcatcagagagcaggtcgagctggacgtacacggcctggaaaatgtttcagactgtatacagagaggagttttcagaatgaccttcaagcacagacgtatcctgagattttgcgatcaaatcttgcaaatgtagttcttaccctgaaaaaactggggattgatgatctggtgcattttgattttatggatcctcctgccccagaaactttgatgcgtgcattagagcttttgaactatttgggtgcactggatgaagatgggtgtttgacaaaactgggacagctgatgagtgaatttccactggacccacagatgtccaagatgctagtcgtcagccctgaattcaactgctctaatgaaattctttccatcactgctatgctttcagtcccaaattgctttctccggccacgggaggcccagaaagctgcagatgaagcaaaggcctgttttgcacacattgacggggatcatcttacgctgctgaatgtgtaccacgcatacaagcaaaacaatgaagatccaaattggtgctacgaaaattttataaattcaagggctctcaaagttgccaacaatgttagacagcagttaactcgcatcatgacaagacacaaccttaagttgtgtagcactgattttaaaagtcacgagtactatcctaatataaggaaggcaatgctcgcaggctatttcatgcaggtggctcatcgagagcggagtggacagtatctcacagtaaaagacaatcagattgttcagttgcatccttcaacctgtgttgatcacaagccagaatgggtcctatacaatgagtatgtgttgacaagtagtaatttcattcgtatggtcactgatgttcgaggagagtggctgatagatattgcccctcattattatgaccttagcaactttcctcagtgcgaggcaaggtatgtcttggagaggctttataacaagcgtgaaagggacaaatcggttcgcaaaaacaagagtaaaaaaattgttcttaaatcagctgtatgttagcctaatctatcctctcaattcctctgacagagataaatgcatatatggtttttggaggttatttgttgaccgttggtccagactccagattaaaccatatggaatgagcttgttcataggagaaactgtataccattttaaactaagttgctgttattatcagcatcatcttcttttttgttgaaacaatgtatttagatagtattggtctctattttatttagcatttttctgataataatatttttctgaatgttcaaagataaatttttgtatttgagagtctaccgtttgcatactgctgtatgatcacaggagactatgccacaatctgtagattgtgttttattgctgttattccttttcctttggaagtaggttttgcggctgtgggcagaaagggcttctagtattgttaagcagcaggttagaaagatcgcttattataatcgttttggttatccccccagagtaaaccaaaactaaatacatatatggtttttggaggttatttgttgaccgatgggctagagtaaaccatatggaatgagcttgttcattggagaaactctatactattttaaaagaagttattatcagcatcgtcttc

SEQ ID NO: 2657 - DNA, 2137 bp, Cichorium intybus
agagaatcagacgcttattttagtcggtgaaaccggtagtggtaaaacaactcagatccctcagtttgtcctggaagctgtcgaggtagagagcgctgatagacgcaagaaattcatggtgggctgtacccaacctcgtagggtggctgcaatgtctgtttcccgtcgagttgcagaggaaatggatgtaacaattggagaagaagtcggttacagcattcgttttgagattgcagcagtgccaaaactgtcttaaagtacttaacagacggtatgctattaagagaagccatgacagacccacttctagaaagatacaaagtgataattcttgatgaagcccacgaaagaacactagctactgatgttctattcggacttctaaaagaagtcctcaaaaaccgacccgatctaaagctggttgttatgagtgccaccctggaagcagaaaaatttcaaggcaatttcttcggtgcaccattaatgaaagtgccaggtagactccaccctgtagaaatcttctacacacaagaacccgaacgcgactacctcgaagcagcaatccgaacagtcgtacaaatccacatgtgcgagccacctggcgacattctagtattcctaaccggtgaggaagaaatcgaagatgcatgtcgaaaaatcacaaaagaagtcggtaacatgggggaccaagtggggcccgtgaaagtcgtccccctgtactcgactctcccgccagctatgcaacagaaaatattcgaacccgcaccggctccggtaacagaaggtgggcccgcgggtagaaagattgtgatctcaacaaacattgcagaaacttcattgactatagatgggattgtttatgttatagacccgggttttgctaaacagaaagtttataacccgcgtgtacgtgtcgaatcgttattggtttctccaatctcaaaagcgagcgcgcatcagagatccgggcgtgcgggtaggacacaacccgggaaatgttttaggctttacacggagaaaagtttcaataatgatcttcaaccgcagacttacccggagattttgaggtctaatttagcgaacacggttcttactttgaagaaactcggtatagatgatttggttcattttgattttatggacccgcctgcccccgagacattaatgcgtgctttagaggttttgaattacttgggagctttggatgatgaaggaaacttaacaaagttgggtgaaatcatgagtgagtttccattggatcctcaaatggggaagatgcttgttgtgagtgctgaattcaactgttcaaatgagattctttccatttcggctatgctatcagtacccaattgctttgtacggcctagagaagctcagaaggctgctgacgaggcaaaagcaagatttggacacattgatggggaccacctcacgctgttaaacgtataccatgcctacaagcaaaacaacgaggaccaatcgtggtgttatgagaactttgtgaatcatagggcgctcaagtctgcagataatgtgaggcaacagctggcgcgtataatggcaagatttaatctgaagatgtgcagcacagattttaacagccgggactactacatcaacatcaggaaagccatgttggccgggtatttcatgcaggttgcacatttggagcgcaccggacattatttgactgtcaaagataatcaagtggttcatttgcacccgtcaaattgtttggatcataagccagaatgggttatttacaatgaatatgtgttgacaagcaggaattttatacgcactgttacggatgttcgtggtgaatggattgtggatattgctccacactactacgatcttgacaacttcccacagtgtgaagcaaagcgtgttcttgagaagctctacaagaaacgggaaaaggacaaagaggagagcagaaacagaagataagccaactcaagtgtctgtgtctgtgtctactttatgaaaactgtttgttttccaagcttattggaatattcgtcatgtatcttagtttagcaacagttggttggttctgtttgaatccaataatcttaaatcagttccatttttaacttcccttgtgtttctgaaagatgatgattttcttcgc

SEQ ID NO: 2658 - DNA, 837 bp, Panicum virgatum
gcccagtgtccttcaactcaattctctggactctggcccataaccagcccattaccttgcacgttgggccgttacctcgtctctcttgactcttggaaccttctagacctctctcgagacaccaatttccccatcctatcctcagccgcagctcgcaccccgcaagctgcccaggggcaaatctgtaaaaagtcctacacccgcgccgtcgccgttatccaaatgaaccctaaaccctgcgggccgcggcaacagtaaagccaccggagaagcagcaagagccagccacccccgccgcttcaacttgctccccaagaagaaaacagcggcggagatggcgaagcgtctgatcccgtcgctgaaccgggtgctggtggagaagctgctgcagcccaagaagagcgccggcggcatcctcctcccggagaccaccaagcagctgaatgctgcgaaagtcatagctgttggaccgggtgatcgtgatagggatggcaagctgatccctgtatctttgagtgaaggtgacactgttctacttcctgagtacggtggaacagaagtgaagctcgctgagaaagagtaccttcttttcagagagcacgacatactgggaaagctagaggagtaatcctgggctgccaggatctctgaaggatagagttgtttggaagtggagatgcaggagtgtagccactgctactgagttttttctttttttggtgtctgtggaggacaaatgaaaagcccatccattgtttgagtattcgatgacattgccttatcctaaacttttttgaattggaatggttgccgctgaattatcgtgctccgtgttct

SEQ ID NO: 2659 - DNA, 690 bp, Saccharum officinarum
cctccaaataaaccctaaaccctgcgagccgcgactacagtaaagccaccgcaaccccgcatcaacttgctccccaagaagaatccagcgcaagaccctcctcgcggccatggcgaagcgtctgatcccctcgctgaaccgggtgctggtggagaagctgctgcagcccaagaagagcgctggcggcatcctccttccggagaccaccaagcagctgaacgctgctaaagtcattgctgttggccctggtgatcgtgatagggatggtaagctgatccctgtatctctgagtgaaggcgacactgttctgcttccagagtatggtggaacagaagtgaagcttgctgaaaaagagtaccttcttttcagagagcacgacatactgggaaagcttgaggagtagctctggacggtcaaaatgtcacctctcaaggctggagttgtttgaaagtagggatgcaggagtgtaaccacgacttctcccttttttttttgtgtgtgtggggacaagcgagaacccgacccttgtgagaattcgatgacgttgcctcattctggacatcatcatcatttaaacatttataaactgaatacaattgcatgtttgaggctgcttgcaccggctcccggtaaggctccctgcacgagctttttaccggaccgaagctcgcaccgctggcctgtaaaacg

SEQ ID NO: 2660 - DNA, 1342 bp, Panicum virgatum
tcctacacccgcgccgtcgccgttatccaaaagaaccctaaaccctgcgggccgcggcaaccggagaagcaggaagagccatccccccgcttcaacttgctccccaagaagaaaacagcggcgatggcgaagcgtctgatcccgtcgctgaaccgggtgctggtggagaagctgctgcagcccaagaagagcgccggtggcatcctcctcccggagaccaccaagcagctgaatgctgccaaagtcatagctgttggcccaggtgatcgtgatagggatggaaagctgatccctgtatctttgagtgaaggtgacactgttctacttcctgagtacggtggaacagaagtgaagctcgctgagaaagagtaccttcttttcagagagcacgacatactgggaaagctagaggagtgatcctgggcttgtcaggatctgaaggatggagttgtgtttggaagtggagatgcatgagtgtagccacagctactcattttaacctgtggaggacaaaaacaaagcccatccattgtttgagaattcgattgatctttgcctcgtcctaaactttttgaagatgccgcctagtaatcgtgccctttgggatgagttgtacctgctgggtgcaggacaagcattatcgtgcagatttatttcgtgctgttgctgttgcacgcgactcggcagctgttcagttttgggatcagcatccgcatgtggacagtatgggcggcgcggcgtacggcccgtccagcacgccccgcgccacgaaccggtacgcgcgcggcctcggtgaggtgcacgccgtcccacgagatgtgctccggcgcgtccgggcacaggaccgaggtggcgttgcaggagaagagcacgccggagttgtgaggcccgccgtcgccgcagcacgccgtcagcgccgcgtccttcctgaacccgtgcatgagagggtcgcgggtgatctccaggacggcggcgtagacgacggcggcggttgaggcacctggcggcgtcgtagtcgctggggtcgtcgctcgggaacagggtcaggaaccgcgggacgcaccccagggggaaagccccggggacgacgatgttcttggctccgagcccgatcagcaccttggtggcgttctcgatcttgtcgatgaccttggggaccaggggccggatctcgtcggcgaaggaccggttctggaagaaggggtggttgtagtcgttacccccgatctcccccagcaggaacagcgaggtcgacatgatgtcctggcgctctgcgggcacagacacgtgtcacgttgtcgtcactgcttggtcagtagatggagtaggatcaattgctccc

SEQ ID NO: 2661 - DNA, 616 bp, Panicum virgatum
caccggagaagcagcaagagccagccatccccccgcttcaacttgctccccaagaagaaaacagcggcgatggcgaagcgtctgatcccgtcgctgaaccgggtgctggtggagaagctgctgcagcccaagaagagcgccggcggcatcctcctcccggagaccaccaagcagctgaatgctgccaaagtcatagctgttggcccaggtgatcgtgatagggatggaaagctgatccctgtatctttgagtgaaggtgacactgttctacttcctgagtacggtggaacagaagtgaagctcgctgagaaagagtaccttcttttcagagagcacgacatactgggaaagctagaggagtgatcctgggcttgtcaggatctgaaggatggagttgtgtttggaagtggagatgcatgagtgtagccacagctactcatttttacctttttgatgtctgtggaggacaaaaacaaagcccatccattgtttgagaattcgattgatctttgcctcgtcctaaactttttgaagatgccgcctagtaaacgtgccctttgggatgagttgtacctgctgggtgcaggacaagcattatcgtgcagatttatttcgt

SEQ ID NO: 2662 - DNA, 671 bp, Pennisetum glaucum
cagaaggccccccgcatcaacttgctccccaagaagaaacgagcggaagagctcctcgcggcgatggcgaagcgtctgatcccatcgctgaaccgggtgctggtggagaagctgctgcagcccaagaagaccgccggcggcatcctcctcccggagaccaccaagcagctgaacgctgctaaggtcatagctgttggtcctggtgatcgtggtagggatggcaaactgatccctgtatccctaaatgaaggtgacaccgttctacttcctgagtatggtggaacagaagtgaagcttgctgagaaggagtaccttcttttcagagagcacgacatactgggaaagcttgaggagtaacttttggctgccaggatcccaaaggctgcagttgtttgcaagtagagaactagagatgcaggattgtagcatgagacttgtctatcttctttttttttgcgtgtgcatggtttgaaacaaaatccaaccatgagaattcgatggcattgcctcatcctgaacatcttttaaaatgatacacttgctcatatttgacagctcgaaggatcgccattgactttacatgattgctcttttgacactcggcacaggataagtgacgctgcagattttttttggtgctgctcagcaccttgtggatgcacacgagttat

SEQ ID NO: 2663 - DNA, 823 bp, Sorghum bicolor
ggagacggtttccccattctaccctcgggcctcggccgcactccaaataaaccctaaaccctgggagccgcggctccaggtaaagccaccgcaacccagcatcaacttgctccccaagaagaatcgagcgcaagaccttctcgcgcggccatccatggcgaagcgtctgatcccgtcgctgaaccgggtgctggtggagaagctgctgcagcccaagaagagcgtcggcggcatcctcctcccggagaccaccaagcagctgaatgctgctaatgtcattgctgttggccctggtgatcgtgatagggatggtaagctgatccctgtatctctgaatgaaggcgacactgttctgcttccggagtatggtggaacagaagtgaagcttgctgaaaaagagtaccttcttttcagagagcacgacatactgggaaagcttgaggagtagctctggatcgtcaaaacgtcaactctcaaggctggagttgtttgaaagtagggatgcaggagtgtagccacgagttctctttttttgcgtatggggcggacatgcgagaacccgacccttgtgagaattcgatgacattgcctcattctggacataatcatttaataaatatttaaactgatacaactgcatgtttgatgcttcattttcgacatgatataatagctagtgaagatcttcccgttgtaggggaagaaaatctagacggtttgaacacgattctgcaaaactatgaaattcgaactcgttcccacccccaaaaaaaaaacaaatagttgattgtaaaattcctttcgtcatgaagtctgtcgagca

SEQ ID NO: 2664 - DNA, 566 bp, Zea mays
aaacaccccataccttttcccttcctacccttggccgcagtcaaaccctaaaccctggcgagccgcggctacggtatagccaccgcaacaccgcatctcaagcgcaagacctcctcgcggctatggcgaagcgtctgatcccgtcgctgaaccgggttctggtggagaagctgctgaagcccagcaagagcgccggcggcatcctcctcccggagaccaccaagcagctgaacgccgctaaagtcgttgctgttggccctggtgatcgtgatagggatggcaagctgatccctgtatctctgagcgaaggcgacactgttctgcttccggagtacggtgggacagaagtgaagcttgcagaaaaagagtaccttcttttcagagagcacgacatactggggaagctggaggagtagctctggtctctggaccgttaaaatggagttgtttgaaagtaggtatgcaagagttttgccacggcttatctttctttttttgtgtgcgggggaacaaatgagaaacccaaccattgtgagaattcaataacactgcctcattcttgacat

SEQ ID NO: 2665 - DNA, 610 bp, Cynodon dactylon
gggggaagccatcggaggccgcctagccgcatcgaccaccaccaacttgctccccaagaagaagaagcggaggagctccctcgcggcgcggcaatggccaagcgtctgatcccgtcgctcaaccgggtgctcgtcgagaagctggtgcagcccaagaagagccccgccggcatcctgctcccggagaccaccaagcagttgaacgccgctaaggtcatagctattggtcccggagagcgtgacagggacggcaagctgatccctgtttcgctgaaggaaggtgaaactgttctacttcctgagtatggtggaacagaagtgaagctcgctgagaaagagtaccttctctatagagagcacgacattctgggaaagcttgaggattaactttggcctgtcattatctcgagagtggcggcatatcagagtagagatgctggagagtggcacgggcttctctgatttgtggtgtgggaggaaaaacaatacccatatgagcaactccttgatgtggcctcattctgaacgttattcgaacttgtagaaattgcttattggaagcttcattttgatatgcttgttgcagttttcttatgaagaaatcgtatga

SEQ ID NO: 2666 - DNA, 1094 bp, Oryza sativa
aattaatcagaatctaatgacttgaaaaatcccagtccaaactccgaactcctacggaaccttagtgtaaaactgtactaaatcactacgaggagcaaaagaaaaaaaaagcccaataccgcgagaagcagagcatctgcaacgaggcccggaaaaacaacggcccactaattcacctgccagcccaacatctcgcatcccctggccgccgccacgaacattctagagctcccgagaaaaccccgaggtttacctattctaccctcacctagacccctagggctccaccctctccacaccatccggaggggcaaaatcgtactttctcgattgaaaaaccctaaacccccgcggattattatagagccaatccggctcgcccgctggtcccccccgtcacccactcacccgtctcctccacgcccatcaacttgctcctcaagaagagagaagaggaagagctcgtcgcggcgcggcaatggcggcgaggaggctgatcccgtcgatgaaccgggtgctggtggagaagctgctgcagcccaacaagagcgccggcggcatcctcctcccggagaccaccaagcagctgaattctgcaaaagtagtggctgttggtcctggcgaacgtgacagggatggcaaactgatccctgtatctttgaaagaaggtgacaccgttctgctacctgagtatggaggaactgaagtgaagcttgctgagaaagagtaccttcttttcagagagcacgacatactcggacggcttgaggagtaacttggacggctcgactcgaggagtaactgggggttgtttgccatgacctcataactcgtttatttaattagacacgctggaatgtgagcgtggaagtttttttctgggagcaaaaatgcctgcctgaatttgatgtcgttgtgtcatcgatcgtgagcattactaaaaactgatgaaaccttctctttttgcgcgccttattcataccttgaatggaactgccagtccagttcatttgtcatgctctttttagatcctggggatagcagtaccccaggtccattgtcgccttgtcgagcgccatttttggcacatcccg

SEQ ID NO: 2667 - DNA, 598 bp, Avena sativa
ggggtagcaaaagcaaagagaccatccctcccatcccacccacgcgctcagaccccatcaacttgttcctcaagaagaagagaagagcggcaatggcgaagcggctgattccgtccctgaacagggtgctggtggagaaactggtgcagcccaacaagaccgccgccggaatcctcctcccggagaccaccaagcagttgaattctgcgaaagtcatagctgttggtcctggtgggcgtgatagggatggcaagctggtccctgtatctctcaaggaaggtgatacggttctactacctgagtacggaggaacggaagtgaagcttgctgagaaagagtaccttcttttcggagagcatgatatactgggacggctggaagagtgactcgggattgtcagaatagcatgatctgattcgagatgctggattgtaggcctctgtattttggcaacaaaaaaaaacctctgaattttatgtcctcgcctcatcttgagccattaaaaactgataatgatggcttctttggtgctttttatcttggtttcaattgctatgcagtttatcatgcgacattagtagatttggaatatcgatgc

SEQ ID NO: 2668 - DNA, 644 bp, Lolium multiflorum
agccgtaaaaaagcaaagatccccatcaacttgttcctcaagaagaagaagaagaagaagagaagagcggcaatggcgaagcggctgatcccgtccctcaacagggtgctggtggagaaggtggtgcagcccaacaagaccgccgccggcatcctcctcccggagaccaccaagcagttgaactctgcaaaagtcatagccgttggtcctggtgttcctgatagggatggcaagctgatccctgtatctctcaaggaaggtgatactgttctattacctgggtacggaggaactgaagtgaagcttgctgagaaagagtaccttcttttcggggagcatgacatactgggacgtctggaagagtaactatgggttgtcaggataacataatctgattgaagatgctggatattaggcttctgtactttgtgagaggataacctctgaatttgatgtccttggatcttgagccattttaaaactaatatgatggcttctttggtgcttcgtgtcttgattggaatttgccacccagtttatcttgcaacttagtagcatatgtcattttttaaatattgcgatgtttggtctcatgttgggtgcatactttattgaaatggcatctgcgtcttcattccgacaaa

SEQ ID NO: 2669 - DNA, 571 bp, Cenchrus ciliaris
gtgaggcgaaggagcgcgcggaagcttcgagctattttggcttgctgcgcaagaagaagagaaggcggcgatggcgaagaggctgctcccgtcgctgaaccgggtgctggtggagaagctggtgcagcccaagaagaccgccggcggcatcctcctcccggagacgtccaagcagctgaacgccgccaaagtagtggctgttggccctggtgagcgtgacagggaaggcaagttgatccctgttgctctgaaggaaggtgacactgttctcctgcctgagtatggtggaactgaagtcaagcttgctgctgataaagagtacctcctcttcagagagcatgacatcttgggtacacttgtggactgattttagacaatccgtgaaacccgtcactagctgtgctagtgtgagagatgcttaggatttgatgctatgaagcaatgcttgatgatgtcatagaattttgtggtggaacatcgtgaactggataatattgttgcttatttctgttgagatgcatttgagtatgagatgcatttgagtaaacttcaccatctgaagtggtgacaa

SEQ ID NO: 2670 - DNA, 647 bp, Cynodon dactylon
ggggggagcaggcgacgggtggttgtggaaggttcgcgcttgttcgcttttcttgtttcgcaaggagagaggaggccggcggcgatggcgaagcgcctgatcccgtcgctgaaccgggtgctggtggagaagctggtgcagcccaagaagacgcccggcggcattctcctcccggagacctccaagcagctgaactctggtaaagtggtggctgttggtcctggtgagcgtgacaaggatggcaaactgatccctgtttcactcaaagagggtgacactgttctcctgcctgagtatggtggacttgaagtgaagcttgctcctgaaaaagagtaccttctcttcagagagcatgacatcttgggtacgcttgtggactgattcggaccagcatcagaggaaagccactgagtcactctaaaacgaaacatctttagtatttgatgctgtggaacaaaatccttgtgaaacaattgtagtgatgatgatgtcatagaattttgttttggaacatcatgatccggataaaatgttgcttattttctgttgagagacgcatttgagtgaacttgctcacttgaagcgtttcccttaaaattatcgttgtgcttacatccgtgttgcaatgcccaattatattggtatta

SEQ ID NO: 2671 - DNA, 843 bp, Setaria italica
atgggctcagagcctgaacaaatggccgttttggaaatgggccaatacagatcaaacaaattgtctgtgatgggccgaccctttcttattgtgtcaggcccggcctgcgaggaaccgtcgggccataaaaccctaaacccccgggcggaaggggaccggttggtggtgaggcgaaggagcgcgtcgtggaagcttcgagctttttggcttgctgcgcaagaagaagaagagaaggcggcgatggcgaagaggctgctcccgtcgctgaaccgggtgctggtggagaagttggtgcagcccaagaagaccgccggcggcatcctcctcccggagacgtccaagcagctgaacgctgccaaagtggtggctgttggccctggcgagcgtgacagggaaggcaagctgatccctgttgctctgaaggaaggtgacactgttctcctgcctgagtatggtggaactgaagtcaagcttgctgctgataaagagtacctcctcttcagagagcctgacatcttgggtacacttgtggactgattttagacaatccgtgaacccatcactagtggtgctagtgtgagagatgcttaggatttgatgccatgaaacaatgcttgagaaattcacgtgatgatgtcatagaattttgtggtggaacatcgtgaactggataacattgttgcttatttctgttgagatgagtaaacttcaccatctgaagtggtgacaataatttgttccgctccatgtccctgcttccaatgtttttgttgaatgttcattggatggattgctgctactttcgttatcctttgcacaaaatatcgaaggcattcgtgtttc

SEQ ID NO: 2672 - DNA, 796 bp, Oryza sativa
gttctagagggccctggagaggggcaagcccgtaaattcgccgccgcgtcgcctccaccttaaaaccctaaaccccacgagcgcggcggaggcgatcgaagagtgtagaacttttgctcggtcttttttgcttgcttcgcaagaagaagaagaagagggcggcggcgatggcgaggcggctgatcccgtcgctgaaccgcgtgctggtggagaagctggtgcagcccaagaagagcgccggcggcatcctcctccctgagacgtccaagcagctcaactctggtaaagtggtggctgttggccctggcgaacgtgacaaggatggcaagctgatccctgttgctctcaaggaaggagacactgttctcctgcctgaatatggtggactcgaagtcaagcttgctgctgaaaaagagtaccttctcttcagagagcatgacatcttgggcacccttgtggactgatttggatcgtcatgaacgccatcagtaatcagttgcgctaatgcaaggcatgtttttttagtattggatcgacgggacacaatcctccagacacaactgtcttttatgatgtcgtagaattttggctaagaacatcatgaacttgcaaaagattgttgcttccttttatctgttgcgatgaaattcagtaaacgttaacgcatctgaagagcctcttcctttttaatctgctctgtcttctatgcatgtttgtgttctctgtgtgctggttggatatgtgtcgctgtgacccgagcttaatgcggagagatcgataagcggatgtgactatg

SEQ ID NO: 2673 - DNA, 658 bp, Panicum virgatum
ggtgaggccaaggagagcgtggaagcttcgagcgtttttgcttgctgcgcaagaagaagagaaggcggctatggcgaagaggctgctcccgtcgctgaaccgagtgctggtggagaagctggtgcagcccaagaagaccgccgccggcatcctcctcccggaaacatccaagcagctgaatgctgccaaagtggtggctgttggccctggtgagcgtgacagggagggcaagctgatccctgttgctctgaaggaaggtgacactgttctcctgcctgagtatggcggaactgaagtcaaacttgctgctgataaagagtacctactcttcagagagcatgacatcttgggtacactcgtggactgatttgagacaatcaggaagctcatcactagtcagtccagtgtgagagatgttttaggttttgatgctacgaaacaatccttgaaaatttacatgatgatgtcatagaattttgtggtgaacatcgtgaactggataacaatgctgctcgtttctgttgagatgcaattgagtaatattcaccatctgaagtggtgccaataattagttccgctccattccctggttgcaatgtttaggctggatgtccactggatggattgttattgcttgctttgtgatcctttgcttctc

SEQ ID NO: 2674 - DNA, 607 bp, Panicum virgatum
ggaactggaggagctgggcggtggtggtgaggcgaaggagggcgtggaagcttcgagcgttttttttttttgcttgctgcgcaagaagaagagaaggcggctatggcgaagaggctgctcccgtcgctgaaccgggtgctggtggagaagctggtgcagcccaagaagaccgccggcggcatcctcctcccggaaacatccaagcagctgaatgctgccaaagtggtggctgttggccctggtgagcgcgacagggaaggcaagctgatccctgttgctctgaaggaaggcgacactgttctcctgcctgagtatggtggaactgaagtcaagcttgctgctgataaacagtacctactcttcagagagcatgacatcttgggtacactcgtggactgatttgagacaatcaggaagctcatcactagtcagtctagtgtgagagatgttttaggacttgatgctacgaaacaatccttgaaaatttacatgatgatgtcatagaattttgtggtgaacatcgtgaactggataaaaatgctgcttgtttctgttgagatgcaatgcaattgagtaatatacaccatctgaagtggtgccaataatt

SEQ ID NO: 2675 - DNA, 1109 bp, Panicum virgatum
gttctagacggcaccggagaggccgaagcacgttgcggcggcgcggcgcacgatctcccaggggcaagtccgtaatttccgctgcgctagcgttcagccataaaaccctaaaccctccgagctgttggggggtggtggtggtgaggccaaggagagcgtggaagcttcgagcgtttttgcttgctgcgcaagaagaagagaaggcggctatggcgaagaggctgctcccgtcgctgaaccgagtgctggtggagaagctggtgcagcccaagaagaccgccgccggcatcctcctcccggaaacatccaagcagctgaatgctgccaaagtggtggctgttggccctggtgagcgtgacagggagggcaagctgatccctgttgctctgaaggaaggtgacactgttctcctgcctgagtatggcggaactgaagtcaaacttgctgctgataaagagtacctactcttcagagagcatgacatcttgggtacactcgtggactgatttgagacaatcaggaagctcatcactagtcagtccagtgtgagagatgttttaggttttgatgctacgaaacaatccttgaaaatttacatgatgatgtcatagaattttgtggtgaacatcgtgaactggataacaatgctgctcgtttctgttgagatgcaattgagtaatattcaccatctgaagtggtgccaataattagttccgctccattccctggttgcaatgtttaggctggatgtccactggatggattgttatcgcttgctttgtgatcctttgcttctcaaaggctttcctgttgctattttatcgttggttccatggttagggagctgggcaagccacgggctatcgagttgatgcatataaacataaaacatcttcagatgattgcaatatcattaagtatagcaaccgtaacatgttctagagatatttctcaccctgtttttagcatcctcagcgtgaataaatccacttcgcgtaatcacaatatagtttaaaacgtgagtaagtctctctatttgaaataatataaatcagaaagattagtagtcaagatttcaccctggaaactgtcctagtgaactttttagg

SEQ ID NO: 2676 - DNA, 1486 bp, Pennisetum glaucum
tttttttaacacatgaatgctatccataacgaaagtaacagccatccagcaattcatccaatgaacatccaacataaaacattggaagcagggacatggagcagaacaaattattgtcaccacttcagatggtaaagtttactcaaatgcatctcaacagaaaaaagcaacactattatccagttcaagatgttccaccaaaattctatgacatcatcgcgtgagtttctcaagcattgcttcatagcatcaaatcctaagcatctctcccactagcacagctagtgatgggttcaagcattgtctaaaatcagtccacaagtgtacccaagatgtcatgctctctgaagaggaggtactctttatcagcagcaagcttgacttcagttccaccatactcaggcaggagaacagtgtcaccttccttcagagcaacagggatcaacttgccttccttgtcacgctcaccagggccaacagccaccactttggcagcgttcagctgctttgacgtctccgggaggaggatgccgccggcggtcttcttgggctgcaccagcttctccaccagcacccggttcagcgacgggagcagcctcttcgccatcgccgccttctcttcttcttcttgcgcagcaagccaaaaagctcgaagcttccgcacgctccttcgcctcaccaccaccaccgcgaagaacccaaacgcaagtagggttaggaagggctcggcggcggcggcggtcagggagaagggagggagcggtttcggcgatgacgggcaaggcgaagccgaagaagcacacggcgaaggagatcgccgcgaagatcgacgcggcgacgacgaatcgtggcggcgggaaggcgggccaggcagaccgtctggggcaggagaagggcggtcacgctaagctggcgtgccccctctgccgcaccccggcgcccgacgtgaagtcgatgcagatccaccacgaggcgcgccaccccaagctccctttcgagcccgagaagatcgtcaacctccactcatccacccccgccgccgcatcggaggccaccacctccaagcccaagcccggcgtccgcggcagcctcaagaagtagcttgcttgattggggtaactcccttcaattccaatcctatccaccaacccgatctataatcaatcaatcaaacgaccgcctctggccaacgttggcggcctgccgcagtcggcctgcggtgtactagtgtgctcctgcttttcattactgctgctacatgtgtcatgtgaaagacgttatatttaactgtatccgtggctatggcttcgctgctgtttgtttcaatctcgtcgcgggcaaatcggcacgttttattatgtgttggttggctgtgatgccggcaacagctgatgctactgttaatgttgaccgggttcagtggtacaaatctgtggcttgtttattttctcttactggcaagtaaagttggtcaagatattgtttt

SEQ ID NO: 2677 - DNA, 605 bp, Eragrostis curvula
  misc_feature (569)..(569): n is a, c, g, or t
  misc_feature (573)..(573): n is a, c, g, or t
  misc_feature (597)..(597): n is a, c, g, or t
ggtggaggaggaggttgtggaagcttcgcgctttttcgcttttcttgtctcgcaagaagaagaggataggacggcggcgatggcgaagcgtctgatcccgtcgctgaaccgggtgctcgtggagaagctggtgcagcccaagaagactcccggcggcattctcctcccggagacctccaagcagctgaactctggtaaagtggtggctgttggccctggcgagcgtgacaaggacggcaagctgatccctgttgccctgaaagagggtgacactgttctcctgcctgagtatggtggacttgaagtcaagcttgctcctgaaaaagagtacctcctcttcagagagcatgacatcttgggtacacttgtggactgattcagcccatctgaggaagcacttcacgaggcgttctaatgcaagacatgcttaggatttgatgcagagcaaaaaccttgtgaaagaactcttctcgcatgatgtaatagaatttttgttttggaacaccatgatccggataaaattgttgcttattttatgttgagacgcaattgagtaaacttgctcattnaaanaaaaaaaaaaaaaaaaaaaaaaanaaaaaaaa

SEQ ID NO: 2678 - DNA, 727 bp, Zea mays
aggaacgttctagagggcacccgagaggccggcgcacgttgcgttggcgcggcgaacgatctcaaaggggcaggctcgtaatttttccgctgcgccggcgtctgtccataaaaccctaaaacctccggctgatcggttggtgttgaggcgagtggaagcttcgagttttttttttcttccttttggcttactgcgcaagaagaagggtaacaagaggacggcggcgatggcgaagaggctgctcccatctctgaaccgggtgctggttgagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggtgacactgttctcctgccagagtatggtggaactgaagttaagcttgcagctgataaagagtacctcctcttcagagagcacgacattttgggcacacttgtggactgattcagagcatcagcaagcctgtcactagtcgttggttctagacttctagtgtgagatgcgtagtatcagattctgggatcaaaatccctaagaactctgaactgtcgtgatgtcatagattttgtgatgaaacatcataattgcctgcttcttgttgcaagcgaacttttgcgtttaaaatggttccctaatattgtgttcgcc

SEQ ID NO: 2679 - DNA, 1118 bp, Sorghum bicolor
aggaacgttctagagggcacccgagaggccggagcacgttgcggcggcgcggcgcacgatctcccaggggcaggctcgtaatttttccgctgcgcccgcgtccgtccataaaaccctaaacccccggctgatcggttggtgttgtggtgaggcgagtggaagcttcgagctttttttttccccccgtttgcttgctgcgcaagaagaagggggacgagagaggagggcggcgatggcgaagaggctgctcccgtcgctgaaccgggtgctggtggagaagctggtgcagcccaagaagaccgcaggcggcatcctcctcccggaaacatccaagcagctgaatgctgctaaggtggtggctgttggccctggtgagcgcgacaaggcaggcaatctgatcccagttgctctgaaggaaggcgacactgttcttctgcctgagtatggtggaactgaagtcaagcttgcggctgataaagagtacctcctcttcagagagcacgacattttgggcacacttgttgactgattcgcgagcttgtcactagtcttcggttgaagtgtgagatgcttaggatctgatgctggcaaaatcgatgagaaagaactctgaactgtcgtgatgccatagagtttgtggtgaaacatcataaggataaaacttgttgcttgccttttgttgtcatgcaattgaggaaactttcgcttttgaagtggttcccttattttgttcccctccctatccctggttggtacgttggttgttcatgtagtactttttattagggtgcacaggatcgattacttgtgaacctttgcacaatccatcaaaggtaatgttggcatgctgctatagtgctatttgatcggcgatgctggttagagacttgcctgtacgctgccgcgccacgacagaggtttggccgcgacgtaactgcggcagcgccagacttagctgcaaaatgaactggcacaagaaccagaaatgtctaagcagggtgtggcacgccacaacatcaatcatgaaccaaaggttagctaaagttagacaatatgaggcatgaaccaaacgtcagctaaaattagacgagacatggtactctctccatccatatatg

SEQ ID NO: 2680 - DNA, 595 bp, Saccharum officinarum
cagcccaaatcgggcggtgaggcgagtggaagcttcgagctttttttttttctttggcttgctgcgcaagaagaagggggagaggagggcggcgatggcgaagaggctgctcccgtcgctgaaccgggtgctggtggagaagctggtgcagcccaagaagaccgccggcggcatcctcctcccggaaacatccaagcagctgaatgctgctaaagtggtggctgttggccctggtgagcgtgacaaggcaggcaatctgatcccagttgctctgaaggaaggcgacactgttcttctgcctgagtatggtggaactgaagtcaagcttgcggctgataaagagtacctcctcttcagagagcatgacattttgggcacacttgtggactgattcaaatcatcagcaagcctgtcactagtcttcggttctagtgtgagatgcgtaggatctgatgccggcaaaatcgatgacaaagaactatgaactgtcgtgatgtcatagaatttgtggtgagacatcgtaaggataaaacttgttgcttgccttttgttgcgacgcaattgaggaaactttggcttttgaagtggttccctt

SEQ ID NO: 2681 - DNA, 1353 bp, Brachypodium distachyon
ccagcggcgggggaaagcgaagagtgtagaagttctcgctttgcttgtttgccaagaagaagaagaggaggcgagagagtgggtgtgaggcgatggcggcgatgaagcgtctgatcccgtcgttcaaccgggtgctggtggagaaggtgctgcagcccaagaagagcgccggcggcatcctcctccctgagacctccaagcagctgaactctggcaaagtcgtggctgttgggcctggtgaccgcgataaggatggcaagctgatccctgttggtttcaaggaaggtgaccatgttctcctgcctgagtatggaggacttgaagtcaagcttggtgctgagaaagagtacctcctcttcagagagaatgacatactgggtaccctccatgagtgatttgggtcaccgggaagtcatcactgcaagacaagatgtcaagagtttcgatgctatcggataagctttgaaataggactccgttttatggtgtcgttagatttttgctcagaggaacatcatgaacttgatataattgttgcaactctttgtcgtgatgctatttggtgaacttgtctcggctaaattgctgcccatatttttcctttttgctggctgcgcgcatgtatgtttcttacttcgttagatatctggatccgatgtatactccatctttagggtttattttggttcgcactctcaagagatttgggtcagtagacaacatggaattgaacatatcccaaccccaaagaaggtagaatcccttccgcagatatggggtatggttcttctgctccttagtgaagccagcaattcccagaaaatcaagcagctcagataagataaagagaatatactgcctcatctccgcttgatttgaattgcacacactccaggagaaacccgcgaactgtaattaattaccagaaaaatgcatctgatttctcatgtatgtatgtctggaaggacggcacggtacaggcgtacagcgtacatctgagtgtagctaatcctcactcgccttcacagaaaatggagccacaaaatgcaacataaaaaatattgacatcgttagcagtttacatttaaaaaaacagcacttgcagatttctgagcagcatctggcgatggttcatcatcagctcttgtaggcatccaggaacctttgagcagcatcaagattcagttctttgtagacctgcagcaagcggaatgatcctgtaagatcttctgaaaaaagtaggatgctgttaccaagtagattcgtggaaaggacagagtcaatacaagtttctcatgagcttcttcaaatgtcttgcagaacaattccgcctttgttgctccaacctggcat

SEQ ID NO: 2682 - DNA, 776 bp, Zea mays
gcacgctggcacgttgcggcggcgcagagcacatccccaattccccaggaacaggctcgtaatttttccactgccatcgcaccctttcataaaaccctaaacccaggacccaggtttatcggtgaggcgagccgcgagtggaactgtggaagcgtcgagcttttttcttctttgtcttgctgcgcaagaagaagggaaacgagaggagggcggcgatggcgaagaggctgctcccgtcgctgaaccgggtgctggtggagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggcgacactgttcttctgcccgagtatggtggatctgaagtcaagcttgcggctgataaagagtacctcctcttcagagaggatgacattttgggcacacttgtggactgattcagatcgcgggcaagcgggtggtgagatgcgtaggatttgaagctgggaacaaactccagaaagaactgtgccctgtcgtgatgtcataaatttgtggtgaaacatcatatcatgaggataaaacttgttgcttttttgtgatgcaattgagaaaactttcgaatttgaactggttcccaatattttgttctcctccctgtcccctgttgaagtgctctctgttttaagttagcaattaacgggatcggatttacttgtgaa

SEQ ID NO: 2683 - DNA, 998 bp, Zea mays
ggagttatttgagtttgtaacactctcgtcgcgcggcttcgccactatattactccacagctgcgcatcgccaatttgatattatgcagcactcatccgcgccatattgggactgttatttttccgagctctggtaccgtgtgttttcttgcggttgatgaagtttgtgtaccccttcgtactaatctacccttcacgcagccgtctaccttaaggtgaccacgccgccgtctgccaccaggtgccagcgccgctgtctgccaacagctgcccgcgccgccgtctgccagcaggagcccgcgaccccgtctgccaccaggagcccagttgcaactccacgaggcgagccgcgagtggaactgtggaagcgtcgagcttttttttcttttcaagaagaagggaaacgagaggagggcggcgatggcgaagaggctgctcccgtcgctgaaccgggtgctggtggagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggcgacactgttcttctgcccgagtatggtggatctgaagtcaagcttgcggctgataaagagtacctcctcttcagagaggatgacattttgggcacacttgtggactgattcagatcgcgggcaagcgggtggtgagatgcgtaggatttgaagctgggaacaaactccagaaagaactgtgccctgtcgtgatgtcataaatttgtggtgaaacatcatatcatgaggataaaatttgttgctttttttgtgatgcaattgagaaaactttcgaatttgaactggttcaaaaaaaatacagttgcaactgcacgtcaaaatgttcagcattcactacgaaacgaaaaggtaagagacacacacaaaaaaacaaagtcagcagcaaccag

SEQ ID NO: 2684 - DNA, 1582 bp, Panicum virgatum
ttttacttctcccgaatggtcgaagccaatctccccacgccactccctcctccggctcgtccactccactgctctctgctcccaggtggtagatagatctcggccagcctcacagtacggctcgccattgacacactctctcactacaagcaagcaagcaacgccgcgcgagtaatccaatccaatcccttccacggactgatcgattgaccgagagggccaagagcctgattggttggtaggtaggtggggtggggggagggaaagcggcggcgagagcgggattgatgcgcgcatggcgctgcgggcgcggctgatggggccgggcggcgggccgcgggtgctgctgctgctctccgcggccttcacggcgctcctcgtcgcctccatcctcctcctcccgtcgctcctcctccggacgggcggcgcgcgggggcccggcttcctcctgtcgtcccccgccgccgccgccgccgagcagcaggacccgcggtacccggtctcgttcgcgtacctgatctcggcgtcgtcgggggacgcggcccgcgcggcgcggctgctggcggcgctctaccacccggccaacacctacctgctgcacctcgaccgggaggcgcccgcgggggagcaccgccgcctggcggagctcgtgtccgcgcgggccgtgtacgcgcgcgccggcaacgtctgggtcgtcggccgccccaacctcgtcacctaccggggccccaccatgctcaccaccacgctgcacgccgtcgcgctgctgctccgcctgcgccgcagctgggactggttcgtcaacctcagcgcgtccgactacccgctcgtcacccaggacgacatgatggaggcgttcgccgggctgcccagggacctcaacttcatccagcacaccagccatctcgggtggaagataaaagaagcgggcgcggccggtgatcctggacacggcgctgtacgaggacgggcgggcggagctcatccgcccggtgaacatcaccaccaacctccggaggttgcccacggccttcaagctctacacagggtcggcgtggacgatgctgtcgcgtcccttcgcggagtacgtgaccatggggtgggacaacctgccccggaccctcctcctgtaccacgccaacatcatctcctcgccggagttctacttccagacggtggcctgcaactcgcggcggttccgcaacgccaccgtgaaccacgacctgcacttcatccggtgggacaacccgcccaagcagcacccgctgcacctcaccgccagggactaccgccggatgctgctcagcggcgcccccttcgcgcgcaagttccgggagggcgacccggtgctggaccggatcgaccgggacatcctgcgccggcgggggcccgcccagttcgcctacggcgggtggtgcgccggggacggggacggggacgccggcgcggcgctgtgcggcaacccacaggagcccgggaggaagggggccgtcagggccggcgccgggtcgcgccggctcaaggtgctgctgggcaaggcgctcgccccggggaacctacggagaaagcagtgtaggtgaaa

SEQ ID NO: 2685 - DNA, 2060 bp, Panicum virgatum
aagaaatgccagtgcagtgcagagtgcaaagcggacccgtgagatcccaatccctcgctaatcagcaaccaggggtggtaattttttacagcatgtccggaggagaagtgccaccccttcaccatcctcctcccaagtcccgagacagcgacctccctccctcctactctacctctactccccctccccggccttgccttttacttgtcccgaatggtcgaagccaagcgccccccgccactccctcctcctccactgctgctctctgctcccaggtggtagatagatctcggccagcctcacagtacggctcgccattgacacactctctcactacaagcaagcaagcaacgccgcgcgagcaatccaatccattcccttccacggactgatcgattgaccgagagggccaagagcctgattggttggtaggtaggtggggtggggggagggaaagcggcggcgagagcgggattgatgcgcacatggcgctgcgggcgcggctgatggggccgggccgcgggccgcgggtgctgctgctgctctccgcggccttcacggcgctcctcgtcgcctccatcctcctcctcccgtcgctcctcctccggacgggcggcgcgcgggggcccagcttcctcctctcgtcccccgccgccggcgacctccagcaggagcagcaggaccagcggtacccggtctcgttcgcgtacctgatctcggcggcgtcgggggacgcggcccgcgcggcgcggctgctggcggcgctctaccacccggccaacacctacctgctgcacctagaccgggaggcccccgcgggggagcaccgccgcctggcggagctcgtgtcggcgcgggccgtgtacgcgcgcgcgggcaacgtctgggtcgttggccgccccaacctcgtcacctaccggggccccaccatgctcaccaccacgctgcacgccgtcgcgctgctgctccgcctgcgccgccgctgggactggttcgtcaacctcagcgcgtccgactacccgctcgtcacccaggacgacatgatggaggccttcgccgggctgcccagggacctcaacttcatccagcacaccagccacctcggctggaagataaagaagcgggcgcggccggtgatcctggacacggcgctgtacgaggacgggcgggcggagctcatccggccggagaacatcaccaccaacctccggaggttgcccacggccttcaagctctacacagggtccgcgtggacgatgctgtcgcgtcccttcgccgagtacgtgacgatggggtgggacaacctcccccggaccctcctgctgtaccacgccaacatcgtctcctcgccggagttctacttccagacggtggcctgcaactcgctgcggttccgcaacgccaccgtcaaccacgacctgcacttcatccgctgggacaacccgcccaagcagcacccgctgcacctcaccgccagggactaccgccggatgctgctcagcggcgcccccttcgcgcgcaagttccgggagggcgacccggtgctggaccggatcgaccgcgacatcctgcgccggcgcgggcccggccagttcgcctacggcgggtggtgcgccggggacggggacggggacggcggcgcggcggcgctgtgcggcaacccgcaggagccccggaggaagggggccgtcagggccggcgccggggcgcgccggctcaaggtgctgctgggcaaggcgctggccccggggaatctcaggagaaggcagtgtaggtgaaagaaatttgttttgggctttttattcacagggtggactgattctgatcaaacatgacatgtatagcgaaagggacaacgacatgaattacaggcaattttggttcggaaggaccctaaaattttctgaggtgaaattttcaggaattctactacaggttatctgctgattatattagcgaggaggtcattcacagtctcacagagctaacattcagcttgtgtacttcactctctcgtgtcagtaaaacgacatcaaacactgtgtacaagatacaactgg

SEQ ID NO: 2686 - DNA, 1876 bp, Sorghum bicolor
gaactaaacaaggcctccgagtttttgacaacacaacaacacgtggtggagctgccacggccgtcgtcgatcctccccatttcggccctgggccccacctgtcactcaccctccacctcccgacagggacctccctcctactactactccccagctttccttttacttctcccgaatgctccaacccatccaatcgcacgccactcgctcctgctctcagctagacccaggggtgctagatctcggagtcgccattgatttgattccaagaaagaccgcgagtgaggtaatccatagattgaccgaccgagagcgagagaaagcgagagagaagttccggattgattcctgattggttggtggagaccgggaggcagagctcagctcacacagctcagggtccccgggagattgatgctcgcatggtgatgcggccgcgggcgatgggtctgagcagcatccggcgtgaggtgctggtctccgccgtcttcacggcgctcctcgtggcgtccatcctcctcctcccttcgctcctcctcacgggcagcaccggcccggccaggaggtggccgtcgttcctgtccccgtccacggccgccgaagacaaggagcagcaggcgcggtacccagtgaggttcgcgtacctgatctcggcgtcgacgggggacgcgccccgcgcggcgcgcctgctggcggcgctgtaccacccggccaacacctacctgcttcacctggaccgggaggcccccgcggaggagcaccggcggctggcggagctggtgtccggtcccgggcgcggcggcgtgtacgcgcgcgctggcaacgtgtggatcgtcggcaggcccaacctggtcacctaccgtggccccaccatgctgaccaccacgctgcacgccgtcgccgttctcctccgcctccgccgccgctgggactggttcatcaacctcagcgcctccgactacccgctcgtcacccaggacgatttgatggaggcgttcgcggggctgcccagggacctcaacttcatccagcacacgagccacctgggctggaagataaagaagcgggcgcggccggtgatcctggacacggcgctgtacgaggacgggagggcggagctcatccgcccggtgaacatcaccaccaacctcaggaggctgcccacggccttcaagctctacacagggtcggcgtggacgatgctgtcgcggtcgttcgcggagtacgtgacgatggggtgggacaaccttccccgggcgcttctcctctaccacgccaacatcgtctcgtcgccggagttctacttccagacggtggcgtgcaactcgcggcggttccgcaacgccacggtgaacagcgacctgcacttcatccgctgggacaacccgcccaagcagcacccgctctacctcacgtccagggactaccgccggatgctcctcagcggcgccgccttcgcgcgcaagttcagggagggagacccggtgctggaccggatcgacagggacatcctgcgccgccgggaacccggacacttcgcctacggcggctggtgctccgacgacggcgagcgcggcggcgccggagccggagcgctctgctccaacccgcaggagcatggtaggcgcggggccgttaaggccggcgccggatccaggcggctcaaggcgatgctgaccaagatgctgtcgccaaggaatttcaggaggcagcagtgtaggtgaaatgcattgcattgggtttacactacaaccattgcactctacacctagttcttctgatcaaacaaattacatgccgttgactcattttgtatgtatgtatgtatagaaaaagatctgaaacgcgtcaagcagggacggatccaggattttgg

SEQ ID NO: 2687 - DNA, 1935 bp, Zea mays
gtcgatcctcctcatttcggcactgggccccactcgtcactcaccctttcaggcctccacggcacctcccgacagggactcccctcctactcctgctctcccagcctgcctttacttctcccgaatgctcgaggcctgcaaagctccagcacatccaatcgcacgacactccctgctgctctctgctgagaggtgctagatctcggactcgccgttgatttgattccaagttaaagacagcgagcaatccatagattgaccggtggagagcgagagaaagcgagagagagaagggaattggttggtaggtggagaccggagggagagctcagctcaggagattgatgcttgcatggtgatgcgggcgcgggcgatggggctgagcagcatccggcgggaggtgctggtctccgccgtcttcacggcgctcctcgtggcctccatcctcctcctcccctcgctcctcctaacgggcgctgggcccatcaggtggccgtccctgtccccgtcgaaggatgccggcatcggcgaggaggaggagcagcaggcgcggtaccccgtgacgttcgcgtacctgatctcggcgtcgacgggggacgcgtcccgcgccgcgcggctgctggcggcgctgtaccacccgggcaacagctacctgctgcacctggaccgggaggcccccgcggaggagcaccggcgtctggcggagctggtgtccgggcgcggcgtgtacgcgcgcgcgggcaacgtgtggatcgtgggcaggcccaacctggtaacctaccgtggccccaccatgctgaccaccacgctgcacgccgtcgccgtgctgctccgcctccgccgccgctgggactggttcatcaacctcagcgcctccgactacccgctcgtcacccaggacggtaccctgtgatgcttgcttgcttgcttgctgttggtcgtccactggatggacagactgtttctgaattttgggggttgcagatttgatggaggcgttcgccgggctgcccagggacctcaacttcatccagcacacgagccacctgggctggaagataaagaagcgggcgcggccggtgatcctggacacggcgctgtacgaggacgggagggcggagctgatccgcccggtgaacatctccaccaacctcaggaggctgcccacggcattcaagctcttcacagggtcggcgtggacgatgctgtcgcgggcgttcgcggagtacgtgacgatggggtgggacgacaacctgccgcggacgctgctgctgtaccacgccaacatcgtctcctcgcccgagttctacttccagacggtggcctgcaactcgcgccggttccgcaacgccacggtcaaccacgacctgcacttcatccgctgggacaccccgcccaagcagcacccgctctacctcaccgccagggactaccgccggatgctgctcagcggggccgccttcgcgcgcaagttcagggacggcgaccccgtgctggaccgcatcgacagggacatcctccgccgccgggaccccgccgcccacttcgcctacggcggctggtgctccgaggccggcgaccaaaacggcggcgccgcgctctgctccaacccgcaggagcccgggaggcgcggggccgtcaagcccggcgccgggtccaggcggctcaaggccatgctcaggaagacgctgtcgccgaggaatttcaggaggcagcagtgtaggtaggggaactgttctgttatgttctgatcaaacaaacaggtcgttgactcaattttgtatgtatagaaaaggcagatctgaaacgcatcaaagcggcccaaagccaattttgttcagttgattcgcacaagtctgaattgaattgtagtagggagatactcctggtggttgatcatctcatacacggaataataatggaaggggcattatg

SEQ ID NO: 2688 - DNA, 3403 bp, Gossypium hirsutum
ctagtaaagaaaagtagaaactcaaaatactgttaaagaaccgatcttagcttctcttgtagacaatcataggtttcttttggcagaaagcagaaagactgaaacccttaccgtaacatttttatggttttttttcttttcctcatatcctatctgattttctgtctctggtaatagcaagaagacaataacaaccaaccatggctgctggcaacaagttcgctagatttttgcataaacacaccagcaaaatcactgttattttagtctacgctgtgcttgaatggatcctcatcttcctcctcttactcaactctttcttcacttacttgattactaagtttgccaattattttggccttaaaccaccttgtccctggtgttctagagttgaccatgtactggagcccgacttcagcaactcctcaaactcttacagggatcttgtctgtgacaaacatggttccgagatttccaaattgagttactgttcaagtcatgggaaactagcggaaacacatctgatgtgtgaggaatgcttggcttctaggccaacgcctagtgacggtaaatccattggaatgacaaggaggattgctttcatttcatgggtgagtggtgatcccaagcttgacaatggtgaaaaggttgtcccttgttcttgctgcaatggcaccaaacttcatcctccatatttcctattcaagcctagttggggtgctttggattgtgcagaaaaaggaagtttgataatacaagcaatcgaagatgatgatgataacgatggcagtgaaagcgatcagtgcaaagatggtgaggatatgattgagattaaactcaacaaccaagatgacgacgatgatgatgacgaccaaaacgatcaaagggctaagtctgagcctcaggtgcttttgttgaaaaagatgtacatgaagatgacagatcagacgccatcaatattgcagagaagcatttcagtagtgccacaagtggaatcgttgaaccttgttttgctggagattatacgctagacttcattaatctgcatcatcagaaatgtgtttcagatcgcttatttcctgttgaattaattgatttatcaacatctgcaagccatttctcagaaaagcaagataatggaagtgaaactagtgattcttctaatgaagagacaccattacatgctattgatgagattgcagagactattaccagtcccagggaggctgaaaacctggagctagatcatcaactagacaagaatgatcttaatttaatggctgagagaccaatttccgagaccacattgttaagcactcaagactctgatctgcctcaaattcaagtgtcagattcttcattgcaatgcttacgagaagatggcttttcaacgtttaaggatcaagctaaaggtgttgatgctcctgaatcaagcaagactcaaattcttggttttacactaggtacacatgaagagaagagcacaatggatgagaacggagaaaggataaacgcttctttatcggttcatacggattgtaacaacaacgaagcagaggaggaaaagttccctgacactccaacttcacacgaaggtatgcattacttgcataataaactgctattcttcgggaaaagacaatcgggtattgaggagtctttagatgggagtgtagtaactgagatggaaagtggtgatccggttcgaaccattgaaaggctgaaaacttccttaaaagctgaaagaaaggcattgagtgctttatatgcagagcttgaagaagagaggagtgcctctgcaattgctgcaaatcagacaatggccatgataacacggcttcaagaggagaaggcggcaatgcaaatggaagctttgcagtaccagaggatgatggaagaacaatctgaatatgaccaagaggcccttcaactactaaatgagcttatgatcaaacgagagaaggagaaggaagaactcgagaaagaattggaaatttaccgcaagaaggttctctattatgaggccaaagaaaagacgaggataatgaggataagcaaagatggaagcttgggaagtgggaaatcttcggctgcttgtagctatgcggaggataacgacgagctatccatagacctgaatcgtgaagccaaagatgaagatagcagcttctctggcaaccaagagagcagcagtgatgcagttggtaacttggaagaaatggcactggattgtgtaaaccatataagtgcccttgatgaatcattgacagaattcgaggaagagaggctgtccatcctggatcagcttaaggcattggaagataagttactaactatgggggatgatcaattcatggaggacttgaaatcaattcagaattcctttgatggtcttgatgagaagaatgacctgcgcagcaaagaaggtaatggattttcaaaagaaacaagttgtggcaaaacaatggcttccatggcaaagagtctccttcctttcctggatgcagctgataacgggactgaagaaggaacgatgtatggaaaacaaggagaatctgattctgaaccggtagtaatgcagacatatcctggtccagaactggagttggaccccaagaaacttgcaattgaagaggaggtggatcatgtttatgagaggctacaagcacttgaagaagacaaggaatttctcaagaactgcatgagttccataaagaaaggagacaaaggaatggatctcctacaagaaatcctgcaacatctccgagatctgagagccgttgaactccgaacaaggcccttgagtggtgatgtgcaagggtgatcttaggcttgccatgcataaaaggaatcacctggacctagtaatttcatatatattcaagtgtctatagggaatatctccagattgatggggagattccttatcttccttccttttgggcttacaagaatgatgcaagttcccaaaattggaaggatctcctctttatctgccttatttacaaccaaaaaagaaagggtggaaaatgaaggaaaacataccatctacctgggttgttcatgtagggtaagtcagttgagaacctagtagtttttcttttttgtttagatttcatttactcttttctccataaggtttggaggaagatttgaaaggagagggaagaaggctttatcctttactctcttagtatttgcatcagggaatgttatatagatttcatgaattttttttcttttttggaactcaaacatatgtgttgactttctatagctttgtatgaaattaatgtgttctttcttctctgggttctctcccttagttaaactgtcatgtgtatggcttctcatttagaacaggaggtattgcatattcaaattacttgtgaatctgatagaa

SEQ ID NO: 2689 - DNA, 1600 bp, Sorghum bicolor
caatatcttaaaatgaagggatgcataactcctgaattgcaaaatggtgcaaatgtttctggaagcatcaatcatagcttagcaagtgcataccggcatctgtccaactttaacgagtaaaaaaaaattaatgcaaagacaaaaagtaacctgtgtccgagccgtcctcctgctcaaggcgccggagcgcgaggcggccaagatggatatggtgcccgcccggtcgcgctcctgctcctgcagcgtgtaggtggcggcggccagcacgtggcggaacgggcggtgtgggcagaactccaccgcgtcggcgttcccgccgaggtagcacgagcccaaatccatccccaaatctatcgccgtcggcggcgggcggcggcggcaacaggagtgtcagaaatcgtttggcaactcacgcggcgggggcaaaatagtcaaaccgttctccacgtctggccgtagagacagcaacatatcctaatcacgattcgggggcaagcgaacggacacgatggtggccttgaccgcggggatttccgtagccgccggcgtcgtgttcagccccgccggccgccggcgcggccgcggccccgacgcctttcgctgctcggcctcctcggccggcgagcggcaggccctcttcagccgcatcgcccccgtctacgaccttctgaacgacgtgctcagcctgggacagcaccgaacgtggaagcgcatatgcgtctcttggtcgagagtgaagatgggggatcgagttcttgatctctgctgcgggagcggggatttggcattcctgctgtctcagaaggtcggcttagatggagaggtgatggctgttgatttttcgaggcagcaactacagactgctgctgaccgtcaggagcaacgctggaagctgtgttacaagaacatcaaatggatcgagggtgatgcacttgatttaccattcacagactgctacttcgatgctgtaacagttggctacggattgcgcaatgtggttaataaatcgaaagcaatgcgagaaatatatagggtcctgaaaccaggatcaagagcctctatccttgattttaacaagagttcatcacttttcacggcatcattacagagttgggcgatagacaacgttgtggttcctttagctagtggctatggactgactgaagaatacaagtacttgaaaagctccatagcacagtatctaacaggagaagagttggagaaattagctaaagaagctgggttctgtgcagcgaagcactatgagcttggtggagggcttatgggaaatctagtagcaactcgatgagtagaatatataaaggaaactcgagtcttatgattcctctgcttcattttagctgattgtatgctcttctatgtatccacctgtaggctcttctatgtatccacctatcatgttttgccgatcccagatgaagttgtggacaaatgttgattccagaggggcctgaatggctgaatatcactgtctgctgtttgagcctgtgcttctgtagtgcatcaacgttttgaccacaatcagatggaccgaaacgcggacgcatgcctgtgcagattatactggcatgctgttctg

SEQ ID NO: 2690 - DNA, 1124 bp, Setaria italica
catatcctaatcacggttcgggagcgagcgaagtagcgaacggatacgatgggcaccgtgaccgcgtcgatttccatatccgccgccgcggcggtgatgtcccgcccagccggccgccgacgacggcgcggccccgccgtctttcgctgctcgtcctctacggccggcgagcggcaagccctcttcagccgaatcgcccccgtctacgaccacctgaacgacgtgctcagcctggggcagcaccggacgtggaagcgcatctgcgtatcttggtcgagggcgaagatgggggatcgggttcttgatctctgctgcgggagcggggatttggcgttcctgctgtctcagaaggtcggcttagatggagaggtgatggctgtcgatttctcgaggcagcaactgcaaactgctgctgaccgtcaggagcaacgctggaaactgtgctacaagaatatcaaatggatagagggcgatgcacttgatttgccgttcacagactgctactttgatgctgtcacgattggctatggattgcgcaatgtggttgacaaatccagagcaatgcaagaaatatttagggtcctgaaactaggatcaagagcgtctattcttgattttaacaagagctcatcacttttcacggcatcattacagagttgggcgattgacaacgttgtggttcctttagctagtggctatggactcactgaagaatacaagtacttgaaaagctccatatcacagtatctgacaggagaagagttggagaaattagccaaagaagccggattctctgtagccaagcactatgagcttggtggagggctcatggggaacctagtagccactcgatgagtacaatatagcaaggaaactcgatttgcacgagtcatctgcattatcttagctggtgcagtggtacctatatctatccagatatcattttttgcctatctcaaatgaagtcgtggacaaacattgattccagagggacctgaatggctgaatatcattgtctgctgtttgaacccgcacctctgtagtgcagcaacggtttgaccacaatcagatggatgagacgcgtgcgggcactgagcattgctggcatgctgttctgttctgca

SEQ ID NO: 2691 - DNA, 1730 bp, Oryza sativa
cagcacctttgtccgatccgtcctcctgctccaggcgccagagcgcgaggcggccgtgggcgtcggcctgcgcgagcagaggcgccacggggctccacttcatgtcgaacaccccggcggtctccaccgtgtggagcagccggagcctccggggcgcgtcctcctcgccggcgtcgacggcgaagagcgacacgctgcccgcgcggtcctgccgctccccgccctgctcctgcagcgtgtaggtggcggcggcgaggacgtggcggaaggggcggtgcgggcagaactccaccgcgtcggcgttgccgccgaggtagcacgaccccaaatccatccccctggaaaaaccctcgcgttcccgcacgacgcggctcgcggcggcggcggcggcggcgagagtcgagagcgctttcacttccgcggcgaggcggcggcggcgggggcaaaatagtcaaacacttagtccaaaccggtcacgatatacctatcctgactggggacgtggcggacacccatggccaccctagccgccgcgatttcggcgggccccgcggcgcccgcccccgccgctcgccgccgccgccgccgcgggttcgccgccgtgagctgcggctcgtcctccgcggccgacgagcggcaggccctcttcagccgcatcgcccccgtctacgaccatctgaacgacgtgctcagcctcggacagcaccggacatggaagcgcatctgcgtgtcttggtccagggcaaggagaggggatcgtgttcttgatctctgctgcgggagtggggatttggcattccttctgtctcagaaggttggcttggatggacaggtgatggctgttgatttctcaagtcagcagctgcaaacggctgctagccgtcaggatcaacgctggaagccttgctacaagaacatcaagtggatcgaaggcgatgcacttgatttgcctttcacagactgctacttcgatgctgttacggttggttatgggttacgcaatgtggttgacaaacccaaagcaatgcgggagatatttagggtcctaaaaccaggatcaagagcatctattctagattttaacaagagctcatcacttttcacaacgtcattgcagagttggatgatcgataacgttgtggttcctttagctagtggctatggactcactgaagaatacaagtacctgaaaagttcaatattacactatctaacagaaaaggagctggaggagttagctaaagaagctggcttttctgcagccaagcattatgaacttggtggaggtctcatgggagacttagttgcaactcgctgagtagaatggttgtgaagaacctgatctgtacaacttacctgaattttgtagctgcttcattccttttccctctacatcatctgatagttatgttccgctgatccaacagggatcatgcatcaaaaactcaaaactttcgtgatgtatatttcctttcttctttaataaaaaaggacaattgtaaccacctgaaaaaatcaataacctgcaattcatgatagtgcaggagcggttcgatcaaaatcagacgattgagatgaaatccggtaccgtgcataccagcgacctggcaacatttgagctatctgactggaaatcagccagttcaatcaacgatccggttatcggaggcatgaaagcagagtgaaggtgtggtaggtgacacagcatgcatacatccacccgaacggcg

SEQ ID NO: 2692 - DNA, 3336 bp, Brachypodium distachyon
catcaatggcaaaatgatttattaatccttctttcacagctttcactcctagttagcttgttgaccatactgggtagtaagttagtatatgagagaacgcatgcgctggaaaagtagaatttgcaaccatggtaacagttaggattaaatggcaacattagaaatctcagaatacagtatatagtgtaatctccagacagaatcatgaccagttaaaagctcagtaagaacccccatccagtggtgtctagattgttgctgaagcatcgctattatgcaccagatggaactttaaaatagtttgttgtcaaacaacaccaattgagagcttcatagagttgtactggggaagcttacaacaaatagtagtgtctgcaagtgcctagctataacacagataacattactatagactcatcatttcaaataaattaacataaattcaaagagctacctgaatgaaatcaatttggttcattcaggaaatatgtcggtccatgtcatagtgagacttgaattgagcccaataatggtttaggacttaaagcctgggtgcttgactaattcctccggttgccacacacggagaaggcgatcataaaatgaacaagtagcaataactgaagaagctgtactatgttctggcgcttcgcttgtctgccaatccgcaccatatgctaaggactcatgcttgcaatatgtttccataactgtagcatctccagcacctactttaacaatggcaaacccattgtgcatgcatgcagacaatacaacatccgcgatactaggatgatatttcatcctccatacacctccccctaaatttagggacttctcatttacaggtttcaccattgatctcatatcccaaactctgagaaattcatcatagcttccagtgagtagcatgttcccatccagtgggttctgagcaatacaacatacacccatactatgagactttttatcccgaaacacagcatttgatgggctttcccgcaagtcccagcaactgaaagagcagtcatctgatccactatacaataagtgtggccttgcacgatcaaaataacaagtccaaacttcatactgatgagcagtccagtgttctgatacctccaagcagtcctctctcatggaaatcacagacagtgaaccatctgatagtccaacggacagagaatcagcattctggttccagtccacatacaagcacattgaagaagaaacgtctccgctacagacatctgttagaacaacacctgtataatttggtgacaggaaacacttgtatcagtcgtcaggatgtgctgacatattgcatacattaagtgtttatagttacatcagttctctcctacagtatggaagtatgtaggtgaacttgttattaattaaacaatgatataacgatgaaatttgagcaatgtatatctttaagactagcagtgcaacccaaatttactttggtcatcaatcagaagcaaattgccattcttctaaatataagataatgacaacctcccctagaatatctcaaggtacaaacaacttgttctgaataggtattaacatttccacctatcttatgacctaaatctcatcatctgcaacaaacattacaactgcatagcccctgaaccccgaaatatttcagcaatcaccactcaccgtcaccagcattcatctgaaattctgaagttctgaagacactcagaactcagaagccaaagaatttgatagctccctttagcatgactgcctacaaagttacattaacacatggcccagttttggtaagacagaagcaggagcaagcaacacctttgtccgagccgtcctcctgctccaggcgtcggagcaccaggcgaccgtgggcgtcggcctgcgcgagcagcggcgccgtggggctccacttcatgtcgaatacgcctgcggtatccaccgtgtggagcagccggagccgctgggactcgtcctccgcgccggcatcgacggagaagagggacacggttcccgcgcggtcctgctgctgctcctcagtaacctgctcctgcagcgtgtatgtggccgcggccaggatgtggcggaaagggcgatgcgggcagaactccacgacatcggcgttgccgccaaggtggaaggaccccaaatccatctctagacctcgctttgccctcggcggcggcggcaaagactcgagaactcgaaatcgcttcgcttcagcggcgggggcaaaagagtcaatcagtcaaaaacctagtcataataacctatcctaatcatgtggcgggggcgagcaaacggtcacccatgggcaccttagccgcggcgatttccgtagtcgccgtctcgccggcgtccagccacgccggtggccgacgacaccgccgcggctctgtcgccatccgctgctcgtccgcggccaacgagcggcaggccctcttcagccgcatcgcccccgtctacgaccatctcaacgacgtgctcagcctggggcagcaccggacgtggaagcgcatctgcgtctcttggtccatggcgaagagaggtgatcgggttcttgatctctgctgcgggagcggggatttggcgttccttctgtctcagaaagtaggactagatggagaggtgatggctgtcgatttctcaaggcaacaactgcaaactgctgctagccgtcgggatcaacgctggaactcttgctacaagaacatcaactggatcgagggcgatgcacttgatttacctttcacagactgctactttgatgctgttacggttggttatggattgcgcaatgtggttgacaaacccaaagcaatgcgagagatttttagggtccttaaaccaggaacaagagcatctgttctcgattttaacaagagctcatcatttttcacaacatcgttgcagagttgggcgatcgataatgttgtggttcctctagctagtggttatggacttactgaagagtacaagtacttgaaaagttcgatatcacagtaccttacaggagaggagttggagaagttagccaaagaagtcgggttctcttccgccaagcactatgaacttggcggagggctcatggggaacttagtcacaactcgttgagtagaattgtagcgatgaaactctctatatgctttgtgtgaattttgtgagttagattccttttcttctacatcattcgagtatccagttttgctgatcccataaggagccatgctccaactttcccagatgtgcatttcccctgtttgagtaagaaaggcatggaaacacgtatggcctgccgctcagtgcaggtgccgttcgatcgaaatcaaa

SEQ ID NO: 2693 - DNA, 857 bp, Hordeum vulgare
gcgagcaaacggacaccgatgggcaccgtgacgattcccgtgaccgccccggcgacgacggcggccagccacgccggcggccgacgacgctatgtcgccgtgcgctgctcctccgcgtccgacgagcggcaggccctcttcagccgcatcgcccccgtctacgaccatctcaacgacgtgctcagcctggggcagcaccggacgtggaagcgcatctgcgtctcttggtccaaggcgaagagaggggatcgggttcttgatctctgctgcgggagcggggatttggcgttccttctgtctcagaaggtcggcctggacggggaggtgatgggcgtcgatttctcagggcagcaactacaaactgctgctagccgtcaggaccagcgatggaaggcttgctacaagaacatcaaatggatcgagggcgatgcacttgatttacctttcacggaccgctactttgatgctgttacggttggttatggattgcgcaatgtggtggacaaacccaaagcgatgcgagagattctgagagtcctaaaaccagggtcacgagcatctgttctagatttcaacaagagctcatcatttttcacggcatcgttacagagctgggcgatcgataatgtggtcgttcctctggctagtagctatggacttactgaagagtacaagtacttgaaaagttcgatatcacagtatcttacaggagaggaattggagaagttagccaaggaagcagggttttcctcagccaagcactatgaactaggtggagggctcatgggaaacctagtagcaactcgctgactagaattttagcgatgaacggtgatctgtacgaattatctgaattt

SEQ ID NO: 2694 - DNA, 937 bp, Triticum aestivum
ccacgcgtccgagcaaacggacaccgatgggcaccttagccgcggcgattcccgtgaccgccggggcgacggcgccgtccaggcacgccggcggaagacgacaccgcccccgcggctccgtcgccgtgcgctgctcgtccgcggccgacgagcggcaggccctcttcagccgcatcgcccccgtctacgaccatctcaacgacgtgctcagcctggggcagcactggacgtggaagcgcatctgcgtctcttggtcaatggcgaagagaggggatcgggttcttgatctctgctgcgggagcggcgatttggcgttccttctgtctcagaaggtcggcctagacggagaggtgatgggtgtggatttctcagggcagcagctgcaaactgctgctagccgtcaggaccaacgctggaaggcttgctacaagaacatcaaatggatcgagggcgatgcacttgatttacctttcacggaccgttactttgatgctgttacggttggttatggattgcgcaatgtggtggacaaacccaaagcaatgcgagagatccttagagtcctaaaaccaggatcacgagcatctgttctagatttcaacaagagttcgtcatttttcacggcatcgttacagagttgggcgatcgataatgtcgtggttcctctggctagtagctatggacttactgaagagtacaagtacttgaaaagttcgatatcacagtatcttacaggagaggagttggagaagttagccaaagaagcagggttttcctcagccaagcactatgaacttggtggcgggctcatggggaacctagtagcaactcgctgattagaattgtagcgatgaacgggatctgtatgaattatctgaattttaatttaaataattaattttcctctgcattaccgaatatgcagtttggctgatcc

SEQ ID NO: 2695 - DNA, 934 bp, Triticum aestivum
ccacgcgtccgagcaaacggacaccgatgggcaccttagccgcggcgattcccgtgaccgccggggcgacggcgccgtccaggcacgccggcggaagacgacaccgcccccgcggctccgtcgccgtgcgctgctcgtccgcggccgacgagcggcaggccctcttcagccgcatcgcccccgtctacgaccatctcaacgacgtgctcagcctggggcagcactggacgtggaagcgcatctgcgtctcttggtcaatggcgaagagaggggatcgggttcttgatctctgctgcgggagcggggatttggcgttccttctgtctcagaaggtcggcctagacggagaggtgatgggtgtggatttctcagggcagcagctgcaaactgctgctagccgtcaggaccaacgctggaaggcttgctacaagaacatcaaatggatcgagggcgatgcacttgatttacctttcacagaccgttactttgatgctgttacggttggttatggattgcgcaatgtggtggacaaacccaaagcaatgcgagagatccttagagtcctaaaaccaggatcacgagcatctgttctagatttcaacaagagttcgtcatttttcacggcatcgttacagagttgggcgatcaataatgtcgtggttcctctggctagtagctatggacttactgaagagtacaagtacttgaaaagttcgattgcacagtatcttacaggagaggagttggagaagttagccaaagaagcgggtttttcctccgccaagcactatgaacttggtggcgggctcatggggaacctagtagcaactcgctgattagaattgtagcgacgaacgggatctgtatgaattatctgaattttaatttaaataattattttcctctgcattaccgaatatgcagtttggctgat

SEQ ID NO: 2696 - DNA, 990 bp, Panicum virgatum
gcatatcctaatcgctaatcgggggcgagcgaacggacacgatgggcaccgtgaccgcggggatttccgtatccgccgccgcggcggtggtggtgccccgcccagccggccgccaacgccaccgcggccccgccgcctttcgctgctcggcctccgcggccagcgagcggcaggcgctcttcagccgcatctcccccgtctacgaccatctgaacgacgtgctcagcctggggcagcaccggacgtggaagcgcatctgcgtctcatggtcgagggcgaagatgggggatcggattcttgatctctgctgcgggagcggggatttggcgttcctgctgtctcagaaggtcggcttagatggagaggtgatggccgtcgatttctcgaggcagcaactgcagactgctgctgaccgtcaggagcaacgctggaagctgtgctacaagaacatcaaatggatagagggtgatgcacttgatttaccgttcacagactgctactttgatgctgtaacggttggctacggattgcgtaatgtggttgacaagtccagagcaatgcaagaaatatttagggtcctgaaaccaggatcaagagcatctattcttgattttaacaagagctcatcacttttcacggcatcattacagagttgggcaatcgacaatgttgtggttcctttggctagtggctatggactcactgaagaatacaagtacttgaagagctccatatcacagtatctaacaggtttgtgtgtttatttccttctccaagaacacatccatgaaagagcagggttgtctttctgatggcagacgcatagggatacctcacaattctcactcttggactgatggggtacaaatacaagatagcaccatttttccccttttcacactggaccacagcacttatttttcacaaaagtttgcatttcctgctctgaagaacggaagtgcttggttccattttgttacgtaaaccccc

SEQ ID NO: 2697 - DNA, 883 bp, Panicum virgatum
  misc_feature (214)..(214): n is a, c, g, or t
gcgagcgaactgacacgatgggcaccgtgaccgcggcgatttccgtatccgccgccgccgcggcggtggtgtcccgcccagccggccgccgacgccaccgcggccccgccgcctttcgctgctcggcctccgcggccagcgagcggcaggctctcttcagccgcatcgccccgtctacgaccatctgaacgacgtgctcagctggggcagcacnggacgtggaagcgcatctgcgtctcgtggtcgagggcgaagatgggggatcgggttcttgatctctgctgcgggagcggggatttggcgttcctgctgtctcagaaggtcggcttagatggagaggtgatggccgtcgatttctcgaggcagcaactccagactgctgctgaacgtcaggagcaacgctggaagctgtgctacaagaacatcaaatggatagagggtgatgcacttgacttaccgttcacagactgctactttgatgctgtaacggttggctacggattgcgtaatgtagttgacaagtccagagcaatgcaagaaatatttagggtcctgaaaccaggatcaagagcatctattcttgattttaacaagagctcatcacttttcacggcatcattacagagttgggcaatcgacaatgttgtggttcctttggctagtggctatggactcactgaagaatacaggagaagagttggagaaattagcagagaagctggtttcactgtaaccaagcactacgagcttggcggagggctcatggggaacctatagcaactcgatgagcagaatatcgcgagaaacttttcaaagtgcgagtcccctggatgtttaactgatttttacatgccccatgtctatcgaaatgtcatgttgtgcc

SEQ ID NO: 2698 - DNA, 1408 bp, Panicum virgatum
aaagttaaaccctggttcccatcgcgctgccggcgccgccaccgcactagccgttgccgctccccttcccttccgtttccccttcccaaggagcccgtcctcgcacgcgcgcggcgaagaggaggcggatccggaggcgcggccgcgaaggtgaccagagatggcgtcgcggacggcgtccaaggacatcatcacgctgcggggctccgccgccatcgtcagcgagttcttcggctacgcggccaatagcatcctgtacaaccgcgcggtgtacccggaggagagcttcaccaaggtgaagaagtacgggctcaccatgctgctcacgcaggacgagggggtgaagaccttcatcgccagcctaacctcccagctctcagagtggctggaggccgggaagctgcagcggattgtgctggtgatcatgagcaaggccaccaacgaggttctcgagcgctggaacttcaacatagtgaccgacgccgaggtcgtcgagaagggggcgatcaaggagaaaagcgacaaggagatcatgcgggagatccaggccatcatgcgccagatcgcgtcctgcatcacctacctcccctgcctcgacgagccatgcgtgttcgacgtgctggcctacacggacacggatgtcgacgcccccggcacctgggtcgagagcgacgccaagctcatcagcaacccacagatggttaagctgcactcgttcgacaccaagattcataaggtggacacgctggtctcgtacaagaaagacgagtgggacgaggaagaatgaaaagtttaggagcacgatgcgtggcgcgtgcttggcgtgaaggttgtgtgaatctttcattcacgtctaggcgcctagacgtgaatctctgaacctctggaactggaaacaatgtaattctggggatgaaacttccctctagcgaatgaccatgtgttatcttccatatgctgttttacttacatcactcgtcgctaacaagcactggtgaggtagtcaactgagaaaacaagaacattgtagctggatccaggtcctgctgaaccgtatcgagaggtgtaccttttttgctgagtatttatcttcatgctctttggcacattcagatatatagatattctgtaaggccacatacagtctagttaaccagaggatcacttaatgcacactttgcatataatcagccacatttacattctaattaactagagaatcacttacactccaattgcatataatcagctacatttatattctaattagcaatatcatcagctacatttacactttgcatataatcagagaataaaggatggactgacttaaattacactaaatggtagtatactatgcttccactgacacacatacatgcctagcccaggcagatgtcacaaaatt

SEQ ID NO: 2699 - DNA, 1121 bp, Panicum virgatum
accgccactgtctggctgtctcgacccgttcgaaaacgctcccacaagttcccacttcccatcgcgctgcgccgccgctagccgttgccgctcccctttccttcccttccgtttcccattcccaaagagtctggtcctcgcacgcgcggcgaagaggaggcggatccggaggcgcggtcgagaaggtgaccagaggagatggcgtcgcggacggcgtccaaggacatcatcacgctgcggggctccgccgccatcgtcagcgagttcttcggctacgcggcgaatagcatcctctacaaccgcgcggtgtacccggaggagagcttcaccaaggtgaagaagtatgggctcactatgctgctcacgcaggacgagggggtgaagaccttcatcgccagcctcacctcccagctctcagagtggctggaggccgggaagctgcagcggattgtgctcgtgatcatgagcaaggccaccaacgaggtgctcgagcgctggaacttcaacatagtgaccgacgccgaggtcgtcgagaagggggccatcaaggagaagagcgacaaggagatcatgcgggagatccaggccatcatgcgccagatcgcgtcctgcatcacctacctcccctgcctcgacgagccatgcgtgttcgacgtgctggcctacacggacacggatgttgacgcccccggcacctgggtggagagcgacgccaagctcatcagcaacccgcagatggttaagctgcactcgttcgacaccaagattcataaggtggacacgctggtgtcgtacaagaaagacgagtgggacgaggaagaatgaaaagttcaggagcacgatgcctggcgcgtactgccgtgaaagctggcttgacgtgaaggttgtgtgaatctttcattcacgtctaggcgcgcgtactggtctactgctgctgctcctctagggaatcttactgctttgggttgaaagaaaagtctgctgcctgtgatgcttctgccaaattgccatttttgcgtattccctgaaatcactgaacctctgaaaacaatgtaattctggggatgaaacttccctccagtgaatgaccatttgctatctttatatgatgttttactttc

SEQ ID NO: 2700 - DNA, 1325 bp, Panicum virgatum
accgccgtgcgaaacaccaccactgtctggctgtctcgacccgttcgaaaacgctcccacaagttcccacttcccatcgcgctgcgccgccgccacactagccgttgccgctcccctttccttcccttccgtttcccattcccaaagagtctggtcctcgcacgcgcggcgaagaggaggcggatccggaggcgcggtcgagaaggtgaccagaggagatggcgtcgcggacggcgtccaaggacatcatcacgctgcggggctccgccgccatcgtcagcgagttcttcggctacgcggcgaatagcatcctctacaaccgcgcggtgtacccggaggagagcttcaccaaggtgaagaagtatgggctcgctatgctgctcacgcaggacgagggggtgaagaccttcatcgccagcctcacctcccagctctcagagtggctggaggccgggaagctgcagcggattgtgctcgtgatcatgagcaaggccaccaacgaggtgctcgagcgctggaacttcaacatagtgaccgacgccgaggtcgtcgagaagggggccatcaaggagaagagcgacaaggagatcatgcgggagatccaggccatcatgcgccagatcgcgtcctgcatcacctacctcccctgcctcgacgagccatgcgtgttcgacgtgctggcctacacggacacggatgttgacgcccccggcacctgggtggagagcgacgccaagctcatcagcaacccgcagatggttaagctgcactcgttcgacaccaagattcataaggtggacacgctggtgtcgtacaagaaagacgagtgggacgaggaagaatgaaaagttcaggagcacgatgcctggcgcgtactgccgtgaaagctggcttgacgtgaaggttgtgtgaatctttcattcacgtctaggcgcgcgtactggtctactgctgctgctcctctagggaatcttactgctttgggttgaaagaaaagtctgctgcctgtgatgcttctgccaaattgccatttttgcgtattccctgaaatcactgaacctctgaaaacaatgtaattctggggatgaaacttccctccagtgaatgaccatttgctatcttttatatgatgttttactttcacatcactcgtcgctaacaagcgtttgtgagataccaaaagtccatttggcaaatatgtgctggagtcaagtagtcaactgagaacacaagaacattgttgcccttggaaccggcgtcctgctgaaccgtttctcatcgagaagtgtaccttttttgcagagtagttttccctcatgctcttt

SEQ ID NO: 2701 - DNA, 1064 bp, Setaria italica
cgaacaccatcccacccacctgtgtcgacccgttcgaaaacgctccggaaagacacacgagtccccatcgcactgcgccgccgccgcactagccgttgctgctccccttccgctcccattcccaaggagctgtcctcgcacgcgcgcggcggagaaaggaggcggatccggaggcgcggccgcgagggagggaaggagaggagaccagagatggcgtcgcggacggcgtccaaggacatcatcacgctgcggggctccgccgccatcgttagcgagttcttcggttacgcggcgaatagcatcctgtacaaccgcgcggtgtacccggaggagagcttcaccaaggtgaagaagtacgggctcaccatgctgctgacgcaggacgagggggtgaagaccttcatcgccagcctcacctcccagctctcagagtggctggaggccgggaagctgcagaggattgtgctggtaatcatgagcaaggccaccaacgaggtgctggagcgctggaacttcaacatcgtgaccgacgccgaggtcgtcgagaagggggctatcaaggagaagagcgacaaggagatcatgcgggagatccaggccatcatgcgccagatcgcgtcctgcatcacctacctcccctgcctcgacgagccatgcgtgttcgacgtgctggcctacacggacacggatgtcgacgcccccggcacctgggtcgagagcgacgccaagctcatcagcaaccctcagatggtcaagctgcactcgttcgacaccaagattcacaaggtggacacgctggtctcgtacaagaatgacgagtgggacgacgaggagtgaagttctcaagagcatcaagtataccctgctcttggcgtgaaggctgtgtgaatcatttattcacgtctaggcgcgtgctgtactagtctaccgctactactgctttggggtgaaagaaaagtctgatgcctgtgacatttcttgcgtgttccctgaaatctctaaacctctgggagtgggaggcatatgtaattctgagattgaaattcccctctagtgaaagcaac

SEQ ID NO: 2702 - DNA, 1276 bp, Sorghum bicolor
cagtgcgtgtggcccacacccacacgaccgttgggcgcgccggtccggcccactttaaaaacccccgtacccgtccaccaccgtgcgaacacatccgatccacccaccagagccggtcgatccgttcgaaaacgctccgaaaagaccccacgagttcttctcccacacccaccacccacaccgcactgctccgccgccgccgcactagccgttgccttctccccttcccttccccgttcccattcccaaggagttatcctcaccggcggatccggggcgccgcagcaagagggaggaaggaggaggagaggatactacccgaatggcgtcgcggacggcgtccaaggatatcatcacgctgcgaggctccgccgccatcgtcagcgagttcttcggatacgcggcgaatagcatcctctacaaccgcgcggtgtatcctgaggagagcttcaccaaggtgaagaagtatgggctcaccatgctgctcacgcaggacgagggggtgaaggacttcatcgccaacctcacctcccagctctcaaagtggctggaggccgggaagctgcagcggattgtgctggtgataatgagcaaggccaccagcgaggttctcgagcgatggaacttcaatatcgtcactgacgccgaggtcgtcgagaagggggctatcaaggagaagagcgacaaggagatcatgagggagattcaggccatcatgcgccagatcacctcctgcatcacctacctcccctgcctcgacgagccatgcgtgttcgacgtgctggcctacacggacaccgacgtcgacgctccgggcacctgggtcgagagcgacgccaagctcatcgacaacccgcagatggttaagctccactcgttcgacaccaagattcataaggtggacacgctggtgtcgtacaagaaggatgagtgggacgaggagtagggtttgcaccaagtaccctgctatcgctagagcttggcgtgaaggcagtgtgaatcgttcattcacgtctagcgcgtactcccactcctaccaaaccattcttgcgtattcccctgtctggagccctggaagctatgtaattctgggattgaaatgcaaccttttgcgatctttttagatgctgtttttacttttataatatgacatgtcgctgacaagcgcctgtgcgatgtaacaattatcttgcccgtttagattccctggacacaatgtgctggaaactttcagatttactgcaagtaatcgtagaacaatctagttctctggagg

SEQ ID NO: 2703 - DNA, 3502 bp, Oryza sativa
cggttctactagtagtctactggtaccagtacaattcatcatcaacaagaggtaaaggactcgaagagagcgcgcggcttgggcgaatcgcgccaaccgaagcccactggcccaccgcccacacgaccgttgggagcgcaggtccggcccacctttaaaaactcccgaaacccacccgcacgccgacaccttctctcccccgcacctgacccaacacgacccatcgacaaacaacgctcccaagttcccaagcgccgcagcccgcagccgatccgctccacactagccgttgcctttgcccggcttttccccccctttcctctttcctctccccccatccgccgccgccgccgccgccgcacgggaggcaagaggaggagttaagaaggtgaggcggatcaggagatggcgtcgaggacggcgtccaaggacatcatcacgctgcggggctccgccgccatcgtcagcgagttcttcggctacgccgcgaacagcatcctgtacaaccgcggggtgtacccggaggagagcttcaccaaggtgaagaagtacggcctcacgatgctgctgacgcaggacgaaggggtgaagaccttcatcgccaacctcaacacccagctctcagagtggctggaggccgggaagctgcagaggatcgtgctggtgatcatgagcaaggccacctccgaggtgctggagcggtggaacttcagcatccagaccgacccggaggtggtcgacaagggtgtcatcaaggagaagagcgacaaggagatcatgagggagatccaggccatcatgcgccaggtcgcctcctgcatcacctacctcccctgcctcgacgagccatgcatattcgacgtgctggcgtacaccgacatggacgtcgcggtgcccttcacctgggtggagagcgacgccaagctcatcgagaatccacagatggtgaagctgcattccttcgacaccaagattcacaaggtggacacgctcgtctcctacaaggtcgacgagtgggacgaggagtagaagccgccggtggaggttggagccatgaggaggagacccccttgctagtttattgctgctagcttatttagctagcttagcttgctaggcgtgatgcttgtgtgaatcgttcgttcattcacgccctagccctatcggaactcgtgtgctctgggagaatcccttttcttgttctttaccgcattttgggagaatcgactgtgtatcgctgcttcaccatgatttttttttcctcagcctttgaaatcctgggttgaaagtaccactggagttgaatgcatcgtgatcgtgtgccacgatttcttcactgtgttgttcaattatatgtgttgtttctcacttcagaatctcaaaagattcaaggtgttttgaagtcatatgctctgtgaataacaaaatgcacttaaattaaaagtaattctgtaccatcttcaatctcaagacagccgtatcctcaaagtttatgttatatcgaccaccgtttttcttgtcaaaacttgcatattaaattagaagtaattttgtaccatcttcaatctcaagacaaaatgcacttctgctgaatgaatttattccagcttcggaacttccaaggctgtttgcaacaatccatcagaaatcttacattttgccagacaaccttcgttgtccggacaaattacacttctgatgaatgtatttgtttccagcttccaagactatttgtgacaaatgtaaaacccagtatcagcatgggtaacaaacacattggaaactaactaacaccaagatgctacagagctacatttacatttacatataaaccagaggaaccccaggacctgttggcagcaactaacaggtcctcatttaggctgtaatctttgtactcagccaaagcaccttggatcttcagagagcttgaatgatcatatttccaactttcaagttccaacttccaaggctatttacttcgggtaaccaatgtatatccagtataacttttccccttcggctgcatggacatttaaaattagcttaggtcaagatgccaaaagctaaatttacaataaccaggaacccatgatttgcttggcttcaaattgcattaaaaggtaggagtatgctccatatctactttggatatattatatgccttggtcaggcaatgtcaccaaatcaatcaccaagtgatcgcatcccttcataaatcacaccaggacgaaggtcatccagagtatcggcgattctgtagcctgaatactccctgaggagtgtccaaccacgccgcgagagaaagtctcggaagtcctcttcagtgtagaatgtcttgtcttctgtccggacctcatcattttcgaacatatatagtttgatggtcattcctgtgaacattgaatgcagcaatgattgaatcaatataactctatctgattccaaaataagttgttttagatctgtgcactaactcaaattgaccttgttggccttcatttatattacattggaaaatatgtatcatttctttatgagagaaggagcatctattttggaaggacaatcatggaggaattttttttgaataagtgcttagaagttcctaaatgacttactaaggaaattgttgagaagtctaaagtaatctatatttggaacaaaagggagcagtgttgatgaacatccttcagtagagtttgaaaaaaaaaacttcagaaaaaaaactaaatcttttagttggcaatgcgcaacttggacgcaaaatagcatcgtaaattgagacgtaaattacaactgataaaacatgatattttttacagtttgttggtaatgagagtgtcattcactattggcagcatccaaacataaatactgacaaacatcactagtatacaaatacccccaaaagaaatttctagttagcaccatactttctagttagatgtacagatgaccaacatgaactagttagctcaacaagaagaatctcaaacaagaaatcggcattcacatttaaagttaatggatgcaaatcttctgtgtggtgccacttgctttcagttcttagttagggtctactgcaccaaccaagtcacaaactgaaaagccatatgttccaaaataatccccccaccacacacaacaacaacaacaacaccacaatacagaaaatactgttacaaatctaaataatctactacggtattcctagttgtggagaaaacaaagtcttgtccataagcagagaaaacgttttccgattaccggtatcgagatgaagggtgtatgttccaaccggcatatccctgtctaaggaacggacaacctcatcctcatcttcaagccaaaaggcccgtcttgttcttagaccaaatgccgatttgatggcttctttaattgcgtctgcagtaccatcaatgcctattcttttagtgtaatcaccccacttgactaaaatgactctcccaccaaaagtaacctgattatctccacctgt

SEQ ID NO: 2704 - DNA, 1035 bp, Aristolochia fimbriata
aacgaaaaaaaactaagccgttgccgcctttttgagccctttcatcttcttcatcgcgacaccctaactcattcctctgtcgtctccccactctgacaatcgttcgcatctccttctcggctcttaacgcagagagagaagcgcataaaggaaaaacccacaaaagggaaatggcttcaaaaactattgccaaagacataatcacgctccgaggatccgccgccatcgtcagcgagttctttggttacgctgcaaacagtattctttataatcgggctgtttatcccgaagaaagctttgcgaaagttaagaaatatggcctgccgatgctattaacacaggacgaaggtgtcaagaccttcattaccaatctgactgcgcaattatcagaatggctagaagccgggaaacttcagaggattgttctcgtgataatgagcaaagccacttcggaggtactagagagatggaatttcaatattgaaactgataaggaagtcgtagaaaaaggggtatcgagggagaagagtgacaaagagatcatgagagagattcaagcaattatgcggcagattgcttcttccattacctacttgccatgccttgacgaaccatgtgtcttcgatgtgttagcttacactgacacggatgtggctgttcctttggcttggatcgagagcgacgccaagctgataaagaacccacaaatggtgaaactccattcttttgataccaagattcataaggtagacactctggtctcctataaaaatgacgactgggatgaagaagagtagacactcgccatcttttttagatagatacatttgtctgtctgtgaattctttattcacgttactgtgtgtgtgtgtgtgtgatgcatgtcttccttgaatgatgatggttttaagaaaaaaaagtgtttttgtttcactagtaaaatatgatgtagttcatcttgatttaacgtgatgggcacccctaaactatcacaaaaaaaaaaaaaaaaggacggatgcgttgttaccactgctt

SEQ ID NO: 2705 - DNA, 1653 bp, Brachypodium distachyon
cccaccccccgtgcgcaacaatccacgatccatttcgaaaacgctctgaggaatccagacccgagtcccccaatcccccacaaacgcagccgccacgccgtactactgaccgttgccgcgccctaactcctcgcacgcaggcggagagagagaaggcaaggaggcgccgccgccgccgccgccgcaaggaagaccccggaagtccgaaggaaaaaaaggaggagagatggcgtcgaggacggcctccaaggacatcatcacgctcaagggctccgccgccatcgtcagcgagttcttcggttacgcggcgaacagcatcctgtacaaccgcggggtgtacccggaggagagcttcgccaaggtgaagaagtacggcctcaccatgctgctcacccaggacgaagccgtcaagaccttcatcaccaacctcacttcccagctctccgagtggcttgaggcggggaagctgcagaggatcgtgctggtcatcatgagcaaggccaccggcgaggtgctcgagcgctggaacttcaacatcgtgaccgacggcgaggtcgtcgagaagggggtggtcaaggagaagagcgacaaggagatcatgagggagatccaggcgatcatgcggcaggtcagctcctgcatctccttcctcccctgcctcgacgagccatgcatattcgacgtgctggcatacaccgacaccgacacctccgtgcccttcacctgggtggagagcgacgccaagctcatagacaacccgcagatggtgaagctgcactcgttcgacaccaagatccacaaggtggacacgctggtctcgtacaagaacgatgactgggatgagcagtagcccgaccggcgaccaaggagcgtccagacctctcccctgctttatagctatgtgtgaatcgttcattcacgtctgggtgtgtgctgttgctcccgctgcgggaggaaccgaggaactatgctctttcccttctgtcgtgcttgtgtgtacctttgggattggatgaatgcatcgctaccatgtttctacttctacattatgtttgattgtaaatcggaaaaaagttctcacagtatttgaggcataacgtgaaatttttcagttgtagtttgctgctctcaagtcattacgagtgtattttgattgtcagtttgtctcaacaaaagtttggcaacgccttcgtgctcagtaacataatgcggtacccagcataataccttgctgaatgaacttgtctccaaggctctttgatcgtcatctggaagatgactggtgtgatttacatacatatatagtgagaggtaaccaagactcgcttggcttcaaactatgttaaactgtatggtccacttctattgtggacagaaattagatgccctttgtgagggaaatgctgacaaaaaatcaatcgataagcgaacgcatcccctgataaatcacaccagggcgaagatcatccagagtatcaacgactctgtagccactatactccctgaggagtgtccaaccttgccgcgacaggaaatctctgaagtcgtcttcagtgtagaacgtcttatcttctgtccggactgtcatgcggtcagcatctgtgcagagcttgattggtatccctgaaatgagcataacaggaatgagcttgg

SEQ ID NO: 2706 - DNA, 1222 bp, Musa acuminata
ggttaatcccgcaaaagtgggtcctatttcccttcttttttttttttgccgtattattctctcctttctgaccgttgcgaaggcgagcgttcaaacgccgagaggcaaacgccaggaagcctccggaatagcaagagaggaaaactagccgttaaaatatcagcgcccctcctctcctatttatcatgtctattccctccctcgaaagaggtcgattcaagaagcgagagcaaaccctaccgaacggctcatccaaacatcaggaagcgatcttgaaagtagaggatggggtcgagaacagcctccaaggacatcatcaccctccgtggctccgccgccatcgtcagcgagttcttcgggtatgcggcgaacagcatactctacaatcgaggcatctacccggaagagagcttcaccaaggtgaagaaatatgggctgccgatgctgctcacccaggacgagggcgtcaaatcgttcctcgccggcctgacatcccagttgacagaatggttggaggctgggaagctgcagagggtggttctagtgatcatgagcaaggccacctcagaggtcctggagagatggaatttcagcatagagacagatgccgaggtcgtcgagaagggtgtcatcaaggagaagagtgacaaagaaatcatgagagagattcaagccatcatgcgtcagatagcctcctccattacttacctgccctgtctcgacgaaccctgcgtgtttgatgtgctggcctacactgataaggatgtcgctgtcccgttcacttggattgaaagtgatgcaaagctgatcaaggacccccaaatggtgaagttacattcctttgataccaagatacacaaagtggacacactggtttcttacaagaacgatgactgggatgagcagtagcagctgtaaatgggattccttcacgcctctaaacaaattgtgtgatcggagggagacatggctctcctgtgaatcattcattcactcttaggataggagtgtatgagcattttgtgctgaaatgtggtggcaacatttcatgcttcttatgaagttgttgtgtgcttcgaatcaagctctcctgtgaatcatttatcactatcagtaatccattcttccgactgttgccggtggtagcatttggtaccgaagcgtgaagacaacaaacattttctattacatctgaattcagctcgggaccaccgtgtgacct

SEQ ID NO: 2707 - DNA, 804 bp, Rosa hybrid cultivar
gcacgagatcaagttttaatctttctctcttcccagattgaatcggatagaatcgttattgggtttcggatttttttgggtactaatggcttcatcaagaaccgcaaccaaggacatcatcactctgcgtggctccgctgccattgtcagcgagttttttggctattcagcgaacagcattttgtacaatcgaggagtgtatcctgaagaaagttttgttaaggtcaagaaatatgggctgcctatgttgctcactcaggatgagggtctcaaatcttttattgccaatctaacttcccagctttctgaatggctggaatctggcaagttacagaggattgttctggtgatcatgagtaaggccactaatgaggttctagagaggtggaacttcagcatcgagactgacagcgaggtcgtcgagaagggtgtttcgagggaaaagagtgacaaggagattatgagggagattcaagcaatcatgaggcagattgcttctagcattacttatctgccatgccttgatgaaccctgtgttttcgatgttttggcatacactgataaggatgttcaagtcccattcacttgggtggaaagtgatcccaaactgatagacaatccacaaatggtgaagctgcattcctttgacaccaagattcacaaggtcaacactctggtatcctacaagaacgatgaatgggatgaggagtaggatataatccatttgtcctagactctggtgttgtgaatgtttcagttcacattttgttaatagttggaaagttgacgattcatgtactactg

SEQ ID NO: 2708 - DNA, 774 bp, Amorphophallus konjac
tcttcggcaataacccatttcccctgtttccatcgataaaaaagggaagagagggggctccttctcttcgatccggcagaagaacacacggaaatcgccagggcagaagcggggaaagaatggcttcccggacccagaacaaggacatcatcacatcaagggctccgccgccatcgtcagcgagttcttcggctatgcggcaaacagcatcctctacaaccgaggggtctatccggaggagtccttcgccaaggtgaagaagtacggcctgcccatgctgctgacccaggacgagggcgtcaagtccttcctcgccagcctcacctcccaattgtccgagtggttggaggccgggaagctgcagagagtggtcctcgtgatcatgagcaaggccacctccgaggtcctggaaaggtggaacttcaacatcgagaccgacgccgaggtctcgagaagggcgtctcgagggagaagagcgataaggagatcatgagggagatccaggtgatcatgcgccagatcgcctcctgcgtcacgtacctgccgtgcctcgacgagccctgtgtttttgatgtattggcctacactgacaaggatgtgctgtgcccttcacttggatcgagagcgacgccaagctgatcaagaaccctcagatggtgaaactgcattcctttgataccaagatccacaaggtggatacacttgtttcttacaagaacgatgaatgggacgaacagtagtagctagcagcatttcacccccccagttgggggg

SEQ ID NO: 2709 - DNA, 956 bp, Allium cepa
cagtcgattcatctgcattcatttgttctctctttccttcattactctgaattccatttgtttttcatcttctgcattataaattttgtgtaaatcgaaattataactctttcgatcaaaataataatggcttcacgaacgctatctaaggatatcatcactctcaagggctccgcagcaattgtcagtgaatttttcggttatgctgcaaacagcattctttacaatagaggagtttaccctgaagaaagtttcagcaaagtcaaaaaatacggtctttctatgcttttgactcaagatgacggtgtaaaatctttcatgtccagcattacttctcaattatcagagtggcttgaagctgggaaactgcagaggattgttcttgtaattatgagtaaggcgacttccgaagttcttgagagatggaatttcagcatcgaaactgattctgacgtcgttcaaaaaggagttgtgaaggagaagagtgacaaggaaataatgagggagattcaagcaatcatgcggcaaatagcttcttgcattacttacttaccttgtctcgatgaaccatgtgtgtttgatgtgcttgcgtatactgacaaagatacagaagtgccacttgcttggatggagagtgatgcaaagttgattaagaatcctcaaatggttaagttgcattcatttgataccaagatacataaggtggatacaatggtttcttataagaatgatgagtgggatgaagaagactgagcttgattgggttatttggtgaattgttcattcacattcgtatctaagtgtgtgctctgaaccaggcatttatatgatggaatgtactctattgttatttggatttgaactattttggtattgtaaaacagctatgtgattccatgcccgcttgctgtgatcaggatttgtatgcattggtttcctttgtgggatgtgtcaaa

SEQ ID NO: 2710 - DNA, 1127 bp, Populus trichocarpa
tagaaaactagccgttacttcccctagcgtctttacatttcatcaaaccctaatctgtttctctcataactccctcaccaaacactgatttcttgcaatcaatcctcaaaaaaacaaaacaaaacccaattttcttgttcaaaaatcgaaacccacatttgattcttttgtttgaaacagacccagattgttttttttccctcttatctccccgtgtaggtttacagtgtttcagtggtgaaagagaattatggcatccagaacggttgcaaaagacataattactctccgtggttctgcagcgattgttagcgagttctttggatatgcagcaaacagtatactttacaatcgaggggtttatccggaagagagttttgtgaaagtgaagaagtatgggctcccaatgttgcttactcaagatgaaggtgttaaatccttcattgctaacctgaatgcacagttatcagaatggctggaagctgggaaattacagagggttgttctggtgataatgagtaaggccacgaatgaggtcctagagaggtggaatttcagtattgagactgatgctgaggttgtggagaaaggactgtcaagggaaaagagtgacaaagaaattatgagagagatacaggcaatcatgcgtcagattgcatcaagcattacttacctgccatgccttgatgaaccttgtgtttttgacgtgttagcgtacactgataaagatgttacagtcccattcacctggattgagagtgaccctaaacttattgccaatccacaaatggtgaaattgcattcttttgataccaagatacacaaggtcgacactcttgtttcgtacaagaacgatgagtgggatgagcagtagaggtggcctatcgttgtttctggatttctccttcagtgtgtcactgtgaatcttttattcacatgttctaaaaacattgctaaaaatgatttgtacctattgtaactgtccatctatgtgtgctcttgtcgaagttgaaacgaaggattgcaaatctagctcttatcctgcttccctgtcttgttatgccagaatgcacgtcggtagaatatgaatggatcttttttctttccctcgtatctttctttcttat

SEQ ID NO: 2711 - DNA, 1110 bp, Populus trichocarpa
tagaaaactagccgttacttcccctagcgtctttacatttcatcaaaccctaatctgtttctctcataactccctcaccaaacactgatttcttgcaatcaatcctcaaaaaaacaaaacaaaacccaattttcttgttcaaaaatcgaaacccacatttgattcttttgtttgaaacagacccagattgttttttttccctcttatctccccgtgtaggtttacagtgtttcagtggtgaaagagaattatggcatccagaacggttgcaaaagacataattactctccgtggttctgcagcgattgttagcgagttctttggatatgcagcaaacagtatactttacaatcgaggggtttatccggaagagagttttgtgaaagtgaagaagtatgggctcccaatgttgcttactcaagatgaaggtgttaaatccttcattgctaacctgaatgcacagttatcagaatggctggaagctgggaaattacagagggttgttctggtgataatgagtaaggccacgaatgaggtcctagagaggtggaatttcagtattgagactgatgctgaggttgtggagaaaggactgtcaagggaaaagagtgacaaagaaattatgagagagatacaggcaatcatgcgtcagattgcatcaagcattacttacctgccatgccttgatgaaccttgtgtttttgatgtgttagcgtacactgataaagatgttacagtcccattcacctggattgagagtgaccctaaacttattgccaatccacaaatggtgaaattgcattcttttgataccaaggcaaatacacaaggtcgacactcttgtttcgtacaagaacgatgagtgggatgagcagtagaggtggcctatcgtttgtgtcactgtgaatcttttattcacatgttctaaaaacattgctaaaaatgatttgtacctattgtaactgtccatctatgtgtgctcttgtcgaagttgaaacgaaggattgcaaatctagctcttatcctgcttccctgtcttgttatgccagaatgcacgtcggtagaatatgaatggatcttttttctttccctcgtatctttctttcttat

SEQ ID NO: 2712 - DNA, 1238 bp, Phaseolus coccineus
aataaaaaaattgaaactagccgttatggtgcttccccatcaagtttcttttccacttccaatccctaatttattgccatctttttcccctttttcaaaccagttcactccgctcaccagataaaaaaatcgttctcattttgcttcaccgcgcaatcaccgatctcaaagtctaaaactttttaacgttttctctttgttggaaattacgcaccgaagaaagggaatggctgcaagaacagttgcgaaagacataatcactcttcgtggttccgcagcaatcgttagcgagttcttcggatatgctgccaacagcattctctacaaccgtggagtttatccagaagaaagttttgtgaaggtgaagaaatacgggcttcccatgttgctcactgaagatgagggtgtcaaatcctttatgaccaatctaactgctcagctttctgaatggcttgaggctggcaagttgcagagggtggtccttgttataatgagcaaggccaccagtgaagtgcttgaaagatggaacttcagcattgagactgacggtgaagttgttgagaagggtatctcgagagaaaagagtgacaaagaaatcatgagagagatacaagctattatgaggcagattgcttcaagtatcacctatttgccttgcctggacgaaccttgtgtttttgatgtgttagcgtacactgacacagatgtggcagttccattcacttggattgagagtgatccaaaacttattgcaaatccacaaatggtgaaattgcattccttcgatactaagattcacaaggttgacacactggtatcatacaagaatgacgaatgggatgaagagtagatgagtccctatctctgttcagcttcagcttttggttgttctcaggtcttgcagtgaattttctattcacattgtatgtttgtgcgtagtgctgtgtgtgtcaaactagtaaggtagtattaatccgcccttctgtgtgtttgacttgttgtggctgtaagaattgccatctcaagaattctccctgttcttcagaaggtggattcatcaatcatttcagtcttataaaataattaatcattctggttgttgaaactatgcatctaagtggcatgtcatagcaaatgaggttgcagccaaatacttcatgtaaatatgttgagatgttgaattgtttttttaatcattccatgaagtattttgagttaaatttattgataaatacttc

SEQ ID NO: 2713 - DNA, 1630 bp, Vitis vinifera
gacttgccccatttccccaaagcccttctctcaatctaaaccctttttctcttgattttctgtttgattcctgagaaataaaaccgatctgtttcagtgcttcatagttttttgtgggtttttttttttttttttttggtgtgagaaaaccctaattttttctcgcccaattcgattgacaaccaaaaaccctagtcatttaatggcttcaagaactgccaccaaagacatcatcactttacggggttccgccgcaatcgtcagcgaattttttggttatgctgcaaacagtattctatacaatcgcggagtttatccggaagaatcttttggaaaagtgaagaaatatggccttccaatgctgcttactcaagatgagggtgttaaatcgttcattgctaacctaacggctcagctttcggaatggctagaaactggaaagctacagagggtggttcttgtaataatgagcaaggcaacaaatgaggtgttggagagatggaacttcagcattgaaaccgatggtgaagtcgttgagaatggggtgtcaagggagaagagtgacaaagagattatgagagagatacaagcaatcatgcgacagattgcttccagcatcacttatttgccatgcatcgatgaaccctgtgtgtttgatgtgttagcatacactgacacggatgttgcagttccattcacctggattgagagtgaccccaaactgattgccaatccacagatggtgaaactgcattcttttgataccaagatacacaaggttgacactcttgtttcatacaagaacgatgaatgggatgaggattagaagaaatgagggggctcttgttgctattctttttcagtttctagaactatctatgagtgtggattctgtgaatcatttattcacattttgtaagctgagttggaaagatgatcttgttgagactctccgctgtcttttgagcgtggtttaacaatgaaatgaaaaggaatacaacaattttattctaggaacataaattatactgcaactattccaagtactgagatttctcagcaatgaaggtgtgtgtagtcaaaaaccaggcatcagagagaccaactccaatcataaattgacatttgcgagaatagtgtgtagtctatttacaagcggcccccacggtatgtcccagggaaacaaaaacccaaactcccattcctataatcaaacatgagtctactatttattttatgcacaattaagaagcattcttttagaatactttcccttgtgtcaaacaacattttagagcttcactggtaaaatctttctcaccacccaagttggggtgcgcagaggcgtgtgtgccccatttgcgcgcttgctcttttttaactcatcccacggtataatgaatcaggacgaagatcatccatattgtcaatgtttctgtacccatttaactccctaagagaagaccatccccgacgggtcagaaaatcacggaaatcttcttcagtataaaacgtcttctcctctgtgtggactggtatgtgctccgactcatcataatggcacacttttatgcctattcctgaaaataggagagctctcacattcagtacttcagacataactacagac

SEQ ID NO: 2714 - DNA, 1061 bp, Glycine max
ttcgctcacaagtgctcctccgaaaaccgaaataaaaccgttcccatcgtgcgaacaagttcaatcgattccaaagtctaaaactgtgaacgttctttattgtgaactctctgataaccgaagaaaaggacatggcctcaagaacagttgcaaaagacataatcactcttcgcggttccgctgcaattgttagcgagttcttcggatatgctgctaacagcattctttacaaccgtggagtttatccagaagaaagctttgtgaaggttaagaaatatggcctccccatgttgcttactgaagatgagggtgtcaaaacttttttagccaatctaactgctcagctctctgaatggcttgaagctggcaagttgcagagggttgtccttgttataatgagcaaggccaccagtgaagtgcttgaaaggtggaacttcagcattgagactgactgcgaggttgttgagaagggtgtctcgagggaaaagagtgacaaggagatcatgagagagatacaagccattatgaggcagattgcttcaagtatcacttatttgccatgcctggatgaaccttgcatttttgatgtgttagcgtatactgacaaggatgtggcagttccattcacatgggttgagagtgatccaaaactcattgcaaatccgcaaatggtgaaattgcattcctttgatactaagattcacaaggttgacacacttgtatcatacaagaatgacgaatgggatgagcagtaatggcagtccgtgtcttgtatttttttgttcagcttcttgcgttttgtttcttcaggtcttgagtgaatttcctgttttgttagacctgtaaattgtgaattttctattcacattgttagatgtgtgtactactctgggattcaacgggtatttattattaatcctcccttttgtatgtttgacttgttgtggcagtaagaattgccatgtgggatctcaagaaatctccctgttgttttcagaaggttggatttatcaatcatttcagtcttatgaaacaaatgccgcattccgagtattaattca

SEQ ID NO: 2715 - DNA, 1116 bp, Glycine max
ccctaatttattgccatcatttccccctttccaaagcagttgttcagttcatttcgctcacaagtgctcctccgaaaaccgaaataaaaccgttcccatcgtgcgaacaagttcaatcgattccaaagtctaaaactgtgaacgttctttattgtgaactctctgataaccgaagaaaaggacatggcctcaagaacagttgcaaaagacataatcactcttcgcggttccgctgcaattgttagcgagttcttcggatatgctgctaacagcattctttacaaccgtggagtttatccagaagaaagctttgtgaaggttaagaaatatggcctccccatgttgcttactgaagatgagggtgtcaaaacttttttagccaatctaactgctcagctctctgaatggcttgaagctggcaagttgcagagggttgtccttgttataatgagcaaggccaccagtgaagtgcttgaaaggtggaacttcagcattgagactgactgcgaggttgttgagaagggtgtctcgagggaaaagagtgacaaggagatcatgagagagatacaagccattatgaggcagattgcttcaagtatcacttatttgccatgcctggatgaaccttgcatttttgatgtgttagcgtatactgacaaggatgtggcagttccattcacatgggttgagagtgatccaaaactcattgcaaatccgcaaatggtgaaattgcattcctttgatactaagattcacaaggttgacacacttgtatcatacaagaatgacgaatgggatgagcagtaatggcagtccgtgtcttgtatttttttgttcagcttcttgcgttttgtttcttcaggtcttgagtgaatttcctgttttgttagacctgtaaattgtgaattttctattcacattgttagatgtgtgtactactctgggattcaacgggtatttattattaatcctcccttttgtatgtttgacttgttgtggcagtaagaattgccatgtgggatctcaagaaatctccctgttgttttcagaaggttggatttatcaatcatttcagtcttatgaaacaaatgccgcattccgagtattaattcactt

SEQ ID NO: 2716 - DNA, 790 bp, Glycine max
ttttccccttttcaaaaccagttcatttcgcttaccgtgttcccacaaccgaaacaaaagcttccccattttgcttcatcgtgcgaacaagctccacccaaccctaagtcgaaaacttgaactttcgttgttcgaaattagactctgattacagaagaaaagacatggccgcaagaacagttgccaaagacataatcactcttcgcggttccgcagcaatcgttagcgagttcttcggatatgctgccaacagcattctctacaaccgtggagtttatccagaagaaagctttgtgaaggttaagaaatatggcctccccatgttgctaacggaagatgagggtgtcaaatcttttctagcaaatctaactgctcagctctctgaatggcttgaagctggcaagttgcagagggtggtccttgttataatgagcaaggccaccagtgaagtgcttgaaaggtggaacttcagcattgagactgacagtgaggttgttgagaagggagtctcaagggaaaagagtgacaaggagatcatgagagagatacaagcgattatgaggcagattgcttcaagtatcacttatttgccatgcctggatgaaccttgtgtttttgatgtgttagcctatactgacaaagatgtggcagttccattcacatgggttgagagtgatccaaaactgattgcaaatccgcaaatggtgaaattgcattcctttgatactaagattcacaaggttgacactcttgtatcatacaagaatgacgaatgggatgagcagtagag

SEQ ID NO: 2717 - DNA, 1384 bp, Glycine max
caaaggcccaaagaagccaccaaaaaaaaacctcaaactagccgttatggtgcttccctatcaagtttcattctttccacttccaatccctaatttattgccattattttccccttttcaaaaccagttcatttcgcttaccgtgttcccacaaccgaaacaaaagcttccccattttgcttcatcgtgcgaacaagctccacccaaccctaagtcgaaaacttgaactttcgttgttcgaaattagactctgattacagaagaaaagacatggccgcaagaacagttgccaaagacataatcactcttcgcggttccgcagcaatcgttagcgagttcttcggatatgctgccaacagcattctctacaaccgtggagtttatccagaagaaagctttgtgaaggttaagaaatatggcctccccatgttgctaacggaagatgagggtgtcaaatcttttctagcaaatctaactgctcagctctctgaatggcttgaagctggcaagttgcagagggtggtccttgttataatgagcaaggccaccagtgaagtgcttgaaaggtggaacttcagcattgagactgacagtgaggttgttgagaagggagtctcaagggaaaagagtgacaaggagatcatgagagagatacaagcgattatgaggcagattgcttcaagtatcacttatttgccatgcctggatgaaccttgtgtttttgatgtgttagcctatactgacaaagatgtggcagttccattcacatgggttgagagtgatccaaaactgattgcaaatccgcaaatggtgaaattgcattcctttgatactaagattcacaaggttgacactcttgtatcatacaagaatgacgaatgggatgagcagtagaggccgtctttgtcttgtatcttttgttcagcttgtatcatacaagaatgacgagaatgtgttttgtttcttcagtttttgagtgaatttcctgttgttagccctgtcaattgtgaattttctattcacattgttagatgtatgtactactgtgggattcaacgggtattagtattaatcctcctcccttctgtatgtttgacttgttgtggcagtaagaattgccatggtagggatctcaagaaatctccctgttcttttcagagaaggttggattcatccatcatttcattcagtcttgtgaaacaaatgcctcattatgagtattaattcatttctggttctggttgttgaaactaagcatctaagtagcgtgggatcataaataacaaatgatgataattagtgaagatatgttttgatttcgaacttttgctggtgtgactctatcccacttctttatcttagctgagctctatagaaatagaaa

SEQ ID NO: 2718 - DNA, 1251 bp, Cicer arietinum
gcccaatgaaaatataaacccaaaataaaatagaactagccgttacggtgcttcctcttcaagtttctttccatccaaatccctaatttattatcctcttctcccacttttcctaatcagttcatactacgcgctctctcttctactcttctaattccaacaccctaaaaatcgttcccattttacttgatcacatcattccttaaatcggaacttgtcaacattttacgaatcgcaaatcacactctgatttctgaaatcccacagtgatataagaacatggcctcaagaacaggttccaaagacataatcactcttcgtggttctgcagcaatcgttagcgagtttttcggatatgctgccaacagcatactttacaaccgtggagtttatccagaagaaagctttgtgaaggtgaagaaatatggacttcctatgttgcttactgaagatgagggtgttaaatcttttatagccaatttaactgctcagctctctgaatggctcgaagctggcaagttgcagaggattgtccttgttataatgagcaagtctactggtgaggttcttgaaaggtggaacttcagcattgagactgatagtgaagttgttgagaaaagtgtgtcgagggagaagagtgacaaggaaatcatgagagagatacaggccattatgaggcaggttgcttcgagtatcacctatttgccatgcctggatgaaccttgtgtttttgatgtattagcatataccgacacagacgtggcagttccattcacttggattgagagtgatccaaagctgattgcgaatccgcaaatggtgaaattgcattccttcgatactaagattcacaaggtggacacacttgtatcatacaagaatgacgaatgggatgagcagtagagctgagccatctgtgtcatttcttgttgtgctgttctgcttttgttcccttcaagtgaatcaattttctgccgttagatgtgtcagttgtgaattttctattcacacattgtaagatatatgtgtacttatgtggatgtcaacgtgtattaaaccttatttgttgtgtgtttgccttctggcagaaagaattgtcatatcaacatgccttctggcttttgtatgtgtttgctttctaacataaagatttgccatgtaaagagatcccaaaaaaataaaaaaaaatccaatctttggttaattttgggtgagtttgtttcatatttattaataaaaaactatttttct

SEQ ID NO: 2719 - DNA, 1292 bp, Theobroma cacao
ttgaaatgttggcttaaaagatagagaaagaaattaacgagagccaaacaaattatgctacgtcgccgtaccattcgtgtcttcaaaataaaagcaccaaaaaagaagaaaaagcggaccgactttcttaccgttaaaggcgcaatttgaaaagttaccgttggctccaggaaactagccgttactctgcttttttggccctttcatgcatttttttttctcaaacccgcatttcttgaaaagtcaccaccgataatccccatcctctaattcaagcctaattttctacttcctgaatcgctgattccggttgccctttctactgattttagcaataacaacatagaatttttttgagtaggcttcgcttcaaatccgaaagaagctgtgatcgtagaaagaagtccaatggcgtcaagaacagctgccaaagatataatcactcttcgaggctcagcggcaattgtaagcgagttctttggatatgcagcgaatagcattctgtacaatcgaggggtttatccagaagaaagttttgtgaaagtgaagaaatatgggcttccaatgttgcttactgaagatgaaggtgttaaatccttcattactaacctaacagctcagctttctgaatggctggaagctgggaagctacagagggttgtgttggttataatgagcaaggcaaccaatgaggtcttggagaggtggaattttagcattgagactgatagtgaggttgttgagaaaggtgtgtcaagggaaaagagtgacaaggaaattatgcgagaaatacaggcaatcatgagacagattgcctcgagcatcacttacttgccatgccttgatgaaccgtgtgtatttgatgtattagcatacaccgataaagatgttgcagtaccattcacttggattgagagtgaccccaagttgattgcaaatcctcaaatggtgaagttgcattcctttgataccaagatacacaaggttgacactcttgtgtcatacaagaatgatgactgggacgaacagtaggagtgcttgaaccttcttgaccgttgggtttattataatctgtgaatcatctattcacatagttccaagattgctatgaaagaagataaagaatgatgtactgggtctgatcttgtatggttgtgaactgttggaatgaaagtaacataatctttcaaacgtattgacctagtgcccaagaatttcaagtgtatctctgctattatacttctataatcaatcaacaagtcaacagcagataatcaattcgtacaagttga

SEQ ID NO: 2720 - DNA, 648 bp, Manihot esculenta
atcaaacctgtaatggcatccaaatcggttgctagagacatcatcactctccgcggttctgcagcaattgtcagcgagttctttggatatgcagcgaacagtatactgtacaatcgaggggtctacccagaagagagttttgtgaaggtgaagaaatatgggctcccaatgttgcttacccaggatgaaggtgttaaatccttcattgccaacctaaatgctcagttatcagaatggctggaagctgggaaattacagagggttgtgcttgtgataatgagcaaggccaccggtgaagttctagagaggtggaattttagtatagagactgatagtgaggtggtggagaagggggtgtcaagagaaaagagtgataaagaaataatgagagagatacaagcaatcatgcgtcagattgcttcaagtattacttacttgccatgcctggatgaagcttgtgtttttgatgtgttagcatacacagataaagacgtggcagtcccttttacttggattgagagtgatcctaaattgattgctaatccacaaatggtgaaattgcattcttttgataccaagattcacaaggttgacactctggtttcatacaagaacgacgaatgggacgaggagtagagaaagctacct

SEQ ID NO: 2721 - DNA, 935 bp, Citrus clementina
atcaaagccctaatatagtaatatttcacgaaccaaaattgaatttcaatttcaatttccttgcaataaattgtttcaattctgtttctttgattctttctggaaccaaaccctataatttgttttcacaatcatggcatcaaggacggtcgctaaagacatcataactctacgcggttctgcagcaatcgtcagcgagttttttggttatgcagcaaacagtatactttacaatcgtggagtttatccagaagaaagttttgtgaaggtgaagaaatatgggctcccaatgttgcttactgaagatgagggtgtcaagtccttcattgctaatcttactgctcagctttcagagtggctggaagctgggaagctacagagggttgtattggtgattatgagcaaggccaccaaagaggttttagagaggtggaatttcagcatcgagaccgataatgaagtcgttgagaagggtgtgtcgagggaaaagagtgacaaagaaattatgagagagatacaagcaatcatgagacaaattgcctctagcattacttacttgccttgccttgatgaaacttgtgtgtttgatgtgttagcatacacagataaagacgttgcagtcccattcacttggattgagagcgacccaaagctgattgcaaatccgcaaatggtgaaattgcattcttttgataccaagatacataaggttgacacacttgtatcctacaagaatgatgaatgggatgagcagtaagagccagaagaggctattatatgaacaaactaatccatgattttaaatcctgttgcacattttgttttctccttgatctgtgaatctttctattcacagcaggagctaccattgttagagtcaaaatttaatttgcaagtttgaatgaaatggcaggattcttgttgttggtattggt

SEQ ID NO: 2722 - DNA, 1252 bp, Gossypium hirsutum
ctattatttctcctatctcaaatttcttctcatctcagccaaaccctaattttctactatattaaccgcaaattcacaccttagaatttttgttccttttttggtcaagtttcctttcaaatacactaggaaatttgatcttagaagtcgaatggcgtcaagaacagttgccaaagatataatcactcttcgaggctcagcagcaatcgtaagcgaattttttggttatgcagcgaatagcattttgtacaatcgaggggtttacccagaagaaagttttgccaaagtgaagaaatatgggcttccaatgttgcttacccaagatgaaggtgtaaaatccttcatttccaacctgacagcccagctttctgaatggctggaagctgggaagctacaaagggttgtgttggttatcatgagtaaggctaccaatgaggtcttggagaggtggaattttagcattgaaacagatagtgaggttgttgagaaaggtgtgtcaagggaaaagagtgacaaagaaattatgagagaaatacaggcaatcatgagacaaattgcttcaagtatcacttacttgccatgccttgatgaaccatgtgtgtttgatgtattagcatacactgataaagatgtagcagtaccattcacttggattgagagtgacccaaagttgattgcaaatcctcaaatggtgaagttgcattcgtttgataccaagatacacaaggttgacacacttgtatcatacaagaacgacgaatgggaggagcagtagagtgatttcaaacttcttttggctgatatctgtgaatctactattcacgtagccatgaaaggggtgatatagaattattttgggtgtgctttttgtgcatggttgtgatgtaattgaactacatatcttttgttaatttcatctttctttagaggttatggtttcaaattagttttcaagggtttcaaatgcaaaccgagaaaacagtcatgatgcgtgattgaaatgtactttttagccactttttgccattgaaataaactggatttcatgaacacgaacatagatgggtggccctctacaattatattttggtatcaataaatctaaataactctttattaatcatatatatttttctatgccaaaataaaagtgatattcttattgtctggatacatgccaaaacgtattgtttttctttttgttgttgtaattgagttttcgtatagaatgaaaccaaccttctttctaaaa

SEQ ID NO: 2723 - DNA, 1576 bp, Gossypium raimondii
ataaaataaaagtgagtattaatttttgaaagcgaaaatggccgcacgcttcgcactttcaaaaataaaaacactttttaccgttacaggcgcaatttaaaatgttaccgttggctccaagacaacgagccgttactctgccttcttttttctcttccctttttcattatttctcctatctcaaatttcttctcatctaagccaaaccctaattttctactatattaaccgcaaattcacaccttagaatttttgtttccttttttggcaagttttcctttaaaatacactaggaaatttgatcttagaagtcgaatggcgtcaagaacagttgccaaagatataatcactcttcgaggctcagcagcaatcgtaagcgaattttttggttatgcagcgaatagcattttgtacaatcgaggggtttacccagaagaaagttttgccaaagtgaagaaatatgggcttccaatgttgcttacccaagatgaaggtgtaaaatccttcatttccaacctgacagcccagctttctgaatggctggaagctgggaagctacaaagggttgtgttggttatcatgagtaaggctaccaatgaggtcttggagaggtggaattttagcattgaaacagatagtgaggttgttgagaaaggtgtgtcaagggaaaagagtgacaaagaaattatgagagaaatacaggcaatcatgagacaaattgcttcaagtatcacttacttgccatgccttgatgaaccatgtgtgtttgatgtattagcatacactgataaagatgtagcagtaccattcacttggattgagagtgacccaaagttgattgcaaatcctcaaatggtgaagttgcattcgtttgataccaagatacacaaggttgacacacttgtatcatacaagaacgacgaatgggaggagcagtagagtgatttcaaacttcttttagctgatatctgtgaatctactattcacgtagccatgaaaggggtgatatagaattattttgggtgtgctttttgtgcatggttgtgataatcaagaattgaactacatatcttttgttaatttcatctttctttagaggttatggtttcaaatttgttttccagggtttcaaatgcaaaccgagaaaacattcatgatgcgtgattgaaatgtactttttagccactttttgccattgaaatgaactggatttcatgaacagaaacatagatgggtggccctctacaattatattttggtatcaataaatctaaataactctttattaatcatatatatttttctatgccaaaataaaagtgatattcttattgtctggatacatgccaaaacgtattgtttttctttttgttgttgtaattgagttttcgtatagaatgaaaccaaccttctttcctgccattttctgaatgtctagattcgtctgaatctgttagtcggtgaagtgaatgttttttgtaggtaggttgcaggtcatgttgaactctatagattatcccaagctaaaacagtgagcatctgattagttttttccacccaatgttggttgaacgac

SEQ ID NO: 2724 - DNA, 931 bp, Citrus sinensis
atcaaagccctaatatagtaatatttcacgaaccaaaattgaatttcaatttcaatttccttgcaaattgtttcaattctgtttctttgattctttctggaaccaaaccctataatttgttttcacaatcatggcatcaaggacggtcgctaaagacatcataactctacgcggttctgcagcaatcgtcagcgagttttttggttatgcagcaaacagtatactttacaatcgtggagtttatccggaagaaagttttgtgaaggtgaagaaatatgggctcccaatgttgcttactgaagatgagggtgtcaagtccttcattgctaatcttacggctcagctttcagagtggctggaagctgggaagctacagagagttgtattggtgattatgagcaaggccaccaaagaggttttagagaggtggaatttcagcatcgagaccgataatgaagtcgttgagaagggtgtgtcgagggaaaagagtgacaaagaaattatgagagagatacaagcaatcatgagacaaattgcctctagcattacttacttgccttgccttgatgaaacttgtgtgtttgatgtgttagcatacacagataaagatgttgcagtcccattcacttggattgagagcgacccaaagctgattgcaaatccgcaaatggtgaaattgcattcttttgataccaagatacataaggttgacacacttgtatcctacaagaatgatgaatgggatgagcagtaaggccagaagaggctattatgtgaacaaactaatccatgattttaaatcctgttgcacattttgttttctccttgatctgtgaatctttctattcacagcaggagctaccattgttagagtcaaaatttaatttgtaagtttgaatgaaatggcaggattcttgttgttggtattggt

SEQ ID NO: 2725 - DNA, 1101 bp, Cajanus cajan
attgccatcttttttcccctttccaaacaagttcatttcccgcaccagtgttccgataaccgaaataaaaagcgtacccattttgcttcatcgtgcgatcaagttccaccgatcccaaagtcgaaacctttggaagttctttgttggaaaaattagactctgataacagaagaaaaggcatggccgcaagaacagtcgccaaagacatcatcactcttcgtggttccgcagcaatcgttagcgagttctttggatatgctgccaacagcattctttacaatcgtggagtttatcctgaagaaagttttgtgaaggtgaagaaatatggtctccccatgttgcttactgaagatgagggtgttaaatcttttataaccaatctaactgcccagctctctgaatggcttgaagctggcaagttgcagagggtggtccttgttataatgagcaaggcaaccagtgaagtccttgaaaggtggaacttcagcattgagactgacagtgaggttgttgagaagggtgtctcaagggaaaagagtgacaaggaaatcatgagagagattcaagcgattatgcggcagattgcttcaagtatcacttatttgccatgcttggatgaaccttgtgtttttgatgtattggcatatactgacaaagatgtggcagttccattcacttggattgagagtgatccaaaactgattgcaaatccacaaatggtgaaattgcattccttcgatactaagattcacaaggttgacacacttgtatcatacaagaatgatgaatgggatgagcagtaggggccttttttcagcttgtgtgttttgtttcttcaggtcttgagtgaattttgtgttgtgttggacctgacaattgtgaattttctattcacattattagatgtgtgtaccactgtgggtgtaaacgtggggtagttttaatcctctcttctttatgggggtctcaagaaatctctgttcttttcttcagaaggttggatttatcaatcatttcagtcttatgaaacaagtgaatcgttctaattaattttttctggttctggttgttgaaaccaagaatgcgattagcgtgtctata

SEQ ID NO: 2726 - DNA, 1159 bp, Cicer arietinum
aaatataaacccaaataaaatagaactagccgttacggtgcttcctcttcaagtttctttccatccaaatccctaatttattatcctcttctcccacttttcctaatcagttcatactacgcgctctctcttctactcttctaattccaacaccctaaaaatcgttcccattttacttgatcacatcattccttaaatcggaacttgtcaacattttacgaatcgcaaatcacactctgatttctgaaatcccacagtgatataagaacatggcctcaagaacaggttccaaagacataatcactcttcgtggttctgcagcaatcgttagcgagtttttcggatatgctgccaacagcatactttacaaccgtggagtttatccagaagaaagctttgtgaaggtgaagaaatatggacttcctatgttgcttactgaagatgagggtgttaaatcttttatagccaatttaactgctcagctctctgaatggctcgaagctggcaagttgcagaggattgtccttgttataatgagcaagtctactggtgaggttcttgaaaggtggaacttcagcattgagactgatagtgaagttgttgagaaaagtgtgtcgagggagaagagtgacaaggaaatcatgagagagatacaggccattatgaggcaggttgcttcgagtatcacctatttgccatgcctggatgaaccttgtgtttttgatgtattagcatataccgacacagacgtggcagttccattcacttggattgagagtgatccaaagctgattgcgaatccgcaaatggtgaattgcattccttcgatactaagattcacaaggtggacacacttgtatcatacaagaatgacgaatgggatgagcagtagagctgagccatctgtgtcatttcttgttgtgctgttctgcttttgttcccttcaagtgaatcaattttctgccgttagatgtgtcagttgtgaattttctattcacacattgtaagatatatgtgtacttatgtggatgtcaacgtgtattaaaccttatttgttgtgtgtttgccttctggcagaaagaattgtcatatcaacatgccttctggcttttgtatgtgtttgctttctaacataaagatttgccatgtaaagagatcc

SEQ ID NO: 2727 - DNA, 973 bp, Brassica rapa
acataagactagccgttacgctccttttatatcttcttttttcgcgttacattcttttgaatcaaaaaccctaagcgacgcttcccaatttcatttgctttcaaatcacaaaatcgttttccgaatcgcatcaatggcttccaaaacagcagctgctaaagacatcatcacactgcacggatctgccgccatcgtcagcgagttcttctgttacgctgccaacagtatactgtacaatagagcagtatacccagaggaaagctttgcgaaagtgaagaagtatggtcttcccatgttgcttacgcaagacgaatccgtcaaatcattcttgtccaatctcacttctcagatctccgagtggcttgaagctgggaagttgcagagagtggtgttggtgataatgagtaaagctactggtgaagtcttggagaggtggaacttccgtattgagactgattctgaagttgttgagaaaggtgtgtcgagggagaagagtgataaggagataatgagggagattcaagctatcatgagacaggttgcttccagcattacttacttgccttgtcttgatgaaccttgtgtgtttgatgtattggcgtatacggacacggatgtagctgttccattcacatgggtcgaaagcgatccgaagttgattgctaatccacagatggttaagctacacgcttttgataccaagattcacaaagtggacaccctcgtctcatacaagaacgacgaatgggatgaagaagagtagtagcaccaagtctcttgctctgctctgctctgctcagccagcgttttccttttctcatgttcttgaatgtcaaagtgaatcctttattcacctatgttgtttcctgtttttcttctttccggattgtttcgagaataataaacctttgttgttgaatagttatcagctttctcattgtctctgtcccttcttgcattaaacattatgttt

SEQ ID NO: 2728 - DNA, 951 bp, Brassica napus
gacataagactagccgttacgctccttttatatcttatgttttcgagttatattcttttcaatcaaaaaccctaagcgacgcttcccgatttaatttgctttcaaatcacaaatcgtttttttggattcatcgtctctgaatcgtttcaatggcttccaagacagcagctgctaaagacatcatcacactgcatggatctgccgccatcgtcagcgagttcttctgttacgctgccaacagtatactgtacaatcgagcagtatacccagaggaaagctttgcgaaagtgaagaagtatggtcttcccatgttgcttactcaagacgaatccgtcaaatcattcttgtccaatctcacttgtcagatctccgagtggcttgaagctgggaagttgcagagagtggtgttggtgataatgagcaaagcgacgggtgaagtcttggagaggtggaacttccgtattgagactgatgctgaagttgttgagaaaggtgtgtcgagcgagaagagtgacaaggagatcatgagggagatccaagctatcatgagacaggttgcttccagcattacttacttgccttgtcttgatgaaccttgcgtgtttgatgtgttggcgtatacggacacggatgtggctgttccgttcacatgggtcgaaagcgatccgaagttgattgctaatccacagatggttaagctacacgcttttgataccaagattcacaaagtggacaccctcgtctcatacaagaacgacgaatgggatgaagaagagtagtaacaccaagtctcttgctcagccagcgttttcctttctcatgttcttgaatgtcaaagtgaatcctttatcacaactatgttgttttctgtttttctcttccggattgtttcgagaataataaaacctttgttgtttatgtctgttcaatagttatcagctttctcgctga

SEQ ID NO: 2729 - DNA, 794 bp, Brassica napus
gaaatcaaaaaccctaagcgacgcttcccaacttcatttgctttcaaatcacaaaatcgttttctgaatcgcatcaatggcttccaaaacagcagctgctaaagacatcatcacactgcacggatctgccgccatcgtcagcgagttcttctgttacgctgccaatagtatactgtacaatagagcagtatacccagaggaaagctttgcgaaagtgaagaagtatggtcttcccatgttgcttacgcaagacgaatccgtcaaatcattcttgtccaatctcacttctcagatctccgagtggctcgaagctgggaagttgcagagagtggtgttggtgataatgagtaaagctactggtgaagtcttggagaggtggaacttccgtattgagactgattctgaagttgttgagaaaggtgtgtcgagggagaagagtgataaggagatcatgagggagatccaagctatcatgagacaggttgcttccagcattacttacttgccttgtcttgatgaaccttgtgtgtttgatgtattggcgtatacggacacggatgtagctgttccattcacatgggtcgaaagcgatccgaagttgattgctaatccacagatggttaagctacacgcttttgataccaagattcacaaagtggacaccctcgtctcatacaagaacgacgaatgggatgaagaagagtagtagcaccaagtctcttgctctgctctgctctgctcagccagtcgttttccttttctcatgttcttgaatgtcaaagtgaatcctttat

SEQ ID NO: 2730 - DNA, 884 bp, Ipomoea nil
ggggaactcatcaaaacgcaaaacctaaattttagatcattcgaaaccaccagcccctacttctcttgagttgaatttagaatctcacattctaagcattcagaaacatggcttcaagaacagcctccaaagatataatcactcttcggggatcagccgctattgtcagtgaattcttcggttatgctgcaaatagtattttatacaaccgcggtttgtatcctgaagagagtttcgcgaaggtgaagaagtatgggcttccgatgttgctcactcaagatgaaggtgtcaaaaccttcatttccaacttaacagcccaaatttctgagtggctggaggccgggaaactacagagggttgtgcttgtgatcatgagtaaggccagtggtgaggtgttagagaggtggaatttcagtattgagacagacagtgaggttgttgagaaaggtgtttcaagggagaagagtgataaagaaataatgcgcgaaattcaagcgattatgagacaaatagcttccagcattacatatctcccatgccttgatgaagcatgcgtgttcgatgtgttagcctacactgatacagatgttgcagtcccgttcacctggatcgaaagtgaccctaaactgatagcaaatccacaaatggtcaaattgcattcctttgataccaagatacacaaggttgacactctggtttcctacaagaatgatgatgagtgggatgaggcatgaatgaatgttagttttaggcagttgtctttattgtccaatgtgttttaagtttgtgaatcgtcaattcacatttagtattatgtaagtgagaggaaagtcctaaactctttataaccaagtattaccatgatttatgttgttgcagctatt

SEQ ID NO: 2731 - DNA, 833 bp, Olea europaea
gtcaaaatccacagtcttcaaagcgtatccatggcttcaagaactgctacaaaagatataattactctgcgtggatcggctgccatagtcagtgaattcttcgggtatgctgcaaacagtattctgtacaatcgtggagtttaccctgaagaagttttgcgaaggtcaagaaatatgggcttccaatgctgcttactcaggacgaaggtgtcaaatcattcatttcaaacttaacggcacagctttctgagtggctaaaatctgggaagcttcagaggatagttctggtgatcatgagcaaggcaactggtgaggttttagagaggtggaatttcagtattgagacggataaagaggttgtcgaaaaaggagtttcaagggagaaaaatgataaggaaattatgagggaaattcaagctattatgagacagatagcatccagcattacatatttgccatgccttgacgaaccttgtgtttttgatgtgttagcctacacagacacagatgtggcagttccattttcttggattgagagtgaccctaaactgatagccaaccctcagatggtgaaactgcattcttttgatactaagatacacaaggttgacacactggtttcatacaagaatgatgagtgggacgaggcatgaagaaacatttctcaacccttagagtacctttggtctatgagcgccgcgcatattcagtattcacatttttcaagttgggagtgtggaaaaatggatccagtgaattgtgaatcgttgattcattcacattgtatttttgagttgtacgtggaattgcatgattggtatgtataactcaga

SEQ ID NO: 2732 - DNA, 984 bp, Sesamum indicum
tagccgttgcatttccatttgcatctccaccaaaaccctaaatttatctcttcaaaattcgccatacagcagcatacaagctctcttcactgaactaatatcaatctcgcgtccttcaattaaaacacattaagccctaatccacagttgcctgtagattttggtgatagagattcgaagagaaaaatctatggcttcaaaaactgccacaaaggacataatcactctgcgaggatccgccgctattgttagtgaattcttcggttatgctgcaaacagtatattgtacaatcgtggagtttatccagaagagagttttgcgagggtcaagaaatatgggcttcccatgctgcttactcaagatgaaggggtcaaatccttcatttcgaatttaacttctcagctttctgagtggctggaagctgggaagctgcagagggtagtgctggtgatcatgagcaaagcaactggtgaggttttagagaggtggaatttcagcatcgagaccgacagtgaggtcgtcgaaaagggagtatcaagggagaagagtgataaagaaattatgagggaaattcaggcaataatgaggcagatagcatccagcattacatacttgccatgccttgatgaaccctgtatatttgatgttctagtgtatacagacaaagattgtgcagtgccttttacttgggtcgagagtgatcctaagcttattgctaatccacagatggtgaaattgcactcgtttgataccaagattcacaaggtcgacacactggtatcatacaagaacgatgaatgggacgaggcataaactacagctgttgtattgctctcctttttagatctttcaagaatcaatcttttgattcacattttgttgcaaacacctcaacaatggtgaatcattgattcacattcggctttagatgtatggttcatgttcttggattgttgcaatagcaaaaatttgaatgctctgcc

SEQ ID NO: 2733 - DNA, 1004 bp, Hordeum vulgare
gcacccgacttccaacttaccccttttcccgtcccattccatagcccagccgccgccccgctgcccgttgctcccctttcttcccccgacccgccgcacccacagccggcgagagagagcgaagaaggcaaagcgccgccgcgaggacgaccgaggccgaggagagatggcgtcgaggtcggcttccaaggacatcatcactctcaagggctccgccgccatcgtcagcgagttcttcggttacgcggccaacagcatcctgtacaaccgcggggtgtacccggaggagagcttcgccaaggtgaagaagtacggcctccccatgctgctcacgcaggacgaggccgtcaagaccttcctcaccaacctcacctcccagctctcagagtggctggagggtgggaagctgcagaggattgtgctggtcatcatgagcaaggccaccagcgaggtgctcgagcgctggaacttcagcatcatcactgacggcgaggtcgtcgagaaaggggtggtgaaggagaagagcgacaaggagatcatgagggagatccaggccatcatgcggcaggtcaactcctgcatctccttcctcccctgcctcgacgagccatgcatattcgacgtgctggcttacaccgactcggacaccaccgtgcccttcacctggatggagagcgacgccaagctcatcgataacccgcagatggtgaagctgcactcgttcgacaccaagatccacaaggtggacacgctggtgtcgtacaaggtggacgacttggatgagcagtgactgacctgtggtgtgacacccagagcgtccagacatcccctgcgggcgtgaagctctgtgtgaatcgttcattcacgacgtctgggcgtcgttatcctactgctgctccccctgccttcgaaattttcctccctgcgtctacgaaaaactgtactgttatgttatccctgaattggatgtatcgcctgccgttttctactcacaagttctgagg

SEQ ID NO: 2734 - DNA, 1276 bp, Hordeum vulgare
ggccgatccatttcgaaaccgcgacccgacttcccaacttaccccttttcccgtcccattccatagcccagccgccgccccgctgcccgttgctcccctttcttcccccgacccgccgcacccacagccggcgagagagagcgaagaaggcaaagcgccgccgcgaggacgaccgaggccgaggagagatggcgtcgaggtcggcttccaaggacatcatcactctcaagggctccgccgccatcgtcagcgagttcttcggttacgcggccaacagcatcctgtacaaccgcggggtgtacccggaggagagcttcgccaaggtgaagaagtacggcctccccatgctgctcacgcaggacgaggccgtcaagaccttcctcaccaacctcacctcccagctctcagagtggctggagggtgggaagctgcagaggattgtgctggtcatcatgagcaaggccaccagcgaggtgctcgagcgctggaacttcagcatcatcactgacggcgaggtcgtcgagaaaggggtggtgaaggagaagagcgacaaggagatcatgagggagatccaggccatcatgcggcaggtcaactcctgcatctccttcctcccctgcctcgacgagccatgcatattcgacgtgctggcttacaccgactcggacaccaccgtgcccttcacctggatggagagcgacgccaagctcatcgataacccgcagatggtgaagctgcactcgttcgacaccaagatccacaaggtggacacgctggtgtcgtacaaggtggacgacttggatgagcagtgactgacctgtggtgtgacacccagagcgtccagacatcccctgcgggcgtgaagctctgtgtgaatcgttcattcacgacgtctgggcgtcgttatcctactgctgctccccctgccttcgaaatttttctccctgcgtctacgaaaaactgtactgttatgttatccctgaattggatgtatcgcctgccgttttctactcacaagttctgaggcgaaatttgcctaccccctatgtgttggatgtatgtgctagtccacttacaagttctgaggcgaaattcgcccagtgtcacaagtaactcctgtgttggatctaaacgggaaagcaaacaacaccatgaagcaattgaatggatctcaaacagcctggtcatggctcctgtaacaataactgagcaaactgaaactcaggcgaccttacagagtttgtttccatggctataatatataataatatttacc

SEQ ID NO: 2735 - DNA, 789 bp, Centaurea maculosa
atcagttttcttttttcttcagaagcactccacctggtttgataaaattccccaaagaaaaccctaaccaacttccaacaaatttcaatggcttcaagaaccgccagcaaagatatcatcactctccgtggatccactgcaatcgtcagcgagtttttcggttatgcagccaacagcattctctataatcgtggagtttaccctgaagaaagtttcgggagggtgaagaaatacggacttccgttgttgctttcacaggatgaaggtgttaagaccttcattgccaatttgaatgctcagctttccgaatggctggaagctgggaagttgcagaggattgttcttgtgataatgagcaaggccaccaatgaagtgcttgaaaggtggaatttcagcatagagactgatggtgaggttgtggagaaaggagtttcaagggagaagagcgataaagaaatcatgagggagattcaagctattatgagacagattgcatccagcattacgtacctgccatgcctcgatgaaccctgtatctttgatgtgttggcatataccgataccgatgttgcagtacccttcacttggaccgagagcgacccgaaactgatagcgaatccccagacggtgaaattgcattctttcgataccaagatacataaggttgacactttggtgtcttacaagaatgatgaatgggatgaacagtaaacaaagatgatgtgatttcttttcattttgtgttttttcttgttgacccttttgaaggtcaattttgattcactgttc

SEQ ID NO: 2736 - DNA, 1081 bp, Gossypium hirsutum
ttacactgctttttgctttttgcccttcgattattatttttttctcaaactcatatttcctgaaaactcatcagccattggagcgatagtcatcttcttctaacccaaacgataatttctacttcctaaatccccaattacagttgccttttttccctaattttaccaattatttagttcctttcatccaaaattttgatcctagaagaagtcgaatggcgtcaagaacagttgccaaagatataataactcttcgaggctcagcggcaatcgtcagcgagttttttggatatgcagcgaacagcattttgtacaatcgaggagtttatccagaagaaagttttgccaaagtgaagaaatacgggctcccaatgttgcttactcaagatgaaggtgttaaatccttcattaccaatctaacagctcagctttctgaatggctggaagctgggaaactacagagggtggtaatggttatcatgagcaaggcaaccaaggaggtcttggagaggtggaatttcagcattgagactgatagtgacgttgttgagaaaggtgtgtcaagggaaaagagtgacagagaaatcatgagagaaattcaggcaatcatgagacagattgcctcaagtattacttacttgccgtgccttgatgaaccatgtgtgtttgatgttctagcatacactgatacggatgttccagtaccattcacttggattgagagtgaccctaagctgattgcaaatccacaaatggtgaagttgcattcatttgataccaagatacacaaggttgacactcttgtttcatacaagaatgatgaatgggacgagcagtagagtgcctgaaccttctgtctcccttcccccccatatgtgaatctttctattcacatatttttaatagattacaatgaaagatgaaatatatctgtttttttgggcttgcttttttgtatagattacaattaattatttcaagttaatttcatctcaattatttcaaaccaactttgaagaatttcatcttacattgttttcatgttatacatgttagttaaaaaaataatatataaactcga

SEQ ID NO: 2737 - DNA, 1686 bp, Gossypium raimondii
ttttaattttttattttaaataagcttaattgccatatgattgattcgatgtgtcatgcggcacatcctgattggcaccatgtgctgtccgtttttttaacactttaaaaaaaaaaaaaaaacttgaatcaaataacaaaatgataatttaagtactttgagaccaaaaaaaataggcaaaatgagaaaatgcataatttgagagccaaactgagattaagccggagaaaacgcctctaactactataaagaatctaacgtggccgcacgattggtacttaaaagaagaaacaaaaaaggtcgagtttcttaccgttgaagacgcaatataaaaagttgtagttggctccaagacgaacatcaagaaagtagccgttacactgctttttgcttttgcccttcgattattatttttttctcaaactcatatttcctgaaaactcatcagccattggagcgatagtcatcttcttctaacccaaacgataatttctacttcctaaatccccaattacagttgccttttttccctaattttaccaattatttagttcctttcatccaaaattttgatcctagaagaagtcgaatggcgtcaagaacagttgccaaagatataataactcttcgaggctcagcggcaatcgtcagcgagttttttggatatgcagcgaacagcattttgtacaatcgaggagtttatccagaagaaagttttgccaaagtgaagaaatacgggctcccaatgttgcttactcaagatgaaggtgttaaatccttcattaccaatctaacagctcagctttctgaatggctggaagctgggaaactacagagggtggtaatggttatcatgagcaaggcaaccaatgaggtcttggagaggtggaatttcagcattgagactgatagtgacgttgttgagaaaggtgtgtcaagggaaaagagtgacagagaaatcatgagagaaattcaggcaatcatgagacagattgcctcaagtattacttacttgccgtgccttgatgaaccatgtgtgtttgatgttctagcatacactgatacggatgttccagtaccattcacttggattgagagtgaccctaagctgattgcaaatccacaaatggtgaagttgcattcatttgataccaagatacacaaggttgacactcttgtttcatacaagaatgatgaatgggacgagcagtagagtgcctgaaccttctgtctccttcccccccaatataaggagacccaggccatatgaacaggtactgtacaggagtgaatatcataaagaacaacatgctaccgacagcaagagttatggggttcatgtttagtaagtggtaatgatgcaaacaacataatcacaatcttcagaaagcaccagagcaaatcttagaaccccatatgctcacttatgtcaaggcaacgcaactctgttatatagaccttcgagatgcaacagctttcagctaacacctcggtatatagtattagtttgaaggtcatccatactgtcaatgtttctgtatccatcaatctctctgagacctgcgtaccctcgaaggactagatattcacggtatgtttaatagtaacatgaaggtgctggcttaaggtttgttctacgtaatatttcatgtgaaagcaactatgcattattaaggctttcacatt

SEQ ID NO: 2738 - DNA, 1025 bp, Medicago truncatula
gcagaactagccgttaaggcgcttcccctacaagtttctttccaactcaaatccctattttattatcctcttttctctcatttttgattcagttcattcttctactcttccaattccaactaccaaaatttcgctctcatttcacttgatcatggcatcaaaaacagttaccaaagacataatcactcttcgtggttctgcagcaatcgttagcgagttcttcggatatgctgctaacagcatcctttacaatcgcggtgtttatccagaagaaagctttgtgaaggtgaagaaatatggccttccgatgttgcttactgaagatgagggtgttaagtcctttataaccaatttaactgctcagctttctgaatggcttgaagctggcaagttacagaggattgtccttgttataatgagcaagtccactggtgaagtccttgaaaggtggaatttcagcattgagactgataacgaggttgtcgagaagggcgagtcaagggagaagagtgacaaggaaatcatgagagagatacaggcaattatgaggcagatagcttcaagtatcacctatttgccatgcttggatgaaccttgtgtgtttgatgtgttagcatatactaacacagatgtggaagttccattcacttggactgagagtgatccaaagctgattgctaatccacaaatggtgaaactgcattcctttgatactaagattcacaaggttgacacacttgtatcatacaagaacgacgaatgggatgagcagtaaagcttagccgcccgtgtccttttcttgtcatgttgttctgtttctgttattttttccaaatcaagtggattgtgccagttgtgaattttctattcacatggttagatgtgtactgatgtggatgtcagatgtattattcctcgcttttttatgttttccttttggcaaggatatcaaaaaacttccctaatcttttcagaattatggttgattgtactcagttttatgaaatagtgaatcattcctagaa

SEQ ID NO: 2739 - DNA, 949 bp, Quercus alba
tttcgttttccatcgatttcacgaaatcccatcattctgtgcgtttgtttgatatttctttgaacgaatcttgattttcttggcttagagaagagaaggtgagagactatggcttcaaaaacagtggctaaagatatcatcactcttcgtggttcagcggcgattgtcagcgagttttttgggtatgctgcgaatagtattctttacaatcgcggagtttacccggaagaaagttttgtgaaggtgaagaaatatgggcttcctatgttgcttactcaggatgagggtgttaaatccttcattgccaacctaaactctcagctttctgaatggctggaagctggacagttgcaaaggattgttcttgtgataatgagtaaggctaccaatgaggtcctagagaggtggaactttaccattgagactgatagcgaggtcgttgagaagggtgtgtctagggaaaagagtgacaaggaaatcatgagagagatacaagctatcatgcgacagattgcttcgagcattacctacttgccatgcctcgatgaagcctgtgtctttgatgtgttggcctacactgacaaagatgttgcagtcccattcacttggatcgagagtgaccccaaacttattgctaatccacagatggtcaaattgcattcctttgataccaagattcacaagattgacactcttgtgtcatacaagaatgacgaatgggatgagcagtagagagaaggccacagatggtcaaattgcatttgtttacctctttgtgtggttccttcttcgcttgagagtgtggtcattgtgaatcttttattcacattttgtagtggctgatgaaagcatggagtgaagaagaaatatgagtgtcttgaattgaattgtaatctgttcccattgtgatatataagtaaatccgttttgcaaaaaaaatgtcgagcgt

SEQ ID NO: 2740 - DNA, 789 bp, Ambrosia trifida
cgataaaactccccactgaaaaaaaatctgcaatcttttcatcatcctaagaaatggcttcaaaaactgcaagcaaagacataatcactctccgtggttccaccgccatcgtcagcgaattcttcggttatgcagcaaacagtattctgtacaatcgcggtgtttatccggaagaaagctttggaagagtcaagaaatatggacttccgttgttgctttctcaagatgagggtgtaaagaccttcattgcaaatttgaacacacagctttctgaatggttggaagctgggaagttacaaaggattgttcttgtgattatgagcaaggcgacaaatgaagtacttgaaaggtggaatttcagtatagagactgataaagaagttgtggaaaaaggagtttcaagagagaagagtgataaagaaatcatgagggagatacaagcgatcatgagacagattgcatccagcatcacatacttgccctgccttgatgaaccatgtatatttgacgtgttagcgtatactgatatggatgttgcagtacctttcacttggacggagagtgatccgaaactgatagcaaatccacagatggtgaaattgcattcttttgatactaagattcacaaggttgacactttggtgtcttacaagaatgatgaatgggatgagcagtaaaagatgggtttttactcttagtttggttactgttgttgtttgttggtcctaaagtattgtgtaatgtagtaatctattttgatttacttacttttttctagtaagtctagct

SEQ ID NO: 2741 - DNA, 624 bp, Malus domestica
atggcttcaaaaacagcgaccaaagatatcatcactctgcgtggctctgccgccattgtcagcgagttcttcggatattcagcaaacagtattctgtacaatcgaggagtgtatcctgaggaaagctttgtgaaggtgaagaaatatggattgccaatgttgcttactcaagacgagggcctcaaatccttcattgcaaacctaactgcccagctttctgaatggctggaatctggaaagttacagagagttgttctggtcataatgagcaaggccaccagtgaggttctggagaggtggaacttcagcattgagaccgacagtgaggtcgttgagaagggcatgtcgagggaaaagagtgacaaggaaatcatgagggagattcaagcgatcatgagacagattgcttcgagcatcacttacttgccatgccttgatgaaccctgtgtgtttgatgtgttggcgtacacggataaagatgttgcagtcccattcacttggatcgagagtgatccgaaactgattacaaatccagaaatagtgaaactgcattcctttgacaccaagatccacaaggttgacactctagtgtcgtacaagaacgacgaatgggacgagcagtaa

SEQ ID NO: 2742 - DNA, 1184 bp, Ricinus communis
ttttataaccgttgaaggcgcaatttaaaaaatcttaccgtttgcctcgagaaggagccataaaaactagccgttgcatttgccttctccacagttcattttcgcaaaccctaagcagttctatttctttccaaactcaatcgaaatttccatttcaattccaattttgccaattaagctttgaatcccaaatttaaaaccatctttgtttttttttttttcttcattgtgtttacaattcaaataaaatccttttgatcccaccaagaataacccatatccttttttatcttttctcgacttcatagtgattttacgagattagaaaaagtaaaagaacctgtaatggcatctaaaactgttgctaaagatatcatcactctacgtggttctgcagcaattgtcagcgagttcttcggttatgcagcaaacagtattctatacaatcgtggggtttatccagaagaaagttttgcgaaggtgaagaaatatgggttaccaatgttgctcacacaagatgaaggtgttaaatcctttattgccaacctaaacgctcagttatcagagtggttagaagctggaaagttacaaagggttgttcttgtgataatgagcaaggccaccaatgaggtcctagagagatggaacttcagcattgagactgatagtgaggtcgtccagaagggggtgtcgagggaaaagagtgacaaagaaataatgagggagatacaggcaatcatgcgccagatagcttctagtattacttacttgccatgccttgacgaagcttgtgtttttgatgtgttagcatatacggataaagatgttgcagtccctttcacttggattgagagtgatccgaaattgatagccaatccacagatggtgaaattgcattcttttgataccaagatacacaaggttgacactctggtttcatacaagaatgatgaatgggatgagcagtagagagatgagattaccttaactttttggtggcatgtttgggcttttcccttttgaatggttactgtgaatcttttattcacattttgtgtaaaaattgatgtttcgagttgtttgctttgcccccctgttttacttgtatttggagaacaccaagcattcaatatcaatttaccccgagtttctttggtacactgaggggttttttatgctagaaa

SEQ ID NO: 2743 - DNA, 824 bp, Cynara scolymus
  misc_feature (52)..(52): n is a, c, g, or t
  misc_feature (75)..(75): n is a, c, g, or t
  misc_feature (141)..(141): n is a, c, g, or t
  misc_feature (256)..(256): n is a, c, g, or t
  misc_feature (465)..(465): n is a, c, g, or t
  misc_feature (587)..(587): n is a, c, g, or t
  misc_feature (728)..(729): n is a, c, g, or t
gcggggggtttttcagagcactacctgtttgataaaattcccacagaaaaanccatactaagtttgaagaaattncactgcagaaatggcttcaagaactgctagcaaagacataatcactctccgtggatccacagccancgtcagcgaattctttggttatgcagcgaacagtattctgtacaatcgtggagtttatcctgaagaaagttttggaagagtgaagaaatatggacttccattgttgctttctcangatgagggtgttaagacattcatcgcgaatttgaatgctcagctttcggaatggctggaagctgggaagttacaaaggattgttcttgtgattatgagtaaggccacaaatgaagtacttgagaggtggaatttcagtatagagacagatggtgaagttgttgagaaaggagtttcaagggagaagagtgataaagaaatcatgagggngattcaagctattatgagacagattgcatccagcattacgtacctgccatgcctcgatgaaccctgtatctttgatgtgttagcatataccgatacggatgttgcagtaccattcacttggnccgaaagcgacccaaaactgatagcgaatccccagatggtgaaattgcattctttcgataccaagatacacaaggttgacactttggtgtcttacaagaacgatgaatgggatgagcagtaaacaaagatgatgtgatttnnttttttgcttttgtgtccttttctttgtgaccctttaaggtcaatggtttttgattcagtttgtgtaagccttgaaatatatggaaaactttaag

SEQ ID NO: 2744 - DNA, 1201 bp, Secale cereale
cgacttcccaatttgccccatttcccgtccccattccatagcccagccgccgcctcgctgcccgttgctcccctttcttcttcccccgagagccaactccccgcccgccgcacccgcacccgcagccggagagagagagagcgaagaaggcaaagcgccgccgcgaggacgaccgaggccgaggagagatggcgtcgaggacggcgtccaaggacatcatcacgctcaagggctctgccgccatcgtcagcgagttcttcggttacgcggccaacagcatcctgtacaaccgcggggtgtacccggaggagagcttcgccaaggtgaagaagtacggcctccccatgctgctcacgcaggacgaggccgtcaagaccttcctcaccaacctcacctcccagctctcagagtggctggagggtgggaagctgcagaggattgtgctggtcatcatgagcaaggccaccggcgaggtgctggagcgctggaacttcaacatcatcaccgacggcgaggtcgtcgagaaaggggtggtgaaggagaagagcgacaaggagatcatgagggagatccaggccatcatgcggcaggtcaactcctgcatctccttcctcccctgcctcgacgagccatgcatattcgacgtgctcgcctacaccgactcggacaccaccgtgcccttcacctggatggagagcgacgccaagctcatcgacaacccgcagatggtcaagctgcactcgttcgacaccaagatccacaaggtggacacgctggtgtcgtacaaggtggacgacttggacgagcagtgactgacctgtggtgtgacccagagcgtccagacatcctctgctgcgtgaagctctctgtgtgaatcgttcattcacgtctgcccgtcagtcatcgtactgttgcccccctgcattagaaattcgcctccctgcgtctaccaaaacttgtactgttatttccaaaaaagtaatactgttttgttatccctgaattggatgtatcgcctgccgttttccacgcacacaagccctgaggcgaagtttgccaaacaaaccctatgtgtcagttttgtcagataactagtacgtgtcagtctgcctcattcaacgtgtaaacaaagcggccttcatgcttttcagtgtcacaaggggtgtaaacgggaaattaacaacagcatgaagcgattcaa

SEQ ID NO: 2745 - DNA, 998 bp, Helianthus annuus
gatggtggtgtgtttgaatctaattatgaagggcccacttgagtcgaccgtttttagtagccgttgctctcattttctcgattaaaccctagccctatttgcttcttcacgatgcactaaacctgttcgataaattccccaaaggaaacatcaggaaacgctctacccatttaaacaaacctaagaagttcgaatctttctactgtagatatggcttcaaaaaccgccagcaaagacataatcactctccgtggatccaccgccatcgtcagcgaattcttcggttatgcggcaaacagcattctgtacaaccgtggtgtttatcctgaagaaagttttggaagagtgaagaaatatggacttccattgttgctttctcaagatgaaggtgtcaagactttcattgcaaatttgaacacacagctttcagaatggcttgaagctgggaaactgcagaggattgttcttgtgataatgagtaaggccaccaatgaagtacttgaaaggtggaatttcagtatagagactgatagtgaagtggttgaaaaaggagtttcaagggagaagagtgataaagaaatcatgagggagattcaagctatcatgaggcagattgcttccagcattacatacctgccatgccttgatgaaccctgtatctttgatgtgttggcgtatactgatgcggatgttgcagtaccattcacttggacagagagtgatccaaaactgatagcaaacccccaaatggtgaaattgcattcttttgataccaagatacacaaggttgacacattggtgtcttacaagaatgatgaatgggatgagcagtaaaagatgggattttactttaatcttgtgtgttgatcctttaagattgatgtgaatcattttgattcccttcttgtgtaacctaacaagaatgaaatatgaatctggaaaattgtttcctcttggcttttaattttaatgacaactgttacttttcctgaatcatt

SEQ ID NO: 2746 - DNA, 891 bp, Helianthus annuus
aaattccccaaaggaaaacgctctacccatttaaacaaacctaagaagttcgaatctttctactgtagatatggcttcaaaaaccgccagcaaagacataatcactctccgtggatccaccgccatcgtcagcgaattcttcggttatgccgcaaacagcattctgtacaatcgtggtgtttatcctgaagaaagttttggaagagtgaagaaatatggacttccattgttgctttctcaagatgaaggtgtcaagactttcattgcaaatttgaacacacagctttcagaatggcttgaagctgggaaactgcagaggattgttcttgtgataatgagtaaggccaccaatgaagtacttgaaaggtggaatttcagtatagagactgatagtgaagtggttgaaaaaggagtttcaagggagaagagcgataaagaaatcatgagggagattcaagctatcatgaggcagattgcttccagcattacatacctgccatgccttgatgaaccctgtatctttgatgtgttggcgtatactgatgcggatgttgcagtaccattcacttggacagagagtgatccaaaactgatagcaaacccccaaatggtgaaattgcattcttttgataccaagatacacaaggttgacactttggtgtcttacaagaatgatgaatgggatgagcagtaaaagatgggattttactttaatcttgtgttactgtgtgttgatcgtttaagattgatgtgaatcattttgattcccttcttgtgcaaccgaacaagaatgaaatataaatctggaaaattgtttcctcttggcttttaattttaacgacaactgttacttttcctgaatcattatcatagaaggcacactgtgttgtc

SEQ ID NO: 2747 - DNA, 962 bp, Trigonella foenum-graecum
ggcgcttccctacaagtttctttccgaatccctaatttattatatatcctcttttccaaaaatttgttcatacttctcaaaactattctactcttccaattctagcaatcgaaatttcactcctattttacttgatcatggcatcaaagacagttaccaaagacataatcactcttcgtggttctgcagcaatcgttagcgagttcttcggatatgctgctaacagcatactttacaaccgtggtgtttatccagaagaaagctttgtgaaggtgaagaaatatgggcttcctatgttgcttactgaagatgagggtgttaaatcttttataaccaatttaactgctcagctttccgaatggcttgaagctggcaagctgcagaggattgtccttgttataatgagcaagtccactggtgaagtccttgaaagatggaacttcagcattgagaccgataatgtggttgttgagaagggcgagtctagggagaagagtgacaaggaaatcatgagagagatacaggccattatgaggcagattgcttcaagtatcacctatctgccatgcttggatgaaccttgtgtatttgatgtgttagcatatactaacacagacgtggaagttccattcacttggactgagagtgatccaaagctgattgcgaatccgcaaatggtgaaactgcattcctttgatactaagattcacaaggttgacacacttgtatcatacaagaatgacgaatgggatgagcagtaaagctgagagccatctgtgtgttttattgtcatgttgttctgtttctgtttttcatatcaagtgaattttatgtcagttgtgaattttctattcacattggtagatatgtttacttatgtggatgtcaatatgtgctaatcctttcttttgtatgtttgccttctgccagaaagaattgacatgtaagggatataaaaaaaa

SEQ ID NO: 2748 - DNA, 1174 bp, Triticum aestivum
ggcgaaaacgcgacccgacttccaatttcccccctttcccgtccccattccagcccagccgccgtctcgctgcccgttgctcccctttcttcccccgagagccaactccccgcccgccgcaaccacagccggagagagagagagcgcgaagaaggcgcgccgccgcgaggacgaccgaggccgaggagagatggcgtcgaggacggcgtccaaggacatcatcacgctcaagggctccgccgccatcgtcagcgagttcttcggttacgcggccaacagcatcctgtacaaccgcggggtgtacccggaggagagcttcggcaaggtgaagaagtacggcctccccatgctgctcacgcaggacgaggccgtcaagaccttcctcaccaacctcacctcccagctctcagagtggctggagggtgggaagctgcagaggattgtgctggtcatcatgagcaaggccaccggcgaggtgctcgagcgctggaacttcaacatcatcactgacggcgaggtcgtcgagaaaggggcggtgaaggagaagagcgacaaggagatcatgagggagatccaggccatcatgcggcaggtcaactcctgcatctccttcctcccctgcctcgatgagccatgcatattcgacgtgctggcctacaccgactcggacaccaccgtgcccttcacctggatggagagcgacgccaagctcatcgaaaacccgcagatggtgaagctgcactcgttcgacaccaagatccacaaggtggacacgctggtgtcgtacaaggtggacgacttggacgagcagtgacctgtggatgtgacccagagcgtccagacatcccctgtaggcgtgaagctctgtgtgaatcgttcattcacgtctggccgtcgttatcgtactgttgcccccctgcctctaccaaaacctgtactgttatttctcaaaaaaaaagtactgttatgttatacctgaattggatgtatcgcctgccgttttccacgcacaagctctgaggcgaagtttgccaaacaaaccctatgtgttagttttgccaaataactactcctttgtaaagaaatataagagctactttagtgatctaaactctcttatatttctttacgtgtcagtctgcctcatgaacatgtaaacaacagcataagcaat

SEQ ID NO: 2749 - DNA, 1004 bp, Capsicum annuum
gcacgaggcatctttagtgtgaagtgggagacggaaagaagtgtgacttgaccgttgttactgtgtcatttcccaaaactagccgttgctctctgctttgtttttcaattgtcataaaaaccctaactatattactttctcccccaaacaatcaatcaaacattcaaaccaatttgttagaaacttcaaaatcatttttctttgttttttgaaatcagatttaggatatggcgtcaagaacagcgtcgaaagacataatcacgcttcgtggttcagccgcaatcgtcagtgaatatttcggttatgcatctaatagcattttgtacaacagaggagtatatcctgaagaaagttttaaaaaagtgaagaaatatggactcacaatgttgcttactgaagatgaaggtgtcaagaccttcatttccaacttgactgcccaactcgccgagtggttggaaactggaaagctacaaagggtggttcttgtgatcatgagcaaggcctccggtgaggtattagagaggtggaatttcagtatcgaaactgatagcgaggttgttgagaaaggcgtttcaagagagaaaagtgataaagaaataatgagggaaattcaagcaattatgaggcaaatagcgtccagcatcacttatttgccttgccttgaggaaccatgtgtgtttgacgtattagcatacactgataccgatgttgcagttccattcacttggattgagagtgaccctaaactgattgcaaatccacaaatggtgaaactgcactcttttgacaccaagattcataaggttgacactttggtttcgtataaaaatgatgatgaatgggatgagtcctagatcatccgtgttgtacttttactttggttgtcattgttgtactttacttttggttttccttgtgaatcattgattcacattttgtatgttgattgtgtaaacctttgaaatctctgttagtatcttcaatgaagtctgaacaaatttgaa

SEQ ID NO: 2750 - DNA, 982 bp, Helianthus annuus
cacggggggccccatttctacttaataatacccagtgcacacaacctgttcgacaaaattccccacagaaacatcttagatcttttcatccatttgaacaaatctatcaagttcgaacatttcccactgcagaaatggcttacaaaaaccgccagcaaagacatcatcactctccgtggatccaccgccatcgtcagcgagtttttcggttatgctgcaaacagtattctgtacaatcgggctgtgtacccggaagaaagctttggaaaagtgaagaaatatggacttcctttgttgctttctcaagatgagggtgttaagaccttcattgcaaatttgaacacacagctttctgaatggctggaagctgggaagttacaaaggattgttcttgtgattatgagcaaggctactaatgaagtacttgaaaggtggaatttcagtatagagactgataaagaagttgttgaaaaaggagtttcaagagagaagagtgataaggaaatcatgagggagattcaagctatcatgagacagattgcatccagcatcacttacttgccatgccttgatgaaccctgtatatttgatgtgttagcatatactgatatggatgttgcggtacctttcacttggaccgagagtgatccgaaactgattgcgaatccgcagatggtgaaattgcattctttcgataccaagattcacaaggttgacactttagtgtcttacaagaatgatgaatgggatgagcagtaattagtaaaagatgtggtttttactttttactcaaactttggtttctgttgttgttggttcccaaagattgtgatgtgaatcattttgattcacattttctgtaagctgcttaagatatatgaaatataaatatggaatcttgttctatcatggctttcatgaaaattgttctctttgattataattatgttcataataaaatgtaaaatgactttatagaggc

SEQ ID NO: 2751 - DNA, 1008 bp, Vaccinium corymbosum
tgagccaaaccctactttgcagaattcaaatcctcctatccctctctcttcttcgtttttacaaatttcataaaacccttgttgtttttcaacagatctacaaaccaaatttacaggttcagacttgaaaagggttcttattggtatgggttcaagaacagccaccaaagacatcatcaccctccgtggatcagccgctatcgttagcgagttcttcggttattctgccaacagtattctctataaccgtggcgtctatccggaagaaagtttcacgaaggtaaagaagtatgggcttccactgttactcactcaagatgaaggtgtgaagaccttcatagctaacctaacggcacagctttccgagtggctggaatctgggaaattacaaagagtggtgcttgtgataatgagcaaggccacaggtgaggtattggagaggtggaacttcagtattgagactgacaatgaagtccttgacaaaggtgtgtcaagggagaagagtgacaaagaaattatgagagagattcaagcaattatgagacaaattgcatccagcataacatacttgccatgccttgatgaaccctgtgtgtttgatgtgttagcatacacggatacggatgttgcagtaccgttcacctggattgagagtgaccccaaactaattgcaaatccacaaatggtgaaattgcattcattcgacaccaagattcataaggtcaacactctggtctcgtacaagaacgatgaatgggacgagcagtgaagagtcaccgctctctggtgttgcgtgaatcattgattccgatttctaattgctctttttggcttctcttttgcgcgtgagctggttttccttcaagtaagacatatgggactcaggtgaatcattgattcacatagacattgtattggtttgtatccatatctcatcatttaacatggaatctttaaggcaccagtagaatttcgatctttgatttctggaggaagatgtttacaatc

SEQ ID NO: 2752 - DNA, 2253 bp, Triticum aestivum
cgaaaacgcgacccgacttcccaatttccccatttcccgtccccattccatagcccagccgccgcctcgctgcccgttgctcccctttcttcttcccccgagagccaactcctcgcccgccgcacccacagccggagagagagagagcgcgaagaaggcaaagcgccgccgcgaggacgaccgaggccgaggagagatggcgtcgaggacggcgtccaaggacatcatcacgctcaagggctccgccgccatcgtcagcgagttcttcggttacgcggccaacagcatcctgtacaaccgcggggtgtacccggaggagagcttcggcaaggtgaagaagtacggcctccccatgctgctcacgcaggacaaggccgtcaagaccttcctcaccaacctcacctcccagctctcagagtggctggagggtgggaagctgcagaggattgtgctggtcatcatgagcaaggccaccggcgaggtgctcgagcgctggaacttcaacatcatcactgacggcgaggtcgtcgagaaaggggcggtgaaggagaagagcgacaaggagatcatgagggagatccaggccatcatgcggcaggtcaactcctgcatctccttcctcccctgcctcgatgagccatgcatattcgacgtgctggcctacaccgactcggacaccaccgtgcccttcacctggatggagagcgacgccaagctcatcgaaaacccgcagatggtgaagctgcactcgttcgacaccaagatccacaaggtggacacgctggtgtcgtacaaggtggacgacttggacgagcagtgacctgtgggtgtgacccagagcgtccagacatcccctgtaggcgtgaagctctgtgtgaatcgttcattcacgtctggccgtcgttatcgtactgttgcccccctgcctctaccaaaacctgtactgttatttctcaaaaaaaaagtactgttatgttatacctgaattggatgtatcgcctgccgttttccacgcacaagctctgaggcgaagtttgccaaacaaaccctatgtgttagttttgccaaataactactcctttgtaaagaaatataagagctactttagtgatctaaactctcttatatttctttacgtgtcagtctgcctcattgaacatgtaaacaacagcatgaagcaattgaatgaatctcaaacagcctggtcatggctcctgtaacaacagcaccgagcaaattgaactcgggaaaccttacagagtttgtttccatggctatatatttacctagatagccattcctatagtcttaaaatatggctcccgaatacaggaatacatttacagtcagggatgcctaggactggcttcgaactatgttcacctgtatggacggaccacttctatggtggacattaatttaggggtatgttttcccatttattttttattatcatagcccaaaaacttgcccattcggccaaaacatgggcaatgggcaatgggcaatgggcaagcaaaccctctccaccttggcagggcgaacttgggctcaaaaccaacataccccagatatagatgccctttgtcggacaaatgatgcaggatcaatctacaagcgagcgcatcccctggtaaatcgcgccagggcgaagatcgtccagagtatcagcaactctgtagccactatactccctgaggagtgtccaaccacgccgtgacagaaaatctctgaagtcgtcttcagtgtagaatgtcttatcttctgtccggactgtcatgcggtctgcatcttcgaatgtgcagagtttgattgttatcccattatcaagatgaagagcatatactccgactggcatgtccctgtccaaggaacgaacaacctcgtcctcatcttcaagccaaaaagcccgccttgttcttaatccaaaggccgatttgatggcctctttaattgcctcggcagtaccatcaatccctattcttttagtatagtcaccccacttgactaggatgaccctcccaccataagtaccttgattatctccaccattagttgaggtgtctctccagttccatggattcacaccattggttgcaactgcatcagctgtcgttaaggcaagtggatgactcgcttcaacaggaccaaatggaatgttggcatcttcaaaacctttatccgcgaattgcaggtaagactcgatcttggaggtgggcgtggggctcttcgcggcgccacctccaccaccac

SEQ ID NO: 2753 - DNA, 866 bp, Taraxacum officinale
cggcggggcacttaacctggtttgataaatttcctcacagaagcatcagaaatcgtttgaataaaagaacatctacatcagaaatggcttcaaggactgcgagcaaagacataatcactctccgtggatccacagccatcgtcagcgaatttttcggttatgcagcaaacagtattctgtacaatcgtggtgtttaccctgaagaaactttcgaaagagtgaagaaatatggacttccattgttgctttctcaggacgagggcgttaagacattcatctcaaatctacataagcagctttccgaatggctggaagctgggaagttacaaaggattgtacttgtgattatgagtaaggccaccaatgaagtactcgaaaggtggaatttcagtatagagaccgatggtgaagttgttgaaaaaggaatttcaagggagaagagtgataaagaaatcatgagagagattcaagctatcatgagacagattgcatccagtatcacatacttaccttgtctagatgaaccatgtatttttgatgtattggcatatactgatacagatgttgcagtaccatttacttggacagagagtgaccctaaactcatagcaaatccacaaatggtgaaattgcattcttttgatacaaagatacataaggttgacactttggtgtcatacaagaatgatgaatgggatgaccagtaaaaaaaagatgggatattgttgatgtaattttggtgtttgatccttattaatgatgatgtgaatcgttttgattcactagaggaatggaatatgaatctagaaacttgtttttgtttggctttttctatggctgaaacattataacacttgaaattgaaa

SEQ ID NO: 2754 - DNA, 1090 bp, Mimulus guttatus
gaccgttgcctttcaatcaatctccccccactatccaaaaaacgatgcagaaatagccgttgcaattccatcaaaaaccctagaatttatctcttcatcattcgaccgcagataagaaaaccccctttttttttctcaattaactccacaatcagtcgaacattaatctaagtttcgctatacttctagggttttgctgtacaattcaataatcgaaagagaagaaaacaatggcttctaaatccgccacgaaagacataatcactctgcgaggatcggccgccattgtcagtgaattctttggttatgctgcaaacagtatactttacaatcgaggggtatatccggaagaaagttttgcgagagtgaagaagtatgggcttccgatgttgcttacgcaggacgaaggggtcaaatccttcatttctaatttaacttctcagctttctgagtggcttgaagaagggaagttacagaggatggttcttgtgatcatgggcaaacaaactggtgaggttttcgagaggtggaatttcagtatcgagactgatggcgaggtcgtcgaaaagggaatttcgagggagaaaagtgacaaagaaataatgagggaaattcaggctataatgaggcagatagcgtccagtattacgtatttgccatgccttgaagaaccctgtgtgtttgacgttttagcgtataccgacaaagattgcgcagtcccgtttacatggatcgagagtgaccctaagctgattgataacccacagatggtgaaattgcattctttcgataccaagattcacaaagtcgacactctggtgtcgtataagaacgatgaatgggacgagccataatttcgtattctccacattttaacatgttcttaaggaatcactgttttgattcatatttttttagtttcgagtgcaaaaaccggaactacggattctcttgtgaatcattgattcacattgtgtgtattagtttgtttgtttgattcatacacattgtgtgtattagtttgtcattgtgtgtattactgttatgcaattatttttatttttttaatccaaaaaaaacatatgttcac

SEQ ID NO: 2755 - DNA, 1149 bp, Mimulus guttatus
gaccgttgcctttcaatcaatctccccccactatccaaaaaacgatgcagaaatagccgttgcaattccatcaaaaaccctagaatttatctcttcatcattcgaccgcagataagaaaaccccctttttttttctcaattaactccacaatcagtcgaacattaatctaagtttcgctatacttctagggttttgctgtacaattcaataatcgaaagagaagaaaacaatggcttctaaatccgccacgaaagacataatcactctgcgaggatcggccgccattgtcagtgaattctttggttatgctgcaaacagtatactttacaatcgaggggtatatccggaagaaagttttgcgagagtgaagaagtatgggcttccgatgttgcttacgcaggacgaaggggtcaaatccttcatttctaatttaacttctcagctttctgagtggcttgaagaagggaagttacagaggatggttcttgtgatcatgggcaaacaaactggtgaggttttcgagaggtggaatttcagtatcgagactgatggcgaggtcgtcgaaaagggaatttcgagggagaaaagtgacaaagaaataatgagggaaattcaggctataatgaggcagatagcgtccagtattacgtatttgccatgccttgaagaaccctgtgtgtttgacgttttagcgtataccgacaaagattgcgcagtcccgtttacatggatcgagagtgaccctaagctgattgataacccacagatggtgaaattgcattctttcgataccaagattcacaaagtcgacactctggtgtcgtataagaacgatgaatgggacgagccataatttcgtattctccacattttaacatgttcttaaggaatcactgttttgattcatatttttttagtttcgagtgcaaaaaccggaactacggattctcttgtgaatcattgattcacattgtgtgtattagtttgtttgtttgattcatacacattgtgtgtattagtttgtcattgtgtgtattactgttatgcaattatttttatttttttaatccaaaaaaaacatatgttcacaatttttttgtttcttgtagcatgctcatgttttttcagcaaaaacagataaacataaa

SEQ ID NO: 2756 - DNA, 1089 bp, Populus trichocarpa
atggtgccgttgttgtcagcctcgagacccagaggaaaactagccgttacttgccctaacgtctttacattacatttcatcactaatctattactcgctcaccaaaccctgatttcttgcaatcaattctcaaataaacaaaaacccatctttctttgtactttgatttcaaagagaatcatggcatcaagaacggttgcaaaagacataatcactctccgtggctctgcagcgattgttagtgagttctttggttatgcagcaaacagtatactttacaatcgaggggtttatccagaagaaagttttgtgaaagtgaagaaatatgggctcccaatgctgcttactcaagatgaaggtgttagatcctttatttctaacttgaatgctcagttatcagaatggctggaagctggaaaattacagagggttgttctggtgatcatgagtaaggccaccaatgaggtcctggagaggtggaatttcagtatcgagactgatagtgaggttgttgagcaaggagtgtcaagggaaaagagtgacaaagaaattatgagagagatccaggcaatcatgcgtcagattgcatcaagcattacttacttgccatgccttgatgaatcttgtgtttttgatgtgttagcatacactgataaagatgttgcagtcccattcacctggattgagagtgaccccaaacttattgccaatccacaaatggtgaaattgcattcattcgacaccaagatacacaaggttgacactctggtttcgtacaagaatgatgaatgggatgaacagtagaggtggccctatcttttgtgaactgtttgtggatttctgctccggtgtctgtcactgtgaatcttttattcacatgttctaagatcggttgctagaaaagtatgtaccgattgtaatcgatcatgtctgtttttgtcgaagttgaaatgaaggagcaaatctaggccttgcttccctgttttacttgtaatgaatgcaagtacatcgaatatgaatccacaacgaagaaactttagctatgatcttttgtacatttcctttctcgcattatctatttttcgaatc

SEQ ID NO: 2757 - DNA, 1101 bp, Populus trichocarpa
atggtgccgttgttgtcagcctcgagacccagaggaaaactagccgttacttgccctaacgtctttacattacatttcatcactaatctattactcgctcaccaaaccctgatttcttgcaatcaattctcaaataaacaaaaacccatctttctttgtactttgatttcaaagagaatcatggcatcaagaacggttgcaaaagacataatcactctccgtggctctgcagcgattgttagtgagttctttggttatgcagcaaacagtatactttacaatcgaggggtttatccagaagaaagttttgtgaaagtgaagaaatatgggctcccaatgctgcttactcaagatgaaggtgttagatcctttatttctaacttgaatgctcagttatcagaatggctggaagctggaaaattacagagggttgttctggtgatcatgagtaaggccaccaatgaggtcctggagaggtggaatttcagtatcgagactgatagtgaggttgttgagcaaggagtgtcaagggaaaagagtgacaaagaaattatgagagagatccaggcaatcatgcgtcagattgcatcaagcattacttacttgccatgccttgatgaatcttgtgtttttgatgtgttagcatacactgataaagatgttgcagtcccattcacctggattgagagtgaccccaaacttattgccaatccacaaatggtgaaattgcattcattcgacaccaagatacacaaggttgacactctggtttcgtacaagaatgatgaatgggatgaacagtagaggtggccctatcttttgtgaactgtttgtggatttctgctccggtgtctgtcactgtgaatcttttattcacatgttctaagatcggttgctagaaaagtatgtaccgattgtaatcgatcatgtctgtttttgtcgaagttgaaatgaaggagcaaatctaggccttgcttccctgttttacttgtaatgaatgcaagtacatcgaatatgaatccacaacgaagaaactttagctatgatcttttgtacatttcctttctcgcattatctatttttcgaatccgaatccacatt

SEQ ID NO: 2758 - DNA, 726 bp, Carthamus tinctorius
  misc_feature (311)..(312): n is a, c, g, or t
ttttttttctttcttcaccaagcactccacctgtttgataaattccccacagaaaaccctaattaacttccaacaaatctcaatggcttcaagaactgccagcaaagacatcatcactctccgcggatccaccgccatcgtcagcgagttcttcggttatgcggccaacagcattctctataatcgcggagtttaccccgaggaaagttttgggagggtgaagaaatacgggcttccgttgttgctttcacaggatgatggtgttaagacatttattgcgaatttgaatgctcagctttctgaatggcttnnagctgggaagttgcagagaattgttcttgtgattatgagcaaggccaccaatgaagtgcttgaaaggtggaatttcagcatagagactgatggtgaggttgtggagaaaggagtttcaagggagaagagtgataaagaaatcatgagggagattcaagcgattatgagacagattgcgtccagcattatgtacctgccatgcctcgatgaaccctgtatctttgatgtgttagcatatactgatactgatgttgcagtaccattcacttggaccgagagcgacccgaaactgatagcgaatccccagatggtgaagttgcactctttcgataccaagatacataaggttgacactttggtgtcttacaagaatgatgaatgggatgaacagtaaacgaagatgatgtggtttct

SEQ ID NO: 2759 - DNA, 1693 bp, Lactuca sativa
gggaccccttattgcccgttgcgtccgcaccaaatcgtttttctcttttgaacaggttgaccgtttgggatatcagagccaacaaagcgagtgccaaaagtagccgttgcgctgcattttatcgatttatatcgtttctaaaccctagccctatttctacatgagatttggcttttcaggaagcactcaacctgcttgataaaaatcccacagaaagatcataaatctatcaactttgaggagtttctacttgtagaaatggcttcaagaactgcgagcaaagacataatcactctccgcggatccacagccattgtcagcgaatttttcggttatgcagcaaacagtattctgtacaatcgtggtgtctatccggaagaaacttttggaagagtgaagaaatatggacttccattgttgctttctcaagacgaaggtgttaagacattcatctcaaatttgaataagcaactttcagaatggctggaagctggcaagttacaaaggattgttcttgtgataatgagtaaggccaccaatgaagtgcttgagaggtggaatttcagtatagagactgatggtgaagttgttgaaaaaggagtttcgagggagaagagtgataaagaaatcatgagagagattcaagctattatgagacagattgcatccagcattacatacttgccctgcctggatgaaccatgtatctttgatgtgttagcatatactgatacggatgttgcagtgcctttcacttggacagagagtgaccctaaactgatagcaaatccccaaatggtgaaattgcattcttttgatactaagatacataaggttgacacaatggtgtcttacaagaatgatgaatgggatgaccagtaaaagaaagaaagatagggatgtttaagaaaattgttgctgtgtttttgttgttgatccttgaaggttgaatgatgtgaatcgttttgattcacttgtgtgtaggaatgaaatatgaatctggaaacttgctttttcttgaaattgaagaacttgcttgctgcaataagacattgattttcttgaaaaatgtcaacacttgtatgggtgtggtttggttaaaattagaccctaaagtgacttgttttcaaaaaaaaatccgataaatccgtcttgtaacagatgatgcaactgcacctttaagacctcagaaaaatcattaagacctcagaatcaggacccggctgccacctcatcttatgaatatacagactcaccaacagatgatgcaactgcaccttttatgatgacattcatgtttggtgatgaagaaagaagttttactttttttatggtgtttgagattgggtcatagtagattacttccgaatctttatcttgtttctccgattcgatgctttttgaggtccaatggtgatcttgttgttgtcttcgattgtggttgattgagatgtgaatattatttggttcatggggttgaagtgggctgttgtggtttgacttttctgaacagatgcttccgaatttgtttggatgaacaagacgactgcagaacaatatcaacaaaagccataaagaaaacttatgtaccatagtactccaaacagaataacatcaccaatcactttcttcctttgacaattgtcccatatagtgcttgtattaagaaattcagtaacacccgagaaccccc

SEQ ID NO: 2760 - DNA, 1533 bp, Eucalyptus grandis
attacgggggggaaaccccaacgataaaagaagaaaaaaacaaccaaatcttcccaaacgtctccgcgcagatcagccatttcgcactccgttctactcgctctccgtccgcccttcgctccgcgcttctccgctcgcgctctttccacggtcggttcgccgatttctcccttcggaatctcgctctcgcgctgcccggttccgcgttcgttcgattccgtccaggggcgaactcgtttagcatggcctcgaagaccgtcgccaaggacatcatcaccctgcgcggctccgcggcgatcgtcagcgagttcttcggttctattctgtacaatcgcggggtgtatccggaggagagtttcgcgaaggtgaagaaatatgggcttccgatgctgcttactcaggatgaaggtgtcaaatccttcattgccaacttaaatgctcagctttcggaatggttggaggctggcaaactgcagagggttgttcttgttataatgagcaaggccactggtgaggtgttggagaggtggaacttcagcatcgagaccgatggtgaggtcgtcgagaagggagtctcgagagaaaagagtgacaaagagatcatgagagagattcaagcaattatgcgacagattgcttcgagcatcacttacttgccatgccttgatgaaccctgtgtatttgatgtgttagcatacactgataaggacgtggcggttccattcacgtggattgagagcgaccctaagttgattgccaatccacagatggttaagttgcattcttttgacacaaagatacacaaggtggacacacttgtatcgtacaagaacgatgaatgggatgagcagtaatttccctcgtgtcttaaactggatattgtgaatcttttattcacattttgtacgacttgaatggactgaccccgagaaacaatgtcctcaagttcctgttatgaatcggctaattctgcaatttttgttaaatgcatcccgagaaatatggcaattgtgaactcccttgtctctgtcccctttcgaccaaatcacggcattcgtgctcattgtcaaaaggacctgaggtggcctccggtaaaatggaagaattctcaaagagattttcagaggaaagccaaatgtaattacaaccttgttacaggccaaaaaggcagttatgtcaacagcatttcggtaatccagggagtgatatatacatttttgaaatgcctcagcacactgctaatcgaataacatctcgtgccaagatgctatacacaatttaacgtcacggttcagctccatcatggtcataattacaaagttccccgcaggcctcatgtcacaccgcggtagattccaccaggccgtaggtcatccatattatcaatgtttctgtacccatcaagctccctcaaacacgtccaccctcttcgggcaagaaaatcacgataatcatcttccgtgtagaaaatcttatcttctggatgaactgaaatatgccctgactcatcatataggcaaacttttatggcca

SEQ ID NO: 2761 - DNA, 904 bp, Fagopyrum esculentum
aatcagatcatacatccgactccactactcttctctctagttttcttaccttgattcaatcgaaaccctaggttccttgcgaaggttttgcgtttgcagaaactagttcttatggcttcaaaaactgtcacaaaagacatcatcactctccgtggatcagccgccatcgttagcgagttctttggctacgctgccaacagtatcctttacaatcgaggagtttatcccgaggagagttttgctaaggtaaagaagtatggattgccaatgttgctcactcaagacgaaggtgtgaaaaccttcataactaatctcactgcccagctttcagagtggcttgaggccgggaagcttcagcgaattgttctagtcataatgagcaaatcgactggggaggttctggaaagatggaatttcagcattgaaactgaccaggaagttgtcgtggagaaagctgtgacgagggaaaagagtgacaaggaaatcatgagagagatacaagcaatcatgagacagattgcttcaagtatcacttacttaccttgccttgatgaaccttgtgtgtttgatgtgttagcatacactgatcaagatgtatcagcaccattaacttggatcgagagtgatcctaagttgatcgctaatcctcagatggtgaaactgcactcttttgatactaagattcacaaagttgacaccctcgtgtcttacaagaacgacgacttggatgactaaagtagacaaagggtttggatccttttgctattccgtatattttcctcgttcaaattgtattggttcttaagaatcgtttgtagttcaattgtgaatcattaattcacagtaagtgtcatggaaacaatgaatcatatgatgaatcagagttctgataaattttctcgcc

SEQ ID NO: 2762 - DNA, 810 bp, Lactuca sativa
agaaatggcttcaagaactgcgagcaaagacataatcactctccgcggatccacagccattgtcagcgaatttttcggttatgcagcaaacagtattctgtacaatcgtggtgtctatccggaagaaacttttggaagagtgaagaaatatggacttccattgttgctttctcaagacgaaggtgttaagacattcatctcaaatttgaataagcaactttcagaatggctggaagctggcaagttacaaaggattgttcttgtgataatgagtaaggccaccaatgaagtgcttgagaggtggaatttcagtatagagactgatggtgaagttgttgaaaaaggagtttcgagggagaagagtgataaagaaatcatgagagagattcaagctattatgagacagattgcatccagcattacatacttgccctgcctggatgaaccatgtatctttgatgtgttagcatatactgatacggatgttgcagtgcctttcacttggacagagagtgaccctaaactgatagcaaatccccaaatggtgaaattgcattcttttgatactaagatacataaggttgacacaatggtgtcttacaagaatgatgaatgggatgaccagtaaaagaaagaaagatagggatgtttaagaaaattgttgctgtgtttttgttgttgatccttgaaggttgaatgatgtgaatcgttttgattcacttgtgtgtaggaatgaaatatgaatctggaaacttgctttttcttgaaattgaagaacttgcttgctgcaataagacattgattttctcg

SEQ ID NO: 2763 - DNA, 917 bp, Raphanus sativus
ggaaatcaaatcatccaaaaaccctaatcgacgctctccgaatccgatttgattacaacagaacacaaatacaaattttcaaaatttacagatcctttcgtttgcttcaaatggcttccaaaaccgcggctgctaaggacatcatcactctccacggatccgccgccatcgtcagcgagttcttctgctacgctgccaacagtatactgtataatagagcagtatacccagaagagagctttgtgaaagtgaagaagtatggtcttcccatgctgcttactcaagacgaatccgtcaaatccttcttatccaatctctcttctcagatctccgagtggcttgaagctgggaagttgcaaagagtggtgttggtgataatgagcaaagctacaggtgaagtcttggagaggtggaacttccgtattgagactgattctcaagttgttgacaaaggtgtgtcgagggagaagagtgataaggagatcatgagggagatccaagctatcatgagacaggttgcttccagcattacttacttgccttgtcttgatgagccttgtgtgtttgatgtgttggcgtatacggacacggatgtggctgttccattcacgtgggtggaaagcgatccgaagctgattgctaatccacagatggttaagctacacggttttgataccaagattcacaaagtggacaccctcgtctcatacaagaacgatgaatgggatgaagaagagtaactaacacaagtctcatgctcagctcaaccaccgttttccttttctcatgttcttgaatgtcaagtgaatcctttattcacctatcttgttttctgtttttcttctttccggatcgtttcagaataatgtatccttgtcgttcatgtttgttcaatagttatcagctttctggttccc

SEQ ID NO: 2764 - DNA, 1021 bp, Raphanus sativus
  misc_feature (782)..(782): n is a, c, g, or t
gggaaatcaaatcatccaaaaaccctaatcgacgcttccgaatccaattcgcttccacatagaacacaaatacacattttcaaaatctacagatcctttcgttttttgcttcaaatggcttccaaaaccgcggctgctaaggacatcatcactctccacggatctgccgccatcgtcagcgagttcttctgctacgctgccaacagtatactgtacaatagagcagtatacccagaggagagctttgtgaaggtgaagaagtatggtcttcccatgctgcttactcaagacgaatccgtcaaatccttcttatccaatctctcttctcagatctccgagtggcttgaagctgggaagttgcagagagtggtgttggtgataatgagcaaagctagtggcgaagtcttggagaggtggaacttccgtattgagactgattctgaagttgttgacaaaggtgtgtcgagggagaagagtgataaggagatcatgagggagatccaagctatcatgagacaggttgcttccagcattacttacttgccttgtcttgatgaaccttgtgtgtttgatgtgttggcgtatacggacacggatgtggctgttccattcacgtgggtggaaagcgatccgaagctgattgctaatccacagatggttaagctacacggttttgataccaagattcacaaagtggacaccctcgtctcatacaagaacgatgaatgggatgaagaagagtaactaacacaagtctcgtgctcagctcagcccccagccancgttttccttttctcatgttcttaaatgtcagtcaagtgaatcctttattcacctatgttgttttctgtttttgttttttccggattgtttgagaataatgtaccttttgtccttcatgtttgttcaatagttaccagctttctggttctctctctgtcccttgcattgacaccatggtgtttacaaaacgaaaacaaatcctttgacatcgacggcaaaaaatgattcttctagttta

SEQ ID NO: 2765 - DNA, 805 bp, Solanum phureja
catttttcttcttccattcctaaatctgaaaatggcgtcaagaacagtctctaaggacataatcacacttcgtggttcagccgcaatcgtcagtgaatattttggctatgctgcaaacagcattttgtacaacagaggagtatatcctgaagaaagttttaagaaagtgaaaaaatatggtctcacaatgttgcttactgaagatgaaggtgtcaagacctttgtttccaacttgactgcccaacttgctgagtggttggaaactggaaagctacaaagggtggttcttgtcatcatgagtaaggcctctggtgaggtattagagaggtggaatttcagtattgaaaccgatagcgaggttgttgagaaaggtgtttcaagagagaaaagtgataaagaaataatgagggaaattcaagcaattatgaggcaaatagcgtccagcatcacttatttgccgtgccttgaggaaccatgtgtgtttgatgtgttagcatacactgatactgatgttgcagttccattcacttggattgagagtgaccctaaactgatagcaaatccacaaatggtgaaactgcactcttttgacactaagattcataaggttgacactttggtttcgtataaaaatgatgatgaatgggatgagtcctagaccatggatcgttgttgtactttacttttgttgtcattgtgaatcattgattcacattttgtatgttagattgtgtaaaccttgaaaaatctattagttgtatcctcaatgaagattggacgacattgaacaatgagatcaatttct

SEQ ID NO: 2766 - DNA, 1020 bp, Gossypium hirsutum
agaaagtagccgttacacttgctttttgcttttgccctttgattattatttctctcaaactcatatttcctgaaaactcatcagccattagagcgatagtcatcttcatctaacccaaacgacaatttctacttcctaaattcccaattacagttgcctttttgccctaaatttaccaattatttagttcctttcatccaaaattttgatcctagaagaagtcgaatggcgtcaagaacagttgccaaagatataataactcttcgaggctcagcggcaattgtcagcgagttttttggatatgcagcgaacagcattttgtacaatcgaggagtttatccagaagaaagttttgccaaagtgaagaaatacgggctcccaatgttgcttactcaagatgaaggtgttaaatcgttcattaccaatctaacagctcagctttctgaatggctggaagctgggaaactacagagggttgtaatggttatcatgagcaaggcaaccaatgaggtcttggagagatggaatttcagcattgagactgatagtgacgtttttgagaaaggtgtgtcaagggaaaagagtgacagggaaatcatgagagaaattcaggcaatcatgagacagattgcctcaagtattacttacttgccgtgccttgatgaaccatgtgtgtttgatgttctagcatacactgatacggatgttgcagtaccattcacttggattgagagcgaccctaagctgattgcaaatccacaaatggtgaagttgcattcatttgataccaagatacacaaggttgacactcttgtttcatacaagaatgatgaatggacgagcagtagagtgcctgaaccttctttgtcccccaccgcctatatgtgaatctttgtccttgaaactctttctgttctcatgttatacatgttatttaaaaaaacaaatagaagttaattcttcaaaattggtgcaaaccttttatgatattaattgtaaaagaaatatttccaaatgatc

SEQ ID NO: 2767 - DNA, 742 bp, Eutrema halophilum
tttgtttatcgtcatttctccatttgattcttcatctcaatcgcttcccatggcgtcaaaaaccgcggctgctaaagatatcatcactctccacggatctgctgccatcgtcagcgagtttttctgttacgctgcgaacagtattctgtataatcgtgcggtttatccagaggaaagttttgtgaaagtgaagaagtatgggcttccgatgttacttattgaagatgaatccgtcaaatcattcctctcaaatctcacttctcagatctccgaatggcttgaagctgggaagttgcagagagtagtgcttgtgataatgagcaaagctactggtgaagtcttggagaggtggaatttccggatcgaaaccgataatgaggttgttgagaaaggtgtatcgagagagaaaagtgacaaggagatcatgagggagatccaagctatcatgagacaagttgcttccagcataacttacttgccttgtcttgatgaagcatgtgtttttgatgtattggcatatacggatacggatgtggctgttccattcacttggatcgaaagcgatccaaagttgattgctaatccacagatggttaagctacacgcttttgataccaagattcacaaagtcgacactctcgtctcatacaagaacgacgaatgggatgaagaagagtaaacagaagtctcttgttcagctcgcgttttcctcggtctctttttatccgtttatgtgccagtg

SEQ ID NO: 2768 - DNA, 802 bp, Solanum lycopersicum
ctacttctatttcctaatctgaaaatggcgtcaagaacagcctccaaagacataatcacacttcgtggttccgccgcaatcgtcagtgaatattttggctatgctgcaaacagcattttgtacaacagaggagtatatcctgaagaaagttttaagaaagtgaagaaatatggtctcacaatgttgcttactgaagatgaaggtgtcaagacctttgtttccaacttgactgcccaacttgctgagtggttggaaactggaaagctacaaagggtggttcttgtcatcatgagtaaggcctctggtgaggtattagaaaggtggaatttcagtatcgaaactgatagtgaggttgtccagaaaggtgtttcaagagagaaaagtgataaagaaataatgagggaaattcaagcgattatgaggcaaatagcgtccagcatcacttatttgccgtgccttgaggaaccatgtgtgtttgatgtgttagcatacactgatatggatgttgcagttccattcacttggattgagagtgaccctaaactgattgcgaatccacaaatggtgaaactgcactcttttgacactaagattcataaggttgacacattggtttcatataagaatgatgatgaatgggatgagtcctagaccatggatccttgttgtaccttacttttgttgtcattgtgaatcattgattcacattttgtatgttagattgtgtaaaccttgaaacatctattagtttgtatcctgaatgagtattgaaggaaattgaacaattagatcaatttctccg

SEQ ID NO: 2769 - DNA, 647 bp, Prunus persica
tgatggcttcaagaactgcgaccaaagacattatcactctgcgtggttccgcggctatcgtcagcgagttcttcggatattcagcgaacagcattctgtacaatcgaggagtgtatcctgaagaaagctttgtaaaggtgaagaaatatgggctgcccatgttgcttactcaagatgaaggcctcaaatccttcatcgccaacctaactgctcagctttctgaatggctggaatctggcaagttacagagagttgttctggtcatactgagcaaggcgactaatgaggttctagagaggtggaacttcagcattgagactgacaatgaggtcgttgagaagggggagtcgagggaaaagagtgacaaggaaatcatgagggagattcaagcaatcatgaggcagattgcttcaagcattacttacttgccgtgccttgaagaagcctgtgtgtttgatgttttggcatacacggataaagatcttgcagtcccattcacttgggtcgagagtgaccccaaactgattgcaaatccacaaattgtgaaattgcattcctttgacaccaaggcaaattcacaaggttgacacactagtgtcctacaagaatgacgaatgggatgagcagtagcggaaggagaggggagg

SEQ ID NO: 2770 - DNA, 1052 bp, Cucurbita pepo
tctcaaatttcctcagatccactcgtttttctctttgtcaatttgatcactcgatcgatttcactttccaatttggttacccctgtatcgattagaagccctaaatccgatcctcgtcttagaatcgaagaaatacaggaacaattcttattgtttcagaagagatttgaagaagatttgttggaatggcttcgaaaacagcgtccaaagacatcatcactcttcgcggttctgcggcgattgtcagcgagttcttcgggtatgctgctaatagcatcttgtacaatcgtggactttatcctgaagaaagttttgcaagggtgaagaaatatggacttccaatgttgcttactcaagatgaaggtgttaagaccttcatttctaatcttactgctcagctttctgaatggctggaagctgggaagctgcaaagggttgtgctggttataatgagcaaagccaacaatgaggtgcttgagaggtggaatttcagaattgaaactgatggagaggtggtcgagcaaggtgtgtcgagggaaaagagtgataaagaaataatgagggagatccaagcaattatgagacagattgcttcgagcatcacttacttgccctgcctagatgaaccctgtgtatttgatgtgttagcatacacagataaagatcttgcagttccatttacttggatcgagagtgaccctaagctgattgctaatccacaaatggtgaagctgcactcatttgatacaaagattcacaaagtggacactcttgtttcttacaagaacgacgactgcgacgatgagtaaaagaaacaaactcgctttcctggaatttgtggttgggtgttctgggatccctccaacccgatcgctttcaaggtggcattttgtgaatcttttattcacatttggtgttgtactgtaatgtaatgtgtaatgtaggaacaatgttttgtgggagcgagtggtgaatatagggtaggatgggttcgcttagatttctttccatctgtgaatggttttgggtttgtttgtttgtgctgtgtgtag

SEQ ID NO: 2771 - DNA, 1019 bp, Amborella trichopoda
aatggcttcaaaaactgcaaccaaggatgtcatcaccctcaaaggatcggcagcaatcgtcagcgagttctttggttacgcagcaaacagcattttgtataatcgaggggtttaccctgaagaatgcttcgtcaaggtgaagaaatatggactacccatgttgttgattgaagacgatgcagtcaaggcctttcttgcctgtcttacttcccaaatatctgaatggctggaatcagggaagctacaaagagtggttctggttattatgagcaaagcttcttcagaagtgttggagagatggaatttcaacatagagactgataacgaagtggttgagaaaggggtttcgagggccaaaagtgacaaggaaatcatgagagaaatccaggccatcatgcgtcagattgcttcaagcatcacctatctgccctgtttggatgagccctgcgtatttgatgtgctagcatatactgatacggatttggagattcctgttacatggatggaaagtgatgcaaaactcattctcaatccgcagatggtcaaattgcattcttttgatactaagatacacaaggttgacactttggtttcatacaagaacgatgaatgggatgagcaatagtcaagttccaagtggtttcttgtggtgacactctggtgacactctgttttcttcttctcaggaatcaatggattatgaatgaggtgatctaattagttttacaggccatgaacaacaacctttgctaaggttgtttactgttgtttgttgatttcaatggacattgttgtacacttccaagtatatttctgctatgtttaactctgctgtaactctctctctcttgttctctctcatacatggtgtagcgttttatattggcgggctgcatccaattttgttggacggtgcagattgcaccatgtcttcacttgaggatgcaatttccattgtccaacaaaagttcaatttgagttaaagaaggctctgaaacaaaaaaaaaaaaaaaaagaaa

SEQ ID NO: 2772 - DNA, 940 bp, Ambrosia trifida
tttagtatcttaaattaggttgggtatggttcgtgactttctaaggacccacttcacttcgtagttcgaccgttttgttaggtccgtttcgtctcctcttacccttctccaatttaaacaaaccctaagtcctcccactttttgtcgctaaaccctagttcgaccaaaattacccccactagaaaccgttcttccccatttgaccaatcactgcagaaatggcctcaaaaaccgccaccaaagacataatcacactccgtggatccacagccattgtcagcgaattttcggttatgcagcaaacagcattttgtacaatcgtggcgtttatcctgaagaaagttttggaagagtgaagaaatatggacttccattgttgctttcacaagatgaaggtgttaagacattcattgcaaatttaaacacacagctttcagaatggcttgaaactgggaaactgcagaggattgttcttgtgataatgagtaaggccaccaatgaagtacttgaaaggtggaatttcagtatagagactgataaggaagtggttgataaaggagtttcaagggagaagagtgataaagaaatcatgagggagattcaagctatcatgagacagattgcttccagcattacgtacttgccatgcctcgatgaaccctgtatctttgatgtgttggcatatactgatatggatgttgcagtaccattcacttggacagaaagtgatccaaaactgatagcaaacccacaaatggtgaaattgcattcttttgataccaagatacacaaggttgacactttggtgtcttacaagaatgatgaatgggatgagcagtaaaagatggcatttttctttaatctgttgttaatccaatccctaaacattgatgtgaatcattttgattcacttttttgtgcaagattgaaatatgaatct

SEQ ID NO: 2773 - DNA, 674 bp, Manihot esculenta
gatttactagccacaattgtaatggcatccaaaacggttgcgaaagacatcatcactctccgcggttcttcggcaattgtgagcgagttctttggattagtgatagatgatttgttgtttagtatactgtacaatcgaggggtttatccagaagagagctttgtgaaggtgaagaaatatgggctcccaatgttgcttactcaagatgaaggtgttaaatccttcatcgccaacttaactgctcagttatcagaatggctggaagctgggaagttacagagagttgttcttgtgataatgagcaaggctaccagtgaggtcctagagaggtggaattttagcattgagactgatagtgaggtggtagaaaagggggtttcaagggaaaagagtgataaagagataatgagagagatacaagcaatcatgcgtcagatagcttcaagtattacttacttgccatgcctggatgaagcttgtgtttttgatgtgttagcatacacagataaagatgttgcagtacctttcacttggattgagagtgatccaaaattgatatccaatccacaaatggtgaaattgcattcttttgatactaagatacacaaggttgacactctggtttcatacaagaacgatgaatgggacgaggagtagagaaagcttacctttca

SEQ ID NO: 2774 - DNA, 1079 bp, Arabidopsis thaliana
atttccgaggaagactagccgttacgctcttattcctttttttttctttttctttctttccttctttttaatccttccctcaaatatctttttttcccttcaaaatcattaaaaccctaagcgacgctgttaacacttgcgaattcaattttcaaaatcaccgatccttagactccatggcgtccaaaacagcggctgctaaagatatcatcactttacacggatctgctgccatcgtcagcgaattcttctgttacgctgcgaacagtatattgtataatcgtgcagtttatccagaggaaagttttgtgaaagtgaagaaatatggacttccgatgttgcttattgaagatgaatccgtcaaatctttcatgtctaatctcacttctcagatctccgaatggcttgaagctgggaagttgcagagagtagtgttagtgattatgagtaaagctactggtgaagtcttggagaggtggaattttcgtattgagactgataatgaagttgttgacaaaggtgtgtcgagggagaagagtgataaggagatcatgagggagattcaagctattatgagacaggttgcttcaagtgttacttacttgccttgtcttgatgaaacatgtgtgtttgatgtattggcgtatacggatactgatgtggctgttccattcacttggatcgagagcgacccgaagttgattgctaatccacagatggttaagttacacggttttgataccaagattcacaaagtcgacacgcttgtctcatacaagaacgacgagtgggatgaagaagagtaacagaagtcgggacacacgtatgcaaggctctttgttcagcttgcgtttatctctttgggagttctcattgttcttaaaggcacgtgaatcctttattcacacacctatatcgttttctcttctgttttttttctttttctgaattgtatgagaattggaatcctgtacttgtgttgtgttttgttcaaaagttatcagctttttcattgtccctgtctcttgtactgaaccgttttgtttaccaatcaaactttatggctcttggatcaaaaa

SEQ ID NO: 2775 - DNA, 748 bp, Beta vulgaris
tctctctcttcaattcaccttcaactacaaatcttcaacacccacaaaatcaaatttcgatttgagaattacccagttgataaatcttgaaaaaatttctagggttttcaatggcttcaaaaactgttgctaaagatatcatcacacttcgtgggtccgcagcaattgtcagtgaattctttgggtatgctgctaacagtattttgtataatagaggtgtatacccagaagaaagttttggcaaagtaaagaaatatggattgccaatgcttttaactcaagatgaaggtgttaaatcctttattactaatcttactgctcaactttcagaatggcttgaatctgggaaattacagagagtagttttggtgataatgagtaaatctacgaatgaagttcttgaaagatggaatttcagcattgaaactgataatgaagtggttgaaaaaggggtatcaagagaaaagagtgacaaggaaattatgagggaaattcaagcaattatgaggcaaattgcctctagcatcacttacttgccttgcattgatgaaccctgtgtttttgatgttttggcatatactgacaaggatttagctgtgccatttacttggattgagagtgatcccaaattgattaataatcctcaaatggtgaaactacattgttttgatactaagattcacaaggttgacactatagtgtcttacaagaatgatgaggaatgggataatgagtaaatctactaatg

SEQ ID NO: 2776 - DNA, 1043 bp, Artemisia annua
tagccgttactctcattttatctcatataaaccctaacccttattttccccaaattaaaacacacaccaactgttcgacaaaattccccatcaaataatggcttccaaaacctcgagcaaagacatcatcactctccgtggatccaccgccatcgttagcgaattcttcggttatgcagcaaacagtattttgtacaatcgtggtgtgtatccggatagtagtttcgaaagagtgaagaagtatgggcttccgttgttgctttctcaagatgagggtgttaagacgttcattgcgaatctgaatacgcagctttcggaatggctagaagctgggaagttgcaaaggattgttctcgtgattatgagtaaggcaaccaatgaagtacttgagaggtggaatttcagtatcgagactgataaggaagttgttgaaaaaggaatttcgagggagaagagtgataaagaaatcatgagggagattcaagctattatgagacagattgcttccagcatcacatatttgccatgccttgatgaaccctgtatctttgatgtgctagcgtatgctgataaggatgttgaggttccgttcacttggacagagagtgaccctaaactgatagaaaatcctcagatggtgaaactgcattctttcgataccaagatacacaaggttggcactttggtgtcttacaagaatgatgaatgggatgagcagtaaaagctgggaatgttgatgtgttttctttgttgaaccttgaagactgatgtgaatcgttttgattcacttttgtaaggcaggaggagtgaaatatgattctggaaacttgtacccttgggatatccatggcagaaacttcaaacgaaatctttgaagttgaagtatttgctcaataatacaattgttttaagaaaattgttatttcttctaagttgtctattatcatcttcacataaagagtatagtatgcaattttgatccaaaatgatatattctgcacaaatacacatctttttgctgtgttgtgttaaatagagacacg

SEQ ID NO: 2777 - DNA, 677 bp, Nicotiana tabacum
  misc_feature (644)..(645): n is a, c, g, or t
  misc_feature (655)..(655): n is a, c, g, or t
  misc_feature (657)..(657): n is a, c, g, or t
tacccctcatgcggccgctacagccaccaaggacataatcacgcttcgcggatcagcagcaattgtcgctgaattttttggctatgcagcaaatagcattttgtacaatagaggagtatatcctgaagaaagtttgcgaaggtgaagaaatatggtctgcagatgttgcttacccaagatgaaggtgtcaagaccttcatttcaatttgactgcccaactctctgagtggttggaagctggaaagctacaaaggatggttcttgtaatcatgagcaaggcctctggtgaggtactagagaggtggaatttcagtgtcgaaaccgacagcgaggttgttgagaaaggtgtttcaagggagaaaagtgacaaagaaataatgagggaaattcaagcaattatgaggcaaattatttcaagcgtcactttttttgccttgccttgaggaaccatgtgtgtttgatgtgttagcatacactgatacagatgttgcagttccattcacttggattgagagtgatcctaaactgattgcaaatccacatatggttaaactgcattcatttgacaccaagattcacaaggttgacactttggtttcatataaacatgatgaatgggatgaggcttaaaccgtcctcctttnnctttaatgantngatgctgtgaatcattgatt

SEQ ID NO: 2778 - DNA, 769 bp, Cucurbita pepo
tctcaaatcttctcaaatccacttgtttttcttttcatcgattcgatttcttcatgatcttgattatcccttgcatcgattaaaaccctagatccgctcctcgtcttagaatccaagattcgggaacaaatcttactgtttctttaggttaaacaaaatttgaaatggcttcaaaaacagcatccaaagacattatcactcttcgcggttctgcagcgattgtcagcgagttcttcggttatgcggcaaatagcatcctctacaatcgtggactttatccggaagaaagttttgcaagggtgaagaaatatggacttccaatgttgcttactcaagatgaaggtgttaagaccttcatttctaatctaactgctcagctttctgaatggctggaagctgggaagttgcaaagagttgtgctcgttataatgagcaaagccaataatgaggtccttgagaggtggaactttagaattgaaactgatggagaggttgtagatcaaggggtgtcgagggaaaagagtgataaggaaataatgagagagatccaggctattatgagacagattgcttcaagcatcacttacttgccctgcctagatgaaccctgtgtatttgatgtgttagcatacactgataaagatctagcagttccatttacttggatcgagagtgaccccaaactgattgctaatccacaaatggtgaagctccattctttcgatacaaagattcacaaagtggacactcttgtttcttacaagaacga

SEQ ID NO: 2779 - DNA, 942 bp, Cucumis melo
aaattttctcacatcctctcctttttctctttgtccgtttggtttcttgattcagctactccaatttttctttcaaattttggtttccccctgtttcgattacaagccctaaatccgctcaacccaagaacttttggggaagatttgaaatggcttcgaaaacagcaaccaaagacataatcactcttcgtggttctgcggcaattgtcagcgagttcttcgggtatgctgcgaatagcatcctttacaatcgtgggctttatccggaggaaagttttgttagggttaagaaatatggacttcctatgttgcttactcaggatgaaggtgttaagagcttcatttctaatctaactgctcagctttctgaatggctggaagctgggaagttacaaagggttgtgctggttataatgagcaaatccaacaatgaggtccttgagaggtggaattttagaattgaaactgatggggaggtggtggaacaaggtgtatcgagggaaaagagtgataaagaaataatgagggagatccaagcaattatgaggcagattgcttcaagcatcacctacttgccctgcctagatgaaccctgtgtattcaatgtgttagcatatactgataaatatcttgctgttccatttacttggatggagagtgaccctaaactgattgctaatccacaaatggtgaagctgcattcttttgacacaaagattcacaaagtggacactcttgtttcttacaagaatgatgatgacggtgacgacgagtaaacacaaaaacaaaactccattttctttcaatttgttgatgattttaatcctccaacctgacctcttgcttttcaaggtggcattgtgaatcatttatttcacatttttgtatttgtactctgacgctggaacgaacaatgttgttttgttgtgttcaattagaatt

SEQ ID NO: 2780 - DNA, 1721 bp, Panicum virgatum
gctggcgagctttgggatccacgcgtcgcctcctcggctgctctggcctcgcacgcaacactcgacgagtcgaatcccacgaccccggcccagcagagcaaaagctgcggccaccgagacctccgccacgcgcgggccccgcgcgtcagggacgcgcgagctggcgaatattcccatccgtcgcggccgcgggcaggggcagttccgtccgattcctcacgggagggaaagcccttagctgccatcaaggcggggggcattccggtcattccacccctctacgcgccgcggcatccttggcccctccccctttttggttttcgtgtgcgctcgcttttgcttttgttcttcctccgtcctcttctccctccctctgctctgcaaagcttccagaaacgagggggaggagccgggccgctccgaatgctctgatctccgctcggcgggttctcctccctcccctcctccatggcgcgcgtcctcccgctcagcatcgagccgggggagacggccagaggcaaagaggtggtgacagacacaccaaattcttcagctggggcatcatgcgcggcagttgatcattctgagcaaaacacaaaggatgatgagtatgcgaggctagttacacgagctcaacatgcaacatctgatctcagtgccacaattttacctgagcaaccaaagtcaagatctttcatttggtggatgaaagttctgcttggctgttttcttcttatattagtgggatacatctttgtgaaatggggagtcccctttgcctttgagaaggttctcttgccaatcatgcagtgggaagcaagtgcttttgggcgtccagtattggctgttgttcttgttgcatctttggccctctttccagttattctagtcccatctggaccttctatgtggttagcaggaatgatctttggttactgttggggtttcttaattataatggtcggaactactattggcatggtggtaccatattggattggctcattgttccgtgaacgtctacatgtatggttaacaaaatggcctcagcagatagcactaataaaacttgctggtgaagggaattggttccagcagtttcgagtggttgcgcttttcagaatctcaccattcccgtatacaatttttaactatgccgtcactgtcacagaaattaagttcaacccttatctatggggttcaattgctggaatggtaccagaggcattcatctacatctacagtggacggttaatccgtacattagctgacatgaagtatggcaactataaaatgaccccggtggagataacatacaacgtcatctccttcatcatcgccatcgtcctcacagtcgccttcacggtgtacgccaagagagctctgaatgaaataaagagttcagaaggtatctgtaaagaagttgtctccagccctgccggcccaggtgcaggaatgaaacaccatcaggagctggatgttgtatgatagtgtatttcaccgagagagtagatacaatatcgactgagaggaggcaggtaggtcgtaggtgtagggttttacaccaatagagctaggtaggctacagcagcaggttaaatgaataacacgcacgcagctccagccgacggcctgacgtttacttcgaatcatttcgtgtgctttattgtctgcacggccatcttgaattgagccgaaggtgcagtggtgctgagtgatga

SEQ ID NO: 2781 - DNA, 1688 bp, Panicum virgatum
gttggaggtcgccttagctgccatcaaggcggggggcattccggtcattccacccctctacgcgccgcggcatccttggcccctccccctttttggttttcgtgtgcgctcgcttttgcttttgttcttcttccgtcctcttctccctccctctgctctgcaaagcttccagaaacgagggggaggagccgggccgctccgaatgctctgatctccgctcggcgggttctcctccctcccctcctccatggcgcgcgtcctcccgctcagcatcgagccgggggagacggccagaggcaaagaggtggtgacagacacaccaaattcttcagctggggcatcatgcgcggcagttgatcattctgagcaaaacacaaaggatgatgagtatgcgaggctagttacacgagctcaacatgcaacatctgatctcagtgccacaattttacctgagcaaccaaagtcaagatctttcatttggtggatgaaagttctgcttggctgttttcttcttatattagtgggatacatctttgtgaaatggggagtcccctttgcctttgagaaggttctcttgccaatcatgcagtgggaagcaagtgcttttgggcgtccagtattggctgttgttcttgttgcatctttggccctctttccagttattctagtcccatctggaccttctatgtggttagcaggaatgatctttggttactgttggggtttcttaattataatggtcggaactactattggcatggtggtaccatattggattggctcattgttccgtgaacgtctacatgtatggttaacaaaatggcctcagcagatagcactaataaaacttgctggtgaagggaattggttccagcagtttcgagtggttgcgcttttcagaatctcaccattcccgtatacaatttttaactatgccgtcactgtcacagaaattaagttcaacccttatctatggggttcaattgctggaatggtaccagaggcattcatctacatctacagtggacggttaatccgtacattagctgacatgaagtatggcaactataaaatgaccccggtggagataacatacaacgtcatctccttcatcatcgccatcgtcctcacagtcgccttcacggtgtacgccaagagagctctgaatgaaataaagagttcagaaggtatctgtaaagaagttgtctccagccctgccggcccaggtgcaggaatgaaacaccatcaggagctggatgttgtatgatagtgtatttcaccgagagagtagatacaatatcgactgagaggaggcaggtaggtcgtaggtgtagggttttacaccaatagagctaggtaggctacagcagcaggttaaatgaataacacgcacgcagctccagccgacggcctgacgtttactcgaatcatttcgtgtgctttattgtctgcacggccatacttgaattgagccgaaggtgcagtggtgctgagtgatgacccagcgatggtgtggcaggatgctgttgcctgttggcagtgtgttggtggcatgtagagtgtagtgtgtagatgcctcctgaagcacggccttgcagcgagcctaccactgcggttctgtggacattggaaacattgtgcacttgtaactccttgaacgaacagcactcgatgagtgtgtttctatt

SEQ ID NO: 2782 - DNA, 1473 bp, Sorghum bicolor
caagcaacaaacttgctcgatatcaccaaagagtagcttcgacgtagaagaaaactttgagcccttcaataaatcccatggccgcgctcggttcttctattacctccagaggcttggcacttcatacatctgtggtttttcatcgtcaccacgggaatccagtgatctccacatcttctcatcgccagcgaaatcttactggtttatcgatgaattcttcaggcatgaacaatgccttccctatcagaggaactacacgaattcctgcagttggtcctggccctgccaatccggcaggaggaaacctcccaatagccagcatgcctccatgggccaagtggttggttggtgctgtcatagttgcgatacctatctacaggaggttcagaacattagaagataagatagagaagacggcagaggtggcgatcgaggtgatcgacacggtggcggaggcgacggagaaggtcgccggcgaggtcgccgacgcattccccggcaacgaaaatctcaaggaagcagcctcgaggattaagacggtcacggatgcgatcgaggaagacgccgagaaagccgaggccctaatcgagaaggttgacgagataaagaaacaagttgattcaattgttgatcctataatcgacaaggttgtgaaggataaagaagcatagacaaggaaccaaagaggagacaatatataacaggcggtgaattgtaggtgtgaacattggttgggtagtggttgccagaagaaactacggaagcagacatggcgaatctcatatcatgatctcctgtttctctcatttgatgttttctaggtctcgtttagttcaccccgaaatccaaaaagttttcaaaattccccatcacatcgaatcttgcggcatatgcatgaagcgttaaacatagacgaaaacaaaaactaatcacacagtttgattataaatcgtaagacgaatcttttgatcctagttagtctatgattgaacaatatttaccacaaacaaacgaaaatactacattagcgaaatccagatttttttcacatctaaacaaggtcctagtcacatgcctgtacaatctatcattggtttccgtacgaactagtacgagagaaagggtaaaagtagacgctattgtttttattgttttatgcctcagtacttcaaatacaagttttttttatctacacttaaacataaactcagaccacacaccatacacagcatgcgcaaggtaaatctacatctatacctaaagacatacacatagcacggacatgacatcttgatcattatagaccatctaagcttgaggctgtaacttaaacctgcaaagaaaatgtcgttgtcgtaaacgacttctaaatcttatagggaggacggtatataactactctctttaaggggaatttccagcatctcagcaccttcgacaactgttcactttttgttttcccccttccatttt

SEQ ID NO: 2783 - DNA, 2930 bp, Sorghum bicolor
ggcgccctaaaaccctcgtcctcgtcctcgcgaagccgcgagctcctcatccactacccgccccttccccccctctaaaccccagcccctcctgccccccggctgctctcagccacaagtaggcggccggcaagccaagaccaagaccaaggagcccgcgagcgcgagggctggccgacgcggatggcgctactcctccgcccgacttctcctccctctccccacctccgcgcgctcctccgccgcctcctctccactggcgccggacccttcccctcacgcatgctcccctcgccccgctccaccgccgccgtccctcggctcctcttcgggccaagggttgtggcggcggcggcggcggccccgcggcggaatggggtcccggtgcgtgcgttcatggcctcaacgacggcgtctgaagcgatgcatgagaagcgggtggccgccgagtacactgctgccaatgtccaggtcctagaagcattagatggagttcgcacaaggcctggtatgtacattgggagcacaggaccacgtggattgcatcatctggtttatgaaatcttggataatgctgtggatgaaggtcaagcgggtcacgcttcaaagattgatgtagttcttcatgatgacaattctgttagtgtaacagacaatggacgtgggattcctacggatatgcacccccagacgaagaaatcttgtgtggagactgtcttaacgttaatgcatgctggtggcaaatttggaggttcaaagagtggttacagtgtctctggagggcttcatggtgttggtttatcagttgttaatgctttatcagaggcacttgaagttactgtttggcgtgatgggaacaaatacagacaaagctattcaaggggaaagccaacaacgccgctaagtagtatcacacttactggtgaaacaagtcctcgtcaaggaacaagcattagattttggcctgataaagatatatttaccaccaccattgattttgacttcaatacaatctccagtcgcattcgggagcttgcctttctaaatcctgagcttacaataaccttgacaaaggaagaagggcacacagttcaacataatgaatactgttatgctggtggccttgttgaatatgttaaatggttgaatactgacaagaaacccctgcatgacccgattgcgttcagaaaggagttggatggtataacagtggatgtctcccttcaatggtcctctgattcgtactctgatacagtgctaggatatgcaaacagtatccggactattgatggtggtactcatattgatggcctgaaggcttcattgacaagaaccattaataactttgcgaagaagtcaaagactattaaggataaggatattaccttgagtggggagcatgtaagagaagggatgacatgcgtcatttcagtgaaggtccctagtccagagtttgaggggcaaacaaagacaaggttgggaaatccagaagtacggagaatagtcgaacaggctgttcaagaaaacttaacagagtacttagagcttcatccagatgttctggattcaatcctatcaaagtcccttaatgctctcaaggcttcgttggcagccaagcgggctagggaactagttaggtcaaagagtgtgttgaaatcttcttcaatccctgggaaattagctgattgtgcatcaactaatcctgaagaatctgaaatcttcattgtcgaaggtgattctgcgggtggtagtgcaaagcaaggacgagatagaagatttcaggctattttgcccctaagaggtaaaattctcaacattgaaagaagggatgaagcagccatgtacaaaaatgaagagatccaaaaccttattcttgcgcttggattaggagtgaagggtgaggattttaagaaggaggctctccggtatcataagatagttatacttactgatgctgatgttgatggcgcacatatccggactctcctccttactttcttcttcagatatcaaagagcattatttgatgaaggttgcatctacgttggtgtacctcctctttataaggttgagcgtggaaaacaagcacattactgctatgatgatgctgatcttaaagagatagttaacaccttccctccaaatgcgtcatatcatatccagaggtttaaaggtttgggtgagatgatgcctgtacaactgtgggaaacaacaatggatcctgagaggcggctgttgaagcagcttaaggttgaagatgctgctgaggccaatgttgtgttctcgtcacttatgggtagccgggttgaatataggaagcaactgatccaggaagctgctagcacgatcagcatggatcaacttgacatttgaaggcatcaagttaggccgacctttctgtgtatgatatagaagctccacctgctgctgttcttaccactacaacaggaatcaagcgttgcagacttgataccttgccaacatttttttggtgctagagtagcagaaaacgtcggggggtagggtagaaacattaaaaccaggatgacaagagtcaggtttcctggcactcctaacggagattctgattcatttgtggcggtgttgtaaccattttggcttgacagagttgagtgctcacgggagttccctgctataggttcggtgctgccattttttggcttgacgcttgacggagttgagtgctcacgggtgtagttcccagctgtcggttctatactgccatcttgcctctgatacggtgtaatcagtaatatgcttttgttaatctcctaatacttgctttatgattccgtgtctccttttttaacctggtagtaagtatctgtatggactatggactagtctggtttgaatccttgaattcgtcatgtgtacggttttaagcccagttgatatgtgagcaaatt

SEQ ID NO: 2784 - DNA, 2788 bp, Setaria italica
cctccctcatccactactcgcacctctaaaccctccctcccgcttcccccagccacaaccacagacctccgcgcgcgcctgggctcgccgccgcggatggcgcccctcctccggccgccacctccccctccccacctccgcgcgctcctccgccgcctcctctccaccggcgccggccccgtcccctcccgcatgctcccctcgctgcgctccaccgccgccgcccctcggttcctattcgggcccagggttgtggtggcgggagcggccccgcggcggaatggggtcccggtgcgggcgttcatggcttccaccgcggcgtccgaggcgatgcaggagaagcgggtggccggggagtacaccgccgccaacgtccaggtcttagaagccctagatggagttcgcacaagacctggtatgtacattgggagcacaggaccacgtggattgcatcatctggtttatgaaatattggataatgctgtggatgaagctcaagcgggtcatgcctcgaagattaatgtagtccttcatgatgacaattcagttagtgtaacagacaatggccgtgggattcctacagacatacacccccagacgaagaaatcttgtgtggagactgtcttaacgttaatgcacgctggtggcaaatttggaggttcaaagagtggttacagtgtctctggagggctgcatggtgttggcctgtcagtggttaatgctttatcagaggcacttgaagttactgtttggcgtgatgggaaggaatacagacaaagctattctcgggggaaaccattgacgacactaaatagtatcacactgtctggtgaaacaagttctcgccaaggaacacgcatcagattttggcctgataaagatatatttaccaccaccatcagttttgacttcaatacaatctctagtcgcatccgagagcttgcctttctaaatcccgagctgacaataaccttgactaaagaagaaggacacacagaggttcaacataatgaatactgttatgctggtggccttgttgaatatgttaaatggttgaatactgataagaaacccctgcatgacccgattgcgtacagaaaggagttggatggtataacagtggatgtctcccttcaatggtgctctgattcctactctgatacagtgctaggatacgcaaacagtatccgtactattgacggtggtactcatattgaaggtctgaaggcttcattgactagaacaattaataaccttgcaaagaagtcgaagactattaaggataaagatattaccttgagtggggagcatgtaagagaaggaatgacatgtgtcatttcagtgaaggtccctagtccagaatttgaaggtcaaacaaagacaaggttgggaaatccagaagtacggagaatagttgaacaatctgttcaagaaaacttgacggagtacttagagcttcatccagatgttctggattcaatcctatcaaagtcccttaatgctctcaaggctgccttggcagctaagcgagctagagaattagtgaggacaaagagcgtgttgaaatcttcttcactccctggaaaactagctgattgtgcatcaactaatcctgaagaatctgaaatcttcatcgttgaaggtgattctgcaggcggcagtgcaaagcagggacgggataggagatttcaggctattttgcctctaaggggtaaaattctcaacattgaaagaaaggatgaagcagccttgtacaaaaatgaagagatccaaaatcttatccttgctcttggactaggagtgaagggtgaggattttaagaaggaagctcttcggtatcataagatagttattctaactgatgctgatgttgatggtgcacatatccggactctcctccttactttcttcttcagatatcagagagcactatttgatgaaggttgcatctacgttggtgtacctcctctttataaggttgagcgtgggaaacaagcacattattgctatgatgatgctgatcttaaaaagatagttaacaccttccctgcaaatgcatcatatcatatccagaggtttaaaggtttgggtgagatgatgcctgcgcagttatgggaaactacaatggatcctgagaggcggctgttaaagcagcttaaggttgaggatgctgctgaggccaatgttgtcttctcatcactaatgggtacccgggtcgaatataggaagcaactgatccagaatgctgcaagcatgatcaacatagatcaacttgacatttgagtgcattgagtaaggctgaccccttcttgtatgatagaaggtccacccgaccaagcatagaagacttggttcttcaccagcaatttatttggtgctagtgtagcagtaaaagtaggctagaactggaacccggatggcagcggcttgcctgatttcctggttcttccgacacatttgtggtagtcctgtgatgtgtaatccattttggcctggcggagattacttggggagtttggggacgttccagtcatggattaaggtagctgacacattgccacggatacggtgtagcagactttcacctagtgaaatttgcggtggattattcattatgctgcgtctcggtctcgcctattctttggttgcactgatgacatatcaattggttacccaagacatttcaaacgattagttagtatgtacggagttctggacaggaggttttgtctcacagtttggaattttggcaattttgaagggactatgggaattgtaacattcttcc

SEQ ID NO: 2785 - DNA, 2643 bp, Panicum virgatum
cgcacctataaactcctcctcctcccgctttcctctcagccacaagcaggcggcagggagacggagaacccagcccagcgtcgccgcgtatggcgatcctcctccggtcgccaccttcccctccccacatccgcgcgctcctcctccgcctcctctccactggggccgccgccggccccctcccctcccgcatgctcccctcgctgagctccgccgccgccgcccctcggttcctgtttgggccaagggttgcggcggctctgcggcggaatggggtcccggtgcgggcgttcatggcttccacggcggcgtccgaggcgatgcaggagaaacgcgtggcaggggagtacaccgccgccaacgtccaggtcttagaagcattagatggagttcgcacaagacctggtatgtacattgggaacacaggaccacgtggattgcatcatctggtttatgaaatcttggataatgctgtggatgaagctcaagcggggcatgcctcgaagattaatgtggtccttcatgatgacaattcagttagtgtaacagacaatggccgtgggattcctacagacatacacccccagacgaagaaatcttgtgtggagactgtcttaacgttaatgcacgctggtggcaaatttggaggttcaaagagtggttacagtgtctctggagggctgcatggtgttggcctgtcggtggttaatgctttgtcagaggcacttgaggttactgtttggcgtgaagggaaggaatacaaacaacactattctcgggggaaaccaataacaacactaactagtatcacactgtctggtgaaacaagttctcgccaaggaacacgcataagattttggcctgataaaaatatatttaccaccacgatcagttttgactttaatacaatctctagtcgcatccgagagcttgcctttctaaatcctgagctgacaataaccttgactaaggaagaagggcacatggaggttcaacataatgaatactgctatgctggtggccttgttgagtatgttaaatggttgaatactgataagaaaaccctgcatgacccgattgcgttcagaaaggagttggacggtataacagtggatgtctcccttcaatggtgttctgattcctactctgatacagtgctaggatatgcaaacagtatccgtactattgacggcggtactcatattgatggtctgaaggcttcattgactagaacaattaataaccttgcaaagaagtcgaagagtattaaggataaggatattaccttgagtggggagcatgtaagagaaggaatgacgtgcatcatttcagtgaaggtccctagtccagaatttgaaggtcaaacgaagacaaggttgggaaatccagaagtacggagaatagttgaacaatctgttcaagaaaacttaacagagtacttagagctccatccagatgttctcgattcaatcctatcaaagtcccttaatgctctcaaggctgcattggcagccaagcgagccagagaattagtgaggacaaagagtgtcttgaaatcttcttcactccctggaaaactagctgattgtgcatcaactaatcctgaagaatctgaaatcttcatcgttgaaggtgattctgcaggcggtagtgcaaagcaagggcgggataggagatttcaggctattctgcctctaaggggtaaaattctcaacattgaaagaagggatgaagcagccatgtacaagaatgaagagatccaaaatcttatccttgctcttggattaggagtgaagggtgaggattttaagaaggaagctcttcggtatcataagatagttatacttactgatgccgatgttgatggtgcccatatccggactctcctccttactttcttcttcagatatcagagagcactatttgatgaaggttgcatctatgttggtgtacctcctctttataaggttgagcgtgggaagcaagcacattattgctatgatgatgctgatcttaaggagattgttaacaccttccctgcaaatgcatcatatcatatccagaggtttaaaggtttgggtgagatgatgcctactcaattatgggaaactacaatggatccagagaggcggctcttaaagcagcttaaggttgacgatgctgctgaggccaatgttgtcttctcatcacttatgggtacccgggttgattataggaagcaactaatccagaatgctgcaagctcgatcaacctagatcaacttgacatttgattgcactgagtaaggctgaccccattgtgtatgatatagaagatccacccaaccaagcagagaagacttgattcttcaccaccaaatgttttggtgctagggtagcagtaaaaataggctagaactggatctaggatgacagtgtcttgctcagtttcctggttctcccgacacatttgtggccatcctgtgacgtgcaatccgttttggcctggcggagatcacctggggagttcgggtagtttcctgccatgtttcccacggatacagtgttgacttttatcttctgaaatttgcagttgattattttttatgctgttttgtccattcttgcacttatgctaatgaaatttgcgcttgattatttgtg

SEQ ID NO: 2786 - DNA, 2866 bp, Oryza sativa
ctctttgcctgcctccgcgacgcggctccgcctaaaccccagcgtcccctcccctccccctcccgtttcaccctcaccacaacagcggcagcaaaagcgagcggcagcgagaggccggccacgcacgcacgcacgtcgaagcgcgccgcccgccgccgatggggcccctcctccggtcgtcgccgccaccgcgccacctgcgcctcctcctccgccgcctcctctccaccgccgccggtcggccctcccgcctcctcccgctccccgcctcctcctccgcccgcctcctcgtcaggcccagggttgcggttgcggctgctgcggcgggtgctcctctgcggcggaatggggtcgcggtgagggctttcatggcatccacggcggcttccgaggcgatgcaggagaagcgggtggccggggagtacaccgctgcgaacgtccaggtcttagaagcattggatggagttcgcacaaggcctggtatgtacattggaagcacaggatcacgagggttgcatcatctggtttatgaaatattggataatgccgtggatgaagctcaagcaggctacgccactaaggttgatgttatccttcatggcgacaattcagttagtgtaacagacaatggtcgtgggatccctacagatatacaccctcagacgaagaaatcttgcgtggaaaccgtcttaacgttaatgcacgctggtggcaaatttggaggttcaaagagtggctacactgtttctggagggctgcatggtgttggcctatcagttgttaatgctttgtcagaggcactagaagttactgtttggcgtgatggaaaagaataccgacaaaattactcacgtggaaaagctatcacgatgctaactagtaggacattgtctgatgaatcaagttctcgtcaaggcacacggatcagattttggcctgataaacatatttttaccaccacaatggactttgacttcaatacgatagctggtcgcatccgggaacttgcctttctaaatcctgagctgacaatagcattgacaaaggaagaagatgacttacaggttcaacacaatgaatactgttatgctggtggtctggttgagtatgttaaatggttgaatactgacaagaaatcccttcatgatccaatcgcattcagaaaagaaatggatggaataacagtggatgtttcccttcaatggtgctctgattcatactctgatacggtgctaggatatgctaacagtatccgtactattgatggtggtactcatattgatgggctgaagacttcattgacaagaacaatcaataacttcgcaaagaagtcgaagactcttaaggataaagatattagcttgagtggggagcatgtaagagagggaatgacctgcattattgcagtgaaggtccctaatccagagtttgaagggcaaacaaagacgaggttgggaaatccagaagtccgaagaatagttgaacaatctgttcaagaaaatttaactgagtacttagagttacatccagatgttttagattcgattctgtcaaagtcccttaatgctctcaaggctgcattggcagctaagagagctagagagttagtgaggacaaaaagtgtattgaaatcttcttcacttcctgggaaattagctgactgtgcatctagtgatcctgaagaatctgaaatcttcatagttgaaggtgattcagctgggggtagtgcaaaacaaggacgtgataggaaatttcaggctattttgcctctaagaggcaaaattcttaacattgaaaggagagacgaggcagccttgtacaaaaacgaagagatccaaaatctaattgtcgctcttggattaggagtaaagggcgaggattttaacaaggaagctcttcgatatcataagatagtcatactcactgatgctgatgtagatggtgcacatatccggactcttctccttactttcttctttagatatcagaaagcactattcgatgaaggttgcatttatgttggtgtgcctcctctttacaaggttgaacgtgggaaacaagcgcactactgctatgatgatgctgaccttaaggagctagttaacaccttcccaacaaatgcttcttatcatatccaaaggtttaaaggtcttggtgagatgatgccggcacaattatgggagacaacaatggaccctgagaggaggatgttgaagcagctaaaggttgaagatgctgctgaggccaacgttgtgttctcatctcttatgggtacccgggttgatgtcaggaagcaactgatccagaatgctgcaagcatggtcaacctagaacaccttgatatttgagcacattcggcaatgctgacagtcgtgtatgttacaggagattatccactgtttcaatcccctcccacaggaaccaagcgtagcaaacttgaattccttgccaacattgttttggtgctaatttagcagtaaatgtaggctagggaagaaaccagaaatgatttcatggggtttaattccttgccaggggagctgtcaactcccctactacattacacaattactgcctaattaactggtatatctgggagacagttcggttgtggtcacgttgtaagttggaactcgttatgacattgggggtaatcttcccttgctaggggaagacgtaatcccctgacaggcggacacttacaaagagtaatcccctgctagtagtaagtattactagtaagtattcaggagtagttgttaatgtttctttcgcctgtaattttgtttagattttgtagcaagtttttggacagttatttccatctcgtccagctcttgttcgcgtcaaacgctcggtccttcct

SEQ ID NO: 2787 - DNA, 2612 bp, Brachypodium distachyon
ctcctaaaaccctcgagccctgcgtcgcctcatcccatttcctccaccacaagcaagcgcagcagcagcccaagccaagcaggagcaaagaggccgacacggcgcgagctcgccgccaccaatggcgctcctcctccggccgtcgcctccccttccccacctccgtttcctcctccgccgcctcctctcgaccgccgcccccacctcccgattgctcccggtcccctccacctccgcccgacccctcttcagacccagggttgtggcggcggcggcggccccgaggcggaatggggtctccgtgagggcttttatggcctcgacggcggcgtccgaggcgatgcaggagaagccggcgtcgggggagtatactgccgcaaacgtccaggtcttagaagcattagatggagttcgcaaaagacctggtatgtacatcggaagcacaggaccacggggattgcatcatctggtttatgaaatattggataatgctgtggatgaagctcaagcaggctatgctaccaagatcaatgtagtccttcatgatgacaattcagttagtgtaacagataatggccgtgggatcccgacagatatacacccccagacgaagaaatcatgcgtggagactgtcttaacgttaatgcatgcgggtggcaaatttgggggctcaacaagtagctacagtgttgctggagggctgcatggtgttggcttatcagttgttaatgctttatcagaggcactggatgttactgtttatcgtgatggaaaggaataccgacaaagctattcgcgtggaaaaccactgacaacgttaagtagtaccacagtgtatggtgaatcaagtactcgccaaggcacatgcatcagattttggcctgacaaagatatatttaccaccacaattggctttgacttcaatacaatctctagtcggatccgggaacttgcatttctcaatcctgagctgacaataacgttgaccaaggaagaagatgatgcagaggttctacacaatgaatactgttatgctggtggcctggttgaatatgttgcatggttgaatactgacaagaaaccccttcatgatccaatagcgttcagaaaggaattggatggaataattgttgatgtctcactccaatggtgctctgattcctactctgatacagtattaggatatgccaacagtatccgtacaattgatggtggtactcatatcgaggggctgaagacttccttgacaagaacagttaatagctttgcaaagaattcgaaggctattaaggataaagatattagcttgagtggggagcatgtaagagaaggaatgacatgcattattgcagtgaaggtccctaatccagagtttgaagggcagacaaagacgaggttgggaaatccagaagttcgaaaaatagttgaacaatctgttcaagaaaatttaaccgaatacttagagttacatccagatgttttagattcaatcctatcaaagtcccttaatgcgctcaaggctgcattggcagccaagcgggctagagagttagtgaggacaaaaagcgtcttaaaatcttcttcacttcctgggaagctagctgactgcgcatcttctaatcctgcagagtcagaaattttcatagttgaaggtgattcagctggaggtagtgctaagcaaggccgggataggaaattccaggccattttgcctctgagaggcaaaattctcaacatcgaaaggagggatgaagcagccatgtacaaaaacgaagagatccaaaatcttattcttggtcttggattaggagtgaagggtgaggattttaagaaggaagctcttcggtatcacaagataattatattgacagatgctgatgtagatggtgcacatatccggactctactactcactttcttctttagatatcagagagcgctatttgatgaaggttgcatctatgttggtgtaccccctctttacaagattgagcgtgggaagcaagcacactactgctatgatgaggcggatctaaaagagctagttaacactttcccaacaaatgcttcttataatacccaaaggttcaaaggtttgggtgagatgatgcctgtacaattatgggaaacgacaatggaccctgcgaggaggctgttgaagcagctgacggtagaagatgctgctgaggcaaatgttgtgttctcatctcttatgggttctcgggttgattataggaaggaactgatccagaaggccgcaggcatggtcaacctagaacatcttgacatttgagagcgtcaaacaaggctgaccattgtctatgatatagaagatcaccactgctattgtgacccatcctgcgtgtacaagcttagcgaactacaattccatgcgtaacatttttggtgctaatgtagcagcaaatctgggctagaagggagaaacattcttgttagagccaatcccctggtacctctaacaagaatggtgcgctcacatgtggccacgttgtacaaactcactttgactcaacgggaaaggtgacgccacttcattgatttagcggccaacttcaagctaatttgctgatctatcgtagtctgtcaatgct

SEQ ID NO: 2788 - DNA, 2853 bp, Secale cereale
tcaggaaaccaccccgttcccttcctaaaaccctcctcgagctccgcgtcgcctcatccactgccgtctaaaccccaacccctcctcccattccccccaccacaagcgcaacccaagcctaggcggacgcgacgcgagctcgccgccgccgccaatggcgctcctcctccggccgtcgcctcccccaccacatctccgtcttcttctccgccgcctcctctccacctcccctgccccctcccgtctcctcccggtcccctccccctccgcccgactcctcttcagacccagggttgtggcggcggcggtcccagggcggaatggggtcgcggtgagggctttcatggcctccacggcggcatccgatgcgatgcaggagaagcgggtggccggcgagtacaccgcagcaaacgtccaggttttagaggcattggacggagttcgcaaaaggcctggtatgtacattggcagcacaggaccacgtggtttgcatcatctggtttatgaaatattggataatgctgtggatgaagctcaagcaggctatgctactgagattaatgtagtccttcatgatgacaattcagttagtgtaaccgacaacggccgtgggatccctacagatatacacccgcagacgaagaaatcatgcgtggagactgtcttaacgctaatgcatgctggtggcaaatttggaggttcaacgagtagctacagcgttgctggagggctgcatggtgttggcctatcagttgttaatgcgttgtcagaggcactagaagttactgtttgccgtgatgggaaggaatatcgacaacactattctcgtggaaaaccacttacaacgctaagtagtaccacactgcctgatgaatcaagtcgtcaaggttcatgtatcagattttggcctgacaaagaaatatttacaaccacaattgagtttgacttcagcacgatctctagtcgcatccgggaatttgcatttttaaatcctgagctgacaataacactgacaaaggaagaacaggatgcaccggttcaacacaatgaatactgttatgctggtggcctggttgaatatgttgcctggttgaatactgacaagaaacccctccacgacccaatagcattcagaaaggaattggatggaataattgttgatgtctccctgcaatggtgctctgattcctactctgatacattactaggatatgccaacagtatccgtactattgatggtggtactcatattgaggggctgaaaacttccctgacaagaacaattaatagctttgcaaagaagtcgaagattatgaaggataaagatattagcttgagtggggagcatgtaagagaaggaatgacatgcgttatttcagtgaaggtccctaatccagagtttgaagggcagacaaagaccaggctgggaaatccagaagtgcgaagaatagttgaacaatctgttcaagaaaatctaactgaatacttggagttacatccagatgttttagattcaattctgtccaagtcccttaatgctctcaaggctgcattggctgccaaacgggctagagagttagtgaggacaaagagtgtcttgaaatcttcttcacttcctgggaaacttgctgactgtgcatcttctaaccctgcagaatctgaaatcttcatagttgaaggtgattcggctgggggtagtgcaaagcaaggccgggataggaaatttcaggctattttgcctctgaggggcaaaattctcaacatcgagaggagggatgaagcagccatgtacaaaaatgaagagatccaaaatcttattcttggtcttggattaggagtgaagggtgaggattttaagaaggaagctcttcggtatcataagatagttatactgacagatgctgatgtagatggtgcacatatccggactcttctcctcactttcttctttagatatcagagagcactttttgatgaaggttgcatctatgttggtgtgcctcctctttacaaggttgagcgtgggaaacaagtgcattactgctatgatgaggctgatcttaaagagctagtcaacaccttccctacaaatgcttcttataatacccagaggttcaaaggtttgggcgagatgatgcccttacaattgtgggaaacgacaatggatcctgaaaggaggttgttgaagcagctaacagtcgaagatgctgcagaggccaatattgtgttctcatctcttatgggtgctcgggttgaatacaggaaggaactaatccagaaggctgcaagcatggtcaacctagatcaccttgacatctgagagcgttaaacaaggttgatcattgtgtatgatatagaaaagaccacaacttgccacccattcaacatagaagttgttttggtgctagtttagtactccctccgtcccaaaatgtcatagtgtcaaaaaacgtcttacattttgggacagagggagtagcaatctaggctagaacggagaaaagggtgcgttcatttgttgacacgctgtacccaactcatcttgacgcgggggttaaaccgcaatatcatgggaagtggtcaacttgctcaggcagctggcaactagtcaaatcaatggcctgtgctacagtagttgaattcctgttacttttgagccgtgctccagtttattgatctgtcatgcatgttttcttcacatgggaggatgcaagcttttaagtgtgtacctgctctcaccaaccgcattcagaaccggtgcttactagtcgacggtattgccccatttgaccacttcatgagaaaataaggtttaatggatttcacattaaaaaaaaacggttagggatcaaa

SEQ ID NO: 2789 - DNA, 2498 bp, Triticum aestivum
cccctcctcccatttcccccaccacaagcagcaacccaggccaaggcaaagcagaagctaggcggacgcgacgcgagctcgccgccgccgccaatggccctcctcctccggccgtcgcctcccccaccccatctccgccttcttctccgccgcctcctctccagcgcccctaccccctcccgtctgctcccggtcccctccccctccgctcgacacctcttcagacccagggttgtggcggcggcggtcccagggcgcaatggggtcgcggtgagggctttcatggcctccacggcggcatccgatgcgatgcaggagaagcgggtagccggcgagtacaccgcagcaaacgtccaggtcttagaggcattggacggagttcgcaaaaggcctggtatgtacattggcagcacaggaccacgtgggttgcatcatctggtttatgaaatattggataatgctgtggatgaagctcaagcaggctatgctactgagattaatgtagtctttcatgatgacaattcagttagtgtaaccgacaacggccgtgggatccctacagatatacacccgcagacgaagaaatcatgcgtggagactgtcttaacgctaatgcatgctggcggcaaatttggaggctcaacaagtagctacagcgttgctggagggctgcatggtgttggcctatcagttgttaatgcgttgtcagaggcactagaagttacagtttgccgtgatgggaaggaatatcgacaacactattctcgtggaaaaccacttacaacgctaagtagtaccacactgcctgatgaatcaagtcgtcaaggttcatgtatcagattttggcctgacaaagaaatatttacaaccacaattgagtttgacttcagcacgatctctagtcggatccgggaacttgcatttttaaatcctgagctgacaataacactgacaaaggaagaacaggatgcacaggttcaacacaatgaatactgttatgctggtggcctggttgaatatgttgcctggttgaataatgacaagaagcccctccacgacccaatagcattcagaaaggaattggatggaataattgttgatgtctccctgcaatggtgctctgattcctactctgatacagtgctaggatatgccaacagtatccgtactattgatggtggtactcatattgaggggctgaaaacttccctgacaagaacaattaatagctttgcaaagaagtcgaagattatgaaggataaagatattagcttgagtggggagcatgtaagagaaggaatgacatgcattatttcagtgaaggtccctaatccagagtttgaagggcagacaaagaccaggctgggaaatccagaagtgcgaagaatagttgaacaatctgttcaagaaaatctaactgaatacttggagttacatccagatgttttagattcaattctgtccaagtcccttaatgctctcaaggctgcattggcagccaagcgggctagagagttagtgaggacaaagagtgtcttgaaatcttcttcacttcctgggaaacttgctgactgtgcatcttctaaccctgcagaatctgaaatcttcatagttgaaggtgattcggctgggggtagtgcaaagcaaggccgggataggaaatttcaggccattttgcctctgaggggcaaaattctcaacattgagaggagggatgaagcagccatgtacaaaaatgaagagatccaaaatcttattcttggtcttggattaggagtgaagggtgaggattttaagaaggaagctcttcggtatcataagatagttatactgacagatgctgatgtagatggtgcacatatccggactcttctcctcactttcttctttagatatcagagagcacttttcgatgaaggttgcatctatgttggtgtgcctcctctttacaaggttgagcgtgggaaacaagtgcactactgctatgatgaggctgatcttaaagagctagtcaacaccttccctacaaatgcttcttataatacccagaggttcaaaggtttgggcgagatgatgcccttacaattgtgggaaacaacaatggatcctgaaaggaggctgttgaagcagctaacggtcgaagatgctgcagaggccaatgttgtgttctcatctcttatgggtgctcgggttgaatacaggaaggaactaatccagaaggccgcaagcatggtcaacctagatcaccttgacatctgagaaccttaaacaaggttgaccattgtgtatgatatagaaaagaccacaacttgccacccattcgacatagaagttgttttggtgctagtttagtagcaatctaggctagaacggagaaaagggttgatcccctggtgcttgtaacatgaatggtgcgttcatttgttgacacgctgtacccaactcatcttgacgcgggggtaaaaccgcaatatcattggaagtggtcaacttgctca

SEQ ID NO: 2790 - DNA, 2455 bp, Triticum aestivum
ggggtcgcagtgagggctttcatggcctccacggcggcatccgatgcgatgcaggagaagcgggtggccggcgagtacaccgcagcaaacgtccaggtcttagaggcattggacggagttcgcaaaaggcctggtatgtacattggcagcacaggaccacgtgggttgcatcatctggttgttgaaatattggataatgctgtggatgaagctcaagcaggctatgctactgagattaatgtagtccttcatgatgacaattcagttagtgtaactgacaatggccgtgggatccctacagatatacacccgcagacgaagaaatcatgcgtggagactgtcttaacgctaatgcatgctggtggcaaatttggaggctcaacgagtagctacagcgttgctggagggctgcatggtgttggcctatcagttgttaatgcgttgtcagaggcactagaagttacagtttgccgtgatgggaaggaatatcgacaacactattctcgtggaaaaccacttacaacgctaagtagtaccacactgcctgatgaatcaagtcgtcaaggttcatgtatcagattttggcctgacaaagaaatatttacaactgcaattgagtttgacttcagcacgatctctagtcgcatccgggaacttgcatttttaaatcctgagctgacaataacactgacaaaggaagaacaggatgcacaggttcaacacaatgaatactgttatgctggtggcctggttgaatatgttgcctggttgaatactgacaagaaacccctccacgacccaatagcattcagaaaggaattggatggaataattgttgatgtctccctgcaatggtgctctgattcctactctgatacagtgctaggatatgccaacagtatccgtactattgatggtggtactcatattgaggggctgaaaacttccctgacaagaacaattaatagctttgcaaagaagtcgaagattatgaaggataaagatattagcttgagtggggagcatgtaagagaaggaatgacatgcattatttcagtgaaggtccctaatccagagtttgaagggcagacaaagaccaggctgggaaatccagaagtgcgaagaatagttgaacaatctgttcaagaaaatctaactgaatacttggagttacatccagatgttttagattcaattctgtccaagtcccttaatgctctcaaggctgcattggcagccaagcgggctagagagttagtgaggacaaagagtgtcttgaaatcttcttcacttcctgggaaacttgctgattgtgcatcttctaaccctgcagaatctgaaatcttcatagttgaaggtgattcggctgggggtagtgcaaagcaaggccgggataggaaatttcaggctattttgcctctgaggggcaaaattctcaacattgagaggagggatgaagcagccatgtacaaaaatgaagagatccaaaatcttattcttggtcttggattaggagtgaagggtgaggattttaagaaggaagctcttcggtatcataagatagttatactgacagatgctgatgtagatggtgcacatatccggactcttctcctcactttcttctttagatatcagagagcacttttcgatgaaggttgcatctatgttggtgtgcctcctctttacaaggttgagcgtgggaaacaagtgcactactgctatgatgaggctgatcttaaagagctagtcaacaccttccctacaaatgcttcttataatacccagaggttcaaaggtttgggcgagatgatgcccttacaattgtgggaaacgacaatggatcctgaaaggaggctgttgaagcagctaacggtcgaagatgctgcagaggccaatgttgtgttctcatctcttatgggtgctcgggttgaatacaggaaggaactaatccagaaggccgcaagcatggtcaacctagatcaccttgacatctgagagcgttaaacaaggttgaccattgtgtatgatatagaaaagaccacaacttgccacccattcgacatagaagttgttttggtgctagtttagtagcaatctaggctagaacggagaaaagggttgatcccctggtgcttgtaacatgaatggtgcgttcatttgttgacacgctgtacccatctcatcttgacgcgggggttaaaccgcaatatcattggaagtggtcaacttgctcatgcagctggcaactcatcaaatacatggcctgtgctagagtagttgaattcctgttacttttgagccgtgctccagtttattcatccagtcatgcatggttttcttcacatgggaggacggaagcttttaagtgtgtacctgctcaccagccgcgttcagaaccggtattgccccatttgaccacttcctgagaaaataaggttaatggattttgcat

SEQ ID NO: 2791 - DNA, 2337 bp, Pennisetum glaucum
caagcgggtcatgcctcgaagattgcatcctctggcttatgaaatattggataatgcggtcgatgaagcacaagcgggtcatgcctcgaagattaatgtagtacttcatgatgacaactcagttagtgtaacagacaatggccgtgggattcctacagacatacacccccagacgaagaagtcgtgtgtggagactgtcttaacgttaatgcacgccggtggcaaatttggaggttcaaagagtggttacagtgtctctggagggctgcatggtgttggcctgtcagtggttaatgctttatcagaggcacttgaagttactgtttggcgtgatgggaaggaatacagacaaagctactctcgggggaaaccattgacaacactaaatagtatcacactgtctggtgaaacaagttctctccaaggaacacggataagattttggcctgataaagatatatttaccactaccatcagttttgacttcaatacgatctctagtcgcatccgagagcttgcctttctaaatcctgagctgacaataaccttgactaaggaagaagagcacacagaggttcaatataatgaatactgttatgccggtggccttgttgaatatgttaaatggttgaataccgataagaaacccctgcatgacccgattgcgtacagaaaggagttggatggtataacagttgacgtctctcttcaatggtgctctgattcctactctgatacagtgctaggatacgcaaacagtatccgtactattgacggtggtactcatattgaaggtctgaaggcttcattgactagaacaattaataaccttgcaaagaagtcgaagactattaaggataaagatattaccttgagtggggagcatgtaagagaaggaatgacatgtgtcatttcagtgaaggtccctaatccagaatttgaaggtcaaacaaagacaaggttgggaaatccagaagtacggagaatagttgaacaatctgttcaagaaaatttgacggagttcttagagcttcatccagatgttctggattcaatcctatcaaagtcccttaatgctctcaaggctgccttggcagctaagcgagctagagaattagtgaggacaaagagtgtgttgaaatcttcttcactcccgggaaaactagctgattgtgcatcaagtaatcctgaagaatctgaaatcttcatcgttgaaggtgattctgcaggtggtagtgcaaagcaaggacgggataggaaatttcaggctatttttgcctctaaggggtaaaattctcaacattgaaagaaaggatgaagcagccttgtacaaaaatgaagagatccaaaatcttatccttgctcttggactaggagtgaagggtgaggattttaagaaggaagctcttcggtatcataagatagttatacttactgatgctgatgttgatggtgcacatatccggactctcctccttactttcttcttcagatatcagagagcactatttgatgaaggttgcatctatgttggtgtacctcctctttataaggttgagcgtgggaaacaagcacattattgctatgatgatgctgatcttaaagagatagttaacaccttccctgcaaatgcatcgtatcatatccagaggtttaaaggtttgggtgagatgatgcctgcacaattatgggaaactactatggatcctgagaggcggctgttaaagcagcttaaggttgaggatgctgctgaggccaatgttgtcttctcatcactaatggggacccgggtcgaatataggaagcaactgatccagaatgctgcaagcatgatcaacatggatcaacttgacatttaagtgcattgaggctgaccccatcatgtatgatatggaagatccacccgaccaagcgtagaagactcgattcttcgcgagcaattgttgtgtgctagtgtagcagtaaaagtaggctagaattggaacccggacgacagcgtattgcctgatttcctggttcttccgacacattttgtggcagtcctgtgacgtgcaatccattttggcctggcgcggagattactcgggggagtttggtggcgcacctgccatgggttaaggtagctgacatattgccatgccacgcatatattttgtgatatttgcggtggattcttcaatatgatgcgtcttgcccattctttgattccagtggtggcgtaacacatagggagttctggataggggaatttggcaatttcgtaggcagaatgggaattgtaatgttatacctgtgagttctgctttcggcaaaaccgtgtgaaaacctaggacttca

SEQ ID NO: 2792 - DNA, 2357 bp, Saccharum officinarum
actcatcccgtcttgtagctgcagccacctttcttggccccctcaaaatcctcctaccaatcccaccagctgctcatctcgaatccaccccgaaacctcccaccacccgcaccgtccacccagttcgtgcgcgatcagctgctgcccggcgctcagggatcgggaaaaaagaggctccttggtggttcctgcgggcgaatctcgcggcgattcgctcagatttggatttaaggtttaggaggcggtggtggtgatcggtttgcgatgtcggcggccgtggcgtgcgcggagagggcgaccaacgacatgctgatcggcccggactgggcggtcaacatcgaactgtgcgacatcatcaacatggatcccggacaagcaaaggatacactcaagctcctaaagaaacgtcttggaagcaagaattcaaaagtgcaaattctaacactttatgtgctagagactctaagcaaaaattgtggggatattgttcatcaacagatcgttgagcgtgacatattgagtgaaatggttaagatagtaaagaaaaagccagacttaagcgtccgagagaagatattgagtttgattgacacatggcaagtggcttttggaggtccatctggaaaatatcgacagtatcatgcggcttaccaagaactcagggctgctggtgttgattttccacctcgtgaagaaaattcagtcccattgtttacaccacctcaaactcaaccgttaagacatccacatctatatccacctccaggtcaaagttatgaagatgctgccatacaagcttctcttcaatctgcccctcctgcacctcccctcagtctgagcgagattcaaagtgctcgagggattgtggatgtgttagatgaaatgttaaatgctctggaccaccggcatcctgagggtgtaagggaggaggtcattgttgaccttgttggccaatgccgatcatatcaatctcgtgtcatggatcttgttaacagtactggcgatgagagccttctatttcaggctctaggactaaatgatgagttacagcgtgttgttcagcgtcatgatgacatagcaaaggggatccctcctggtactggagcacctgtacctgcttctgcaaatgtcaaccaagggactgccccacctaggtccactgcggtttcattttctccacttctaaatgtacacgaggacgatgaaccggaagatgagttctctgtgctttcccgcaggtctgcaagggatggcgcagtagcacagaacaacctgccttctgctccaagaaatgaaaggccatcatacccaagcccacttcttcctccaccaccagcatctaagaggcctgtttacacagaggcaagcggtattgactatcttagtggtgactcctataagtcagaaaaggcatcagatgatttcatcaacccaactgctccagctaatatatctacatcatccaattcaaagccagaagcatatccggcaccaagttatggtagtagcaggccagacagtgtgtctgacgactttataaacccaactgcgcctagcttctctgcaccttctcgtcctacaaatgaggagccaatccgctcgtccgtgaagcagcaggagagtctacctgatgacgacttcataaacccaactgctcttcctggtttctcgtcatcttcggctactaaggagtctagtgaagatcttccaaaagctccatgggaatcacaagctgctgctgcaggtgccctgccgccacctccggcgaggtatggccagagacagcagtactttgagcaaaacgtgtactctggtgggagcaacggaggtgggtacgatggactgctgacacagactgaaaacctctccctgaacccacggagcagtgagaatgagaagagtgcatcacggccgacagcatcccgccaggctaaacccgaggactcccttttcaaggacctggtcgactttgcaaagaccaagccttcatctccgtcgaaaccagccaacagccgcaggacccgctgaaacgacttgtgcgatacgtgtacattgagtcgtccagctattcatttcacaggttaggggcttcagattatatataccaatgaaataagggcgtttgaagactggttttcattgcattgcatgggaaattattttggttgcgtttagaatcacagctgtcagatacagacagtacttggtcataatcctgggtgtgttatgtctagttagctgctcttaaatctctgtgttgtcggctttacttccattttttttctttttacttagctgtgtatatatatgttacccgattggacagcaatattcatagttgagtttgcaacttgagg

SEQ ID NO: 2793 - DNA, 2904 bp, Sorghum bicolor
caaagaattattgttagccctcgtattcacatcacactgacaaaaaaaaaaagtccatgaccgcgtttttctcttctccctttcgtgccgccggccgggtctactcatccccgtcttgtagctgcagctacctttccttggccccctcaaaatcctccaaccaatcccaccagctgctcatctcgaatctgcccggagacctcccaacaccctcaccgtccacccagttcgtgcagctgcccggcgttcagggatcggggaaaaaaaggcgctttggtggttcttgcgggcgaatctcgcggcgattcgctcagatttggatttagggtttaggtggtggtggtggtgatcggtctgtgccgccgggagagatgtcggcggctgtggcatgcgcggagagggcgaccaacgacatgctgatcggcccggactgggcggtcaacatcgagctctgcgacatcatcaacatggatcccggacaagcaaaggacacactcaagctcctaaagaaacgtcttggaagcaagaattcaaaagtgcaaattctaacactttatgtgctagagacgctaagcaaaaattgtggggatattgttcatcaacagatcgttgagcgtgacatattgagtgaaatggttaagatagtaaagaagaagccagacttaaacgtccgcgagaagatattgagtttgattgacacatggcaagtggcatttggaggtccatccggaaaatataaacagtatcatgtggcttaccaagaactcagggctgctggtgttgattttccacctcgtgaggaaaattcagtcccgttgtttacaccacctcaaacgcaaccattaagacatccacatctatatccacctccaggtcaaagctatgaagatgctgccatacaagcttctcttcagtctgcccctcctgcacctcccctcagtctgagtgagattcaaagtgctcgaggtattgtggatgtgttagatgaaatgttaaatgctctggaccaccggcatcctgagggtgtaagggaggaggtgattgttgatcttgttggccaatgtcgatcatatcaatctcgtgtcatggatcttgttaacagtactggcgacgagagccttctatttcaggctctaggactaaatgatgagttacagcgtgttgttcagcgtcatgatgacatagcaaaggggatccctcctggtactggagcacctgtacctgcttctgcaaatgtcaaccaagggactgcgccacctaggtccactgcggtttcattttctccacttctaaatgtacatgaggacgatgaaccggaagacgagttctctgtgctttcccgtaggtctgcaagggatggcgcagtaccacagaacaatctgccttctgctacaagaaatgaaaggccatacccaagcccacttcttcctcctccaccagcatcgaagaggcctgtttacagtgaggcaagcagtattgactatcttagtggtgactcctacaagtcagaaaaggttccagatgatttcatcaacccaactgctccatctaatatatctacatcatcccattcaaagccagaagtatatccgccaccaagttatggtagcaggccagacagtgtgtctgatgactttataaacccaactgcacctagcttctctgcgccttctcgtcctacaaatgaggagccaacccattcatctgttaagcggcaggaaagtctacctgacgatgacttcataaacccaactgctcttcctggtttctcgtcatcttcagctagtaaggagtccagtgaagatcttccaaaggctccatgggaatcacaagctgctgctgcaggttccctgccgccacctccagcgaggtatggccagagacagcagtactttgagcaaaatgtgtattccggtgggagcaatggaggtggttacgatggactgatgacacagactgaaaacctctccctgaacccacggagcagtgagagtgcatcacggccaacagcatcccgccaggctaaacccgaggactcccttttcaaggacctggtcgacttcgcaaagaccaagccttcgtctccatcgaaaccagccaacagccgcaggacccgctaaacgatatatgtacattgagttgtccagctattcatttcacaggttagcagcggctttagattatacccaatgaaataagggcgcttgaagacaggttttcattgcgttgcgttgcatggggaattattttggttgcgtttagaatcacagctgtcagatacagacagtacttggtcataatcatgggtgtgtgatgtctagttagctgctcttaaatctctgtgttgtcggctttactttttttttcctttttacttagctgtgtatatatatgttacccgattggacagcagtattcatagttgagtttgcagacaagacttggctgattattttcagttaggataaatttggtgcccatggtcaattgttggctgcttgtttttcgtactcggctgagcagcaaagctttgtgtagagtttccatgatctctgcagttgatttccaaccggttggacagctgcattacagttctgtggctagtatttgtttctgtttgccgggaactgttttttatcccatggtctctgcagatagatagatttatttctgcattacaaatatgtacaatcgcctggtgacttagatatcatttgagggacgtctcggtcctcgaccatgacttcacggatgatatgatacctggcggatatgctagttgcctggactgtttgttagaaccaaaagatgtcaagaaaatacctggtcatgagctcgtggtcctggccatgtcatgtactgaatactgatgcgtggttaactagactacaaggagagcatctg

SEQ ID NO: 2794 - DNA, 2478 bp, Setaria italica
tcgtccgcgttttccttcctttctcccgttcctgccgccggccgggtctactcgtctcgtcctgcagctgcagctacctttcttcgccccctcaaaatcctccaaccaatcccaccagcttctcagctcgaatccgccccgaaacctcccaccctccgcaccgcccgcccggttcttgcgcgatcagcggctgcccggcgctcccggatcgggaaaggaggccgctttggtggctccggcgggcgaatctcgcggcgattcgctcagatttggatttagggttttggaggtggtagtgggttttgtgacgccgggagagatgtcggcggctgtggcgtgcgcggagagggcgacgaacgacatgctgatcggcccggactgggccgtcaacatcgagctctgcgacatcatcaacatggatcccggacaagcaaaagatacaatcaagcttttaaagaaacgtcttggaagcaagaattcaaaagtgcaaattctgacactttatgtgctggagacactaagcaaaaattgtggggatgttgttcaccaactgatcgttgaacgtgacatattaagtgaaatggttaagatagtaaagaaaaagccagacttaaatgtccgggagaagatattgagtttgattgacacatggcaagtggcttttggaggtccttctggaagatatccgcagtatcatgcagcttaccaagaactcagggctgcaggtgttgattttccacctcgtgaggaaaattcagtcccattgtttacacctcctcaaactcagccattgagacaaccacatctatatccacccccaggtcaaagctatgaagatgctgccattgaagcttctcttcaatctgccccttctgtacctgccctgagtctaagtgagattcaaagtgctcgaggaattgtggatgtgctagatgagatgttaaatgctcttgaccacagacatcctgagggtgtgagggaggaggtcatcattgaccttgttgggcagtgccgatcatatcaatctcgtgtcatggatcttgttaacagtaccggtgatgagagccttttatttcaggctctaggactaaatgatgaattacagcgtgttgttcagcgtcatgatgacatagcaaagggaattcctcccggtacaggagcaactgcccctgcttctgcaaatacaaaccaagggactgcccctcctaggtccactgcggtttcattttctccacttctaaatgtccacgaggacgatgagccagaagatgagttctctgtgctttcccgcaggtctgcaagggatggcacagtggcacagagcaatcagccttctgctccgaggaatgaaaggccatacccaagcccgctccttcctccacctccggcatctaagaggcctgtttacacagaggcaagcaatattgactaccttagtggggactcctacaagtcagaaaaagtatcagatgatttcatcaacccaactgcccctgccaatatatctacatcatcccatttgaagacggaagcgtatccgcctccaagttacggtagcaggtcagaaagtgtgcctgatgactttgtaaacccaacagcacccagcttctctgcgccttctcgtcctacaagtgaggagccaacccgtacatctgtgaagcagcaggagagtctgcctgacgatgacttcataaacccaactgctcttcccagtttctcatcatcttcagctacgaaaggttatgaagattccagggaagatattccgaaggctccatgggaaccacaggctgccgcaggttccctacccccacctccggcaaggtacggccagagacagcagtactttgagcagaacgtgtactctggtgggagcaacggaggcggctacgatgggctggtgacacagacagaaaacctctccctcaaccagaatgagaagagcacatcacggccgacagcgtcccgccaggctaaacctgaggactcccttttcaaggaccttgtcgactttgcgaaaaccaagccatcatcaccatcgaaaccagccaacagccgcaggactcgctgagcaacttgtgtgatactttcacaggttagcagctttagatgattaccgtgaaataagagcatttgaagactggattcctttgcgtcgcgaattattttcggttgtgtttttgaggatttagaatcacagatgtcggataccatacttggccataatcctgggtgtgttatgtgtagttagctgctcttaaacttcctttgttgtcggctttacttcctttttttttcacttagctgtgtatatatatgctactcagattcgacagtgatattcatagttgagtttgcaatttgagggcaaatactttggcttgtccattttcagtgtctgtaaattaggcgcatttggttgaatttttagcttgttttctcatctcagtggagcagaaaaggtccgtgctctctgtg

SEQ ID NO: 2795 - DNA, 2252 bp, Pennisetum glaucum
gcggcgattcgctccgatttggatttagggttttggaggtggtagtgtgtttgtgccgccgggagagatgtcggcggctgtggcgtgcgcggagagggcgacgaacgacatgctgattggcccggactgggccgtcaacatcgagctctgcgacatcatcaacatggatcccggacaagcaaaagatacaatcaagctcttaaagaaacgccttggaagcaagaattcaaaagtgcaaattctgacattatatgtgctggagacactaagcaaaaactgtggggatgttgttcaccaactgatcgttgaacgggacatattaagtgaaatggttaagatagtaaagaaaaagccagacttaactgtccgggagaaggtattgagtttgattgacacatggcaagtggcttttggaggttcttctggaagatatccgcagtatcatgcagcttaccaagaactcagggctgcaggtgttgattttccacctcgtgaggaaaattcagtcccattgtttacacctcctcaaactcagccattgagacaaccacatctatatccacccccaggccaaagctatgaagatgctgccattgaagcttctcttcagtctgccccttctgtacctgccctgagtctaagtgagattcaaagtgctcgaggaattgtggatgtactagatgagatgttaaatgctctggaccacagacatcctgagggtgtgagggaggaggtcatcattgaccttgttgggcagtgccgatcatatcaatctcgtgtcatggatcttgttaacagtaccggtgatgaaagccttttatttcaggctctaggactaaatgatgaattgcagcgtgttgttcagcgtcatgatgacatagctaagggaattcctcccggtacaggagcaactgcccctgcttctgcaaatacaaaccaagggactgcccctcctaggtccactgcggtttcattttctccactcctaaatgtgcacgatgacgatgagccagaagatgagttctctgtgctttcccgcaggtctgcaagggatggcacagtggcacagagcaaccagccttctgctccgaggaatgaaaggccatacccaagccccctccttcctccacctccagcatctaagaggcctgtttacacagaggcaagcaatattgactaccttagtggggactcctacaagtcagaaaaagtatcagatgatttcatcaacccaaccgcccctgctaatatatccacatcatcccattcaaagacggaagcatatccgcctccaagttatggtagcaagtcagaaagtgtgcctgatgactttgtaaacccaacagcacccagcttctctgcgccttctcgtcctacaagtgaggaaccaacccgtacaactgtgaagcggcaggagagtctgcctgatgatgacttcataaacccaactgctcttcctggtttcccatcatcttcagctacgagaggttatgaagattccaaggaagatattccaaaggctccatgggaaccacaggctgctgcaggttccctacccccacctccggctaggtatggccagaggcagcagtactttgagcagaccgtgtactctggtgggagcaacggaggcggctacgatggattggtgacacaggcagaaaacctctccctcaaccagaatgagaagagctcatcacgaccgacagcatctcgccaggctaaacctgaggactccctttttaaggacctagtcgactttgccaagaccaagccgtcatcaccgtcgaaaccagccaacagccgcaggactcgctgagcaacttgtggttactttcactcaggttagcggcacgtgaaataagagcatttgaagacttggatttctttgcgtcgcgagttatttcggttgcgttttcgagaacttagaaatcacagatgtgggatactatacttggccataatcccgggtgtgatgtgtagttagctgctcttaaaacctcctttgttgccggcttcgcttccattttttaccccttcgcttagctgtgtatatatatgcaactcgatttgacagttatattcatagttgagttcgcaatttgagggcaaagactttgatgattgtccatttttgtgtctgtaaattaggcgcgtctggtcaattttttttgcactcgtttctattctcagtgtagcagaaaacttgtgcgaaagtctgtgctatgctgctatctgtggttattttttca

SEQ ID NO: 2796 - DNA, 2692 bp, Panicum virgatum
attagatcctggccaaaccttttcagaacacgagaccaactgaaaaaaaaaatgaaactgcgagatttgccaagagcctaatcaaactccaaaaatacggacaaccatattctagatgttgcccaaagttgccaaaaattccccaaaactgacataaaataaaatataattgctgcgggtcatcatattcacacaggagtactcttcacacagtgtgaccggaaaaaaaaaagtcgcccgcgttttccttcctttctcccgttcctgccgccggccgggtctactcgtctcgacctgcagctacagctacctttcttcgccccccctcaaaatcctccaaccaatcccaccagcttctcatctcaaatccgccccgaaacctcccaccgcccgcccgggtcgtgcgcaatcggcagctgcccggcgctcccggatcgagaaaggaggccgctttggtggttctggcgggcgaatctagcggcgattcgctcagatttggatttagggttttggaggtggtagtgggcttctgccgccgggagagatgtcggcggctgtggcgtgcgcggagagggcgactaacgagatgctcatcggcccggactgggcggtcaacatcgagctctgcgacatcatcaacatggatcctggacaagcaaaagatacactgaagctcctaaaaaaacgtcttggaagcaagaattcgaaagtgcaaattctgacactttacgtgctggagacactaagcaaaaattgtggggatgttgttcaccaactgatcgttgaacgtgacatattaagtgaaatggttaagatagtaaagaaaaagccagatttaaatgttcgggagaagatattgagtttgattgacacatggcaagtggcttttggaggttcttctggaagatatccccagtatcatgcagcttaccaagaactcagggctgcaggtgttgattttcctcctcgtgaggaaaattcggtcccactttttacacctcctaaaactcagccattgagacatccacatttatatccacctccaggtcaaagctatgaagatgctgccatagaagcttctcttcaatcagccccttctgtacctgccctgagtctaagtgagattcaaagtgctcgtggaattgtggatgtgctagatgagatgttaaatgctctggaccacaagcatcctgagggtgtgagggaggaggtcattgttgaccttgttgggcagtgccgatcgtatcaatctcgtgtcatggatcttgttaacagtaccggtgatgagagccttttatttcaggctctaggactaaatgatgaattacagcgtgttgttcagcgccacgatgacatagcaaagggggttcctcctggtacaggagcaacggcccctgcttctgcaaatgtaaaccaagggactgctcctcctaggtccactggggtttcattttctccacttttaaacgtacacgaggatgatgagccagaagatgagttctctgtgctttcccgcaggtctgcaagggatggcacagcagcccagagcaatccaccttctgctccgagaagtgaaaggccatacacaagcccacttcttcctcccccgccagcatctaagatgcctgtttacagagaggcaagcaatattgactaccttagtggggactcctacaagtcagaaaaggtttcagatgatttcatcaacccaaccgcccctgccaatatatccacgtcatcccattctaaggcagaagcatatccaccaccaagctacggtagcaggacagacagtgtgtctgatgactttataaacccaactgcacccagcttctccgcgccttctcatcctaaaagtgaggagccaacacgttcatctgcgaagcagcaggagagcctacctgatgatgacttcataaacccaaccgctcttcctggtttctcatcgccagctaccaaaggttatgaagattccagggaagatgttccgaaggctccttgggaaccacaggctgctgcgggttccctacccccgcctccagcgaggtatggccagaggcagcagtactttgagcagaacgtgtattctggcgggagcaatggaggcggctacgatggacttgtgacgcagacagagaatctctccctcaaccagaatgagaagagcagcgcctcatcacggccagcggcatcccgccagacgaagcccgaggactccctcttcaaggacctcgttgactttgcgaaggccaagccgtcatcaccgtcgaaaccagccaacagccgccggactcgctgagccaacgcgtgcagcacgcgcacaaagcttagcgggcctagatgatactgtcaaaataagagccatttgaagactggattccttttgggtcgccaattgttccgattgcattttcgagaatttagagtcgaggatttcagatactatactgggccatgatccagtgtgtgcgcgcacgatgtgtagttagctgctctcaaacttccattgctgttggcttcaccacccattttttttctctcacttagctgtgtatatatatgctactcggatttgacagtgatattcatagtctgagtttgcaatttgttgtcaaagacttcttttccagtgtcaggtaaatttggtgccttttgtcaaatttctacttgtttctcttatcagtgcagaaaa

SEQ ID NO: 2797 - DNA, 2442 bp, Zea mays
cagtcgtgggtgtttacccatcttgtagccgcagctgcctttctggctttcttggcccctcaaaatcattcaaccaatcccactaccaccctcaccgtgtacccagttcgtgcgcgatcagctgctacccagcgctctgggatcgggaaaaggaggctcttttgtggttcctgcgggcatatctcgcggagattcggtcagatttggatttagggtttaggaggtggtggtggtgatcggtttgtaccgccaggtgaaatgtcggcggctgtggcgtgcgcggagaaggcgaccaacgacatgctgattggcccggactgggcgatcaacatcgaactctgcgacatcatcaacatagatcccggagaagcaaaggatacactcaagctcctcaagaaacgtcttggaagcgagaattcaaaagtgcaaattctaacactatatgtgctagagactctaagcaaaaattgtggggatattgttcatcaacagatagttgagcgtgacatattgagtgaaatgattaagatagtgaagaaaaagccagacttaaacgtccgagagaagatattgagtttgattgacacatggcaagtggtttttggaggtccgtccggaaaatatcgacaatatcatgcagcttacgaagaactcagggctgctggtgttgattttccacctcgtgaggaaaattcactcccgttgtttacaccacctcaaactcaaccattaagacattcacatctatatccacctcctggtcaaagctatgaagatgctgccatacaagcttctcttcaatctgcccctcctgcacctgccctcagtctgagcgagatccaaagtgctcgagggattgtggatgtcttagatgaaatgttaaatgctctagaccaccggcatcctgagggtgtaagggaggaggtcatcgttgaccttgttggccaatgccgatcttatcaatctcgtgtcatggatcttgttaacagtactggcgatgagagccttttatttcaggcactaggactaaatgatgagttacagcgtgttgttcagcgtcatgatgacatagcgaaggggatcctccctcctggtaccggagcacctgtacctgcttctgcaaatgtcaaccaagggactaccccacctaggcccacggcggtttcattttctccactcctgaatgtacacgaggacgatgaaccggaagacgagttcgtcgtgcttttccgtaggcctgcaagggatggcacagtagcacggaacaatctgccttatgcacgaagaaatgaaaggccgtaccgaagcccacttcttcctccaccaccagcatctaagaggcctgtttacaccgaggcaagcagtatcgactatcttagtggcggctcctacaagtcgtcagaaaaggttccagatgatttcatcaacccaactgctccagctaatgtaactacatcaccccattcgaagccagaagcatatccgccaccgagttacagtagcaggccagacagtgtgtccgacgacttcataaacccaaccgcgcctagcttttctgcgccttctcgccctacagacgaggagccaacccgttcgcctgtgaagcggcaggagagtatacccgacgatgacttcataaacccaactgctcttcctggtttttcgtcgtcttcagctactaaggagttcagcgaagatcttccaagggctccatgggaagcacaggctgccgcagcaggttccctgccaccgcctccggcgaggcatggtcagagacagcagtacttggagcaaaacgtgtattctggtgggagcaacggaggtggatatgatgaactgttgacacggactgaaaacctctccctgaaccctgagaagaatgcttcacggccgacagcatcctgccaggctaaacccgaggactcactcttcaaggacctggtcgacttcgcgaagaccaagccttcgtctccgtcgaaatcggccaacagccgcaggacccgctaaacggttatccgtttcgcaggttagcagctttagattgcataccccatgaaataagggcgttggaaaattatttggttccgtttagaagcagatgtcagaaacaatacttggtcattgtcctgggcgtgtgtgtggtgtcagttagctgctcctaaatatgtgtcattggcttccatttgtttgtttgtttttttcaatagctgagtatgtatatattacccgattcggcagcaacattcatagttgagtttgcaacttgagtgttgcctattttcagtgtggataaattaggaggctatggtcaaaccttcatttttttttggtactgggcgagcttttcttttcttttttttttttaaaaaaaagctgtgtagaatggtctatgcagacagaattatgcactacaattgcttggtggcttgaggctagtcttaa

SEQ ID NO: 2798 - DNA, 2514 bp, Panicum virgatum
cggttccgcaccgcgccggtttggtaggaccgatcggtaatgttaaccctgtgtctacctcgtctcgacctgcagctacagctacagctacctttcttcgccccactcaaaatcctccaaccaattccaccggcttctcggctcaaatccgccccgaaacctcccagcgcccgcaccgtccgccagggtcgtgcgcgatcggcagctgccccggcgctccagatcgagggaaaggagaccgctttggcggttccggcgggcgaatctagcggcgattcgctcagatttggatttagggttttggaggtggtagtgggcttgtgccgccgggagagatgtcggcggctgtggcgtgcgcggagagggcgaccaacgacatgctcatcggcccggactgggcggtcaacatcgagctctgcgacatcatcaacatggatcctggacaagcaaaagatacactcaagcttctaaagaaacgtcttggaagcaagaattcaaaagttcaaattctgacactttatgtgctggagacactaagcaaaaattgtggggatgttgttcaccaactgattgttgaacgcgacatattaagtgaaatggttaagatagtaaagaaaaagccagatttaaatgttcgggagaagatattgagtttgattgacacatggcaagtggcttttggaggtccttctggaagatatccccagtatcatgcagcttaccaagaactcagggctgctggtgttgattttccacctcgcgaagaaaattcggtcccactgtttacacctcctcaaactcagccattgagacatccacatttatacccacctccaggtcaaagctatgaagatgctgccatagaagcttctcttcaatctgccccttctgtacctgccctgagtctaagtgagattcaaagtgctcgtggaattgtggatgtgctggatgagatgttaaatgctctggaccacaggcatcctgagggtgtgagggaggaggtcattgttgaccttgttgggcagtgccgatcgtatcaatctcgtgtcatggatcttgttaacagtaccggtgatgagagccttttatttcaggctctaggactaaatgatgaattacagcgtgttgttcagcgccatgatgacatagcaaagggggttcctcctggtacaggagcaactgcccctgcttctgcaaatgtaaaccaagggactgctcctcctaggtccactggggtttcattttctccacttttaaatgtacatgaggatgatgagccggaagacgagttctctgtgctttcccgcaggtctgcaagggatggcacagcagcccagagcaatctgccttctgctccgagaagtgaaaggcaatacacaagcccaattcttcctcccccgccagcatctaagaggcctgtttacacagaggcaagcaatatcgactaccttagtggggactcctacaagtcagaaaaggtttcagatgatttcatcaacccaaccgcccctgccaatatatccacatcatcccattcgaagacagaagcatatccaccaccaagctacggtagcaagacagacagtgtgtcagatgactttataaacccaatcgcacccagcttctccgcgcctgctcatcctaaaagcgaggagccaacccgttcatctgcgaagcagcaggagagcctacctgatgatgacttcataaacccaaccgctcttcctggtttctcaccgccagctaccaaaggttatgaagaccccagggaagatgttccgaaggctccttgggaaccacaggctgctgcgggttccctacccccacctccggcaaagtatggccagaggcagcagtacttcgagcagagcgtgtattctggcgggagcaatgggggcggcagctacgatagactcgtgacgcagacagagaatctctccctcaaccagaatgagaagagcagcacatcatcacggccggcggcatcccgccagaccaaacccgaggactccctcttcaaggaccttgtcgactttgcgaaggccaagccgtcagcgccgtcgaaaccagccaacagccgccggactcgctgagccagctcgtgcgacgcacgcgcaaagctcagcgggcctaggtgatgctgtcaaaataagagccatttgaagactggattccttctgcatcgcgaattgttccggttgcattttcgagaatttaagagccgcagatttcagatactatgatacttggccataatccagggtgcgtagttagctgctcacaaacttccattgctgttggcttcacctccatttttttctctctctcacttagctgtgtatatatatgctactcggattcgacagtgatattcatagtttgagtttgcaatttgatgtcaaagacttgatttccagtgtcaggtaaattcggcgcctttttgtcagattcccgcttgtttctcgtatcagtagagcagaaaacttgtgcataagtctgtgctctccgccgcta

SEQ ID NO: 2799 - DNA, 2409 bp, Panicum virgatum
aaaaaaagtcgcccgcgttttccttcctttctcccgttcctgccgccggccgggtctactcgtctcgacctgcagctacagctacctttcttcgcccccctcaaaattctccaaccaatcccaccagcttctcatctcaaatccgccccgaaacctcccaccgcccgcccgggtcgtgcgcaatcggcagctgcccggcgctcccggatcgagaaaggaggccgctttggtggttctggcgggcgaatctagcggcgattcgctcagatttggatttagggttttggaggtggtagtgggcttctgccgccgggagagatgtcggcggctgtggcgtgcgcggagagggcgactaacgagatgctcatcggcccggactgggcggtcaacatcgagctctgcgacatcatcaacatggatcctggacaagcaaaagatacactgaagctcctaaaaaaacgtcttggaagcaagaattcgaaagtgcaaattctgacactttacgtgctggagacactaagcaaaaattgtggggatgttgttcaccaactgattgttgaacgtgacatattaagtgaaatggttaagatagtaaagaaaaagccagatttaaatgttcgggagaagatattgagtttgattgacacatggcaagtggcttttggaggttcttctggaagatatccccagtatcatgcagcttaccaagaactcagggctgcaggtgttgattttcctcctcgtgaggaaaattcggtcccactttttacacctcctaaaactcagccattgagacatccacatttatatccacctccaggtcaaagctatgaagatgctgccatagaagcttctcttcaatctgccccttctgtacctgccctgagtctaagtgagattcaaagtgctcgtggaattgtggatgtgctagatgagatgttaaatgctctggaccacaggcatcctgagggtgtgagggaggaggtcattgttgaccttgttgggcagtgccgatcgtatcaatctcgtgtcatggatcttgttaacagtaccggtgatgagagccttttatttcaggctctaggactaaatgatgaattacagcgtgttgttcagcgccatgatgacatagcaaagggggttcctcctggtacaggagcaactgcccctgcttctgcaaatgtaaaccaagggactgctcctcctaggtccactggggtttcattttctccacttttaaatgtacatgaggatgatgagccggaagacgagttctctgtgctttcccgcaggtctgcaagggatggcacagcagcccagagcaatctgccttctgctccgagaagtgaaaggcaatacacaagcccaattcttcctcccccgccagcatctaagaggcctgtttacacagaggcaagcaatatcgactaccttagtggggactcctacaagtcagaaaaggtttcagatgatttcatcaacccaaccgcccctgccaatatatccacatcatcccattcgaagacagaagcatatccaccaccaagctacggtagcaagacagacagtgtgtcagatgactttataaacccaatcgcacccagcttctccgcgcctgctcatcctaaaagcgaggagccaacccgttcatctgcgaagcagcaggagagcctacctgatgatgacttcataaacccaaccgctcttcctggtttctcaccgccagctaccaaaggttatgaagaccccagggaagatgttccgaaggctccttgggaaccacaggctgctgcgggttccctacccccacctccggcaaagtatggccagaggcagcagtacttcgagcagagcgtgtattctggcgggagcaatgggggcggcagctacgatagactcgtgacgcagacagagaatctctccctcaaccagaatgagaagagcagcacatcatcacggccggcggcatcccgccagaccaaacccgaggactccctcttcaaggaccttgtcgactttgcgaaggccaagccgtcagcgccgtcgaaaccagccaacagccgccggactcgctgagccagctcgtgcgacgcacgcgcaaagctcagcgggcctaggtgatgctgtcaaaataagagccatttgaagactggattccttctgcatcgcgaattgttccggttgcatttttcgagaatttaagagccgcagatttcagatactatgatacttggccataatccagggtgcgtagttagctgctctcaaacttccattgctgttggcttcacctccatttttttctctctctcacttagctgtgtatatatatgctactcggattcgacagtgatattcatagtttgagtttgcaatttgatgtcaaagacttgatttccagtgtcaggt

SEQ ID NO: 2800 - DNA, 2473 bp, Hordeum vulgare
ctcgccaaccccaatcccaaaccagtctgactctgaccagcccttcctaccaagaacacatccaatcccacaccagtccgctctaaatcccgatccgcccccaccaatcccacgaacgaactcccccgccccccccctctcgtcctggcacgagcgcgtcggccccatcgccccggatcggagcagaggcggctccggcgctgaatctcccttcagattcggatttagggtttttggacgtggtcggtggtggtcgtgggcttgcgcggccggtttggaaatgtcggcggccgtggcgtgcgcagagcgggcgacgagcgacatgctgatcggccccgactgggccgtcaacatcgagctctgcgacatcatcaacatggatcccggacaagcaaaggatgcacttaagctcctaaagaagcgccttgggaataagaattcaaaagtgcaaattctggccctttatgtgctagagactctaagcaaaaattgcggggatattgtttaccaacagatcattgagcgtgatatactaagcgaaatggtcaagatagtaaagaaaaagccagacttaaatgtgcgggagaaaatattgagtctgattgacacatggcaagtagcttttggaggtccttccgggagatatccccagtatcacactgcgtaccaagaactcagggcggctggtgttgattttccacctcgtgaggagaatacagttccactttttacacctcctcagactcaacctttgaggcagccacatttatatcctccaggtcaaagttatgaagatgtagctatacaagcttctctccaatctagtacccctgctgcacctcccctgagtctaagtgagattcagagcgctcgtggaattgtggatgtgctggatgagatgttaaatgcacttgaccacagacaccccgagggtgtgagagaggaggtcattgttgaccttgttgggcagtgtcgatcttaccatgctcgtgtgatggatcttgttagcgatactggtgatgagagccttctgtttcaggctctaggactaaatgatgagttgcagcgtgttcttcagcgtcatgatgacatagcaaaaggagttcctccaaacataccagtgcctgttgctggtaatgtaaaccaaggggcagcccctcctcggcctgccggggtgtcattttcccctcttcttaatgtacaccatgaggacgatgaaccagaagatgagttctctgtgctttctcgcaggtctgcacgggacgccgcagcagcacagggcaacatgtcttctgttccgagaaatgaaaggccatacccgagcccacttcttcccccaccaccatcgacaaaaaggcctgtttacacagaggcaagcagtgtcgactatctaagtggagactcctacaaatcggaaaaagtaccagatgattttgtcaacccaacagcccccgcaaatatatctgcaccatcttattcaaaaacagagacggatcacgagccaaaatatgatagcaggtcagaatatgtgcctgatgacttcataaacccaactgcagcacccagtttttccatgccctctcgccctacgagtgagccgaataattcatctgtgaataagcttgagagccttcctgatgatgacttcataaaccccactgcacttcctggcttttcttcgtcttcaactagtgaagatcttccaaaagctccatgggaagcgcaagctccagtttccctaccaccgcctcctgcaaggcatggccaaagacaacagttctttgagcaacagcatggctttcctggtgggaacaatgaaggtggctatgatgaaatgctgacgcagacaggaagcctttctcttaatcaaaggaacactgagaatgggaagagtgcatcggtgtcgactgcatcccgccagcccaaacatgaggatgccctttttaaggatcttgttgattttgccaagaagaatccgtcttctccatctaaaccagccaacagccgcaggactcgctgagtgatgagtgttccagtcatgtaacacacataattgagttgccggcctgctggttttgctacaggctagcgaattagatataccgtcaaataagagggttcggagtttggactgtttcacatcacaacattggcagttatttgatttgcgcattggacaattaaaatcacaggttcagatacatagtcatgatactgggtgtggtgtgtagtgagctgcctttcacctttttcttgtgtggtattggttatcgattctggctttattttgcttagctgtatatatttctccatttgacagcagtattctattcatagttgagtttacaattgatcttgtaagacttagttaacagtttattttcaacgtggacgctcccatttgttcttgtactgagcagtaaccttggctagaattcaagctccttgcaactaaattatggtgccgtttgaa

SEQ ID NO: 2801 - DNA, 2632 bp, Brachypodium distachyon
accaaacccagtctctaggcgagacaagtccttcctaccttccttcccaagaacaagaacaagaaccctccaatcccacaccagctgccgctcgaatccgccctccccttccatttctccaacgaacccctacagttccccccccgtcttcgcacttccggatcggagaagaggctgccccggtgctgctaattggcgccgaatctcggcggcgtccgctcagatttggtaacgatttgggttcttgggggttgagggtgttgggttcttggggttgggatcgggggttggatggtgcggtggatcgtggcgctgattgatttgattcgggggtgttgggtttggtttgagcgcaggatttttagggtttttggaggtggccgcggtggcgggcttggtgcgcgggcgggcggaaatgtcggcggccgtggcgtgcgcggagagggcgacgagcgacatgctgatcgggcccgactgggccgtcaacatcgagctctgcgacatcatcaacatggatcccggacaagcaaaggatacactcaagctcctaaagaagcgccttgggaacaagaattcaaaagtgcaaattctggcactttatgtgctagagactctaagcaaaaattgtggggatgttgtttaccaacagatcattgagcgtgacatattaagtgaaatggttaagatagtgaagaaaaagccagacttaaatgtacgggagaaaatattaagcttgattgacacatggcaagtggcttttggaggtccatctgggagatatccccagtatcacacagcatatcaagaactcaggacagctggtgttgattttccacctcgcgaggagaatacagttccattgttcacacctcctcaaacccaaccattgaggcagccgcacctatttcctccaggacaaagctatgaagatgtagctatacaagcttctcttcaatctagtgcccctgctgcagctgccttgagtctaagtgagattcagagtgctcgaggaattgtggatgtgctggatgagatgttaaatgcacttgaccaccgacaccctgagggagtgagggaggaggtcatcgttgaccttgtggggcagtgccgatcttaccatgctcgtgtgatggatcttgttagtgatactggtgacgagagccttctatttcaggctctaggactaaatgacgagttgcagcgtgttcttcagcgtcatgatgacatagcaaagggactgcctcccaatataccagtgcctgttgctggtaacgtaaaccaaggggcaccccctcctcggcctgccggggcttcattttccccacttcttaatgtacatcatgaggatgatgaaccagaagatgatttctctgtgctttctcgcaggtctgcaagggatggcacagcagcacagggcaacctttcttctgttgcaagaaatgaaaggccatacccaagcccacttcttcctccaccgccatcaacaaagagacctgtttacacagagtcaagcagtgttgactacctgagtggagattcctacaagtctgaaaaagtaccagatgattttgttaacccaactgccccagccaatatatctgcgccatcttattcaaaagcagaaacaaaccggcaaccaagttatgataacaggtcagaaagtgtgtctgatgacttcataaacccaactgccgtacacagcttctctatgccttctcgtcctgtgagtgagccaaacagttcatctgtgaatcagcatgagagtttacctgacgatgactttataaaccccactgcactgcctggtttttcttcgtcttcaactagtgaggatcttccaaaagctccatgggaagcacaagctccagtttcactaccgccacctcctgcaaggtatggtcaaagacagcagttctttgagcaaaatcatgtctttcctggtgggaacaatggaggaggctacgatgaactactgacgcagacagggaacctttctcttaatcaaagaaacaccgagcatgagaagagtgcatcagcatcgaccgcaccccgtcagcccaaacctgaggattctcttttcaaggatctagtcgattttgccaagaagaatccgtcttctccaactaaaccagcgaacagccgcaggactcgctgagtgacgagtgttccagtgatgtaacacagttaattgagttattgggctgttggttttattacaggttagcgggtttacatacaccatcaaataagagtgttcagaccttttttttccattatgttggggattatttcggtttgcgcgttggacagttagaaccacagatgtcagtcagatacaacgtgatgatactgggtgtggtgtgtagtgagttgccatttcaccttttcgatgtattggttttcggttctgctttcccttttattttttgcttagctgtatatattattactccattcaacagcaatattcatagttcagtttggagtttgatgatctatataaaggcttatgttcgctcttcttttggtgaactttgttggtgaaattaggtgtttctttttacttgttcgtttgtgtagaattcagcagagaagttttaacagagagtaaaatgcatggtcaatttgtggc

SEQ ID NO: 2802 - DNA, 2464 bp, Triticum aestivum
ccaacccagtctacccagtctttctttcccaccaagaacacctccaatcccacaccagtccgccccaaatctgatccgcccccaccattcccctcgtcttggcacgagcgcgtcggccccgtcgccccggatcggaggagagccggctacggcgctgctcggcgctgaatctccgctcagattcggattagggtttttggacgtggtcgtcgttgtgggtttgcgccgccggtttgaaaatgtcggcggccgtggtttgcgcagagagggcgacgagcgacatgctgatcggccccgactgggccgtcaacatcgagctctgcgacatcatcaacatggatcccggacaagcaaaggatgcacttaagctcctaaagaagcgccttgggaataagaattcaaaagtgcaaattctggccctttatgtgctagagactctaagcaaaaattgcggggatattgtttatcaacagatcattgagcgtgatatactaagtgaaatggtcaagatcgtaaagaaaaagccagacttaaatgttcgggagaaaatattgagtctgattgacacatggcaagtggcttttggaggtccttccgggagatatccccagtaccacactgcgtaccaagaacttagggcagctggtgtcgattttccacctcgcgaggagaatacagttccactgtttacacctcctcagactcaacctttgaggcagccacatctgtatcctccaggtcaaagctatgaagatgtagctatacaagcttctctccaatctagtacccctgctgcacctcccctgagtctaagtgagattcagagtgctcgaggaattgtggatgtgctggatgagatgttaaatgcacttgaccacagacaccccgagggtgtgagggaggaggtcattgttgaccttgttgggcagtgtcgatcttatcatgctcgtgtgatggatcttgttagcgatactggtgatgagagccttctgtttcaggctctaggactaaatgatgagttgcagcgtgttcttcagcgtcatgatgacatagcaaaaggagtccctccaaatataccagtgcctgttgctggtaacgtaaaccaaggatcagcccctgctcggcctgctggggtttcatttgcccctcttcttaatgtacaccatgaggacgatgaaccagaagatgagttttccgtgctttctcgcaggtctgcaagggatggcgcagcagcacagggcaacatgtcttctgttccaagaaatgaaaggccatacccaagcccacttcttcctccaccaccatcgactaaaaggcctgtttatacagaggcaagcagtgtcgactatctaagtggagactcctataagtctgaaaaagtaccagatgattttgtcaacccaacggccccagccaatatgtctgcaccatctcattcaaaaacagaaacagatcaagtgccaaattatgatagcaggtcagaaaatgtgcccgatgacttcataaacccaactgcagcacccagtttttccatgccttctcgtcctacgagtgagccatctgtgaataagcttgagagccttcctgacgatgactttataaaccccactgcacttcctggtttttcttcgtcttcaactagtgaagatcttccaaaagctccatgggaagcgcaggctccagtttccctaccgcctcctcctgcaaggtatggccaaagacagcagttctttgagcaacagcatggctttcctggtgagaacaatgaaggtggctacgatgagatgctgacgcggacaggaagcctttctcttaatcaaaggaacactgagaatgggaagagcgcatcagtgtcgaccgcatcccgccagcccaaacctgaggatgcccttttcaaggatcttgttgattttgccaagaagaatccatcttctccatctaaaccagccaacagccgcaggactcgctgagtgatgagtgtttcagtcatgtaacacacataattgagttgccaggctgctggttttgctacaggtcggcgaattagatatatcatcaaataagagggttcggtcggtctgttctttattgcctcagggaattatttggtttgcgcattggacaattagagtcacaggtgtcagatacgtagtcatgatactgggtgtggtgtgtagcgagttgcatttctcacctttttcttgtgtggtattggttaccgattcttgctttattttacttagctgtatatatttctccatttgacagcagtattctattcatagttgaatttgcaatttgatcttgtaagacttactccctcgtgtaccaatatctaagacgtttttgaactgcaaaaacgtcttatattttgatacggaggtagtatttcatagtttcttttaaacgtggagaaattatgctcgccccagtttgttctactgaacagttagcttgagaattc

SEQ ID NO: 2803 - DNA, 2451 bp, Triticum aestivum
gcttctcccccacctccccaaccccaacccactctacccagtctttctttctttctttcctaccaagcaacacctccaatcccacaccagtccgccacaaatctgatccgccccctccattcccacgaacccactccccgcccccctcgtcttggcacgagcgcgtcggcaccatcgccccggatcggagcaggggcggctccggcgctgatctccgctcagattcggatttagggtttttgggcgtggtcgcggtggtgggttcgctcggccggtttggaaatgtcggcggccgtggcgtgcgcagagagggcgacgagcgacatgctgatcgggcccgactgggccgtcaacatcgagctctgcgacatcatcaacatggatcccggacaagcaaaggatgcgcttaagctcctaaagaagcgccttgggaataagaattcaaaagtgcaaattctggccctttatgtgctagagactctaagcaaaaattgcggggatattgtttaccaacaaatcattgagcgtgatatactaagtgaaatggttaagatagtaaagaaaaagccagacttaaacgttcgggagaaaatattgagtctgattgacacatggcaagtggcttttggaggtccttccgggagatatccccagtaccacactgcgtaccaagaactcagggcagctggtgtcgattttccgcctcgcgaggagaatacagttccactgtttacacctcctcagactcaacctttgaggcagccacatctatatcctccaggtcaaagctatgaagatgtagctatacaagcttctctccaatctagtacccctgctgcacctcccctgagtctaagtgagatccagagtgctcgaggaattgtggatgtgctggatgagatgttaaatgcacttgaccacagacacccagagggtgtgagggaggaggtcattgttgaccttgttgggcagtgtcgttcttatcatgctcgtgtgatggatcttgttagcgatactggtgatgagagccttctgtttcaggctctaggactaaatgatgagttgcagcgtgttcttcagcgttatgatgacatagcaaaaggagtccctccaaatataccagtgcctgttgctggtaacataaaccaagggacagcccctcctcggcctgctggtgcttcatttgccccccttcttaatgtacaccatgaggacgatgaaccagaagatgagttctccgtgctttcccgcaggtctgcaagggatggcgcagcagcacagggcaacatgtcttctgttccaagaaatgaaaggccatacccaagcccacttcttcctccaccaccatcgacaaaaaggcctgtttacacagaggcaagcagtgtcgactatctaagtggggactcctataagtctgaaaaagtaccagatgattttgtcaacccaacggccccagccaatatgtctgcaccatctcattcaaaaacagaaacagatcaagtgccaaattatgatagcaggtcagaaaatgtgcccgatgacttcataaacccaactgcagcacccagtttttccatgccttctcgtcctacgagtgagccatctgtgaataagcttgagagccttcctgacgatgactttataaaccccactgcacttcctggtttttcttcgtcttcaactagtgaagatcttccaaaagctccatgggaagcgcaggctccagtttccctaccgcctcctcctgcaaggtatggccaaagacagcagttctttgagcaacagcatggctttcctggtgagaacaatgaaggtggctacgatgagatgctgacgcggacaggaagcctttctcttaatcaaaggaacactgagaatgggaagagcgcatcagtgtcgaccgcatcccgccagcccaaacctgaggatgcccttttcaaggatcttgttgattttgccaagaagaatccatcttctccatctaaaccagccaacagccgcaggactcgctgagtgatgagtgtttcagtcatgtaacacacataattgagttgccaagctgctggttttgctacaggttggcgaattagatataccatcaaataagagggttcggtcggtctgttctttattgcctcgggaattatttggtttgcgcattggacaattagaatcacaggtgtcagatacgtagtcatgatactgggtgtggtgtgtagcgagttgcatttctcacctttttcttgtgtggtattggttatcgattctggctttattttacttagctgtatatatttctccatttgacagcagtattctacatagttgagtttgcaatttgatcttgtaagacttgctccctctgtaccaatatctaagacggtttttgcagttcactttgaactgcgaagcgttttaaattttggacgtagtatttcatagttccttttc

SEQ ID NO: 2804 - DNA, 2263 bp, Triticum aestivum
aacacctccaatcccacaccagtccgctccaaatctgatccgcccccaccattcccacgaaccaactccccgttcccctcgtcttggcacgaggcgcgtcggccccatcgccccggatcggaggagaggcggctccggtgctgcctggcgccgacccccccgctcagattcggattagggtttttggacgtggtcgtcgtcttgggtttgcgccgctggtttgaaaatgtcggcggccgtgtcttgcgcagagagggcgacgagcgacatgctgatcggccccgactgggccgtcaacatcgagctctgcgacatcatcaacatggatcccggacaagcaaaggatgcacttaagctcctaaagaagcgccttgggaataagaattcgaaagtgcaaattctggccctttatgtgttagagactctaagcaaaaattgcggggatattgtttaccaacagatcattgagcgtgatatactaagtgaaatggttaagatagtaaagaaaaagccagacttaaacgtccgggagaaaatattgagtctgattgacacatggcaagtggcttttggaggtccttccgggagatatcctcagtaccacactgcgtaccaagaactcagggcagctggtgtcgattttccgcctcgcgaggagaatacagttccactgtttacacctcctcagactcaacctttgaggcagccacatctatatcctccaggtcaaagctatgaagatgtagctatacaagcttctctccaatctagtacccctgctgcacctcccctgagtctaagtgagatccagagtgctcgaggaattgtggatgtgctggatgagatgttaaatgcacttgaccacaggcaccccgagggtgtgagggaggaggtcattgttgaccttgttgggcagtgtcgttcttatcatgctcgtgtgatggatcttgttagcgatactggtgatgagagccttctgtttcaggctctaggactaaatgatgagttgcagcgtgttcttcagcgtcatgatgacatagcaaaaggagtctctccaaatataccagtgcctgttgctggtaacataaaccaagggacagcccctcctcggcctgctggggcttcatttgccccccttcttaatgtacaccatgaggacgatgaaccagaagatgagttctccgtgctttcccgcaggtctgcaagggatggcgcagcagcacagggcaacatgtcttctgttccaagaaatgaaaggccatacccaagcccacttcttcctccaccaccattgacaaaaaggcctgtttacacagaggcaagcagtgtcgactatctaagtggggaatcgtataagtctgaaaaagtaccagatgattttgtcaacccaacggccccagccaatatgtctgcaccatctcattcaaaaacagaaacagatcaagtgccaaattatgatagcagatcagaaaatgtgcctgatgacttcataaacccaactgcagcacccagtttctccatgccttctcgtcctacgagtgagccatctgtgaataagcttgagagccttcctgatgatgacttcataaaccccactgcccttcctggtttctcttcgtcttcaactagtgaagatcttccaaaagctccatgggaagctcaagctccagtttccctaccgcctcctcctgcaaggtatggccaaagacagcagttctttgagcaacaacatggctttcctggtgagaacaatgaaggtggctacgatgagatgctgacgcggacagaaagcctttctcttaatcaaaggaacactgagaatgggaagagcgcatcagtgtcgacagcatcccgccagcccaaacctgaggatgcccttttcaaggatcttgttgattttgccaagaagaatccatcttctccatctaaaccagccaacagccgcaggactcgctgagtgatgagtgtttcagtcatgtaacacacataattgagttgccaagctgctggttttgctacaggttggcgaattagatatgccatcaaataagagggttcggtcggtctgttctttattgcctcgggaattatttggtttgcgcattggacaattagaatcacaggtgtcagatacgtaatcatgatactgagtgtggtgtgtagcgagttgcatttctcacctttttcttgtgtggtattggttatcgattctggctttattttacttagctgtatatatttctccatttgacagcagtattct

SEQ ID NO: 2805 - DNA, 2458 bp, Triticum aestivum
ctccccaaccccaacccagtctaaccagtctttctttcccaccaagaacacctccaatcccacaccagtccgccacaaatctgatccgcccccaccattcccacgaaccaactccccgttcccctcgtcttggcacgaggcgcgtcggccccatcgccccggatcggaggagaggcggctccggcgctgcctggcgccgacccccccgctcagattcggattagggtttttggacgtggtcgcggtggtgggtttgcgccgctggtttgaaaatgtcggcggccgtgtcttgcgcagagagggcgacgagcgacatgctgatcgggcccgactgggccgtcaacatcgagctctgcgacatcatcaacatggatcccggacaagcaaaggatgcacttaagctcctaaagaagcgccttgggaataagaattcaaaagtgcaaattctggccctttatgtgttagagactctaagcaaaaattgcggggatattgtttaccaacagatcattgagcgtgatatactaagtgaaatggttaagatagtaaagaaaaagccagacttaaacgttcgggagaaaatattgagtctgattgacacatggcaagtggcttttggaggtccttccgggagatatcctcagtaccacactgcgtaccaagaactcagggcagctggtgtcgattttccgcctcgcgaggagaatacagttccactgtttacacctcctcagactcaacctttgaggcagccacatctatatcctccaggtcaaagctatgaagatgtagctatacaagcttctctccaatctagtacccctgctgcacctcccctgagtctaagtgagatccagagtgctcgaggaattgtggatgtgctggatgagatgttaaatgcacttgaccacagacaccccgagggtgtgagggaggaggtcattgttgaccttgttgggcagtgtcgttcttatcatgctcgtgtgatggatcttgttagcgatactggtgatgagagccttctgtttcaggctctaggactaaatgatgagttgcagcgtgttcttcagcgtcatgatgacatagcaaaaggagtccctccaaatataccagtgcctgttgctggtaacataaaccaagggacagcccctcctcggcctgctggtgcttcatttgccccccttcttaatgtacaccatgaggacgatgaaccagaagatgagttctccgtgctttcccgcaggtctgcaagggatggcgcagcagcacagggcaacatgtcttctgttccaagaaatgaaaggccatacccaagcccacttcttcctccaccaccattgacaaaaaggcctgtttacacagaggcaagcagtgtcgactatctaagtggggaatcctataagtctgaaaaagtaccagatgattttgtcaacccaacggccccagccaatatgtctgcaccatctcattcaaaaacagaaacagatcaagtgccaaattatgatagcaggtcagaaaatgtgcctgatgacttcataaacccaactgcagcacccagtttttccatgccttctcgccctatgagtgagccatctgtgaataagcttgagagccttcctgatgatgacttcataaaccccactgcccttcctggtttctcttcgtcttcaactagtgaagatcttccaaaagctccatgggaagcgcaagctccagtttccctaccgcctcctcctgcaaggtatggccaaagacagcagttctttgagcaacaacatggctttcctggtgagaacaatgaaggtggctacgatgagatgctgacgcggacaggaagcctttctcttaatcaaaggaacactgagaatgggaagagcgcatcagtgtcgaccgcatcccgccagcccaaacctgaggatgcccttttcaaggatcttgttgattttgccaagaagaatccatcttctccatctaaaccagccaacagccgcaggactcgctgagtgatgagtgtttcagtcatgtaacacacataattgagttgccaagctgctggttttgctacaggttggcgaattagatataccatcaaataagagggttcggtcggtctgttctttattgcctcgggaattatttggtttgcgcattggacaattagaatcacaggtgtcagatacgtagtcatgatactgggtgtggtgtgtagcgagttgcatttctcacctttttcttgtgtggtattggttatcgattctggctttattttacttagctgtatatatttctccatttgacagcagtattctacatagttgagtttgcaatttgatcttgtaagacttgctccctctgtaccaatatctaagacgtttttgtagttcactttgagctgcaaaaacgtcttatattttgatccggagtagtttctttcaacgtggagaaattatggaaacag

SEQ ID NO: 2806 - DNA, 2115 bp, Oryza sativa
aaatctcgcattatcttcttccccaatttgcgccgctactagtaggtgctagtctcgcctcgagcccaaatccagcctgctcgcgtcggccgatcgatcgatcataccacgggccgattcgtggctcgcgccgcgcggctggggtctaagctagggtttacgctcgcgaaaaaaaaaaagaaaagtgttgagcgaataatttgctcctagacctttgctgcttctcccctgtcgataaagccgaccacactgctcgcgtccccccgcgccgttcttttcggagattccgctcgcgcgcgccgccgccgccgcagccgcccgccggggagcccgggacgaggatggaggtcgtcgtggcgaggcagccgaaggcgaagaagcagataaacctcttctactgctccgagtgcgaggagctcgcgctcaaggtcgccgctagctccgacaccatccatctccagtccatcaactggaggagcttcgacgacgggttccccaacctgttcatcaacaacgcgcacgacatccgggggcagcacgtggcgttcctggcgtcgttcagctcgccgtcggtcatcttcgagcagatctccgtcatcttcgcgctgcccaagctgttcatcgcctccttcacgctcgtgctgcctttcttccccacgggctccttcgagcgcgtcgaggaggagggcgacgtcgccaccgcgttcaccctcgcgcgcatcctctccatgattcccaagtcccggggcggcccgaccagcgtcgtcatctacgacatccacgcgctccaggagaggttctacttcggggacgacgtcctcccctgcttcgagaccgggattccgctcctgctgcagcgcctccggcagctccccgatgctgacaatatcaccattgccttcccggatgatggggcgtggaagcgtttccacaagctattgctcaacttcccaatggttgtctgcgcaaaggttcgggaaggtgacaagaggatagttcgaattaaggaggggaatcctgaaggccggcatgtggttattgttgatgatttagtgcaatctgggggaactcttagagaatgtcagaaagttttggctgctcatggtgctgcaaaagttagtgcttacgtgactcatgctgtttttcccaagcagtcgtatgagcgcttcactcacactaattccgctgggtcagctgacaagtttgcgtatttctggatcactgactcctgccctcaaacagtgaaagccatcaaccaacaacctccatttgaggtgttgagccttgctggttcgattgcggatgcccttcaaatatgaactttgtttttggtaatgggctactcccatttttcctaaatgttagagttcactttcagctccagtaaaaacaaataatgtggagtgagttatcttaattatggctttggcctgacgtcttcataaacatctcaatatgtgatggtaaaataaggcatttgatgctcatctgttccttcttgagcaaagcgcacacaatcactgctttatttcctgacatgtatactactggaggctgagcacatctgcacaagtgctcgttttttgtcttgctcccgaaaaaagcgcttatttctgtcttaatattgatatgactgtttattaaaactcatgttttattctacattttgagttcttatagcaacacatgctggttgattagttggtactacctctgtttcacaatgtaagtcattctagaattttccacattcatgttgatgttagtagattcattaacatcaacatgaatgtgggaaatgctagaatgacttatattgtgaaatgaaggaagtatgttatttgggaagatgaattacctcttcaattcgttgtgcgttgtgttgtacgacagtgcattgtgtgctataggatggaatggatcacttcttttgaagacatcatatagatagctgatgtatagaaaagtggagcatacgtattctttccttctaactggctcctagtaaaagttgcataatgttctatcgagataattcatgctcctgacaagtaaaagtagaatagcctggtaatattttttcattctccgattattggtctggctcttttcttt

SEQ ID NO: 2807 - DNA, 1085 bp, Elaeis guineensis
ccgatacatctcttctactgcgcggagtgcgaagagctcgcgaggaaggttgcggagcaatccgacgccattcagctccaatccatctcttggagaagctttgatgatggattcccaaatctctttatcaagaatgcacatgatattagagggcagcacgttgcttttttagcttctttcagttctcctggagtaatttttgagcagatttctgcaatatttgcattgccaaaactcttcattgcctcctttacattggttttaccattcttcccaactggttctttcgaacgtgtggaagaagaaggagatgtggctactgcatttacaatggcacgcatattgtcaatgatccctaaatctaggggcggtccaaccagtgtggtcatctatgacatacatgctctgcaggaaagattctactttggggatgatgtcttgccttgctttgaaagtggtatacctctgttgttgcaacgtcttcgccagcttcctgatgccgataatgtaacaatagcattcccagatgatggtgcatggaagcgttttcacaagcaactgctaaattttcctatggttgtttgtgcaaaagttcgtgaaggtgataagaggatagttcgaattaaggaaggcaaccctgagggtcggcatgtcgtaattgttgacgacttggtgcagtctggaggcactcttattgaatgtcagaaagttttggctactcatggtgctgcaaaagttagtgcatatgtcacccatggtgtgtttcccaagcaatcatgggagcgattcctgcagaatggttctgaggggtcgccaaacaattttacttacttctggataacagactcctgcccacttactgtcaagaccatagcaaatagcgctccatttgaggtgctcagccttgctggatccattgcagatgctcttcaaatctaatactgcaataaagactggtattggaatggagatgaactttgcagatactatcctaatatttgtaaaaactcattaggactcgtgttaccatggagataagctgattcaattttggaagcaccaaaagatgatctgagagaaaatca

SEQ ID NO: 2808 - DNA, 1444 bp, Musa acuminata
agaagatagcttttcccttctaagatgatttgtatgcctttgggtgcattgatgtggcgactatattaccgactttggggaaaagtttccgtaaattctctttcttcgaatcgatttcctttcgggactcgacgagacggtgaagaaactttgggcttaggcggcagggcggcgttggtgcggggtgctgggcaatggcgatgaggacaaagaagcaggtaaacctcttctactgctccgagtccgaggagctggccaggaaggtggccgatcagtccgacgcaatccaactccggaccatctcttggagaaactttgatgatggattccctaaccttttcatcaacaatgcacatgatattagaggacaacatgttgcatttctagcctctttcagctcaccaggagtcatttttgagcagatatctgcaatttttgccttaccaaaactctttattgcttctttcaccttggtattaccattcttcccaaccggctcgtttgaacgaatggaagaagaaggagatgttgctactgcatttacgatggcacggatattgtcaatgattccaaagtctagaggtggaccaactagtattgtgatatatgatatacatgctttgcaggaaagattttactttggggatgatgtcttgccttgctttgaaactggtattccactattgttgcagcgccttcgcaaacttcctgatgctgataatgtaactatagcattcccggatgatggggcctggaagcgatttcacaagcaattgatgcattttcccatgattgtttgtgcgaaggttcgtgaaggtgacaagagaatagttcaaattaaggaaggtaatcctgcaggtcgacatgttgttattgttgatgatttggtgcaatctggtggcactctaattgaatgccagaaggttttgactgctcatggtgctggaaaagttagtgcttacgttacacatggtgtgttccccaagagatcatgggagcgatttgtgcatatcaaggctgagagatccgatcatcgatttgcaaacttttggataactgactcgtgtccgcttaccgtgaaggccattgctaatgaggctcctttcgaggtgcttagccttgctggctccatagcggatgccctgcaggtctaaattcttgtgcaccagctttgctgactctaactctgatggcagccctattaggtcattgagatgcttgtgctaagcttttgccagtcttttcagaatgaccctaataagagttcacactccaagcccacattccgctcttctttcagttctgttctttttgttctcttcagtatcataatatgatctttccgcttgtcttctcatccagcattccttccaaactaacttgtgttatgtttcgtcgcgtgcaatgagaaatcttcttcagctaattgcccaaaaatctagtt

SEQ ID NO: 2809 - DNA, 1162 bp, Phalaenopsis aphrodite
gcggaagccgaagagctcgcgcgcaaggtggcggagcaatcggattccattcagcttcggtccatagcatggaggagttttgatgatgggttcccaaatctctttatcaatgatgcacatgatattaggggacaacatgttgcctttttagcctctttcagctcaccggcagttatttttgagcaaatatctgcaatatttgctttaccaaaactctttattgcttcattcacgttggttctacctttcttccctaccggatcttttgagcgaatggaagaagagggagatgttgcgaccgcattcactatggcacgaatactttctatgatacccaaatctaggggtggcccaactagtgtggtcatctatgatatacatgccttgcaggaaaggttctattttggagatgatgttttaccttgttttgaaactgggatccccctcttgttactgcgcctccgccaactccctgatgctgataatataactatagcattccctgatgatggagcatggaagagatttcacaagcagttgcagcattttcctatggttgtttgcgcaaaggttcgtgaaggcgataaacgaatagttcgaatcaaagaaggaaatcctaacggtcgccatgttgttattgttgatgatttggtgcaatctggaggcactcttattgaatgtcagaaagttttggcaagtaatggtgctgctaaagttagtgcctatgtgacccatggtgttttccccaagcaatcatggcaacgttttgtacaaaataattccaatgatctcagtaactggttcacttacttctggatcactgactcttgcccgcttactgttaaagccattggtggtaagcctccatttgaggtactgagccttgcgagctccattgcagatgctcttcagatctgaggagcgttgtgctgagaagtgattctgatgcctcggaattagtaccctcgcagtttctaacacgcgaacttttttgaaatctgaaaatagcatctgatgcatttgtcattcgctcaagtggtaagagaattttatcaaggaatgaaagctttgcatcattggtggtattatttattagttatctttgagattttattctgtatgctgacatcggagaacaatataatatttatccctaaaagaa

SEQ ID NO: 2810 - DNA, 1316 bp, Papaver somniferum
cgaatagtcgcgacatctaagcggacgatggcaataattgcgacatctagggttttctttctgtttgaaaacacataaacccctctctttcgtccttgggaggaaataaaagacagtccaatctgatagcactcacagatacagagaagagatggagaagtgcaagcagaagaaagtgttgttattttactgtgttgagtcggaagatcttgctagaaaagttgctgcttcacagtccgattctatacaacttcagtctattaattggaggagctttgatgatggatttcctaatctattcatcaacaatgcgcaagatatccgaggccagcatgttgctttcttagcttctttcagttctccagctgtcatctttgagcaactctcagtcatctttgctcttcctaggttatttgttgcatcgtttacgcttgttttaccattctttccaaccggttcttttgaacgcatggaagaggaaggagatgttgcaactgcgtttaccatggcaaggatattatctaatatacccatatcaaggggaggtccaaccagtttggtcatctatgatatacatgctttgcaggaaagattttacttcggagatcacgttttgccatgtttcgagactggaatccccctattgaagcaacggcttgatcagcttcctgatgcagacaatattgtcgtggcatttccggatgatggagcatggaaacgtttctacaagcagttgcagcattatcccatggtcgtgtgtactaaagttcgcgaaggtgataaaagaatagttcgactcaaagaaggaaacccagctggccgccatgtcgtaattgttgatgatttggtgcaatctggagggaccctcattgagtgccagaaagttttggcagctcatggtgctactaaggttagtgcgtatgttacccatggtgtgttccctaagcgttcatgggagcgatttacatcctgcaatgaaaaggaggaatcagaaagagcattctcttacttttggatcacggattcctgctcgcacacagtgaaagctataggtgacagagctccttttgaggttctgagtctggctgggtctatcgccgatgcccttcagatctaatgacaaaaagcatctgatcttagagttggcatggtgcaaggaccaacccatggctgagtttatagaagaggttaaggctgtgatctctgatggttttctttgtctgctgtaaagcctgtaatactatgaagttaaatttttgtgcagaactgatggcttcaattaaatgatatttgaataatatacaaccaggaaaaaa

SEQ ID NO: 2811 - DNA, 812 bp, Zea mays
aatgacgagactgcccctcctccgtctctgcgccacccgctccctgggcggaagccctcaggaagccacgcgcacaccgcaactggtcgacgacgacttcctcgtctctctcctccggcctcgagtcgcctccgatccgtccgagaaaacaaaacaaaccgaaagaagaaaggcgacgaggaagagaaggctctccgcgagatctgggggagctcccattctcaagatgcacgacttctgcttcaccatcccctacgggttcgccgtgctggccggcggcgtgctgggctacctccgccgcggcagcaccgcctccctggcggggggcgccggcgccggcgcgctgctcctcctcgcgggcttcgtcagcctgaaggccttcgagaagagacgcaactcctacgtcgccctcgcgctcgagacgctttgtgcattagccttaactttcgttatggggcaaagattcctcgagacttcgaagattatgccagctggtgtcgttgctggcctcagtgctgtgatgtccgcgttttatctgttcaaaattgcaagcggcggcaaccacatcccaccaaagaaagagtaaactggactctaacttgtaaagtatgttcgattgaactcggaagactacgagccactgcgttatctagttgcatggtaacttcaggtactagcatcttgttctccatttgtggtgtggctagagtgtaccatggtttgtgaacattgtaaaagaaataagtatgcggttcacggaaatgaatatgaacttccctgtggcggcaggcgcgaaagaattaagaggtcta

SEQ ID NO: 2812 - DNA, 820 bp, Panicum virgatum
atgcacgacttctgcttcacgatcccctacgggttcgccgtgctggcaggcggcgtgctgggctacctccgccgcggcagcaccgcgtccctggcggggggcgccggcgccggcgcgctcctcctcctcgcggggttcgtcagcctcaaggccttcgagaagcggcgcaactcctacctcgccctcgcgctcgagaccctttgtgcattcgccttgacctacgttatgggacagagatacctagaaacttcgaagataatgccagctggtgttgttgctggtctcagcgccgtgatgtctgcattctatctattcaagattgcaactggcggcaaccacatcccaccaaagaaagagtaaaccaatgtttaacttgtaatatatgtttgattgaactcaaagatcacgaccgattgtgttgtctagttgcacggtaacttgagggactagtgatgctctccatttgtaattctgttagaatgtaccatggatctctgaactttgtacaagaaataaagattaaagatgtgattcacaaaacgaacgtggcgcgtgtgattgatcatggtgtctgctgcttgtggtgggtgaaaccgtggaagctgtttgtgggggtcggggctgtgacccgagtaatctatctttctctgccttgcccttgtggaggcagcagagaaagaagaacccttttcagatatcatatatccaattctcctgagaaaggcagcacgctaggagcttcatgttacaagcacaaagcgagagcaagaggcggcgatgtgcagccgcggaagaagcatcacccttgttcattcagcca

SEQ ID NO: 2813 - DNA, 591 bp, Cynodon dactylon
ggaaggaaaccttgcgagatcttggccggcgtcaagcgagatctgggccaggcgcgagcttgcggaaatgcacgacttttgcttcaccatcccctacggcttcgccgtgctggccggcggcttgctgggctacctccgccgcggtagcacggcgtccctggccggcggcgccggcgccggcgcgctccttctcctcgcgggcttcgtcagcctcaaggccttcgagaagcgccgcaactcctacgtggccctcgccatcgagacgctttgtgcattggccttgacttatgttatgggacaaaggttccttgaaacttcgaagataatgccagctggtgttgttgctggtctgagtgccttgatgtctgcattctatctgttcaaaattgcaaccggtgggaatcatatcccacccaagaaagagtagactggacttttgcttgtaaaatatgtgtaattgaactttgaactacgatcgatggtgttgcctaattgtatcgtaactttagaggtttccgttataattttgttagaatgttccatggacttctgaacaattcaaaagaaataaagattaaaagtgtcatcgat

SEQ ID NO: 2814 - DNA, 720 bp, Panicum virgatum
gacgacttcctcctcctccctccctcccttcccccctcgcgcccccggagaaaacaaaccaaaagaagaaagccacgccgcgagatctgggagagggagagagagagagagagagagagagagagagggagagagagagagagagagagagagagagagagagagaggcccccgcaagatgcacgacttctgcttcacgatcccctacgggttcgccgtgctggcaggcggcgtgctgggctacctccgccgcggcagcaccgcgtccctggcggggggcgccggcgccggcgcgctcctcctcctcgcggggttcgtcagcctcaaggccttcgagaagcggcgcaactcctacctcgccctcgcgctcgagaccctttgtgcattcgccttgacctacgttatgggacagagatacctagaaacttcgaagataatgccagctggtgttgttgctggtctcagcgccgtgatgtctgcattctatctattcaagattgcaactggcggcaaccacatcccaccaaagaaagagtaaaccaatgtttaacttgtaatatatgtttgattgaactcaaagatcacgaccgattgtgttgtctagttgcacggtaacttgagggactagtgatgctctccatttgtaattctgttagaatgtaccatggatctctgaactttgtacaagaaataaagattaaagatgtgattcacaaaacg

SEQ ID NO: 2815 - DNA, 648 bp, Pennisetum glaucum
ctctctctctctctctcccaccgcgcccccggagaaaacaaaccaaaagaagaagaaagcagcgagggagcagcctcgccgcgagatctgggactgggtgggagagagagaggcgtctcgaagatgcacgacttctgcttcacgatcccgtacgggttcgctgtgctggccggcggcgtgctgggctacctccgccgcggcagcaccgcctcccttgcggggggcgccggcgccggcgcgctcctcctcctcgcgggctttgtcagcctcaaggccttcgagaagcggcgtaactcctacctagccctcgcgctcgagaccctttgcgcattcaccttgacctacgtcatggggcagagatacctagaaacttcaaagataatgccagctggtgttgttgctggtctgagtgctgtgatgtccgcattctatctattcaagattgcaaccggtggcaaccacatcccaccaaagaaagagtaaaccaagttttaacttgtaatatatgtttgattgaactcaaaggtcacgagcgattatgttgtctagttgcatgataacttcagggactagtgatgttctccatttgtaattctgttagtgtgtaccatggagttctgaactttgtacaagaaataaagattaaag

SEQ ID NO: 2816 - DNA, 734 bp, Saccharum officinarum
gactttctcgtctctctcctcccgcctcgcgtcgcctccgatccgtccgagaaaacaaaccaaaccaaaagaaggcaaaggcgacgagcgagggggagaaggctcgccgcgagatctgggagagctccggtccccattccccaagatgcacgacttctgcttcaccatcccctacgggttcgccgtgctggccggcggcgtgctgggctacctccgccgcggcagcaccgcctccctggtggggggcgccggcgccggcgcgctcctcctcctcgcgggcttcgtcagcctcaaggccttcgagaagcgccgcaactcctacgtcgccctcgcgctccagacgatttgtgcattagccttaacttacgttatggggcaaagattccttgagacttcgaagattatgccagctggtgtcgtcgctggtctcagtgccgtgatgtccacgttttatctgttcaaaattgcaaccggtggcaaccacatcccaccgaagaaagagtaaaccaggctttaacttgtaaactatgtttgattgaactcgaagactacgagcaattgtgttgtctagttgcatggtaacttcaaggactagcatcttggatactatgctctcatttgtaatgaggctagaatgtaccatgatttgtgaacaatgtaaaagaaataaagatgtgattcgcgggtcacctgatatgggtaacccgaatgccccaaaactccctgccctaaac

SEQ ID NO: 2817 - DNA, 773 bp, Setaria italica
aatgaccaaactgcccctccacctctgcgccacccgctccttcgccgcaagccgcgcaggccgccacgcgcacaccccaactggtcgacgacgacttcctccctcccacctcgcccccggagaaaacaaaccaaaagaagaaagcagctagggagcagcctcgccgcgagatctgggactgggagatagagagagaggcgccccgaagatgcacgacttctgcttcacgatcccctacgggttcgccgtgctggccggcggcgtgctgggctacctccgccgcggcagcactgcctccctcgcggggggcgccggcgccggcgcgctcctcctcctcgcggggttcgtcagcctcaaggccttcgagaagcggcgcaactcctacctcgccctcgcgctcgagaccctttgtgcattcgccctgacctacgttatggggcagagatacctagaaacttcaaaggtaatgccagctggtgttgttgctggtctcagcgccttgatgtctgcattctatctattcaagattgcaaccggtggcaaccacatcccaccaaagaaagagtaaaccaagatttaacttgtaatatatgtttgattgaactcaaaagatcacgaccgattatgttgtctagttgcacggtaacttcagggactagtgttgttctccatttgtaatttctgttagaatgtaccatggagctctgaactttgtacaagaaataaagattaaagatgtgattcacggaagcgaatgtgatgttactgacgca

SEQ ID NO: 2818 - DNA, 1015 bp, Oryza sativa
cggctggtgagtgggtggcacacttctcttctctccgtctccctcccggtcatcgattagccgcctgaaatgacgaaagtgcgcctcccgccgcagaccagaccgaccaccgatcgacgacttctctccgcggcgcaccacggattagccaaaaataagcgagagcgagtacgagagagattgagagagagagtcagagagagagagaagaaactgctctcgagatctcaccggcgaggcggggcgagatctggtaagagagaaggagggagggaggccgagagagcgagatgcacgacttctgcttcacgatcccctacggcttcgccgtcctggccggcggcgtgctgggctacgcccgccgcggcagcaccgcctccctggccggcggcgcgggcgccggcgcgctcctcctcctcgcgggcttcgtcagcctcaagaccttcgagaagcgccgcaactcctacctcgccctcgccctcgagaccctatgtgcactagctttgacttatgttatggggcagagataccttgagacttcaaagataatgccagctggtgtcgttgctggcctcagtgctttgatgtctgcgttctacctgttcaaaattgcaactggtggcaaccatatcccaccgaagaaagagtgaaccaggctttgcttgtgaagcatgttttgttatactctaagactacgacagatttgtgttgtggagtttcattgtaagtccagtgatcagcaaagccatttttcgcctgtaattctttagagtgcacttctgatgtctgaacaatgtaaaagaattaaatatttaacttcctacggtacgtgtatatgaatgatatactcctgaactttttaactggccttcctccccctaatctctatataccaaacatatatatccattgatggatgtaatggtagacctgatggtgtttccaccatcatattcaacattatccttccatgctgctttcctttactaaagccggtttgttcggttaatctctc

SEQ ID NO: 2819 - DNA, 1264 bp, Sorghum bicolor
ggctagctgttgtctgttgacatgtttgaaacactgaacttaaacttgaattaattttgagctggctgtactcttttcctttctagggtttctcccacaagggtgggtttacctagaaaggtttttaatgaggcagcattgcacaaacagctcattttgcatcttctgttgtgattctgtgctttttctgttgtgattctgtgctttttctctttgaaatgaaattgtatcatgtttttttcatatgctgtgagactgccctgtgatatgcttgtcgggctgtgggccggcccgaggtaccgggctgaacgggcggcacggcccgggaaaatggcccacggaccggaccatgggccgcaccctcggcccgcagcacggtagtggcccggcacggtcggcccgtggcccgacgtggcccgccccgtgccgtgccggcacgggccggcccgttgtacatctatacccgcaggaagccacgcgcacaccgcaaccgcaaccggaacaggtcgacgacgactttcttcgcgtctctctcctcccgcctcgcctcgcctcgcctccgatccgtccgagatagtataaagaaggcacaaaggcgacgagggagggggagagtaggctcgccgcgagatctgtgagagctccccacccattcttcccaagatgcacgacttctgcttcaccatcccctacgggttcgccgtgctggccggcggcgtgatgggctacctccgccgcggcagcaccgcctccctcgcggggggagccggcgccggcgccatcctcctcctcgcgggcttcgtcagtctcaaggccttcgagaagcgccgcaactcctacgtcgccctcgcgctccagacgctttgtgcattagccttaacttacgttatggggcaaagataccttgagacctcgaagattatgccagctggtgttgttgctggtctcagtgccgtgatgtcagtgttttatctgttcaaaattgcaaccggcggcaaccacatccctccaaagaaagagtaaaccaggctttaacttgtaaactatgtttgattgaacttgaagactacgagcgattgtgtttgtctagttgcatggtaacttcagggactagcatcttgttctccttttgtaatgtggctagaatgtaccatggtttgtgaacaatgtacaagaaataaatatgcgattcacggaaatgaatgtgatgttactgaggcaggcgtgtgatcttgttgattgcttgtttgctggtgcgtagaag

SEQ ID NO: 2820 - DNA, 718 bp, Hordeum vulgare
ataaggcgcacaagcacaagtcgacgaccaaaaaacagaggaagaagaagaaaaggcaaggcctccaagatctcggctccgcgagagatctgagagagagagaggtgcttcggagatgcacgacttctgcttcacgatcccctacgggttcgcggtcctggccggcggcctgctgggctacctccgccgcggcagcaccgcctccctggcgggcggcgccggcgtgggcgggctcctcctcctggcagggttcgtcagcctcaaggccttcgagaagcgccgcaattcctacctcgccctcgcactcgagaccctttgcgcactggccttgacctttgttatggggcaaagataccttgaaacttcaaagataatgccggctggtgtcgttgctggtctcagtgctctgatgtcggcattctatctattcaaaattgctaccggcggcaaccatttcccgccaaagaaagagtagaccaggcgtccttggccaaactcaaagaccatagatggcacatattgtgttctgcattggaattgtaacttgagtgatgatctatgttgtgcttgcactcttgctgaatgttttgtatgcggacttggaaagtactcaccatgtaaaagaaccaacatttggaaatgtgcttcgctgaggcgcaaacttgtcttaattgcctgttgtccatgagcagaagtaaataattcttcttctttgact

SEQ ID NO: 2821 - DNA, 689 bp, Triticum aestivum
cgcgcacaagcacaagtcgacgaccaaaaacagaggaagaagaagaaaaggccaggcctccaagatctcggctgcgagagagagatctgagagagacggaggtgcttcggagatgcacgacttctgcttcacgatcccctacgggttcgcggtcctggccggcggcctgctgggctacctccgccgcggcagcaccgcctccctggcgggcggcgccggcgtgggcgggcttctcctcctggcagggttcgtcagcctcaaggccttcgagaagcgccgcaactcctacctcgccctcgcactcgagaccctttgcgcactggccttgacctttgttatggggcaaagataccttgaaacttcaaagataatgccggctggtgtcgttgctggcctcagtgctctgatgtcggcattctatctattcaaaattgctaccggtggcaaccatttctcgccaaagaaagagtagaccagacggtgcttggccaaacccaaagaccatatggcatattgtgttctgcattcgaattgtaacttgactgatgttctatgttgtgcttgcacctttgctcaaatgttttgtatgtggacctggaaagtattcaccatgtaaatgaactaacatttcaattgtgcttcgctgaggcgcaaacttgtcttagttgcctgttgtcattgagcaaaaa

SEQ ID NO: 2822 - DNA, 981 bp, Brachypodium distachyon
accaaagcgccctccgttgcagccaccacaccggctcttttcttttcttcgtcgctgaccaccgcgcgcacacattcgacgaccaaaacagaggaagaagaaaagagaaggttctcgagatctcagcggcgagagagatctgcgaggaagagagacggtgctgcttccgagatgcacgacttctgcttcacgatcccctacgggtttgcggtcctggcaggcggactcataggctacctccgtcgcggcagcaccgcctccctggccggcggcgccggcgtcggcgggctgctcctcctggcgggattcgtcagccttaaggccttcgagaagcgccgcaactcctggctcgccctcgccctcgagaccctctgcgcgctggcgttgacctatgttatggggcaaagatacctggaaacttcgaagataatgccagccggtgtcgttgctggtctcagtgctctgatgtctgcattctatctatttaaaattgcaaccggtggcaatcatatctcaccaaagaaagagtaaaccacggttttcttgcaagatgtgttttggccaaactagaagactgctgcaggttgtgttgtgcatttgcattgtaaacctcaatgatgttgttatttcctgtttgtgctgctattccaatgtatcgtggagttctgacgtgctcaccgccatgtagaagaagtgaatattttgaatgtgcttcaccgaggcgcaagttttatattaattgctagctatccatgtgctttaaacaagatgatggctgttataattatcgattgttatatgaatgaacaatggtgggtgtctcgtatgctttttgttacggatgctgatatgagttgtcattggaaaagcattacccaattttgatggttggaaaaattataatgtgctcgaacttcatgattcaaattttcaatgcgatggtatgttcatagcaataaatttatgtagcaaggcccggga

SEQ ID NO: 2823 - DNA, 664 bp, Pseudoroegneria spicata
  misc_feature (34)..(35): n is a, c, g, or t
  misc_feature (39)..(40): n is a, c, g, or t
  misc_feature (42)..(42): n is a, c, g, or t
  misc_feature (48)..(48): n is a, c, g, or t
accaggcgcacacgcacaagtcgacgaccaaaannagannangaaggnctccaagatctcggctccgagagagagatctgagagagaggtgcttcggagatgcacgacttctgcttcacgatcccctacgggttcgccgtcctggccggcggcctgctgggctacctccgccgcggcagcaccgcctccctggcgggcggcgccggcgtaggcgggcttctcctcctggcaggattcgtcagcctcaaggccttcgagaagcgccgcaattcctacctcgccctcgcactcgagaccctttgcgcactggccttgacctttgttatggggcaaagataccttgaaacttcaaagataatgccggctggtgtcgttgctggtctcagtgctctgatgtcgttattctatctattcaaaattgctacgggtggcaaccatttctcaccaaagaaagagtagaccagatgtgcttggccaaactgaaagaccatatacggcatatcgtgctctgcattcttggaattgtaacttgagtgatgctctatgttgtgcttgcactcttgcttgtgtgttttgtatgcggacttgggaaagtattcaccatgtaaaagaaccaacatttgaaatgtgtttcgctgaggcgcaaacttgtcttaaaaaaaaa

SEQ ID NO: 2824 - DNA, 635 bp, Secale cereale
ccaaaaacagaggaagaagaagaaaaggcaaggtctccaagatctcggctccgagagagatctgagagagaggcgcttcggagatgcacgacttctgcttcacgatcccctacgggttcgcggtcctggccggcggcctgctgggctacttccgccgcggcagcaccgcctcactggcgggcggcgccggcgtgggcgggcttctcctcctggcaggattcgtcagcctcaaggccttcgagaagcgccgcaactcctacctcgccctcgcactcgagaccctttgcgcactggccttgacctttgttatggggcaaagataccttgaaacttcaaagataatgccggctggtgtcgttgctggcctcagcgctctgatgtcggcattctatctattcaaaattgctaccggtggcaaccatttctcgccaaagaaagagtagaccagacggtgcttggccaaactcaaagaccatattggcatattgtgttctgcattgaattgtaacttgactgatgctctgtgttgtgcttgcacctttgctcaaatgttttgtacgcggacctggaaaatattcaccatgtaaatgaactaacatttcaattgtgcttcgctgaggcgcaaacttgtctta

SEQ ID NO: 2825 - DNA, 705 bp, Secale cereale
gactcttctgcgcagaccaccaggcgcacaagcacaagtcgacgaccaaaaacagaggaagaagaagaaaaggcaaggtctccaagatctcggctccgagagagatctgagagagaggcgcttcggagatgcacgacttctgcttcacgatcccctacgggttcgcggtcctggccggtggcctgctgggctacttccgccgcggcagcaccgcctccctggcgggcggcgccggcgtgggcgggcttctcctcctggcaggattcgtcagcctcaaggccttcgagaagcgccgcaactcctacctcgccctcgcactcgagaccctttgcgcactggccttgacctttgttatggggcagagataccttgaaacttcaaagataatgccggctggtgtcgttgctggcctcagtgctctgatgtcggcattctatctattcaaaattgctaccggtggcaaccatttctcaccaaagaaagagtagaccagacggtgcttggccaaactcaaagaccatattggcatattgtgttctgcattcgaattgtaacttgactgatgctctatgttgtgcttgcacctttgctcaaatgttttgtatgcggacctggaaagtattcaccatgtaaatgaactaacatttcaattgtgcttcgctgaggcgcaaacttgtcttaattgcctgttgtcattgagcaaaa

SEQ ID NO: 2826 - DNA, 808 bp, Triticum aestivum
accattggccccttctgcgcaggccaccacgcgcacaagcacaagtcgacgaccaaaaacagaggaagaagaagaaaaggcaaaggcctccaagatctcggctccgagagagatctgagagagaggtgcttcggagatgcacgacttctgcttcacgatcccctacgggttcgcggtcctggccggcggcctgctgggctacctccgccgcggcagcaccgcctccctggcgggcggcgccggcgtgggcgggcttctcctcctggcagggttcgtcagcctcaaggccttcgagaagcgccgcaactcctacctcgccctcgcactcgagaccctttgcgcactggccttgacctttgttatggggcaaagataccttgaaacttcaaagataatgccggctggtgttgttgctggcctcagtgttctgatgtcggcattctatctattcaaaattgctaccggtggcaaccatttctcgccaaagaaagagtagaccagacggtgcttggccaaactcaaagaccatatggcatattgtgttctgcattccaattgtaacttgactgatgctctatgttgtgcttgcacctttgctcaaatgttttgtatgcggacctgggaagtattcaccatgtaaatgaactaacatttcaattgtgcttcgccgaggcgcaaacttgtcttaattgcctgttgtcattgagcaaaagtaaatacacctaatttcttgttcttcgattaatcatgcagaattgatgtctggatcatggtgtgtgatgtgataagttacacggcttaaaacttc

SEQ ID NO: 2827 - DNA, 373 bp, Triticum aestivum
ctcgcgtgtcaagcagtggtatcaacgcagagataccttgaaacttcaaagataatgccggctagtgttgttgctggcctcagtgttctgatgtcggcattctatctattcaaaattgctaccggtggcaaccatttctcgccaaagaaagagtagaccagacggtgcttggccaaactcaaagaccatatggcatattgtgttctgcattccaattgtaacttgactgatgctctatgttgtgcttgcacctttgctcaaatgttttgtatgcggacctgggaagtattcaccatgtaaatgaactaacatttcaattgtgcttcgccgaggtgcaaacttgtcttaattgcctgttgttattgagcaaaaa

SEQ ID NO: 2828 - DNA, 716 bp, Avena sativa
cacaccgggtcatcggctcctctctcctcttttcttcgcgcagaagtcgacgaccaaaccagacgaataagaaagaaaagagaagagaagagaagagaaggttcccaagatctcagttgagagagatctgagacaggggtgtggttccgagatgcacgacttctgctttacgatcccctacgggttcgcggtcctggccggcggcttgctgggctacctccgccgcggcagcaccgcctccctggcggggggagccggcgtaggtggcctgctcctcctggcgggcttcgtcagcctcaaggctttcgagaagcgccgcaactcctacctcgccctcgccctcgagaccctctgtgcggttgccttgacctttgttatgggacaaagataccttgaaacttcaaagataatgccagctggtgtcgttgctggtctcagtgctgtgatgtctctgttctatgtattcaaaattgctaacggcggcaaccatttctcaccaaagaaagagtagaccagtactacagtagtattttgcttgtaagacatgtttcgccaaactgaacgaccacggcatactgtgttgtgcatccgcattgtaactccattgatgttgttattttctgtttgcttgaatgcatgcacgtgaacttgtaacgtgtccgccatgtaaaagaatgaacaactcagatgtgcttcgctgaggcttatattgatct

SEQ ID NO: 2829 - DNA, 2643 bp, Sorghum bicolor
cacgcaacggcggcggcggtgaaaaagggtggggactgggagggagtaggactgtgggaggagggagaaaggaggctgctttccctgtcgcgggtgtcaccgcaccaccctcactggcagcgctgacggcggcaggcaagaaaagtggtgatcgctccaaaatcagattgagatggcagagaccttgaatgtatcgcccgatgatgccaatgggagcgctgcagttcagactgagccttcatcccatgaagacgccgccattgaggatatggaatctttcttggttgaagtggatgaagtaaaggacaagtttcatgtttttggagttgtgaataaagctatcatcaagggaatcctaagtgatgtgcaacaagaagctgctagtcaaattgctctcaaggatgcggagatagcatcactgaaccaaaagctgcagcaactaggaaatggcagcttgagtttatccgaggggcgggacaagagacatgatgaattttatagtctccgccagcagcttgactccatttccaagtcactcttgaattctgagtgggggctttcgggatcacagcataactttgaagatgaaaatgcgagcaagcagcaggacaaggaaaaaccctctagaaatggtgtagcaaagaccattggtccgggagagtccaaagaagtagtttttggtgatccaaaacttctggaccacatggataaggctgctttgatatctcatttcaataaatcgatgaatgagatgaaaaggcagcatgattcagttctgcacgagaggacggaagagatattcaagctgaagcgtgaaatcctaaagaaggatggatcaaacccttttcatttacggaataacaaagaacttgagcaaaccaggaagaaaatggaggaagtcatctcgaagttggatgtgctcctcttggagaataaaagaaaccctgttcgtatcaagtcaaacacaattcctggtcaacaagataagaacaatgtattagattctgaaatccagcaactagaaagtggtgcaagtaataatgaagaagacgattgctctattccaactcactcttcacattttgcatccagagaggcagatcatgaactgaatattgtaaggcttgaatctgacgttgaagatgccagaattgcagccacctttagagaagagatagaaaggattatcataaaagagttcattagtgaaataaatgttgaattgcatggttttgagatcgagggtgatatgaagcaggaagtttgctcaataattcacaatgaggctgttgctagagcaatgtcaaacattgattctttgttgtcgaagtatgaggagaaaaagagtcatgctgaagaggaatctctacataagcaaaatattgaaaaactgaaactaattgtggattctttcactgaagtagtgagtgaaaaggagaaatttatatcacagattggattggaagcaatgcagattcgcgtggagtcaatgtgtcgtgaacttgttttgctaagagacaaaatggcaaagcaagattcctacctatctgaaaagaacagggagtttggtgtcattatgggcaggttggagcaagcgcggcagcatgttcaacacaatgatgttactttggttgagctgaatggtagacttagaaccatttcagactctaaaaaggacttagaaaaacagaatcaagctctacataatgtcattgaagaaaaggagaagatgctaacattggctgtttctaaagacaactatatgagaaaattcatggaaaatgttgttaaatctatcagagattttgaaattctcatgatggatcaacaagctgttgttgcaaataaagtccagcacattgaatcaaggttctgtttcttaaaagaacaatgtaaacaccttgcaaaagaaggcaatcttttaagaaagaaggcattgcgatacaaagagatatctgaggcaagaggctctaatcttcagaaagctgaacttgaggtggatttgcttggtgatgaggttgaggccttaacaaatcttcttgcaaaaatctatactgcacttgatcactattctcctgtccttcaacactacacgggcgttatggagaccttgaacatgattaagaaacatattagcatgacaaagtaaaatgcttttggtcggcttgacattgtagaattgtaggcttgacagcaggcttccagtggtttgagataagtttgtagaattttaggtggcagcaagcttttggttccgactcaaggactaggtaatgcagactggattgctctcttttgcaggcagtagtagtcttagtagcttttgagcactttgtaaatgacccaaccgtagctattagttcttatgtttggcttttgatgccatgggctttgccacctgctatgctgggttgcaaaggtttactcttgtaacagtgacctactgtgttgaactgtggactgacacgggtagccgagaggatgttaaagaggccgagtttttgagatgataataacttcttttttttctggcacaatggcagatgaatccacacattactctggccagctgtgatcgtttgatctggatttgctatccttttgatccttgctattgacaattaatagtttttgaaacttgac

SEQ ID NO: 2830 - DNA, 1389 bp, Sorghum bicolor
cgaaaatagtcggcaggggcactttggtcaatccacgccaacggcaatcgcacggccgacacacatgacacatgcggcgagagagcagcggagcaggtgcgcacgaaaaaagccataaaagagagcgagctcgcagcgcagatcgaacgggagaagagaacaagagatacctctgctcgccagctcaccctgctccagttctccttccactcccacactcccagccgagctcgcgcgcacgcacaggcacagcacacacgcgcaagcaggagctcctgctagatcccaaactgtcctctgcccgcccgcgcgcgttgcggggggcgcaagcaaaggatcatcggatggcgacgatgttcgcgcggccggtgctggccgccctgctgctgccggcgttcctgctctccgccgccggggccgccgacagcaaggacaaccctgccgatcagctcgttgcattgatcaacagcaaccgtactgccagcaaggcttctgctgtttctgataatcaaggtttaggatgcattgctctgcagtacatcagagcatatgaaggtcattgtgaccaggtggatgacaagaagccgatggagtcaagtttcaccgacacatttgccccaacctgtggcgtccaagccacaactctttccaagattactggtaggcttgtgggctgccagtccaagtatgcgactccagctgaggcctttaacatcctggtgaatgatgcgaagggccttcaaatattgcacagcaagaaccacacagaggttggggcagctgtgagtggcaccgatggtggtggaccttacttctggtgtgtcctgttcagtgacgggaagcctactaccagcttcaaggtggatggcgaagtgcccaaggcggccatccatccagggtgcttcagtggcaacaatgacgactgcatgggcgcgacgaatggcgccatttcgaccaatgctggtgcatcgaggctggtggcggcccttccttttgctgtagcttgtgcctttgctttgtgagcttgtaagtaggtgtgatgttttcggccattattttgctttgtgaaaaggagctgaacaccgtctcctgtttgcagtggcacgccattcttttgcttctctgagcatatgaactatacatgcaaggatttatagatcagtattcaacatttcagactatcatttatagatcattgttcagcatttgagactatcatttatagatcattgttcagcattttagactatctgttacctgttcagagtgttcatcatagtaactttgtgcttgtgcattcttttagcacgtttgctatgactataagagctatttgagcaaagctgattgttcgtagcatgcgatttctgatgccagatgctctgtttt

SEQ ID NO: 2831 - DNA, 2665 bp, Sorghum bicolor
gcaacgataaaaaggcaagggaaacaaaaggaagcatcacgagataaaagagaggaggctggccggcgaccagtactcgccacagctagacgccgctaggctgttgtgtcctgtgtgcggaatcgccgctctcggccgccgccgctggtgtccctccctccctcttgcgccgcctgtccccgcacccctcgcactcgaaacctttccccaacagatttcgtcctggtgtgggcggctgttgcttgtggatacgtttcatctctatatatctcactgctttggattcttcttcctgatttgccaagagaggcccagaagaggaagcacgcaggaaccaaccaaccagtcatcgaatcggcgtgcggcggtctggtgattttaagggtcgagatcgtgttcttgggaggctgagggacaagagctcccttcctgtcctctttcctgcggcttgtcttggtccaagagggcaaaactcgccgggaggaaatggcggaggtgaagccggaggagataagccatccgcccatggagcagctccaggggttcgagtactgcatagactcgaaccctccctggggcgaggcgatcatactgggcttccaacactacatactggcgctgggcacagcggtgatgatcccggcggtgttggttcccatgatgggtggcgacgatggagacagggtcagggtggtgcagacgctgctgttcgtgacggggataaacacgctgctgcagtccctcttcgggacccggctgccgacggtcatcggcggctcctacgcgttcgtgatcccgataatggccatcatccaggaaccgtcgctttcggggatagccgatggtcaccagaggttcctcgagaccatgaaggcgatacagggggcactgatagtgtcctccagtattcagatcatcctgggctacagccagctgtggggtattttctccagatttttcagtccagtggggatgactccagtggttgcgctgctgggatttggccttttcgaaagaggtttccctgtggttgggagatgcgtggagattggcttgccaatgctgattctctttgttgtgctctctcagtatctgaagaatatacaaataaaagaaattcccatactggaaaggttctcccttttcatctgtatcgcattggtatgggcatatgctcaaatcctcacttcaggtggagcctataagaatagctctgaggtcactcagaacaactgccgcactgacagagccaatctgatctcttctgccccatggattaagattccttacccgttgcaatggggtgcaccaaccttcaatgctggccagtcatttggtatggtgtctgctgttttggtctcgctagtagagtccactgcctcttacaaagctgctgctcggcttgcaagtgcgactccacctccggctcatatcctgagtagaggcattgggtggcagggaatcggcatccttcttgatgggctctttggaacggggactggatccactgtctcagtggagaacgttgggttgcttgggtcgacaaggattgggagccggcgcgttatacagatctcagctggcttcatgatatttttctccatactggggaaatttggagctttgttcgcttctatcccattcaccatctttgcagctgtgtactgcgtcttgtttggactagttgctgcagtggggctgtccttcttacagttcactaacatgaactccatgcgcaacctctttatcgtcggcgtctccatcttcctgggcctgtccgtgccggaatactttttccggtacaccatggctgctcaccgtggtcctgcgcacaccaaagctggatggttcaacgactacatcaacaccatcttctcgtcaccgccgacggtggggttgattgtggccgtgttcctggacaacacgctggagatgaaggacgcgggcaaggaccgggggatgccgtggtggctgcggttccgggcgttcaagggcgacagcaggaacgaggagttctacagcctgccattcaacctcaaccgcttcttccctccggcgtaaacccggccgcttctctggaacaagtcacactcagattgctgagcccagctttgatttgtgtaggagatcgatcgagttgcccacattgtttgattcgttgatctctagctgtttcatgttgtagattatcttggggaggggaggtctcctagtatgctactgaccaacccagtaaaaatggtcgcctaccgtttttgttatacttgttagtacatgcgtgtaccgtcgtctatctccggccagccatagcgaatgccgtgcaatctgcggcggtccaatgctccagtgagtcttgtcctgtcctgcaccagcatccgggatggatggcgcgccggagcaggaatcctatgtgacggaagtggacgttacgtccgtaagaagactgagaagcaaatcgtggtggagtatgtgcacgcttccagtcccctcacttcacgcgcggacgcagcactgcctagctcaccaggccgccaatggcagggcagcagctgggcgtgcgcgtgccgcgtgcgcctgacagacagctacgaactcgcaatgccatgacgcggatgatcatgagtaggtcacgcacggctcgcttgctctggtcgcagattctcgc

SEQ ID NO: 2832 - DNA, 2068 bp, Setaria italica
ctaacagatttcgtcctggtgctcgccagcaacgggcggcggttgccggtggagacgtttcatctctatctccccgcttggctgcttcttctcgctttgccgtgagaggcccagcgcgcaggattttaaggcgtgctgctggtgggtgattttaagcgaagagaccgtgttcttggggggccgagagacagagctctctatctgtcctgtttccgggttcttttggtcgaagaggcagagctcgtcgaggggcaatggcggaggcgaagccggaggagatcagccatccgcccatggagcagctccaggggtttgagtactgcatagactccaaccctccctggggggaggcgatcatacttgccttccagcactacatactggcgcttggcacggcggtgatgatcccggcggtgttggttcccatgatgggtggcgacgatggggacagggtgcgggtggtgcagacgctgctgttcgtgacggggataaacacgctgctgcaatccctcttcgggacgcggctgccgaccgtgatcggcggctcctacgcgttcgtgatcccgatagtggccatcatccaggactcgtcgctcgcggcgatacccgatggccacgagaggttcctcgagaccatgagggcaatacagggggcactgatagtgtcctccagtattcagataatcctgggctacagccaactctggggcattttctccagattcttcagtccagtggggatggcgccagtggttgctctgctaggatttggccttttcgaaagaggattccctgtggttgggagatgcgttgaggtcggtttgccgatgctgattctctttgttgtactctctcagtatctgaagaatatacaaataaaagatattcccatactggaaaggttctcccttttcatctgtatcgcgttggtatgggcatatgctcaaatcctcacttcaggtggtgcctataagaacagcactgaggtcactcagatcaactgccgcactgaccgagccaatctgatctcctctgctccatggattaagattccttacccactacaatggggggcaccaaccttcaacgctggccaatcatttggtatggtgtctgccgttttggtctcactagttgagtccacagcatcttacaaagctgctgctcgtcttgcaagtgcgactccacctccagctcatatcctgagtagaggcattggatggcagggaatcggcatcctccttgatgggctatttggaacgggcactggctccactgtctcagtggagaacgtcgggctgcttggatcgacaaggatcgggagccggcgtgttatacagatctctgccggtttcatgatctttttctccatgctggggaaattcggagcgctgtttgcttccatcccattcaccatcttcgcagccgtgtactgcgtcttgtttgggctcgttgctgcggtggggctgtccttcttgcagttcactaacatgaactccatgcgcaacctctttatcgtgggcgtctccatcttccttggcctatccgtgccggagtactttttccggtacaccatggctgctcagcgtggtcctgcgcacaccaaagccggatggttcaacgactacatcaacaccatcttctcatcgccgccaacggtggggctgatcgtggccgtgttcctggacaacacgctggagaccaaggacgcaggcaacgaccggggcctgccgtggtgggtgcggttccggtcgttcaagggggacagcaggaacgaggagttctatagcctgccgttcaatctcaaccgcttcttccctccggcctagaccgggcgggcgatcttaccgcctaccgagagtgatgaaaaagaaaaggaggaagcggccggtctctgcttctctggatgaactcagattgctgagcggagggatagtagtagctgtgtgtagtagtagctggccattgtttgattcgttgatctgtagttgttcatgtctttagatcgttgttgccttgttgggaggtcccccaacccagtaaaaatggttgcctaccgttttacctc

SEQ ID NO: 2833 - DNA, 2100 bp, Panicum virgatum
aaacccagtcagcccagcgataaaaatgccagccagcaaagaaaaaagggtggcagccaccagcacgagataaaaagaggccggccggccggcgaccagtactccaccctgtactcgccgctgctagacgccgctgcccagcgtgcggaatcgctcccggccgccgccgctgctagtgtccctccccgccccctctcgaaactttttctccggctagctaacagatttcgtcctggtgctcgccagcaacgggcggcggtttcccgtggagacgtttcatctctatctccctgcttggctgcttcttctcgctttgccgagactctcaggcccggcagaggaaagccagcgcgcagggatcaccaaccggataggcgtgcggcgaggagaccgtgttctcgggagaccgagagacagagctcttcctgtcctatttccggcttcgtcggggcgaagaggcgaagggaaatggcggaggcgaagccggaggagatcagccatccgcccatggagcagctccaggggttcgagtactgcatagactccaaccctccctggggcgaggcgatcatactggccttccagcactacatactggcgctcggcacggcggtgatgatcccggcggtgttggttcccatgatgggtggcgacgatggggacagggtgcgggtggtgcagacgctgctgttcgtgacggggataaacacgctgctgcagtccctcttcgggacgcggctgccgacggtgatcggcggctcctacgcgttcgtgatcccgattgtagccatcatccaggactcgtcgctcgcgccgatacccgatggacacgagaggttcctcgagaccatgagggcgatacagggggcactgattgtgtcctccagcattcagatcattctgggctacagccaactctggggtattttctccagattcttcagcccagtggggatggcgccagtggttgcgctgctcggatttggccttttcgaaagaggattccctgtggttgggagatgcgttgaggtcggcttgccaatgttgattctctttgttgtactctctcagtatctgaagaatgtgcaaataaaagatattcccatactggaaaggttctcccttttcatctgtattgctttggtatgggcatatgctcaaatcctcacttctggtggtgcctataagaacagcactgaggtcactcagatcaactgccgcactgaccgagccaatctgatctcctctgccccatggattaagattccttacccactacaatggggggcaccaaccttcaacgctggccaatcatttggtatggtgtctgctgttttggtctcactaatagagtccacagcctcttacaaagcagctgctcgtctcgcaagtgcaactccacctccagctcatatcctgagtagaggcattggatggcagggaatcggcatcctccttgatggcctttttggaacggggactggctccactgtctcagtggagaacgttggtttgcttggatcaacgaggatcgggagccgacgggttatccagatctctgccggtttcatgatctttttctccatgctgggaaaattcggggcgctgtttgcttccatcccgttcaccatcttcgcagccgtgtactgcgtcttgtttgggctcgtcgctgcggtggggctgtccttcttgcagttcactaacatgaactccatgcgcaacctctttatcgtcggcgtctccatcttcctcggcctttcagtgccggagtactttttccggtacaccatggctgctcagcgtggtcctgcgcacaccaaagctggatggttcaacgactacatcaacaccatcttctcgtcgccgccgacggtggggctgatcgtggccgtgttcctggacaacacgctggagaccaagggcgcggccaacgaccggggcctgccgtggtgggcgcggttccggtcgttcaagggggacagcaggaacgaggagttctacagcctgccgttcaacctcaaccgcttcttccctccggcctgaacccccggccgatcttcctgcctaccattgccgagagataaactaaaagaggtggaa

SEQ ID NO: 2834 - DNA, 2376 bp, Brachypodium distachyon
gttcccctgaaggagggaagaagaacaccgcccccttcaaagacgagagaaagcattaacccggcaggaacaacagcaacccgaggataaaaggaaaagggaagggggagagggaggaaagaaagaaaggagaggcaccacgacacaaagaacggctggcgaccagcagtaggacgtccgccagtagccgtcgacgctggcaacagtgcgaattgctgctcttggcgctgctcgcctcgcgacttttccccaactgatttcgtcctggtttccttgcaaaggccactgggagtgttgtagtagtaggaggagtggaagcaagcctgctatatccgtccgtttggctgtttcttccactcgcattcgcgataaggcagagaagaagagggtgcacgaggatcatcccgtcggcggcgtgcggtggtcacctccataagcgaggtgaaatcgtgccgtgtgaggaacacagaggccggcgtgtttctttcgcatttttttttctctatttccttctcggcctcggtgcgagttgtcaacaaggggggaagaagaaatggcagaggtgaagccggaggagatcagccatccggccatggagcagctccaggggttcgagtactgcatagattccaaccctccatggggggaggcgatcatactgggcttccagcactacatcctggcgctgggcacggcggtgatgatcccggcggtgttggtgccaatgatgggtggtacagatggagacagagtgagggtggtgcagacgctgttgttcgtgaccggcataaacacgctgctgcagtcgctgttcgggacgcgactgccgacggtgatcggcggctcctacgctttcgtggtcccgatcatggccatagtacaggactcgtcgctcgcagggatacctgacgaccatgagaggttcctccaaagcatgagggccatacagggggcactgatagtgtcctccagtattcagatcattctgggttacagccagctgtggggtattttctccagattcttcagtccactggggatggcgccggtggtcgcgctgctcggttttggcctttttgaaagaggattccctgtggttgggagatgcgttgaggttggcctgccaatgttgatcctatttgttgtgctttcccagtatctgaagaatatacagataagagatattcccatactggaaagattctccttgttcatttgtatcgcattggtttgggcctatgctcaaatcctcacttctggtggcgcgtataaacatagcagtgaggtcactcagaacaactgccgcactgaccgtgccaatctgatctcttccgccccatggattaagatcccatatccactgcaatggggggcaccaacattcagtgctggccaatcgtttggtatggtgtctgcagttttgatctcgctgatagagtccacagcttcttacagtgctgcagcacggcttgcaagtgcgactccacctccagcccatatcctgagcagaggcatcgggtggcagggaatcggcatcctcctcagtggcctatttggaacggggactggctccactgtatcagtggagaatgtggggctattaggatcaacaaggatcgggagccggcgcgttatacaaatctctgctggtttcatgatctttttctccatgctgggaaaattcggggcgctgttcgcttccattccattcaccatcttcgctgccgtgtactgcgtcttgttcgggctagttgctgcagtggggctctccttcttgcagttcaccaacatgaactccatgcgcaacctctttatcgtgggcgtctccatcttccttggcttatctgtgccggagtacttcttccgctacagcatggctgctcaacgtggtcctgcgcacacaaaagctggatggttcaacgactacatcaacgcgatcttctcgtcgccgccgacggtggggctgatcgtggccgtgttcctggacaacacgctggaggtgaaggacgcggggaaggaccgggggatgccgtggtgggtgcagttccggtcgttcaagggggacaccaggaacgaggagttctacagcctgcccttcaacctcaaccgcttcttccctccctcctaaacaaaccgtcaagtcaaagtggggaggggattgatgagggaaaaagaaaaagaaaaagagagtttgtctgatgatgaatgatgtgatcgtctgccgcgtgtttgtctgaaacaactcagaatgttgagcagaggcaaaatagagagggttagatgttttagctgttcgttgattccattcgttatttatttttgtatgtctatgctcgtagattgtgataatatagttggtgtttttttttagctgtt

SEQ ID NO: 2835 - DNA, 2537 bp, Oryza sativa
gaaagaaagatgttccagatttgcaatttgtcctaggattattagagtaagaaagtgtagcatcttcggtaaactaaaacaaaacgaagaaacagcagcgtgttttactcgcaggattaggaaaaaaaaaaaagaacggctagtcgtagggagtagttaatgcacgaaggggaaactggtgagtggcggaggggcaattcggtcacaccaaaaaagccaacggccagttcagtttcccggaaggagggaagaagcactcgaaacacggataaaagggggaaaaaatggagaagcaaaagggagagaagaagaaagcaccacgacgacaaacggccccagtgagcgagtgtgaggaccaaggctgacgaacgagtgtgagagtgaacagtagccgcgccggcgagagtgcgaatttgctctttgcgctgcctccctctctcacgcagacgagccatcctctctcgcggctttttctccaacagatttcgtcctgatctccccccctgcggaagggggacgctgccgtgtgccgtgccggagcgcgtacgctgaataagcccccacctggctggctccagaagccttctcgagagagaggccaaggagagagcacgcagcggcgcctacataagcgaggaacccgtgtgttttcctgttcccgtgtgttttcattgctcggcggcgggatcctgacgggcaaagaagagggtggtggtgcggcgacgatggctgaggtgaagccggaagagatcagctacccgcccatggagcagctgcaggggttcgagtactgcatcgactccaaccctccctggggggaggcgatcatactgggattccagcactacatcctggcgctgggcacggcggtgatgatcccggcggtgctggtgcccatgatgggcgggagcgacggggacagggtgagggtggtgcagacgctgctgttcgtcaccggcatcaacacgctgctgcagtcgctgttcgggacgcgcctgcccacggtgatcggcggatcctacgcgttcgtggtcccgataatggccatcatacaggactcatcgctcgccgccatacccgacgaccacgagaggttccttcagaccatgagggcgatacagggggcactcatcgtgtcctccagcattcagatcatcctcggctacagccagctgtggggcattttctccagattcttcagcccgttggggatggcgccagtggttgcattgctcgggtttggccttttcgaaagaggattccctgtggttgggagatgcgttgaggttggacttccaatgttaattctgtttgtcgtgctttctcagtatctgaagaatgtacagataagagatattccaatactggagaggttctccctgttcatctgcatcgcgttggtttgggcctatgctcaaatcctcactgcaggtggcgcgtataagcatagccctgaggtcactcagatcaactgccgcactgaccgtgccaatctcatctcttccgcgccatggattaagatcccttttccactacaatggggcgcaccaactttcagtgccggtcaatcctttggtatggtatctgctgttctggtatcgctagtagagtccacggcttcttacaaagctgcggctcggcttgcaagtgctactccacctccagcacatatcctcagtagaggcattgggtggcagggaattggtatccttcttgatgggctatttggaacgggtactggctccaccgtgtcagtggagaatgtcgggttgttaggatcaacgaggatcgggagccgacgagttatacagatctctgccggcttcatgatcttcttctccatgctaggaaaatttggagcattgtttgcttccatcccatttaccatctttgcggccgtgtactgcgtcttgtttggactagttgcggcagtggggctctccttcttgcagtttactaacatgaactccatgcgcaacctctttatcgtcggtgtctccatctttcttggcctatctgtgcccgaatactttttccggtacagcatggccgctcagcgtggccctgcgcacacaaaagctggatggttcaacgactacatcaacactatcttctcatcgcctccgacggtcggactgatcgtggccgtcttcctggacaacacgctggaggtgaaaaacgcggccaaggaccgggggatgccatggtgggtaccgttccggtcgttcaagggggacgccaggagcgaggagttctacagcctgcccttcaacctcaaccgcttcttccctccgtcttaaaaccagcacggggagaagtttgagggaaacggggatttcgtcgctgatgcgcgatcgaatcgtttgtgtctgtgtcagaaagaactcagaatgctgagcagaggcaatgtagatgttcttctagttggccattatttcattcgttgattttgttgtgcttatgctggtgaggtgaaagtagccgcgcactctgtcccgttgcagaaatgatctgcttcctcgatcaaaagagagccg

SEQ ID NO: 2836 - DNA, 2279 bp, Triticum aestivum
gcacgaggcgacggcacgagaaaggctggcgactcactccagtggcgtagcggtacgctagcggccagccgcagtatctctagcgtcgtagtgccgcggattgctcttgccgttcgcacttcgccgctcgcttgctcaccatcatcatccccgcagcctttttccccaacagatttcgtcggggctcctgcaaaggtgcgccgaggctcttgagtgctgcgggtggaggaagcaagccccccgtccggttgtcttcttcccccgccagaggacaaggagcggtcacaagggatcaccgccagggccgccgtgcggtgcggtggttgccttcataagccagggagggaagcaaccctgtgggctgtggagtgcggtacagaggagcggcgtttcttctttctttcttcttcctctcggcggcggtgcgaggccagcaaggggagatgtcggaggtgaagccggaggagatcagccacccggccatggagcagctccaggggttcgagtactgcatcgactccaaccctccatggggggaggccatcatactgggcttccagcactacatcctggcgctgggcacggccgtcatgatcccggcggtgctggtgcccatgatgggcgggagcgacggagacagggtgagggtggtgcagacgctgctcttcgtcaccggcatcaacacgctgctgcagtcgctcttcgggacgcggctgccgacggtcataggcggctcctacgccttcgtcatcccggtgatggccatcgtgcaggactcgtcgctcgcggccatacccgacgaccacgagaggttcctccagagcatgagggccatacagggggcgctcatagtgtcctccagcattcagatcatccttggttacagccagctctggggtattttctccagattcttcagtccactgggaatggcgccggtggttgcgctgctcggttttggtctcttcgaaagaggattccctgtggttgggagatgcgttgaggttggcctgccaatgttaatcctctttgttgtgctttcccagtatctgaagaatgtacagataagagagatccccatactggaacgattctccctgttcatctgtatcgcattggtctgggcgtatgctcaaattctcacttctggtggcgcgtataatcatagcaccgaggtcactcagatcaactgccgcactgaccgtgccaatctgatctcttccgccccatggattaagatcccataccccctgcagtggggggcaccaaccttcagtgccggccaatcgttcggtatggtgtctgcggttttggtctcgctaatagagtccacagcttcttacagcgctgcagctcggcttgcaagtgcaactccacctccagctcacatcctgagcagaggcatcgggtggcagggaatcggcatcctcctttgtgggctctttggaacagggaccggctccactgtctcagtggagaacgtggggttactaggatcaacgaggatcgggagccgccgcgtcatacaaatctgtgctggcttcatgatcttcttctccatgctggggaaatttggagcgctgttcgcttccatcccgttcaccatctttgccgcggtgtactgcgtcctgttcggactagttgctgcggtggggctctccttcttgcagttcaccaacatgaactcgatgcgcaacctgttcatcgtcggcgtgtccatcttccttggcctgtccgtgccggagtacttcttccgctacagcatggctgcccagcgtggtcctgcgcacactaaagctggatggttcaacgactacatcaacaccatcttctcgtcgccgccgacggtggggctgatggtggccgtgttcctggacaacacgctggaggtgaaggacgctggcagggaccgcgggatgccgtggtgggtgcccttccgctccttcaagggggacagcaggaacgaggagttctacagcctgccattcaacctcaaccgcttcttccctccctcgtaaacgctccagggataaaaggaagaaaggacatggtttctttcttggctgatgcgatcatgtgcgcggctgttctgatcggagtgttgttgaacagtggaaatagtagatgtgtattgcctctagctggtcattgtttcattcgttcattttctttgttatctatatgcttgtagatcggggtggggaggtgccggctcggtgaaccaaccctgtcgtatgtagttcctgtttttgaccattccgcaaacaagatcatgtatg

SEQ ID NO: 2837 - DNA, 2356 bp, Triticum aestivum
gcacgaggcgacggcacgagaaaggctggcgactcactccagtggcgtagcggtacgctagcagccagccgcagtatctctagcatcgtagtgccgcggattgctcttgccgttcgcacttcgccgctcgcttgctcaccaccatcatcatccccgcagcctttttccccaacagatttcgtccgggctcctgcaaaggggcgccgaggctcttgagtgctgtgcgcggcggaagcaagcccccgtccggttgtcttcttcccccgccagaggacaaggagcggtcacaagggatcaccgccagggccgccgtgcggtgcggtggctgccttcataagcgagggagggaagcaatcctgtggagtgcggtacagaggagcggcgtttcttctttctttcttcttcctctcggcgacggtgcgaggccagcaaggggagatgtcggaggtgaagccggaggagatcagccacccggccatggagcagctccaggggttcgagtactgcatcgactccaaccctccatggggggaggccatcatactgggcttccagcactacatcctggcgctgggcacggccgtcatgatcccggcggtgctggtgcccatgatgggcgggagcgacggagacagggtgagggtggtgcagacgctgctcttcgtcaccggcatcaacacgctgctgcagtcgctcttcgggacgcggctgccgacggtcataggcggctcctacgccttcgtcatcccggtgatggccatcgtgcaggactcgtcgctcgcggccatacccgacgaccacgagaggttcctccagagcatgagggccatacagggggcactcatagtgtcctccagcattcagatcatccttggttacagccagctctggggtattttctccagattcttcagtccactgggaatggcgccggtggttgcgctgctcggttttggtctcttcgaaagaggattccctgtggttgggagatgcgttgaggttggcctgccaatgttaatcctctttgttgtgctttcccagtatctgaagaatgtacagataagagagatccccatactggaacgattctccctgttcatctgtatcgcattggtctgggcgtatgctcaaatcctcacttctggtggcgcgtataatcatagcaccgaggtcactcagatcaactgccgcactgaccgtgccaatctgatctcttctgccccatggattaagatcccatatcccctgcagtggggggcaccaaccttcagtgccggccaatcgttcggtatggtgtctgcggttttggtctcgctaatagagtccacagcttcttacagcgctgcagctcggcttgcaagtgcaactccacctccagctcacatcctgagcagaggcatcgggtggcagggaatcggcatcctcctttgtgggctctttggaacagggaccggctccactgtctcagtggagaacgtggggttactaggatcaacgaggatcgggagccgccgcgtcatacaaatctgtgctggcttcatgatcttcttctccatgctggggaaatttggagcgctgttcgcttccatcccgttcaccatctttgccgcggtgtactgcgtcctgttcggactagttgctgcggtggggctctccttcttgcagttcaccaacatgaactccatgcgcaacctgttcatcgtcggcgtgtccatcttccttggcctgtccgtgccggagtacttcttccgctacagcatggctgcccagcgtggtcctgcgcacactaaagctggatggttcaacgactacatcaacaccatcttctcgtcgccgccgacggtggggctgatggtggccgtgttcctggacaacacgctggaggtgaaggacgctggcagggaccgcgggatgccgtggtgggtgcccttccgctccttcaagggggacagcaggaacgaggagttctacagcctgccattcaacctcaaccgcttcttccctccctcgtaaacgctccagggataaaaggaagaaaggacatggtttctttcttggctgatgcgatcatgtgcgcggctgttcggatcggagtgttgttgaacagtggaaatagtagatgtgtattacctctagctggtcattgtttcattcgttcattttcttgttattatctatatgcttgtagatcggggtggggaggtgccggctcggtgaaccaaccctgtcgtatgtagttcctgtttttgaccattccgcaaacaagatcatgtatgtggcctaccgtggtgtgatatagttgtactccctcccgaaatgctcaatggagagctcggcctccgtggaggccaaattt

SEQ ID NO: 2838 - DNA, 2256 bp, Secale cereale
ggcgactctggtggcgcagtggcacactagctagcagccagccgcagtatctctagcagtagcgtagcgcggattgctcttgccgctctcccgctcactcaccaccatcatcctctcgcagcctttttccccaacagatttcgtccgggctcctgcaaaggggcgctgaggctcttgagtgctgtgggtggaggaagcaagcccccgtccggttgtcttcttcccccgccagcggacaaggagcggtcacaagggatcaccaccagggccgccgtgcgccttcataagcgagggagggaagcaatcctgtggagtgcggtgcagagaaggagcggcgtttcttctttcctcttcctctcggcgtgcgacggtgcgaggccaagaaggggagatgtcggaggtgaagccggaggagatcagccacccggccatggagcagctccaggggttcgagtactgcatcgactccaaccctccatggggggaggccatcatactgggcttccagcactacatcctggcgctgggcacggccgtcatgatcccggcggtgctggtgcccatgatgggcgggaacgacggagacagggtgagggtggtgcagacgctgctcttcgtcaccggcatcaacacgctgctgcagtcgctcttcgggacgcggctgcccacggtcataggcggctcctacgccttcgtcgtcccggtgatggccatcgtgcaggactcgtcgctcgcagccatacctgacgaccacgagaggttcctccagagcatgagggccatacagggggcgctgatagtgtcctccagcattcagatcatccttggttacagccagctctggggtattttctccaggttcttcagtccactgggaatggcgccggtggttgcgctgctcggttttggtctcttcgaaagaggattccctgtggttgggagatgcgtggaggttggcctgccaatgttaatcctctttgtcgtgctttctcagtatctgaagaatgtacagataagagagatccccatactggaacgattctccctgttcatttgtatcgcattggtctgggcgtatgctcaaatcctgacttctggtggcgcgtacaatcatagcaccgaggtcactcagatcaactgccgcaccgaccgtgccaatctcatctcttctgccccatggattaagatcccatatcccctgcagtggggagcaccaaccttcagtgccggccaatcgttcggtatggtgtctgcggttttggtgtcactaatagagtccacagcttcttacagcgctgctgctcggcttgcaagtgcaactccacccccagcccatatcctgagcagaggcatcgggtggcagggcattggcatcctcctttgtgggctctttggaacagggaccggctccactgtctcagtggagaacgtggggttgctgggatcaacgaggatcgggagccgccgcgtgatacaaatctgtgctggcttcatgatcttcttctccatgctggggaaatttggagcactgttcgcttcaatcccattcaccatctttgctgccgtgtactgcgtcctgttcggactagttgcggcggtggggctctccttcttgcagttcaccaacatgaactccatgcgcaacctgttcatcgtcggcgtgtccatcttccttggcctgtccgtgccggagtacttcttccgctacagcatggctgcccagcgtggtcctgcgcacactaaagctggatggttcaacgactacatcaacaccatcttctcgtcgccgccgacagtggggctgatggtggccgtgttcctggacaacacgctggaggtgaaggacgccggcagggaccgcgggatgccgtggtgggtgcccttccgctccttcaagggggacagcaggaacgaggagttctacagcctgccattcaacctcaaccgcttcttccctccgtcgtaaacgctccagggatgaaagaaaggacggaaggaagaaaggacatggtttctttcctggctgatgatgatgcgatcgtgtgcgcgtctgtcggatcggaatgctgtttatcagtggaaatagtagatgtgtattaccgctagctggtcattgtttcattcgttcatttcgtttgttacttatatctatatatgcttgtaatcggggtggggaggtgccggctcggtgaaccaaccctgtgatatagtagtagttcctgtttttgaccattccgcaaacaagatcatgtatgt

SEQ ID NO: 2839 - DNA, 2300 bp, Triticum aestivum
agtggtgtagtggtacgctagcagccagccgcagtatctctagtatcgtagcagcgcggattgctcttgccgttcgcacttcgcccctcgcttgctcaccaccatcatcatcctcgcagcctttttccccaacagatttcgtccgggctcctgcaaaggggcgccgaggctcttgagtgctgtgcgcggcggaagcaagcccccgtccggttgtcttcttcctccgccagaggacaaggggcggtcacaagggatcacccacagggccgccgtgcggtgcggtggctgccttcataagcgagggagggaagcagtcctgtggagtgcggtacagaggagcggcgtttcttctttcttcttcctctcggcgacggtgcgaggccagcaaggggagatgtcggaggtgaagccggaggagatcagccacccggccatggagcagctgcaggggttcgagtactgcatcgactccaaccctccatggggggaggccatcatactgggcttccagcactacatcctggcgctgggcacggccgtcatgatcccggcggtgctggtgcccatgatgggcgggaacgacggagacagggtgagggtggtgcagacgctgctattcgtcaccggcatcaacacgctgctgcagtcgctcttcgggacgcggctgccgacggtcataggcggctcatacgccttcgtcatcccggtgatggccatcgtgcaggactcctcgctcgcagccatatctgacgaccacgagaggttcctccagagcatgcgggccatacagggggcactgatagtgtcgtccagcattcagatcatccttggttacagccagctctggggtattttctccagattcttcagtccgctgggaatggcgccggtggttgcgctgctcggttttggtctcttcgaaagaggattccctgtggttgggagatgcgttgaggttggcctgccaatgttaatcctctttgttgtgctttcccagtatctgaagaatgtacagataagagagatccccatactggaacggttctccctgttcatctgtatcgcattggtctgggcgtatgctcaaatcctcacttctggtggcgcgtataatcatagcaccgaggtcactcagatcaactgccgcactgaccgtgccaatctcatctcttctgcgccatggattaagatcccatatcccctgcagtggggggcaccaaccttcagtgccgggcaatcgttcggtatggtgtctgcggttttggtgtcgctaatagagtccacagcttcttacagcgctgcagctcggcttgcaagtgcaactccacccccagctcacatcctgagcagaggcatcgggtggcaggggattggcatcctcctttgtgggctctttggaacagggaccggctccactgtctcagtggagaacgtggggttactaggatcaacgaggatcgggagccgccgcgtcatacaaatctgtgctggcttcatgatcttcttctccatgctggggaaatttggagcgctgttcgcttccatcccgttcaccatctttgccgccgtgtactgcgtcctgttcggactagttgctgcggtggggctctccttcttgcagttcaccaacatgaactccatgcgcaacctgttcatcgtcggcgtgtccatcttccttggcctgtccgtgccggagtacttcttccgctacagcatggctgcccagcgtggtcctgcgcacactaaagctggatggttcaacgactacatcaacaccatcttctcgtcgccgccgacggtggggctgatggtggccgtgttcctggacaacacgctggaggtgaaggacgcgggcagggaccgcgggatgccgtggtgggtgcccttccgctccttcaagggggacagcaggaacgaggagttctacagcctgccattcaacctcaaccgcttcttccctccctcgtaaacgctcgtgggataaaaggaagaaagggcatggtttctttcttggctgatgcgatcatgtgcgcggctgttcggatccgagtgttgttgagcagtggaaatagtagatgtgtattacctctagctggtcattgttttattcgttcattttcttgttattatctatatgcttgtagatcggggtggggaggtgccggctcggtgaaccaacccttcctgtttttgaccattccgcaaacaagatcatgtatgtggcctaccgtggtgtgatatagttgtactccctcccgaaatgctcaatggagagctcggcctccgcgaggccaaattta

SEQ ID NO: 2840 - DNA, 1977 bp, Hordeum vulgare
ctctctctcgctctctttgccgttccttctctattcttcctcctctcggcgacggtgcgaggccaagaaggggaaatgtcggaggtcaagccggaggagatcagccacccggccatggagcagctgcaggggttcgagtactgcatagactccaaccctccgtggggggaggccatcatactgggcttccagcactacatcctggcgctgggcacggccgtcatgatcccggcggtgctggtgcccatgatgggcggcagcgacggagacagggtgagggtggtgcagacgctgctgttcgtcactggcatcaacacgctgctgcagtcgctcttcgggacgcggctgcccacggtcataggcggctcctacgccttcgtcgtcccggtgatggccatcgtgcaagactcgtcgctcgcggccatacctgacgaccacgagaggttcctccagagcatgagggccatacagggagcactgatagtgtcctccagcattcagatcatccttggttacagccagctctggggtattttctccaggttcttcagtccactgggaatggcgccggtggttgctctgctcggttttggcctcttcgaaagaggattccctgtggttgggagatgcgttgaggttggcctgccaatgttaatcctctttgttgtgctttcccagtatctgaagaatgtacagataagagagatccccatactggaacgattctcgctgttcatttgcatcgcattggtctgggcctatgctcaaatcctcacttctggtggcgcgtataatcatagcaccgagatcactcagatcaactgccgcactgaccgtgccaatctcatctcttccgccccatggatcaagatcccatatcctctgcaatggggggcaccaaccttcagcgcaggccaatcgttcggtatggtatctgcggttttggtctcgctaatagagtccacagcttcttacagcgccgcatctcggcttgcaagtgcaactccacctccagcccatatcctgagcagaggcatcgggtggcagggaatcggcatcctcctttgtgggctctttggaacaggcaccggctccactgtctcagtggagaacgtggggttactaggatcaacgaggatcgggagccgccgcgtcatacaaatctgtgctggcttcatgatcttcttctccatgctggggaaatttggagcgctgttcgcttccatcccgttcaccatcttcgccgcggtgtactgcgtcctgttcggactagttgctgcggtggggctctccttcttgcagttcaccaacatgaactccatgcgcaacctgttcatcgtcggcgtgtccatcttccttggcttatccgtgccggagtacttcttccgctacagcatggccgcccagcgtggtcctgcgcacactaaagctggatggttcaatgactacatcaacaccatcttctcgtcgccgccgacggtggggctgatggtggccgtgttcctggacaacacgctggaggtgaaggacgccggcagggaccgcgggatgccgtggtgggtgcccttccgctccttcaagggggacagcaggaacgaggagttctacagcctccccttcaacctcaaccgcttcttcccgccgtcgtaaaacggcaacgctggagggataaaagggatggaaggaagaaggctgatgcgatcgtgtgcgcggctgttcggtgttgccgagcagtggaaatactaggatgtgtattatcgctagctggtcattgtttcattcgttcattttgttttgttatctataatgtgcttgtggatcggggtgcggaggtgccggctcggtgaaccaaccctgtgatatagtagtagttcctgtttttgaccattccgcaaacaagatcatgtatgtggcctaccgtggtgtgatattatagtagtactcccccctgaaatgctcaatggagctcggtggtac

SEQ ID NO: 2841 - DNA, 2510 bp, Hordeum vulgare
ccggaaagcatttaaccctcccgaggataaaaggaaaaggggaggcgagagagggaaaggagaggagaggcaccaccaccaccacggcaccaaggctgtcgaccgtagcagcagcagcacgctagccagcagccagccgcggtatcatagcagcgccgcggattgctcttggcgttggccaccttcatcctcatcctcatcctcgcacgcagccttcctttccccccaccccaacggatttcgtcctggctcctgcaaaggggcgccgaggctcttgagtgccgtgtgtgccggaagcaagccggttgtcttcttcctccgccagaggacaaggggctgtcacaaggtccgccaccagggccgccgtgcggccttcataagcgagcagagtgcggtacagagaagcgctcggttttatcttctctctctctcgctctctttgccgttccttctctattcttcctcctctcggcgacggtgcgaggccaagaaggggaaatgtcggaggtcaagccggaggagatcagccacccggccatggagcagctgcaggggttcgagtactgcatagactccaaccctccgtggggggaggccatcatactgggcttccagcactacatcctggcgctgggcacggccgtcatgatcccggcggtgctggtgcccatgatgggcggcagcgacggagacagggtgagggtggtgcagacgctgctgttcgtcactggcatcaacacgctgctgcagtcgctcttcgggacgcggctgcccacggtcataggcggctcctacgccttcgtcgtcccggtgatggccatcgtgcaagactcgtcgctcgcggccatacctgacgaccacgagaggttcctccagagcatgagggccatacagggagcactgatagtgtcctccagcattcagatcatccttggttacagccagctctggggtattttctccaggttcttcagtccactgggaatggcgccggtggttgctctgctcggttttggcctcttcgaaagaggattccctgtggttgggagatgcgttgaggttggcctgccaatgttaatcctctttgttgtgctttcccagtatctgaagaatgtacagataagagagatccccatactggaacgattctcgctgttcatttgcatcgcattggtctgggcctatgctcaaatcctcacttctggtggcgcgtataatcatagcaccgagatcactcagatcaactgccgcactgaccgtgccaatctcatctcttccgccccatggatcaagatcccatatcctctgcaatggggggcaccaaccttcagcgcaggccaatcgttcggtatggtatctgcggttttggtctcgctaatagagtccacagcttcttacagcgccgcatctcggcttgcaagtgcaactccacctccagcccatatcctgagcagaggcatcgggtggcagggaatcggcatcctcctttgtgggctctttggaacaggcaccggctccactgtctcagtggagaacgtggggttactaggatcaacgaggatcgggagccgccgcgtcatacaaatctgtgctggcttcatgatcttcttctccatgctggggaaatttggagcgctgttcgcttccatcccgttcaccatcttcgccgcggtgtactgcgtcctgttcggactagttgctgcggtggggctctccttcttgcagttcaccaacatgaactccatgcgcaacctgttcatcgtcggcgtgtccatcttccttggcttatccgtgccggagtacttcttccgctacagcatggccgcccagcgtggtcctgcgcacactaaagctggatggttcaatgactacatcaacaccatcttctcgtcgccgccgacggtggggctgatggtggccgtgttcctggacaacacgctggaggtgaaggacgccggcagggaccgcgggatgccgtggtgggtgcccttccgctccttcaagggggacagcaggaacgaggagttctacagcctccccttcaacctcaaccgcttcttcccgccgtcgtaaaacggcaacgctggagggataaaagggatggaaggaagaaggctgatgcgatcgtgtgcgcggctgttcggtgttgccgagcagtggaaatactaggatgtgtattatcgctagctggtcattgtttcattcgttcattttgttttgttatctataatgtgcttgtggatcggggtgcggaggtgccggctcggtgaaccaaccctgtgatatagtagtagttcctgtttttgaccattccgcaaacaagatcatgtatgtggcctaccgtggtgtgatattatagtagtactcccccctgaaatgctcaatggagctcggtggtacaaaatgcatgtacatgtgggtaaatttttaggacgaaatatgttaaaacgagtgctacaaaaaacaaaaaaacaaattcgaggctttttagtagacgcaccatctaaaag

SEQ ID NO: 2842 - DNA, 1765 bp, Panicum virgatum
gaatggtgttgctgctcgcagggggacagggtgcgggtggtgcagacgctgctgttcgtgacggggataaacacgctgctgcagtccctcttcgggacgcggctgccgacggtgatcggcggctcctacgcgttcgtgatcccgattgtagccatcatccaggactcgtcgctcgcggcgatacccgatggacacgagaggttcctcgagaccatgagggcgatacagggggcactgatagtgtcctccagtattcagattattctgggctacagccaactctggggtattttctccagattcttcagcccagtggggatggcgccagtggtcgcgctgctcgggtttggccttttcgaaagaggattccctgtggttgggagatgcgttgaggtcggcttgccaatgctgattctctttgttgtactctctcagtatctgaagaatgtgcaaataaaagatattcccatactggaaaggttctcccttttcatctgcattgctttggtatgggcatatgctcaaatcctcacttctggtggtgcctataagaacagcactgaggtcactcagatcaactgccgcactgaccgagccaatctgatctcctctgccccatggcttaagattccttacccactacaatggggagcaccaaccttcaacgctggccaatcgtttggtatggtgtctgctgttttggtctcactaatagagtccacagcctcttacaaagctgctgctcgtctcgcaagtgcaactccacctccagctcatatcctgagtagaggcattggatggcagggaatcggcatcctccttgacggcctttttggaacggggactggctccaccgtctcagtggagaacgttggtttgcttggatcgacgaggatcgggagccgacgggttatccagatctgtgccggtttcatgatcttcttctccatgctgggaaaattcggggcgctgtttgcctccatcccgttcaccatattcgcagccgtgtactgcgtcttgttcgggctcgtcgccgcggtggggctgtccttcttgcagttcactaacatgaactccatgcgcaacctctttatcgtcggcgtctccatcttccttggcctttccgtgccggagtactttttccggtacaccatggctgctcagcgtggtcctgcgcacaccaaagctggatggttcaacgactacatcaacaccatcttctcgtcgccgccgacggtggggctgatggtggccgtgttcctggacaacacgctggagaccaaggacgcgggcaaagaccggggcctgccgtggtgggtgcggttccggtcgttcaagggggacagcaggaacgaggagttctacagcctgcccttcaacctcaaccgcttcttccctccggcctgaaccccgggcgatcttcctaccactaccatcaaccgagagataaaagcggcggcctctcactggaagaactcggactgctgagccggaggcatagtagaacttactagctgtgtgtgtgttgtagctaggccattgtttgattcgttgatcttgtagctgttcatgtctgtagatcgttgttggggaggtcgcttagcttagtatactgtccccaacccaacccagtagaaatgctctcctaccgttttgctgcgatgcatccatacatttttcttgtccccaaccggtggtgaggaagatggcgcacgaaaaggggaatcctatggtgcggacggcgacgtctcaaagagaggagaga

SEQ ID NO: 2843 - DNA, 2053 bp, Musa acuminata
ggggaggtgagttttggtgggtggcaaagcaagcgtttcctgtcgccagtccagtcttccttccctttttctgcgagcgacgacaagctcttctctactctcctcgctcacttctcttcttttccttcgtcccatcctctgtgcctctgcttgcacctacatttcctctcagctttcggcggtagttctgcagcttttctcccaagaccaccttttccccttgctgcttggttccccatccgcttagccgtcggaaaaaccccatcttggttctttttagaagaactgagaaaggttggctttttttttattctctttcagcgcctccccccccccccctgtttgggtttttggagcttttgggggttcgtagatatggcagaaatcaagcctgaggagatcacgcatccgcccatggatcagctacagggatttgagtactgcattgactccaatccatcttggggagaggctattgtcttgggatttcagcattacatattggccttgggcacggccgtgatgatcccgactctgttggtaccattgatgggcggaagtaatgatgacaaggtcagagtggttcagacgttgctatttgtgactggagtaaatactttgcttcagactctatttgggactcgtcttccgactgttgttggtggttcatatgcatttgtggttcccatcatatccataattcatgactcatccctgacacgaatagtcgatgaccatgaaagattcctccaaaccatgagagctatacaaggggctttaattgtctcttccagcattcagattattcttggttacagccagttgtggggtatattctccagatttttcagccctctgggaatggttccagtggtttcactggtaggattcggcttatttgacaaaggattccctgtggttgggagatgcgtagagattggcattccaatgctcatcctattcattgcttcctcccagtatctaaagcatctacatgttagacggttgcccgtattagagaggttctctctcctgataaccattaccatcatatgggtttatgcccacttgcttacggttgggggtgcatacaaataccggcctgagcgcacccaattcaactgccgtactgaccgtgccaacctcatctcctctgctccctggataaagattccataccctttgcaatggggtgcaccaacttttgatgctggccattctttcgggatgatggctgctgtctttgtatccttgattgagtcgacagggacttataaagctgcagcccgcctagctagtgcaacaccacctccagctcatgttctgagccgaggcattggatggcagggaataggaattctacttgatgggctatttggcactgtaactggatcaactgtgtctgtggagaatgtcgggcttcttggatcaactagagttgggagtcgtagagtcatccagatctcagctgggttcatgatattcttctccatcttggggaaatttggagcattgtttgcctccattccattcaccatctttgctgctgtttactgtgttctatttggagttgtggctgcggtggggctctccttgttgcagttcaccaacatgaactccatgcgcaacctcttcatcgttggcgtctccatcttcctcggcctatcggttcctgagtacttcttccgctacacaatgagtgctcagcatggtccagcccacaccaaggcatcatggttcaatgactacatgaacacaatcttctcctctccacctactgtggcactgatagttgcagttttcctggacaacacactcgacttcaaggacactggcaaggaccgaggcatgccatggtgggccaggttccggacgttcaacggagacagccggagtgaggagttctacactctccccttcaaccttgaccgcttcttccctccatcatgacttgctgatggaaagcgaagagaagactcggatcgtcgagcagaggagagtagacacggtgtacgctttagccaaattgtaggccaattgcttggacttgttg

SEQ ID NO: 2844 - DNA, 2025 bp, Musa acuminata
cacttggtgggtggcaaagaagtggtttttttggccctctgaatcatccccgcctagttttttctttctttgttgtgtttgcgagcgaggccatacgttctttctcgcgcagtcactctctctcgtgttcttttctgtcttcgtatcatcctccgtgtctttttttctttgacaccacagtatctctcagctttcaccaatgattctccagccttttctttcgctattagatttctcatccgcgtagcagtcggaaaaaaaccatcttggtaccgtttggaagaaacgagaaagatcagatttttatcggttttcaggccttctcttttcctgtttgtgcgtttggggagtttggtagcttatggagatggcagaagtcaagccggaggagatcacgcatccgcccatggatcagctccatggtttggagtactgcatcgattccaatccatcttggggagaggctattgcgttgggatttcagcattacatattggccttgggcacggcggtgatgatcccgacccttctggtacacttgatgggtggaactgatgatgataaggtaaaggtggtccagacattgttgtttgtgtctggaataaatacattgcttcaaaccctattcggaactcgacttccaattgtcatcggtggttcatacgcatttgtggttccaatcatatccataattcatgactcatcgctggcgcagataactgacgaccatgaaaggttcctccaaaccatgagagcgatacaaggagctttaattgtctcttccagcattcagatcattctgggctacagccagttgtgggggatctgctccagatttttcagccctcttggaatggttccagtggtttcactggtaggatttggattattcgacagaggattccccgtggttggaagatgtgtggagattggcattccaatgcttatcctattcattgcatcctcccagtatctaaagcatctgcacattagacggtggcccatattggagaggttctctcttctgataaccattgtcatcatatggatttatgcctacttgcttacggttggtggtgcatacaaacaccggccagaacgcacccaggtcaactgtcgcactgaccgagccaatctcatctcctctgctccctggataaagattccatacccattgcaatggggtgcaccaactttcaatgctggccattcttttgggatgatggctgctgtccttgtatccttgatcgagtcaacaggcgctttcaaagctgcagcccgcctagccagtgcaacaccacctccagctcatgttctgagccgaggcattggatggcagggaataggaattctacttgatgggctatttggcactgcaagtggttcgactgtctctgtggagaatgtggggcttctcggatcaacgagagttgggagtcgtagggtcacacagatctcagcttgtttcatgatatttttttccatcatggggaaatttggagctttctttgcctccattccattcaccatctttgctgctgtttactgtgttctgttcgggcttgtggctgcggtggggctgtccttgttgcagttcaccaacatgaactccatgcgcaacctcttcatcgttggcgtctccatcttccttggcctatccgttcctcaatacttcttccgctacactctgagtgctcagcatggtccagcccacaccaacgcaggatggttcaatgactacataaacacaatcttctcctccccgccaaccgtggcattgatagttgcagttttcctagacaacacactcgacttcgaggacgctgccgcagaccgaggcatgccatggtggacgaggttccgaaccttcaagggagacagcaggaacgaggagttctatactctcccattcaacctgaaccgcttctttgctccatcatgaggtggtagacattgttgagtcgatacaaatgtagattttaatcaaatctagtactcatatcatgtatattctgagtttgatgg

SEQ ID NO: 2845 - DNA, 1991 bp, Elaeis guineensis
ctttcttcccaactttcgttctcttttttacttcctttttcgggtcggtagtttcgtattcccttactttcgtctactattaccctttcgtccctaaaattacctatcttggttattcgtataattacgtaaagtttccgggtggttttagtgaaaagtttgttttttcttcttgtttcgttgattcttctgctcgggtgcttggtgttttggtggtctaggagaagatgacggatttcaagccggaggagatcagccatccgcccatggatcagctccagggcttcgagtactgcatcgactccaacccatcttggggggaagcgatcgctttgggctttcagcattacatactggcgttgggaacggcggtgatgatccccaccctgttggttcctttgatgggtggaagtgatgatgataaggtcagggtggttcagacattgctatttgtgactggtataaacacattgctgcaaaccctattcggactcgccttccaactgtggttggtggttcttatgcattcgtggtcccgatcatctccataatacaggactcgtcgctgacacggatatctaatgaccatgagaggtttcttcagaccatgagggccacacagggagccctgataatctcttctagcattcagatcattcttggttacagccagctgtggggtattttctccaggttttttagcccgttgggaatggtttcagtggtggcgctggtgggctttgggctttttgatagaggattccctgtggttgggagatgtgtggagattggccttcccatgctaatcttattcattgcattctcccagtatctgaagcatctacatgcaaggcgtgtgccaatactggaaagatatgccctcctgatctccatcaccatcatatgggcctatgctcacatcctcacagtgagtggtgcatacaggcaccgccccttgatcacccagatcagttgccgtaccgaccgtgccaacctcatctcttctgctccttggataaagatcccatatccattgcaatggggtcccccaagctttgatgctggtcattgttttgggatgatggctgctgtcttagtatccttgatcgagtcaactggggcttacaaagctgcagctcggctagcaagtgcaacgccacctcctgctcatgttctgagccgaggcattggatggcagggtgtagggatcctactagatgggctttttggaaccgggactggctctactgtttctgtggagaacgttgggcttcttggatcaacaagagttggaagccgcagagtcattcagatatcagctggtttcatgatattcttctccatattggggaaatttggagcactgtttgcctctataccattcacaatctttgctgctgtatactgtgttctctttggtcttgttgcggcggtggggctatccttattgcagttcactaacatgaactccatgcgaaacctcttcatcaccggtgtctccatcttccttggcctatcaatcccccagtacttcttccgctacaccgcaagcgatcagcatggtcctgctcacacaagggccggatggtttaatgactatattaatacaatcttctcatctccaccgactgttgcattgatcgtcgctgtgttcctcgacaacacgcttgacttcaaggatgcagataaagatagagggatgccatggtgggccaggttccgaactttcaaaggagatagcaggaatgaggagttctacactctccccttcaaccttaaccgtttctttcctccatcttgaaccatagctttgcaagttagagaagggaaagggaaaggtgtgagactcagattgttgagcagagcgtggtggatacaatggtaggttccagccaaatttctaatgtggtaaatttttgcatgggtttctagtcattgcatgtatatttttaatttgttgggcaataaaactggttgtttcttctaaaaaa

SEQ ID NO: 2846 - DNA, 2345 bp, Phalaenopsis aphrodite
gtattcaagctgcaggaccattctttctctctctctctttcacccttttggtcgcacttacatcccataaacctttgggcagtccctttccggttcctcatcatcttgaggtacactaaacctagtgaagaaatacagagaagaagatagccaaggaagaaaagattcgatttttgcacggtatcatcatcttgtttctctcatttccagcttgttgatataggaaacccatcttctgcaatagagataagagctggctaaagaagaaatttcctatttttatcttcaacaccttctcgctctgctgatattaaaataactaatccctggagaaggaatcagagtttaacgacaaggaaagaaaaagtttcgatttttactggatttcccccctctttcggtctttgtttggatttctggttttcccctgtgagatatgtcggatttcaagccggaggagattagccatccacccatggatcagcttcagggcttcgagtactgcatagactccaacccatcctggggtgaagcgatagcgctagggtttcagcattacatactggcgttggggactgcggtcatgattcccacttttctagttccattaatgggcggcagtgacgatgataaggtgagggtagttcagacattgctatttgtgggaggaatcaacacattgattcaaaccctcttcggaacccgtcttccaaccataattggaggatcatatgcattcttaatccctacgatttccataattcatgattcatccttcagccaaattgctaatgaccatgagagatttttacaaaccatgagggctattcaaggagcacttatagtttcttcaagcattcaaattatattgggctacagccagttatggggtatatgtacaagattcttcagccctgtgggaatggttcctgtggtctcgttggtgggctttggccttttctatagaggttttccagtggtgggaagatgtgtggagattggcgttcccatgctcatcctttttgtcgcattatcacagtatctgaagcatctgaatgtgaggcgattacctgtgctggagcgcttcgctttgctaatttcaattgccatcctttggctctacgctcatatcttgacggtgagcggagcctacaagtacaggccagcgaaaactcagtttaattgtcgcaccgatcgagcaaaccttatatcttctgcatcatggataaaaatcccatacccacttcaatggggggcacccacttttgatgccggccatgcttttggcatgatggctgctgtatttgtgtcacttgttgagtccactggagcatataaggcggcagctaggctggcaagcgcaacaccgccaccagctcatgttcttagtcgtggcatcggatggcagggtattggaattttactggatgggctctttggtacagtttctggctctactgtctctgtggagaatgtgggacttctaggaagcacgagggtcggcagccgaagggtgatacagatatcagctggtttcatgatattcttctccatcttgggtaagtttggagcactatttgcctccattcctttcaccatatttgctgcgctctattgcgttcttttcggcctcgttgcggctgtgggtctctccttcttgcagttcacgaacatgaactcgatgcgcaatctcttcatcgtaggcttatccatgttcctcggcctgtcaattccggagtacttcttcagctatacagagagcgcgaatcacggtcctgctcacaccaaagcagaatggttcaatgactacatcaacaccatattctcttctccagcaacagttgctctgattatttctgtgtttctggacaacacgctggacttcaaggagacgggtaaagatagaggaatgccatggtgggtcagattcagaacttttaagggagatagtagaaatgaagaattctacactcttcctttcaatcttaatcgcttcttcccaccttcttaaagaacaaacagtgcaggctttgttcagagagcttatattgttatggagaagagcttttgggggaagggttatgttatttgatgagcaaattttgagagaaattaagggagttcaatgaaagtgtgtaagagagaacccactgaatctgaccccacctaacttagggaacttgatgcagttattagaatgatggaagttgggtctgttttttagttgtaagtagtagtatttatggattctggatttattatgtaatttattctgctaatatgtaaaatttatcttctttttttaaaatcttaatcttgaagactgttttggttgtcaatataac

SEQ ID NO: 2847 - DNA, 2275 bp, Musa acuminata
catttccgtcgcaaaaataccaacgggcaaattcccatggagacacacacgacagggagatatatagacgacggcgaacggaggggattccgtgggtggtgttgtctcgaatcctgcctccccccatccttcgagcgactctctctctctctctctctctctctctcccgcccactttcgtcctcatcttctgtgcccctttggaaacctcttctttatctcagctttcatcaacaattctccagcttttttcacccgaggccacctttctcttttgctgctccactcctcagccgcagagcaatcggaaaaattccatcttggtgctgtttggaagacccaaaaaaggtcgggtttttcattgctttccaatccttcttcccccggttgggtgttgttttggtgattcttggagatggcggaagtcaagccggaggagatcatcacgcatccgcccatggatcaactccaggggttcgagtactgcatcgactccaatccttcttggggtgaggcgattgctttgggatttcagcattacgtattggcgttgggcacagcggtgatgatcccaacctttctggtacccttgatggggggaagtgatgatgataaggttagggttgtgcagacactgctatttgtgaccggaataaatacactgattcagaccctattcgggactcgccttccaactgtgattggtggttcatacgcatttatggttccgatcatatctataattcacgactcatccctgacacagataaccgatgatcatcaaaggttcctccaaaccatgagagccatacaaggagctttaattgtctcttcctgcattcagattattctgggttacagccagttgtggggtatctgttccagatttttcagccctctgggaatggtgccggtagtttcactggttggattcgggttattcgacagaggattccctgtggttgggagatgtgtggagattggtgttccgatgctcatcctattcgttgcatcctcccagtatctgaagcatctacatgttagagggttgcccatattggagaggttctctcttctgataaccatcaccatcatctgggtttatgcccacttgcttacggttagcggtgcatacaaacaccatcccgagcgcacccaagtcaactgccgcactgaccgtgccaacctcatctcctctgctccctggataaagattccatacccattacaatggggtgcaccaacttttgatgctggccattcttttgggatgatggctgctgtctttgcatccttgatcgagtcaaccggtgcttacaaggctgcagcccgcctggctagtgcaacacctcctcctgctcatgtcctgagccgaggcattggatggcagggaattggaatcctacttgatgggctgtttggcactgtaactggttcgactgtctctgtggaaaatttggggcttctcggatcgactagagttgggagtcgtagggtcattcagatctcagctggtttcatgatattcttctccatcatggggaaatttggagctttatttgcctccattccgttcgtcatctttgctgctgtttactgtgttctattcggaatcgtggcggcggtggggctctccttgttgcagttcaccaacatgaactccatgcgcaacctcttcatcactggcgtctccatcttcctcggcctgtctgttcctcagtacttcttcaagtacacctcgagcgctcagcgtggtccagcccacaccaacgcagaatggttcaatgactacataaacacgatcttctcctccccaccgaccgtggcattgatcgttgcggttttcctggacaacacactcgacgtcagtggcactgccggcgaccgaggcatggcatggtgggctaggtttcgaaaattccaaggagacagcaggaatgaggagttctatactctcccctttaacctcaaccgtttctttcctccatcatgagcttgctgatggaagaacttggtgagactcagatcgttgagcagagaagggtacagaattaggttttggccaaatccactgggtgattgcttcgactcgtagtcgtttcatgtatattttggattcgtcgagcgatagtaacagctattgaagtccactagaaatgatgttataaggatcaatgtgtttgcaggaacaaaagatcatcagcatagttcaagttcgaactttttttgggttgaaagggtagattgagttgaaggaaaggaaactataattctt

SEQ ID NO: 2848 - DNA, 1911 bp, Aristolochia fimbriata
atacaatcagttcatttggttgctttatcgattctttcatttatttgtgagatacccatttgaggtcgttggagcttgtgagttttctagtattggtttgccatggctgctcccaagccggaagagatttcccatcagcccatggatcaactccaggggttcgagtactgtatcgactccaatccgtcgtggggcgaagcaatcgcgttgggctttcagcactacattctcgcattggggacctccgtgatgattccgtcgctgctggttccggtcatgggagggacggatgacgacaaagtgagagtggttcagacgttactcttcgttggggggattaacacgttattgcagaccctcttcgggacgcgactgccgaccgtcataggaggctcctatgccttcgtagttccgataatgtcgataatccgcgattcctcgctgatgcggatctcagatcctcacacgagatttctacagagcatgagagcgatccaaggagctctgatagtctcttcaagcgtgcagattattctggggtacagccaattatggggtatctgctccaggtttttcagtcctctggggatggttcccgtaatagcattggtgggttttggcctcttcgatcgaggtttccctgtggtcgggaaatgtgtagagatcggcgttccgatgctcatcctatttgtggcattttcacagtacttgaagcgtttccaggcgaggaacttaccgatattggagagattcgctcttctgctagcagtaacgatcatttgggcttacgcgcacttgctgactgcaagcggggcttacaggcaccgcccggagaggacccaaaacaactgccgaaccgatagagccaatctcatctcctccgcgccctggatcaagattccttacccgcttcaatggggagcacccaccttcgacgccggccatgccttcggaatgatggctgccgtcctcgtctccctcatcgagtcaactggggcgtacaaggcagcatctagactggcgagcgctacgccacctccagctcatgttctcagtcgaggcatcggttggcagggaattgggattttactggatgggctcttcggaacagggactggctcaaccgtctctgtagagaatgtgggtcttcttgggtctaccagagtcggaagccgtagagtgatacagatatcagctggtttcatgatattcttctccatattagggaaatttggggcgctgtttgcttcaatcccgttcaccatttttgctgctgtgtactgtattttgtttggacttgttgcttcggtggggctatctttcttgcagttcacgaatatgaactcgatgaggaacctgttcatcacaggggtttcactgttcctggggttatcgattccgcaatacttctacgagtacactgcgtccgctggtcatggccctgctcacaccggggcaggctggttcaatgatttcttgaacaccatcttcttctctccgccgactgttgctcttatcgtggctgtttttcttgataataccctcgattacaaagacacagctttggacagaggaatgccatggtgggctcgcttcaggacgttcaagggggatagtcggaacgaggagttttacacactccctttcaatctcaatcgcttcttccctccgtcatgaacagcatcatctagaagtgaatgaagatgacgacttgacagatgcagatcaaggacgttgttgtcctactgcattcatattttggttagcaattgtacctataaggttgtgttttttaggggttaaattaatttaataaaactaaaatttttagttattgtctcaaaaaaaaaaaaaaaagaaaaaaaactaagtagaacgaaccgaccgaaaccaaacggggaaagggtaagg

SEQ ID NO: 2849 - DNA, 2395 bp, Musa acuminata
cacccacctcccctgtccatggaactccctaatctctcttagctgcgatcaccagattaactccaatttgtaattgttggacgtaatcgttccggcttttcaatagattgtgtcaggccacaattgcaaccacgcaaaagttgttctcatcgacgatgatgaaactttcgtccctttctccctgcctcttttgaatcgtcagcagtcgccataaatgctgaagagctgctctcatggctggaaactactgcgcacgacacagcaaggccaacgggagaattcccatggcgatagctataaagcaaggagagagagaaagcataaaaaggggaacagagtgagtgggtggcatagtggtttttgtcccggacgcagcctcctctaccctttttctcttgccagcgacgacacactctctcttccttttcgttcgtcctcatcctctgcgcgtccttttccaacgcctactccttttctcctcgcagctttcaccaaataattcttcggctttttttgcctctcaagacgaaccttttcttttgttgctggattcctcatccgctgcgcagtcggaaaaattccttcttggtgtgctagttggaagatctcagaaaggtcggatttttcttggaagcctgtttgggtgttcgggagctctgtaggtcttggagatggcggaagtcaagccggaggagatcgtcacgcatccgcccatggatcagcttcagggattcgagtactgcatcgactccaatccatcttggggagaggccatttctttgggctttcagaattacatattggcgttgggcgcagcggtgatgatcccaactttgctggtaccattgatgggaggaagtgacgatgataaggtcagggtggtccagacattgctgttcgtgaccggcataaacacattgcttcaaaccctgttcgggactcgccttccaactatcgtcggtggttcatacgcatttgtggttccgatcatatccataattcacgactcatccctgacaaggataactgatgaccacgaaaggtttctccaaaccatgagagcaatacaaggagctttaatcgtgtcttcctgcattcagattgttctgggttatagccagttgtggagtatcttctccagatttttcagtcctctgggtatggttccggtggtctcgctggtaggattcggtttattcgacagaggattccccgtggttgggagatgtgtggagattggcgttccgatgctcatcctattcattgcggcctctcagtatctgaagcatctgcacgttagacggctgcccgtattggagaggttctctcttctgttgaccatcaccatcatctgggtttatgctcacttgcttacggtcggcggcgcctacaagcaccgccccgagcgcacccaaatcaactgccgcactgaccgtgccgacctcatctcctctgctccctggataaagattccgtacccgttgcaatggggtgcaccaacttttgatgctggccattctttcgggatgatggctgctgttcttgtatcaatgattgagtcaacaggggcttacaacgctgcagcccgcctcgctagtgcaacaccgcctccagcttacgttctcagccgaggcattggatggcagggaattggagttcttcttgatggactcttcggaactgcgaccggttcaactgtgtcagtggagaatgtggggcttcttggatcaacaagggtgggaagtcggagggtcattcagatctctgctggcttcatgatcttcttctccatcttggggaaatttggagctttgttcgcctccattcccttcaccatcttcgctgctgtttactgtgttctgtttggtatcgtggctgcggtggggctctccttgttgcagttcaccaacatgaactccatgcgcaacctcttcatcacgggcgtctccatcttcctcggcctatccattcctcagtacttctttcgctacactgcgagcgcacggcacggtccagcccacaccaaggcagaatggttcaatgactacatcaacacgatcttctcctctccgccaacggtggcattgatcgtcgcggtgttcctggacaacacgcttgacttcaaggacaccgccggtgaccgagggatgccgtggtgggcgaggtttcgaaagttcaaaggagatggcaggaacgaggagttctacacgctccccttcaacctgaaccgcttctttccccctcgatgaggccgatgaaggaggagaacggcgagactcggatcattgagcagagaaagagtacaggaaaatgtaggctttagctgaatccagcttgtagtcatttcatgtacatttattttggatttgatggtcaataataccatctaatcttt

SEQ ID NO: 2850 - DNA, 2542 bp, Oryza sativa
tctcaatgcgccttttgatgtcactcatggctgctctcttttgatcttttcctctttttcttcttcttctttgaagcatcatcaactagggcggtagggcctctttcctttgttcgttttatctttatagcttctctctatctctctctctctctgtgccctcttcttcctagccgaattctgctggtctccattgcggctactgttcttggggttgccctctctctctccttcctttggttttgggcggttttcttttgctgaaaaaaactagttcttgattggttcttgtcatctttgggaggacattgctctgggtgtgtgtcaagattgtgctgggagcataaagctgggatctttggccagattgtagagggcttctggttcttgtcactgggggtgctttagagcatttcttggtgtccattactgttctgggtcatagagtttccaatctttggcaattactcggaggaattcttgagctgtgtgctactgtttcctttccctgataaatcaaccaagggaagggaaggctgtatattttccctttcttgttcttgatctttgcaataattttgatcatcttgaagaaaagaagtgtaaagtgtttggctgtgaaatggctgaggtgaagcctgaggacatggtccatcatccacccatggaccagctccagggatttgagtactgcatagactccaatccatcctggggtgaagcaattgctttgggctttcagcattacattctttccctgggcactgctgtgatgatcccaacaatgctggttcctcttatgggtggaaatgatcatgacaaggcaagagttgttcaaacactgctatttgttactgggataaaaacactgctccagacattattcggcactcgacttcctaccatcattgggggctcatatgcatttgttgttccaatcctctccattatccgtgacccatcgcttgcgcaaattgctgatggccatactagatttgtgcagacaatgagagcaatacaaggctccctgatagtctcctcgagcattcagataattcttggctatagccaattgtgggcaatttgctccaggttctttagcccacttgggatggttccggtggtcgcgcttgtggggcttggcctattcgagagaggattccctgtgattgggagatgtgtggagatcggccttccaatgctcatcctgtttgtcgcgctctcccaatatctgaagcatgtaaatgtccggcatgttccagttttggagaggttttcgctgcttatatgcgttgctcttgtgtgggtatatgcccacatcctcacagcaagtggcgcctacaagcacacagccctgctcacccagttcagctgccgaacagaccgtgccaacctcatctcttctgctctatggataagcattccgttcccgttgcaatggggtgcaccaacattcagtgcaaatcatgcgtttggtatgatggctgccgtcgtggtgtcgttaattgagacaactggagctttcatggctgctgcccggttggcaagcgcaacaccaccacctgcatatgtgctgagtagaggcattggatggcagggaatcggtaccttactagatggtctatttggcactggtactggatctactgtttctgttgagaatgttggtcttcttggatcaacaagggttggtagcaggagagtgatacagatttctgcaggattcatgatcttcttctccatgctaggaaaattcggtgcactatttgcctccattccattcccaatatttgcggctatatactgcgtaatgtttggcattgtcgctgctgtgggactatcctttttgcaattcaccaacatgaactcaatgcgcaacctcttcattgttggtgtctccctctttcttggcttatcaataccagagtacttttctcggtataccacgagcgcacaacaaggaccagcgcacactaaggctggatggttcaatgactacatcaacagcgtcttctcgtctccaccgactgtcgccctcatcatggcggttctccttgacaacacactcgatgtcagagaggcggcaagggaccggggaatgccatggtgggcgcgattcaggacgttccgaggcgacagcaggaatgaagagttctacaccctgccattcaacctcaataggttcttcccaccatcttgagcagagcagagcagagctgccgaaattcagagaatgcaaagacaaagttccagatgcaccaagcagtgaaatgtagtctgcttttgatagggtagaacagaaagttgagctgacaaaatgagcaattttaccagcaggcaaggaggaactctcttctagctgtccacttgtacatagaaacgattcgtttttcttttcatcagcttcaacaccgaggatgtttgattttgctgtaagcaattaattaatatcttgtgaacaactggtcatattagtttgaataagaactgttagttataatttttttatccattacatccatctgcaactagccaaaaaaaa

SEQ ID NO: 2851 - DNA, 1931 bp, Sesamum indicum
cttttcttggtcctgtctctcttttgcctttttgctttctatcttaattgattaactcatccgccattactgtgaacaaaccaagaatttgtttgttcacactaagccctgttaagttaattttgattttggtgaatccctttcgggaatttgggagaaagagggaaagttggtgaagagaagtgagtttagtgagatggcggctccaaaaccagaggaaataagtcatcctccgatggaccaacttcagggattagagtattgcattgactctaatccttcttggggggaggcaatagcgcttggatttcaacattatattttggcactggggaccgcggtcatgattccttcttttcttgttccgttgatgggcggaaccgacgatgataaggtgagagtagttcagactttgctatttgttggaggaataaacacattgctgcaaacactgttcggaaccagattgcctactgttattggtggatcatgggcattcatggtgcctataatttcaatcatccatgattcgtccttgcagagaattccagaccctcatatgagatttctgaatacaatgagagcaatacaaggtgcattgatagtagcatcgagcgtgcagatcattttgggctacagtcagctgtgggctatatgttccaggtttttcagtccgctcgggatggttcctgtaatttctcttgtgggtttcggtctattcgatcgaggcttccctgtggttgggcgatgtgtggaaattggcattccgatgttcatcttatttgttgccttctcccagtacttgaagcacttccaaacaaaacaaatccctgtattggaacgatttgctcttctcatttcagtcactgttatatgggcttacgcacatctcctcactgctagcggggcttacaagcatcaccctgaattaacccaaagaaactgtcgcactgacaaagcgaacctcatttcttctgcaccttggatcaaaatcccgtacccacttcagtggggtgcaccgacatttgatgctggccatgcgtttggaatgatgtctgctgtactagtctccttgatcgagtcaaccggagcatacaaggcggcatctcgtttggcaagtgccacaccacctcctgctcatgttcttagccgtggaataggctggcagggcatcggaatcctgttggacggaatgtttggtacagctacaggatctacagtttcagtggaaaacattggtctgcttggaagcactcgtgttggcagtcggagggtaatacaaatttcagctggtttcatgatcttcttctcaattttggggaaatttggagcattatttgcatcaatacctttcacaatatttgcagctttgtattgcgttatgttcggtcttgttgcttccgtggggctgtcgtttttacaattcacaaacatgaactcaatgaggaacctcttcatcactggcgtctccctcttccttggtttgtccattcctgagtacttcagggaatataccgctgctgctcttcatggtcctgcacacaccaaagctggatggttcaatgatttcctgaacacaatatttctgtcatcgccaactgttgccttaatggtggctgtattcctggataacacacttgactataaggacagtgctagagaccggggaatgccgtggtgggctaagttcagaacattcaaaggggacagcagaaatgaagagttttacaccctccctttcaatctcaacagattcttccctccttcatgatctacaaggacaaaacgaagaggaaaagtcaattagatgtacgcgaagaggattgtattaaatactaatacaatcctgattcgtagaagaatgtttgtagattgacagattcacctcctctgtcattattttttcatttgtttgaactcatctggtttgg

SEQ ID NO: 2852 - DNA, 1905 bp, Cucumis sativus
taatggaagctccaaaaccagaggagattacccatccaccaatggatcaacttcagggcttggagtactgtattgattctaacccgtcttggggggaagcaattgctttgggttttcagcactacattctggctttgggtactgctgtgatgattccttctttccttgttcctttgatgggaggcgatgatggtgataaagtgagggttgtacagactctactttttgttgaagggatcaatacgcttctacaaactctgtttggtacaagattgcctactgttatcggaggttcttatgcttttatggttccgattatttcaatcattcacgactcatctttatcaagaatcgaggacccccatttgagatttctgaacacaatgagagcagttcaaggagctctaattgtatcatcaagcatacagattatcctgggatacagtcagttgtgggctatttgttcgaggttcttcagtcctcttggaatggtccctgtgattgcactagtaggctttggtctgtttgacagaggcttcccagtggttggaagatgtgtggaaattggcgttccaatgcttatactgttcatagccttctcacagtatctcaaaggttttcataccaggcaactgcctatactcgaacggtttgctcttcttataacagtcactgtgatatgggcatatgcacacctattgacagccagtggtgcttacaaacatagaccggaattaactcaaatgaattgtcgaactgacagggccaacctcatatcatctgctccatggattaagattccataccctcttcagtggggtgctccaactttcaatgctggtcacgcttttgggatgatggctgcagttctggtatctttggttgagtcaaccggagcgtttaaggcagcttcacgtttagcaagtgcaacccctcctccagctcatgttctaagccgaggcattggttggcaggggattggtattcttctgagtggtctatttgggacactctctggatcaactgtgtcaatagaaaacgtagggctgctcggtagcacccgtgttggtagccgcagggttatccagatttcagctggatttatgatattcttctcaattctagggaaatttggagcattgtttgcttcaatacccttcaccatatttgcagctgtatattgtgtcttatttggtcttgttgcctccgtagggttgtcatttttgcaatttaccaacatgaattcaatgaggaatctcttcattactggggtagcattgtacttaggtttgtctgtgcctgattattttagggagtacactgcaaaggcttttcatggtcctgctcacacaaacgctggatggttcaatgacttcctcaacactatcttcttctcgccaccaacagtagccctcattgtcgctgttttcttggataacacactagactataaagacagtgctagagacaggggaatgccatggtgggttaagttcaggacgtttaagggagacagcaggaatgaggagttctacactcttccatttaacctaaatcgtttcttccctccatcttgaattgaaggatgaaactgaagagagaacaaagttcgcttcccaccaacagagagatcgcaaacaatttgtggaaagcatcatttcctggttgagaaaagattctttgaatgttgaggaagggtgaagtactaaaaggcgagactagactccatcaatggcagggcatcccttagcctcccagttttgaatgataaccttgctcggaatatattcgagttgaaaaaaaataaagccaacctgtattgtattgaaaggagagacctcgtagtctatttatttttttttttcaatcaatgataattttgtacctcaaagaaaattcaatcaa

SEQ ID NO: 2853 - DNA, 1783 bp, Mimulus guttatus
ctttcatcaatggctgcagtaaaaccagaggaaataagtcatgctcccatggaccagcttcaaggattagagtattgcatcgattccaatccttcttggggggaagcaatagcacttggattccagcattatattctggcattgggtactgcggtgatgattccttcctttcttgtacctctaatgggcggaagtgacgatgataaagtgagagtagttcagacattgctgtttgtcggaggaataaacacagtgctgcaaacgttgtttggaacaagattgcctactgtaattggaggttcatgggctttcttggtgcctataatttcaattattcatgatccttctttggaaagaatcatagaccctcatcagagatttctgagtacaatgcgagcaatacaaggtgcacttatagtagcatcaagcgtgcagattattctgggatacagtcagctgtgggctatatgttcaaggtttttcagtccacttggaatggttccagtaatttctctagtgggttttggtctcttcgatagaggcttccctgtggttggccgatgcgtggaaatcggaattccgatgttcatcttattcgttgcattctcccagtatttgaagcacttccaaacaaagcaaatccctgtcttggaaagatttgctcttgtgatttcggtcaccgttatatgggcttacgcgcacctcctcaccgctagcggtgcgtacaagcaccaccccgagttgactcagcggaactgtcgtaccgacaaagccaaccttatttcttctgctccgtggatcaaaattccttatccgcttcaatggggggcaccgacattcgatgctggacatgcatttggaatgatggctgctgtactagtttccttgattgagtcaacgggagcgtataaggcggcatctcgtttagcgagcgccacaccacctcctgcccatgttcttagccgtggaatcgggtggcagggaatcggaatcttgttggatggactgttcggtaccggtactggatcaacggtttcagtggaaaatattggtcttcttggaaccacgcgagtcggcagtcgacgtgtaatccaaattgcagctggtttcatgatattcttctccattttggggaaattcggagctctatttgcatcaatacctttcacaatattcgcagctgtatattgcgttatgttcggtcttgtcgcttcggtgggattatcgttcttacaattcacaaacatgaactcaatgagaaacctcttcataacgggtgtctccctcttcctcggtttgtcgattcccgagtactttagggaatataccgccgctgctcttcacggaccttctcatacaaaggctggatggttcaacgatttcctcaacacgatattcttgtcctcaccgacagttggcttactagtagccgtatttcttgacaacacgctcgagtacaaggatagcgctgtggatagaggaatgccttggtgggctaagttcagagcattcaaaggagatagccgaaacgaagagttctacactcttccgttcaatctcaaccgattcttccctccttcatgatcggacacaatcttcattcttgaagaaaaacgattatcgagttaaagagtgagagtgagtgagtccgcatgttttcgactcctcggtggttttttagtgtgtgacagattagtctcatctgtcattaattttttcatttatttgaactcgtctttatttgggttattcgagtttaatccaataaaactaaaattattgt

SEQ ID NO: 2854 - DNA, 2468 bp, Mimulus guttatus
aggcaagttcaaaatgtagacatgtctgaaaaattacctaataagcagagaaaagaattaaatatggctagaaaagtacagcgcagaaagccagggtccaacggtaacatctcgtttggctgttccttcaggggcaatctccaaacaaagcaaatcaagaactcactccctcctctctctgcaaatcaaagctcgagagtgggtttcagcaaactgcactttttctctctcccctctctctctgaatctctctgaatacacacacacacacacacatacacacactgttttggtccaatcacatttgactccagctttctccatcaccttttttctacttttcttttttctctattcaattcaattcttcttttgctttttgtttctactttgtatctcgttgagaaactcaaaaccctagtagtctgaacttaatcgatttagctgtgagaaagaagaagaagaagaagaagtgagctttcatcaatggctgcagtaaaaccagaggaaataagtcatgctcccatggaccagcttcaaggattagagtattgcatcgattccaatccttcttggggggaagcaatagcacttggattccagcattatattctggcattgggtactgcggtgatgattccttcctttcttgtacctctaatgggcggaagtgacgatgataaagtgagagtagttcagacattgctgtttgtcggaggaataaacacagtgctgcaaacgttgtttggaacaagattgcctactgtaattggaggttcatgggctttcttggtgcctataatttcaattattcatgatccttctttggaaagaatcatagaccctcatcagagatttctgagtacaatgcgagcaatacaaggtgcacttatagtagcatcaagcgtgcagattattctgggatacagtcagctgtgggctatatgttcaaggtttttcagtccacttggaatggttccagtaatttctctagtgggttttggtctcttcgatagaggcttccctgtggttggccgatgcgtggaaatcggaattccgatgttcatcttattcgttgcattctcccagtatttgaagcacttccaaacaaagcaaatccctgtcttggaaagatttgctcttgtgatttcggtcaccgttatatgggcttacgcgcacctcctcaccgctagcggtgcgtacaagcaccaccccgagttgactcagcggaactgtcgtaccgacaaagccaaccttatttcttctgctccgtggatcaaaattccttatccgcttcaatggggggcaccgacattcgatgctggacatgcatttggaatgatggctgctgtactagtttccttgattgagtcaacgggagcgtataaggcggcatctcgtttagcgagcgccacaccacctcctgcccatgttcttagccgtggaatcgggtggcagggaatcggaatcttgttggatggactgttcggtaccggtactggatcaacggtttcagtggaaaatattggtcttcttggaaccacgcgagtcggcagtcgacgtgtaatccaaattgcagctggtttcatgatattcttctccattttggggaaattcggagctctatttgcatcaatacctttcacaatattcgcagctgtatattgcgttatgttcggtcttgtcgcttcggtgggattatcgttcttacaattcacaaacatgaactcaatgagaaacctcttcataacgggtgtctccctcttcctcggtttgtcgattcccgagtactttagggaatataccgccgctgctcttcacggaccttctcatacaaaggctggatggttcaacgatttcctcaacacgatattcttgtcctcaccgacagttggcttactagtagccgtatttcttgacaacacgctcgagtacaaggatagcgctgtggatagaggaatgccttggtgggctaagttcagagcattcaaaggagatagccgaaacgaagagttctacactcttccgttcaatctcaaccgattcttccctccttcatgatcggacacaatcttcattcttgaagaaaaacgattatcgagttaaagagtgagagtgagtgagtccgcatgttttcgactcctcggtggttttttagtgtgtgacagattagtctcatctgtcattaattttttcatttatttgaactcgtctttatttgggttattcgagtttaatccaataaaactaaaattattgtcttcgtttcgtgtatttatattatctatcgagtgaaaacaatatctatatatatacacacacacgcgcgaaaaagtaatacggctccaatatatgcaagaagaagtactattagtgatgcttgcacatgcattctttgcatctcggctgtcgataaatgcttctaccatattctctggtacgaactctttggccttcttcgatcatct

SEQ ID NO: 2855 - DNA, 2168 bp, Citrullus lanatus
ttcagacccacttttgcttttttccatttcttcttttctcattgtagtagtaatctcttttctcttctattctctctctgttttttgctacaagttttcttgagagagagaggttgctttgctttgctttgtttgtttgtttctctgttctttcgacgttttggttatttttaccagaatcccatttgggatttttacacattggagagtttgagaagtggggtttgtgagtaatggaagctccaaaaccagaggagattagccatccaccaatggatcaacttcagggcttggagtactgtattgattctaacccatcttggggggaagccatagctttggggtttcagcactacattctggcgttgggtactgctgtgatgatcccttctttccttgttcctttgatgggaggcgatgatggtgataaagtgagagtggtacagactctactttttgttgaagggatcaatacgcttctacaaactctgtttggaacaagattgcctactgttatcggaggttcctatgcctttatggttccgattatttccatcattcacgactcatctttatcaagaatcgaggacccccatttgagatttctgaacacaatgagagcagttcaaggagctctaattgtatcatcaagcatacagattattttgggatacagtcagttgtgggctatttgttccaggttcttcagtcctcttggaatggtccctgtgattgcactagtaggcttcggtctgtttgacagaggcttcccagtggttggaagatgtgtggaaattggcgttcccatgcttatactcttcatagccttctcacagtatctcaaaggttttcatacaaggcaactgccaatactcgaacgcttcgctcttcttataacagtcactgtgatatgggcatatgcacacctcttgacagccagtggtgcatacaagcatagaccagaattaactcaaatcaattgtcgaactgacagggccaacctcatttcatctgctccatggatcaagattccataccctctgcagtggggtgctccgactttcaatgctggccatgcttttgggatgatggctgcagttctggtatctttaattgagtcaactggagcttttaaggcagcatcacgtttagcgagtgcaactccgcctccagctcatgttctgagccgaggcattggttggcagggaattgggattcttctgagtggtctatttgggacactgtctggatcaacggtgtcaatagaaaatgtagggctgctcggaagcacccgtgttggtagccgcagggttatccagatttcagctggatttatgatatttttctcaattctagggaaatttggtgcattgtttgcttcaatacccttcaccatatttgcagctgtatattgtgtcttgtttggtcttgttgcctctgtggggttgtcgtttttgcaatttaccaacatgaattcaatgaggaatctcttcattactggtgtggcattgtacttgggtttgtctgtgcccgattattttagagagtacactgcaaaggcctttcatggtcctgctcacacaaacgctggatggttcaatgacttcctaaacactatcttcttctcgccaccaacagtagccctcatcgtagcggttttcttggataacacactagactacaaagatagtgctagagacaggggaatgccatggtgggttaagttcaggacgttcaagggagatgccaggaatgaagagttctacactcttccatttaacctaaaccgcttcttccctccatcttgaatatagaaggacagaggagagagaacaaagtttgctttgcaccaacagagagagatggcaaacaaattgtggaaagtatcatttcctggttgagaagattctttgaatgatggagtgaagagtattaaaagacgagactaactccatcaatggccatcccttagcctcccagttttgaatgataatcagtaatcactttgctcggaatattcgagttgaaaaaataaagcctacttagtcttgaaaagtcttgaaagaagacctgtattgtctatttcttttttcaatcaatgatatttttgtacctcagagaaaattcaatcaactccttgagccagcattgtgaatgtgataaattta

SEQ ID NO: 2856 - DNA, 2260 bp, Sorghum bicolor
atttccacagggcccaatcccaacccctcactcctaaagcgccgcccatcgcgatctgctgcggtggccgctgccggcgccgcccaccctccaccgcccaccgccactgcctccaccacgtccccgacgccgcgtctcagtctctcactccaccctcgccgcgccgcccaacgcccacgatgcggcacgtcctcctctcccgcttcctcctccgccgccaacagggcggcggcatgcctaccgcccaccaccaccacctcctccgcgccctctcctccgccccgtccccggtctcctccgacgccgagctccgcaagtacgcgggctacgcgctgctcctcgtcggctgcggcgccgcgacctactactccttcccgctccccgccgacgcgctgcacaagaaggccgtgccgttccgctacgcgccgctgccggaggacctccacgccgtctccaactggagcggtacccacgaggtacacgcccgcgtcttgctccagccggactcgctcccggcactcgagggcgcgctcgccgccgcgcacaaggagcgccgcaagctcaggcccctcggctccggcctgtcccccaatggcatcgcgctctcccgcgccgggatggtcaacctcgcgcttatggacaaggtgctcgacgtcgacgccaagaagaagaccgtcactgtgcaggctgggatacgtgtcgcggagctcgtcgacacgctccgggaacatggcctcacgctgcagaactttgcgtccattcgggagcagcaggtcggagggttcactcaggttggtgcccatggcactggtgcaacattacctccggttgatgagcaagtcattagcatgaaactggttacccctgccaaagggacaatagagttatcgagggagaaggatcctgagttattttatcttgctcgctgtggacttggtggcctaggtgtcgtcgcagaagttaccttgcaatgtgtagaaagacaccagcttgtggaacatacatttgtttccaatgcagatgaagtcaagaaaaaccacaagaagtggctctctgaaaacaaacatatcaagtacttgtggattccatatactgatacggttgttgttgtccaatgcaatcctccctcaaagtggagaaccccaaagttgggatcaaaatatggaaatgacgaagctttacagcatgttcgggacctttatcgtgagtcactgaaaaaatatagaactgaagcagaaagtaatgacccagacatagatacactttcatttactgagctgagggacaaactgcttgctcttgatcctctggataaagatcatgtgatgaaaatcaataaagcagaagctgagtattggaagaagtcagaagggtatcgcatgggttggagtgatgagatactgggctttgattgtggtgggcagcagtgggtttctgaaaactgcttccccgctggaaccctagcaacaccaagtatgaaggatcttgattatatagataagctgctgcggttgattgaaaaggaagagatacccgcacctggacctattgagcagcgttggactgcccgcagcaagagcccaatgagcccagcatcaagctctgaagaagaagacatattttcatgggttggtattataatgtacctgccaacatcagatgctcgccaaaggaaggaaattacagaggagttcttcaactacaggagcctggctcaaagtctctgggatgattattctgcctatgaacactgggccaaaattgaggttccaaaagacaaggatgaacttgctgaagtccaggcccggttgaggaagcgtttccctgtggatgcatataacaaggcacgtttggagctggacccccacaaggttctctcaaatgcgaagctagagaagctgttcccagtgttggagccggttcaccaaacaaagtagcatagagcaaagggcacataaacttcgttgcagaggcttaatacatccacatttgtaacactgctcctatcatgattctgtgatcctgtcaaatgagatggtgattaggatttgtcactcgaaataaagtagaggaaacaattgatgattcaatctgtggcagcagctagcactggaagcaaatcatgttgctcctggtgaatttcgtcctctgactgagaacacctaaaaatgggttcatccaatcaattaatcatcaaatcagtaaattctctgttagtttcttctgagtctgacagatgagcaaatttgcagtaggagca

SEQ ID NO: 2857 - DNA, 2379 bp, Setaria italica
tgcaaaacccatcgcgatctggtgcggtggccgctcccctgcgcccctgccggcgccgcccgtccaccccaacgccaccccaacgggacgagcacgatgcggcacctcctcctctcccgcctcctcctccgccgcggcagtagcccctcctcccaccaccacctcccgctcctccgcgccctctcctccgctccctcccccgtctcatccgacgccgacctccgcaagtacgccggctacgcgctccttctcctcggctgcggcgccgccacctactactccttccccttccccgccgacgcgctccacaagaaggccgtccccttcaagtacgcaccgctccccgaggacctccacgccgtctccaactggagcgccacccacgaggtccacacccgcgtcctcctccagccggactccctcccggccctcgaggacgcgctcgccaccgcccacaaggagcgccgcaagctcaggccgcttggctccgggctgtcccccaatgggatcggtctctcccgggccggaatggtcagtctcgggctcatggacaaggtgctcgacgtcgacgtgaagaagaagaccgtcacggtgcaggcggggattcgtgttgcggagctagttgacgcgctccgggaacatggcctcacgctgcagaatttcgcgtccattagggagcagcaggtcggaggcttcattcaggttggtgcccatggcactggtgccagattgcctcctgttgatgagcaagtcattagcatgaaactggttacccctgccaaaggcaccatagagttatcgagggagaaggatcctgagttattttatcttgctcgctgtggactcggtggcctaggtgtcgtcgcagaagttactcttcaatgtgtagaaaggcaccagcttgtggaacatacatttgtttccaatgcagatgaagtcaagaaaaaccacaagaagtggctctctgagaacaaacatattaagtacttgtggattccatatactgacacagttgttgttgtccgatgtaatcctccctcaaagtggaaaaccccaaagttgacttcaaaatatggaaaggatgaagctttacagcatgttcgtaacctctatcgggagtcactgaaaaaatatagaactgaaacagaaagtaatgacccggaaatagatacgctttcatttactgaactgagagataagctgcttgcccttgatccgctggataaagatcatgtggtgaaagtcaataaagcagaagctgagtattggaaaaagtctgaagggtatcgcatgggctggagtgatgaaatactgggctttgattgtggtgggcagcaatgggtttctgaaaactgcttccccacaggaaccctagcaaagccaagtacgaaggatctggattatatagagaagttgctgcagttgattgaaaaggaagatatacccgcacctgcaccaattgagcagcgttggactgcccacagcaagagtccaatgagcccagcatcaagctctgaagaagatgatgtgttttcatgggtcggtattataatgtacttgccaacatcagatgctcgccaaaggaaggaaattacagaggagttcttcaattacaggagcctagcgcaaactctctgggatgattattctgcatatgaacactgggcaaaaattgaggttccaaaggacaaagacgaactagctgaactccaggccaggctgaggaagcgtttccctgtcgatgcatataacaaggcacgcatggagctggaccccaacaaggttctatcaaatgcaaagatagagaagctgtttccggcgctggagccagtgaagtaaatgtgctgaagtgcgaacacataacttgccgttctgttgttgacaccttgatcaagagaaaaaggaccaaaactaccattcctgcgctgtttgtggttttcagacatgcagatttatgaggttttgttgggttttggagtttaaagtgctccatcccgttgttaggctctaaagtaaatgcaagatacgtttgttgcaggaggtccttcacagtttgtaactctattcctgtcatgatgctttgatctgtcaaatgaaatcgtgattaaggatctggcagtcgaaatgaagtgagaggagacaaatactgatgattcaatcaatggcaggaacaagttaaaactttacagcacattttcttcaaccctattattacattttgcaactgtgacgaagttagcactaatcctgttctaaatcttggtatcgttattctcgcccccatcgtttggactttgaagggtggcagatccagcacgctgccggttcatccatttcaacacgagaaatggactccgcggagagcacggccgccatcgc

SEQ ID NO: 2858 - DNA, 2111 bp, Panicum virgatum
atcgcgatctggccgctgccggcgccgcccgtccccgcaacgccaccgctcactccacgcccgcggcgctctcccctcgccaccgccgcgccgtccaacgcgacgatgcggcacctcctcctctcccgccacctcctccgccgcggtggcagcagcagccccaccgcccaccacctccccctcctccgcgcgctctcctcggccccctcccccgtctcctccgacgccgacctccgcaagtacgccggctacgcgctcctcctcctcggctgcggcgccgccacctactactccttccccttccccgccgacgcgctccacaagaaggccgtccccttcaagtacgcgccactccccgaggacctccacgccgtctccaactggagcgccacccacgaggtccacacccgcgtcctcctccacccggactccctcccggccctcgaggacgcgctcgccaccgcccacaaggagcgccgcaagctcaggccgctcgggtccggcctctccccaaatgggtctcgctctctcccgggccggaatggtcagtctcgcgctcatggacaaggtgctcgacgtcgacgtgaagaagaagacagtcacggtggcaggccgggatccgagttgcggagctagttgacgcgctccggggaacacggcctcacactgcagaattttgcctccattagggagcagcaagtcggaggcttcattcaggttggtgcccatggcactggtgccagattgcctcctgttgacgagcaagtcattagcatgaaactggttacccctgccaaagggacgatagagttatcaaaggagaaggatcctgagttattttatcttgctcgctgtggacttggtggcctaggtgttgttgctgaagttactcttcaatgtgtagaaagacaccagcttgtggaacatacattcgtttccaatgcagatgaagttaagaaaaaccacaagaagtggctctcagaaaacaaacatattaagtacttgtggattccttatactgatacagttgttgttgtccaatgcaatcctccatcaaagtggagaaccccaaagttgacatcaaaatatggaaaggatgaagcattacagcatgttcgcagcctttatcgggagtcactgaaaaaatatagaactgaaacagaaagtaatgacccagaaatagatacactttcatttactgaattgagggataagctgctttcccttgatccactggataaagatcatgtgatgaaagtaaataaagcagaagctgagtattggaggaagtctgaagggtatcgcatgggctggagtgatgaaatactgggctttgattgtggtgggcagcagtgggtttctgaaaactgcttccccactggaaccgtagcaaagccaagtatgaaggatctggattatatagagaagttgctgcagttgattgaaaaggaggatatacccgcacctgcaccaattgagcagcgttggactgcccacagcaagagtccaatgagcccagcatcaagctctgaggaagatgatgtgttttcatgggttggtattataatgtacttgccaacatccgatgctcgccaaaggaaggaaattacggaagagttcttcaattacaggagcctggcgcaaagtctctgggatggctattctgcatacgaacactgggccaaaattgagattccaaaggacaaggacgagctagccgagctccaggccaggttgaggaagcgtttccctgtcgatgcatataacaaggcacgcatggagcttgaccccaacaaggtcctctcaaacacaaagttagagaagctgttcccagttctggagtctgttcaccaggcaaagtaacgcgcgtgctggagagtgaagacacagtaacctgtcattctgtcgttgatacttactcagcactgttggtggaatggtggtttacagactcgtagagttctgacttctgagattttgttggtgccgtcacatctcacatttgtaattctattcatatctatcatcatggtagcatgatctaatcgaacatgagttatactaaacatttggcagacaaaataaagtgacagaaaattaccgtaatgatc

SEQ ID NO: 2859 - DNA, 2180 bp, Setaria italica
ggcgccgcccgttccccccaacgccaccactcactccacgcgctcccctcgccgcaccacgccgtccaacaggacgaggacgatgcggcacctcctcctctcccgcctcctcctccgccgcggcagtagcccctcctcccaccaacaccaccaccacctccctttcctctgcgccctttcctccgccccctcccccgtctcctccgacgccgacctccgcaagtacgccggctacgcgcttctcctcctcggctgcggcgccgccacctactactccttccccttacccgccgacgcgctccacaagaaggccgtccctttcaagtacgcgccgctccccgaggacctccacgccgtctccaactggagcgccacccacgaggtccacgcccgcgtcctcctccagccggactccctcccggccctcgaggacgcgctcgccaccgcccacaaggagcgccgcaagctcaggccgcttggctccgggctgtcccccaatgggatcggtctctcccgcgccggaatggtcagtctcgcgctcatggacaaggtgctcgacgtcgacgtgaagaagaagaccgtcacggtgcaggcggggattcgtgttgcagagctagttgacgcgctccgggaacatggactcacgctgcagaatttcgcgtccattagggagcagcaggtcggaggcttcattcaggttggtgcccatggcactggtgccagattgcctcctgttgacgagcaagtcattagcatgaaactggttacccctgccaaaggcaccatagagttatcgagggagaaggatcctgagttattttatcttgctcgctgtggacttggtggcctaggtgttgtcgcagaagttactcttcaatgtgtagaaaggcaccagcttgtggaacatacatttgtttccaatgcagatgaagtcaagaaaaaccacaagaagtggctctctgagaacaaacatattaagtacttgtggattccatatactgacacagttgttgttgtccgatgtaatcctccctcaaagtggaaaaccccaaagttgacctcaaaatatggaaaggatgaagctttacagcatgttcgtaacctctatcgggagtcactgaaaaaatataaaactgaaacagaaagtaatgacccggaaatagatacgctttcatttactgaactgagagataagctgcttgcccttgatccactggataaagatcatgtggtgaaagtcaataaagcagaagctgagtattggaaaaagtctgaagggtatcgcatgggctggagcgatgaaatactgggctttgattgtggtgggcagcagtgggtttctgaaaactgcttccccacaggaaccctagcaaagccaagtacaaaggatctggattatatagagaagttgctgcagttgattgaaaaggaagatatacccgcacctgcaccaattgagcagcgttggactgcccgcagcaagagtccaatgagccccgcatcaagctctgaagaagatgtgttttcatgggttggtattataatgtacttgccaacatcagatgctcgccaaaggaaggaaattacggaggagttcttcaattacaggagcctggcgcaaactctctgggatgattattctgcatatgaacactgggcaaaaattgaggttccgaaggacagagacgaactagctgagctccaggccaggctgaggaagcgtttccctgtcgatgcatataacaaggcacgcatggagctggaccccaacaaggttctatcaaatgcaaagttggagaagctgttcccagcgctggagcctgttaagtaaaatatgctgaagcgcgaagacacataacttgccgttctgttggtggcccttgatgaagagcaaaaagagcaaaactaccatgcctgagctgttgggtttttggagttttagtgctccatcccgttgttaggctctaaagcgatacggttgttgcagcaggtccttctccttcacagtttgtaactctattgctatcatgatgctttgatctgtcaaatcaaatttgattagggatttggcagtcgaaataaagtgagagagaacaaatattgatgattcataccgtcaaaaaaattatattgatgattcatcagtagcaggaacaagctaaaactttacagcacatttt

SEQ ID NO: 2860 - DNA, 2671 bp, Panicum virgatum
gatattgtagcaacttactgtagcatattttcaaaaaaattataactaattcatatgaactcggatggaaataaaatttatatgaaaattacagacctcgatgaaatcttatcaagctctataattttcatataaattttatctccatccaaatttatataaattaattataattttttgaaaatatgctacaataaattgctatagtgttaccgggtgaactgatggtaagctacaagcctgcggaaatcgctacagtactcctatcgccggatgaacaggcagtaagtttgctacattgcacatgccggcggtttatccaacggtatattcattctgccagatgaaatggcggaaggatgtcagatctgcaaaaaaaactttgaggtatatatttttaaaattgaaaaataaatataaaaataaaaaattcgtaatggcccgccggcgggggagtgccaacccatatatgtatgtgggttttatgggccatgagcccatcaaccacaactaatcagcccacctaacaagactgcaaacctcattgctctaaacccatcgcgatctggccgctgccggcgccgcccgtccccgcaacgccaccgctcactccacgcccgcggcgctctcccctcgccaccgccgcgccgtccaacgcgacgatgcggcacctcctcctctcccgccacctcctccgccgcggtggcagcagcagccccaccgcccaccacctccccctcctccgcgcgctctcctcggccccctccccccatctcctccgacgccgacctccgcaagtacgccggctacgcgctcctcctcctcggctgcggcgccgccacctactactccttccccttccccgcctacgcgctccacaagaaggccgtccccttcaagtacgcgccgctccccgaggacctccacgccgtctccaactggagcgccacccacgaggtgcacacccgcgtcctcctccagccggactccctcccggccctcgaggacgcgctcgccaccgcccacagggagcgccgcaagctcaggccgctcgggtccgggctctcccccaatgggctcgctctctccagggccggaatggttagtctcgcgctcatggacaaggtgctcgacgtcgacgcgaagaagaagacagtcacggtgcaggcggggatccgagttgcggagctagttgacgcgctccgggaacacggcctcacgctgcagaattttgcgtccattagggagcagcaggtcggaggcttcattcaggttggtgcccatggcactggtgcaagattgcctcctgttgacgagcaagtcattagcatgaaactggttacccctgccaaaggaacgatagagctatccaaggagaaggatcctgagttgttttatcttgctcgctgtggacttggtggcctaggcgtcgttgttgaagttactcttcaatgtgtagaaagacaccagcttgtggaacatacattcgtttccaatgcagatgaagttaagaaaaaccacaagaagtggctctcagaaaacaaacatattaagtacttgtggattccttatactgacacagttgttgttgtccaatgcaatcctccctcaaagtggagaaccccaaagttgacatcaaaatatggaaaggatgaagcattacagcatgttcgcagcctttatcgtgagtcactgaaaaaatatagaactgaaacagaaagtaatgacccagaaatagatacactttcatttactgaattgagggataggctgctttcccttgatccactggataaagatcatgtgatgaaagtaaataaagcagaagctgagtattggaggaagtctgaagggtatcgcatgggctggagtgatgaaatactgggctttgattgtggtgggcagcagtgggtttctgaaaactgcttccccactggaaccgtagcaaagccaagtatgaaggatctggattatatagagaagttgctgcagttgattgaaaaggaggatatacccgcacctgcaccaattgagcagcgttggactgcccacagcaagagtccaatgagcccagcatcaagctctgaggaagatgatgtgttttcatgggttggtattataatgtacttgccaacatccgatgctcgccaaaggaaggaaattacggaagagttcttcaattacaggagcctggcgcaaagtctctgggatggctattctgcatacgaacactgggccaaaattgagattccaaaggacaaggacgagctagccgagctccaggccaggttgaggaagcgtttccctgtcgatgcatataacaaggcacgcatggagcttgaccccaacaaggtcctctcaaacacaaagttagagaagctgttcccagttctggagtctgttcaccaggcaaagtaacgctcgtgctggagagtgaagacacagtaacctgtcattctgtcgttgatacttactcagcactgttggtggaatggtggtttacagactcgtagagttctgacttctgagattttgttggtgccgtcacatctcacatttgtaattctattcatatctatcatcatggtagcatgatctaatcgaacatgagttatactaaacatttggcagacaaaataaagtgacagaaaattaccgtaatgatcacaaa

SEQ ID NO: 2861 - DNA, 2405 bp, Oryza sativa
gttacggcccactaacttgcagccattgggcctttcgttatatgggctttattccaagtgcgggccaaaaaattgaaaagaaaaaaggaaaaggaaaaaaaaaagaaaaaaagaaaaccccatttcgatctggtgcggtggctgcatttcgtccctgttctgccgccgacgagcgacgatgcggcgcctcctcctcgccggcatcctccgccgcgcctcctcctccccttcctcccaccaccacctccaccttgtcagggcgctctccgcctcgtccccgctcccggcctccgacgccgacctccgcaagtacgccggctacgcgctcctcctcctcggctgcggcgccgccacctactactccttcccgcttccccccgacgcgctccacaagaaggccgtccccttcaagtacgcgccgctccccgacgacctccacgccgtctccaactggagcgccacccacgaggtccacacccgcgtcctcctccagcccgactccctccccgccctccacgacgcgctcgccgccgcccacggcgagtgccgcaagctcaggcccctcggctcgggcctgtcccccaatggcctcgcgctctcccgcgccggcatggtcaacctcgcgctcatggacaaggtgctcggcgtcgacgccaagaagaagaccgtcaccgtgcaggccgggatacgcgtcgccgagcttgtcgacgcgctccgggagcatggtctcacgctgcagaacttcgcgtccattcgggagcagcaggtcggcggcatcattcaggttggtgcccatggcactggtgcaagattgccaccaattgatgaacaagttattagcatgaaattggttacccctgccaaggggacaatagagttgtcaagggagaaggatcctgatttattctatcttgctcgctgtggacttggtggccttggagttgtagcagaagttactcttcaatgtgtggaaagacaccaacttattgaacacactttcgtttccaatgcagacgaagtcaagaaaaatcacaagaaatggctctctgaaaataaacatattaagtacttatggattccatacaccgatacagttgttgttgtccaatgcaatcctccttcaaggtggagaactccaaagtttacctcaaaatatggaaaggatgaggctatacaacatgttcgtgatctttatcatgagtcattgaagaaatatagaactaaagcagaaagtaatgacccagaagtagatcagctttcattcactgaattgagggatcggttgcttaccctggatcctctagacaaagatcatgtgatcagaattaacaaagcagaagctgaatattggaagaagtcagagggttatcgcatgggctggagtgacgaaatattaggctttgattgtggtgggcagcagtgggtttctgaaacttgcttccctgcagggaccctagcaaagcctaatatgaaggatctggattatatagaggagctgctgcagttgattgagaaggaagatatacccgcaccggcacctattgagcagcgttggactgcctgcagcaggagtcccatgagcccagcatcaagctctcaagaagatgacatattttcatgggttgggataataatgtacctcccaacgtcggatgctcgccaaaggaaggaaattacagaggaattttttaattacagaagtaagacgcaaacaaatctatgggatggttattctgcatatgaacactgggccaaaattgaggttcctaaggataaggatgaactcgctgaactccaggctaggttgaggaaacgtttcccagtagatgcatataacaaagcacgcatggagcttgaccctaacaaggttctttccaatgcaaagttagagaagctcttcccagtaacagaggtccaacatgaaaagtaaggttgtgctgattgttgacatgtttgaagacatgtcggggatacttaaatcaatagccaaaactacaattctggtggtttctcgttacataaccggatatgaagagttaaattctttgtagaacgtggtctgttgctggagaagggttttagtgctcctcctcttggatcagtgcttagtactgaactgacgcgtttgttgctggaggcttttatacttgggaacatccatgcctattatgagactaaatggtctgttttatcaagagaaatggcatgtaaccttttgcagcagaaataaagtgcgtgaaataacaatttgatgcgcttcaagaaattaaagatttggccagtctaattagcttttataaaccaaaatgatagttttattcgataataatatactagtacttgcttctagctcgcctagaattgtgataagtggtgattaacagcggaaaaagggagtggaccag

SEQ ID NO: 2862 - DNA, 2210 bp, Oryza sativa
aaaggaaaaaaaaaaagggaaaaccccatttcgatctggtgcggcggtggctgtgcttcgtcccgtctctgccgccgacgagcgacgatgcggcgcctcctcctcgccggcatcctccgccgcgcctcctcctccccttcctcccaccaccacctccacctcgtcagggcgctctctgcctcgtccccgctcccggcctccgatgccgacctccgcaagtacgccggctacgcgctcctcctcctaggctgcggcgccgccacctactactccttcccgcttccccccgacgcgctccacaagaaggccgtccccttcaagtacgcgccgctccccgacgacctccacgccgtctccaactggagcgccacccacgaggtccacacccgcgtcctcctccagcccgactccctccccgtcctccacgacgcgctcgccgccgcccacggcgagcgccgcaagctcaggcccctcggctcgggcctgtcccccaatggcctcgcgctctcacgcgccggcatggtcaacctcgcgctcatggacaaggtgctcgacgtcgacgccaagaagaagaccgtcaccgtgcaggccgggatacgcgtcgccgagcttgtcgacacgctccgggagcatggcctcacgctgcagaacttcgcgtccattcgggagcagcaggtcggcggcatcattcaggttggtgcccatggcactggtgcaaggttgccaccaattgacgaacaagttattagcatgaaattggttacccctgccaaggggacaatagagttgtcaagggagaaggatcctgatttattctatcttgctcgctgtgggcttggtggccttggagttgtagcagaagttactcttcaatgtgtggaaagacaccaacttattgaacacactttcgtttccagtgcagatgaagtcaagaaaaatcacaagaaatggctctctgaaaataaacatattaagtacttatggattccatacaccgatacagttgttgttgtccaatgcaatcctccttcaaggtggagaactccaaagtttacctcaaaatatggaaaggatgaggctatccaacatgttcgtgatctttatcgtgagtcattgaagaaatatagaactaaagcagaaagtaatgacccagaagtagatcagctttcattcactgaattgagggatcggttgcttgccctggatcctctagacaaagatcatgtgatcagaattaacaaagcagaagctgaatattggaagaagtcagagggctatcgcatgggctggagtgatgaaatattaggctttgattgtggtgggcagcagtgggtttctgaaacctgcttccctgcagggaccctagcaaagcctaatatgaaggatctggattatatagaggagctgctgcagttgattgagaaggaagatatacccgcaccggcacctattgagcagcgttggactgcctgcagcaggagtcccatgagcccagcatcaagctctcaagaagatgacatattttcatgggttgggataataatgtacctcccaacgtcggatgctcgacaaaggaaggaaattacagaggaattttttaattacagaagtaagacgcaaacaaatctgtgggatggttattctgcatatgaacactgggccaaaattgaggttccgaaggataaggatgaactcactgaactcctggctaggttgaggaaacgtttcccagtagatgcatataacaaagcacgcatggagcttgaccctaacaaggttctttccaatgcaaagttagagaagctcttcccagtaacagaggtccaacatgtaaagtaaggttgtgctgattgttgacatgtttgaagacatgtcggggatacttaaatcaatagccaaaactacaattctggtggtttctcgttacataaccggatatgaagagttaaattctttgtagaacgtggtctgttgctggagaagggttttagtgctcctcttggatcagtgcttagtactgaactgacgcgtttgttgctggaggcttttatacttgggaacatccatgcctgttatgagactaaatggtctgttttatcaagagaaacggcatgtaaccttttgcagcagaaataaagtgcgtgaaataacaatttgatgcgcttcaagaaattaaagatttggccagtctaattagcttttataaacca

SEQ ID NO: 2863 - DNA, 2546 bp, Brachypodium distachyon
atggtgctgccgctgtggggaacccaggtcgcgagcggagacggcttggaggcgggcgacagcggcttggagacgggcaacggcgacagcgacacggagaagaacgagaaacggcctaagcaggaaaaaaaagaccgccgtaagctaagcaccccgttgaaaacccatttgattctcaaacggcgattaaaacccatcgcgatctggtccggtggcctctcgctcccgtcctgccatccctccggcggccacgactccgccgccgcagcaccagctccgacgatgcggcacctcctcatcccccgcttcctccgccgcgcctcttccctaacccactaccactcccacctccagctcctccgccccctctcctcctcctccccgctcccggcctccgaatccgacctccgcaagtacgccggctacgcgctgctcgtcctcggctgcggcgccgccacctattactccttcccgttcccgcccgacgcgctccacaagaaggccgtccccttcaagtacgcgccgctccctgacgacctccacaccgtctccaactggagcggcacccacgaggtccacacccgcgtgctcctccagccggactcgctcccggatctcgaggaagccctcgccgccgcccacaaggagcaacgcaggctcaggcccctcggctccgggctgtcccccaatggcctcgcgctctcccgggccggcatggtcaacctcgccctcatggacaaggtgctcgacgtcgacgtgaagaagaagaccgtcaccgtgcaggccgggatacgtgtcgccgagctcgtggacgcgctccgggagcatggcctcacgctgcagaacttcgcgtccattcgggagcagcaggtcggcggcatcattcaggttggtgctcatggtacaggtgctggattgcctccaattgatgagcaggttattagcatgaaactggttacacctgccaaggggacaatagagttatcgagggagaaagatcctgacttgttttatcttgcccgctgtggacttggtggcctaggagtcgttgcagaagtcacacttcagtgtgtagaacggcaccaacttgttgaacatacttttgtttctaatgcagatgaaatcaagaaaaaccacaagaaatggctctctgaaaacaaacatattaagtacttatggattccatatactgatacagttgttgttgtcaaatgcaatcctccttcaaggtggaaaactccaaagttgacatcaaaatatggaaaagatgaagcgatacaacatgttcgtgacctttatcgtgaagcactgaagaaatatagaactgaagcagaaagtaatgacccagcgatagatcaactttcatttactgaattgagggatcaattgcttgcccttgatcctctggataaagatcatgtgatcagaattaataaagcagaagctgagtattggaagaagtcagagggatatcacatgggctggagtgatgaaatacttggttttgattgtggtgggcagcagtgggtttccgagacctgcttccctacaggaaccctagcgaagccaagtatgaaggatttagattatatggaggaattgctgcagttaattgagaaggaagatatacctgcacctgcacctattgagcaacgttggactgcccgcagcaggagtcccatgagcccagcatcaagctctgaagaagatgatatattttcatgggttggtataataatgtatttaccaacatctgatcctcgccaaaggaaggacattacggaggaattcttcaactacagaagtctggcgcaaactagtctctggaatgattattctgcgtatgaacactgggccaaaattgagattccaaaggacaaggacgaacttgctgagctacaggctaggctgaggaagcgattccctgtcaatgcatataacaaagcacgcatggagctggatcctaacaaggttctctccagtgcgaggttagagaagctgttcccagcaacagggactgtccaaagtgcgaagtaaaggtgttctgattgttaccatctggaatgaaggcacagtgctttcacaatgtgtatgcctttttcttcctatggagaaaggtactcttccaagttggattctgttgttgatacttgaccagaactcaaaattataccatccttctcttctggtggtttgcatgacaaccttgcaggccgcagagttagtttctcccatagaaattgctctgttggtagagataggttttagtgctctaccttgtgctggagcttttgttgcatgaggcttattccttgatccgcggctgaaaaatctatgcttatcgggatactgtcattctgtgttgtaccaaatgtgatagtgatgaacatttggcagctgaaataaagcgtgagaaaaaacacgaattgatgcacttcaatctaatctatcacagttataagcctcagtttgtggttcggtttgatgtgttttgatttctgtaggatttagaaaaccatgatatcttaattctatattattctcta

SEQ ID NO: 2864 - DNA, 2370 bp, Triticum aestivum
gaatgagacacgtattaccatgaaaaaaaataacagccctgtagtgaatttttctccagcgaataccccgttcccaaacgaaccggcgattaaaaccccatcgcgatctggtgcggtggcctctcccgtcgccattcctccggccgcgattcgaccgccgccgcgctcccactcccgctccccacgatgcggcacctcctcctctcccgtctcctccgccgcgcctcctccccctcccagcctcaccacaacctccaacttatccgtgctttctcctcctcctcccctctcccggcctccgacaccgacctccgcaagtacgccggctacgcgctcctcgtcctcggctgcggcgccgccacctactactccttccccttcccgcccgacgcgctccacaagaaggccgtccccttcaagtacgcgcccctccccgacgacctccacaccgtctccaactggagcggcactcacgaggtccacacccgcgtcctcctccagcccgactccatcccggcgctcgaggatgccctcgccaccgcccacagggagcgacgcaggctcaggcccctcggctccgggctgtcccccaatggcctcgggctctcccgggccggcatggtcaaccttgcgctcatggacaaggtgctagacgtcgatgtcaagaagaagaccgtcacggtgcaggctgggatacgtgtcgccgagctcgtcgatgcgctcagagagcatgggctcacactgcagaactttgcgtccattcgagagcagcaggtcggcggcatcattcaggttggtgcccatggtactggtgcgagattgcctccaattgatgagcaggttattagcatgaaactggttactcctgccaaagggacgatagagttatcaagggagaaagatcctgatttgttttatcttgcccgctgtggacttggtggcctaggagtcgttgcagaagttactcttcagtgtgtagaaagacaccaacttgttgagcatacttttgtttctaatgcagatgaaatcaagaaaaaccaccagaaatggctttctgaaaacaaacatatcaagtacttgtggattccatatactgatacagttgtcgttgtccaatgtaatcctccttcaagatggaaaactccaaagttggcatcaaaatatggaaaggatgaagccctacagcatgttcgtgacctttaccgagagtcattgaagaaatatagaactgaagccgacagtaaagacccagcgatagatcaactttcatttactgaattgagggatcaattgctcgcccttgatcctctggataaagatcatgtgatcagaattaataaagcagaagctgagtattggaagaagtctgagggatatcgcatgggctggagtgatgaaatactaggttttgattgtggtgggcagcagtgggtttctgaaacctgcttccctacaggaactctagcgaagccaaacatgaaggatttatattatatggaggagttgctacagttgattgagaaggaggatatacctgcacctgcacctattgagcagcgttggactgcccgcagcaggagccccatgagtccggcatcaagctctgaagaagatgacatattttcatgggttggtataataatgtatttaccaacatcggatcctcgccaaaggaaggatattaccgaggagttcttcaactacagaagtctgacgcaaactagtctctgggatgattattctgcatatgaacactgggctaaaattgaggttccgaaggacaaggatgaacttgctcaactgcaggctaggttgcggaaacgcttccccgttgacgcgtataacaaggcgcgcatggagctggaccctaacaaggttctctccagtgccaagttagagaagtttttcccaggaatgcagactgtccaacatgcaaggtaaaggtgtcctgattgatggcatgctgaaggcacagagctttatcataatgtgtatcttttttttttgccctctggagaaatgtactcttccaagttggattctgtcgttgatagttggatcaaaagtcaaaactatcatgctgatgtgctggtggtttacatgattatagacgcgggcttccgagttaatttctttgtagaacttgcttggttggtagagccgtagaggtagttttttagtgatctcaggttaagcgcttgttggaggaggatgtctttggttcatgactaaacaatctatgcttatctatggtactatatatcatcctctgttgaaataaattctggggaagaagaacaaattgattcagttcaatgtgcagctggagaatttctttttaaaccaaaattttaacaaatcatcgtgttg

SEQ ID NO: 2865 - DNA, 2141 bp, Hordeum vulgare
gtcgccattcctccgggcgcgactggaccgccgccgagcaccccctccccctcgccacgatgcggcacctcctcctctcccgtctcctccgccgcgcctcctccccctcccagcctcaccacaacctccaactcattcgtgctctctcctcctcatcccctctcccggcctccgacaccgacctccgcaagtacgccggctacgcgctcctcgtcctcggctgcggcgccgccacatactactccttccccttcccgcccgacgcgctccacaagaaggccgtccccttcaagtacgcgcccctccccgacgaccttcacaccgtctccaactggagcggcactcacgaggtccacacccgcgtcctcctccagcccgactccatcccggcgctcgaggatgccctcgccaccgcccacagggagcgacgcaggctcaggccactcggctccgggctgtcccccaacggcctcgcgctctcccgggccggcatggtcaaccttgcgctcatggacaaggtgctcgacgtcgatgtcaagaagaagaccgtcacggtgcaggccgggatacgtgtcgccgagctcgtcgatgcgctcagagagcatgggctcacactgcagaactttgcgtccattcgggagcagcaggtcggcggcatcattcaggttggtgcccatggcactggtgcgagattgcctccaattgatgagcaggttattagcatgaaactggttactcctgccaaaggaacaatagagttatcaagggagaaagatcctgatttgttttatcttgcccgctgtggacttggtggcctaggagtcgttgcagaagttactcttcagtgtgtagaaagacaccaacttgttgagtatacttttgtttctaatgcagatgaaatcaagaaaaaccaccagaaatggctttctgaaaacaaacatatcaagtacttgtggattccatatactgatacagttgtcgttgtccaatgtaatcctccttcaagatggaaaactccaaagttgacatcaaaatatggaaaggatgaagccctgcagcatgtccgcgacctttaccgagagtcattgaagaaatatagaactgaagccgacagtaaagacccagcgatagatcaactttcatttactgaattgagggatcaattgcttgcccttgatcctttggataaagatcatgtgatcagaattaataaagcagaagcagagtattggaagaagtctgagggatatcgcatgggctggagtgatgaaatactaggttttgattgtggtggtcagcagtgggtttctgaaacctgcttccctacaggaactctagcaaagccaaacatgaaggatttatattatatggaggagttgctacagttgattaagaaggaagatatacctgcacctgcacctattgagcagcgttggactgctcgcagcaggagccccatgagtccagcatcaagctctgaagaagatgacatattttcatgggttggtataataatgtatttaccaacatcgaatcctcgccaaaggaaggatattaccgaggagttcttcaactacagaagtctgacgcaaactagtctgtgggatgattattctgcatatgaacactgggccaaaattgaggttccaaaggacaaggatgaacttgctgaactgcaggctaggttgcggaaacgtttccccattgacgtgtataacaaggcacgcatggagctggaccctaacaaggttctctccagtgccaagttagagaagttgttcccaggaatgcagactgtccaacatgcaaagtaaacgcgttctgattgatggcatgctgaaggcacagagctttatcataatgtgtatcttctcttttttgccctctggagaaatttactcttcaagttggattctgtcgttggtgttggatcagaagtcaaaactatcatgatgatgtgctggtggcttctgagttaatttctttgtagaacttgctcggttggtagaggtagtttttagtgcttgttgcaggaggattcctttggttcatgactaaagaatctatgcttatctatggtactatatatcatcctctgttgaaataaattctgagaaagaagaacaaattggttcggttca

SEQ ID NO: 2866 - DNA, 2304 bp, Hordeum vulgare
atgaaaattcacacacattcctcaccctagcactctcccagcaaaaacctcgttcccaaacgaaccggcgattaaaacccatcgcgatctggtgcggtggcctcttccgtcgccattcctccgggcgcgactggaccgccgccgagcaccccctccccctcgccacgatgcggcacctcctcctctcccgtctcctccgccgcgcctcctccccctcccagcctcaccacaacctccaactcattcgtgctctctcctcctcatcccctctcccggcctccgacaccgacctccgcaagtacgccggctacgcgctcctcgtcctcggctgcggcgccgccacatactactccttccccttcccgcccgacgcgctccacaagaaggccgtccccttcaagtacgcgcccctccccgacgaccttcacaccgtctccaactggagcggcactcacgaggtccacacccgcgtcctcctccagcccgactccatcccggcgctcgaggatgccctcgccaccgcccacagggagcgacgcaggctcaggccactcggctccgggctgtcccccaacggcctcgcgctctcccgggccggcatggtcaaccttgcgctcatggacaaggtgctcgacgtcgatgtcaagaagaagaccgtcacggtgcaggccgggatacgtgtcgccgagctcgtcgatgcgctcagagagcatgggctcacactgcagaactttgcgtccattcgggagcagcaggtcggcggcatcattcaggttggtgcccatggcactggtgcgagattgcctccaattgatgagcaggttattagcatgaaactggttactcctgccaaaggaacaatagagttatcaagggagaaagatcctgatttgttttatcttgcccgctgtggacttggtggcctaggagtcgttgcagaagttactcttcagtgtgtagaaagacaccaacttgttgagtatacttttgtttctaatgcagatgaaatcaagaaaaaccaccagaaatggctttctgaaaacaaacatatcaagtacttgtggattccatatactgatacagttgtcgttgtccaatgtaatcctccttcaagatggaaaactccaaagttgacatcaaaatatggaaaggatgaagccctgcagcatgtccgcgacctttaccgagagtcattgaagaaatatagaactgaagccgacagtaaagacccagcgatagatcaactttcatttactgaattgagggatcaattgcttgcccttgatcctttggataaagatcatgtgatcagaattaataaagcagaagcagagtattggaagaagtctgagggatatcgcatgggctggagtgatgaaatactaggttttgattgtggtggtcagcagtgggtttctgaaacctgcttccctacaggaactctagcaaagccaaacatgaaggatttatattatatggaggagttgctacagttgattaagaaggaagatatacctgcacctgcacctattgagcagcgttggactgctcgcagcaggagccccatgagtccagcatcaagctctgaagaagatgacatattttcatgggttggtataataatgtatttaccaacatcgaatcctcgccaaaggaaggatattaccgaggagttcttcaactacagaagtctgacgcaaactagtctgtgggatgattattctgcatatgaacactgggccaaaattgaggttccaaaggacaaggatgaacttgctgaactgcaggctaggttgcggaaacgtttccccattgacgtgtataacaaggcacgcatggagctggaccctaacaaggttctctccagtgccaagttagagaagttgttcccaggaatgcagactgtccaacatgcaaagtaaacgcgttctgattgatggcatgctgaaggcacagagctttatcataatgtgtatcttctcttttttgccctctggagaaatttactcttcaagttggattctgtcgttggtgttggatcagaagtcaaaactatcatgatgatgtgctggtggcttctgagttaatttctttgtagaacttgctcggttggtagaggtagtttttagtgcttgttgcaggaggattcctttggttcatgactaaagaatctatgcttatctatggtactatatatcatcctctgttgaaataaattctgagaaagaagaacaaattggttcggttcagtgtgcagctggataatttctttttaaaccaaaatttaaccgaatcattgtgttg

SEQ ID NO: 2867 - DNA, 2111 bp, Secale cereale
tgcggcacctcctcctctcccgtctcctccgccgcgcctcctccccctcccagcctcaccacaacctccaactcatccgtgctctctcctcctcccctctcccggcctccgacaccgacctccgcaagtacgccggctacgctctcctcgtcctcggctgcggcgccgccacctactactccttccccttctcgcccgacgcgctccacaagaaggccgtccccttcaagtacgcgcccctccccgacgacctccacaccgtctccaactggagcggcactcacgaggtccacacccgcgtcctcctccagcccgactccatcccggcgctcgaggatgccctcgccaccgcccacagggagcgacgcaggctcaggcccctcggctccgggctgtcccccaatggcctcgggctctcccgggccggcatggtcaaccttgcgctcatggacaaggtgctcgacgtcgatgtcaagaagaagaccgtcacggtgcaggccgggatacgtgtcgccgagctcgtcgatgcgctccgagagcatgggctcacactgcagaactttgcgtccattcgggagcagcaggtcggcggcatcattcaggttggtgcccatggcactggtgcgagattgcctccaattgatgagcaggttattagcatgaaactggttactcctgccaaagggacagtagagttatcaagggagaaagatcctgatttgttttatcttgcccgctgtggacttggtggcctaggagtcgttgcagaagttactcttcagtgtgtagaaagacaccaacttgttgagcatacttttgtttctaatgcagatgaaatcaagaaaaaccaccagaaatggctttccgaaaacaaacatatcaagtacttgtggattccatatactgatacagttgtcgttgtccaatgtaatcctccttcaagatggaaaactccaaagttgatatcaaaatatggaaaggatgaagccctacaccatgttcgcgtcctttaccgagagtcattgaagaaatatagaactgaagccgagagtaaagacccagcaatagatctactttcatttactgaattgagggatcaattgctcgcccttgatcctctggataaagatcatgtgatcagaattaataaagcagaagctgagtattggaagaagtctgagggatatcgcatgggctggagtgatgaaatactaggttttgattgtggtggacagcagtgggtttctgaaacctgcttccctacaggaactctagcgaagccaaacatgaaggatttacattatatggaggagttgctacagttgattgagaaggaagatatacctgcacctgcacctattgagcagcgttggactgcccacagcaggagccccatgagtccggcatcaagctctgaagaagatgacatattttcatgggttggtataataatgtatttaccaacatcggatcctcgccaaagaaaggatattacggaggagttcttcaactacaaaagtctgacacaaactagtctctgggatgattattctgcatatgaacactgggccaaaattgaggttccaaaggacaaggatgaacttgctaaactgcaggctaggttgcggaaacgcttccctgttgacgcgtataacaaggcgcgcatggagctggaccctaacaaggttctctccagtgctaagttagagaagttgttcccaggaatgcagactgtccaacatgcaaagtaaaggtgttctgattgatggcatgctgaaggcacagagctttatcataatgttttttttttttgccctctggagaaatgtactcttccaagttgaattctgccgttaatggttggatcaaaagtcaaaattatcgtcctgatgtgctggtggtttacatgattatagacgtgggcttccgagttaatttctgtgtagaacttgcttggttggtagagccgtagagttagttttttagagctctcaggttaagcccttgttccaggaggggatgtctttggttcatggctagacaatctatgcttatctatggtaattggtactatatatcatcatatattgaaataaattcagaggaagaac

SEQ ID NO: 2868 - DNA, 2195 bp, Triticum aestivum
tcggcacgaggccgtcgccacctccggccgcgactcgaccgccgccgcgcacccactcccgctccccacgatgcggcacctcctcctctcccgtctcctccgccgcgcctcctccccctcccagcctcaccacaacctccaactcatccgtgctctctcctcctcctcccctctcccggcctccgacaccgacctccgcaagtacgccggctacgcgctcctcgtcctcggctgcggcgccgccacctactactccttccccttcccacccgacgcgctccacaagaaggccgtccccttcaagtacgcgcccctccccgacgacctccacaccgtctccaactggagcggcactcacgaggtccacacccgcgtcctcctccagcccgactccatcccggcgctcgaggatgccctcgccacagcccacagggagcgacgcaggctcaggcccctcggctccgggctgtcccccaatggcctcgggctctcccgggccggcatggtcaaccttgcgctcatggacaaggtgctagacgtcgatgtcaagaagaagaccgtcacggtgcaggctgggatacgtgtcgccgagctcgtcgatgcgctcagcaagcatgggctcacactgcagaactttgcctccattcgagagcagcaggtcggcggcatcattcaggttggtgcccatggtactggtgcgagattgcctccaattgatgagcaggttattagcatgaaactggttactcctgccaaagggacgatagagttatcaagggagaaaaatcctgatttatttgatcttgcccgctgtggacttggtggcctaggagtcgttgcagaagttactcttcagtgtgtagaaagacaccaacttgttgagcatacttttgtttctaatgcagatgaaatcaagaaaaaccaccagaaatggctttctgaaaacaaacatatcaaatacttgtggattccatatactgatacagttgtcgttgtccaatgtaatcctccttcaagatggaaaactccaaagttggcatcaaaatatgtaaaggatgaagccctacagcatgttcgtgacctttaccgagagtcattgaagaaatatagaactgaagccgacagtaaagacccagcgatagatcaactttcatttactgaattgagggatcaattgctcgcccttgatcctctggataaagatcatgtgatcagaattaataaagcagaagctgagtattggaagaagtctgagggatatcgcatgtgctggagtgatgaaatactaggttttgattgtggtgggcagcagtgggtttctgaaacctgcttccctacaggaactctagcgaagccaaacatgaaggatttatattatatggaggagttgctacagttgattgaggaggaggatatacctgcacctgcacctattgagcagcgttggactgcccacagcaggagccccatgagtccggcatcaagctctgaagaagatgacatattttcatgggttggtataataatgtatttaccaacatcggatcctcgccaaaggaaggatattaccgaggagttcttcaactacagaagtctgacgcaaactagtctctgggatgattattctgcatatgaacactgggctaaaattgaggttccgaaggacaaggatgaacttgctcaactgcaggctaggttgcggaaacgcttccccgttgacgcatataacaaggcgcgcatggagctggaccctaacaaggttctctccagtgccaagttagagaagtttttcccaggaatgcagactgtccaacatgcaaggtaaaggtgtcctgattgatggcatgctcaaggcacagagctttatcataatgtgtatccttttttttgccctctggagaaatgtactcttccaagagttggattctgtcgttgatagttggatcaaaagtcaaaactatcatgctgatgtgctggtggtttacatgattatagacgcgggcttccgagttaatttctttgtagaacttgcttggttggtagagccgtagaggtagtttttttagcgatctcaggttaagcgcttgttggaggaggatgtctttggttcatgactaaacaatctatgcttatctatggtactatatatcatcctctgttgaaataaattctggggaagaagaacaaattgattc

SEQ ID NO: 2869 - DNA, 1776 bp, Panicum virgatum
cagcagccccaccgcccaccaccaccaccacctccccctcctccgcgccctcccccgtctcctccgacgctgacctccgcaagtacgccggctacgcgctcctcctcctcggctgcggcgccgccacctactactccttccccttcccagccgacgcgctccacaagaaggccatccccttcaagtacgcgccgctccccgaggacctccacgccgtctccaactggagcgccacccacgaggtccacacccgcgtcctcctccagcgggactccctcccggccctcgaggacgcgctcgccaccgcccacagggagcgccgcaagctcaggccgctcgggtctgggctgtcccccaatgggctcgctctctcccgggctggaatggtcagtctcgcgctcatggacaaggtgctcgacgtcgacgtgaagaagaagacagttggtgcccatggcactggtgccagattgcctcctgttgacgagcaagtcattagcatgaaactggttacccctgccaaagggacgatagagctatcaaaggagaaggatcctgagttgttttatcttgctcgctgtggacttggtggcctaggtgtcgttgcagaagttactcttcaatgtgtagaaagacaccagcttgtgcaacatacattcgtttccaatgcagatgaagttaagaaaaccacaatatatctatatacatggaagtggctctcagaaaacaaacatattaagtacttgtggattccttatactgacacagttgttgttgtccaatgcaatcctccctcaaagtggagaaccccaaagttgacatcaaaatatggaaaagatgaagcattacatcatgttcgcaacctttatcgggagtcgctgaaaaaatatagaactgaaacagaaagtaatgacccagaaatagatacactctcatttactgaattgagggataagctgcttgcccttgatccactggataaacatcacgtgatgaaagtcaataaagcagaagctgagtattggaagaagtctgaagggtatcgcatgggctggagtgatgaaatattgggctttgattgtggtgggcagcagtgggtttctgagaactgcttccccacaggaacaatagcaaatccaagtatgaaggatctggattatatagagaagttgctgcggttgattgaaaaggaggatatacctgcacctgcaccaattgagcagcgttggactgcccacagcaagagtccaatgagcccagcatcaagctccgaagaagatgatgtgttttcatgggttggtattataatgtatttgccaacatcagatgctcgccaaaggaaggaaattacggaggagttcttcaattacaggagcctggtgcaaagtctctgggatgattattctgcatatgaacactgggccaaaattgaggttccaaaggacaaggacgaactagctgaactacaggccaggctgtggaagcgtttccctgtcgatgcatataacaaggcacgcatggagctggaccccaacaaggtcctctcaaatgcaaagtttgagaagatgttcccagtgttggagcctgttcaccaggcaaagtaacgcgtgtgctgaagagtgaagatacataacttgtcattctgtcgttgatgcttaaccaagagccgaaactaacattcaacactgttggtggaatgttcagacttgtagtgttctgactttccagattttgtttgtgccttcacgtttgcaattctacccctatctgtaatcatag

SEQ ID NO: 2870 - DNA, 1537 bp, Setaria italica
tggagggttcgcggacctccacaacccgaacgttcgggtgaaggcaaaaattccagagaccacacgcagcgccttcacctcctccccgtcctctccccaatccggccaccccattcaccaacccaaaataaaagccgtctccggccaccagacccgggaattcctccggcgatccctcccttcgacggccgtctccttctccctgcgctccaggagattctccagcctgcagggcccaactaactgctgcgaaatggatagagggcagaacgggagggatccttttgctgggtttggtggctttggtccccaaaggagcttgatctctggcttctttggagggagggatccttttgatgatccattctttacccagccatttgggggtcggacgatgggtggccctggcatgtttggacctagtcctttcgggccgatgggagggccgttcggtgacatgaggaatgatggattcatcgagcaagctcctcctagaagtaacgtcagaaggcctgtcatcacagagcttgatgaggaaggagaaaatgcggagcacggtaacgagcagtcgaaccaggattcttatgttcaggagccagatgatacaagtgatgggatggaaggtggtcaagtccagctgcggagggaactcaatagggctaatagtggagggcagccgcaagctcgtactttcacatatcagagctcttctgtcacctatggtggtattaatggagcttactacactgcttcaaagactaggcggtctggtagtgatgggatcactgtggaagaaagcaaggaagcagatacaacaaccaaacaggccactcatagaatatcacgaggaatacatgataagggccattccctaacaaggaaactgaattcagatggaaaggttgacaccacacagacactgcacaacctgaatgaagatgaactggctggatttgaggaatcatggaagggtaatgctggacatcccttgcctggctggaatcagaatgctggtgcacctaatagtgataattctggtaaccgtagctccagtggacgtgaccggcgatctgcgtggggctgggcgcttcctggaacagagcaaggccgtgatccgaggcgcaacgggaagccgaaatcacgggtcatcccaatctcctgaagagagtatcttgcagaagtagataaataaacagccggtttgttgagatctgcttggttcaggtccgagttcgtttcaaggaaatgatctataggatcccaagtaacccgagaaagtccgaacgtgcccagcgcctgacgcgctattgtctgaaactctgaatgtatggaaacgtagaagccccaaattcagaagcttctgtagttgtgtaccactttatgtgaacaatttggctcatcgagccttgctgtaaaagcatcgtgtatattgcaaaacctgatcctgtgtttgctttgttggcggtgttcttgtttgggtcgctgaaggacgtgattatgcatttatgtgaagcgatctgctgctgtgtttggaaaa

SEQ ID NO: 2871 - DNA, 1843 bp, Panicum virgatum
aacattttaaaatactagttcaatatttttaatgctagttcaatatcaattagattttaatatactttatagataatttgattaaccagcccccgagcctgctgcccgcactggtcaaatctgcagggttcgcggacctccacaacccgaacgttcgggagaaggcaaattccagagaccacacagcgccttcacggcttcacctcctcctcagcgtctctccccaatccggccaccccattcatcaccaacccgaaataaaagccgtccccggccaccagactcgggaattcctccggcgatccctcccttcgacggccgtgtccttctcggtgcgccccaggagatcctctagcttgcagagatcacctaatagctccgaaatggatagggggcagaacgggagggacgacttcttcggtggcagggacccatttgctgggtttggtgattttggtccccagaggagcttgatttctggcttctttggagggagggatccatttgatgatccattctttacccagccgttcggtggtcggatgatgggtggtcctggcatgtttggacctagtctttttgggcagatgggagggtcgttcggtgacatgaggaatgatggatttatcgagcaagctcctcctcgtagtaatggcagaagacctgtcatcacagagcttgatgaggagggaggagaaaacgcagagcacggtaacgcgcaggcgaaccaggattcttatgttcaggagccagatgttgcgagtgatgggatggaaggtggtcaagtccagccgtggagggatctcaatagggctaatagtggagggcaatcacaagctcatactttcacatatcagagctcatctgtgacctatggtggtattaatggagcttattacactgcttcaaagactaggcgtactggcagtgatgggatcactgtggaagaaagcaaggaagcagatacaacaactaaagaggccactcatagaatatcacgaggaatacatgataagggccactccctgacaaggaaactgaagtcagatggaaaggttgacactacacagatactgcataacctgaatgaagatgaactagctggatttgaggagtcgtggaaggggaatgctggacatcacttgcctggctggaatcaaaatgctggtcctccaaatagtgataattctggtaaccgtagctccagtggacgcgaccggcgatctgcgtggggctgggcgcttcccggaacagagcaaggccgtgatccgaggcgcaatgggaagccgaaatcacgggtcatcccaatctcctgaagacagctatcttatggaagtagataaataaacaggtggtttgtcatttgtggaaagctgcaaggttcaggtccaagtgcctgacatgctgctgtctgaatgtattgatacgttgaaacattttggctcatcgagcctcgctgtaaaagcatcgtgtatactgcaaacctgatcatatatttcagtgtttgctctgtgctgttgtgaatttgtgaagcgatctgcttgctgctgtgtccaggaaacgggaactctggaattctgcttttgccactgttaaaacagcgggagtgtctgtcgtggatgagtagttaacggacggatgcccggcccatcagcagagaagaacgcaacggcgtagtctccgtcagagcgtgttcggccgtggcattggctgattggcagcccgcgacgcgccgccgcctctcggggctcgtcgcggcgtccgactccggcagctgagccacgcagcagcggatgtgcctcgaagccggaaatgctgatggggtttatgcccacgccagata

SEQ ID NO: 2872 - DNA, 1370 bp, Panicum virgatum
cgtctctccccaatccggccaccccattcatcaccaacccgaaataaaagccgtccccggccaccagactcgggaattcctccggcgatccctcccttcgacggccgtgtccttctcggtgcgccccaggagatcctctagcttgcagagatcacctaatagctccgaaatggatagggggcagaacgggagggacgacttcttcggtggcagggacccatttgctgggtttggtggttttggtccccagaggagcttgatttctggcttctttggagggagggatccatttgatgatccattctttacccagccgttcggtggtcggatgatgggtggtcctggcatgtttggacctagtctttttgggcagatgggagggtcgttcggtgacatgaggaatgatggatttatcgagcaagctcctcctcgtagtaatggcagaagacctgtcatcacagagcttgatgaggagggaggagaaaacgcagagcacggtaacgcgcaggcgaaccaggattcttatgttcaggagccagatgttgcgagtgatgggatggaaggtggtcaagtccagccgcggagggatctcaatagggctaatagtggagggcaatcacaagctcatactttcacatatcagagctcatctgtgacctatggtggtattaatggagcttattacactgcttcaaagactaggcgtactggcagtgatgggatcactgtggaagaaagcaaggaagcagatacaacaactaaagaggccactcatagaatatcacgaggaatacatgataagggccactccctgacaaggaaactgaagtcagatggaaaggttgacactacacagatactgcataacctgaatgaagatgaactagctggatttgaggagtcgtggaaggggaatgctggacatcacttgcctggctggaatcaaaatgctggtcctccaaatagtgataattctggtaaccgtagctccagtggacgcgaccggcgatctgcgtggggctgggcgcttcccggaacagagcaaggccgtgatccgaggcgcaatgggaagccgaaatcacgggtcatcccaatctcctgaagacagctatcttatggaagtagataaataaacaggtggtttgtcatttgtggaaagctgcaaggttcaggtccaagtgcctgacatgctgctgtctgaatgtattgatacgttgaaacattttggctcatcgagcctcgctgtaaaagcatcgtgtatactgcaaacctgatcatatatttcagtgtttgctctgtgctgttgtgaatttgtgaagcgatctgcttgctgctgtgtccaggaaacgggaactctggaattctgcttc

SEQ ID NO: 2873 - DNA, 1832 bp, Sorghum bicolor
agtgtggacggttcgcgagcctccacgacccgaacgttcgggagaaggcaaattccagacaccacacgcacagcgccgaacggatttcctcgtctcgtctctcccccaatccgaccacccccattcattcaccaacccaaaataaaaaagccgtcccggggcaccaggctccggagttcctccggcgatccctcccttagacggccgtccccttgcgcgcgcgctccaggagggccttccgccttcagcttgcagagcccacctaattgctgcgaaatggatagagggcagaacaggagggatgacgtcttcaggggcagggatccatttgctgggtttggttcccacaggagcttgatttctggcttctttggggggagggatccatttgatgatccattctttacccgtccgtttgggggtcagatgatgggtggcatgtttggacctagcccgtttgggggtcagatgatgggtgagcatgacatgtttggacctagcccttttgggccgatgggagggccttttggggacagggggaaccatgggttcatcgaccaagctccgcctaggggtaacagcagaaggcctgtgatcacagaggttgatgaagatgaaggagaaaacgcagagcacggtaacgagcagcccaaccaagattcttatgttcaggggccagatgatgggagtgatgggacagaaggtggccaagtccagctgcgcagggatctcaatagggctaatagtggagggcagccgcaggctcgtactttcacatatcagagctcttctgtgacgtatggtggtattaatggagcttactacactgcttcaaagactcggcggactggcagtgatgggatcactgtggaagaaagcaaggaagcagatacaacaactaaagaggccactcatcggatctcccgaggaatccatgataagggccattccctgacaaggaaactgaattcagatgggaaggttgacaccacacagacactgcacaacctgaatgaagatgaactagctggatttgaggaatcatggaaggggaatgctggacattacttgcctggctggaaccaaaatgctggtgtacctaatagtgataattctggtaaccgtagctccaatggacgtgaccggcggtcggcctggggctgggcgcttcctggcacggagcaaggccgtgatccaaggcgcaatggaaagccaaagtcacgggtcatcccaatctcctgaagagagtacacacgctttagcatggacggagtagatagataaataaacagctggtttgtggaagctgcaactctgcaaggttcaggtccaagttcgtttcaaggaaacaacctaaggtccaagtaaccagagtcctgacgaaggtccgaacgtgcccggtacctgaattactatttgtgtgaatgtgtggaaacgtagaaactcccccattcctgtggttgtacagtgttactaccttattatctctgatgtgaaaccatttgtttcgtcgagacgtcttgctataaaagcatcgcgtatattgcaagccaaacctgattcgttaggacaagtgctgacattgttctgttgtgagttgtttgggtcgctgtctctgaaggatgtgataagcgatctgcttctgtgtttggggaataacaagatgacctcggtttttttttgttttgtttttttttttgcttttgccactgttagcagcagaaaggatggtcgaagaggagaaactacaagaatcgggtgggaacaggtgccactggtaacagtcgccatcggcggttcagggcttgaggagctcagctctggcattggca

SEQ ID NO: 2874 - DNA, 1684 bp, Panicum virgatum
ttgatcgctcaaaagaattgaaacggggacaacgggccgaaaatctcaagtttttctctgaggaagctcggctcgatccacgacgagtggcccaagacatgaattcgctctaaagcccagtaagggaactggcccagtctggagtgttcgcggacctccacaacccgaacgttcgggagaaggcaaattccagagaccacacagcgccttcacggcttcacctcctcgtctctccccaatccgaccaccccattcaccaacccgaaataaaagccgtccccggccaccagactcgggaattcctccggcgatccctcccttcgacggccgtctccttctcagtgcgccccaggagatcctccagcttgcaaagatcacctaattgctccgaaatggaaaggaggcagaacgggagggacgacttcttcggtggcagggacccatttgctgggtttggtggttttggtccccagaggagcttgatttctggcttctttggagggagggatccatttgatgatccattctttacccagccattcgggggtcggatgatgggtggccctggcatgtttggacctagtcttttcgggccgatgggagggccgttcggtgacatgaggaatgatggattcatcgagcaagctcctcctaggagtaatggcagaagacctgtcatcacagagcttgatgaggagggaggagaaaacgcggagcacggtgatgagcaggcgaaccaggattcttacgttcaggttcaggagccagatgatgcaagtggtgggatggaaggtggtcaagtccagctgaggagggatctcaatagggctaatagtggagggcaatcacaagctcgtactttcacatatcagagctcttctgtgacctatggtggtattaatggagcttattatactgcttcaaagactaggcgtactggcagtgatgggatcaccgtggaagaaagcaaggaagcagatacaacaactaaagaggccactcatagaatatcacgaggaatacatgataagggccactccctgacaaggaaactgaagtcagatgggaaggttgacactgcacagatactgcataatctgaatgaagatgaacttgctggatttgaggagtcgtggaaggggaatgctggacatcacttgcctagctggaaccaaaatgctggtgcaccaaatagtgataattctggtaaccgtagctccagtggacgtgaccggcgatctgcgtggggctgggcgcttcccgaaacagagcaaggccgtgatccgaggcgcaatgggaagccgaaatcacgggtcatcccaatctgctgaagagagttatcttgtacaagtagataaataaacacaggtggtttgtggaaagctgcgaggttcaggtccaagttcttccagtgcctgacgtgctgttgtctgaatgtaccgatacgttgaaacccctgcagtggagtttctgtagttgtgtagtgccttctgtggtccgtgaaacattttggctcgtcgagccttgctgtaaaagcgtcatttatactgcaaacctgatcatatgtttcagtgtttgctctattctgttgtgaagctaaatgcttgctgctgtgtccagaaaacgggaactttggaagtctgcttttgccactgttaaaagacagcgggagcgtctgtcgtcg

SEQ ID NO: 2875 - DNA, 1457 bp, Panicum virgatum
acagcgccttcacggcttcacctcctcgtctctccccaatccgaccaccccattcaccaacccgaaataaaagccgtccccggccaccagactcgggaattcctccggcgatccctcccttcgacggccgtctccttctcagtgcgccccaggagatcctccagcttgcaaagatcacctaattgctccgaaatggaaaggaggcagaacgggagggacgacttcttcggtggcagggacccatttgctgggtttggtggttttggtccccagaggagcttgatttctggcttctttggagggagggatccatttgatgatccattctttacccagccattcgggggtcggatgatgggtggccctggcatgtttggacctagtcttttcgggccgatgggagggccgttcggtgacatgaggaatgatggattcatcgagcaagctcctcctaggagtaatggcagaagacctgtcatcacagagcttgatgaggagggaggagaaaacgcggagcacggtgatgagcaggcgaaccaggattcttacgttcaggttcaggagccagatgatgcaagtggtgggatggaaggtggtcaagtccagctgaggagggatctcaatagggctaatagtggagggcaatcacaagctcgtactttcacatatcagagctcttctgtgacctatggtggtattaatggagcttattatactgcttcaaagactaggcgtactggcagtgatgggatcaccgtggaagaaagcaaggaagcagatacaacaactaaagaggccactcatagaatatcacgaggaatacatgataagggccactccctgacaaggaaactgaagtcagatgggaaggttgacactgcacagatactgcataatctgaatgaagatgaacttgctggatttgaggagtcgtggaaggggaatgctggacatcacttgcctagctggaaccaaaatgctggtgcaccaaatagtgataattctggtaaccgtagctccagtggacgtgaccggcgatctgcgtggggctgggcgcttcccgaaacagagcaaggccgtgatccgaggcgcaatgggaagccgaaatcacgggtcatcccaatctgctgaagagagttatcttgtacaagtagataaataaacacaggtggtttgtggaaagctgcgaggttcaggtccaagttcttccagtgcctgacgtgctgttgtctgaatgtaccgatacgttgaaacccctgcagtggagtttctgtagttgtgtagtgccttctgtggtccgtgaaacattttggctcgtcgagccttgctgtaaaagcgtcatttatactgcaaacctgatcatatgtttcagtgtttgctctattctgttgtgaagctaaatgcttgctgctgtgtccagaaaacgggaactttggaagtctgcttttgccactgtt

SEQ ID NO: 2876 - DNA, 1506 bp, Pennisetum glaucum
gaccacacgcaggcgcagcgccttcacctccccccctccccgtctctccccaatccggccaaccccattcaccaacccaaaataaaagccgtctccggccaccacacccgggaattcctccggcgacacctcgctccgactgccgtctccttctccccgtgctccaggagatcctccagcttgcagaacccacctaattgctgtgaaatggatagagggcagaacgggagggacgacttcttcggtggcagggacccatttgctgggtttggtggttttggtccccaaaggagcttgatttctggcttctttggagggagggatccttttgatgatccattctttacccagccattcgggggtcggatgatgggtggccccggcatgtttggacctagtcccttcgggccgatgggaggaccgttcggtggcatgaatgatagattcatcgaccaagctcctcctcctagaagtaacagcagaaggcctgtcatcacagaacttgatgaggaaggggaaaatacagagcatggtaacgagcagtcgaaccaggattcttatgttcaggagccagatgatgcaaatgatgggatggaaggtgatcaagtccagctgcggagggatcccaataaggctaatagtggagggcagcctcaagatcgtactttcacatatcagagctcttctgtgacctatggtggtatcaatggagcttactacactgcctcaaagactaggcggtctggcagtgatgggatcactgtggaagaaagcaaggaggcagatacaacaacaaaacaggccactcacagaatatcacgaggaatacatgataagggccattctctgacaaggaaactgaattcagatggaaaggttgataccacacagacactgcacaacctgaatgaagatgaactggctggttttgaggaatcatggaaggggaatgctggacattacttgcctggttggaatcaaaatgctggtgcgcctaatagtgatatttctggtaatcgtagctccagtggccgtgaccggcgatctgcgtggggctgggcgcttcctggaacagagcaaggccgtgactcaaggcgcaacgggaagccaaaatcacgggtcatcccaatctcctgaagagagagtcttgcagaagtatagataaataaacagctgttttgttgagagctgcttggttcaggtcctgagttcgtttcaaggaaatgatctacaaggatccaagtaaacccgtgcccagcgggcagctgcgctgttgtctgaaactctgaatgtactctgaatgtatggaaacgtagaagcccttgattcagaagcttctgtagttgtgtaccactttattatgtaaacaatttggcttgtcgagcctgtgaaagtgtgagtatattgcagacctgatcctgtgtttgcttcgttggtggtggtcttttggatcgctgaaggatgtgattatgaaaagccatatacatgcaggtgtgtttgggaaaa

SEQ ID NO: 2877 - DNA, 801 bp, Setaria italica
ccgccacctgctctccctccgccgcctcccccgccatccgctgcctcccgtgcccgtcgccgcccctcccgtccgccacctgctctcgctccgccgcctcccctgctctccgccgccgcccctccccaccgtcgcacctccccatcgcctctcatcccgtccgccaccttccctcccctccgcctcctccctgctgtccaccggtgaccctcccatcggcgcaccggagcaaggacatcttcaggatctcagcttcgtttcgccaagagaaatggaactgggtgataaggcagttggttttctgctgacgctaactagcttatccatcttcacctactatacattctgggtcattatcttgccattcgtcgacagcgaccactttgtccacaagtacttcctgcctcaagagtatgcgattttaataccagtgattgctggcgtggttcttctttctttcttgagcgtctttgtgggtctcgtgatgctcaaatcaaagaaaaagaagaagaccaattgattgttttgacatgtacactgtattcttcacttactatgattaaatccatgagttcagtctctatgtactccctccgttccaaaatttgggacataacccaataattaggtgcattgcaaaatttatgtatctaaaaaagttaaaatgatctgcattttggaatggagggagtaattgctagaagctcggtaaacggttccaatatattgaaaggcgctcactttgtaactcagaactctatagcctttttaattcttgggtcacgtcaattaaaagatgac

SEQ ID NO: 2878 - DNA, 804 bp, Sorghum bicolor
tttttttttccgccgtctgcttccccttccgtccgctgacgactcctccttccctcctcctgtctctctctcgctcgctaccctctcgctcccagacgactgttgggccgccgccgccgccgccgcctaggccaggtgctgaggctttccttggtctcttcgccggccacgagcaccaccagacaaatggaactgggtgataaggtagtcggttttctactgactctgacaagcttatccatatttacatactatacattctgggtcatcattttgccattcgttgacagcgaccactttgtgcacaagtacttcctgcctcaagagtatgcaattttgataccagtgcttgccggcgtagttctcctttcgttcttgagcgtctttgtgggtcttgtgatgctcaagtcaaagaagaagaagaagaccacttgatcgggtttgccatgtacattgcttactgtgatgaaatacatgattcagagtatttaattgctagaggcttggttttgtaatcagttctgtcatactttaaaggtgtttactttgtagtttgggtgtattttttttgtgtgtttttattctggtggttaactaaaagcagtgttgatcaaaactctagttagaggtcacaaagcattatccattattctgactgaacagtcttttaaagggcaaacggttgacagtgattgaaagatgaccgctcactcatcctcgtttgaactgtggggttgtcatccaggtgctcagattcaattcaacagctattgtaattagattagaaacacgtcctcagccttc

SEQ ID NO: 2879 - DNA, 746 bp, Saccharum officinarum
ggcacgaggccgccgccgcctgcatcgcactgacaaaggtccctcttcccagatcgagcctccctcttcccagatcggttcctagtgacaacggtccctcttccgagatcggttcctagttgggctaccgccgccgccgccgccctacgacgggtgccgaggccttcgctgatgagcgcccgccagacaaatggaactgggtgataaggtagtcggttttctactgactctgacaagcttatccatatttacatactatacattctgggtcatcattttgccattcgttgacagcgatcactttgtgcacaagtacttcctgcctcaagagtatgcgatttgataccagtgctggccggcgtagttctcctttcattcttgagcgtctttgtgggtcttgtgatgctcaagtcaaagaaaaagaagaagactacttgatcgggtttgccatctacactgcagtgttattcacgtactgtgatgaaatacacgagttcggagtatctaattgctagaaggtcggttctgtaatcagttcggtcgtactttaaaggtgtttactttgtaatttggatgtatttttttgtatttttgactctggtgttcatcaaaactctagttagaagaggtcacatatcattagccgttggttggactgaacagccttttaaagggtgaacgggtgacagtgactaaaagatgaccgctgactcatcctctttagtttataactgtcgggttgttta

SEQ ID NO: 2880 - DNA, 941 bp, Panicum virgatum
gttgcatttgatgcttggagttgtagccatgtggtagcagtagcactattgcaatctcagaccatatttatgtttaatcagcactttgtgtagatatgtaggcacagtagcaactgccgcacgtccagatgtgtagtaatgcctaaatttgtgataatgcactatatgacaaggcatagtgtatatgagtgttactaagctagtgctgctctgtttcagttgtttatcttgccttcgtttgggtgcattgctaggacaggctttgcagtggagtggctgcttgtctcccttgataccgttctagcagtctagtctatttttcccatattggattattttttgtgcaatacttttgtgctgttcagattatgaacccatcatagaacatatttgacatttggtttggattatcatgtccattcatctgccaaaattcactgacaaggttgttaatttctattattctcagagaaatggaactaggtgataaggcggttggttttctgctgacgctaacgagcttatccatcttcacctactatacattctgggtcattatcttgccgttcgttgacagcgaccactttgtgcacaagtacttcctgcctcaagagtatgctattttgataccagtgattgccggcgtggttctcctttctttcttgagcatctttgtgggtctcgtgatgctcaagtcaaagaaaaagaagaagaccacttgattgggtttggcttgtatattgtagtactcttcgcttactatgatgattaaatccatgagttcagagtctatataattgctggaatctcggtaaacagttccatcgtatcgttggcgctcactttgtaactcagatctctgttttcatttgtgattctcagatcaatcaagttaattgaaagacgaccactcaggttgtccgtttttctttattgtaaaa

SEQ ID NO: 2881 - DNA, 890 bp, Panicum virgatum
aggttcgtttcctactggacgcactctcaactttggcccatccacttctactgtagaactgggcttggtagtggaaaccaatcccatgggccagacgcggtccaagcccggatcaaataccgggcccgtccaagcccatgggctgggaacgggtgcgaaatttttatccgaacggacccgatttctacccggcccgagtccggcccagcccataaatgggtctacctcagcccgtctcccccgtcccttccagatccgtcgccgcccggcgcccgtctccgccgtccgccggccgcgccgcccacgcgcctcctcgcgctcgtgctgggcacggcgccgcccgtctccccggcccgcgccgcccctccgcggcgtctgcgtgccacctcgcgctcgcgccgccgcccgtcccggaagagaaatggaactgggtgataaggcagttggttttctgctgacgctaacgagcttatccatcttcacctattatacattctgggtcattatcttgccgttcgttgacagcgaccactttgtgcacaagtacttcctgcctcaagagtatgagattttgataccagtgattgccggcgtggttctcctttgtttcttgagcatctttgtgggtctcgtgatgctcaagtcaaagaaaaagaagaccacttgattgggtttgccatgtacattgtagtactcttcacttactatgatgattaaatccatgaattcagagcccatgtaattgctagaagctcggtaaacagttccatcatattgaaggcgctcactttgtaactcagatctctgttttcatttgtgattctcagatcaagttaatcgaaagatgaccactcaggttgtcggtttttctttattgtgaaatatatgtt

SEQ ID NO: 2882 - DNA, 1641 bp, Panicum virgatum
caagtaatggaaacataaacttttaaccacactatcagccaggttttgacttcctgtagttcagctgagatgaattgcatatggtatcacccaattttactcatatagcccaacctttgagcaattggaccattctaacatgtttattatagcaggttgtctgtcctggcgtccatacttaataacaaagtagaactaagggcttttgttgttttgagtagctaagccatttatcaactatgaagtaatcaccacattgtacttaggacttcatgtgtgtgcaaatgatataaagaagggaaatttgtgtaagcaatgctcataaagaatttttgtaaatcagtataggaaactgagcaactaccagtacagacatttttcttatgtaattttagagaatgatgttgaccgagcatagtaacaaatgtgtaccaacatagtgtgtctttggtaaattaaagtttgatttcctttcttcaaagtactgatatcctacctgtaggcattccgcttttctaggatgtcattacactatgttatttgagaatttaagttatttaccagaaattccattatcatactatgtgagtttctaatatggttggattttctaaaatgtgagttttagttttatagtaatataccagaatttgtgcttggattttctagtagttatgtttcctgcaacttcatgatgaaatgtcgtacctgttgcatttgatgcttggagttgtagccatgtggtagcagtagcactattgcaatctcagaccatatttatgtttaatcagcactttgtgtagatatgtaggcacagtagcaactgccgcacgtccagatgtgtagtaatgcctaaatttgtgataatgcactatatgacaaggcatagtgtatatgagtgttactaagctagtgctgctctgtttcagttgtttatcttgccttcgtttgggtgcattgctaagacaggctttgcagttgagtggctgctcgtctcccttgataccgttctagcagtctagtctatttttcccatattggatattttttgtgcaatacttttgtgctgttcagattatgaacccatcatagaacatatttgacatttggtttggattatcatgtccattcatctgccaaaattcactgacaaggttgttaatttctattattctcagagaaatggaactaggtgataaggcggttggttttctgctgacgctaacgagcttatccatcttcacctactatacattctgggtcattatcttgccgtttgttgacagcgaccactttgtgcacaagtacttcctgcctcaagagtatgcgattttgataccagtgattgccggcatggttctcctttctttcttgagcatctttgtgggtctcgtgatgctcaagtcaaagaaaaagaagaagaccacttgattgggtttggcttgtatattgtagtactcttcgcttactatgatgattaaatccatgagttcagaatctatgtaattgctggaagctcggtaaacagttccatcatattgaaggcgctcactttgtaactcagatctctgttttcatttttcattctcagatcatgttaattgaaagacgaccactcaggttgtcggtttttctttattg

SEQ ID NO: 2883 - DNA, 4213 bp, Oryza sativa
atggtgcctcatgaagaaagagcagtggtggtagatggagcaggaggaacgatggtgcctcatggagaaagagcggtggtggagaggggcgccggtctccatctggcgagcacaggaggggatcctgaacggtcaggatcatctctgcttaaaatccaacgctgaggatcgtctccaccgcgccctcttctccgccccctctctctcgctctcacgcgccgccgcccctccccaaccccgacctacgcccaaacccccgtctaccttaatctctccctctcacgctgcgccaccgccgtcgacgccgccctcgactgccgccgctccgccgtcgtcgcaaccgtcgtctcgccgccacctatccccgccgccggctcgccctcaaccgatccccatcgccgtcgtcgcatccgtcgccctcaaccgatccgccgtcgcatgccgcatcatcgccgtcgcgcgccgtcgaccccctgtccgcccctcctgacctgatagagaaatccgcctccccaatccccccgcgccccgctccacagtcccgcatcgccccccgcccccttcctcgctctcgctctccaaaccctaaccctaaccccaaccctggtcgtctcggagcatctagcaccggatcccgcggtcccctcaccatcttcgcttgcgatctcactggtcgcgcctctattcacggccactgcggaccgctcccctccaaccggaacagcagcatcgccatcggcgacgggagcaggatccccatctggatcagcggtaaacaagtaggtgattggattggctttcttttatttggttgttttctgcactttgaacgaaagcaagcaaattatcccttcttttattttggttcgattcagaattgacaatacataataaatctgagtaaatgttaagcaatcttagtatcttacattactcctttcctttaattgtgagatgatgctagagatattgagtgggattttataacatgatatatattcagctactacctgcagaatgcattctcttgtgccgtctaaaatgggaaaagaaatggctctaatttcactgagggttttttaaaatgtaacaatgacatagcattgctattgacaaattttatcattttaatttatttctctatcaggtcactgctaaccttgattatctaccctataattcaccaacttcactcctacatacctcattcatcaaatccaatgacccaaaattcttgaatctaacaactcacatacacggtgattgaggcaagaaattatgtagcatgtacagcaggttttcttggggaatagttgtgtttattgcttccaggataatctttttctaaaattatctgcactgctgtgctgcacattactatagtcaaggtctggagaaagcgtgataaggagagtattcttaccttagtgcaaagcaataggaagctaggcttcagaagaattatgagtacaagcagtgatggggcttctacaactgccactggaatcctaatgctcttatttattttaccatggaactgccactaaaattatgtgggtcatgaattttataacagtaccctaatagaaatggattttatttacaactgccactggaatcctaatgctcttatttattttaccatggaacggctactaaaattatgtgggtcatgaattttataacattaccctaatagaaatggattttattttatcatatttaattacattctttattgtgcttactgcattcgatttttgagatatgcacatgggtaagttcattgcactctataaatgtggtaattcactagcaaagttttgggagtataaacttgtctaggaaaatgcctgggaactggtcagaataccatgtggctctgaacactctgatttatagggtttatgataacacactgacttacttacctgaatattgtttctgaattttatcttattatcttcctcagataatttattttatgaggaatggttaaaactaacatgcaaactgttgtattcctattaaggccactgtgtgagggacgacgctgcagctgctgaggaagtagattttatcatctgaatcaagtttagatttgtacaatatctgcacaaatggaattgggggacaaggcagtaggctttattttaaccttgacaagtctatccatctttacatactatactttctgggtcatcatcctgccatttgttgacagtgatcacttcgtccacaagtactttctgcctcaagagtatgctattttgatcccagtgcttgctggcgtgattctcctatctttcttaagcgtgttcatgggtcttgttatgctcaagtcaaagaaaaagaagaagaccacttgattgaatttaaccatatttgtttattgattacgattgcaagctctatacaagaaagcaggttttgcatatgattccgttctatgtagtggtttttgcatgtaagtcgtagtttcagctttattattattatttcatttttgctgttgggttgtgaactaaacttaaagtgcatgtttatatcttcatggctaatttcagctggacagtccgaggacttgtattgttatgcaaatcaaatccactagaagtataagcgcggcgccacgccgcgcacgctaacatatgcatagggcgcgcacgtccggatccgccgctgccgaaggccggtcgtgtggcgacggatccgccggaggacccccgttgccgtcacttggggaagggggggggtcgcacgggccaccgaatgccgcccgcacggcggcagctccgccttgctcctcctcgccgccgccaacaaagtctgtaccgtccccgcgccgactcgagggcagagagctcctccgcgccgctgacctacttaatgcctccccgcggagttccacccccaagatctgcccagcaccgcctcattgtcggagaggtcccacgcctcgtactacccctcggccccatcctcatcggcagccctgccaccatcgccatcaccggaaaatcctccttctctttctccttctcggccttcatacgaacctgcagtggtgacggcgcacaggaagggggcggcggcgcagcacaatggagaggaggtgggaggcggcgcgcggaaggacggcgacaacacgcgagggagggggtagcggcgtagcacagcggggaggaggtgggaggcggccgggcggcggcgcgcggggagagggccgcggcgcagcacgggaggagttgggaggcggccgggcggcgatgcgcgaggaggggtggtggagctccacgtctttcgatctgcgtgaggtggggaggggtggcgaactcgcggtcgaaaccggcatcgccgccaagctcctgttgtggtcgccgctgtcgagttccgcaagctcctccacgctgacgatttcttgctccccggctccctgcttgccctgttcgcccgccgcggcttcctgatggggacggctggcgctcgcggctgggtcagccgccgccgcatgccccattgccggccggcggcgggataggggagagagcaagggggaggggcggcggcgaagcgtcgtggggaggggatgtgaggatagagtttgggggtgggagctgggaggggaggggataggtatgatatgtttttttttggaaaaaacctcttgttttttatgtttacatcgctaccccctaagagtagaactctatcttcttcgtgttgtatttctataaaatacgagggttgtttcgtataaaatggaacgtgatgttagtcggtgggaggcagtgcacgctattccgttcaaacacgaggatttttttgcataaatatcagcacgcgtcatttgctccaaggaggcaaaacgtgacgcacatgcagcgcgtgaccggcagaaccgatggggaacccgaagagagagaaaaggaaaggctccacagctcacccaatcgaggagctcctaacgaggagcaaaaaaaaataatatttcaaaaaaaagagagaatcggtagctttagggcttttattaattgataatttctttcggagttaattaccgagaaaagaatcatatgtacatgacaaacaattggctctctcctctccagtcctaccatacctcttgctctcaatttgtcttcccttcctgaatcaaaggtcatgtaaagattattatcaaaggtcatgtaaagatcattgatttgatgct

SEQ ID NO: 2884 - DNA, 279 bp, Oryza sativa
acaatatctgcacaaatggaattgggggacaaggcagtaggctttattttaaccttgacaagtctatccatctttacatactatactttctgggtcatcatcctgccatttgttgacagtgatcacttcgtccacaagtactttctgcctcaagagtatgctattttgatcccagtgcttgctggcgtgattctcctatctttcttaagcgtgttcatgggtcttgttatgctcaagtcaaagaaaaagaagaagaccacttgattgaatttaaccata

SEQ ID NO: 2885 - DNA, 465 bp, Panicum virgatum
  misc_feature (15)..(15): n is a, c, g, or t
  misc_feature (27)..(27): n is a, c, g, or t
  misc_feature (45)..(45): n is a, c, g, or t
  misc_feature (51)..(51): n is a, c, g, or t
  misc_feature (56)..(56): n is a, c, g, or t
  misc_feature (72)..(72): n is a, c, g, or t
agagaaatggaactnggtgataaggcngttggttttctgctgacnctaacnagctnatccatcttcacctantatacattctgggtcattatcttgccgttcgttgacagcgaccactttgtgcacaagtacttcctgcctcaagagtatgctattttgataccagtgattgccggcgtggttctcctttctttcttgagcatctttgtgggtctcgtgatgctcaagtcaaagaaaaagaagaagaccacttgattgggtttggcttgtatattgtagtactcttcgcttactatgatgattaaatccatgagttcagagtctatataattgctggaagctcggtaaacagttccatcgtatcgttggcgctcactttgtaactcagatctctgttttcatttgtgattctcagatcaatcaagttaattgaaagacgaccactcaggttgtccgtttttcttt

SEQ ID NO: 2886 - DNA, 429 bp, Panicum virgatum
cagagaaatggaactgggtgataaggcagttggttttctgctgacgctaacgagcttatccatcttcacctattatacattctgggtcattatctagccgttcgttgacagcgaccactttgtgcacaagtacttcctgcctcaagagtatgagattttgataccagtgattgccggcgtggttctcctttgtttcttgagcatctttgtgggtctcgtgatgctcaagtcaaagaaaaagaagaccacttgattgggtttgccatgtacattgtagtactcttcacttactatgatgattaaatccatgaattcagagcccatgtaattgctagaagctcggtaaacagttccatcatattgaaggcgctcactttgtaactcagatctctgttttcatttgtgattctcagatcaagttaatcgaaa

SEQ ID NO: 2887 - DNA, 393 bp, Panicum virgatum
aatggaactgggtgataaggcagttggttgtctgctgacgctaacgagcttatccatcttcacgtattacacattctgggtcattatcttgcccttcgttggcagtgaccactttgtgcacaagtacttcctgcctcaagagtatgctattttgataccagtgattgccggcgtggttctcctttcattcttgatcatttttgtaggtctcgtgatgctcaagtcaaagaagaagaagaagactacttgattgggtttggcatatacattgtagtatttatagcctttcattcttgacttactatgattattaaatccatgagttcagagtctatgtaattgctagaatctcggtaaacagttccatcatattgaaggcgctcactctgtaac

SEQ ID NO: 2888 - DNA, 279 bp, Oryza sativa
acaatatctgcacaaatggaattgggggacaaggcagtaggctttattttaaccttgacaagtctatccatctttacatactatactttctgggtcatcatcctgccatttgttgacagtgatcacttcgcccacaagtactttctgcctcaagagtatgctattttgatcccagtgcttgtcggcgtgattgtcctatctttcttaagcgtgttcgtgggtcttgttatgctcaagtcaaagaaaaagaagaagaccacttgattgaatttaaccata

SEQ ID NO: 2889 - DNA, 608 bp, Avena sativa
ctcattttctctcgtatcgtatacgaacagagcaagaggcccacccttaaaataaaaacagagcagggaggcgatcggcaccgaggccgcgagcaccggcggcgaagacgatcactggaggccaataaagccgacctgctacaccgccgaatcccttctgttcctcccctcgaggaaacctcaaatcaagcttagctttccagaagtttctgaagaaatggaaatgggagacaaggcggttggccttgtgttgaccatgacaagtttatccatttttacctactatactttctgggtcataatcttgccattcgttgatgatgatcactttgtccacaagtactttctgcctcaagaatatgccatcttcatccctgtgtttgccggtgtggtgctactctcgttcttgagtatatttgttggtcttgtgatgctgaaatcgaagaaaaagaagaccgcttgatagttgaggctctcccgtgctgatctaatgtattcgagtggatcagaagtctacatgtagaacttagtagaagttgtgttttgtggatgattcgtttactttttttgaattaccttcgattatagttttaaggttttctcttcac

SEQ ID NO: 2890 - DNA, 933 bp, Brachypodium distachyon
aatttctccttttatttgctttgcttggcaaccttccctcccctggcccatctcgctgccgagcgccccgacggcgcaaccccgtcgctcgtcttcctcctcgaacgagcgacccgtgccgctgctgagcgccccagccccctcgctccgtcgctcgtcttcctcctcgtgcgagtgcctccaccgcagggagctgatatttgtacctgcacaaaaattaggttaagttaccataaatttctgaagaaatggaattgggagacaaggcgattggccttgtgttgaccatgacaagtttatccatattcacctactatactttctgggtcataatcttgccatttgttgacgacgatcactttgtccatgagtactttctgcctcaagaatatgccatcttcatcccggtgttagccggtgtagtgctcctttcattcttgagtatatttgtcggtctcgtgatgctgaattcaaagaaaaagaagaaggccgcttgactgactggcatttctactgccgatctgatctgatggagtttctggctgtagaagtctatatatagaacttggtacaagtttggcttttgtggatgatttcattctatcaaattgccttcacttgtaatttaaggttttctcttggcacatctgtcctcacttgaaacttctaacagatatttgcatgttcttggctaattcttgatcgctgtgtcactccaattctaaacatcttttttttcctagaatacatcaaaaatggtgtatcatcaattaagaagaagatgctgcggagcagctacatgcccattacaggccgggattactcaaatatcagaagaatgccttctggagtcagaaaccaacttcttagcctcgatatccagcacggtattctgaggaacctcaaatatgttattgctccagcctcaaatgg

SEQ ID NO: 2891 - DNA, 798 bp, Eucalyptus grandis
ggaacattggaataatcagatttgcaaaattcaaactcctcgtgccaatcgattccaaatctcaaatttaggctaaaactttttagcccaaattgaaaccaattccattaagcccaaagcccatctaaatttctttcgtccgtcaagctcctcctttttcctggcgaatgattccaccgttgctgggcaaaacgggggtcagagccgaatcgggtcgatttcttccctttcaatctcgaccggcaaaatcctccggcgtcggcagctgttcagccgtttctctggggtgcccgtagctcaaggttaggggcatgcgaaatggaactggcggacagagcagtggggtttctgttaacacttgttagcttatccatcttcacttactacaccttttgggtcatcattctgccttttgtggatagcgatcacttcgtccaccagtactttctaccacaggaatacgcaatactcattcccgttttcgcaggcgtggtgctcttatgcttcttatgtgtgttcattgggcttgtgatgctcaaaccgaaaaagaagaaagcatagtgaccggtatttatagttccttttctgtttggcctaacactaccacatgctgattctgtaattagttatcttttttccggattagatgtaatgaagaacatgtggactgatacttcttgtaatggatctttgactggaagaggattttttgctgggtaaatggattcctacatttcaaagacttgtttattgatctatatcttctccattggcgtcaacggaaccatcgctgatcaa

SEQ ID NO: 2892 - DNA, 666 bp, Triticum aestivum
gggaaagtttgcctgtttggtttctctccatccctcgttcttctctgtcccgtgcggcgtcggctagatcgtggcgctccggcgacggcggttgaagggcgacggctgcggcagggcgtaggaaacccatttgtgtatctcaaatcaagagtaggttcctacaaattctgaagaaatggaaatgggagacaaggcggtcggccttgtgttgaccatgacgagtttatccatctttacctactacactttctgggtcataatcttgccatttgttgacgatgaccattttgtccaccaatactttctacctcaagaatacgccatcttcatccctgtgtttgccggtgtggtgctactttcgttcttaagtatattcatcggtcttgtgatgctgaaatcgaagaaaaagaaggctgcttgatggatttggcgactcccccgctgttccagtggaatttctggtttacttgtagaacctagtagacaggtttcgtggatgattgtatttcattgagtcgccttcacttgtgatccaaggctttctcgtgactgcgtgttcttggtagttatcgatcgcaaggtgtatgccattccaagaataaacatgggtcaaatatcaagtgttgttacatcgataattctcggatgatgtgtttgatcaatgta

SEQ ID NO: 2893 - DNA, 784 bp, Triticum aestivum
agggaaagtttgcctgtttggtttctctccatccctcgttcttctctgtcccgtgcggcgtcggctagatcgtggcgctccggcgacggcggttgaagggcgacggctgcggcagggcgtaggaaacccatttgtgtatctcaaatcaagagtaggttcctacaaattctgaagaaatggaaatgggagacaaggcggtcggccttgtgttgaccatgacgagtttatccatctttacctactacactttctgggtcataatcttgccatttgttgacgatgaccattttgtccaccaatactttctacctcaagaatacgccatcttcatccctgtgtttgccggtgtggtgctactttcgttcttaagtatattcatcggtcttgtgatgctgaaatcgaagaaaaagaaggctgcttgatggatttggcgactcccccgctgttccagtggaatttctggtttacttgtagaacctagtagacaggtttcgtggatgattgtatttcattgagtcgccttcacttgtgatccaaggctttctcgtgactgcgtgttcttggtagttatcgatcgcaaggtgtatgccattccaagaataaacatgggtcaaatatcaagtgttgttacatcgataattctcggatgatgtgtttgatcaatgtagtcggcactcaacatgtatcatgcttctgcttctgtgtagttctcttttggtgcgggtacaaaagtttgacataaagctacagcactgcccgggtacatgtatccatcttttacggc

SEQ ID NO: 2894 - DNA, 569 bp, Hordeum vulgare
aggaaacccagtttttttttaatctcaaaccaagactaggttcctataacttctgaagaaatggaaatgggtgacaaagcagtcggtcttgtgttgaccatgacgagtttatccatttttacctactacactttctgggtcataatcttgccatttgttgacgatgatcattttgtccaccaatactttctacctcaagaatacgcaatcttcatccctgtgtttgccggcgtcgtgctactttcattcctaagtatattcatcggtcttgtcatgctgaagtcaaagaaaaagaagaaggctgcttgatggatttcgcgaccccccaccccccctcttccagtggaatttctggtttccttatggatagtagacaggttttgtggatgatcgtatttcattgaatcgccttcacttgtgatctaaggatttctcattgcacttatgtcttcaattagatctaactggcatttgcatgttcttggtagttattgatcgcaaggtgtataacattccaagaataaacattggtcaaatatcaagtattgttacatttagttggcgctcaa

SEQ ID NO: 2895 - DNA, 661 bp, Hordeum vulgare
cggcacgagggcctctttggtctctccatccctcgttcttctctgcccgtgcggcgtcggctagatcgcgggctccggcgacggcggttgaagggcgacggctgcggcagggcgtaggaaacccagtttttttttaatctcaaaccaagactaggttcctataacttctgaagaaatggaaatgggtgacaaagcagtcggtcttgtgttgaccatgacgagtttatccatttttacctactacactttctgggtcataatcttgccatttgttgacgatgatcattttgtccaccaatactttctacctcaagaatacgccatcttcatccctgtgtttgccggcgtcgtgctactttcattcctaagtatattcatcggtcttgtcatgctgaagtcaaagaaaaagaagaaggctgcttgatggatttcgcgaccccccccccccccccattcttccagtggaatttctggtttccttatggatagtagacaggttttgtggatgatcgtatttcattgaatcgccttcacttgtgatctaaggatttctcattgcacttatgtcttcaattagatctaactggcatttgcatgttcttggtagttattgatcgcaaggtgtataacattccaagaataaacattggtcaaatatcaa

SEQ ID NO: 2896 - DNA, 648 bp, Cynodon dactylon
gggggccgcatttgcatccaaccaatcagccccctcgactctcccagcatccccagccttcccagtcgagcggcggcggcggcgcgccggttgggcggggcggaggctgcggcggcgccaggccgagtcggaggcggcgcgtgaccgaggcggaggtggcggatcttggggccggcgtggcgacgcgaggcaagtgacgcgaacggcggctccatcgcgacggcggcctccacggtgcccccttcccctgcaacgtcgacgacctgcaccaccttctcgccggttattaactgtaatattttcatagatggaattgggcgataaggcggtcggttttctgttgactctgacaagtttatccatctttacctactacactttctgggtcattattttgcgatcacttcgtccacaagtacttcctgccacaagagtatgctattttgataccagtttttgccggtgtactactacttactttcctgagtgtctttgtgggttctgtcatgctcaagtcgaagaaaaaaaagaagaccacttgattatgtttattatggcatccaattctttgcttactctgatgaaatctatgaggttggagaccatgtaatcctgaattcagctttgtttttgtggtggacatgtcat

SEQ ID NO: 2897 - DNA, 428 bp, Sorghum bicolor
cagacaaatggaactgggtgacaagctagtcggttttctactgactctgacaagcttatccataattacatactatacattgtgggtcattattttgccattcgttgacagggatcactttgtgcacaagtatttcctgcctcaaaagtatgcgaatttgatatcagtgctggcgggcgtagttctcgtttcattcttgagcgtgtgggtcttgtgatgctcaaaagaagaagaagaagaccacttgatcgatttgccacgtacactgcagtgttattgacttactgcgatgaaacgcatgagttcagagtatgttagaagctcggttctgtaatcagttctgtcatacttccaaggtgtttactttgtaatttggatgtatttgttgtaatttagattttggtggtcaactaaaagcagtgttcatc

SEQ ID NO: 2898 - DNA, 445 bp, Bupleurum chinense
atcggcgagtaatcaaaaattgacagtaaaagcgacggagaaccatggaattagcagatagagcagtaggatttctcttatcatttactagcttgtcaatatttacttattacaccttttgggtcatcatcctgccatttgttcacagtgatcattttgttcacaagtacttcctacctcaagagtacgccattctcattcctgtatttgctggtgtcacgcttctatgcttcttatgtgtgttcattggacttgtgatgctgaaatctaaaaagaaaaaggcgtgaagcatttatcctctttgccttacctacctacacaacatattttgtcatctgtaatgattttgtggtctctatacttgtttgaatttggttgcccaacatccctaggatttcgcactagttagatttctctttttcttttctgtatcggcaaccacaac

SEQ ID NO: 2899 - DNA, 825 bp, Carica papaya
ctctacccgttaactatttgctcgagacaaagccgattctcagacaacggagatcatcatcgccggccggccgtacgtgcagcccgtttacgtcatcgagagcatcaatttcggtgaccactcccagcgattcgaacaacaagaggagaaattctcagaggaaagggaagagggaaggcagaagaaaattcgagaggcagtcaaaacattggatattggaatggaattggcagatcgagcagttggattcctactatgtcttatcagcttatccgtatttacttattatactttttgggtcatcattttgccatttgtagacactgatcacttcatccacaactattttctacctcaagaatatgccatactcatcccggtatttgctggtgttgtgctcctctcgttcttatccgtatttatcgggctggtgatgcttcaatccaaaaagaagaaggcttgatcttctacactattcttctttttttctctctccatcatttcattctgtgttatcaggcctcggttttgacaagaacacaggtttgcagggtaagattttagatgaatgaaaacctcctctctttaatctcctttgtcaatttatatttcttaatttgcaaagttacattattaatacagaacaatgaattctcaagccgaaatccttgtttgtgaatgtgtgtgtgtatatagctatacatatgtatgcgtgggtgtaagagtaggttttagatagtaggcaatcttactcggtatattttcaatttaacttttgttactttaatagctgtgtgttaatttattgtaacttgctttatgtta

SEQ ID NO: 2900 - DNA, 715 bp, Citrullus lanatus
aaaataatgaggacagaagcgtaattttgaaaacataagtccaaaaatctgtatttttttggcatgggttaaaaatcaaatttagcgttccaaattggattgttcttcgcgaaaacctttccagatttttgtctcattccttaatcctttcaacattttcagcttcgattattccaaagtgttcgttcgatcaattacctagaattccggcgaccacgaatcaggaaataatagccccgaaatggagttagcagacaagacggttggatttttgctatcgttaaccagcttgtctatattcacttactatactttctgggtcattatcctgccatttgtagatagtgatcacttcatccacaactatttcttaccacaggaatatgctatcctgatacctgtgtttgctggtgtggtacttctgagcttattaggcatatttgtagggatggtgatgctcaaatcaaaaaagaagaaggcatgaggataattatttggcagttcattttttgtttcttttttcttttctttactctctcaaagcttttctctttaaaaatcggtaggagatcaaatcatcgacctttgtgatagtaatatacgtcttattccctaaggtatgctaaagattgtctattgtgtcaaatggttgttggttatcttcttagcaaagctagtaaacttaatataatttagtttagtggtttttaaagaa

SEQ ID NO: 2901 - DNA, 719 bp, Triticum aestivum
cccgtgcggcgtcggctagatcgtgggctccggcgacggcggttgaagggcgacggctgcggcagggcgtaggaagcccatttttgtatctcaaatcaagattaggttcctataagctctgaagaaatggaaatgggtgacaaggcggtcggtcttgtgttgaccatgacgagtttatccatctttacctactacactttctgggtcataatcttgccatttgttgacgatgatcattttgtccaccaatactttctacctcaagaatacgccatcttcatccctgtgtttgccggtgtagtgcttctttcgttcctaagtatattcatcggtcttgtgatgatgaagtcgaagaaaaagaaggccgcttgattgatttggcggctcccccgctgttccagtggagtttctggtttacttaaacctagtagacaggtttcgtggaagattgtatttcattgagctcacttgtgatctaaggctttctcgtggcacttacaagcgggtatttgcgtgttggtaattattgatcgcaagaataaacattggtcaaatatcaagtgttgttacatcgataattctcggatgatatgttagatcaatgtagtcggcactcaacatgtatcatgcttctgcttctgtgtagtttgacataatgcttctgactctaaacattttctccatgttttcgctgaaatgaagtagattggcattcctcg

SEQ ID NO: 2902 - DNA, 651 bp, Secale cereale
gtgcggcgtcggctagatcgggggctccggcgacggcggttgaaggacgacggctgcggcagggcgtaggaaacccatttttgtatctcaaatcaagagtaggttcctataaattctgaagaaatggaaatgggggacaaggcagtcggccttgtgttgaccatgacgagtttatccatctttacctactacactttctgggtcataatcgtgccatttgtcgacgatgatcattttgtccaccaatactttctacctcaagaatacgccatcttcatccctgtgtttgccggtgtggtgctactttcgttcctaagtatattcatcggtcttgtgatgctgaagtcgaagaaaaagaagaaggctgcttaatagatttggtgactcccctgctgttccagtggaatttctggtttacttgtagaaactagtggacgggtttcgtggatgattgtatttcattgaatcgtcttcgcttgtaatctaaggctttcgaacaggtatttgcatgttcttgttagttattggtcgatcacaaagtgtatgacattccaagaataaacactggtcaaatatcaagtgtgttacatcgacaattcttggatgatgtatttgaccaatatagtcggcactcaacatgtatcgtgcttc

SEQ ID NO: 2903 - DNA, 441 bp, Nicotiana benthamiana
tttacaggcagcacgagtagaagagcctcaatggaattagcggacagagctgttgggctgcttttgacattgacgagtttgtccattttcacatattataccttttgggtcatcattctgcctttagttgatagcgatcatttcgtgcacaagtattttctaccacaagaatatgccattctcattcctgtatctgctggagtggcactcatctgcttattgagtgtgtttattggatatgttatgctcaaatccaagaagaagaaggcatgatatggccatgtgatgtcaaatccatttttgttctctactaatttcatgataaccaataatctcttctatttttaactcttctcaactttgaacagccctcacatagatgtgtctctctattcttgtattaactatgatttggaacctctagatatgattttttagtta

SEQ ID NO: 2904 - DNA, 555 bp, Fagus grandifolia
tcccgatactattatgtatttgcttttccttttcatatcatattatcattcatcctgaaaactgcaattcctccggtaaacgaaattaaaacatttccatcaactttcgcggaaccggcctattaatcaggcagtgatcaggatggaattagcagacaaggcagttgggtttctattgtcttttatcagcttatccatattcacgtattatactttctgggtcatcattctgccatttgtagacagtgatcacttcatctacaattatttcctaccgcaagaatacgccatacttatacctgtatttgccggtgtggttcttctctgtttcttatctgtatttattggatttgtgatgctcaaatccaaaaagaagaaggcttgatgcaattacttttgcctattttttatttctttgagaaaaacttagaattttacctatttttcttctttgtttttcctatcccttactacattttctgatctggatgagttgttttagttttggtatttgttgctagcttgcagtatttttgtatatctgtattaatttct

SEQ ID NO: 2905 - DNA, 440 bp, Bupleurum chinense
atcggcgagtaatcaaaaaattgacagtaaaagcgacggagaaccatggaattagcagatagagcagtaggatttctcttatcatttattagcttgtcaatatttacttattacaccttttgggtcatcatcctgccatttgttcacagtgatcattttgttcacaagtacttcctacctcaagagtacgccattctcattcctgtatttgctggtgtcacgcttctatgcttcttatgtgtgttcattggacttgtgatgctgaaatctaaaaagaaaaaggcgtgaagcatttatcctcttgccttacctgcctacacaacatattttgtcatctgtaatgattttgtggtctctatacttgtttgaatttggttgcccaacatccctaggatttcgcactagttagatttttctttttcttttctgtatcggcaacc

SEQ ID NO: 2906 - DNA, 512 bp, Vigna unguiculata
gggctccaccttacttctctggtattttccggcgatcactgcttccagtttgacatgattgacgacccgtcccattgaagtatagctgttgcgctttgtacacaggagtgagagcaatcaacagaaaaatggaattagcagatagagcagttggatttctgttatccgttacaagcttgtccatatttacctactatacattttgggttatcatcctgccttttgtggatgatgatcatttcgttcacaagtactttttaccccaagagtatgccatactaattccagtctctgctggcgttacactgctttgtttcttgagtatatttgttggagtcgtgatgctcaaatccaaaagaaagaaggcttgatttgtattttccgttttgttgcaccagttgttataaattttgaaacagcgaatgtattaagtgtattttcgaacatttcattcaagaaaagctttaccttgactgtgatgtttgtctgcacatggaagtaggtagatggat

SEQ ID NO: 2907 - DNA, 646 bp, Vigna unguiculata
gggctgcctttatgcatctactcctccagggcaatcgcacgtgcgaatcaaatctgtcacgtgtttccaagtcttttcactggaacagatcaaacagaataccgttttctattcgctgaactcttccctctctgcggggtcaccggagacctctaccgatgtcgtgaatgtgagcagttatttgtgtctttcgttgtcaacaaggagtgagagcaatcaacagaaaaatggaattagcagacagagcagttggatttctgttatccgttacaagcttgtcgatatttacctactatacattttgggttatcatcctgccttttgtggatgatgatcatttcgttcacaagtactttttaccccaagagtatgccatactaataccagtctctgctggcgttacactgctttgtttcttgagtatatttgttggagtcgtgatgctcaaatccaaaagaaagaaggcatgattcacttattcaaagttttgaaactgtgaatgtattaaatgtattttagaacatttcataccagctttgcccgagtgaagataggtatttgtctgtaggtaaataccactttcatggatcacaaaatataaatcatgatttggccattgagaataaataagaattaatttataaac

SEQ ID NO: 2908 - DNA, 466 bp, Cucurbita pepo
tcaaatttcgccttccaaattggctcattcttcggaaaaacccttccagattcttgccgcattccttaatccttccaatattttcacctccgattacgttcatcgttcgatcaatcacccagaattccggcgacgacgacgaatcaggaagtaatagcaccaaaatggagttagcagacaagacggttggatttttgttatcgctaactagcttgtcgatattcacttactatactttctgggtcattatcctgccatttgttgatagtgatcacttcatccacaactatttcttaccacaagaatatgccatcttgatacctgtatttgctggtgtggttcttctgtgcttattagccatatttgtaggaatagtgatgctcaagtccaaaaagaagaaggcatgaggatagagttcagtattgtctgtatttttgatagtttacttcaaaaatgtgctgcctcg

SEQ ID NO: 2909 - DNA, 1250 bp, Cucumis melo
gatattgtttatacttaacaataaaactaaaactgatgtgttcttcctcttgttttattcggatcaatgaaccctaccctactttttaaattggaggattttggaattcttttaataaaaaataaaaattctaccattcaaaagacaattaaatttcgaagctaagccacatttaaaatgtcgatattgatgaaattgtaatggtctaatgtaaatgaaaatattaaagaaacatttattcatttcttgaaaattataaaaacaaagaacgctaataaatatttttcttgtttattttttatgatatttttttacaatgaaattaaaatgttaattcattaaaattaaaacaataagataaaataatgaggacagaagcgtaattttgaagttctaagtccaaaaatctttagttttctcatatgggttaaatatcaaatttagaattccaaatgggccattcttccgaaaaaccttccctgattttggcctcattcctaaatcgttccgacgttttcagcttcgatttgcgtaaattgttcgctccaccaatcttccagaattccggcgacgaccaatcaggaaataatagcctcaaaatggagttagcagacaagacggttggatttttgttatcgctaacgagcttgtctatattcacttactatactttctgggtcgttatcctgccatttgtagatagtgatcacttcgtccacaactatttcttaccacaggaatacgctatattgatacctgtatttgctggtgtggtacttctatgcttattaggcatatttgtaggaactgtgatgctcaaatccaaaaagaagaaggcatgactttactttttttggcagttccttttttcttttctttttctttactgtttcaaagctttttctttttcattttcttttataatttagtaggaaatcagaccatcgtcttttgtgatggtaacatatgacttgttcgccaaaagattgtgtagtgtgtcaaatggttgtttgttaccttcttagcaaaggttgttaggttaaatataatgtggtttagtagttattagcacttcttttttctttaccaagtttcttcttagttcttaccaatatctcgggttatgaatagtacatttttaataggtaatagttgtaaatataaatattagattcaaagtattagtatatataacaacgttttaaaaaattacaaatacattaaaatttgtttgagtttgtcaaaaaaaa

SEQ ID NO: 2910 - DNA, 401 bp, Lippia dulcis
tcagaagcaaggggaaaaaagcaaaagaccaagatggaactagcagacagggcggtgggcttgcttttatcaataattagcttaaccattttcacctactacaccttctgggttatcatcctgccttttgtcgacagtgatcattttgtgcacaagtactttctgcctcaggaatacgccattctcattcctgtatatgctgttgtggcgctcatttccttcctttctgtgtttattggatatgtgatgctcaaatccaagaagaaaaaggcatgagaatcagatcaatcctggttaacaattcattgatgacattatataggatgtgttatacatatgaaatccttccacaaattttgtagttctactgtttgtcataactcagttttttttattgccaa

SEQ ID NO: 2911 - DNA, 1027 bp, Populus trichocarpa
cggctttggaaagtagaaaccggcgcctgcactttagtaacctctcctcgttcgaaagaagagaacaggcacaaacaactgcaaacactggcatggagttggcagacagagcagtagggtttttgttatctttaaccagtatatctatcttcacttattatactttctgggttatcattttgccatttgtagacagtgatcactttgtccaccagtatttccttccacaagaatacgccatacttgtacctgtatttgctggcatggtgcttctctgcttcttatgcgtgtttgttggatttgtgatgcttaaatccaaaaagaagaaagcataatgcaaccacgattaccattttgcatattctaatacattttacactcacaaaccttaccttctctcgttgatagatttgcaacccagagtgtttttcttgtgagattagagcaattataacattattgtggcattagatttcttgcttgcaatgactgattcttccttattgactatcattgcatcgttgacacatgagcagtttaagaatatggctcgattatcaagtttcttgtgacatgtagaatattaagccagaacatccagttctgaactgagtttgttcattttactctctctttcagttctttatcgcttcgagtctataaagagcatgcctcctcttttttatttttttctggcccattcccctcactctcagaggataacaaaaggttttctggtttatacagttcctcattaatttgagcctcatgcacccttaaattcggaaatgactctgttctgtctaacgattgctgctcaattagttcacagcctgatggagtagttataattccagggatttctcacatttctcctctaatatcgaaagaaaattcagtcgtaccatcatcagggttctttgcttggttatcaaccgatgttattgtttacttgcagccaagaaatttggtgtttgttctgttgacgtagactattatacaatacatctaaaacaaatgaccgttc

SEQ ID NO: 2912 - DNA, 1189 bp, Populus trichocarpa
aatttccacctgttttatatttctccggctttggaaagtagaaaccggcgcctgcactttagtaacctctcctcgttcgaaagaagagaacaggcacaaacaactgcaaacactggcatggagttggcagacagagcagtagggtttttgttatctttaaccagtatatctatcttcacttattatactttctgggttatcattttgccatttgtagacagtgatcactttgtccaccagtatttccttccacaagaatacgccatacttgtacctgtatttgctggcatggtgcttctctgcttcttatgcgtgtttgttggatttgtgatgcttaaatccaaaaagaagaaagcataatgcgaccacaattaccattttgcatattctaatacgttttacactcacaaaccttaccttctctcgttgatagatttgcaacccagagtgtttttcttgtgagattagagcaattataacattattgtggcattagatttcttgcttgcaatgactgattcttccttattgactatcattgcatcgttgacacatgagcagtttaagaatatggctcaattatcaagtttcttgtgacatgtagaatattaagccagaacatccagttctgaactgagtttgttcattttactctccctttcagttctttattgcttcgagtctataaagagcatgcctcctcttttttatttttttctggcccattcccctcactctcagaggataacaaaaggttttctggtttatacagttcctcattaatttgagcctcatgcatccttaaattcggaaatgactctgttctgtctaacggttgctgctcaattagttcacagcctgatggagtagttctaattccagggatttctcacatttctcctctaatatcaaaagaaaattcagtcgtaccatcatcagggttctttgcttggttatcaaccgatgttattgtttacttgcagccaagaaatttggtgtttgttctgttgacgtagactattatatttttttttaacattttgatcactgaacatttatttctctaacttcttcatttcatgtgatgtttgtgataaatcacgtgttgatttagtcttctccttgtattttcttgacaatccaaagtatttaaataaaatttctgaaatgaattagaggtaaatttcat

SEQ ID NO: 2913 - DNA, 723 bp, Secale cereale
ttcttctctgtcccgtgcggcgtcggctagatcgggggctccggcgacggcggttgaaggacgacggctgcggcagggcgtaggaaacccatttttgtatctcaaatcaagagtaggttgctataaattctgaagaaatggaaatgggggacaaggcagtcggccttgtgttgaccatgacgagtttatccatctttacctactacactttctgggtcataatcgtgccatttgtcgacgatgatcattttgtccaccaatactttctgcctcaagaatacgccatcttcatccctgtgtttgccggtgtggtgctactttcgttcctaagtatattcatcggtcttgtgatgctgaagtcgaagaaaaagcagaaggctgcttaatagatttggtgactcccctgctgttccagtggaatttctggtttacttgtagaacctagtagacgggtttcgtggatgattgtatttcattgaatcgccttcacttgtaatctaaggctttcgaacgggtatttgcatgttcttggtagctattgatcgatcacaaagtgtatgacattccaagaataaacactggtcaaatatcaagtgtgttagatcgacagttcttggatgatgtatttgaccaatatagtcggcactcaacatgtattgtgcttctgtgtagttttctaatggtaccagcacaaaagctggaccaaggtgcagccaaaaagtc

SEQ ID NO: 2914 - DNA, 608 bp, Nicotiana benthamiana
gcaagtgaaaaaaaattcgatttgatgaagacgacgatcttcatgctctgaaatcgaagcttttcatcatcaagaacgaagcttttcaggcaacacaagtagaagagcctcaatggaattagcggacagagctgttgggctgcttttgacattgacgagtttgtccattttcacatattataccttttgggttatcattctgcctttagttgatagcgatcatttcgtgcacaagtattttctaccacaagaatacgcgattctcattcctgtatatgctggagtagcactcatctgcttattgagcgtgtttattggatatattatgctcaaatccaagaagaagaaggcatgatatggccatgtcaaatccatttttgttctctactagtttcatgataaccaataatctcttatatttttaactcttctcatctttgaacagccgtcacatagatgtgtctctctattcttgtattaaccatgatttgaaacctctcaatatgatttttagttatacagacattaaacaagacatggtcgattgttctcttgttatttgctgatggagtgtaggaaaactttctggtggatgactaattgttgga

SEQ ID NO: 2915 - DNA, 692 bp, Cucumis sativus
aaaatattaactaaacatttaatccatttcttgaaaagttataaaaacaaataacactaataaatatttttcttgtttaatatttttttttataatgttttgtcattttttacaataaaattaaaatgatattccattaaaattagaacaataagataaaataacaaggacagaagcgtgattttgaaggtctaagtccaaaaatctttatttttctcacatgggttaaaaatcaaatttagaattccaagttggaccattcttcggaaaaaccttcccagaattttgcctcattcctaaatccttccaacgttttcagctttgattttcgtaaattgttcgttccaccaatctttcagagttccggcgacgaccaatcaggaaataatagcctcaaaatggagttagcagacaagacggttggatttttgttatcgctaacgagcttgtctatattcacttactatactttctgggttgttatcctgccatttgtagatagtgatcacttcatccacaactatttcttaccacaggaatacgctatattgatacctgtatttgctggtgtggtacttctatgcttattaggcatttttgtaggaactgtgatgctcaaatccaaaaagaagaaagcatgagtttactttttttggcagttcctttttctttttctttactgtttcaaagct

SEQ ID NO: 2916 - DNA, 445 bp, Carpinus betulus
aagcatttccatcaactttctccgtaccggcctaataggcagttaaagccaagaacatcagaatggaaatagcagacagggcagttgggtttcttttatctttgatcagcttatccatattcacgtattatactttctgggtcatcattctgccatttgtagacggtgatcacttcattcacaagtacttcctgccgcaagaatacgccatactaattcctgtatgcgctggtgtcgtgcttctttgtttcttatgcgtatttattggatcagttatgcttaaatccaaaaagaagaaggcttaatggaattagcttagtctatttttttgttctttgataattaatttagtaatttttacttatttttcttgtctttcccccccttttcccttctactttttctttatcttagacgtgtgtctttgtttttggtattttgtctt

SEQ ID NO: 2917 - DNA, 653 bp, Arachis hypogaea
tcctccgttagcaacttatgagagctccatgaaaatctcaattttttttaatcttctttttctgattcttgtgtttcgtgaacgatctcgtttcatcgatcaagattctcttcggtagccttctcccccatcattggagagtgagaagagcaaaaagggggcaaatcttttcaaatggaattagctgatagagcagttggatttctactaacttttcttagcttatcaatattcacgtattatacattctgggttataatcctgccatttgtagatggtgatcactttgtgcacaagtatttcttgcctcaagagtatgccatactaataccggtttcagctggtgttgcaattctttgcttcttgtgcatatttattggattggtcatgctcaaatcaaaaaagaagaaggcttaattgttgtatgttttggaggttatttggttgtcctttataatgtaactagtgttcatttttgtgaaggcaattagtgttttttatctggtaaattgagaagaaatttatttctttataacttataagagttcaatattactatcctatgactatgagtggttttgttttgattggattagagattttcactaaatagagcagtacatcaaggtaaaaaaaaagaaaaaaaaacaaag

SEQ ID NO: 2918 - DNA, 534 bp, Cajanus cajan
gttgttaacaggaagtgaaagcaataagcatcaaaatggatttagcagacagagcagtcggatttctgttatcctttataagcttatcgatatttacttattatactttctgggttatcatactgccatttgtggatgatgatcatttcgtgcataagtacttcttaccccaagagtatgccatactgataccagtttctgctggtgtggcacttctttgcttcttaagcatatttgttggattcgtgatgctcaaatccaaaaagaagaaggcttaatttttattgtccatttattgcacagtttattctaggttttgaaacagtgaacatttcataccagttagcaagttagcaaccgctttaccttttgtttcctcttaaaatcaaaggtcagttttcttagctgtgtcttccagttatgtaagttgtgtttatttgtttgtgtctacattaaactacatgggtgagtgaagtgagccatgctacaaaatttagttacttgtcaatagtgttaatgttaacaaagaaaaaa

SEQ ID NO: 2919 - DNA, 693 bp, Primula obconica
gaaaaatcaatcaaatataatttctccgtctctctcagaaaatccaatagcttccatccgtttcgctcaattaaggtggctaattgcagctagcacgggatggaattggcagacagggcagttggattattgctaaccatcatcagtctatccatattcacttattataccttatgggtcattatccttcccttcgtggacagtgatcacttcattcaccagtattttctccctcaagaatacgctatcctcatccctgtatttgctggtgtgacccttctgtgcttcttatccgtatttgttgggcttgtaatggtcaaatccaaaaagaagaaggcatgaacatactcgttattatattgatttaagcaacttctgttgcaaagagatttatcattttttgtttcagcgaaaggggttttgcttagttaatatgcagccttatttatagtgccagatgacctccgaaacttgattctgattagtgttttaggttgagttaacgtcttcaagaattttcggatcttgtgtttttcaatgtggttagtttctttgtttagctaaaattctcttatgtatacattttcttatgtcttacaaaatgtacttcacctatgctcgtctgttttgcattcgagattgagtacattcattttaattctggttaataacattttacttttgatcataata

SEQ ID NO: 2920 - DNA, 331 bp, Solanum phureja
ggcgatcttcatgctctgaaagcagaaatcttcaacaccaagaaccgaacttttcaggcggcacaagcagaggagtctcgatggagttagctgacagagctgttgggctcattttaacattgactagtttgtccatttttacatattataccttctgggttatcattctgcctcttgttgatagcgatcatttcgtgcacaagtattttctaccacaagaatacgctattctcattcctgtatatgctgcagtggcactcatctgcttcttgagcgtgtttattggatatgtcatgctcaagtccaagaagaagaaggcatgaaaacataa

SEQ ID NO: 2921 - DNA, 612 bp, Camellia sinensis
gaagttaaaggtcagttgtaggggctgaagcgttcagcaaaggattgtcgtcaccatcctctgattgccccaaaaaggcagcaaaatcccacaattattgtaatggaattagcagacaaggccgttgggtttctgttatcagttgtcagcctagtcatgttcacttattatactttttgggtcatcatcctgccatttgttgacgatgagcactttatccacaagtactttcttccccaagaatttgccattctcattcctgtacttgctggtgtggctcttctctgcttcttgtctgtctttgttgggtttgtgatgctcaagtccaaaaagaaggcggcatgatgcttactatgacagcagtttttaattggttttgaagacggtttttagctatctgacatcttgtagttttaagatgagagcagctcctaggatgtgtgtgtgcgagtgcatgcgtttttcctcatatactatcttgattcttgagtaccattgagtcttctcgaattgtttttatttcagttgtcgtagttactttgacgtgtaggtgactctgactgttacgtatcattatgatttgtaataccatatcactcttttttcctgttc

SEQ ID NO: 2922 - DNA, 459 bp, Nicotiana tabacum
atcatcaagaacgaagcttttcagacggcacaagtagtagtggttcaatggagttagcggacagagctgttgggctgcttttgacattgactagtttgtccattttcacatactataccttctgggtcatcattctgcctttagttgacagtgatcatttcgtgcacaagtattttctaccacaagaatacgcaattcttattcctgtatatgctggagtggcactcatctgcttattgagcgtgtttattggatatattatgctcaagtccaagaagaagaaggcatgatatggccatgtcaaatccatttttgttctctactaatctcatgataactgatgatctcttgtgtttttaactcttttcattttgaacagaagtgtcatagatcacatagatgactctctattcgtgggttcactatgatttggaacctctagatatgatttttagttag

SEQ ID NO: 2923 - DNA, 1026 bp, Sorghum bicolor
ttaaggtacgtggtgccttcaagaagctacggtactgaatctgtgtccatccgagttgttaacgagccgagccggctcgttttatccagtctaacccaaaccaaacagacagccaccgagtcctgccgctctgctataaacgcacactcttctgtctccacgagatcgttgaattcatctcttccctagcagcaccagccatggcgaagccgcagcttcttctctgcttcctagtcgccgccgccgcgacgctgctcgtcgccacggccaagaaatccggggacgtgacggaactccagatcggcgtcaagtacaagccggaatcttgcagcattcaagctcacaaaggtgacaaggttaaagttcactaccgtggaaaacttactgatggaacagtttttgattcaagctatgaaagaggtgaccctattgaatttgatttgggcactggacaagtgatcaaaggatgggatcagggtctcctaggaatgtgcgttggtgaaaagcggaagttgaagattccatcaaagcttggctatgggcctcaaggctcgccacctactattcctggtggagcaaccctaatatttgacacggagcttgtcgctgtcaatggagaaccagccaaccaatctgacaacgagctttagatatatcaaatagatgaatgcataaccttattactcagaactcggcaaatgtaatacattccaagaaatgagccttcattccctgtgactttctttcgatattccacaagaacatctaggatttctggagcaaactctggtctgttttgactagtttacgcatctgtgtctggaatccggagaattgctctgaaatcatttccttggccctaaaaaaggtgctgcttagtttcttggccctttttttttctcgaacttgcttatttggctctaaaacaaatttcctttggtttcttggctcttccgttagtttgatggactaacaatgttaagttgtatgcgaaagaaggctacaattcatggggttttcaggcta

SEQ ID NO: 2924 - DNA, 775 bp, Saccharum officinarum
accaaacccaaaccaaacagccagccactgagtcctgcctctctctgttatatacgcacagctcttttgtctccacgagatcgttgaaataatcccttccctagcaccagccatggcgaagccgcagtttctactctgcttcctactcgccgccgctgcgccgctgctcgttgccacggccaagaaatccggggacgtgacggagcttcagatcggcgtcaagcataagccggaatcttgcagcattcaagctcacaaaggtgacaaggttaaagttcactaccgtggaaaacttactgatggaacagtttttgattcaagctatgaaagaggtgaccctattgaatttgatttgggcactggacaagtgatcaaaggatgggatcagggtctcctgggaatgtgcgttggtgaaaagcggaagttgaagatcccatcaaagcttggctatgggcctcaaggctcgccacctactatccctggtggagcaaccctcatatttgacacggagcttgtcgccgtcaatggagaaccagccaaccaatctgacagcgagctttagatatatcaaatagatataaatacataacctttttactcagaactcggcaaacgtaatacattccaagaaatgagccttcattccctgcgacttccttttgctattcaacaagaacatctaggatttctggagcacactctgatctggtttgactagtttacgcgtctgtgtctagaatccggagaatcgctctgaaatattaatttctttttc

SEQ ID NO: 2925 - DNA, 828 bp, Panicum virgatum
caaacggccaaacagcccctcactcctgccgctctgttataacgcacatcccgtctgcaccccgagatcggcgaattgctctctcttccggtcttctctcgcaagtcatggcgaagccgcaggttcttctctgcctcctagtcgccgccgccgcgctgctactcgtcgccgcggccaagaaatccggcgacgtgactgagctccagatcggcgtcaagtacaagcctgaatcctgcagcattcaagctcacaaaggtgacagagttaaagttcactaccgtggaaaacttactgatggaacagtttttgattcaagctatgaaaggggtgaccctattgaatttgaattgggcactggccaagtgatcaaaggctgggatcagggtctcctgggaatgtgtgttggtgagaagcggaagctgaagatcccatcaaaacttggctatggccctcaaggatcaccgcctactattccaggtggagcaactctcatatttgacaccgagcttgttgctgtcaatggggagccatccagcaaatctgatgagagcagtgagctttagatagcagggagggtagaattggcttccagaatccagatcaaaaagttaccagatcagatagatgaatgcataaaccattttactcagaattcggcgaatgtaatgcacttagagaaatgagcatccgttccctgtgactttgttttgttattccacaagaacaattagtctttctggagcaaactcctgatctcgtgatttctttttgggaatcactacaggcttgtgacttcatttggatgacaagattcatattgaacttatg

SEQ ID NO: 2926 - DNA, 833 bp, Panicum virgatum
ctctgttataacgcacatcccgtctgcaccccgaggtcggcgaattgctctctcttccggtcttctctcgcacaagtcatggcgaagccgcaggttcttctctgcctcctaatcgccgccgccgcgctgctactcgtcgccgcggccaagaaatccggcgacgtgactgagctccagatcggcgtcaagtacaagcctgaatcctgcagcattcaagctcacaaaggtgacagagttaaagttcactaccgtggaaaacttactgatggaacagtttttgattcaagctatgaaaggggtgaccctattgaatttgaattgggcactggccaagtgatcaaaggctgggatcagggtctcctgggaatgtgtgttggtgagaagcggaagctgaagattccatcaaaacttggctatggccctcaaggatcaccgcccactattccgggtggtgcaactctcatatttgacaccgagcttgttgctgtcaatggggagccatccagcaaatctgatgaggacagtgagctttagatagcgggagggtagaatcggcttccagaatccagatcaaacaattatcagatcagatagatgaatgcagaaaccattttactcagaactcggcaaatgtaatgcacttagagaaatgagcattcgttccctgtgacttcgttttgctattccacaagaacaactagtctttctggagtaaactcctgatcttgtgacttcttttttggaatcgctagtcttgtggcttcatttggatgacaagattcatattgaacttatgaacgggttattttatagaggcatgccattacaaggca

SEQ ID NO: 2927 - DNA, 914 bp, Panicum virgatum
ccaagcaatcccaaacggccaaacagcccctcactcctgccgctctgttataacgcacatcccgtctgcaccccgagatcggcgaattgctctctcttccggtcttctctcgcaagtcatggcgaagccgcaggttcttctctgcctcctagtcgccgccgccgcgctgctactcgtcgccgcggccaagaaatccggcgacgtgactgagctccagatcggcgtcaagtacaagcctgaatcctgcagcattcaagctcacaaaggtgacagagttaaagttcactaccgtggaaaacttactgatggaacagtttttgattcaagctatgaaaggggtgaccctattgaatttgaattgggcactggccaagtgatcaaaggctgggatcagggtctcctgggaatgtgtgttggtgagaagcggaagctgaagatcccatcaaaacttggctatggccctcaaggatcaccgcctactattccaggtggagcaactctcatatttgacaccgagcttgttgctgtcaatggggagccatccagcaaatctgatgagagcagtgagctttagatagcagggagggtagaattggcttccagaatccagatcaaaaagttaccagatcagatagatgaatgcataaaccattttactcagaattcggcgaatgtaatgcacttagagaaatgagcatccgttccctgtgactttgttttgttattccacaagaacaattagtctttctggagcaaactcctgatctcgtgatttctttttgggaatcactacaggcttgtgacttcatttggatgacaagattcatattgaacttatgcatgggttacgacatgtcattacaagttttttttgaaactttggatgctaactttatttcaccattgacttggtc

SEQ ID NO: 2928 - DNA, 551 bp, Triticum aestivum
  misc_feature (268)..(268): n is a, c, g, or t
  misc_feature (346)..(346): n is a, c, g, or t
  misc_feature (474)..(474): n is a, c, g, or t
  misc_feature (493)..(493): n is a, c, g, or t
  misc_feature (522)..(522): n is a, c, g, or t
  misc_feature (527)..(527): n is a, c, g, or t
  misc_feature (540)..(540): n is a, c, g, or t
gccgcagcttcttctctgtttcctactcgccgcctccgcgccgctaatcgtcgccacggccaagaaatccggggacgtgtcggagctccagatcggcgtcaagtacaagccggaatcatgcagcattcaagctcacaaaggtgacaaggttaaagttcactaccgtggaaaacttactgatggaacggtttttgattcaagctatgaaagaggtgacccgattgaatttgaattggggcactgggacaagtgatcaaaggatgggatnaagggtctcctggggaatgtgcgttggtgaaaagcggaagttgaagattccatcaaagcttggctatgggctcaaagntcgccacctactattcctggtgggagcaacctcatattttacacggacttgtcgctgtcaatgggagaaccaaccaacaatctgacagctttagatcatcaaacaaatgaaccatcactttttactcnggatcagcagatgttatantccaaagaaatgacctcatcccgcaactnaaaantcttcgcggtcanacggacatcta

SEQ ID NO: 2929 - DNA, 858 bp, Setaria italica
caaacggccgaacagacactcactcctgcgatcctgcgacttgcggtactgccgcactgagcccctgatataacgcacagcacccatctggccgtctgctccccgagatcggcgaattcctctctcccccctcgcacaagccatggcgaagccgcagctccttctctgccttctagtcgccgccgccgcgctgctactcgtcgccgtggccaagaaatccggggacgtgacggagctccagatcggcgtcaagttcaagccagagacctgcagcattcaagctcacaaaggtgacagggttaaagttcactaccgtggaaaacttactgatgggacagtttttgattctagctatgaaaggggtgacccaattgaatttgagttgggctctggtcaagtgatcaaaggatgggatcagggtctcctgggaatgtgcgttggtgagaagcggaagctgaagatcccttcaaagcttggctatgggcctcaaggatcaccgccaactattcctggtggagcaactctcatatttgacacggagcttgttgctgtcaacggggagccagccagcaaatctgatgacagtgagctttagatagccaggagagtaggatcggcttccagaacaagtgattatcaaatcgaatagatgaatgcataaaccattttacccagagctcggcaaaatgtaatgcataccgagatcccttagacagacgaaacatttgttccctgtgacttaatttcgcttgctatcccataagaacaatctagtcgtcctggagcaaactccttatctgttatgacctgtttggaaaatcgaaaaggatcctctttttctttacaatcatctgggtt

SEQ ID NO: 2930 - DNA, 726 bp, Avena sativa
ctgcatccatggcgaagccgcagcttcttctctgcctgctcgtcgccgccgccgcgctgctgctcgtcgcctccgccaagacggccgccgacgtgtcggagctccagatcggcgtgaagttcaagccagagtcctgcagcattcaagctcacaaaggtgacagagttaagttcactaccgtggaaaacttactgatgggacagtttttgattctagctatgaaaggggcgacccaattgaatttgagttgggcactggtcaagtgatcaaaggatgggatcagggaattttgggcatgtgcgttggtgagaagcggaagctgaagatcccttcaaagctcggctacggggaatcaggatcaccacctaccattccgggtggagctactctcatattcgatacagagcttgttgccgtcaatggtgaaccggctagcaaatcggacgagggcgacgttggcagtgagctgtagagagctggaacagcgcaatcatccttaagatcaaccaaagcctagttttcgaatcgaatagatcaatgcacatgcacgggattcttactcgagtagggcaagcactatgatttcagtagaggccggaacattatcttaccatgatcaaacatgagttatgttgtcataatggaatagatggagtgactttggtaccctgtgcaactcttgccctcctgaacaactctccagtctataattctatgttcgtgatc

SEQ ID NO: 2931 - DNA, 710 bp, Pennisetum glaucum
tggccgtctgcaccccgagatcggcgaattccctcgcacaagaccacaagccatggcgaagccgcagcttcttctctgcctcgtcgtcgccgccgccgcgctgctactcgtcgcagccgcggccaagaaatcgggcgacgtgacggagctccagatcggcgtcaagttcaagccagagacatgcagcattcaagctcacaaaggtgacagggttaaagttcactaccgtggaaaacttactgatgggacagtttttgattctagctttgaaaggggtgacccaattgaatttgagttgggcaccggtcaagtgatcaaaggatgggatcagggtctcctgggaatgtgcgttggtgagaagcggaagctgaagatccctgcaaagctcggctatgggcctcaaggatcaccaccaactattcctggtggagcaactctcatatttgacacggaacttgttgctgtcaacggggagccagccagcaaatctgatgacagtgagctttaggtagccaggagagtaggatcgtcatcgagatcaagcgattatcaaattgaatagataatgcgtaaaccatctactcagagcttggcaaaaatgtaatccatagttccataccaagatcctttagacagatgaaacatttgttccctgtgacttaaaaatttcatttgcctttccataagaacatctacttgtcccggagcaa

SEQ ID NO: 2932 - DNA, 758 bp, Triticum aestivum
atctctacccgaacaaaccccagctgcatccatggcgaagccgcggcttcttctctgcctgctggtcgccgccgccgcgctcctgctcgtcgcctccgccaagaagtccggcgacgtctcggcgctccagatcggcgtcaagtacaagccagaatcgtgcagcatctcggctcacaaaggtgacagagttaaagttcactaccgtggaacacttaccgatggaacagttttcgattctagctttgaaaggggtgacccgattgaatttgaattgggcactggtcaagtgatcaaaggatgggaccagggaattttgggcatgtgcattggtgagaagaggaagctgaagatcccttcaaagctcggctatggggatcagggatcaccacctaccattccaggcggagcaactctcatattcgacacagagcttgtcgctgtcaatggcgagccatctagcaaatcagacgaggatgacgctgatctgtaggcagctcggcgcagcacgatcgcccagttatcaaatcgaataggactatgtatgggaaacttactcttgtagggcagacacaatgaggcaggaacattgtcttaccatgatcaaacagaggagtctagttctcaaaatcgaatagatcaagtgacttttgttaccctatgtaattctctggaataattctcctatctaccttgttacttttgcttttgttcttggaatggttataaagtactactcccttcatttctcattttacttt

SEQ ID NO: 2933 - DNA, 786 bp, Avena sativa
acctctcccctgaacaaagaaaaactccagctgcatccatggcgaagccgcagcttcttctctgcctgctcgtcgcggccgccgcgctgctgctcgtagcctccgccaagaaggccgccgacgtgtcggagctccagatcggcgtcaagttcaagccagagtcctgcagcatttcagctcacaaaggcgacagagttaaagttcactaccgtggaaaacttactgatgggacagtttttgattctagctatgaaaggggtgacccaattgaatttgagttgggcactggtcaagtgatcaaaggatgggatcagggaattttgggcatgtgcgttggtgagaagcggaagctgaagatcccttcaaagctcggctacggggaatcaggatcaccgcctaccattccgggtggagctactctcatattcgatacagagcttgttgccgtcaatggtgaaccggctagcaaatcggacgagggtgatgttggcagtgagctgtagacagctggaacagcgcaatcatccttcagatcaaccaaagcctagttttcgaatcgaatagatcaatgcagtgcacggggattcttagtcgagtagggcaaacgctatgaattcagtagaggacggaacattatcttaccatgatcaaacatgagttatgttgtcataatggaatagatggagtgactttggtaccctgtgcaactcttgccctcctgaacaactctccagtctataattctatgtttgtgatcaattgtgatatgtttggcttcatggaaaa

SEQ ID NO: 2934 - DNA, 784 bp, Avena sativa
ggccgcactctgctgctctataaacacacacacacccctggtaaagttcggccgaaatcctctcccctgaacagaaaaactccaactgcatccatggcgaagccgcagcttcttctctgcctgctcgtcgccgccgccgcgctgctgctcgtcgcctccgccaagaaggccgccgacgtgtcggagctccagatcggcgtgaagttcaagccagagtcatgcagcattcaagctcacaaaggtgacagagttaaagttcactaccgtggaaaacttaccgatgggacagtctttgattctagctatgaaaggggtgacccaattgaatttgagttgggcactggtcaagtgatcaaaggatgggatcagggaattttgggcatgtgtgttggtgagaagcggaagttgaagatcccttcaaagctcggctacggggaatcaggatcgccacctaccattcctggtggagctactctcatattcgatacagagcttgtttccgtcaatggtgaaccggctggcaaatcggacgagggcgatgttggcagtgagctgtagacagctggaacagcgaagtcatctttcagatcaaccacagcctagttttcgagtcgaatagatcaatgcacgggattttattcgcgtagggcaaacgccatgaaatcagtagagaccggaacattatcttatgatcaaacaggagtttagttgtcataatggatagacgaagtgacttttggtacctgtttgcaactcttgcccttctgaacaactctccgatcta

SEQ ID NO: 2935 - DNA, 793 bp, Triticum aestivum
cgcaacccctcacgagttcggccaaaatcctcctcctctctacccgaacaaaccccagctgcatccatggcgaagccgcggcttcttctctgcctgctggtcgccgccgccgcgctcctgctcgtcgcctccgccaagaagtccggcgacgtctcggcgctccagatcggcgtcaagtacaagccagaatcctgcagcatctcggctcacaaaggtgacagagttaaagttcactaccgtggaacacttaccgatggaacagttttcgattctagctttgaaaggggtgacccgattgaatttgaattgggcactggtcaagtgatcaaaggatgggaccagggaattttgggcatgtgcattggtgagaagaggaagctgaagatcccttcaaagctcggctatggggatcagggatcaccacctaccattccaggcggagcaactctcatattcgacacagagcttgtcgctgtcaatggcgagccatctagcaaatcagaggaggatgacgctgatctgtaggcagctcggcgcagcacgatcgcccagttatcaaatcgaataggactatgtatgggaaacttactcttgtagggcagacacaatgaggcaggaacattgtcttaccatgatcaaacagaggagcctagttctcaaaatcgaatagatcaagtgacttttgttaccctatgtaattctctggaataattctcctatctaccttgttacttttgcttttgttcttggaatggttataaagtactactcccttcatttcttaaaaaaaaaa

SEQ ID NO: 2936 - DNA, 1248 bp, Brachypodium distachyon
ttaggcggcggcgcacgagcgtcagtgtgatcctgtccagagtgtaacatcttttgtgcgtgagtgcgacttaggcttctgagactggtccctgacttgtggttaaagcctttaaaggtttaagaattagtaacacaacccgaactccccagacccaaacccgggcaggccaacactgccgctctataaacacaacacatcacaatttgggacgcaagttcggccaaaaaatcctctcccctgaacaaactcctgctgcatccatggcgaagccgcagcttcttctctgcctgctggtcgccgccgccgcgctgctactcgtcgcctccgccaagaagtcggccgacgtgacggagctccagatcggcgttaagcacaagccaaagtcctgcagcattcaagcacacaaaggtgacagggttaaagttcactaccgtggaaaacttactgatggcacagtttttgattctagctatgagaggggtgacccgattgaatttgaattgggcactggtcaagtaatcaaaggatgggatcagggaattttggggatgtgtgttggtgagaagcggaagctgaagattccttcaaagcttggctacggcgatgggggatcaccacctaccattcctggtggagcaactctcatattcgatactgaactcgtgtccgtcaacagtgagccagccaccaaatcagacgatgaagatgagctttagacagccaggtgcagcaagatcatcttccggatcaaagaaagcctagttttcaaatcacatagatgaagaaaccatgagacttttactttagttgggcaaaagcagtgcctcaatagagacaggaacgttctcttaccatgatcaaacacagtctaattgtcaaaatcagatagatcagtgactcttgttagtcttgtatctggcgaccacttggtccttgggaacaattatccgtccaatcatatttcttacttgcaggtttaccactgttacttctacttttgtttgtggaatggatctaaatgaagatgtccatgtcggttaggcacaatggatgtaacgagtagcaaaaattagcctttttattagcaagtataaagcaatatttatatgttgcgtgggccctgccttgtcaattttcgtgtggtactatctgtaaacaggtcgccctaagattatgttcaacgggatacccaaattttgtcctcaccccgttttggggaggagggagagtggacttaacatttta

SEQ ID NO: 2937 - DNA, 860 bp, Hordeum vulgare
gaaaaccactgctgctctataaacgcacccctctcgcaagttcggcaaaaatcctcccttctcccccgaacaaacccctgccgcatccatggcgaagccggggcttcttctctgcctgctggtcgtggccgccgcgctcctgctcgtcgcctccgccaagaagtccggcgacgtgtcggcactccagatcggcgtcaagtacaagccagaatcgtgcagcatctcggctcacaaaggagacagagttaaagttcactaccgtggaacacttaccgatggaacagtttttgattctagctatgaaaggggtgacccaattgaatttgaattgggcactggtcaagtgatcaaaggatgggatcagggaattttgggcatgtgcattggtgagaagaggaagctgaagatcccttcaaagctcggctacggggatcagggatcaccacctaccattccaggcggagcaactctcatattcgacacagagcttgtcgcagtcaatggcgagccttctagcaaatcagacgaggatgtcgctgatagtgatctgtaggcagctcggcgcagcaagttcgcccagttaccaaatcgaataggactatgtatggggaacttactcttgtagggcagacgcaatgagacatgaacattctattaccatggtcaaacaaaggagtctagttgtcaaaatcgaatagatcaagtgacttttgttatcctatgtaattctctggaataattctcctatctaccatgttacatttgcttttgttcgtggaatggttataaagacaagtcatgtcgatttggatctgactccaatgccccatggatttaacaagtcaagagaaattgcagat

SEQ ID NO: 2938 - DNA, 911 bp, Hordeum vulgare
accactgctgctctataaacgcacccctctcgcaagttcggcaaaaatcctcccttctcccccgaacaaacccctgccgcatccatggcgaagccggggcttcttctctgcctgctggtcgtggccgccgcgctcctgctcgtcgcctccgccaagaagtccggcgacgtgtcggcactccagatcggcgtcaagtacaagccagaatcgtgcagcatctcggctcacaaaggagacagagttaaagttcactaccgtggaacacttaccgatggaacagtttttgattctagctatgaaaggggtgacccaattgaatttgaattgggcactggtcaagtgatcaaaggatgggatcagggaattttgggcatgtgcattggtgagaagaggaagctgaagatcccttcaaagctcggctacggggatcagggatcaccacctaccattccaggcggagcaactctcatattcgacacagagcttgtcgcagtcaatggcgagccttctagcaaatcagacgaggatgtcgctgatagtgatctgtaggcagctcggcgcagcaagttcgcccagttaccaaatcgaataggactatgtatggggaacttactcttgtagggcagacgcaatgagacatgaacattctattaccatggtcaaacaaaggagtctagttgtcaaaatcgaatagatcaagtgactttagttatcctatgtaattctctggaataattctcatatctaccatgttacatttgcttttgttcgtggaatggttataaagacaagtcatgtcgatttggatctgactccaatgccccatggatttaacaagtcaagagaaattgcagattgttaaactgacccagatatatataagttagcttatttgtggtcgggtttgatcc

SEQ ID NO: 2939 - DNA, 745 bp, Pseudoroegneria spicata
cccgaactaaccccagctgcatccatggcgaagcagcggcttcttctctgcctgctggtcgccgccgccgcgctcctgctcgtcgcctccgccaagaagtccggcgacgtgtcggcgctccagatcggcgtcaagtacaagccagaatcctgcagcatctcggctcacaaaggtgacagagttaaagttcactaccgtggaacacttaccgatggaacagttttcgattctagctatgaaaggggtgaccctattgaatttgaattgggcactggtcaagtgatcaaaggatgggaccagggaattttgggcatgtgcattggtgagaagaggaagctgaagatcccttcaaagctcggctatggggatcagggatcaccacctaccattccaggcggagcaactctcatattcgacacagagcttgtcgctgtcaatggcgagccatctagcaaatcagacgaggatgacgctgacagtgatctgtaggcagctcggcgcagcacgatcgcccagttatcaaatcgaataggactatgtatgggaaacttactcttgtagggcagacacaatgagacaggaacattgtcttaccatgatcaaacagaggagtctagttctcaaaattgaatagatgaagtgacttttgttatcccatgtaattctctggaataattctcgtatctagcatgttacgtttgcttttgttcgtggaatggttataaagtacgggattgctatttca

SEQ ID NO: 2940 - DNA, 756 bp, Secale cereale
taaacgcaacccctcacgagttcgcccaaaatcctcctcttctctacccgaacaaagcccagctgcatccatggcgaagccgcggcttcttctctgcctgctggtcgccgccgccgcgctcctgctcgtcgcctccgccaagaagtccggcgacgtgtcggcgctccagatcggcgtcaagtacaagccagcatcgtgcagcatctcggctcacaaaggtgacagagttaaagttcactaccgtggaacacttaccgatggaacagttttcgattctagctatgaaaggggtgacccgattgaatttgaattgggcactggtcaagtgatcaaaggatgggatcagggaattttgggcatgtgcattggtgagaagaggaagctgaagatcccttcaaagctcggctatggggatcagggatcaccacctaccattccaggcggagcaactctcatattcgacacagagcttgtcgctgtcaatggcgagccatctagcaaatcagacgaggatgacgctgacagtgatctgtaggcagctcggcgcagcacgatcgcccagttatcaaatcgaataggactatgtatgggaaacttactcttgtagggcagacacaatgagacaggaacattgtcttaccatgatcaaacagaggagtctagttctcaaaatcgaatagatcaagtaacttttgttaccctatgtaattctctggaataattctcctatctaccatgttatgtttgcttttagtt

SEQ ID NO: 2941 - DNA, 723 bp, Secale cereale
acccgaacaaagcccagctgcatccatggcgaagccgcggcttcttctctggctgctggtcgccgccgccgcgctcctgctcgtcgcctccgccaagaagtccggcgacgtgtcggcactccagatcggcgtcaagtacaagccagcatcgtgcagcatctcagctcacaaaggtgaccgagttaaagttcactaccgtggaacacttaccgatggaacagttttcgattctagctatgaaaggggtgacccgattgaatttgaattgggcactggtcaagtgatcaaaggatgggatcagggaattttgggcatgtgcattggtgagaagaggaagctgaagatcccttcaaagctaggctatggggatcagggatcaccacctaccattccaggcggagctactctcatattcgacacagagcttgtcgctgtcaatggcgagccatctagcaaatcagacgaggatgacgctgacagtgatctgtaggcagctcggcgcagcacgatcgcccagttatcaaatcgaataggactatgtatgggaaacttactcttgtagggcagacacaatgagacaggaacattgtcttaccatgatcatacagaggagtctagttctcaaaatcgaatagatcaagtaacttttgttaccctatgtaattctctggaataattctcctatctaccatgttacgtttgcttttgtttgtggaatggtta

SEQ ID NO: 2942 - DNA, 989 bp, Oryza sativa
aaatcaaaacagcccaagagattcaggaagaataataataataaaaaaaaaggccatgctgccgctctataaacaaacagtcacccttcgccctcctcgcggaaaatcctagaaacagaaagaaatcgcactcatggcgaagccgcagcttcttctggtcgtcgccgccgccgcactgctactcgtcgttgcagcctccgccaagaaatccggcgacgtgacggagctccagatcggcgtcaagcacaagccagaatcctgcagcattcaagctcacaaaggcgacagagttaaagttcactaccgtggaaaacttactgatggaacagattttgattctagctatgaaagaggtgacccaatcgaatttgagttgggcactggccaagtgatcaaagggtgggatcagggcattctgggcatgtgcgttggcgagaagaggaagctgaagatcccttcaaagctcggttatggtgctcaagggtcaccgccgaccatccctggtggagcgactctcattttcgataccgagcttgttgctgtcaatggcgagccagccagcaaatccgatgaggacgatgatgacagcgagctttagatagccaggatggttcacatcttacgcgccaaaacaaagtctagttgtcgaatcaaatagtgagtagtgaaatgcaatgcatttcaaattcaggaccccatagagaaatcaactctctttttttttcaccatgaccttatctgctattttataacataagcttctatttaacttttagcctttctgaacaattgcatgatctgtgatgcatcttttgttccaaattgtagacttgttttgcgcttcgttttgtttggaaaatggttacaaacataactgctgtgccggtttggcttctatgtgtgatatagcatccgaattgtatgaagttcgaagtggacatatccaggctaaaacctgatcagtttgatttaatttgagttaatttagc

SEQ ID NO: 2943 - DNA, 712 bp, Secale cereale
cgcggcttcttctctgcctgctggtcgccgccgccgcgctcctgctcgtcgcctccgccaagaagtccggcgacgtgtcggcactccagatcggcgtcaagtacaagccagcatcatgcagcatctcggctcacaaaggtgacagagttaaagttcactaccgtggaacacttaccgatggaacagttttcgattctagctatgaaagaggtgacccgattgaatttgaattgggcactggtcaagtgatcaaaggatgggatcagggaattttgggcatgtgcattggtgagaagaggaagctgaagatcccttcaaagctcggctatggggatcagggatcaccacctaccattccaggcggagctactctcatattcgacacagagcttgtcgctgtcaatggcgagccatctagcaaatcagacgaggatgacgctgacagtgatctgtaggcagctcagcgcagcacgattgcccagttatcaaatcgaataggactatgtatgggaaacttactcttgtagggcaggcacaatgagacaggaacattgtcttaccatgtttggcaggcacaatgagacaggaacattgtcttaccatgatcaaacagaggagtctagttctcaaaatcgaatagatcaagtgacttttgttaccctatgtaattctcttgaataattctcctatctaccatgttacgtttgctttt

SEQ ID NO: 2944 - DNA, 1940 bp, Saccharum officinarum
gctccccgtctcctccgcccgcactcgctcgtccgcgcgcaggaaggttgacctgtcgagggccggcgagcccgagtcaaaatggatggaagtactagagggggtggacattctgaagcattaaggaactacaacctgggaagaactttaggtattggcacatttggaaaagtgaagattgccgagcataagcttacgggacatagggttgctataaagatcatcaattgtcgccaaatgagaaatatggaaatggaagagaaagcaaagagagaaatcaagatattgaagttgttcattcacccccatatcatccggctttatgaggtcatatacacaccaacagatatatatgttgtgatggaatattgtaagtatggcgagttgtttgattacattgttgagaaaggcagattactagaagatgaggctcgccgcatcttccagcagatcatatctggtgtcgaatactgccatagaaacatggttgtccaccgtgacctaaagccagaaaacttgttacttgattcaaagtataatgtaaaacttgctgactttggtttgagcaatgtcatgcatgatggccattttttgaagaccagctgtgggagtccgaactatgctgctccagaggtaatatctggtaaactatatgctggacctgaggtcgatgtatggagttgtggagtgatcctttatgctcttctttgtggaactcttccatttgatgatgagaatattcccaacctgttcaaaaaaattaagggaggtatctacacacttccaagtcatttatctgctttggctagggatttgatcccacgaatgcttgttgtcgagcctatgaagagaatcacaattcgggaaattcgggagcatcaatggttccagactcgccttcctcgttacttggcagtgcctccaccagacacgacacagcaagccaaaatgattgatgaagatacacttcgagatgttgttaatatgggatttaacaagaaccatgtgtgtgaatcactgtgcagcagacttcaaaatgaggcaactgttgcatattatttactattggacaatcggtttagagcaactagtggctatcttggggcagattatcaagaatcaatggacaggaatttaaatcagctggcgtcgtccgaatcatctagttctggtacgaggaattatgttccaggaagcagtgatcctcatagcagcggtttgcggccacattatcctgttgaaagaaaatgggcgcttggactccagtctcgggcccaccctcgtgaaataatgattgaggtcttaaaagcacttcaagaattaaacgtcagctggaagaagaatgggcactacaacatgaaatgcagatggctcccagggtttcctgaagtccatgacatgttagatgccagcaacagctttcttggtgactctaccatcatggataatgatgatgcaaatgggaggctacctgctgtgatcaagtttgaattccagctttacaagacaaaggacgacaagtacctcctcgatatgcagagagttactggacctcaactcctcttccttgacttttgtgcggccttccttaccaagcttagggttctatagtgctctgtttctcttcagagtggtgaaaaactaagaatagagctctaccatgtgcagtttttcactgaggtgatgaataaacgaaagcatgtaaataggaacctttttctcgtctttggacagcgaacatgtttgagtgactggtcttgtgtcaagcgcctaaaggttgcctgttaacttatcctaggtgtatacttaggtttagtatattactgtctgcatggacattgctgtttctgcaggctgtggcaccgcagatggcgatgctgtactggctattatgaaaaaaaaatgcaagatcgggagcccattcgctggagattatcagc

SEQ ID NO: 2945 - DNA, 2474 bp, Sorghum bicolor
aagaccgaaaaggcacaaggagccaaacgcgggcgcggccgggagagcgagctgccacgtcagcgcgacggtgaccttcccccggtaacgccgccgccgcctcgcgcaaccccaacccggccgagggcgggcgattaaattaaactaagctaacaccggggttttctccgccccccggaatcggacaccaaagtcggccatacgcccaagcgcaaaacctctcttagtcttcgctccgctctcgcacccgtgggtgctccgttccccgtctcctccgcccgcactcgatcgtccgcgcgcaggaaggttgatctgtcgagggccggcgagcccggtaagtaagagtgaaaatggatggaagtacaagagggggtggacattctgaagcattaaggaactacaacctgggaagaactttaggtattggcacatttggaaaagtgaagattgccgagcataagcttacaggacatagggttgctataaagatcatcaactgccgccaaatgaaaaatatggaaatggaagagaaagcaaagagagaaatcaagatattgaagttgttcattcacccccatatcatccggctttatgaggtcatatacacaccaacagatatatatgttgtgatggaatattgtaagtatggtgagttgtttgattacattgttgagaaaggcagattacaggaagatgaagctcgccgcatcttccaacagatcatatctggcgttgaatactgccatagaaacatggttgtccaccgtgacctaaagccagaaaacttgttacttgattcaaagtataatgtaaaacttgcggactttggtttgagcaatgtcatgcatgatggccattttttgaagactagttgtgggagtccgaactatgctgctccagaggtaatatctggtaaacaatatgctggacctgaggttgatgtatggagttgtggagtgattctttatgctcttctttgtggaactcttccatttgatgatgagaatattcccaacctgttcaaaaaaattaagggaggtatctacacacttccaagtcatttgtctgctttggccagggatttgatcccacgaatgcttgttgtcgagcctatgaagagaatcacaattcgggaaattcgggatcatcaatggttccagactcgccttcctcgttacttggcagtgcctccaccagacacgacacagcaagccaaaatgatcgatgaagatacacttcgagatgttgttaatatgggatttaacaagaaccatgtgtgtgaatcactgtgcagcagacttcaaaatgaggcaactgttgcatattatttactattggacaatcgatttagagcaactagtggctatcttggagcagattatcaagaatcaatggacaggaatttaaatcagatggcgtcgtccgaatcatctagttctggtacgaggaattatgttccaggaagcagtgatcctcatagcagcggtttgcggccacattatcctgttgaaagaaaatgggcgcttggactccagtctcgggcccaccctcgtgaaataatgattgaggtcttaaaagcacttcaagaattaaacgtcagctggaagaagaatgggcactacaatatgaaatgcagatggctcccagggtttcctgaagtccatgacatgttagatgccagcaacagctttcttggtgactctaccatcatggataatgatgatgcaaatgggaggctacctgctgtgatcaagtttgaattccagctttacaagacgaaggaagacaagtacctcctcgatatgcagagagttactggacctcaactcctcttccttgacttttgtgcggccttccttaccaagcttagggtattatagtgctctgtttctcttcggattggtgaaaaaactaaacatagggctctaccatgtgcagtttttcactgaggtgatgaataaacgaaagcatgtaaataggaacctttttctcgtctttggacagcaaacatgtttgagtgactggtcttgtgttaagcgcctgaatgttgcctgttaacttatcctagatgtatacttaggtttagtatattgctgtctgcatggacattgctgtttctgcaatcagtggcaccgcagatggcgatgcagcagtgcaagctattatggattttttttttttgcaagatccggcttttgttcgccttactgtacatagctatggtgtgttgcacttgaaaattttgcagttgctgatattttcttgacaactactgagtcgcatctgtaaaaaaaatcgtgctacttgatttaatttttgaatagatataggaccgctcgacagtaaatttactaatatctgttcactgtgagccattaagataaggtgtacttttttatgatttttaatcaaatattttcatgtttctctttttctttctccctatatatgcatggaggaatcgtacaagcacg

SEQ ID NO: 2946 - DNA, 2010 bp, Setaria italica
agtgaaaatggatggaagtgctagagggggtgggcattctgatgcattaagaaactacaacctgggaagaacattaggtattggtacatttggaaaagtgaagatcgcagagcataagcttacaggacatagggttgctataaagatcattaactgccgccaaatgaaaaatatggaaatggaggagaaagcaaagagagaaatcaagatattgaagttgttcattcacccccatatcatccggctttatgaggtcatttacacacctacagatatatatgttgtgatggaatattgtaagtatggtgagctgtttgattacattgttgagaaaggcagattacaggaagatgaagctcgtcgtatcttccagcagatcatatctggtgtggaatactgccatagaaacatggttgtccatcgtgacctaaagccagaaaacttgttacttgactcaaagtataatgtaaaacttgcggactttggcttgagcaatgtcatgcatgatggtcattttttgaagactagctgtgggagtccaaactacgctgctcctgaggtaatatctggtaaattatatgctggacctgaggttgatgtatggagttgtggagtgatcctttatgcacttctttgtggaactcttccatttgatgatgagaatattcccaacctgttcaaaaagattaagggaggtatctacactcttccaagtcatttgtctgctttagctagggatttgatcccaagaatgctcgttgttgagcctatgaagagaatcacaattcgtgaaattcgggagcatcaatggttccagaatcgccttcctcgttacttggcagtgcctccaccagacacgacgcagcaagccaaaatgattgatgaggatacacttcgagatgttgttaatatgggatttaacaaggaccatgtgtgcgaatcactgtgcagcagacttcaaaatgaggcaacagttgcatattatttactattggacaatcggtttaaagcaaccagtggctatcttggggcagattatcaagaatcaatggataggaatttaaatcagctggcatcatccgaatcaactagttctggtgtgaggaattatgttccaggaagcacagatcctcatagcaacggcctgcggacacattatccagttgaaagaaaatgggcacttggacttcagtctcgggcccacccacgtgaaataatgattgaggtcctaaaagcacttcaagaattaaatgtcagctggaagaagaatggacactacaacatgaaatgcagatggtgtccggagttttcagaagcccatgatatgttagattccagtaacagctttcttggtgactctaccatcatggataatgatgatgcaaatggaaggctacctgctgtgatcaaatttgaaatccagctttacaagacgagggatgagaaatacctcctcgatatgcagagagttactggacctcagctcctcttcctggacttttgtgcggccttccttaccaagcttagggttctatagtgctctgtttctcttcagagtggcgaataactaaacttagggctctgccgtgtgagttttttcactgcagtaatgaataaactacagcttgtaaatagaaataggaacctttgcgcctttttcatgtctttggacagcagaacgtgttgtttgagtgactggtcttgtgttatgcccaaaggttggcagttaacttgttatagatatatagatatacataggtttagtataactgtctggggagaaattgctttttaagcaagctgtgggctgtggcatcgcagatggcaatgctgcagtataaagctcttgtgaaaaatgcaagatccagcttctgttcaccttactacatagctatcctccgatgtacttgaattttttgcaattgctaatgttttcttgatagccagagacatctgcaaaagtatcatgcttcttgacttaccttctgtaactaaattgatatacgaaac

SEQ ID NO: 2947 - DNA, 2272 bp, Panicum virgatum
gtagtaatctgtggacaagatccagtgtgccgacactgtaaaggctgtgctttaacctgcgattccattacggggaagatggcttacatcactttggggaggccaaaggccttcaaatgctttggatatagcttatggttagggtttggttaaggggatgatacatgataggatggtgcgggtgcatgatcgtatttgttttacacttaaatgtaatgctttatagcgattacatagttttatgttcctaaggaagtaaaataatttatgttgttgggacatgggaccattagaaacatggactacaccgagtgtgatttgtatttcaactgtgcaagcaatcttattcaatgcaacttatagttgccctaattcatatataataatatctcttctttcattaatggtagagtgaaaatggatgggagcactaaagggggtgggcattctgatgcattaagaaactacaccctgggaagaacattaggtattggtacatttggaaaagtgaagattgcagagcataagcttacaggacatagagttgctataaagatcattaactgccggcaaatgagaaatatggaaatggaagagaaagcaaagagagaaatcaagatattgaagttgttcattcacccccatatcatccgtctttatgaggtcatttacgcacctatggatatatatgttgtgatggaatattgtaagtatggtgagctgttcgattacattgttgagaaaggcagattacaggaagatgaagctcggcgaatcttccagcagatcatatctggtgttgaatactgccacagaaacatggttgtccatcgtgacctaaagcctgaaaatctgttacttgattcgaagtataatgtaaaacttgcggactttggcttaagcaatgtaatgcatgatggccattttttgaagactagctgtgggagtccaaactatgctgctccagaggtaatatctggtagattgtatgctggacctgaggttgatgtatggagttgtggagttatcctttatgcacttctttgtggaacacttccatttgatgatgagaatattccaaacctgttcaaaaagatcaagggaggtatctacactcttccgagtcatttatctgctttggccagggatttgatcccaagaatgcttgttgtcgagcctatgaagagaatcacaattcgtgaaattcgagagcatcaatggttccagtttcgccttcctcgttacttggcagtgcccccaccagacacggcacagcaagccaaaatgattgatgaggatacacttcgagatgttgttaatatgggatttaacaaggacgatgtgtgtgagtcactgtgcagccgacttcaaaatgaggcaactgttgcgtattatttattattggacaatcggtttagagcaaccagtggctatctcggggcagattatcaagaatcaatggataggaatctaaatcagctggcgttgtccgaatcaactagttctggtgcgaggaattatgttccaggaagcagcgatcctcatagcagcggtttgcggacacattatcctgttgaaagaaaatgggcgcttggacttcagtctcgggcccaccctcgtgaaataatgattgaggtcctgaaagcactccaagaattaaatgtcagctggaagaagaatggacactacaatatgaaatgcagatggtgtcctgggttttctcaagtccatgatatgttagatgccagcaacagctttcttggtgactctaccatcatggataatgatgatgcaaatggaaagctacctgctgtgatcaaatttgaaatccagctttacaagacgagggatgaaaaatacctcctcgatatgcagaaagttactggacctcagctcctcttcctggacttttgtgcggccttccttaccaagcttagagttctatagtgctgtctatgttcagagcggcgaataactaaacatagggctctaccgtgtgacgttttacactgtagtaatgaataaacagcaccatgtaaataggaatctttgcacctttttcttgtctttggacagcgaaacgtgttgtttgagtgactggtcttgtgcttcgcccaaaggttggctgttaacttgttatagatatacatagcgaaaatgcaagatccagctgcaattcaacttacaacatagctatcctgcgatgtactttaaaattttgcagtcgcaaatattttttcatgacaaccactgaggcatatctgcaaaaata

SEQ ID NO: 2948 - DNA, 1990 bp, Pennisetum glaucum
gggtgctctctccccgtctctctcctctcgctcgtctctccctcctcccgcacccccccgcccgcgcgcaggaaggttgaccccgtcgggtgggccggcgagcttgctgaggtgagagtgaaaatggatggaagtgctagaggggctgggcattctgatgcattaataaactacaacctgggaagaacattaggtattggtacattcggaaaagtgaagattgcagagcataagcttacaggacatagggttgctataaagatcattaactgccgccaaatggaaactatggaaatggaggagaaagcaaagagagaaatcaagatattgaagttgttcattcacccccatatcatccggctttatgaggtcatttacacacgtacagatatatatgttgtgatggaatattgcaagtatggtgagctgtttgattacattgttgagaaaggcagattacaggaaaatgaagctcgtcgtatcttccagcagatcatatctggtgtggaatactgccatagaaacatggttgttcatcgtgacctaaagccagaaaacttgttacttgattcaaagtataatgtaaaacttgcggactttggcttgagcaatgtcatgcatgatggtcattttttgaagactagctgtgggagtccaaactacgctgctcctgaggtaatatctggtaaattatatgctggacctgaggttgatgtatggagttgtggagtgatcctttatgcacttctttgtggaactcttccatttgatgatgagaatattcccaacctgttcaaaaagattaagggaggtatttacactcttccaagtcatttgtctgctttagctagggatctgatcccaagaatgctcgttgtcgagcctatgaagagaatcacaattcgtgaaattcgggaacatcaatggttccagaaccgccttcctcgttacttggcagtgcctccaccagacacgacgcagcaagccaaaatgatcgatgaggatacacttcgagatgttgttaatatgggatttaacaaggaccatgtgtgcgaatcactgtgcagcagacttcaaaatgaggcaacagttgcttattatttactattggacaatcggtttaaagcaaccagtggctatcttggggcagattatcaagaatcaatggaaaggaatttaaatcagctaccgtcatctgaatcaactagttctggtgcgaggaattatgttccaggaagcacagatcctcatagcaacggcctgcggacacattatcctgttgaaagaaaatgggcacttggacttcagtctcgagcccacccacgtgaaataatgatcgaggtcctaaaagcacttcaagaattaaatgtcagctggaagaagaatggacactacaacatgaaatgcagatggtgtccggagttttctgaagcccatgatatgttagattccagtaacagctttcttggtgactctaccatcatggataatgatgatgcaaatggaaggctacctgctgtgatcaaatttgaaatccagctttacaagacgagggatgagaaatacctcctcgatatgcagagagttactggacctcagctcctctacctggacttttgtgcggccttccttaccaagcttagggttctatagtgctctgtttctcttcagagtggcgaataactaaacttagggccctgccttgtgagttttctcactgcagtaattaataaacaacagcctgtaaatagaaataggaacctttgcgcgtttttcgtgtctttgacagcaggacgtgttgtttgcgtgactggtcttgtattatgctcaaaggttggcagttaacttgttatagatatatagatatacaaaggtttagtatactgtgggggagaaattgcttttaagcaatctttgggatgtggcgtcgcagatggcagtgctgcagtataatgctcttgtgaaaaatgcaagatccagcttgtgtacc

SEQ ID NO: 2949 - DNA, 2070 bp, Panicum virgatum
agacgccccaacccccaaaacctctccccgctctccgctctccgctctccgctcgtgggtgctccccgtctctctcctcccgcgcacgcccgcgcgcaggaaggttgacccccgtcggccaccagcgagctccggtaagagtgaaaatggatgggaacactagagggggtggacagtctgatgcattaagaaactacaccctgggaagaacattaggtattggtacatttggaaaagtgaagattgcagagcataagcttacaggacatagagttgctataaagatcattaactgccgccaaatgagaaatatggaaatggaagagaaagcaaagagagaaatcaagatattgaagttgttcattcatccccatatcatacggctttatgaggtcatttacacacctatggatatatttgttgtgatggaatattgtaagtatggtgagctgtttgattacattgttgagaaaggtagattacaggaagaggaagctcggcgaatcttccagcagatcatatctggtgttgaatactgccatagaaacatggttgtccatcgtgacctaaagccagaaaatctgttacttgattcgaagtataatgtaaaacttgcagactttggcttaagcaatgtaatgcatgatggtcattttttgaagactagctgtgggagtccaaactatgctgctccagaggtaatatctggtagattatatgctggacctgaggttgatgtatggagttgtggagtgatcctttatgcacttctttgtggaactcttccatttgatgatgagatattcccaacctgttcaaaaagatcaagggaggtatctacactcttccgagtcatttatctgctttggccagggatttgatcccaagaatgcttgttgtcgagcctatgaagagaatcacaattcgtgaaattcgagagcatccatggttccagtttcgccttcctcgttatttggcggtgcctccaccagacacggcacagcaagccaaaatgattgatgaggatacacttcgagatgttgttaatttgggatttaaaaaggacgatgtgtgtgagtcactgtgcagccgacttcaaaatgaggcaactgttgcgtattatttactattggacaatcggtttagagcaaccagtggctatctcggggcagattatcaagaatcaatggataggaatttaaatcagctggcgttgtccgaatcaactagttctggtacgaggaatcatgttccaggaagcagcgatcctcatagcagcggtttgtggacacattatcccgttgaaagaaaatgggcgcttggacttcagtctcgggcccaccctcgtgaaataatgattgaggtcctgaaagcacttcaagaattaaatgtcagctggaagaagaatggacactacaatatgaaatgcagatggtgtcctggattttctgaagtcgatgatatgttagatgccagcaacagctttcttggtgactctaccattatggataatgatgatgcaaacggaaagctacctgctgtgatcaaatttgaaatccagctttacaagacgagggatgaaaaatacctcctcgatatgcagagagttactggacctcagctcctcttcctggacttttgtgcggccttccttaccaagcttcgagttctatagtgctctgtctatgttcagagtggcgaataactaaacatagggctttaccttgtgaggtttttggtgatgaataaacaacaccatgtaaataggagcctttgcacctttctcttgtctttggacagcaaaacgtgtttgtttgtgtttgagtgactggtcttgtgattcgcccaaaggttggctgttaacttgttatagatatgcataggtttagtataactgtctgggggggcatttctgtttaagcaagctgtagcaccgcagatggcaattctgcagtgcaaccacttgcgaaaaatgcaagatccagcttctattcaacttactacatatctatcctccgatgtacttcaaaattttgcagtcgcaaatattttttcatgaccaccagacac

SEQ ID NO: 2950 - DNA, 1996 bp, Panicum virgatum
taatggcagagtgaaaatggatgggaacactagagggggtggacagtctgatgcattaagaaactacaccctgggaagaacattaggtattggtacatttggaaaagtgaagattgcagagcataagcttacaggacatagagttgctataaagatcattaactgccgccaaatgagaaatatggaaatggaagagaaagcaaagagagaaatcaagatattgaagttgttcattcatccccatatcatacggctttatgaggtcatttacacacctatggatatatttgttgtgatggaatattgtaagtatggtgagctgtttgattacattgttgagaaaggtagattacaggaagaggaagctcggcgaatcttccagcagatcatatctggtgttgaatactgccatagaaacatggttgtccatcgtgacctaaagccagaaaatctgttacttgattcgaagtataatgtaaaacttgcagactttggcttaagcaatgtaatgcatgatggtcattttttgaagactagctgtgggagtccaaactatgctgctccagaggtaatatctggtagattatatgctggacctgaggttgatgtatggagttgtggagtgatcctttatgcacttctttgtggaactcttccatttgatgatgagaatattcccaacctgttcaaaaagatcaagggaggtatctacactcttccgagtcatttatctgctttggccagggatttgatcccaagaatgcttgttgtcgagcctatgaagagaatcacaattcgtgaaattcgagagcatccatggttccagtttcgccttcctcgttatttggcggtgcctccaccagacacggcacagcaagccaaaatgattgatgaggatacacttcgagatgttgttaatttgggatttaaaaaggacgatgtgtgtgagtcactgtgcagccgacttcaaaatgaggcaactgttgcgtattatttactattggacaatcggtttagagcaaccagtggctatctcggggcagattatcaagaatcaatggataggaatttaaatcagccggcgttgtccgaatcaactagttctggtacgaggaatcatgttccaggaagcagcgatcctcatagcagcggtttgtggacacattatcccgttgaaagaaaatgggcgcttggacttcagtctcgggcccaccctcgtgaaataatgattgaggtcctgaaagcacttcaagaattaaatgtcagctggaagaagaatggacactacaatatgaaatgcagatggtgtcctggattttctgaagtcgatgatatgttagatgccagcaacagctttcttggtgactctaccattatggataatgatgatgcaaacggaaagctacctgctgtgatcaaatttgaaatccagctttacaagacgagggatgaaaaatacctcctcgatatgcagagagttactggacctcagctcctcttcctggacttttgtgcggccttccttaccaagcttcgagttctatagtgctctgtctatgttcagagtggcgaataactaaacatagggctttgccttgtgaggtttttggtgatgaataaacaacaccatgtaaataggagcctttgcacctttctcttgtctttggacagcaaaacgtgtttgtttgtgtttgagtgactggtcttgtgattcgcccaaaggttggctgttaacttgttatagatatgcataggtttagtataactgtctgggggggcatttctgtttaagcaagctgtagcaccgcagatggcaattctgcagtgcaaccacttgcgaaaaatgcaagatccagcttctattcaacttactacatatctatcctccgatgtacttcaaaattttgcagtcgcaaatattttttcatgaccaccagacacatctgcaaaaatgtcatgcttattgactcttttgtaactaagtagatatatggaa

SEQ ID NO: 2951 - DNA, 2562 bp, Oryza sativa
agcaaatccacgccaccggcgagcccgtccatccaaagcgatgcacaccgagagggaacaaaacagaaagtgtgagagagagagaggaaaaaaaataataaaagagcggagagacagaagcctacgaacgggcaaagcggccgccacgtagacgtgtacatcttctccggtaacaccgcccaaaactcccccccttcatcacttttttaataatccgcgacgacgccgagcgattattagtattaaagtgaagtgtgagctccaagtccgaaccccccaaaacctcccgtctcttcccgtccccgctccagtgggcgggctctctccctcttcctcctccgctccgctccacctcggttgaccaccacccgatcggcggcgagggcggggagctccggcgtgctcagtgaaaatggatggaaatgctaaaggcggtgggcattctgaggcactgaagaactacaatcttggaagaactttaggtattggctcatttggaaaagtgaagattgcagagcataagcttacaggacacagagttgctataaagatcctgaaccgccgccaaatgagaaatatggaaatggaggagaaagcaaagagagaaatcaagatactgagattgttcattcatccccatatcattcgcctttatgaggttatatacactcctacggatatatatgttgtgatggagtactgcaagtttggagaactgtttgattacattgttgagaaaggcaggttgcaggaagatgaggctcgccgaatcttccagcagattatatctggggttgaatactgccacagaaacatggtggttcatcgtgatctgaagccagaaaacttgctactggattcaaagtataatgtaaagcttgctgactttggtttgagtaacgtcatgcatgatggccattttttgaagacaagctgtgggagtccaaactatgctgctccagaggtgatctctggtaaattatatgctggacctgaggttgatgtatggagctgtggagtgatcctttatgctctcctttgtggtactcttccatttgatgatgagaatatccccaacctattcaaaaagataaagggtggtatatatactctcccaagtcatttatctgctctggccagagatttgatcccaaggatgcttgttgttgatccaatgaagagaatcacaattcgtgaaattcgagagcatcagtggtttcagattcgccttcctcgttacttagcagtgcctccaccagacacagcacagcaagccaaaatgattgatgaagatacccttcaagatgtcgtaaacttgggttatggaaaggaccatgtgtgtgaatctctgcgcaatagactgcagaatgaggcaactgttgcatattatttactcttggacaatcgattccgagctaccagtggctatttgggagcagactatcaagaatctttggagaggaattttaatcgctttgcttcatcggaatcagcaagttcaaatacaaggcattatcttccaggaagcagtgatcctcatgccagtggtttgcgcccacattatcctgttgaaagaaaatgggctcttggacttcagtcacgagctcaacctcgcgagataatgattgaggtcctaaaggcacttcaagacttaaatgtctcctggaagaagaatggacagtacaacatgaaatgcagatggagcgttgggactcaggccactgatatgttagatgttaacaacagctttgttgatgactcaatcataatggataacggtgatgtaaatgggaggctacctgctgtgatcaagtttgaaatccagctttacaagaccagagacgagaagtatctgctggatatgcagagagttacggggcctcagctccttttcctggacttctgtgcagacttccttaccaagctgagggttctatagtacccttgtgttggcttcagtgaaaaaccaaacctagggttttatcatgtgcggtttttcactgcaataatgaataaaggacaccatgtaaataggcagctgtgactttcttcccagtccttagacagcgaaggttgttgtttgagtgactagtgttgtgttaagcaccaaaatgttggttgttacagacttacatagtatatagatctttataagctatctgggtgggcgaatgcttgatttctaatttttgcaggctgcagctatactgctggtgatgccgcagtacaagcttttctttttgctcctgcacacggttattatacgtgtgcatggaaattttgctactgctaggaagaagctagtaagaatatcagccccttgctgccgggttgtggtataaatgtagatgacagcaaatttagtggaatatttctatgacaacaaatgtagtcgtatgatcatgctcatgcccccctatggagaatcgagatatcctttctcttgtcgtgtgctgctgtgcataccatcactagagaattcatcatattgtcttgtactatttcgatgtgcaccataactccataaggaccttcaaaaaagttttcgttataagaaacgga

SEQ ID NO: 2952 - DNA, 1880 bp, Avena sativa
aggcctccctccctccacccagtgggtgctctcctcgtctcctccttccactccccgcccggttgacccaggccatagtgaaaatggatgggaacactagaggaggtgggcattctgacgcgttaaagaactacaatctgggcagaacattaggtattggaacatttggaaaagtgaagattgcagagcataagcatacaggtcacaaagttgctataaaaatcctgaaccgtcgtcaaatgagaactatggaaatggaagagaaagcaaagagagaaatcaagatattgaggttgttcattcacccccatatcatccggctttatgaggtcatttacacacctacagatatattcgttgtgatggaatattgcaagtatggtgagctattcgactgcattgttgagaaaggcaggttacaggaagatgaggctcgcagaatcttccagcagattatatctggtgttgaatattgccatagaaatatggttgttcatcgtgatctaaagccagaaaacctgttacttgattccaaatataatgtcaaacttgctgactttgggttaagtaatgtcatgcatgatggacattttttgaagactagctgcgggagtccaaattatgctgctccagaggttatctcaggcaaactgtatgctggacctgaggttgatgtttggagctgtggtgttatcctttatgctcttctttgtggtactcttccatttgatgatgacaacattcccaacctcttcaaaaagataaagggaggtatctatatccttccaagtcatttatctgctcttgcaagggatttgatcccaagaatgcttgttgttgatcctatgaagagaattacaattcgtgaaatccgagagcatccgtggtttcagaatcaccttcctcgctacctagcagtgcctccaccagacacagcacagcaagccaaaatgattgatgaagatacacttcaagatgttgtcaacctgggatatgacaaagaccatgtgtgtgagtcactgtgcaataggctgcaaaatgaggcaactgttgcatattacttactcttggacaatcggttccgagctactagtggctatctgggggcagaacatcaatcaatggataggagttataatcaggttgcatcatcggaatcagcaagttcaagtaccaggaattatcttccaggaagcaatgattctcatggcagtggcttgcggccatattatccagttgaaagaaaatgggctctcgggcttcagtcccgagctcacccacgtgagataatgattgaggttctaaaggcacttcaagaattaaatgtctcctggaagaaaaatggacattacaacatgaaatgcaggtggtgccctgggtttcctcaggtcagtgatatgttagatgccaaccacagctttgttgatgactctaccatcatggataatggcgaagcaaatgggctacctgttgtgatcaagtttgaaatccagctttacaagaccagggatgacaagtacctgctggatatgcagagagttactggacctcagctccttttcctggatttctgcgcagccttccttaccaaccttagggttctatagtgcctatttgggctgaggggtgaatataaagacatatgtctatcgcgtgtggttcatcactgcaacgatgaataaatgaatccatgtaaataggtgtgtttcagcttccttttacaatgttaagtccctgacagcgaaacgtgttgtttgagtgactagtcttgtgtcaagcaccaaaaagttaataggtgattgtaagacttacataggctgtggtgaggcaatgtgggcgaatccttgcttattcataagcaaaaaaattgacaatgttca

SEQ ID NO: 2953 - DNA, 2634 bp, Brachypodium distachyon
aagcgacaaaacggaggaggatgaatgatgacacgaggagccaaatgctctcgcaagcaaaagcaaaacgaagcggagccaaagcaagcggcgcgcgagcgggtcgacacgcaagcccggcgtgacgctcatcatctcccctcgcctcctccggtaataacgccgctcatccccccggccgctcgccttaaactaaagcgcttctaaagcctccggagcaaccaaccccaaaacctctctcgagtccgactgggtgctctcgtcttcctcctccactcccccgcgcggttgaccccggcgactggctggtagtgacaatggatggaaacgctagaggaggtgggcattctgaagccttaaagaactacaatctgggcagaacattaggtattggcacatttggaaaagtgaagatcgcagagcataagcatacaggacacaaagttgctataaagatcctaaaccgtcgtcaaatgagaactatggaaatggaagagaaagcaaagagagaaatcaagatattgaggttgttcatccacccccatatcatccgactttatgaggtcatttacacccctacagatatatttgttgtgatggagtattgcaagtatggtgagctatttgactgcattgttgagaaaggaaggttacaggaagatgaggctcgccgaatcttccagcagattatatctggtgttgaatactgccacagaaatatggttgttcatcgtgatctgaagccagaaaacctgttactcgattcaaaatataatgtgaaacttgctgactttggcttgagtaatgtcatgcatgatggccattttttgaagactagctgtggcagtccaaattatgctgctccagaggttatctccggtaaattatatgctggacctgaggttgatgtttggagctgtggagtgatcctttatgcacttctttgtggtagtcttccatttgatgatgacaatattccgaacctgttcaaaaagataaagggaggtatctatatccttccaagtcatttatctgctctggcaagggatttgatcccaagaatgcttgttgttgatcccatgaagagaatcacaattcctgaaatccgagagcataattggtttcagaatcgccttcctcgctacttggcagtgcctccaccagacacagcacaacaggccaaaatgattgatgaagatactcttcaagacgttgtcaacttgggatatgaaaaagaccatgtgtgtgaatcactctgcaataggctccaaaatgaggcgactgttgcatattatttactgttggacaatcggttccgagctactagtggttatctgggtgcagactatcaagaatcaatggataggagttttaatcagtttacttcatcggaaccagcaagctcaagcaccaggaattatctcccaggaagtagcgattctcaaggcagtggcttgcggccatattatcctgttgaaagaaaatgggctcttggtcttcagtctcgagctcaccctcgtgagataatgattgaggttctaaaggcgcttcaagaattaaatgtctgctggaagaagaatggacattacaacatgaaatgcaggtggtgccctggatttcctcaggtcagtgatatggtagatgccaaccacagttttgctgatgattctaccatcatggataacgtcaatgtaaatgggaggctacctgctgtggtcaagttcgaaatccagctttacaagaccagggatgacaagtacctgctggatatgcagagagttactggaccacagcttcttttcctggatttctgtgcggcgttccttaccaaccttagggttctatagtgcctgttctgctggagagtgctgaataacagaacatatgtctctgtcgcgtgtggtctatcactgcagtgataaataaacgacaccgtgtaaataggtgtgtttttacccagtccttgacagcgaacagtgttgtttgagtgactagtcttgtatcaagcaccagaaggttaatcggttgttacaagacttgcatagtaaataggctgtggtgaggtatgagggtggatccttgtgtggcacttgctggtgaggatgatgcatcggaaactttgtgatattaaaaagaagattaggcttctattcacattactgttgaacatggcgatcctgtgtgtgcatggaaattttgcaattgcccagaaactaccaacaatacctgcccatttctggaggtggttatctagccatgaagggccagatacgctgcacaattatatgcatcttcataactgcaacactatcgggagggaagttctagttctaccaactcactgcagcactacgcataagctatataaaattccgaagaaaaaaatcgtgtacatagattgttttattttaattctacagaatttgaacgcaaatcccatccgaacatgtaaatagcaataaaaatgtcggaattctgcgacgaatggtaccttcatcatttcctctctctttgggatactattaacaacaaattgtcttttttcaactcaatgtgtaaactaaattttattgtgaaattttatgacatgatagatatatgctggatcaatggtacaccacaaggcttctctca

SEQ ID NO: 2954 - DNA, 2505 bp, Oryza sativa
aagcgatggctgcacacggagaacagaaagaaagagagagaaaaaaaaaaaagagaatggtgccaaaatgggatggcccccacttgcagcggctgaggtgggaatgggatgttcaagaagcaatccacttgcgcagcactagcccaccaccgcctccgccgaccccgatccccatccatcccgccagcgaccgagcagggtcgccgtcgttcgccgtcgtcctgctgcttccgccgcatccatcccggtgagcagtcacatcctccgccaccgccgcctgcgccgatccccatccatccctccagcgagcagggcgggcgccgtcgttcctcctgctgcttccgcccgcatccatcctggtcactgtgaaaatggaaggaaatgctagaggcggtgggcattctgaggcactgaagaactacaatctaggaagaactttaggtattggttcatttggaaaagtgaagattgcagagcataagcttacagggcacagagttgctataaagatcctgaaccgtcgccaaatgagaaatatggaaatggaggagaaagcaaagagagaaatcaagatattgaggttgttcattcatccccatatcattcgcctttatgaggtcatatacactcctacggatatatatgttgtgatggagtactgcaagtttggagaactgtttgattacattgttgagaaaggcaggttgcaggaagatgaggctcgccgaatcttccagcagattatatctggggttgaatactgccacagaaacatggtggttcatcgtgatctgaagccagaaaacttgctactggattcaaagtataacgtaaagcttgctgactttggtttgagtaatgtcatgcatgatggccattttttaaagacaagctgcgggagtccgaattatgctgctccagaggtgatctctggtaaattatatgctggacccgaggttgatgtatggagctgtggagtgatcctttatgctctcctttgtggtactcttccatttgatgacgagaatatccccaacctattcaaaaagataaagggtggtatatatactctcccaagtcatttatctgctctggccagggatttgatcccaaggatgcttgttgttgatccaatgaagagaatcacaattcgtgaaattcgagagcatcaatggtttcagattcgccttcctcgttacttagcagtgcctccaccagacacagcacagcaagccaaaatgattgatgaagatacccttcaagacgttgtaaacttgggttatgaaaaggaccatgtgtgtgaatctctgcgcaatagactgcaaaatgaggcaactgttgcatattatttgctattggacaatcgattccgagctaccagtggctatctgggagcagactatcaagaatcattggagaggaatcttaatcgctttgcttcatcagaatcagcaagttcaaatacaaggcattatctcccaggaagcagtgatcctcatgccagtggtttgcgcccacattatcctgttgaaagaaaatgggctcttggacttcagtctcgagctcagcctcgcgagataatgattgaggtcctaaaggcacttgaagacttaaatgtctgctggaagaagaatggacagtacaacatgaagtgcagatggagcgttgggtatcctcaggccactgatatgttagatgtcaaccacagctttgttgatgactcaattataatggataatggcgatgtaaacgggaggttacctgctgtgatcaagtttgaaatccagctttacaagagcagagacgagaagtatctgctggatatgcagagagttacggggcctcagctccttttcctggacttctgtgcagccttccttaccaaactgagggttctatagtaccccgtgttggcttcagtgaataaccaaacctagggttttatcatgtgcggtttttcactgcaataatgaataaaggacaccatgtaaataggcagctgtgactttcttcccggcccttagatagagaaggttgttgtttgagtgactagtgttatgttgagcaccaaaatgttggttgttacaggcttacatagtatatagatcttgataagctatctgggtgggcgaatgcttgatatctaattttttgcaggctgcagctatactgctggtgatgctgcagtacaagcttttctttttgctcctgcacacggttattatgcgtgtgcatggaaattttgctactgctagaaagaagctaggtaagaatatcagccccttgctgccgggttgtggtataaatgtagatgacagcaaatttagtgaaatatcaacaaatgtagtcgtatgatcatgctcatgtccccctatggagaatcgaggtatcctttctcttgtcttgtgcatatcatcgctagagaattcatcatattgtcttgtactatttcgatgtgcaccattactctataaggcccttcaaaaaggttttcgttataagaaa

SEQ ID NO: 2955 - DNA, 2276 bp, Hordeum vulgare
gggtgacgagccaatttcctttccgcgagcgcgatgacgaagcaccagactagagctaagagaaaaaaaaaaactgacggggagaaacgacagaggaggaaaacaggaagcggcacgggagggaggcgacacgcaagcgccatgctgatgctcgtctttccccggttagcccgccccccactggcccggctcgccttaaactaagcttaggcttagctgctctctcctaaagcctcccacccccggagaagtactaaccgaccccaaaacctcctccgctgggcgctctcgtcgtctccgctgccgagccgcgcgcctcctccccgtccgagcggttgaccgcgggatttggccagtgaaaatggatgggaacactagaggaggcgggcattctgaagcgttaaagaactacaatctgggcagaacattaggtataggcacatttggaaaagtgaggattgcagaacataagcatacagggcacaaagttgctataaagattctgaaccgtcgtcaaatgagaactatgaacatggaagagaaagcaaagagagagatcaagatattgaggttgttcattcaccctcatatcatccggctttatgaggtcatttacacacctacagatatatttgttgtgatggaatattgcaagtatggggagctattcgactgcattgttgagaaagggcggttacaggaagatgaggctcgtcgaatcttccagcagattatatctggtgttgaatactgccacagaaacatggttgttcatcgtgatctaaagccagaaaacctgttacttgattccaaatataatgtgaaacttgccgactttggattaagtaatgtcatgcatgatggccattttctgaagactagctgcgggagtccaaactatgctgcaccggaggttatctcaggtaaattgtacgctggacctgaggttgatgtttggagctgtggggtgatactttatgctcttctttgtggcactcttccatttgatgatgacaatattcccaacctgttcaaaaagataaagggaggcatctatatccttccaagtcatttatctgctcttgcaagggatttgatcccaagaatgcttgttgttgatcctatgaagagaatcacaattcgtgaaattcgagaacacccatggtttcagaatcgccttcctcgctacctggcagtgcctccaccagacacggcgcagcaagccaaaatgattgatgaagatacacttaaagacattgtcaacctgggatatgataaagaccatgtgtgtgaatcactgtgcaataggctgcaaaatgaggcaactgttgcatattacttactcttggacaatcggttccgggccactagtggctatttgggggctgactatcaacaatcaatgggtaggagtcttaatcagtttacttcatcggaatcagcaagcccaagtaccaggcagtatcttccaggaaccaatgattctcaaggcagtggcttgcggccatattaccccgttgaaagaaaatgggctcttgggctccagtctcgagctcaccctcgtgagataatgattgaggttctaaaggcacttcaagaattaaatgtctcctggaagaagaatggacactacaacatgaaatgcagatggtgccctgggtttcctcaggtcagtgatatgttagatgccaaccacagctttgttgatgactctaccatcatggataacggcgatgccaatgggaggctacctgccgtgatcaagtttgaaattcagctttacaagaccaaggatgacaagtacctgctggatatgcagagacttactggacctcagctcctcttcctggatttttgtgcggccttccttaccaaccttagggttctgtagtatggtgcctgttctggttgagtggtgaatggttagacatatgactgtcagcgatgaataagtgatggtgtgtaaataggtggtgtgtttcgtcttcgttttacccagtccctgacagcgaaccgtgttgttttgagtgactagtcctgtgtgaagaaccaaaaggttaagtggttgttataaataagacttgctatatggtaaataggcgtggtgaactttttctattttttgaattttgtgagccattttctgattctgcgggctgcgccaccgctggttgtgatgctgcagcacaagcctttgtgatatactactccttccatccgagaaaacttgtccatagcttagttcaattgtaattttggaaaaaaaaagaaaaaaa

SEQ ID NO: 2956 - DNA, 1840 bp, Triticum aestivum
attccagcggttgacggcgggagtcggccagtgaaaatggaagggaacactagaggaggcgggcattctgaagcgttaaagaactacaatgtgggcagaacattaggtatcggcacatttggaaaagtgaggattgcagagcataagcatacagggcacaaagttgctataaagattctgaaccgtcgtcaaatgagaactatggaaatggaagagaaagcaaagagagagatcaagatattgaggttgttcattcaccctcatatcatccggctttatgaggtcatttacacacctacagatatatttgttgtgatggaatattgcaagtatggtgagctattcgactgcattgttgagaaagggcggttacaggaagatgaggctcgtcgaatcttccagcagattatatctggtgttgaatactgccacagaaacatggttgctcatcgtgatctaaagccagaaaacctgttacttgattccaaatataatgtgaaacttgccgactttgggttaagtaatgtcatgcatgatggccattttctgaagactagctgcgggagtccaaactatgctgcaccagaggttatctcaggtaaattatacgctggacctgaggttgatgtttggagctgtggggtgatactttatgctcttctttgtggcactcttccatttgatgatgacaatattcccaaactgttcaaaaagataaagggaggcatctatatccttccaagtcatttatctgctcttgcaagggatttgatcccaagaatgcttgttgttgatcctatgaagagaatcacaattcgtgaaattcgagaacacccatggtttcagaatcgccttcctcgctacctggcagtgcctccaccagacacagcgcagcaagccaaaatgattgatgaagatacacttaaagagattgtcaacctgggatatgataaagaccatgtgtgtgaatcattgtgcaataggctgcaaaatgaggcaactgttgcatattacttactcttggacaatcggttccgggccactagtggctatttgggggctgactatctacaatcaatgggtaggagttttaatcagtttacttcatcggaatcagcaagcccaagtaccaggcagtatcttccagcaagcaatgattctcaaggcagtggcttgcggccatattatcccgttgaaagaaaatgggctcttgggctccagtctcgagctcaacctcgtgagataatgatcgaggttctaaaggcacttcaagaattaaatgtctgctggaagaagaatggacactacaacatgaaatgcaggtggtgccctgggttccctcaggtcagtgatatgttagatgccaaccacagctttgttgatgactctaccatcatggataacggcgatgctaatgggaggctacctgccgtgatcaagtttgaaatccagctttacaagaccaaggatgacaagtacctgctagatatgcagagagttactggacctcagctcctcttcctggatttttgcgcggccttccttaccaaccttagggttctatagtatggtgcctgttctggttgagtgatgaatagtaagacatatgactgtcagcgatgaataagttggtgcctgttctggttgagtgatgaatagtgaaacatatgactgtcagcgatgaataagtgatgggtgtgtaaataggcggtgtgtttcatcttcgttttacccagtccctgacagcgaaccgtgttgtttgggtgactagtcctgtgtgaagcaccaaaaggttaagtggttgttataaataagacttatatggtaaaaagaaaaagta

SEQ ID NO: 2957 - DNA, 2008 bp, Triticum aestivum
cccttaaccctcccctggttggccttccggttcggacgagttccctcaacggaacggagggcccggaccgacgacaggtgtctacgacgcagagtacggcggggggagaaagaaaaggaccaaccgcccccaaaacctctcctgctctccctcgaggcctcctccactggccgctctcgtcgcctccccacccattcgagcggttgaccgagggattcggccagtgaaaatggaagggaacactagaggaggcgggcattctgaagcgttaaagaactacaatgtgggcagaacattaggtatcggcacatttggaaaagtgaggattgcagagcataagcatacagggcacaaagttgctataaagattctgaaccgtcgtcaaatgagaactatggaaatggaagagaaagcgaagagagagatcaagatattgaggttgttcattcaccctcatatcatccggctttatgaggtcatttacacacctacagatatatttgttgtgatggaatattgcaagtatggtgagctattcgactgcattgttgagaaagggcggttacaggaagatgaggctcgtcgaatcttccagcagattatatctggtgttgaatactgccacagaaacatggttgctcatcgtgatctaaagccagaaaacctgttacttgattccaaatataatgtgaaacttgccgactttgggttaagtaatgtcatgcatgatggccattttctgaagactagctgcgggagtccaaactatgctgcaccagaggttatctcaggtaaattatacgctggacctgaggttgatgtttggagctgtggggtgatactttatgctcttctttgtggcactcttccatttgatgatgacaatattcccaaactgttcaaaaagataaagggaggcatctatatccttccaagtcatttatctgctcttgcaagggatttgatcccaagaatgcttgttgttgatcctatgaagagaatcacaattcgtgaaattcgagaacacccatggtttcagaatcgccttcctcgctacctggcagtgcctccaccagacacggcgcagcaagccaaaatgattgatgaagatacacttaaagagattgtcaacctgggatatgataaagaccatgtgtgtgaatcattgtgcaataggctgcaaaatgaggcaactgttgcatattacttactcttggacaatcggttccgggccactagtggctatttgggggctgactatctacaatcaatgggtaggagttttaatcagtttacttcatcggaatcagcaagcccaagtaccaggcagtatcttccagcaagcaatgattctcaaggcagtggcttgcggccatattatcccgttgaaagaaaatgggctcttgggctccagtctcgagctcaacctcgtgagataatgatcgaggttctaaaggcacttcaagaattaaatgtctgctggaagaagaatggacactacaacatgaaatgcaggtggtgccctgggttccctcaggtcagtgatatgttagatgccaaccacagctttgttgatgactctaccatcatggataacggcgatgctaatgggaggctacctgccgtgatcaagtttgaaatccagctttacaagaccaaggatgacaagtacctgctagatatgcagagagttactggacctcagctcctcttcctggatttttgcgcggccttccttaccaaccttagggttctatagtatggtgcctgttctggttgagtgatgaatagtaagacatatgactgtcagcgatgaataagttggtgcctgttctggttgagtgatgaatagtgagacatgtgactgtcagagatgaataagtgatggtgtgtaaataggtggtgtgtttcatcttcgttttacccagtccctgacagcgaaccgtgttgtttgggtgactagtcctgtgtgaagcacgtgttgtttgggtgactagtcctgtgtgaa

SEQ ID NO: 2958 - DNA, 2292 bp, Triticum aestivum
aaagcctccctccctccctcccacccccggagaagaaaaggaccgaccgaccccaaaacctctcctgctctccctcgaggcctcctccactgggctctctcgtcgcctccccacccattccagcggttgaccgcgggattcggccagtgaaaatggaagggaacactagaggaggcgggcattctgaagcgttaaagaactacaatgtgggcagaacattaggtatcggcacatttggaaaagtgaggattgcagagcataagcatacagggcacaaagttgctataaagattctgaaccgtcgtcaaatgagaactatggaaatggaagagaaagcaaagagagagatcaagatattgaggttgttcattcaccctcatatcatccggctttatgaggtcatttacacacctacagatatatttgttgtgatggaatattgcaagtatggtgagctattcgactgcattgttgagaaagggcggttacaggaagatgaggctcgtcgaatcttccagcagattatatctggtgttgaatactgccacagaaacatggttgctcatcgtgatctaaagccagaaaacctgttacttgattccaaatataatgtgaaacttgccgactttgggttaagtaatgtcatgcatgatggccattttctgaagactagctgcgggagtccaaactatgctgcaccagaggttatctcaggtaaattatacgctggacctgaggttgatgtttggagctgtggggtgatactttatgctcttctttgtggcactcttccatttgatgatgacaatattcccaaactgttcaaaaagataaagggaggcatctatatccttccaagtcatttatctgctcttgcaagggatttgatcccaagaatgcttgttgttgatcctatgaagagaatcacaattcgtgaaattcgagaacacccatggtttcagaatcgccttcctcgctacctggcagtgcctccaccagacacggcgcagcaagccaaaatgattgatgaagatacacttaaagagattgtcaacctgggatatgataaagaccatgtgtgtgaatcattgtgcaataggctgcaaaatgaggcaactgttgcatattacttactcttggacaatcggttccgggccactagtggctatttgggggctgactatctacaatcaatgggtaggagttttaatcagtttacttcatcggaatcagcaagcccaagtaccaggcagtatcttccagcaagcaatgattctcaaggcagtggcttgcggccatattaccccgttgaaagaaaatgggctcttgggctccagtctcgagctcaacctcgtgagataatgatcgaggttctaaaggcacttcaagaattaaatgtctgctggaagaagaatggacactacaacatgaaatgcaggtggtgccctgggtttcctcaggtcagtgatatgttagatgccaaccacagctttgttgatgactctaccatcatggataacggcgatgctaatgggaggctacctgccgtgatcaagtttgaaatccagctttacaagaccaaggatgacaagtacctgctagatatgcagagagttactggacctcagctcctcttcctggatttttgcgcggccttccttaccaaccttagggttctatagtatggtgcctgttctggttgagtgatgaatagtgagacatatgaccgtcagcgatgaataagttggtgcctgttctggttgagtgatgaatagtgagacatatgactgtcagagatgaataagtgatggtgtgtaaataggtggtgtgtttcatcttcgttttacccagtccctgacagcgaaccgtgttgtttgggtgactagtcctgtgtgaagcaccaaaaggttaagtggttgttataaataagacttatatggtaaataggcggtgcaaaggaagccatacccccgcgtacccccgcgtcgcctgggaggcgactcgggggaaccctagcccgccgcgccgccaccccctctccccggctcccctgccgcgccgccgccggaggaaaccgccgggcgaagcccgcgcggcggacggcggcggcggggcttcccgctcgcgcgcgcggcgtcgttccacgacggcgaccgctccaggtggggaaggctcggcctccggcgctgcggccgtcccggcgctccccggcggccctctgcttcgtctcgcgcttctccttctctgggtgggtggaccgcactccccccgcccccgattgccccccaggag

SEQ ID NO: 2959 - DNA, 2104 bp, Triticum aestivum
gcggcgggcgcgggagggagccgacacgcaagcgcgatgctgatgctgatgctcatctttccacggttacgccgcccccgctggctcggctcgccttaaactaagctcaagctagcggctctcgcctaaagcctccctccctccctcccacccccggagaagaaaaggaccaaccgaccccaaaacctctcctgctctccctcgaggcctcctccactgggcgctctcgtcgcctccccacccattccagcggttgaccgcgggattcggccagtgaaaatggaagggaacactagaggaggtgggcattctgacgcattaaagaactacaatgtgggcagaacattaggtataggcacatttggaaaagtgaggattgcagagcataagcatacagggcataaagttgctataaagattctgaaccgtcgtcaaatgagaactatggaaatggaggagaaagcaaagagagagatcaagatattgaggttgttcatccaccctcatatcatccggctttatgaggtcatttacacacctacagatatatttgttgtgatggaatattgcaagtatggtgagctattcgactgcattgttgagaaagggcggttacaggaagatgaggctcgtcgaatcttccagcagattatatctggtgttgaatactgccacagaaacatggttgctcatcgtgatctaaagccagagaacctgttacttgattccaaatacaatgtgaaacttgccgactttgggttaagtaatgtcatgcatgatggccattttctgaagactagctgcgggagtccaaactatgctgcaccagaggttatctcaggtaaattatacgctggacctgaggttgatgtttggagctgcggggtgatactttatgctcttctttgtggcactcttccatttgatgatgacaatattcccaaactgttcaaaaagataaagggaggcatctatatccttccaagtcatttatctgctcttgcaagggatttgatcccaagaatgcttgttgttgatcctatgaagagaatcacaattcgtgaaattcgagaacacccatggtttcagaatcgccttcctcgctacctggcagtgcctccaccagacacggcgcagcaagccaaaatgattgatgaagatacacttaaagagattgtcaacctgggatatgataaagaccatgtgtgtgaatcattgtgcaataggctgcaaaatgaggcaactgttgcatattacttactcttggacaatcggttccgggccactagtggctatttgggggctgactatctacaatcaatgggtaggagttttaatcagtttacttcatcggaatcagcaagcccaagtaccaggcagtatcttccagcaagcaatgattctcaaggcagtggcttgcggccatattaccccgttgaaagaaaatgggctcttgggctccagtctcgagctcaacctcgtgagataatgatcgaggttctaaaggcacttcaagaattaaatgtctgctggaagaagaatggacactacaacatgaaatgcaggtggtgccctgggtttcctcaggtcagtgatatgttagatgccaaccacagctttgttgatgactctaccatcatggataacggcgatgctaatgggaggctacctgccgtgatcaagtttgaaatccagctttacaagaccaaggatgacaagtacctgctagatatgcagagagttactggacctcagctcctcttcctggatttttgcgcggccttccttaccaaccttagggttctatagtatggtgcctgttctggttgagtgatgaatagtgagacatatgaccgtcagcgatgaataagttggtgcctgttctggttgagtgatgaatagtgagacatgtgactgtcagagatgaataagtgatggtgtgtaaataggtggtgtgtttcatcttcgttttacccagtccctgacagcgaaccgtgttgtttgggtgactagtcctgtgtgaagcaccaaaagtgttgtttgggtgactagtcctgtgtgaagcaccaaaaggttaagtggttgttataaataagacttatat

SEQ ID NO: 2960 - DNA, 2307 bp, Secale cereale
catcagcgcctcgtcaccaatcaatccatcctacatgcgacggaggacgttgaggtgaggtgacgaaccaatttcctttccgcgaggcgacgacgaagcacgagacgagagcagaggggagaaaatactgacgtggggaaacgacagaggaggagaagcaagcggcgggcgcggtagggagccggcacgcaagcgcgatgctgatgctcacctttccccggttgcgccgcccccgctggctcggctcgccttaaactaagcttaagctaaagctgccctcgcctaaagcctcccacacccggagaaggaccaaccgacccaaaacctctcctgctctccctcgaggcctcctccactgggtgctctcgtcgcctccccacccattcgagcggttgaccgcgggatttggccagcgaaaatggatgggaacactagaggaggtgggcattctgaagcgttaaagaactacaatctgggcagaacattaggtataggcacatttggaaaagtgaggattgcagagcataagcatacagggcacaaagttgctataaagattctgaaccgtcgtcaaatgagaactatggaaatggaagagaaagcaaagagagagatcaagatattgaggttgttcattcaccctcatatcatccggctttatgaggtcatttacacacctacagatatatttgttgtgatggaatattgcaagtatggtgagctatttgactgcattgttgagaaagggcggttacaggaagatgaggctcgtcgaatcttccagcagattatatctggtgttgagtactgccacagaaacatggttgctcatcgtgatctaaagccagaaaacctgttacttgattccaaatataatgtgaaacttgccgactttgggctaagtaatgtcatgcatgatggccattttctgaagactagctgcgggagtccaaactatgctgcaccagaggttatctcaggtaaattatacgctggacctgaggttgatgtttggagctgtggggtgatactttatgctcttctttgtggcacacttccatttgatgatgacaatattcccaaccttttcaaaaagataaagggaggcatctatatccttccaagtcatttatctgctcttgcaagggatttgatcccgagaatgcttgttgttgatcctatgaagagaatcacaattcgtgaaattcgagaacacccatggtttcagaatcgccttcctcgctacctggcagtgcctccaccagacacggcgcagcaagccaaaatgattgatgaagatacacttaaagacattgttaagctgggatatgataaagaccatgtgtgtgaatcactgtgcaataggctgcaaaatgaggcaactgttgcatattacttactcttggacaatcggttccgggccaccagtggctatttgggggctgactatcaacaatcaatgggtaggagttttaatcagtttacttcaccagcaagcccaagtaccaggcagtatcttccaggaagcaatgattctcaaggcagtggcttgcggccatattaccccgttgaaagaaaatgggctcttgggctccagtctcgagctcaacctcgtgagataatgatcgaggttctaaaggcacttcaagaattaaatgtctgctggaagaagaatggacactacaacatgaaatgcaggtggtgccctgggtttcctcaggtcagtgatatgttagatgtcaaccacagctttgttgatgactctaccatcacggataacagtgatgctaatgggaggctacctgccatgatcaagtttgaaatccagctttacaagaccaaggatgacaagtacctgctagatatgcagagagttactggacctcagctcctcttcctggatttgtgcgcggccttccttacaaaccttagggttctgtagtatggtgcctgttctggttgagcggtgaatagtgaaacatatgatagtcagcgatgaataaatgatggtgtgtaaataggtggtgtgtttcatcttcgttttacccagtctccgacagcgaaccgtgttgtttgagtgactagtcctgtgtgaagcaccaaaaggttaagtggttgttataaataagacttatatggtaaataggcgtggtgaaccttttctttttcttgtgaaccgttttctaattctgcaggctgcgccaccgctggttgtgatgctgcagcacaagcttttgttactcttggacagatagaagcggtttccaggcttctatttgccttgctgttgaaaatgtacctgaattt

SEQ ID NO: 2961 - DNA, 4136 bp, Sorghum bicolor
ccgctcggctgctctccacacggggtgacgagtgacgctcccctccgtcccttacacttcaaaacatttcgaattcctcaacccccgaaagggcgaaaaccccaacgcctccaaaattttcccgccccaacccgtcgaaccctagccccaccaccggccggcgacgcctcgccggcggccggcgagatgcacatcaaggaggtaaccctcgaggggttcaagtcgtacgcagggcggacggtggtgtcggggttcgacccgctgttcaacgccatcaccgggcttaacggctccggcaagtccaacatcctcgactccatctgcttcgtgctcggcatcacagatctccgccaggtgcgcgccgcctcgctccaggagctcgtctacaagcagggccaggccggggtcaccaaggctaccgtctccattgtcttcgacaactccgaccgctcccgctccccgctcggctacgaggactcgcccgagatcactgtcacgcgccagattgttgttggtggaaggaacaaataccttatcaatggccatcttgcacaaccttcccgtgtccagaccctattccactcagtgcagcttaatgtaaacaatcctcattttctaattatgcaagggcgcattacaaaagtcctgaacatgaagcctccagaaattttgtcaatgttagaagaggcagcaggcacaagaatgtatgaaatgaagaaagaatctgctcttaagacacttgagaagaagcagaataaagttgatgagattaataaactccttgatgttgaaatcctccctgcactagagaagcttagaaaggagcggtgccaatacatgaaatgggccaatggcaatgctgaactggataggctcaaaagattttgtattgcctatgagtttgttcaggctgagagagtgcgagatggtgcgctcagtgatgtcaaacaaatcagggcaaagattgatgagctggatgaaaatacagaaacgataaaagcagatatacaagaaatggacaataacatttctaccttggctgctgaaaaagaagctaaagaaggcggcgagatgaagcttctgtccgataaagttgataaattatcgcatgtacttatcaaggaaacttctgtgatgaataatcaagaggaaaccctgaaatctgaggaaaagggtgctgagaagattctcacaaacattgaggacataaaaaagtccatacttgagagagatgctgctgttaaaaatgtagagattgaggcatctgatatgaaaagaagagcagaggagctcacaaaggagttggacgagaaggagaaagaataccagggtgtgctagcaggaaaaagcagtgcaagcgagaagaaatgccttgaagatcaactcagagatgcaaaagctgcagttggagatgcagaatctggactaaagcagctagccacaaaaataaaacactctgaaaaggagttgaaggagaagaaagctctgttagtgtccaagcgtgatgaggctattgcagctgagaatgagctgaaaacaaggacaaaggacttggatggtatcaaggcatccatgggatctattaattatgatgagggccagatggaagctttgcaaaaggaccgttctatggagttagaaattggtcagaaattaaaggaccgtgttcgtaagctttctggtgagcttgcaaatgtccacttcagttatcgagaccctgaaaggaattttgacagatctaaagtcaaaggggttgttgcacgtcttattaggattaaggatagctcaacagctacagcactggaggttgccgcaggtgggaggttatataatgtcgtagttgacacagaagaaactggaaagcagctattaaagaatggggatctacgtagtagagtaaccatcatacctctgaacaaaatccaaacatacacgatacctgacagagttcagcaggcagctcgtagactggttggtcctgacaatgtaacattagctctagaattggttggatatggtgaggaagtgaagaatgccgtggcttatgtctttggctcaacatttgtgtgtcgtaatatggatgcggcaaaagaggttgcgtttaatagggaagttagcagtactagtgtgactcttgagggtgacacttatcagcctagtggtcttttgactggaggtagtaaagggggtagagggaacttgctaaggaaactcgacgaactagctaaagctgaggctgatctatctgatcatgagaaaaggctctctgtcattgaacaacagattggagcccttttaccattgcaaaaaaggtacactgagttgaaatctcagtttgaactcaagtcatatgatctctcgctatttcagagcagagttgagcaaaatgaacatcacaagttaggtgaacttgtaaagaaaattgaacaagagcttcaagaatcaacacaagagttgacagaaaaggaagtgcagcatgaaagatgtgtgtctacagtttctgagttagaaacaactatcaagacttatggcactgaacgagagggcagactcaaagcgctggagaaaaggatcaaatcaattaaatcagagatgcaatccatgtcaaagcaactaaaggcttatgaaagtgacagggagaggcttatcatggagaaagatgcagttgctaatgagcttgctacactggaagagcagttaacaacttcaaaagctcaaattacatctctgtctgaaaccttggaaaaacaaaaggacaaggttacttccataaagcaagattatgatcaagctgaaagtgagctcaatgttgggcgttctaaactgaaggaatgtgactcacagataaaccgtatggccaaggaacagcagaaacttcagcaaaagttaagtgactcaaatgttgaaaggaagaaaatggaaaatgaggttaagaggatggagatagagcagaaggattgctcttcaatagttgataagctactggagaagtatagctggattgtaactgagaaacagttgtttgggaaaagcggtacagattatgattttcattcttgtgaaccacataaagcccgcgaggaacttgaaaatcttcaagctcaacaatccagtcttgagaagagggtcaataagaaagttatggcaatgtttgagaaggcagaggatgagtacaatgatttgatgtcaaagaaaaacatcatcgagaatgacaaggcaaaaatcaagaacgtgatagaggagttggatgagaagaagaaggaaaccttgaaagtcacatggctcaaagtaaacaaggatttcggatctatattcagtactcttttacctggtacaatggcaaaacttgatcctccagaaggtggcactttcttggatggtcttgaagttcgtgtggcatttgggacagtttggaagcagtctctatctgaacttagtggagggcaacggtcccttcttgctcttagtcttatcctggctttgcttctttttaaacctgcaccactttacatattggatgaggttgatgctgctcttgatctgagccacacccaaaacattggtagaatgatcaaggctcatttcccgcactctcagttcatagttgtctctttaaaagagggtatgttcaacaatgccaatgtgatattccgaacaaaatttgttgatggtgtgtccactgtgacacgtacagtgccttcaaaacagagatgatcagtttacacagaatgcacattcttaaggagaactattccacgaaagctgaaccctacaattacttgatgttgtggccgcttgatgcctcaagcccctcgcttgtctggcaatggcatcaaaataggtgctgtaactgtaacctcatgccgtgacgtccatggtgaccttgactgccttctatgttatgcgctttcatctgacccaatgtgtaattagcggttgaactattttgtgttgaagatcgaccttgtaatgtcatgtaacaggcatttattatcagggtcagggatacttctgacttgctaacttaccttgtgttcttatttctaattttttgatgtgcctctccccctattttcgatttaccttttattactccggaccaaagtttaaaatagtgggctattaaaaatagcgat

SEQ ID NO: 2962 - DNA, 4079 bp, Panicum virgatum
acggccgctgccgctctcactttcttcttcacacggggggacgcgccgctccgtccctgacccgtccacttcgaaacatttcgaaatctccaaccccgaccgcccgacgcctcgaaacttttcccgcccggagcctccaaaccctagccccatctccggccggcgacgcctccccggcggccggcgagatgcacatcaaggaggtaacactcgaggggttcaagtcgtacgcggggcggacggtggtgtcggggttcgacccgctgttcaacgccatcaccgggctcaacggctccggcaagtccaacatcctcgactccatctgcttcgtgctcggcatcaccgacctccgccaggtccgcgccgcctcgctccaggagctcgtctataagcagggtcaggcgggggtcaccaaggccaccgtctccatcgtcttcgacaactccgaccgctcccgctccccgctcggctatgaggactcgcccgagatcaccgtcacgcgccagattgtagttggtggacggaacaaataccttatcaatggccatcttgcccaaccttcccgggtgcagacccttttccactcagtgcagcttaatgtaaacaatcctcattttctaattatgcaagggcgcataacaaaagtgctcaacatgaagcctccagaaattttgtccatgttagaagaggcagcgggaacacgaatgtatgaaatgaagaaagaatctgctcttaagacacttgagaagaaacagaacaaagttgatgagattaataaactccttgatgctgaaatccttcctgcactagagaagcttaggaaagagcggtgccagtacatgaaatgggccaatggcaatgctgaactggatcggctcaaaaggttctgtatctcctatgagtttgttcaggcggagagagtgcgagatggtgcactcaatgatgtcaaaaaaatcagggcaaagattcttgagctggatgaaaatacagaaaagctaaaagcagatatacaggaaatgtacaagaacatttctaccctggctgctgaaaaggaagctaaacttggtggtgagatgaaggttttgtcagagaaagtagataaactatcacatgcacttattaaggaaacttctgtgatgaataatcaagaggaaaccttgaagtccgaggaagagggagctgagaagattctcaaaaacattgaagacattaaaagatctatgatcgagagagatgctgctgtaaaagacttagaggatggggcgtctgacatgaaaaggaaagcggaggatctgacaaagaagttagacgagaatgagaaagaatatcagggtgtgctagcaggaaaaagtaacgcaaacgagaagaaatgcctcgaagatcaacttagggatgctaaagctgcagttggagatgcagaatctggattaaagcagctgaatacaaaaataagtcattctgaaaaggagcttaaggagaagaaagctcttttagtatccaagcgtgatgaggctactgctgctgagaatgaactgaaagcaaggacaaaagacttggaagctatcaagacatccatgggatctatcaattatgatgagggccagatggaagctttgcaaaaggaccggtctacagagttggaaatggttcagaatttgaaagaccgtgttcgtaagctttcaggtgagcttgctaatgttcacttcagctatcgagaccctgaaaggaattttgacagatcaaaagtcaaaggggttgttgcacgtcttattagaataaagaatagctcagcagcaacagcactggaggttgctgcaggtggaaggctgttcaatgtggttgttgacacagaggagactgggaagaaattattgaaaaatggggatctccagagcagagtaaccatcatacctttgaacaaaatccaaacatacacgatacctgatagagttcagcaggcggctcgtagactggttggtcctgacaatgtaacattagctctagaattggttggatatggcgaggaagtaaagaatgctgtgtcttatgtatttggctcaacattcgtgtgtcgcaattcggaggcagcaaaagaggttgcatttaatagggaagttgccagtactagtgtgactcttgaaggtgacacttatcagcctagtggccttttgaccggaggcagtaaaggaggtagagggaatttgctacggaaacttgatgaattggctaaagctgaggctgatctatccaatcatgagaaaaggctctctgtcattgaacaacagattggagcccttttaccattgcagaaaaggtacactgagttgaaatctcagtttgaactcaagtcatatgatctctcattatttcataaaagagttgagcaaaatgaacatcacaagttaggtgaactcgtaaagaaaattgaacaagagattcaagaatcaaaacaagagttgacagaaaagcaagtgcagtatgaaaaatgtgtatcaatggtttcagagttggaacaaacgatcaggacttatggcactgagcgtgaaggcagactcaaagcactggaaaaaacgatcaaatcattgaaatcggagatgcagtccatgtcaaagcaattaaaggctcatgaaagtgagagggagaggctgatcatggagaaagatgcagttgttaatgagcttgctaatctagaagagcagttatcaacttcaaaagctcaaattacctctcagtctgaaacattggaaaaacaaaaggacaaggttgcttccataaagcaagattatgatcaagctgaaggtgagctcaatgttgggcgttcgaaactgaatgaatgtgactcacagataaaccacatggccaaggaacagcagaaacttcaacagcaattgagtgattcaaatgttgaaaggaagaaaatggaaaatgaggttaagaggatggagatagagcagaaggattgctcttcaatagttgataagctagtggagaagtatagttggatttcaactgagaaacagttgtttggaaaaagtggtacagattatgattttgaatcttgtgaaccacataaagcccgagaggaattagaaaatcttcaagctcaacaatccagtcttgagaaaagggtcaataagaaagttatggctatgtttgagaaggcagaggatgagtacaacgacttgatgtcaaagaaaaacatcatcgagaatgacaaggcaaaaatcaagaaagtgatagaagagttggatgagaagaagaaggaaaccttgaaagtcacatggctcaaagtaaacaaggattttggatctatattcagtactcttctacctggtacaatggcaaaacttgatcctccagaaggtggtactttcttggatggtcttgaagttcgtgtagcatttgggacagtttggaagcagtctctatctgaacttagtggagggcaacggtcccttcttgctcttagtcttatcctggcactgcttcttttcaaacctgcaccactttacatattggatgaggttgatgctgcccttgatctgagccatacgcaaaacattggtagaatgatcaaggctcactttccgcactcacagttcatagttgtctcacttaaagagggtatgttcaacaacgccaacgtaatattccggacaaaatttgttgatggtgtgtccactgtgacgcgaacagtgccttcgaaacagagatgaccaatttattatagccatgcttcttctgtagattgccaggtggtttgctgcaccctaactttgagatagtagtgcttggcgctgtggccgcaaaatgtctcaagcagtcaagctcctcgcttgtctgctttggatcctcttcccaaattaggtgctataactgtaatcccgtgccgttacgttaatgacctcgtatgtactttaatctgccctaatgtgtaattagtggttgaacaatttcgttttgaagattgaacacctatattggcataatgtgtagcaagtaatgtagtgccatgctttgttcccttcacgagggtttttttttttgtgaaaactagatcaagaggttatttgttccga

SEQ ID NO: 2963 - DNA, 4021 bp, Panicum virgatum
cgaaacatttcgaaatccccaaccctctcctccccgaaagaacgaaaaccccgacgcctcgaaaattttcccgcccggagcctccaaaccctagccccatctccggtcggcgacgcctccccggcggccggcgagatgcacatcaaggaggtaacactcgaggggttcaagtcgtacgcggggcggacggtggtgtcggggttcgacccgctgttcaacgccatcaccgggctcaacggctccggcaagtccaacatcctcgactccatctgcttcgtgctcggcatcacggacctccgccaggtccgcgccgcctcgctccaggagctcgtctataagcagggtcaggccggggtcaccaaggccaccgtctccatcgtcttcgacaactccgaccgctcccgctccccgctcggctacgaggactcgcccgagatcaccgtcacgcgccagattgtagttggtggacggaacaaataccttatcaatggccatcttgcccaaccttcccgcgtgcagacccttttccactcagtgcagcttaatgtaaacaatcctcattttctaattatgcaagggcgcataacaaaagtgctcaacatgaagcctccagaaattttgtccatgttagaagaggcggcaggcacacgaatgtatgaaatgaagaaagaatctgctcttaagacacttgaaaagaaacagaacaaagttgatgagattaataaactgcttgatgttgaaatccttccggcactagagaagcttaggaaagagcggtgccagtacatgaaatgggccaatggaaatgctgaactggatcggctcaaaaggttctgtatcgcctatgagtttgttcaggcggagagagtgcgagatggcgcactcaatgatgtcaaacagatcagggcaaagattcttgagctggatgaaaatacagaaaagctaaaagcagatatacaggaaatggacaagaacatttctaccttggctgctgaaaaggaagctaaacttggtggtgagatgaaggctttgtcagagaaagtggataaactatcacatgtgcttattaaggaaacttctgtgatgaataatcaagaggaaaccctgaagtccgaggaaaagggagctgagaagattctaaaaaacattgaagacataaaaagatccatgatcgagagagatgctgctgtaaaagacttagaggacggggcgtctgacatgaaaatgaaagcagaggatctgacaaagaagttagatgagaatgagaaagaataccagggtgtgctggcaggaaaaagtaatgcaaatgagaagaaatgcctcgaagatcaacttagggatgctaaagctgcagttggagaggcagaatctggattaaagcagctgaatacaaaaataagtcattctgagaaggagcttaaggagaagaaagctcttttagtatccaagcgtgatgaggctactgctgctgagaatgaactgaaagcaaggacaaaagacttggaagctatcaagacatccatgggatctatcaattatgatgagggccagatggaagttttgcaaaaggaccggtctacagagttggaaatggttcggaatttgaaagaccgtgttcgtaagctttcgggtgaacttgctaatgttcacttcagttatcgagaccctgaaaggaatttcgacagatcaaaagtcaaaggagttgttgcacgtcttattagaataaaggatagctcagcagcaacagcactggaggttgctgcaggtggaaggctattcaatgtggttgttgacacagaggacactgggaagaaattactgaaaaatggggatcttcaaagtagagtgaccatcatacctttgaacaaaatccaaacatatacgatacctgatagagttcagcaagcggctcgtagactggttggtcctgacaatgtaacattagctctagaattggttggatatggcgaggaagtaaagaatgctgtgtcttatgtatttggctcaacattcgtgtgtcgcaattcggaggcagcaaaagaggttgcatttaatagggaagttggcagtactagtgtgactcttgaaggtgacacttatcagcctagtggccttttgaccggaggcagtaaaggagctagagggaatttgctgcggaaactcgacgaattggctaaagctgaagctgatctatccaatcatgagaaaaggctctctgtcattgaacaacagattggagcccttttaccattgcagaaaaggtacactgagttgaaatctcagtttgaactcaagtcatatgatctctcgttatttcataaaagagttgagcaaaatgaacatcacaagttaggtgaactcgtaaagaaaattgagcaagatcttcaagaatcaaaacaagagttgacagaaaagcaagtgcagtatgaaaaatgtgtatcaacggtttcggagttagaacaaacgatcaggacttatggcactgagcgtgaaggcagactcaaagcactggaaaaaacgatcaaatcattgaaatcagagatgcagtcaatgtcaaagcaattaaaggctcatgagagtgagagggagaggctgatcatggagaaagatgcagttgctaatgagcttgctaatctagaagagcagttatcaacttcaaatgcgcaaattacttctctgtctgaaaccttggaaaaaacaaaaggacaaggttacttccataaagcaagattatgatcaagctgaaggtgagctcaatgttgagcgttcgaaactgaaggaatgtgactcacagataaaccacatggccaaggaacagcagaaacttcaacagcaattaagtgattcaaatgttgaaaggaagaaaatggaaaatgaggttaagaggatggaggtagagcagaaggattgctcttcaatagttgataagctagtggagaagtatagttggatttcaactgagaaacagttgtttggaaaaagtggtacagattatgattttgaatcttgtgaaccacacaaagcccgagaggaattagaaaatcgtcaagctgaacaatccagtcttgagaaaagggtcaataagaaagttatggctatgtttgagaaggcagaggatgagtacaacgatttgatgtcaaagaaaaacatcatcgagaatgacaaggcaaaaatcaagaaagtgatagaagagttggatgagaagaaggaaaccttgaaagtcacatggctcaaagtaaacaaggattttggatctatattcagtactcttctacctggtacaatggcaaaacttgatcctccagaaggtggtactttcttggatggtcttgaagttcgtgtagcatttgggacagtttggaagcagtctctatctgaacttagtggagggcaacggtcccttcttgctcttagtcttatcctggcactgcttcttttcaaacctgcaccactttacatattggatgaggttgatgctgcccttgatctgagccatacgcaaaacattggtagaatgatcaaggctcattttccacactcacagttcatagttgtctcacttaaagagggtatgttcaacaacgccaatgtaatattccggacaaaatttgttgatggtgtctccactgtgacgcgaacagtgccatcgaaacagagatgaccagtttatacgccatgcttcttctgtagatgtttgctgcaccctaacttttgtgatgctagtgcttggtgctgtggccgcaaaatgtctcaagcagccaagctcctcgcttgtcaggcgatggcatcaaattaggcgctatagtctataactgtaaccccgtgctgttacgtttatgacctcgtatgtactctgatctgccctaatgtgtgtaattagtggttgaataattttgttttgaagattgaacacctatatattggcataatgtgtgtagcatgtaatgtagtggccatctgttaccatggcttatcttttcatcatgttttgctccctttaagaggttctttttgtcctgat

SEQ ID NO: 2964 - DNA, 4024 bp, Setaria italica
cgaaacatttcgaaatctccaaccccaacacccgaaagggcgaaaacccggcacctcgaaattttcccgcccggagcctccaaaccctagccccatctccggccggcgacgcctccccggcggccggcgagatgcatatcaaggaggtaaccctcgaggggttcaagtcgtacgcggggcggacggtggtgtcggggttcgacccgctgttcaacgccatcaccgggctcaacggctccggcaagtccaacatcctcgactccatctgcttcgtgctcggcatcaccgacctccgccaggtccgcgccgcctcgctccaggagctcgtctacaagcagggtcaggctggggtcaccaaggccaccgtctccgtcgtcttcgacaactccgaccgctcccgctccccgctcggctacgaggattcgtccgagatcaccgtcacgcgccagattgtagtcggtggacggaacaaataccttatcaatggccatcttgcacaaccttcccgggtgcagacccttttccactcagtacagctaaatgtaaacaatcctcattttctaattatgcaagggcgcataacaaaagtgctcaacatgaagccaccagaaattttgtccatgttagaagaggcagcaggcacacgaatgtatgaaatgaagaaagaatcggctcttaagacacttgagaagaaacagaacaaagttgatgagattaataaactccttgatgttgaaatccttcctgcactagagaagcttagaaaagagcggtgccagtacatgaaatgggccaatggcaatgctgaactggatcggctcaaaaggttctgtatcgcctatgagtttgttcaggctgagagagtgcgagatggtgcactcaatgatgtcaaacaaatcagggcaaggattcttgagctggatgaaaatacagaaaagctaaaagcagatatacaggaaatggacaagaacatttctaccttggctgctgaaaaggaagctaaacttggtggtgagatgaaggctttgtcagataaagtggataaactatctcatgcacttattaaggaaacttctgtgatgaacaatcaagaggaaaccctgaagtctgaggaaaagggcgttgagaagattctcaaaaacattgaggacataaaaagatctatgatcgagagagatgctgctgtaaaagatgtagaagatggggcgtctgacatgaaaaggaaagcagaagatctgacaaggaagttggatgagaatgagaaagaatatcagggtgtgctagcaggaaaaagtaatgcaaacgagaagaaatgcctcgaagatcaacttagagatgcaaaagctgcagttggagatgcagaatctggattaaagcagctgactaccaaaataagtcattctgagaaggagctgaaggagaagaaagctctgttagtatccaaacgtgatgaggctactgctgctgagaatgagctgaaagaaaggacaaaagacttggaagctatcaagacatcgatgggatcttttaattacaatgaggcccagatggaagctttgcaaaaggaccattctacggagtcagaaattattcagaatttgaaggactgtattcgtaacctttcgggtgagcttgctaatctccacttcagttatcgagaccctgaaagggattttgacagatcaaaagtcaaaggggtcgttgcacgtcttattagaataaaggatagctcagcagcaacagcactggaggttactgcaggtggaaggctgtttaatgtggttgttgatacagaagacactggcaagaaattattgaaaaatggggatctccgaaaacgagtaaccatcatacctttgaacaaaatccaaacatacatgatacctgatagagttcagcaggcggctcgtagactggttggtcctgacaatgttacattagctctagaattggttggatatggcgaggaagtaaagaatgctgtggcttatgtatttggttcaacatttgtgtgtcgcaatacggaggcagcaaaagaggttgcatttaatagagaagttggcagtactagtgtgactcttgaaggtgacacttatcagcctagtggccttttgactggaggcagtaaaggaggtagaggggatttgctacggaaactcgacaaattggctaaagctgagactgatctatccgatcatcagaaaaagctctctgtcattgaacaacagattggagcccttttaccattgcaggaaaggtacactaagttgaaatctcagtttgaactcaagtcatatgatctctcgttatttcagaaaagagttgagcaaaatgaacaccacaagttaggtgaactcgtaaagaaaatagaacaagagcttcaggaatcaaaacaagagttgacagaaaagcaagtgcagtatgaaaaatgtgtgtcaatggtttctgagttagaacaaacgatcaggacttacggcactgaacgcgaaggcagactcaaagcactggaaaaaatgatcaaatcactgaaatcagagatgcagtctatgtcaaagcaactcaaggcttatgaaagtgagagggagaggctgatcatggagaaagatgcggttgctaatgagcttgctacgctagaagagcagttatcaacttcaaaggctcaaattacttctctgtctgaaaccttggaaaaacaaagggacaaggttactgccataaagcaagagtatgatcaagctgaaggtgagctcaatgttgggcgttcgaaactgaaggaatgcgactcacagataaaccgcatggccaaggaacagcagaaacttcaacagaaattaagcgattcaaatgttgaaaggaagaaaatggaaaatgaggttaagaggatggagatagaacaaaaggattgctcttcagtagttgataagctagtggagaagtatagttggattgcaactgagaagcagttgtttgggaaaagtggtacagattatgattttgaatcttgtgaaccacataaagcccgggaggaacttgaaaatcttcaagctcaacaatccagtctggagaaaagggtcaataagaaagttatggcaatgtttgagaaggcagaggatgagtacaacgatttgatgtcaaagaaaaacatcattgagaatgacaaggcaaaaatcaagaaagttatagaagagttggatgagaagaagaaggaaaccttgaaagtcacatggctcaaagtaaacaaggattttgggtctatattcagtactcttttacctggtacaatggcaaaacttgatcctccagaaggtggtactttcttggatggtcttgaagttcgtgtagcatttgggacagtttggaagcagtctctgtctgaacttagtggagggcaacgatcccttctcgctcttagtcttattctggcgctgcttcttttcaaacctgcaccactttacatattggatgaggttgatgctgcccttgaccttagccacacacaaaacattggtagaatgatcaaggctcattttcctcactcacagttcatagttgtctcgcttaaagagggtatgttcaacaatgccaacgtaatattccggacaaaatttgttgatggtgtgtccactgtgacgcgaacagtgccttctaaacaaaaatgaccagtttatacaccacgctgcttctgtaggagaatgatttatgcaagctgaacccccacaattgcttctagattgccaaatggtttgatgcaccctaacttatggggtgctcgtgcttggtgctgtggccgcaaaatgtctcaagctcctcgcttgtcaggccgtggcatcaaattaggcactataactgtaaccccatgttacgttgatgacctcgtatgtactttgatctgccccagtgtgtaattagtggttgaacaatttcgttttggagattgaacacctacgtcgtcatgattggcgtagcatgtaaagtatcggccatctgttgtcgtgggttatcttttcatgcttttgttccgttt

SEQ ID NO: 2965 - DNA, 4219 bp, Oryza sativa
acgcgtccgcggccgcggcatttcgaattcccaaccccgaaaatccccacgccccgaaaatttttcgcgcccaaacccaccaaaccctagacccacctccggccggcgacgccgccgccggcggccggcgaggatgcacatcaaggagatatgcctggaggggttcaagtcgtacgccgggcggacggtggtgtcggggttcgacccgctgttcaacgccatcaccgggctcaacggctccggcaagtccaacatcctcgactccatctgcttcgtgctcggcatcaccgacctccgccaggtgcgcgccgcctcgctccaggagctcgtctacaagcagggccaggccggcgtcaccaaggccaccgtctccatcgtcttcgacaactccgaccgctcccgctcgccgctcggctatgaggattcacccgagattaccgtcacgcgccagattgtagttggtgggcgaaacaagtatcttatcaatggccatcttgcacaaccttcccgagtgcagactcttttccattctgtgcagctaaatgtgaacaatccccattttctaattatgcaaggacgcataacaaaagtgctgaacatgaagcctccagaaattctctccatgttggaagaggcagcaggtacaaggatgtatgaaatgaagaaggaagctgctctgaaaacactcgagaagaagcagaataaagtggatgagattaataaactccttgatgaagaaatccttcctgcattagagaagcttaggaaagagcggtgtcagtacatgaaatgggccaatggcaatgctgacttagatcggctcaaaagattctgcatcgcttatgagtttgttcaagctgagcgagtgagagatggtgcactcaatgatgtcaaacaaatcagggcaaagattgttgagctggatgaaagcacagagaagctaaaatcagagatacaggaaatggataagaacatatctaacttggctgctgaaaaagaagctaaactaggtggtgagatgaaaactttgtcagagaaagtggataagctctcacatgcacttatcaaggaaacttctgtgatgaataatcaagaggaaacaataaagtcagaggaaaagggtgctgaaaagattctcaagaacattgaagacatcaaaagatctataattgagcgggacacagctgtaaaaaatgcagaggatggtgcagctgacatgaaaaagagagcagatgatctgacaaaagagttggacgagagtgagaaagaataccagggtgtactagcaggaaaaagcaatgcaaatgaaaagaaatgcctagaagatcaactaagagatgcaaaagctgctgtcggagaggcagaatctggactaaagcagctgacgacaaaaataagccattctgagaaggagctaaaagataagaaagcccagttggtatctaagcgtgatgaagctactgcggctgagaatgagctgaaagctagggaaaaggacttggaaactgtcaaggcatccatgcaatctgtaaattatgaagaaggacagatggaagctttgcaaaaggatcgatctattgagttagacgccgtccagaaactgaaggacaaaattcgtgctctctctggtgaactagcaaatgttcacttcaattatcgagaccctgttaagaattttgacagatcaaaagtgaaaggagtagttgcacggcttatcaaaataaaggatagctcaactgcaacagcgctggaggttgctgctggtggaaggctatacaatgtggttgttgatactgaaaccactggaaagcaactcctacaaaatggagatctcaaaagaagggtaaccatcataccattgaataagatccagacaggtaccatacctgagagagttcggcaggcagctcgtagactggttggagctgaaaatgtaacattggctctagaactggttggctatgttgaagaagtaaagaatgctatgacttatgtctttggttcaacatttgtgtgtcgaaatatggaatccgcgaaagaggttgcatttaacagagaagttggcagtacaagtgtgacccttgaaggtgacatttttcagcccagtggccttttgactggaggtagtcgcagaggtggtggggacttgctaaggcaactacatgaattagctaaagctgaggctgatcttgccaatcatgagaaaagactttctgttattgaacaaaagattgtggtgcttttgcctctgcagaagaagttcacagagttgaaatcacagtttgaactcaaatcatatgacctgtcattatttcagaaccgtgttgagcaaaatgaacatcacaagctaggtgaacttgtaaagaaacttgaacaagagcttcaggaatcaaagcaagagctaaaagcaaagcaagcgcagtacgaaaaatctgtctctactgtttctgagctagaaaagaccatcaagacttatggcagtgagcgtgaaggtagactcaaagctctggaaagaaaaatcaaatcattaaaatcggagttgcagtccatgtcgaagcaactaaaggcccatgaaagtgagagggagaggcttattatggagaaagatgctgttgccaatgagcttgccatgcttgaagagcaactgacaacttcaaaagctcaaattgccgctatgactgaaactttgaataggcatcagaccaaggttgcttccataaagcaagactatgatcaagctgaatctgagctcaacattgggcgttctaaactgaaggaatgtgactcacagataaatagcatggccaaggagcagcaaaaactgcagcagcaactaagtgattcaaatgttgaaaggaagaaaatggaaaacgaggttaagaggatggagattgagcagaaggattgctcttcaaaggttgataagttagtagagaagtacagttggattgcaactgaaaaacagttgtttggaaaaagtggcactgattatgactttgtatcatgtgaacctcataaagcacgagaagaacttgaaaatctccaagctcaacaatccagtcttgagaagagggtcaataagaaagttatggcaatgtttgagaaggcagaggatgagtataatgatttgatgtcaaagaaaaacatcattgagaatgacaagtcaaaaatcaagacagtgatagaagagttggatgagaagaagaaagagaccttgaaagtcacatggcttaaagtaaacaaggattttggatctatattcagtacacttttacctggcacaatggccaaacttgatcctcctgaaggtggtacttttttggatggtcttgaagttcgggtggcatttggaacagtttggaaacaatctttatctgaacttagtggagggcaacggtccctcctcgctcttagtcttatcctggcgctacttcttttcaaacctgcaccactttatatattagatgaggttgatgctgccctagatctgagccatacacaaaacattggtagaatgatcaaggcgcattttccgcactcccagttcatagttgtctcactaaaagagggcatgttcaacaacgcaaatgtgatattccgaacgaaatttgttgatggggtgtccactgtgacacgaacggtcccttcaaagcaaagatgattggattcattcatcacttcgtctgaaggaggatgaagtcgtttgttatgctctttgctaacttttctgctgatgctacccccaaagggtgtgtttggataatgggaaatgagggatgggattgggattgggaaatgaatgaagggttaggattaaatggatgagggagaatgaatggttaagatttaaagaggggtgggaaatcatttcccttagacatttgccaaacactgccaaaatgtttcaagcgcctcgcttgtcaggcccataacattaacgtgactcagtaaaatgttctagaacacccttacgttgatgcatctatctagttccctgtatgtatttgatctgacagaatgtaagattaactattacatttgtagtaaataagtgtagccttttattattagaaaattggcttgaataactggaacgtgtcgaaactctcgtgttcccctcttcgaattgttgtagtttgttacgatgggcatgtaagcctatctagccttaactagaaagtctcaagcttgtgtctagtataccttttcgtgtcagcgt

SEQ ID NO: 2966 - DNA, 4151 bp, Brachypodium distachyon
ttcgcttcatacggccgaaacatttcgaaatcccaacccggaaaatccccacgcctcgaaaattttcccgcccagaccagccaaaccctagtccgatctccggccggcgacgcctccggcggccggcgggatgcacatcaaggaggtatgtctggaggggttcaagtcgtatgcggggcggacggtggtgccggggttcgacccgctgttcaacgccatcaccgggctaaatggttccggcaagtccaacatcctcgactccatctgcttcgtgctcggcatcaccgacctccgccaggtgcgcgccgcctcgctccaggagctcgtctacaagcagggccaggccggcgtcaccaaggccaccgtctccatcgtcttcgacaactccgaccgctcccgttccccgctcggctacgaggactcggccgaaatcactgtcacgcgccagattgtagttggtgggcgaaacaaataccttatcaatggccatcttgcacagccttcccgggtgcagactcttttccactctgtgcagcttaatgtgaacaatccccattttctaattatgcaaggacgcattacaaaagtgctgaacatgaagcctccagaaattctttccatgttggaagaggctgcaggtacaagaatgtatgaaatgaagaaggaatctgctcttaaaactctcgagaaaaagcaaaataaagttcatgagatcaacaaactgctcgatgatgaaatccttcctgcattagagaaacttagaaaagagaggtgtcagtacatgaaatgggccaatggtaatgctgaactagaccggcttaaaagattctgtattgcttatgagtttgttcaagctgagggagtgcgagatggtgcagttagtggggtgaaacaaatcaggggaaagattgttgaactggatgagagcacagaaaagctaaaagcacagataaatgaaatggacaaaaacatatctaccttagctgctgaaaaagaagccaaattaggtggtgagatgaaggtattgtcggagaaagtggataagctctcacatgctcttgttaaggaaacttctgcgatggataatcaagaggaaactctaaggtcagaggaaaaagctgctgaaaagattctcaagaacattgaggacatcaagagatctataattgagagagatgctgctgtaaaaaatgcagaggatggcgcatctgatatgaaaaagagagcagaggatctgacaaaggagttggatgagagtgagagagaataccagggtgtgcttgcaggaaaaagcagtgcaaatgagaagaagtgcctagaagatcaacttagagatgcaagaggtgctgtgggagaggcagaatctggactaaagcagctgacgacaaaaataagcctttctgagaaggagctgaaagagaagaaagcccagatggtatccaagcgtgatgaagctactgcagctgagaaagagctgaaagctaggacaaaagacttggaagctatcaaggcatccatgggatctatagattatgaagagggacagatggaagctttgcaaaaggatcgatctacagagttagatgtggttcagaaattgaaggacaaagttcgtgcgctttctggtgagctggcaaatgttcacttcagctatcgagatcctgttaggagctttgacagatcaaaagtgaaaggggtagttgcacgacttattaagataaaggacagcacaacagcaacggcattggaggttgcagctggaggaaggctatataatgtggttgttgactcagaaaccactggaaagcagctcctacaaaatggagatctcaaaaggagggtaaccataataccgttgaataaaatcaaagcaggtacgatacctgatagagttcagcaggcagctcgtagaatggttggagctgaaaatgtaacattagctctcgaactggttggctattccgaagaagtaaagaatgctatggcttatgtgtttggttcaacatttgtgtgcagaaatatggatgcagcaaaggagatcgcgtttaatagagaagttggcagtacaagtgtgactcttgaaggtgacatttttcagcctagtggcctattgactggaggtagtcgcagaggtggtggggatttgctaaggcaacttcatgaattagctaaagcggaggctgatctctctgatcacgaggacaggctctctgttattgaacagaagattgctgtgcttctacctcttcagaaaaagtacgctgagttgaaatctcaatttgaactcaaatcatatgatctctcattatttcaaaacagagttgagcaaaatgagcatcacaagttaggtgaacttgtgaagaaacttgagcaggagctccaggagtcaaggacagagctgacagaaaagaaagtgcagtatgaaaaatgtgtgtccactgtttctgagttagaaaagacgattaagacttatggtactgaacgggaaggtatgctcaaagctctggaaggaaagatcaagtcgttgaaatcagaaatgcagtccatgtcgaagcagttaaaggctcatgaaagtgagagggagaggctgattatggagaaagatgcagttgctaatgagcttgctattcttgaagatcaactagtaacctcgaaagctcagattactgctctgtcagaagcctgggccacaaataagagcaaggttgcttccattaagctagactatgaccaagctgaatctgagctcaacactgagcggtccaaactgaaggactgtgattctcagataaactgcatagccaaggagcagcaaaaacttcagcagctactaagtgattcaaatgttgaaaggaagaaaatggaaaacgaggttaagagaatggagatagagcagaaggattgctctttgaaggttgataagctagtggagaagtacagttggattacaactgagaaacagttgtttggaagaagtggtacagattatgactttgcatcatgtgaaccacataaagcacgggaagaatttgaacagctccaagctcaacaatctggtcttgagaagagggtcaataagaaagttatggcaatgtttgagaaggcagaggatgagtacaatgatttgatatcgaagaaaaatatcatcgagaatgacaaggcaaaaatcaagaaagtgatagaagagttggatgagaagaagaaagaaaccttgaaagtcacatggctcaaagtaaacaaagattttgggtctatattcagtactcttctacctggtacaatggcaaaacttgatcctcctgaaggcggtaccttcttggatggtcttgaagttcgggtggcatttggaacagtctggaaacaatcgttatctgaacttagtggaggccagcggtctcttcttgctcttagtcttatcctggctttacttctgttcaaacctgcaccactttacatcttagatgaggttgacgctgcccttgatctgagccatacccaaaacattggtagaatgataaaggcacattttccacagtcccagttcattgttgtctctctaaaagagggtatgttcaacaatgccaatgtgatattccggacgaaatttgttgatggagtgtccgctgtgacccgtacagtcccttcgaaacagagatgattgaaatatgtgacgtacagtatgtgaaggaagaatgtgtggagctgaactttttggtcacggtaatcacaaatttaaggttgccaaacgatttgtgagcttcgacaacggttctgcgctggtgcgattgtgctgtcgctacaaaatgtctcaagcccctcgcttgtcacttgactggccattaacatcagaataggctgtgcaaacctatgtaactcagtattagaagatattgttgtgtccatatatcttgcatatttgttcggaccgactgtaagtagagtagggacttggaaacctattttcctttgagctctgaacgttcttgcctagtatagtatgtagcggcagtgtattatggtgccatattaccatgtgtatggaatacgtaagtttcaccgtttggttcaagcaatctagtcatattcatatccgtaccttttattcactccgtactttctctctactcaaattaaggttatatctgtatgtg

SEQ ID NO: 2967 - DNA, 4186 bp, Hordeum vulgare
actacagtcgccagttcattccacacggcggaaaacatttcgaaaccccatccccaaaaatccccgccccctcgaaaactttcccgctcgaaccccccaaaccctagccggatctcccgccggcgacgcccccggcggccggcgagatgcacatcaaggaggtctgcctggagggcttcaagtcgtacgcggggcggacggtggtgccggggttcgacccgctgttcaacgccatcaccgggctcaacggctccggcaagtccaacatcctcgactccatctgcttcgtgctcggcatcaccgacctccgcgccgtgcgcgccgcctcgctccaggagctcgtctacaagcagggccaggccggcgtcaccaaggccaccgtctccatcgtcttcgacaactccgaccgcgcccgctccccgctcggctacgaggactcggcggagatcaccgtcacgcgccagattgtagttggtggacggaacaaataccttataaatggccatcttgcacagccttcccgggtgcagactcttttccactccgtgcagcttaacgtgaacaatccccattttctaattatgcaagggcgtattacgaaagtgctgaacatgaagcctccagaaattctttccatgttggaagaggcagcaggcacaaggatgtatgaaatgaagaaggaatctgctcttaaaacacttgagaagaagcagaataaagtcgaggagatcaataaacttcttgatgatgaaatccttcctgcattagagaaacttagaaaagagaggtgccagtacatgaaatgggccaatggtaacactgaactagatcgacttaaaagattctgtattgcatatgagtttgttcaagctgagagagtgcgagaaagtgcactcagtgatgtcaaacaaatccagggaaagattgttgaactggatgaaagcacagaaaagctaaaagcagacatagatgaaatggacaaaaacatagctaccttaactgctgaaaaagaagccaaactaggcggtgagttgaaggttttgtcagagaaagtggataagctctcgcatgcacttattaaggaaacttctctgatggataatcaagaggaaactctaaggtcagaggaaaaggctgctgataagatcctgaagaacattgaggacatcaagagatctattgttgagagagatgcagctgtaaaaaatgcagaggacggtgcatctgatatgagtaagagagcagaggatctgacgaaggagatagatgagagcgagaaagaatatcagggcgtgctagcaggaaaaagcagtgcaaatgagaagaaatgcctagtagatcaacttagagatgcaaaagctgctgttggagaggcagaatctggagtaaagcggttgacgaccaaaataagccattccgagaaggagctgaaagagaagaaagctcagatgaaatccaagcgtgatgaagctactgcagctgagaaagagctgaaagctaggacaaaggatttggaagctatcaaggcatccatggggtctataaattacgaagagggccagatggaaactctgcaaaaggatcgatcgacagaggtagaggtggttcagaaattgaagtataaagttcgcgcactttctggtgagctggggaatgttaacttcagctatcaagatcctgttaaaaattttgatagatcaaaagtcaaaggagtagttgcacagcttgtgaagataaaggatagctccacagcaacagcattggaggttgctgctggaggcaggctatataatgtggtagttgacacagaaaccacaggaaagcagctcctacaaaacggagggctcaataggagggtaaccataataccgttgaataaaatccatacaggtactatacctgatagagtccagcaggcggctcgtagaatggttggagctgaaaatgtaacattagctctagaattggttggctatgacgaagaagtaaagaatgctatggcttatgtctttggctcgacatttgtatgtcgaaacatggaggcagcaaaggagattgcctttaatagggaagttggcagtacaagtgtgactcttgaaggtgacattttccagcctagtgggttattgaccggaggtagtcgcagaggtggcggggacttgctaaggaaactccatgaattggctaaagctgaggccgatctctctgaccatgaggacatgctctctgttattgaacagaagatcgctgtgctcctgcctctgcataaaaagtacgctgagttgaaatctcagtttgaactcaaatcatatgatctgtcattatttcaaagcagagttgaacaaaatgaacatcacaagttaggtgaacttgtgaagaaacttgagcaagaactccaggaatcaaaagaagaattgaaggaaaaacaggtggagcataaaaaatgtgtctccactgtttctgatttggaaaagacaattaagacttatggcagtgaacgtgaaggtaggctcaaagctctagaaaaaaagataaagtcattgaaatcggaaatgcaggccatgtcggatcaattaaaggcttatcaaagcgagagggagagacttattatggagaaagatgcagttgctaatgaacttgctacgcttgaagagcaattgataacttcgaaagcccagattactgcactgtctgaaacctggggcacacataagagcaaggttgctggcacgaagctagagtatgaccaagctgaatctgagctcaatattggtcgctccaaactgaaagaatgtgactcacaaataaacagcatctccaaggagcagcaaaaacttcagcagctactaggtgattcgaacgtcgaaaggaagaaaatggaaaacgaggttaagaggatggagatagagcagaaggattgctcttcaagggttgataagctaatggagaagtacagttggattgcaactgagaaacagttgtttggaaaaagtggtacagattatgactttgcatcgtgtgaaccacacaaggcacgggaagaacttgataatctccaaactcagcaatccggtcttgagaagagggtcaataagaaagttatggcaatgtttgagaaggcagaggatgaatataatgatttgatatcgaagaaaaatattatcgagaatgacaagtcaaaaatcaagaaagtgatagaagagttggatgagaagaagaaagagaccttgaaagttacatggctcaaagttaacaaggattttgggtctatattcggtactcttctacctggtacaatggcaaagcttgatcctcctgaaggtggtaccttcttggatggtcttgaagttcgggtggcatttggaacagtctggaagcaatctttgtctgaacttagtggaggacagcggtcccttcttgctcttagtcttattctggcgttacttctttttaagcctgcgccgctttacatattagatgaggttgatgctgcccttgatctgagccatacccaaaacattggtagaatgataaaggcgcattttccacagtcccagttcattgttgtgtcgctaaaagagggtatgttcaacaacgccaacgtgatattccgaacgaaatttgtggatggggtgtccactgtgacacgaacagtcccttcgaaacagaaatgatagacgtgctttgtctgaagaggtgcctgattcagggaaaacgactgtgaagaactctttggtcatggcagtcaactaatcggcttccaatgttctgtggtagttggattcactacgaagtctcaagcccctcacttgtaggctattggcatcgctatatgtttgcaaacctatgtactaactcaatattactacttgtggtcatgttgatgtatatatatattttcttctgtgtatcttggcctggtggcgtattattcactctatatttgtaactgcttgttttgtttctgtctagggtctatttctgtgtgtgtgatactattctagagctagccgtttcctaaatgggtgccatggattattttagcagaaccagggtgttttatatttcattcaagtaataaaggatcctctgcagtagcataccatgcagtacagtcactgccttatggacctgacctcacatgtcatccgtactacaataccatacagtagtgcataggatccca

SEQ ID NO: 2968 - DNA, 3882 bp, Hordeum vulgare
tagccggatctcccgccggcgacgcccccggcggccggcgagatgcacatcaaggaggtctgcctggagggcttcaagtcgtacgcggggcggacggtggtgccgggattcgacccgctgttcaacgccatcaccgggctcaacggctccggcaagtccaacatcctcgactccatctgcttcgtgctcggcatcaccgacctccgcgccgtgcgcgccgcctcgctccaggagctcgtctacaagcagggccaggccggcgtcaccaaggccaccgtctccatcgtcttcgacaactccgaccgcgcccgctccccgctcggctacgaggactcggcggagatcaccgtcacgcgccagattgtagttggtggacggaacaaataccttataaatggccatcttgcacagccttcccgggtgcagactcttttccactccgtgcagcttaacgtgaacaatccccattttctaattatgcaagggcgtattacgaaagtgctgaacatgaagcctccagaaattctttccatgttggaagaggcagcaggcacaaggatgtatgaaatgaagaaggaatctgctcttaaaacacttgagaagaagcagaataaagtcgaggagatcaataaacttcttgatgatgaaatccttcctgcattagagaaacttagaaaagagaggtgccagtacatgaaatgggccaatgataacactgaactagatcgacttaaaagattctgtattgcatatgagtttgttcaagctgagagagtgcgagaaagtgcactcagtgatgtcaaacaaatccagggaaagattgttgaactggatgaaagcacagaaaagctaaaagcagacatagatgaaatggacaaaaacatagctaccttaactgctgaaaaagaagccaaactaggcggtgagttgaaggttttgtcagagaaagtggataagctctcgcatgcacttattaaggaaacttctctgatggataatcaagaggaaactctaaggtcagaggaaaaggctgctgataagatcctgaagaacattgaggacatcaagagatctattgttgagagagatgcagctgtaaaaaatgcagaggacggtgcatctgatatgagtaagagagcagaggatctgacaaaggagatagatgagagcgagaaagaatatcagggcgtgctagcaggaaaaagcagtgcaaatgagaagaaatgcctagtagatcaacttagagatgcaaaagctgctgttggagaggcagaatctggagtaaagcggttgacgaccaaaataagccattccgagaaggagctgaaagagaagaaagctcagatgaaatccaagcgtgatgaagctactgcagctgagaaagagctgaaagctaggacaaaggatttggaagctatcaaggcatccatggggtctataaattacgaagagggccagatggaaactctgcaaaaggatcgatcgacagaggtagaggtggttcagaaattgaagtataaagttcgcgcactttctggtgagctggggaatattaacttcagctatcaagatcctgttaaaaattttgatagatcaaaagtcaaaggagtagttgcacagcttgtgaagataaaggatagctccacagcaacagcattggaggttgctgctggaggcaggctatataatgtggtagttgacacagaaaccacaggaaagcagctcctacaaaacggagggctcaataggagggtaaccataataccgttgaataaaatccatacaggtactatacctgatagagtccagcaggcggctcgtagaatggttggagctgaaaatgtaacattagctctagaattggttggctatgacgaagaagtaaagaatgctatggcttatgtctttggctcgacatttgtatgtcgaaacatggaggcagcaaaggagattgcctttaatagggaagttggcagtacaagtgtgactcttgaaggtgacattttccagcctagtgggttattgaccggaggtagtcgcagaggtggcggggacttgctaaggaaactccatgaattggctaaagctgaggccgatctctctgaccatgaggacatgctctctgttattgaacagaagatcgctgtgctcctgcctctgcataaaaagtacgctgagttgaaatctcagtttgaactcaaatcatatgatctgtcattatttcaaagcagagttgaacaaaatgaacatcacaagttaggtgaacttgtgaagaaacttgagcaagaactccaggaatcaaaagaagaattgaaggaaaaacaggtggagcataaaaaatgtgtctccactgtttctgatttggaaaagacaattaagacttatggcagtgaacgtgaaggtaggctcaaagctctagaaaaaaagataaagtcattgaaatcggaaatgcaggccatgtcggatcaattaaaggcttatcaaagcgagagggagagacttattatggagaaagatgcagttgctaatgaacttgctacgcttgaagagcaattgataacttcgaaagcccagattactgcactgtctgaaacctggggcacacataagagcaaggttgctggcacgaagctagagtatgaccaagctgaatctgagctcaatattggtcgctccaaactgaaagaatgtgactcacaaataaacagcatctccaaggagcagcaaaaacttcagcagctactaggtgattcgaacgtcgaaaggaagaaaatggaaaacgaggttaagaggatggagatagagcagaaggattgctcttcaagggttgataagctaatggagaagtacagttggattgcaactgagaaacagttgtttggaaaaagtggtacagattatgactttgcatcgtgtgaaccacacaaggcacgggaagaacttgataatctccaagctcagcaatccggtcttgagaagagggtcaataagaaagttatggcaatgtttgagaaggcagaggatgaatataatgatttgatatcgaagaaaaatattatcgagaatgacaagtcaaaaatcaagaaagtgatagaagagttggatgagaagaagaaagagaccttgaaagttacatggctcaaagttaacaaggattttgggtctatattcggtactcttctacctggtacaatggcaaagcttgatcctcctgaaggtggtaccttcttggatggtcttgaagttcgggtggcatttggaacagtctggaagcaatctttgtctgaacttagtggaggacagcggtcccttcttgctcttagtcttattctggcgttacttctttttaagcctgcgccgctttacatattagatgaggttgatgctgcccttgatctgagccatacccaaaacattggtagaatgataaaggcgcattttccacagtcccagttcattgttgtgtcgctaaaagagggtatgttcaacaacgccaacgtgatattccgaacgaaatttgtggatggggtgtccactgtgacacgaacagtcccttcgaaacagaaatgatagacgtgctttgtctgaagaggtgcctgattcagggaaaacgactgtgaataactctttggtcatggcagtcaactaatcggcttccaatgttctgtggtagttggattcactacgaagtctcaagcccctcacttgtaggctattggcatcgctatatgtttgcaaacctatgtactaactcaatattactacttgtggtcatgttgatgtatatatatattttcttctgtgtatcttggcctggtggcgtattattcactctatatttgtaactgcttgttttgtttctgtctaaaaaaaaaaaaaaaa

SEQ ID NO: 2969 - DNA, 814 bp, Zea mays
atcgatttgttggagaatactgcatccctatctatctatctaggcctagcacagctatatcctgggttacgttcctcgcacggcggaggcaaacaaaccctagccgccaggcgcaggcggtcagggagcgagtaccgagcgccccagttcacacgtgagatgtcagaatacaagaacgtcgttggggggaggctaaagctgaagggtaaggcactggatgtgaaggaaggtggagtcaagaagaaaaaaaagaagcatcagcttgaagagtcgtctcagattgagcacgatgagctccacaaagggggaaactctggcttaccagctgatcacaacaatgagcttattgaagctggcaaggtgggagatgaagaaaggaatctacatccagactacgaccacctcacaccggcggagcgacgctatatagatcagaagcagaagatcgacatgcaaaagctggccaaagttgctaacaagtcacacagggaccgtatccaggacttcaaccagtatctggcgaacctcagcgagcactatgacatccctaaagttggccctggctaacaaacatagccaaactgctgtgtacgcacaaacaattgtatgctcggtgggcttcaagaacattaaaaatatataaatgtatgttgggtgattgggtctatccagctttttgttagcatgttatatatatcctagtattttccacttttcttttaaaaaacataattgatactcttatgtgtattgatttgaattgaattacgtctgcatatgttcaatttgaaagtagcaagactcaatttgcctt

SEQ ID NO: 2970 - DNA, 701 bp, Saccharum officinarum
ccctccccccggcatactctctcgctcgcgtgcgtaactgggcggcgacgagcagaggggaccttctccccccctccccccataaggtgcctaatctccatcttcgggaccttctccggcgacgagcgcccaccagcgagatgtcggaataccagaacgttgttggggggaggctgaagctgaagggtaaagcgctggacgtgaaggaaggtggagtgaagaaaaagaaaaagaagaagtatcagcgtgaggagtcgtctcagattgggcacgatgagctccacaaaggggggagctctgaattaccaactgatcccaacaatgagctgattgaagctgacaagatcggagatgaagaagggaatccacatcctgactatgatcatctcacaccagcagagcgacgctacatggaacagaagcagaagattgacatgcagaagctggccaaagttgccaacaagtcgcacagggaccgcatccaggacttcaaccagtacctggcaaacctcagcgagcactacgacatccccaaagttggccctggctaacatagccaaactgatgtgttgcgcacaaacaattgtatgctgggtctatccagctttatgttggcatgttatgtatcattttatatatgttgtaaaacgatctgttgccaccaggagacgatatttaatttcaaaaacatgttccaagta

SEQ ID NO: 2971 - DNA, 1134 bp, Sorghum bicolor
cgcgggaatcatcgattaggcgatgacggtttgaggaccgattttgatacggcccatgaaagaaaagcagcctagcttacctccccacttgttgtgatctattcccgcacagcccaggtgccaggtttgccccacgcgagtggcgactccgaacggcggccggttgcgggacagttcccggccggcggcgaccctcccagctcccgccgccctaccgctgcacctctgcgcccctgtcctcggtggctcactgttgaatcggcaggcggtgccccctccctgcttaaggcggcccgccccgctacagcacaagcctttgcgcccctaatccaagcatccctaggcgggctcaccgtcgaattggccggccggctttctgcatcccagcaagattcaatcgtcggtgaagagcgcgatgtcggaataccagaacgttgttggggggaggctgaagctgaagggtaaagcgctggacgtgaaggaaggtggagtcaagaaaaagaaaaagaagaagcatcagcttgaggagtcgtctcagattgagcatgatgagctccagaaaggcagaaactctgatttaccaactgatcccaacaatgagctggttgaagctgacaagatgggagatgaagaagggaatccacatcctgactatgaccatctcacaccagcagagcgacgctacatggaacagaagcagaagattgacatgcacaagatggccaaagttgccaacaagtcgcacagggaccgcatccaggacttcaaccagtatctggcaaacctcagcgagcactacgacatccccaaagttggccctggctaacataaccaacgcacggtccatccagctttatgttattacgttatgtatgattattatatgtggtaaaatgagctgttgccaccggaagacggtatttttatttcaaaagctttattttagctatgttttgcttgcccctttctgttacaatcctttagccaaacttgagatgctatgactctcgtcgtctaaatttcgtttgggcctgctgggccagggccggcttctaaaaagagcacatactggtctccggccgccacattccatgccagtaaacgtcccaacaacacatccttgttttgtgttgc

SEQ ID NO: 2972 - DNA, 930 bp, Sorghum bicolor
ttatataattctcgtgaaaattcacgcgttcctatctcccgttcggcacgacagcgtctctcccttttcccgtcccgtgctctctcgcgtgcccccccggcatattccctctctcgcgtgcgtaaccaggcggccgccgccgccgcgccgccctgcgtcaggtgtctagatctccatcgggaccttctctggcgacgagcgcccaccagtgagatgtcggaataccagaacgttgttggggggaggctgaagctgaagggtaaagcgctggatgtgaaggaaggtgcagtgaagaaaaagaaaaagaagaagtatcagcgcgaggagtcgtcccagagtgggcacgagcacaatgagctccacaaagggggaagctctgaattaccaactgatcccaacaacgagctgattgaagctgacaagatcggagatgaagggaatccacatcctgactatgatcatctcacacctgcagagcgacgctacatagaacaaaagcagaagattgacatgcagaagctggccaaagttgccaacaagtcgcacagggaccgcatccaggacttcaaccagtacctggcaaacctcagcgagcactacgacatccccaaagttggccctggttaacatatacgcacaaacaattgtatgctcggtctatccagctttatgttggcatgttatgtattattttatgtgttgtaaaacaacctgttgctactatgagacaaatttcaaaaacatgttaataagtattttgatcgtgtgtttaagctattttttggttgccccttttagttgcaatcgtttaattcaaaatgtgatcagcttttgatcattccagggaactcattttctttcaatacaatggcagagctaaacaacaaattatacacaaattggtgcacataagtcagatcaacatgacct

SEQ ID NO: 2973 - DNA, 752 bp, Setaria italica
caagcgcagcaaattacgcctccgcacgcgcaccccctctcgatactcgatagccacagccgcgccttcttctccgtccgagctcagccgctctcttttcctctcctccgattcgtgctcgtccagctctagtgggttggggtacacgtccggcgacgagcgagatgtctgaataccagaacgttgttgggggaaggctgaagctgaaggggaaagcactggatgtgaaggaaggtggagtcaagaaaaagaagaagaagaagcagcaccgtgaggagtcatctcagatcggccacgacgagcttcatgaagggggaagctctgaattgccaacagatcctaacaatgagctgactgaagctgacaagttgggggaggaggaagggaacccacaccctgactacgaccacctcacaccagccgagcgacgttacatggaacagaagcagaagattgacatgcagaagttggccaaagtctccaacaagtcgcacagggaccgtatccaggacttcaaccagtacctggcaaacctcagcgagcactacgacatcccaaaagttggtcctggctaatatggacaaactgccttgcttcacagaaacgattgtatgcttggcctattaagccttatattgccttatattcgcacgctatgtgttatcagtatgttgtaaaacaaatcgattgacactgaagacagtattttatttcaaaaccatgttccgagcattggccattttgagtatctg

SEQ ID NO: 2974 - DNA, 705 bp, Panicum virgatum
ggccgtctctctctctgtgtgtctctctctccccctcgtcgccggacacattgaagcaggtcgtcgaggcgtcggttcccagccgcccccgagggggaaccgcagggaacacctgcgagatgtccgagtaccaaaatgtcgttggggggaggctgaagctgaaggggaaagcgctggatgtcaaggaaggtggagtcaagaaaaagaagaagaagaagcagcaccgtgaggagtcgtctcagattgggcatgatgaacttaatgaaggtggaaactctgaattgccaaccgatcctaacagtgagctgactgaagcggacaagatgggagaggaggaagggaacccacatcctgattacgaccacctcacaccagccgagagacgctacatggaacagaagcagaagattgacatgcagaagttggccaaagttgccaacaaatcacacagggaccggatccaggacttcaaccagtacttggcaaaccttagcgagcattacgacatcccaaaagttggtcccggctaacatggcgaaagtgcagtgcttcacagaaacagttgtatgcttggcttgttaagtctgtttcatgttatgcgttatcagtatgttgtaaaattgtggaaactattttatttcaaaaccatgttccaaacgttgcaatatatttccttttgaaacaagcattggccaatttgagtcc

SEQ ID NO: 2975 - DNA, 954 bp, Panicum virgatum
cctttgcttgcctcgccgtctctctctctgtctctctctctccccctcgtcgccggacacattgaagcaggtcgtcgaggcgtcggttcccagccgcccccgagggggaaccgcagggaacacctgcgagatgtccgagtaccaaaatgtcgttggggggaggctgaagctgaaggggaaagcgctggatgtcaaggaaggtggagtcaagaaaaagaagaagaagaagcagcaccgtgaggagtcgtctcagattgggcatgatgaacttaatgaaggtggaaactctgaattgccaaccgatcctaacagtgagctgactgaagcggacaagatgggagaggaggaagggaacccacatcctgattacgaccacctcacaccagccgagagacgctacatggaacagaagcagaagattgacatgcagaagttggccaaagttgccaacaaatcacacagggaccggatccaggacttcaaccagtacttggcaaaccttagcgagcattacgacatcccaaaagttggtcccggctaacatggcgaaagtgcagtgcttcacagaaacagttgtatgcttggcttgttaagtctgtttcatgttatgcgttatcagtatgttgtaaaattgtggaaactattttatttcaaaaccatgttccaaacgttgcaatatatttccttttgaaacaagcattggccaatttgagtccatcctgaccgtggtttatttacatgcgttactgttgacctttccaggggatttcttcactctgaggttcaagttcggtagtcgagttgtgttttctttttttttaatcaccttgtttttttgtggctagtttttccttgtctttagtcgtagatcgttttttctctttcatggtcctgtaatagttgtttagctatcttggttagaggtcgggcgtgcgttgtaatcaaacttcttgt

SEQ ID NO: 2976 - DNA, 786 bp, Pennisetum glaucum
caagctcagcaaattacccctccgcacgcgcacccctctcgatagcaacaacagccgcgccttcttctccgtccgggttcagccgctctcttctcctctccgattcatggtcgtccagctctagtgagttgtggtacacggccggcgacgagcgagatgtctgaataccagaacgttgtcgggggaaggctgaagctgaaggggaaagcactggatgtgaaggaaggtggagtcaagaaaaagaagaagaagaagcagcaccgtgaggagtcatctcagattggccacggcgagcttcacgaaggggggagctctgaattgccaacagatactaacaatgagctgacggaagccgacaagttgggggaggaggaagagaacccacaccctgactacgaccacctcacaccagccgagcgacgttacatggaacagaagcagaagattgacatgcagaagttggccaaagtctccaacaagtcgcacagggaccgcatccaggacttcaaccagtacttggcaaacctcagcgagcactacgacatcccgaaagttggtcctggctaacatggccaaacaaccgtgcttcacagaaacgattgtatgcttggcgcctcggcctacaaaacttttatattcacatgctatgtgttatcagtatgttgtaaaacaaatctgattgacgttgtgaagacagtttttttcttcttggaaacaatgctccaagcaatggccatttttggaaccaaaaaaaaaaaaaagaaaaaaagtaaactctgcgttgat

SEQ ID NO: 2977 - DNA, 667 bp, Cynodon dactylon
ggggaggcagccactgttctacttgttctctctcgcttcggcgcgagtcacgcatccgactctcgccgccgcccagcccccaccgccggcgagggcggacccgccgggacactagcgagatgtcggaataccaaaatgttgtcggggggaggctgaagctgaagggtaaagcgctggatgtgaaggaaggtggagtcaagaaaaagaagaagaagaagcagcatcgcgaggagtcttctcagattggacgcgacgagcttcacgaaggtggaagctctgaattaccacctgatcctaacagtgagctaactgaagctgacaagatgggggaggaagaaggtaacccgcatccagattacgaccaccttacaccagctgagcgacgttacatggagcagaagcagaaaattgaccagcagaagctggccaaagttgccaacaagtcacacagggaccgaatccaggacttcaaccaatacctggcaaacctcagtgagcactatgacattccaaaggtcggccctggctaatggggcaaaattgcgatgtttcacaagggggcttgtatgtttggcctacccagccttatctcagcatgttatgtgttgtccatgtgtaaaacgatgcctgtcaatcatgaagacagttttggaataatgttttaata

SEQ ID NO: 2978 - DNA, 922 bp, Eragrostis curvula
  misc_feature (782)..(782): n is a, c, g, or t
ggggcttttcgtccggtcgccctctcgcttcccgccaggcgccagcatcggagtctcgctatcggcggcgagggagaacccaccggagcgccagcgagatgtcggaataccagaacgttgttggggggaagctgaagctgaaggggaaggcgctggatgtgaaggaaggtggagtcaagaaaaagaagaagaagaagcagaaccgcgaggagtcgtctcagatcgggcacgacgagcttcacgaaggtggaagctctgaattaccaacagatcctaacaatgagctgattgaagctgacaaaatggcagaggaagaaagggagcgacatcctgattacgaccacctcacaccagccgagcgacgttacatggagcagaagcagaaaattgacatgcagaagctggctaaagtcgcaaacaagtcacatagggaccgcatccaggacttcaaccaatacctggcaaaccttagcgagcactatgacatcccaaaggttggccctggctaacgaggcgagattgcaatgtttccagatgtggcaggcctataccaagcgttatgtcatagcatgttctgtgttaaccagatgttgaacaatatttgccatccgggaaaacgatttctattccaaaaccatgtttcaagaattctggttgtgcgcgcgaaggccatgtaaattttaggccgctttcagtaacaatgttttaattggatgcaatttctcgttcaaaaaaaaaaaaaaaaaaaaaaaattaaaaaaaaaaaaaaaaaaaaaaaaaanattccccggggttgacccccgggttaaaccctaaggaaatcccggccccccggcgggcccccatttgggaaaaccccccccggcggggagggcaaacttgggtttttctagagggcccccaaaagggttggggaaaccgg

SEQ ID NO: 2979 - DNA, 701 bp, Panicum virgatum
tctctctctccccccgtcgccggacacattgaagcaggtcgtcgaggcgtcggttcccagccgcccccgagggggaaccgcagggaacacctgcgagatgtccgagtaccaaaatgtcgttggggggaggctgaagctgaaggggaaagcgctggatgtcaaggaaggtggagtcaagaaaaagaagacgaagaagcagcaccgtgaggagtcgtctcagattgggcatgatgaacttaatgaaggtggaaactctgaattgcctaccgatcctaacagtgagctgactgaagcggacaagatgggagaggaggaagggaacccacatcctgattacgaccacctcacaccagccgagcgacgctacatggaacagaagcagaagattgacatgcagaagatggccaaagttgccaacaaatcgcacagggaccggatccaggacttcaaccagtacttggcaaaccttagcgagcattacgacatcccaaaagttggtcccggctaacatggcgaaagtgcagtgcttcacagaaacagttgtattgtatgcttggcctgttaagtctgtttcatgttatgcgttatcagtatgttgtaaaacaaatcaattgtcgttgtggaaactattttatttcaaaaccatgttccaaacgttggcaatatatttccttttgaaacaagcattggccaatttgagt

SEQ ID NO: 2980 - DNA, 642 bp, Panicum virgatum
gccagacacgtcgaagaaggtcgtcgaggcgtcggctccccgccgcgcccgccgcccccgagggggaacagccgggcgagatgtccgagtaccaaaatgtcgttggggggaggctcaagctgaagggcaaagcactggatgtcaaggaaggtggaatcaagaaaaagaagaagaagcagcaccgtgaggagtcgtctcagattgggcgtgatgaacttcaggaaggtggaagctctgaattgacaaccgatcctaacagtgagctgattgaagccgacaagatgggagaggaggaagggaacccacatcctgactacgaccacctcacaccagccgagcgacgctacatggaacagaagcaaaagattgatatgcagaagctggccaaagttgccaacaaatcgcacagggaccggatccaggactttaaccagtacttggcaaaccttagcgagcattatgacatcccaaaagttggtcccggttaacatggcgaaagtgccgtggttcacagaaacagttgtatgcttggcctatcaagacttctgtttcatgttatgcgttatcagtatgttgtaaaacaaattggttgtcattgtgtaaactattttatttcaaaaccatgttccaaacgttggccat

SEQ ID NO: 2981 - DNA, 1141 bp, Panicum virgatum
tcactcatatatgaatcaaaaacttaatcaaaggtcctctactgccagcgcggcaatgccgcgacgcctttctagtatttctgcaacctttcctcgccgtcgccgtctgctcgtccgtctctctctcgtcgccagcggccagacacgtcgaagaaggtcgtcgaggcgtcggctccccgccgcgcccgccgcccccgagggggaacagccgggcgagatgtccgagtaccaaaatgtcgttgttggggggaggctcaagctgaagggcaaagcactggatgtcaaggaaggtggaatcaagaaaaagaagaagaagcagcaccgtgaggagtcgtctcagattgggcgtgatgaacttcaggaaggtggaagctctgaattgacagccgatcctaacagtgagctgattgaagccgacaagatgggagaggaggaagggaacccacatcctgactacgaccacctcacaccagccgagcgacgctacatggaacagaagcaaaagattgatatgcagaagctggccaaagttgccaacaaatcgcacagggaccggatccaggactttaaccagtacttggcaaaccttagcgagcattatgacatcccaaaagttggtcccggttaacatggcgaaagtgccgtggttcacagaaacagttgtatgcttggcctattaagacttctgtttcatgttatgcgttatcagtatgttgtaaaacaaattggttgtcattgtgtaaactattttatttcaaaaccatgttccaaacgttggccatatatttttttctttggaaacaagcattggccaattgggtccatccttgtgcggtgtactgcagcaaaaaaactagtgtgttacaacaaagaaaatacctcattctcgcagtgtcctacagctaatttcacgaaggagagcaaaaattcccaaacaaattcaggtgctttgcttttggcaacatgctcattcctggactgaagtgcagtgcagtacagtacagtacagaacatcaaacacactcttgggcgagaagcccagcctgtgcccttctgcacggcgcgcttcagctgctcgtcgagcatgctgccgtaggttgattttttctagctctttcgtgattctgtaatagttgtttag

SEQ ID NO: 2982 - DNA, 675 bp, Setaria italica
tcgcaagtcaccagacacacatcgaagaagctcgtcggggcgtcggctccccgccgcgcctgccgccggtgaggagaaccgccgcaacgccagcgagatgtcggagtaccaaaatgtcgttgggggaaggctgaagctgaagggaaaaacgctggatatcaaggaaggcggagtcaagaaaaagaagaagcagcagcaccgtgaggagtcgtctcagatcgggcacgatggacttcatgaaggtggaatctctgaattaccaactaatcataacaatgagctaactgaaggcgaaaagacgggagaggaggaagggaacccacaccctgactacgaccacctcacaccagccgagcggcgttacatggaacagaagcaaaagattgacatgcagaagatggccaaagtcgccaacaagtcgcacagggaccgcatccaggacttcaaccagtacctggcaaacctcagcgagcactacgacatcccaaaagttggtcctggctaacatggccaaaccgcggtgcttcacagaaacgattgtatgattggcctactaagccttctgttacaatgttatgtgctagcagtatgctgtaaaagcaatcgattgccactgtgaagacagtattttatttcaaaaccatgtcccgagcattagccataattattcattta

SEQ ID NO: 2983 - DNA, 857 bp, Zea mays
atttctcgtggaaatttcatgcgttccttatcttccgttccgctcggaagtctctctaccaccttctccccattccgctgttccgccctctcgcgtcgcctccaggtccctcctctgcgtaactgggtggccgccgatccgccgccaccgccctgcgtcaggtgttccggtgacaagcgtccacctgcaagatgttggaataccaaaacgcaattggggggagactgaagctgaagggtaaagcgctggacgtaaaggatggtggggtgaagaaaaagaagaagaagtaccagcgtgaggagtcgtctcagattgcgcacgatgagctccacaaaggggggagatctgaatcaccaattgatcccaacaatgagcggattgaatctgacaagaccggagatgaagggaacccacatcctgactatggccatctcacaccagcagagcgacgctacatggaacagaagcagaagatcgacatgcagaagatggccaaagtcgccaacaagtcccatagagaccgcatccaagacttcaatcagtacctggcaaacctaagcgagcactacgacatccccaaagttggtcctggctaacatagccaaactggctgtgttacgcacaacaattgtgtgctgggtctatccatttatgttagcatgttatgtatcgtttaaaacgatttgttgccaccagaaattgatatttaatttcaaaagcatgttccaactattctgatcctgtgtttaagttgtttgttgccccttttagttgcaatcgttttattcaaaatgtgatcaaaatttgatatttccagggaactaattttctttcaatatagcggcagagcctaccaa

SEQ ID NO: 2984 - DNA, 671 bp, Eragrostis curvula
  misc_feature (36)..(36): n is a, c, g, or t
  misc_feature (57)..(57): n is a, c, g, or t
  misc_feature (113)..(113): n is a, c, g, or t
  misc_feature (117)..(117): n is a, c, g, or t
  misc_feature (174)..(174): n is a, c, g, or t
  misc_feature (190)..(190): n is a, c, g, or t
  misc_feature (305)..(305): n is a, c, g, or t
  misc_feature (429)..(429): n is a, c, g, or t
  misc_feature (460)..(460): n is a, c, g, or t
  misc_feature (477)..(478): n is a, c, g, or t
  misc_feature (529)..(529): n is a, c, g, or t
  misc_feature (542)..(542): n is a, c, g, or t
  misc_feature (546)..(546): n is a, c, g, or t
  misc_feature (565)..(565): n is a, c, g, or t
gcgcgggggtctaaatttcccatcgctctctcgctnccgcacgccagcatcgagtcncgccgtcggcggtgagggagaacccgccggagcgccagcgagatgtcggaataccngaangttgttggggggaggctgaagctgaaggggaaagcgctggatgtgaaggaaggtggngtcaagaaaaagaagnagaagaagcagaaccgcgaggagtcgtctcagatcgggcacgacgagcttcacgaaggtggaagctctgaattaccgacagatcctaacaatgagctgattgaagctgacaaganagcggaggaagaaagggagcaggaagaaagggagcgacatcctgattacgaccacctcacaccagccgagcgacgttacatggagcagaagcagaaaattgacatgcagaagctggccaaagtngcaaacaagtcacacagggaccgcatccagnacttcaaccaatacctnncaaaccttagcgagcactatgacatcccaaaggttggccctggctaacgangggagattgcaangttnccagatgcggtgggcctancaagacttatgtcagcatgttatgtgttatctagatgttgtaaaacaatattttccatctgggaaaacgattccggttccaaaacaagaattctgctggtgtgtgc

SEQ ID NO: 2985 - DNA, 3783 bp, Oryza sativa
cacctagggagtaaaattgcaccggttttaatagttcgggggtcgagatatccggttttgcggtttagggtcatggattagattcgagtaacttttaagggagtcaaagtgaacttattccattccttccaattctactggcggttttgcaactcacggcccaatttgaatttacggtgttacccttcctcggctgccctcgcatcctctctctctctttcccatcaaatcgtcgtccccaaatcggaagccgccgaaccctcgcttctcggggacgcggagcggccagccggccaccttccactgcctcgagctcctctccttctccgggttggtgtggcgtggagatccatcctggccgacctctttcgctaggcgagatgtctgagtaccagaacgtcgttgggggtaggctcaagctgaaggggaaggcgctggatgtgaaggaagggggagtcaagaagaagaaaaagaagaagcagcaccgcgaggagtcatctgaagccgggcacggagagcttcaccaaggtggaagctctgaagtaccagctgaccctaatgatgaattgactgaagctgataagatgggagaagaagggaacctgcaaggcgactatgatcacctcaccccagctgagaggcgttacatggagcagaagcagaagattgacatgcataagctagccaaagtagccaacaagtcacacagggaccgcatccaggacttcaaccaatacctggcaaatcttagcgagcactacgacatcccaaaagttggccctggttaactttgcctattcagagcttcgcaggaatgcttcctatgctgtacccatccagccatctgttagcttgtgatgctcctacctgtattgttctaaaacatttggttgtcttcgagtgttgtatttcgaaaacccaaaccatgtttaattcaagtgttcgtattctgagtactgtagttttcaaccttattgactgcagttgagttctttacaatctaatgaccagcaggtatcaccattgaattcaaactcccattacgttgacgaatataatatataacctgaaacgactggcaaaaacactgcgaattgggaagtattcctgtattgatttctcacgctattgttacacaaagttactcctactactacaacaatttatgacaagtactagttctacgtttacataatgcacaattcggtgcagctgaacaagctattgttacacaaagttactcctactacaacaacaatttatgacaagtagttgtacgtttacataatgcacaattcggtgcagctgaacaatgtagtaatactaccatacagaatgtacgatattatctctggacaggtttacagttcaactaaattctattttcctaaatattatactactattaggatgtagtagcttccttcaaggcttcagccctcgacttggagctagggccgagacagtcagttgacatgattacttcaaaccgagttcatcgctgctgtgtgtacattggtcatggccaagaaaaggggagcgtttccaaaatatcaaaagaaatataagagggtcttcatgttgaatgatactccctccattccaaaatataaggcataaccaccaagtccaccttaacccaaaaacaaagaaaatagttattatcatattatagtttggatcatcctaataaatacaatgcatccatccaatagaattagagaacatgagtagaggatttaaaaaagtaataatttaaaggagaaggggtcatagttaaattgcctacatacatgcatgccttatattatggaacatatagaaaaagtggttgtgccttatattatggaatagagggtgtataagttttgcggtttaggtgaattagacattagaagacaacacgattaaaacggaaaataacaacttaacagacgattgtcttgtccaaaaaaactcaaatttcataccaaacaatgtaacaaaacccaagctagaaagcaagaactacaggatctagcatattgctcagagattcatgagaaacaatcaaataactttgaagaccatgaatggatgaatcaacaatcttgcttagagattcatgagaaacaatcagttgttttgctttttgcaaggcttttatctgaacaatcttggcttttattccctctaatatattcggcaaatcttttgccactttcggggtttttttttttaaaaaaagaatggatgcatcaacactagatacttcagatcaattgacctcctcattttgcttccaggaatcataaaacatagtttaaattaaaaaaccatccaaagcatatgtcagtgttactactattatcagatagcatattgcttggggaatggggattcatgagagcaatcagagaactttgaagaccatgaatggatgtatcaacattagatacttcagatcgattgatctcctcattttgcttctagaaatctaaaaacaaagtttcgattcaaacatcacccaaagcatgtcagtgttacgtgatatcagatagcatattacttggagaatggaaattcatgagagcaatcagagaactttgaagaccttgaattatcaacattagatacttcagatcatataacctcctcattttgctctacacaattaaaacactacattgtcaattcaagcattatccaaaagcaagtaatacatgatcttagatagcatgctgatgttgcatgggattcatgagagcaatcagagaactttgaagaccatgaatggatgtatccacattagatacttcagaacaaacagcctcctcattttgatttccatttcccagcaactaaaggcaaaggcactatacatcattcaaaacaccataaaggtacaacataatagccacagaatgggaaaaaacaatgataaactttattaattatcagggaaaacaaaacaaagattgcattgagaaaagcaaccaaagaactttggtgactgcctatgcgttattagcagatcagcactaaaatttcagatgcaatgacttccgattttgcttcacacctatatgttggttctttgaacacgattaaaaaacttcccccaaatcaacaaatgaattgtcccacattacaaatagctacagatcaagagactaaaaattagtttaacatggagcgatcagagaactttgaagaccatgtacgtgttttccacaagaaaaacttcggatgatttttcctcctcatttcgcttcagaacacaacaacaaatgcaaatgcattaaaatgaattaagtgcaaccaaaatataagtaacaatgtggacagaagagatgattctgaggaaaccgctggattccacagaagtttagagcccctgtccaatccatggatatagcacccatatatatccttttctcgcagttttccctgtatccaatctcaagagaacagggggctaatggtgcgagtcgaccacaacaataccatcaaatccaagaacagcatgcgcttaaataaaccaatcaaacaaaagtacctaattcttgttgtctaatagctactccaaggctctagcaaaaaagaatggagtatcaaatcagcacactcgaagtaaaaccacgattaaatcatccccgcagcacaagaccgaagaaggacgagaacaataatcgaaaaaaaaaagaaaggaaaatgatcgcacagagcgaacaggattgctgaatcctttttgtgggaggcgggcgactggatggtcatggtcagtccctccctggcggctag

SEQ ID NO: 2986 - DNA, 801 bp, Secale cereale
gcctcgaacccctcgtcctcctcctcgtgcctgccatcctccaccggatcggcgcggatcggaggctcccgcgaagcgattcctcctgtcaggcagtcgagatgtcggagtaccagaacgtcgttggggggaggctcaagctgaaggggaaaccgctggatgtcaaggagggcggagtcaagaagaagaataagaagaagcaccgccgcgaggagtcgtctcaaggcgagcacggcgagctccgcgaaggtggaagctctgaattgccaggtgaccctgacaatgagttcagtgaagccggcaagctgggagaggaagggagtgcgcaagcagattatgatcacctcactccagccgagaggcgttacattgagcagaagcagaagatcgacgtacacaagctggccaaggtggccgacaagtcgcacagggaccgcatccaggacttcaaccagtacctggcaaatcttagtgagcactatgatatcccaaaggtcggccctggttaattaaggtccgtagtagtgttccagtgtgctggacctatgcttgcagctcgtcaatttcgcgtgggtgcaatggattgtgttgtctttagagaaaaaccgagtacctctgcacttgtagaccgattgcactttatctctgtttgagcatcatgtttaatggagtacttgccagtgttctgagtacgagtactttcttgtaaattgtttctcgagtactttatctccgctccagtttgtaagtcttgcttctcgagtacaagtttgaccaacgaaatatatgggacatgtggaa

SEQ ID NO: 2987 - DNA, 850 bp, Avena sativa
aacccatacccggtagtctggcatcggtgaatccccaaatcgaccgccgccgtgacctcgatcttcgccggcgccgccaagcggcccttcgcaccgaagcacgcgcctcgccctcttcctcctcctgccgcgctctggttgattggcgcggatcgaagattcatgcgggccaatttctcttgctaggcaatcgagatgtcggaataccagaacgtcgttggggggaggctcaagctgaaagggaaaccactggatgtcaaggaaggtggagtcaagaagaagaagaagaagcaccgccgcgaggagtcgtctcaagtcgagcatggccagcaatacgaaggtggaagctctgaattaccgggtgaccctgaattgagtgaagctggcaagatgggagaggaaggggatgtacagcccgattatgatcacctcactccagctgagcgccgttacattgaacagaagcagaagattgacgtgcacaagttggccaaggtagctgacaagtcgcacagagaccgcatccaggacttcaaccagtacctggcgaatcttagtgagcactacgatatcccaaaggtcggccctggttaagtaagcaagaaaatcgaggttcacaccaatgttgtgtgctggacttgtctggtcatctatttgcgtgggcacgtcctgaaacaatgggttgtctcgtctctgaagaacaaaaactgagaacatgtgaacttattgcgctttatctgtatttgaagaccatgtttaatactctctccgtcccaaaacaaatatgtgacatcctttttgggcatagtgagtaaactgttgtgagcatctgcgtgtgcagtttgattgt

SEQ ID NO: 2988 - DNA, 712 bp, Pseudoroegneria spicata
atttgcagctgatgtcggagtaccagaacgtcgttggggggaggctcaagctgaaggggaaaccgctggatgtcaaggagggcggagtcaagaagaagaataagaagaagcaccgccgcgaggagtcgtctcaaggcgagcatggcgagctccgcgaaggtggaagctctgaattgccaggtgaccctgacaatgagttcagtgaagccgacaagctgggagaggaagggtctgcgcaagcagattatgatcacctcactccagctgagaggcgttacattgaacagaagcagaagatcgacgtacacaagctggccaaggtggctgacaagtcgcacagggaccgcatccaggacttcaaccagtacctggcaaatcttagtgagcactatgatatcccaaaggtcggccctggttaattaaggttcgaacgagtgttccagtatgctggacctatgcatgcagcccgtcaatttcgcgtgggtgcgctctgaaacaatggattgtgttgtctttagataaaaactgagtacctctgcacttgtaaactgattgcactttatctctgtttgaagaccatgtttaatacttgcaagtgttctgagtactttcttgtaaattgatacttcctccgctccagtttataagtcatgcttcccgagtacaagtttgaccaacgaaatatatgggacatgtgccacatgttatacca

SEQ ID NO: 2989 - DNA, 689 bp, Triticum aestivum
cgtcctccaccggatcggcgcggatcggagactcccgcgaagcgattcctcctgtccggcagtcgagatgtcggagtacaagaacgtcgttggggggaagctcaaactgaaggggaaaccgctggatgtcaaggagggcggagtcaagaagaagaataagaagaagcaccgccgcgaggagtcgtctcaaggcgagcacagcgagctccgcgaaggtggaagctctgaattaccaggcgaccctgacaatgaattcagtgaagctgacaagctgggagaggaagggagtgcgcaagccgattatgaccacctcactccagccgagaggcgttacattgaacagaagcagaagatcgatgtacacaagctggccaaggtggctgacaagtcgcacagggaccgcatccaggacttcaaccagtacctcgcaaatcttagtgagcactatgatatcccaaaggtcggccctggttaattaaggttcgcacaagtgttccagtgtgctggacctatgcttgcagctcgtcaatttcgcgtgggtgcgctctgaaacaatggattgtgctgtctttattagagataaactgagtacctctgcacttgtaagctgattgcactttatctctgttgaagaccatgtttaacaaaaaaaagaaaaaaacaaagtctctgcgttgataccactgctt

SEQ ID NO: 2990 - DNA, 625 bp, Triticum aestivum
tcctccaccggatcggcgcggatcggaggctcccgcgaagcgattcctcctgtcaggcagtcgagatgtcggagtaccagaacgtcgttggggggaggctcaagctgaaggggaaaccgctggatgtcaaggagggcggagtcaagaagaagaataagaagaagcaccgccgcgaggagtcgtctcaaggcgagcacggcgagctccgcgaaggtggaagctctgaattgccaggtgaccctgacaatgagttcagtgaagctgacaagctgggagaggaagggagtgcgcaagccgattatgatcacctcactccagctgagaggcgttacattgaacagaagcagaagatcgacgtacacaagttggccaaggtggctgacaagtcgcacagggaccgcatccaggacttcaaccagtacctcgcaaatcttagtgagcactatgatatcccgaaggtcggccctggttaattaaggtccgcaagtgctccagtgtgctggacctatgcatgtagctcgtcaatttcgcgtgggtgtgctctgaaacaatggatgattgtgttgtcttcagagataaactgagtatctctgcacttataagctgattgcactttatctctgtt

SEQ ID NO: 2991 - DNA, 642 bp, Triticum aestivum
tcctcctccggatcggcgcggatcggagactcccgcgaagcgattcctcctgtcaggcagtcgagatgtcggagtacaagaacgtcgttggggggaagctcaagctgaaggggaaaccgctggatgtcaaggagggcggagtcaagaagaagaataaaaagaagcaccgccgcgaggagtcgtctcaaggcgagcacggcgagctccgcgaaggtggaagctctgaattgccaggtgaccctgacaatgagttcagtgaagctgacaagctgggagaggaagggagtgcgcaagctgattatgaccacctcaccccagccgagaggcgttacattgaacagaagcagaagatcgacgtacacaagctggccaaggtggctgacaagtcgcacagggaccgcatccaggacttcaaccagtacctggcaaatcttagtgagcactatgatatcccaaaggtcggccctggttaattaaggttagcacgagtgttccagtgtgctggacctatgcatgcagctcgtcaatttcgcgtgggtgcgctctgaaacaatggattgtgttgtctttagagaaaaattgagtacctctgcacttgtaaactgattgcactttatctctgttcgaggaccatgtttaata

SEQ ID NO: 2992 - DNA, 973 bp, Triticum aestivum
tcgggggtaacggtaaatggatgccgaccaaagcagccccaccgaccctgttggtctcgcaccattaggatccccttccccgacccaaatcggccgccgccgagccctcgaccttcgccggagccaccgagccaaccaccgaagctcctcgaactcctcatcctcctccggatcggcgcggatcggagactcccgcgaagcgattcctcctgtcaggcagtcgagatgtcggagtacaagaacgtcgttggggggaagctcaagctgaaggggaaaccgctggatgtcaaggagggcggagtcaagaagaagaataaaaagaagcaccgccgcgaggagtcgtctcaaggcgagcacggcgagctccgcgaaggtggaagctctgaattgccaggtgaccctgacaatgagttcagtgaagctgacaagctgggagaggaagggagtgcgcaagccgattatgaccacctcactccagccgagaggcgttacattgaacagaagcagaagatcgacgtacacaagctggccaaggtggctgacaagtcgcacagggaccgcatccaggacttcaaccagtacctcgcaaatcttagtgagcactatgatatcccaaaggtcggccctggttaattaaggttcgcacgagtgttccagtgtgctggacctatgcatgcagctcgtcaatttcgcgtgggtgcgctctgaaacaatggattgtgttgtctttagagaaaaactgagtacctctgcacttgtaagctgattgcactttatctctgttcgaggaccatgtttaatacttgcaagtgttctgagtacttacttgtaaattgatacttgggtacttcctccgctccagtttataagtcatgcttctcgagtacaagtttggccaacgaaatatatgggacatgtgccacatgttataccatttatgaattcgtatttaaataaatccagtggtatcatt

SEQ ID NO: 2993 - DNA, 778 bp, Avena sativa
gatgccgaccccaaacagccccaacccatccccggtagtctggcatccttaaatccccaattcgatcgccgccgtgccctcgatcttcgctggcgccgccaagcggcccctcgcaccgaagcacgcgcctcgtactcttcctcctcctgccgcgctcttgttgatctgcgcggatcgaagattcatgcgggctcatttctcttgctaggcaatcgagatgtcggaataccagaacgtcgttggggggaggctcaagctgaaagggaaaccgctggatgtcaaggaaggtggagtcaagaagaagaagaagaagcaccgccgcgaggagtcgtctcaagtcgagcatggccagcaatacgaaggtggaagctccgagttaccgggtgaccctgaattgagtgaagctggcaagatgggagaggaaggggatgcacaggccgattatgatcacctcactccagccgagcgtcgttacattgaacagaagcagaagattgacgtgcacaagttggccaaggtagctgacaagtcgcacagggaccgcatccaggacttcaaccagtacctggcaaatcttagtgagcactatgatatcccaaaggtcggccctggttaagtaagcatgaagatcaaggttcacatgaatgttccgtgtgctggagttatctagacatctatttgtgtgggcactccctgatacaatgggttgtctcgtctaaactgggaacttgtgaattgattccactcttatctgtatttgaagaccatgtttaatagt

SEQ ID NO: 2994 - DNA, 910 bp, Setaria italica
gcagacttctgaccagcgttgaccggtgagcctttggacaccgcggcttccctcgtggcctcatctgaccgtcgccgccgaaggggaaaacgcaggtgttcttgtttctctctccagcccaaactggtggcggaatcaacccaaaaccttgccagatttccaacctgattacgacatgatccggttcatcctgctgcagaaccggcaggggaagacgcggctggccaagtactacgtcccgctcgaggactcggagaagcacaaggtcgagtacgaggtgcaccggctggtcgtcaatcgggaccccaagttcaccaatttcgtcgagtttcgcacacacaaagttatctacaggagatatgcagggctgtttttttcaatttgtgtggacataactgacaacgagttggcatacttggaatgcattcacttgtttgttgaaatattggaccatttctttagcaatgtttgtgagcttgacttggtttttaattttcacaaggtttatctgattctagatgagtttattcttgctggagaactgcaagaaacaagcaaaaaggcgataattgagcgaatgggtgaactagagaagctggaatgagggtgaggggaagaggcggccgctgcagtgccccatggctgctcaccatttgtacaataatttgtaggtgttgtgcatttactttcgttgttcttcatttcggatttcattggttgggtgaatggtccatgccatcactttgtctcaagtaaccgttgcttacctgagattgcttgcatgttacagaaacttcactgtagttagtttctcactgcagcgatgaaaaaaaaaagttttctactttgttgccaaaccagctgcagatgagaagctcgttagtgaacgtgaatcccaagctgatgcaaa

SEQ ID NO: 2995 - DNA, 1067 bp, Sorghum bicolor
atacttttttatgtcgcaataggcctcaggctgccttccttgttcctccgtctgtccgtcagcgccagaggtgaccggaaaaccacgccgttcttgcatttctccccggcccaaattgctgactggatcaatccaagaccttgcaggattttcgatctgattgcggcatgatccgcttcatcctgctgcagaaccggcaggggaagacgcggctggccaagtactacgtcccgctcgaggactcggagaagcacaaggttgaatacgaggttcaccggctcgtggtcaatcgggaccccaagtttaccaacttcgtcgagtttcgcacacacaaagttatctacaggagatatgcaggactgtttttttcaatatgtgtggacataactgataacgaattggcctacttggaatgcattcacttgtttgtcgagatattggaccatttctttagcaatgtttgtgagcttgatttagtgtttaattttcacaaggtttacctcatactagatgagtttattcttgctggagagctgcaagaaacaagcaaaaaggcaataattgagcgaatgggtgaactggagaagctggaatgagaacgaccaggaagatgctgccgcctgccgcgtgccttgtgttccaacttgtactattcgtttcaggtgtttttgtgtttgctttcatggttcttggttccggttgacagtcagcgtgaggccatgctgtcattctctcgaagaatggtatgtaacatgagattagtgccaattacattataattctcgtacctttgaaaaaacattataatctgtcaggaaattgcctgtggtggaaaagaaaagaggcttttacatatatgtcattatgaaagttggcaattacatacaagtcattaaaaaagttgagttctcatagatgccactgttccaaactcttttactctctatgccacttccgtcagatttgactgttaaattataggcatgaaaagtcaaaaataccttaatgtttgaatatgcaattaatttgttttgagcattttaacgatctcaaatgaaaaaaagtca

SEQ ID NO: 2996 - DNA, 765 bp, Saccharum officinarum
acaggctgccgccttcctagttcctcctctgtccgtcagcgccagaggtcaccgcaaagccacggcgttcttgcttctctccccggcccaaattgctaaccggatcaacccaagaccttgcaggatattcgatctgattgcggcatgatccgcttcatcctgctgcagaaccggcagggaaagacgcggctggccaagtactacgtcccgcttgaggactcggagaagcacaaggttgaatacgaggttcaccggctcgtggtcaatcgggaccccaaattcaccaacttcgtcgagtttcgcacacacaaagttatctacaggagatatgcaggactgtttttttcaatatgtgtggacataactgataatgaattggcatacttggaatgcattcacttgtttgtcgagatattggaccatttctttagcaatgtttgtgagcttgatttagtgtttaattttcacaaggtttacctgatactagatgagtttattcttgctggagagctgcaagaaacaagcaaaaaggcaataattgagcgaatgggtgaactggagaagctggaatgagaatgaccatgaagctgctaccccgtgtgttgtgttccaatttgtactattcgcttctggtgttttggtgtttgctttccttgttcttcgttcctgttgacagtcagcgtgaggcccatgctgtcattctctcaaagaatggtacatgtaacatgccattggtgccatttacattataatttctcgttcatt

SEQ ID NO: 2997 - DNA, 1516 bp, Prunus mume
ctttacccgcgccgcgacccactggaactgcgaaacgacatcgcaaagtaaaccccccccccccaaaaaaaaaaaaaacttagtagttttcgtgccgaagttttgggtgtctgctctctgctgttgttagcttcactttgaattttgctttgacaatgatccgattcatattgttacagaaccggcagggaaagacccgtttagctaagtactacgttcctctcgaggattctgagaagcataaggtcgaatacgaggttcatcgtttggtggtcaacagagatcccaagttcacaaatttcgttgagttccgtacgcacaaggtgatctacaggagatatgcggggttgtttttctcactgtgtgttgatataacagataatgaattggcatatttagaatgcattcatctattcgtggagattttggatcattttttcagcaacgtttgcgagcttgatttggtctttaactttcacaaggtctatctgatacttgatgaattcattcttgctggagagctccaagaaacaagcaagaaggcgataatagagagaatgggggaactggaaaaactggagtgagatttcatctgcggtgacaagtttcaaggatgcaatatggttctgtgtttctgctgattgtttcagttaattcttgtagcccaccatattccttgtgtgaattcctctcgtgtaataaaagttaattgaactagaagattttgtacccccggcttttcctcattttgccatttgtgtttgaaatacacattcatataatgaaaggcgtgcacatgaacaaagttgtctgttctgttcaggttgaggagtaatatcatgtcatttaaaaaaaccaaggaggactggagaagattgtacagtgcaaggatcttatactcggttgccgcccaatattgaaagaggattaaaaacagagtatgctttggttaacttgacctcaaagcaagtgcgccattgtggaaaatccttgtaagagaccaaatagcaccaaaactaccaaaatcttcagaattcagtcagatgtagccaaatatcagactgcaccgaatttgggcgtaccaacaaatctttcaattgataattgattgttggctttgttttgattcggtacatctctgccgactatggtccaaaagtccaagccatttttcagacgcaagcttagttaacactcccacttactaaaaaagtagaaaactatatataccacattctttttttcttcagttgccgatgagaagaatggtaggcaacttagcattaggataagggctgtgttagatccatcccagtgtacaccagaagacaaattgaaaaagaagataaaaggcttcaatcagaaaccaaaaagagaaaatggaaaagcgtctcatctttattttttattctggtttcatctgcgaaccttgaaagtgcacagcgtttactcactttttcattgaatttgcctactaaaacccccacttaagagtttgagagttttaattgaataa

SEQ ID NO: 2998 - DNA, 2417 bp, Malus domestica
ctatattctcacatctttccttttcatagatctcaccgtactacacaatgtcagctgctaccacgtccccagccgttcgatctttctacctccggcgccgatcacctacggtggccatgcctcgctgcaggatggccgtccgatccgctgccgtttccctatctccgctgttgaccaagctacacaacgacagtgccactcccctgcccctcctgcgccacgtggcagactccatggcctccgacatgcgtgccgggctcgcccgggacggcggcagcgacctcaagatgatactcagctacgttgattccctcccaagcgggaatgaggaggggttgttttatgcactggatcttggaggcacaaacttcagggtgctgagagtacaattaggcggcaaagatgagcgcgtgattgcaaccgaattcgaccaagtttccatccccccggagctcatgtgtggcacctcagaggaactgtttgattttattgcttctggtttggcaaagtttgcacaaaaggagggtaataaattccaccttccaactggtacgaaaagagaaattggattcacattttcgttccctgtgaagcagacctccattgattccggcatactaattaagtggacaaaaggtttttccgtatctggaacggcaggaagagatgtggttgcttgtctgaatgaggctatggaaaggaagggactcgatatgcgcgtgtctgctctggttaacgatacggtaggaactttagctggagcaagatattgggacgatgatgtcatggttgctgtcattttgggtactggtaccaacgcttgctatgttgaacgtgtagatgctattcccaaactacagggccaggtttcttcttccggcagaacgattatcaacactgagtggggagcattctcaaatggtcttcctttgacggaattcgatagagatatggatgctgctagcatcaatcccggtgaagatctttgagaaaacaatctcgggaatgtacctcggggaaattgtaagaagagtactagtaaagatggctgaagcagatgctttgtttggtgaatctgtcctagaaaaactatcaacaccttttctactcaggactccatatctttgcgctatgcagcaagatgcatctgatgaccttcaagctgttgggtcaatcctatacaatgtagcaggggttgagtccagtttaagtgcaagaaagattgtggtggatgtatgtgacaccatagtgaagcgaggcggacgcttagcaggtgcaggaatagtagggatactgcaaaagatggaggaggattcaaaagatctcatttttggcaagaggactgttgtggccatggatggagggctgtacgaaaactatccacaataccggaggtatttacaagaggcggtggcagagcttctagggacagagatttcgaagaacgtggtgatcgagcattcgaaagacgggtctggtataggggccgctctcttggctgctgcaaattcccaaatacaaattaaccgttggatacttatgttgaccaagaccatcaacggagacaagtctcctctacccaagttaagcacaccgttttttatcttcctctttctcttaccgccccgcgacccactggaactccgagacgacatcgcacaacgaaaccataaaagaaaagggaagttggtagctttcgtcccgaagtttcggtgttccgctgttgttaatttctccagttttgcttcgacaatgatccgattcatactgttacagaaccggcagggaaagacccggttagccaagtactacgttcctctcgaggattccgagaagcacaaggtcgaatacgaggttcatcgtttggtggtcaacagagatcccaagttcacaaatttcgtcgagttccgtacacacaaggttatatacaggagatatgcaggattgtttttctcactgtgtgttgatataactgacaatgagctggcatacttggaatgcattcatctgttcgtcgaaattttggatcattttttcagcaatgtttgtgagctcgatttggtctttaactttcataaggtctatctgatactggatgagttcattcttgctggagagctccaagaaacaagcaagaaggcaataatagagagaatgggggaactcgaaaaactagagtgaaaattatcatgtggatgacaagtttttaggattgcagtattggttctttgtttctgcggatcgtttcagtcaatttttgtatcgccattccctgtgtgaattcctctcgtgtaataaaccttaattgaactagaaggtttccctttttcatatatccgttgtacccggctttccccccattttggcatttgtgtttgaaatacatgttcatataattgaaggcatatacacgacca

SEQ ID NO: 2999 - DNA, 652 bp, Fagus grandifolia
gttgattggtctaaattatacacacgctagatttcaccctctcccttcctgcaaagacttcaaggctcagctgcgactggaatttgcgttgtgcccaagattttcgctctctccaaaatcatttcaattcctagctgctctctttcttaatctccctttgttttcttttgattcaagaatgatccggttcatactattacagaacaggcaaggaaagacccgtcttgccaagtactatgttcctctcgaggattccgagaaacacaaggtcgaatacgaggttcatcgattggtggtaaatagagatcctaagtttacaaatttcgttgagttccgcactcacaaggtaatatacaggcgatatgccgggttatttttctccctctgcgtcgacattactgataatgagctggcttatttggagtgcatccatttattcgtggagatactggatcatttcttcagcaatgtgtgcgagctagatttggtttttaactttcacaaggtttatctgatacttgatgaattcattcttgctggggagctccaagaaacaagcaaaaaggcgattattgaaagaatgggcgaactggaaaagttggagtgagaagttattctgaggagtgttatcagagtgtctttatttctgtgg

SEQ ID NO: 3000 - DNA, 605 bp, Beta vulgaris
tttacaaatcactcgtctctcaccgtcgacaacccttttttaccatatcttccggcattacaaaatttcttagctagactgcagagagagaaattattctgctctttaacctaccaatcacttccaatccctctgaaaaagaaaatgatccgattcatattgttacagaacagacaagggaagacgcggttggcaaagtactacgtacctctcgaagattccgagaagcacaaagttgaatacgaggttcatcggttggtggtaaatagagacccgaaattcaccaattttgtcgagttccgtacacacaaggttatctacaggcgttatgctggattgtttttctccatgtgtgttgatatcacagataatgagttagcttacctcgagtgcatccatctcttcgtggagatactggatcacttcttcagcaatgtgtgcgagctggatttagtcttcaattttcacaaggtatacctgatacttgatgaattcatccttgccggagagcttcaggaaacgagtaagaaggctataatagagaggatgggtgaattggagaaactcgagtgattttaatttgttgtagatgagtaacgcggcag

SEQ ID NO: 3001 - DNA, 1012 bp, Theobroma cacao
gtctgcgtgagtacacgctaggtttcattgccgtctttgtgaactttcaattccagccttcgaccaattgcgaaacgagaaaaagaaactttgacaataaaacattttcgtaccattttcctgccctagatttttgctctttgcccatttactcctaaaactccttgggttccaacaatgatccgattcattttgttgcaaaacaggcaaggcaagactcgtctagccaaatactatgttcctctcgaggattccgagaagcacaaggtcgaatacgaggttcatcggttggtggttaacagagatccaaagttcactaatttcgttgagttccgtacgcacaaggtaatctacaggcggtatgctggtttgtttttctcattgtgtgttgatataacggataatgagttggcatatttggagtgcatccatttatttgtggagatattggaccattttttcagcaatgtttgtgagctcgacttggtttttaattttcacaaggtttatctgatacttgatgaattcattcttgctggagagcttcaagaaacaagcaaaaaggctatcatagagagaatgggggagctggagaagctagagtaaagatgattctgcacgaaagagtcatgtcgatttttctcaattcttgctttttttttttgggggtgttattataactcgttcacctgttttgcacagccaattctttacttgtatcatcagaaaactgaaacacctagtgtcccaggactcctcttttccctttcaactgtttgtgcaatgttttatggaggcatgtaaaagaaacccgtgttattaatggggtagcttctcttgttttccattgttgtccatttgatatttatatatatctgagtaggttacttgaccttgtaattttgtgctaaattttgttttggggaattgatttgcgtgttatttcagcgttctacttgaataatcagcagaatagtgatggaaaattataccatcaaactgaaacatatag

SEQ ID NO: 3002 - DNA, 472 bp, Manihot esculenta
ttgttattctttgattttgattttggcagatccgattcatactcctgcaaaacaggcaaggaaagactcgtcttgccaaatactatgttcctctcgaggattccgagaagcacaaagtcgaatacgaggttcatcggctggtggttaacagagatcccaagttcacgaattttgttgagttccgaacacacaaggtcatctacaggcgatatgctggattatttttctcaatttgcgttgacataacagataatgaattggcatatttagagtgcatccatttatttgtggagatattggatcatttcttcagcaatgtttgtgagctagatttggtattcaactttcacaaggtttatctgatacttgatgaatttattcttgctggggagctccaagaaacaagcaagaaggcaatcatagaaagaatgggggaattggagaagctcgagtaggaatctttctttttata

SEQ ID NO: 3003 - DNA, 3169 bp, Ricinus communis
agaaaaaagaaaaaaggataatacatcaacggtgcctagcgatttagagtcattgtacacttttgattcgtatacatcattacacagtagattccactctcctttttcccattcgaaaattcaaccttcaccaccttaccaaagaactttgacccaaaaaaaagaaagaagaagaaattgtacaaaattcatccttgtagcctagattcacgctagcagtacacaattggtatcagatcttcgattaatcctcattttgatcgtggaaacaagaatgatccggttcatactattgcaaaacaggcaaggcaagactcgtctcgccaaatactatgttcctctcgaggattccgagaagcacaaagtcgaatacgaggttcatcgattagtggtcaacagagatcccaagttcactaatttcgttgagttccgaacacacaaggtcatctacaggcggtatgctggattatttttctctctctgtgttgatataacagataatgaattggcatatctagagtgcatccatctatttgtggaaatattggatcatttcttcagcaatgtgtgtgagcttgatttggtattcaattttcataaggtttatctgattcttgatgaattcattcttgctggggaactccaagaaacgagcaagaaggccatcatagaaaggatgggagagttggagaagcttgagtaaacttctgcattgagcagtgtttacggacgttattttttctgtactttttttacccctactcttttttcttttaattattatttttggaatttgtttgctcatttgtcacagccagttcttctcttgtaatatttgaagattttgaaaggaatttcacatctttgtacatttctttcggtgtttgtgacaatgtggccaattaattattttctatgaaatctgaatttgttttaaaccaacttgggaaatcaagtagaaaaaacctctgttcaagtaggctagagggtgtgctttctcaggattgatatacaaataattggggagttcattagtttgcttgataggaactgttggtaaaagctggatatatgggtgcacgtcatcaattagtttattagtttgcttgataaactggggccatatgttgtctcctatactggaggcaacaaatgtgtctaatgaaatgcctctatctttggaattgaatcatgtggtaaatgcttgtaaaagagtaattaataataaaagcttatatctttgttcttttctctctgcttttttaagagggcaacaagcagtttccaagtgctaatcctgtccagtgcaagtagagaataactttacatataaagcaaaaaagattaagaaaataggctcaagaggcaaaggtttatatactgaagcgggggcaccggaataaacaaagtcctttctattctaataaactctctttgttaattggtgagattgtcacttgaactgtgcttataagaagaggatgctgcagattgttctcagccaaccatccttagcagctgatcagatttatttccaggtgctaataactttcttgtctttcaagcctgctctgcctccctctgctattttatcccatcaatcatatatattccttgcttattcgccttccagtcgtgccaaaatggatcaccaagtcacaagaactaatacaagaattagacgatgttattgtccatccatatgattccagtacagcctctgacctattgctttctcatagtcgctcattgcagagcaactgcaaaggcagtgcaccaccaccagctcgaaatccgaccccagagtcttcataaacagaagaaagatggtgatcctgccttttcatccttgcatgtggtagcgtgatggccatgaactgctgctgctgctgctgagagacctgaggatacttgtggcctagtacttctaaagttgaaggcgatgatgagaaaaatggcataagcgtatttgaatcttgccttccattttgccagcttggaaactgagtcacggttgaggaagtcccattattcctgaactgagctgccaactgggccgcccaaaaacgttgttgttgttgttgctgctttgtcaaggctttgggattggcatgaggaccacagtatgggctgctgaaatggggaggtaactgaagttgggcctacaatcaagtattaggacaaaaaatgagcaacttccataccaacccaatcattagacatgttacaaatggcagttgaacttgatgcaaattttggacttcatgacaagtcagcaatgggctagctgcacgttaaagagacttttagctatttccttgtcatgctcttatgtaaaatgacgtattgtctctggtcccaacacgaaaatcctgtatttccaacgcatcccatcatccatttgaggcattatttatcagtagactcttaaccttggggtgattaataaacagtctcaatgatctgtttaataggcttggatgctacctcttcaaataaacacaaattcaaatctaatagtaaagaataaaacctgttgggctgctgctgctgaaaactgatcagggtaagcaggggcatattgcgcttgggacatggagaatggcatgatcgtgggatgttgggcattataaggaacctgcagctgtgccgatggttcggaaccatgtccagctccactcaaactagtttctataccaccaccacccgctgacagagacaagaaattgcaaccctacaagaaagaaaaacttatcagacctaatcaaatgggaataaatatccggaaatggaatactgaactcacctgcttctgagaagtgtatacaccacatgacagagcaggctgtgaatgatcttgacgtagccttaggtgttgaagattaccacttttagcatcacttggattcttcttgattttgttaattaagctgctagcagatgcaactccatttaaatcattgctgttgaagtcatttattgtcatgagtacaccttgctttaatatttcatgtggtctcagttgatttgaagggagttgcaagctttctttgctttcagggacttctagtacccgaatgagacggcttatgtaaacatgagctgcacacctcttccacgaccttctatcagttggaactttagaaagctgtattattcatgatccacc

SEQ ID NO: 3004 - DNA, 860 bp, Castanea mollissima
tatacgtgatacgttacggttttcacccgttgtctcttctcgcaaagactttgaacctgcgactggtacttgagctgtgccctagattttcgctctctccaaaatccaaatccatttcaatttctagctcctctcttgcttaatttccttcgttttcattcaacaatgatccggttcattctattacagaacaggcaaggaaagacccgtcttgccaagtactacgttcctctcgaggattccgagaaacacaaggtcgaatacgaggttcatcgattggtggtaaacagagatcccaagttcacgaatttcgtcgagttccgcactcataaggtaatctacaggcgctatgctgggttatttttctcgctctgcgtcgacattactgataatgagttggcttatttggagtgcatccatttattcgtggagatactggatcatttcttcagcaatgtgtgcgagctagatttagtttttaacttccacaaggtttatctgatacttgatgaattcattcttgctggggagctccaagaaacaagcaaaaaggcgattattgaaagaatgggtgaactggaaaagttggagtgagaccttattctgaggagcgtgttataggagtgtcatttttctttccctttttttccccagttggtttctattttgtttacaaaattcattctgcggctttcatcttgtaatatcagaaaattgttccttccttgttcatttctctaatgtgtttcttcttcttcacttttccccatgttgctgttagtaacatgggtggctgtaagtcatattcaatcaacaaaggcaatatacataaacgcagcagcgctgcgcgcacacacaca

SEQ ID NO: 3005 - DNA, 591 bp, Euphorbia peplus
acggtgtcagaaggaaccaatttgactgaaaatattcggaacaagaagaaagaaagaattgccgtctaaattgacggttgtcgctcctaatccggcatcgttttgcttcgatttcatcacacaagaatgatccgattcatacttcttcagaacaggcaaggcaagactcgtctcgccaaatactacgttcctctcgaggattctgagaagcacaaagttgaatacgaggttcatcgcttggtggttaatcgggatcccaagttcaccaatttcgttgagttccgaacgcacaaggtcatttacaggagatacgcaggattgtttttctcactgtgtgttgatataacggataatgaattggcatatttggagtgcatccatttgtttgtggagatattagatcatttcttcagcaatgtatgtgaactagatttggtattcaactttcacaaggtttatctgatactcgatgaattcattcttgccggggagctacaagaaacaagcaagaaggcaatcatagagagaatgggagagctggagaagctcgagtagatatccatcccgtagtaaagagtgattacagtttca

SEQ ID NO: 3006 - DNA, 735 bp, Heritiera littoralis
tccttcgttccgaccatgatccgattcattttgttgcaaaacaggcaaggcaagactcgtctagccaaatactatgttcctctcgaggattccgagaagcataaggtcgaatacgaggttcatcgattggtggttaatagggatccaaaatttactaatttcgttgagttccgaacgcacaaggtaatctacaggcggtatgctggattgtttttctcactgtgtgttgacataaccgataatgagttggcatatttggagtgcatccatttatttgtggagatattggaccattttttcagcaatgtttgtgagctcgacttggtgtttaattttcacaaggtttatctgatacttgatgaattcattcttgccggagagcttcaagaaacaagcaaaaaggctatcatagaaagaatgggggagttggagaagctagagtaaagatgattctgcatgaaagagagttggtgcaatttgtgttaaaattttctcaatcattgcttcttttggtgttagtataatctgttcacctgttttgcactgccaattcttgtattattagaaaactgaaatacatagtgacccgttactccatttcccctttagctgtttgtgcaatgtttagtggaggcctggaaaagatgctgtgttaacaatgaagcatcatctattgtttccccctttgatagatgattgataaaatttgtaattttatgttcaattttagttttg

SEQ ID NO: 3007 - DNA, 824 bp, Humulus lupulus
gaatacgaaggtgtgttgatcggcttattaccataatcaaaccaatcttctctttcctttctcgttcgcttcttctgttcttcaattgtagaacaatgatccgattcatactcttacagaatcggcaaggcaagacccgtctggcaaagtactacgttccccttgaggattctgagaaacacaaggttgaatatgaggttcatcgtttggtggtaaacagagatcccaaattcacaaatttcgttgagtttcgtacacacaaggtgatctacaggcgttatgctggattgtttttctcgttgtgtgtcgatattacagataatgagttagcatatctggagtgcattcatttatttgtggagattttggatcatttctttagcaacgtttgcgagctagatttggtttttaactttcacaaggtctatctcatacttgatgagttcattcttgctggagagctccaggaaactagcaagaaggcaattatagagagaatgggggagctggaaaaactagagtaacatttctgtggtgaagagtgtgtagaagcgcggactctgtttttctggggcgttaagacttgtttaccttagacgatgtgatgctctagtgtaacattagaaatggaactaaaattgtttcttcttcttctttgcatcaccaatgtactttccattttctttttctatttttttgacaattcatgtgatatactattatcaccataggcgagagagagtgcttctgttcagtgggttgtgcttatatctgcaatttttttcaatgtgtttttccaactttttctattatatccaacggta

SEQ ID NO: 3008 - DNA, 909 bp, Quercus alba
atgggacccaccaaaaataaataaaattggcacaccgttgattggtctgattttacatacgttacagtttttcacccgttgtcccttctcgcaaggactttgaacctgcgactggtatttgagctgtgccctagattttcgctctctccaaaatccaaatctatttcaatttctagctcctctctttgcttaatttccttcatttttcattcaaaaatgatccggttcattctattacagaacaggcaaggaaagacccgtcttgccaagtactacgttcctctcgaggattccgagaaacacaaggtcgaatacgaggttcatcgattggtggtaaacagagatcccaagttcacgaatttcgtcgagttccgcactcataaggtaatctacaggcgctatgctgggttatttttctcactctgcgtcgacattactgataatgagttggcttatttggagtgcatccatttattcgtggagatactggatcatttcttcagcaatgtgtgcgagctagatttggtttttaacttccacaaggtttatctgatacttgatgaattcattcttgctggggagctccaagaaacaagcaaaaaggcgattattgaaagaatgggcgaactggaaaagttggagtgagaccttattctgaggagtgtgttataggagtgtcatttttcatttttctttttctttccctttttttccccagttggtttctattttgtttacaaaattcatactgcggctttcttcttgtaatatcagaaaattgttccttgttcatttctctaatgtgtttcttcttcttcacttttccccatgttgctgttagtaacatgggtggctgtaagtcacattcaatcaacaaaggcaatatacataaacgtagcagcactgtgt

SEQ ID NO: 3009 - DNA, 902 bp, Carica papaya
caccattcgatctgcgagttacgattggctgcgaaacgaagaaattgacgataaagcaaaaacatttcagtattctctcgccctaaattctctctctgcgcataagtcgtcgaacttctttgctagtttcatctccaattttatccggaaatgatccgatttattttgttacagaacaggcaaggcaagactcgtctcgccaagtattacgttcctcttgaggactctgagaaacacaaggtcgaatacgaggttcatcggttggtggtgaatagagatccaaagttcaccaatttcgttgagtttcgcacgcacaaggtaatctataggcggtatgctgggttgttcttctcattgtgtgtcgacataacggataatgagttggcatatttggagtgtatccatttatttgtggagatattggatcatttcttcagcaatgtgtgcgagctagatttggtgtttaattttcacaaggtttatttgatacttgatgaattcattcttgctggagagcttcaggaaacaagcaagaaggcaatcatagagagaatgggagagctggagaagctagagtaattattctatactgcaagagtgtttaaaagtctgcaatttgttttgtaattgtttccttttgtgggtgatattggtttgtcattctgcacagccttctcacccgtgaatgtccaaaacagaaagattaacaagaaaatattctttgttttaagaagcgctataatctgtcagcatttttcctcccccttttagctgtttgtaacaattgcagcgatagatgatcattctgtaggcaaggctgtatctggtacattatcatatcttgagaagacctcatttgtgattggaaagacattatacaattgaactgtttctaggtgcta

SEQ ID NO: 3010 - DNA, 1564 bp, Prunus persica
ctggctctccctctctcgcctttctcttgggcttttacccgcgccgcgacccactggaactgcgaaacgacatcgcaaagtaaaaccccccaaaaaaaaaaaatttcagttttcgtgccgaagttttgggtttctgctgttgttagtttcactttgaattttgcttcaacaatgatccgattcatattgttacagaaccggcagggaaagacccgtttagctaagtactacgttcctctcgaggattctgagaagcacaaggtcgaatatgaggttcatcgtttggtggtcaacagagatcccaagttcacaaatttcgttgagttccgtacgcacaaggtgatctacaggagatatgcggggttgtttttctcactgtgtgttgatataacagataatgaattggcatatttagaatgcattcatctattcgtggagattttggatcattttttcagcaacgtttgcgagcttgatttggtctttaactttcacaaggtctatctgatacttgatgaattcattcttgctggagagctccaagaaacaagcaagaaggcgataatagaaagaatgggagaactagaaaaactggagtgagatttcgtctgcgggacaagtttcaaggatgcaatatggttctgtgtttctgctgattgtttcagtcaattcttgtagcctaccatattccttgtgtgaattcatctcgtgtaataaaagttaattgaactagaagattttgtacccccggcttttcctcattttgccatttgtgtttgaaatacacattcatataatgaaaggcgtgcacatgaacaaagttgtctgttctgttcaggttgagtaatatcatgatgtcatttaaaaaaactaagcaggactggagaagattgtacagtgcaaggatcttatactcggttgccgcccaatatggaaagaggattaaaacaaagtttgctttggataacttgacctcagagcaagtgggccattatggaaaatccttgtaagagaccaaatagcaccaaaaataccaaaatcttcagtattcagtcagatgtagccaaataccaaactgtaccgaatttgggcgtaccaccaaatctttcaatcggtaccaccaaatctttcaattgataattgattgttggctttgtttcgattcggtacatctctgccgactatggtccaaaagtccaagccattttttagacgcaagcttagttcacactcccacttattaaaaaagtagaaaactatatataccacattctttttttcttcagttgccgatgagaagaatggtaggcaacttagcattaggataagtgctgtgttagatccatcccagtgtacaccagaagacaaattgaaaaagaagataaaaggcttcaatcagaaaccaaaaagagaaaatggaaaagcgtctcattttcattttttattctgttttcatctgcgaaccttgaaagggcacagcgtttactcactttttcattgaataaaatggaaaacccctacttaaagagtttgagagttttgattgaataatggaataatgttg

SEQ ID NO: 3011 - DNA, 757 bp, Euphorbia esula
tcttcttctcctctgcgtgtgtcagtcaggtcaggacgaaccaatttgactcaaaatttaaacgaagaagaaagaattccaattgatttacacctcaattcgcggttgtagctcccaattcggaaccgttcttcgatcatttctgatttcatcacacaacaatgatccgattcatacttctgcagaacaggcaaggcaagactcgtctcgctaaatactacgtccccctcgaggattctgagaagcacaaagttgaatacgaggttcatcgattggtggttaatagagatcccaagttcacgaatttcgttgagttccggacgcacaaggtcatttacaggagatatgcagggttgtttttctcactgtgtgttgatataacggataatgaattggcatatttggagtgcatccatttgtttgtggagatattagatcatttcttcagcaatgtatgtgaacttgatttggtattcaactttcacaaggtttatctgatactcgatgaattcattcttgccggggagctacaagaaacaagcaagaaggcaatcatagagagaatgggagagctggagaagctcgagtagatatctatcttgtagtaaagagtgattacagtttcatttttgttaaattttttccttatcttttgccccaatttcttctgcatttatgtctttggcactgctagttcttttgtattattaaaaattgaaaattttcttgtgtgccttttctttgtttggattcttgt

SEQ ID NO: 3012 - DNA, 1031 bp, Fragaria vesca
ggagcaacgactcaccggggcacaacgaaacgacatcgcagcaaacgttagcaaaatttgctccgaaggctttgggcctctcctccgcttctgttccccatttctctctctaaaatcttcgacttcaacaacaatgatccggttcatattgttacagaaccgccagggaaagacacgtttagctaagtactacgttcctctcgaggattccgagaagcacaaagtcgaatacgaggttcatcgtttggtggttaatagagatcccaagttcaccaatttcgttgagttccgtacacacaaggtgatctacaggcgatatgccgggttgtttttctcgctgtgtgttgatataactgataatgagttggcctatttggaatgcattcatctattcgtcgagattttggatcatttcttcagcaacgtttgcgagcttgatttggtcttcaactttcacaaggtctatctgatacttgacgaattcattcttgctggagagctccaagaaacaagcaagaaggcgattatagagagaatgggggaactggaaaagctggagtgaagtttgtatttatcctgtcgagccaagatttttggattgcaatatgtttctttgttcctgctgatcataccagttaatttgcacactaccattccttgtgtcaattcttcttgtataataaaaagtaatgaactataatatatcccttttttcctatctcctttgttccgggctttccctatctgccatttgtggttgaattccctccctcccaaaaaaaaaaatacatattggaggccgtgtgtactggacaagaaaagcaagattttcagttttgtagttctgagtatgtaatgttgtattatggataatgaaattcagaggtttgtgtggtgtgctgtttctgaaactgatcaagctttcctggataatttgtaatagatctgaacaatggaagatgtatgtaggtccaagtatgtcttgaggaaccaaaggggtaagataaaattaacccttgtgttatgataaa

SEQ ID NO: 3013 - DNA, 964 bp, Panicum virgatum
agggggatatatgctaaaatcggaagccgcggatggccactggctggggctgcagacttctgacttctcaaccgcggcttccctcgtctgaccgtcagcgccgaaggggaaaacggagcggttcttgtttctccccccagcgcaagcaggtggcggaatcaacccaaagccttgccgggtttccgacctgatcacgacatgatccggttcatcctgctgcagaaccggcaggggaagacgcggctggccaagtactacgtcccgctcgaggattcggagaagcacaaggtcgagtacgaggtgcaccggctggtcgtcaatcgggaccccaagttcaccaatttcgtcgagtttcgcacacacaaagttatctacagaagatatgcagggctgtttttttcaatttgtgtggacataactgacaatgagttggcatacttggaatgcattcacttgtttgtcgagatattggaccatttctttagcaatgtttgtgagcttgacttagtgtttaattttcacaaggtttatctgatattagatgaatttattcttgctggagagctgcaagaaacaagcaaaaaggcgataattgagcgaatgggtgaactggagaagctggattgaggatgagagggaagaggcagctgctcatgtgcgccgccatttgtacaataatttgtaggtgttgtgcatttaattttgatgttcttcatttcggatatcacttgttgacctggtgagtggcccatgctgtcacttttgtcttgaggattgttcaccgatgctagcatattttgcatatatgaacgatgtgccatataaattggatcatttgagtcggatcaaccgaaatgccacatatgaatgcttgactctgcattatttagcatatttgatgatgtgccatgaccctttgctctgatcttccacacatgcaagggtttgatgtacacggtttggg

SEQ ID NO: 3014 - DNA, 872 bp, Panicum virgatum
ggcaggctgaggctgcagacttcagacttctcaaccgcggcttccctcgtctgaccgtcagcgccgaaggggaaaacggagcggttcttgtttctccccccagcgcaagcaggtggcggaatcaacccaaagccttgccgggtttccgacctgatcacgacatgatccggttcatcctgctgcagaaccggcaggggaagacgcggctggccaagtactacgtcccgctcgaggattcggagaagcacaaggtcgagtacgaggtgcaccggctggtcgtcaatcgggaccccaagttcaccaatttcgtcgagtttcgcacacacaaagttatctacagaagatatgcagggctgtttttttcaatttgtgtggacataactgacaatgagttggcatacttggaatgcattcacttgtttgtcgagatattggaccatttctttagcaatgtttgtgagcttgacttagtgtttaattttcacaaggtttatctgatattagatgaatttattcttgctggagagctgcaagaaacaagcaaaaaggcgataattgagcgaatgggtgaactggagaagctggattgaggatgagagggaagaggcagctgctcatgtgcgccgccatttgtacaataatttgtaggtgctgtgcatttaattttgatgttcttcatttcggatatcacttgttgacctggtgagtggcccatgctgtcacttttgtcttgaggattgttcaccgatgctagcatattttgcatatatgaacgatgtgccatataaattggatcattcgagtctggatcaactgaaatcccacatatgaatgcttgactctgcattatttagcatatttgatgatgtgcc

SEQ ID NO: 3015 - DNA, 808 bp, Panicum virgatum
aaggggaaaacggagtggttcttgtttctctccccagcgcaagctggtggcggaatcaacccaaaaccttgccggatttccgacctgatcacgacatgatccggttcatcctgctgcagaaccggcaggggaagacgcggctggccaagtactacgtcccgctcgaggattcggagaagcacaaggtcgagtacgaggtgcaccggctggttgtcaatcgggaccccaagttcaccaatttcgtcgagtttcgcacacacaaagttatctacagaagatatgcagggctgtttttttcaatttgtgtggacataactgacaacgagttggcatacttggaatgcattcacttgtttgtcgagatattggaccatttctttagcaatgtttgtgagcttgatttagtgtttaattttcacaaggtttatctgatattagatgaatttattcttgccggagagctgcaagaaacaagcaaaaaggcgataattgagcgaatgggtgaactggagaagctggattgaggatgagagggaagaggcagctgctcatgtgcgctaccatttgtacaataatttgtaggtgttgtgcatttaattttgatgttcatcatttcggatttcacttgttgacttggtcagtggcccatgctgtcactgttgtcttgaggattagtcgccgatgctagcttgagattggtcgccagctgtagtaaaatctctctgcatcagtttctccctgcagttggaaagaaaaacaatgttttgtactgtgttgccacatagattgctttatgctgttttcctta

SEQ ID NO: 3016 - DNA, 1247 bp, Triticum aestivum
tggagaggaagccgaggcaccacttttcaacggtgaacccacccacagctcatctgcatatagccaacccaacaaaccaagcaacacaaatccgattcattcccctcccaagctccaatcccgcgaattctcaagcgtggtcgtcatcatcatcacccagcatgatccgtttcatcctgttgcagaatcggcaggggaagacgcggctggccaagtactacgtcccgctcgaggactcagagaagcacaaggttgaatatgaggtgcatcggctggtcgtcaacagggaccccaagttcactaacttcgttgagttccgtacgcacaaagttatctacaggagatatgcaggactatttttctcaatatgtgtagatatcacggataatgagttggtatacttggaatgtatccacttatttgtggagatattggaccatttcttcagcaacgtgtgtgaacttgatttagtatttaacttccacaaggtttacttgatattggatgagtttattctcgctggagagttgcaagaaacaagcaaaaaggcgattatagagagaatgggtgaacttgagaagctggattaagaagaaactgtgtcgccagcgtgcatggggagataactaaacgcaaaagcaaaacccattccttctgccatgtcgaagaattttctccgtttgtacaattctgttgtagctgttattatgattacccctggttcaccaactttatggctgccttctagaaatggctgctttctagaaaaaacattatgatggttgcttggtggggttcgttgtggatcgttctgtaactaggtgccgtggaattccttgccatcttcacgcatttcattagcaatcatgatggcagtcttttctccaatcataagagcatgcatgtctagagcacccacgatgtttgaagcaatctgttgcactattccttgggctaaagatcgcaatgatgtcgtttcaccacttgggaatagtatcacagatcgtcaaaacaccttatcttacttgtcttattagatggttcagagcgtctcaagctgtaaacatacatatacatcgtgcaatagaacaaagatgccaaacaaagattccttttcgtcaacctggacttttgttgtaccacgcacatcatgtcagggtgaagaagacacgtcagaattgtccaggcgtggaaggagataacggctgtgttgagtattatgattattaggaagtataggatagact

SEQ ID NO: 3017 - DNA, 903 bp, Hordeum vulgare
ggtgagcccacacacagctcattctgcataccagcccaacaaaccaagcagcacaaatccgattcatttcgcccccaagctccaatccggcgaattctcaagcgtggttgccatcatcatcacccagcatgatccgtttcatactattacagaaccggcaggggaagacgcggcttgccaagtactacgtcccgctcgaggactcggagaagcacaaggttgagtatgaggtgcatcggctggtcgtcaacagggatcccaagttcactaacttcgttgagttccgtacgcacaaagttatctacaggagatatgcaggactatttttctcaatatgtgtagatatcacggataatgagttggtatatttggaatgtatccacttatttgtggagatattggaccatttcttcagcaacgtgtgtgaacttgatttagtatttaacttccacaaggtttacttgatattggatgagtttattctcgccggagagctgcaagaaacaagcaaaaaggcgattatagagagaatgggtgaacttgagaagctggattaagaagaaaatgtgttgccagcgtgcgtggggagataactaaaggcaagagcaaaacccattacttctgccatgccgaacaattttccccgtttgtacaattctcttgtagttgctatatgattacccttggttcatcaacttctgtatggctgctatctacaaaaaactttatgatggttgctttgtggggttcgttgcggatcattctgtaactaggtgccatggaattccttgccatctttgcccatttcattaacaatcatgatggcagttttttttcctatcataagagcatgcatgtctagagcacccacgatatttgaagcaatcggttgcaccaaaaaag

SEQ ID NO: 3018 - DNA, 2106 bp, Brachypodium distachyon
gaggccccacagtttggttgtcgttgaaagttctgtattcaagtctcccagcccaacaaacacaactcattgccctcaaaaaaaaaaaaaaaaaaaaaaaaacacaactcatttccatctactcttccgatctcctcccagctcccaaacctcgcggattctcaagcgacgttgtcatcgtcctcaccggccaccatgatccggttcatcttgctgcagaaccggcaggggaagacgcggctggccaagtactacgtcccgctcgaggactcggagaagcacaaggtcgagtacgaggtgcatcggttggtggtcaaccgagaccccaagttcaccaacttcgtcgagttccgtacacataaagttatctacaggagatacgcaggactgtttttttctatatgtgtggatatcactgataatgagttggtatacttggaatgtatccacttgtttgtggagatattggaccatttcttcagcaatgtgtgtgaacttgatttagtattcaacttccataaggtttacttgatattggatgagtttattctggctggagagcttcaagagacaagcaaaaaggcaatcattgagagaatgggtgagcttgagaagctggattaagaagaaacggtgtagtggtgtacactagcgggcttgtggcgataactaaactgaagagcgaaaccaattccttcctctgccatttatacaattctttgtagccgttgtgtgatcagtatccgtggtctctctacctttctggatggttgcttggtgaggttacttgcagattgttctgtaactagataacatggggttttccctgccatctgtgtgcatttgcttaaagtaacatcatatagtggaatagtggatgtcgtcttcttttcttaccttcctgagcttatatgatggtgatttagcaacatactccctccatccggaaataagggacgtgaatttgtataaaaatctatacaaatctaagtcacttgttttgggacggaggaaggacaatgtttgaggctatctaggtaaacaatcggatgcaattgtaacagtgactgttttttttcttttattgagagaaaatctttgttccatttatggtgtgatcaggatgtggagataattaaaaataaaaagatgtaatctagctagatacacttgtgtttactgaaataagattcacaaaggtgctacgttcgatttggtgtgataccatcctgcaaatacaacaattcagcactcttttttctaactgacaattcagtaatgatttgtcggtgcaaagatggacgagaagatgcaacattctgtgctgggtgcaagaaacggggcttgagacatggttggacattataattttaccctgtatttcagaattcccatttgcagtacaaatgcacaatcctacaaaacaaaactggcagcactaagcatgactagtaaatccaagatagctgtacaatcagctagcagagggtccaaaattgcgtgcttcaactcaagcctattatgcaaagctacacggcaattagcggaggtcaagtgtttcactcctagtccaggtcgaaggcgacagtttcttcttcaacgcccaacacctcatccacctcaacctccttggcttcatactcttcttcctcctcgctgtcctccccacctctcagcgccatcctgtatgctcgttcctcttcgtgctgctgcttccagctagcaacccacccttcccattcctcctgaagctgcttccgccgcttgcgatcctgctcgctcacctggttgaacacgtcctggtcctcttgctcgtacttcttgctgtacctcttaaggtttgccgagatctcttcctccttctcaggagtaagtagtgatggtggccttggacgccaatggaactgcgtcatttagttcaaagcaaatggcaaagcattagtacaatgatacggcaatgtatgggttttaagaacagaggatggaagctatacctgatagaagtgatcctttgacactttgtaaatttgtttcccattgaaggaccaaatttgaaaaccattctccatctcatggactgaggtaactgccgttgcaaggaatctg

SEQ ID NO: 3019 - DNA, 937 bp, Cannabis sativa
atgaaatcttgggtgtgacatgaataatgagaaaataaattatgtagctgacttttcttggtcagagtagtgtccatggtgaccatggcagaatggaagcaaaataagtaaaggagaaataaccaaagaaacatcgaatcgaattacagattgatggaagtggaaatcggcctattaccataaccactcacttcaaacccactcttctctttcctttcttaatcgcttctactcttcttctcttcaatttgtaaaacgatgatccgattcattctcttacagaatcgccaaggcaagactcgtcttgcaaagtactacgttcccctcgaggattctgagaaacacaaggttgaatatgaggttcatcgtttggtggtaaacagagatcccaaattcacaaacttcgttgagtttcgtacacacaaggtaatctacaggcgttatgctggattatttttctcgttgtgtgttgacattacagataatgagttagcatatctggagtgcattcatttgtttgtggagattttggatcatttctttagcaacgtctgtgagctggatttggtttttaactttcacaaggtatatctcatacttgatgagttcattcttgctggagagcttcaagaaactagcaagaaggcaattatagagagaatgggggaactggaaaaactagattaagaattctgtggtgattgaagagtgtgtagaactaaatttgttttattatgatatattccctattgtaacatttgagtttcttcttcgtatttgcatatcaccaatatactttgcatcactttttctttctatttttgataattcatgtgaaaatccttctatcctttgttgaagtatcattcccattacaatggtgaaatgttttccattaaaattaaatttcaaataaaaataaatacaattccttcca

SEQ ID NO: 3020 - DNA, 891 bp, Cicer arietinum
accgtaacggggtaaaggttatttacattacacggaagttatacaatacaacctccactcactacatacgcgaataaattagtggaaagtataaacagattcaaatcttcgtctcttgcaaatcaaatcaattcaattcatcgtgttctccttttaatcgcaaatccatttccatttccttcgaaatgatccgattcattcttttgcagaacaggcagggcaagacccgtttagccaaatactatgttcctctcgaagattccgagaaacataaggtcgaatacgaggttcatcgcctcgtcgtcaatagagaccctaaatatactaatttcgttgagtttcgtacacacaaggtcatttacaggcgatatgctggattgtttttctcactttgtgttgacatcactgataatgagttggcatatttagagtgtattcatttgtttgttgaaattttggatcacttcttcagcaatgtctgcgaactcgatttggtttttaacttccacaaggtctatcttatacttgatgaattcattctagcgggtgaactgcaagaaactagcaagaaggctatcattgagagaatgggggaacttgaaaaacttgagtgaaacattacgtttcagcagggtcacaatggtttggagattatgatgatttacctgtgcacttggtgtgatttttgtattttaattgtgatacagaattttgatttttttttccttgagccatgtattctgtacactactaaggcttcttaattggcttgtgttaatatgttgtagacattcacaaagtcagggtttttagtaaagtaaccctttttcattgtctatgtgttctgttataaaaaaaatttgggcttcctgataagttagcaacacaccg

SEQ ID NO: 3021 - DNA, 3330 bp, Cicer arietinum
aagaaaagtaaggagagcaccgtaacggggtaaaggttatttacattacacggaagttatacaatacaacctccactcactacatacgcgaataaattagtggaaagtataaacagattcaaatcttcgtctcttgcaaatcaaatcaattcaattcatcgtgttctccttttaatcgcaaatccatttccatttccttcgaaatgatccgattcattcttttgcagaacaggcagggcaagacccgtttagccaaatactatgttcctctcgaagattccgagaaacataaggtcgaatacgaggttcatcgcctcgtcgtcaatagagaccctaaatatactaatttcgttgagtttcgtacacacaaggtcatttacaggcgatatgctggattgtttttctcactttgtgttgacatcactgataatgagttggcatatttagagtgtattcatttgtttgttgaaattttggatcacttcttcagcaatgtctgcgaactcgatttggtttttaacttccacaaggtctatcttatacttgatgaattcattctagcgggtgaactgcaagaaactagcaagaaggctatcattgagagaatgggggaacttgaaaaacttgagtgaaacattacgtttcagcagggtcacaatggtttggagattatgatgatttacctgtgcacttggtgtgatttttgtattttaattgtgatacagaattttgattttttttttccttgagccatgtattctgtacactactaaggcttcttaattggcttgtgttaatatgttgtagacattcacaaagtcagggtttttagtaaagtaaccctttttcattgtctatgtgttctgttataaaaaaaattgggcttcctgataagttagcaacacaccgaagatatacaactggataattatactatataaataaacaaattcagaatgattagatttgatactataaaacagccagtgttgaagtatggtaaatgttataatttcagtattcctttctcgccactttcatgtatatgcacggcaacaattgtgacaggttttgcactaaaacctgggtaatgaaacaatgctgtacctatacttgggaacctgtctctaatttcttcacatatagaattgagatgaagatcttgcccatttgtcatggatgggggaaacaagctgctgctgtcgccctgagattggagtaatcttggatccaaatatttcttgtgatgcagaggtatgaggaaagatggcttgggcgcatggacccaccgtagaagagtcattccttccaatttgccaattagggttttgggtcctcactgtattgcaattcacagaagacctaccttgagctgcttgttgcatctcccaaaagttttggtgctcttgtttactatttgagactggtgaactatattgagttccacataattggctaccataataatgaggttgttgcaaccgaagctgtggtcctacaacagtccgttgatcaaggtaaactgtcgaaacatttcgactctgcggcgttggaattggcatgaccctttgttgctgtgctagtgaatgaaaataaggcacttgcaactttgaaaacggttccaacctatttccaacttcattatgattattattgtcgacctttaatccataacttccgattgacaaggacaagaagttgaaaagcttacttgcttttgagggccatataatgcaggtgttggagcagcctgagattgctgcaaaagaattccattcttactttcattgggattcctcgcagtagtaactccatttcttattcggttcgagttgtgtacttcgaaaagaactccacactttgatccttctttgtaacattcatgaagcttagattctttgaaaactccttgctttggtacttccgaagtctggattgtatgactgatgtaaacatgagttgcacaccttttctgtgatcttttatgagtagtaacaggttcagaaatctgcacagttaattattgacaacaacataggtatttgagtggagagcattatttaggactaagcaattttaacattataggggccagtcgtgcaagacagcgacaatggtcaatttgtgagtctttacctttctactagacgaacaagttaaagtttccatcaaatccaaagacaagcctggccacaatgcaagactttctgagaaaacaacagaaagatgtccaagaattagtcatatttatgtaaaaaaacttagcctatactttatcatcaacaaaataagaattcaccactattaaaaatgacattttgttgtttgtggaagcataccaacttttcctttttcattgatcaaatgctgtttttgctttttgtcctgaaatgtgaatgtatcacgccaataacatcagtactactaattcaaataattttgtttgaaagaaccatacaaactaagaaaattataatgcctactgcttctaattcaacatctggtttcctctcacattgtgaaatccgtgattgtccagtcatatttaatctgaaatatgatgacaaaacatgttaattgtaacacgccgacacgagtcttacattaatggatacaaaagacttgaaaactgaaaagtatagagatttcagaatgtaactgaaaaatactcaccccattgctagacacaattcagagtcatgcaatgcaactttgttgcaaaattcaagcttaacaatcccaggcatggtctgaagatttattgttggagtagtgctatgagatgccaccaataacttagctctctcagattgttcttgaccaatagtttcattaatagaagtgatttttgaagcttcaccatgtaaacaactttcaggacaaagagttccaccttgaccagttactgaggctagaatatatcgcaaaagaaaaaggaaaataaatatgcacgagttaataactaacaaggatcgcagcgcaggcaaatgaacacgcgtgaaaatagaagcttgcatttgtagcttttgtgatcataacaacaaacacaggctaagacaagtgttgtgggagagaataattattatgtaatagagaagggtgaaaataaccttcaatagcagcattagcattctccttcatgttctgcaaaactgaagagttctgtatcaaagattctccatctagtttcttacaaatgtgattggagccactttgaggaaacattccagccaaggcatacagagtctcagctacctcttcctcatcttttgtgatggacacagaaacttcttctctttgggaccagttttggaaaattccttgtttcta

SEQ ID NO: 3022 - DNA, 986 bp, Citrus clementina
ataaaaatcaaccagaccagctactgcttacgcggaaggaagaaaaaacactatcgtgatcgcgcactcaattttcgtcgttgtcaaattttcattcaatctatcaacaatgatccggttcatattgttacagaacaggcaaggaaagactcgtctcgccaagtactatgttcctctcgaggattccgagaaacacaaggtcgaatacgaggttcatcggttggtggtcaacagagatcccaagtttactaatttcgttgagtttcgtacacacaaggtaatctacaggcggtatgctggattgtttttctcgctttgtgtcgacataacagataatgaattggcatatttggagtgcatccatttatttgtggagatattggatcatttcttcagcaatgtctgcgagctagatttagtatttaattttcacaaggtttatctaatacttgatgaattcattcttgctggggagcttcaagagacaagcaagagggcaatcatagagcgaatgggggaactggagaagctagaatgaagagttatgatttagtaaagggtgttaaagtgaagtttggttttgccttttcacatttttccatttgatggattggttctattataatttgtttacctattttttgcacagccaatctttctctagtattctcagaaatcgaaaacccaatcctacggttgtattatcataaattgtacgaataacttgcgatttgctgtcattgtttgcgaggcaatcctcactgagtaaccagtaaaaaatgcatgcttgaagctgttgtccgtttatcattagttgaagatattcatggcttagagtattttaagagttagttcatctgtcgacttcattggatgttgtttgggtgtgtctctaatcctgtgcgaggaatctaatttctgcattgagccttttttttttatttgccaaatgcacatatctaccaaccagcggacatctctagcaa

SEQ ID NO: 3023 - DNA, 1065 bp, Gossypium hirsutum
caaacatgccataagtaattagtcatgttaattcttatctaaactcaagaatctgacttgattaacttgaaaacgataaatctaaaattatcgaaaaatacctggaatctaaaatgacttaacaagttaacctatcctaaaatagtcggaatcgaaaattatccaaataaaagaaaatttaaaatccaagtgatgtagaagtaaattcaacagatcaacggttaagaaacgccatcacacgagtctacccgtgtgtgttagtacacgctagtgtcttcttgtcatcttgtaaactttcaaatccttctgagtattcagccatctgtgaaaagagactttgaaaattataactttttggtacccaaaggctcgatttttgctattttgccaattaaaccctaaaattctttggttccaacaatgatccgattcgttttgttgcaaaacaggcaaggcaagactcgtttagccaaatactatgttcccctcgaagattctgagaaacacaaggtcgaatacgaggttcatcgattggtggttaatagagatccaaaatttaccaatttcgttgagtttcgtacgcataaggtaatttacaggcggtatgccggattgttcttctccttgtgtgttgacataaccgataacgagttggcatacttggaatgcatccatttatttgtggagatattggatcatttcttcagcaatgtttgtgagcttgacttggttttcaattttcacaaggtctatctgatactcgatgaattcattcttgctggagagcttcaagaaacaagcaaaaaggctataatagagagaatgggagagctggagaagctagagtaaagatgattctgcatgaaacagagattagtgcaatttgtgttgaattttctccatttgttgcttttctttttctgtgtgtgatattattaatttgtgtgcaatttgaaaactgaatacatggtgtccctttactcctgttttcctttgctacaatattgactaccaaaaatagagctgtgggacagtttttttaaggattgttgatatatatttgaa

SEQ ID NO: 3024 - DNA, 1102 bp, Cucumis sativus
attttgggtgcttcgttcctttgatccatcctctaacagaccaagccgaagggggagaaaattcaagcccagtggtattgaactttcaaaacaccaattcgccggcaacttgtgctccgaattcggcttccgtttcatctattttccttcctcattttcaagaatgatccggttcatacttttgcagaacaggcagggcaaaacccgtctcgctaagtattatgttcctcttgaggaatccgagaagcacaaggtcgagtatgaggttcatcgattggtggttaatagagatcccaagttcacaaatttcgtcgagttccgaacacacaaggtcatctatagaagatatgcaggattgtttttctctctttgtgtggacataacagacaatgagttggcctacctcgagtgtattcatttgtttgtggagattctggatcatttcttcagcaatgtgtgtgagctcgatttggtttttaattttcacaaggtctatctgatacttgatgaatttattctagcgggagaactccaagaaacgagcaaaaaggcgataattgaaagaatgggggaactggaaaagctggagtgaagatagtacacgttagagagctaagactgcaatttattttttgtggccgaatttattgtgttaatgatttgagtttaccttgttgtttcccccacagtatatttgtccgtgtgatcttgttgtgacaaatagaacaaaaaaaagttgaacaaaatttgaggtccctgcatctctcttgcatagtttttgaacatttccgaacatcaaccgtctataaatagtgaaatctacagaattcattcttgttgatatacttctagaatcaaagttgttatctcattaatttattacattcagaaaaaagaccatcttgattttaacatctttattttggatatctgtgatatgaaatcaaacatcatcatcatagaatcaacaagaatatctagggacacttgtgcctgccaccatgtgtggtcatattagcatagcagggacaaaaatcatagttgcctgaagtgcctggcggaacgcattgacagcgactgcaacaggttccacatgccctct

SEQ ID NO: 3025 - DNA, 811 bp, Cucurbita pepo
gatcaacgcaactctgtgcaccaaaattcgtcctccgataatcaacgcaactttgtgcaccaaaattcggcctccgacaatcaattggagttggattcgtggatcttccttcgtcattttcaagaatgatccgattcatacttttgcaaaataggcagggcaagacccgtctggctaagtattacgttcctcttgaggaatccgaaaagcacaaggtcgagtacgaggttcatcgattggtggttaatagagatcccaagttcacaaatttcgttgagttccgaacacacaaggtcatctacagacgatatgcaggattgtttttctccctttgtgtggacataacagacaacgagttggcctatcttgagtgtattcatttgtttgtggagattctggatcatttcttcagcaatgtgtgtgagctcgatttggtttttaattttcacaaggtctatctgatacttgatgaatttattcttgctggagaactccaagaaacgagcaaaaaggcgattattgaaagaatgggggaactggaaaagctggagtgaagataggacatgtcaaagagctaagattgcaatttgttttccgtgacagagttgattgtgttacgattccagttttctttgtttcccccacagtatatttgtccgtgtggtctttgttgtgacagatagagtcccttgcatcacctttgcatagtttttgaacatttcagaacatcaaccctctataaatagtgaaatctacagtattcattcttgttgatatacttctagaatcgaagttattatctcaattattc

SEQ ID NO: 3026 - DNA, 734 bp, Euonymus alatus
ggaacacagcgcatccgacattgtagatttcggctaatttcagagttcttacgttaattttttgttctttcttttcgttcgtgatctgtcaaagaatgatccgattcatacttcttcagaacaggcaaggcaagactcgtctggccaagtactatgttcctctcgaggattcagagaagcacaaggtcgaatacgaggttcatcggcttgtggtgaacagagatcccaagttcacgaatttcgttgagtttcgtacacacaaggtaatctacaggcggtatgctggattgttcttttccctctgtgttgacataacagataacgaattggcttatttggagtcaatccatctatttgtggagatattggatcattttttcagcaatgtttgcgagctagatttggtgtttaatttccacaaggtctatttgatacttgatgaattcattctcgctggggagctccaagaaacaagcaagaaggcaattatagagaggatgggggaactggagaagctggagtgaacggttatgttgtctgcctactcgttagattctgagtattactgtcttttccccaagccccactccttattgtgtgggtctcttttctttcttttttcccctctatgaacttaattcttcattgtactgtttatgtattttgtgctaccaattcttcccttgtaatatcttcaattgaattataaaattgcatggcaaaaactcactctt

SEQ ID NO: 3027 - DNA, 844 bp, Euonymus alatus
aataaaatttcttcgaatttgtaaaagcaaaaaacgaaaaaagtccatggggtgggaccgggagaatgaatgaaaactagccgttcgatcaacttcttctcttcttgcgagttttcaacattccgggctggacttgtggcggcaagcagagaacacatccgacattgttgagccgtagatatcggctgatttcacataattccgacgttaatttgtttttcttttctttcgtcatctgtcaaagaatgatccgattcatacttcttcagaacaggcaaggcaagactcgtctagccaagtactacgttccactcgaggattcagagaagcacaaggtcgaatacgaggttcatcggcttgtggtgaacagagatcccaagttcacgaatttcgttgagtttcgtacacacaaggttatctacaggcggtatgctggattgttcttttccctctgtgttgacataacagataatgaattggcttacttggagtgcatccatctatttgtggagatattggatcattttttcagcaatgtgtgcgagctagatttggtgtttaatttccacaaggtctatttgatacttgatgagtttattctcgctggggaactccaagaaacaagcaagaaggcaattatagagagaatgggagaactggagaagctggattgaacggttaagttgtggtacagcaagtctgagtacatgttagattctgagttatgctgtcttccccccgcccatattgtgaatttcttttctttttcttcaatgtactttgtttaccaattttgtgctactaatcatttgtaatttcttcaattgaatttgaaaattgcttg

SEQ ID NO: 3028 - DNA, 554 bp, Festuca arundinacea
ggcacgagggtcatcatcatcgcccagcatgatccgattcatcctgctgcagaaccggcaggggaagacgcggctggctaagtactacgtcccgctcgaggactcggagaagcacaaggtcgagtacgaggtgcatcggctggtggtcaacagggaccccaagttcaccaacttcgttgagttccgtacacacaaagttatttacaggagatatgcaggactatttttctcaatatgtgtggatatcaccgataatgagttggtatacttggaatgtatccacttatttgtcgagatattggaccatttcttcagcaacgtgtgtgaacttgatttagtgttcaacttccacaaggtttacttgatattggacgagtttattcttgctggagagcttcaagaaacaagcaaaaaggcgatcatagagagaatgggtgaacttgagaagctggattaagaagaaaaagtttaccccagcgtggcaaccaagcgcaagagcgaaaccactgccatggcggagaattttctccctttgtaccattctttgtagctgt

SEQ ID NO: 3029 - DNA, 1141 bp, Gossypium raimondii
caaacatgccataagtaactagtcatgttaattcttatccgaactcaagaatccgacttgattaacttaaaaatgataaatctaaaataatcaataaataaacctggaatctaaaatgacttaaaaagttaacctatcctaaaatagtcggaatcgaaaattatccgaataaaagaaaaattaaaatccaagtgatgtagaagtaattcaacagatcaacggttaagaaacgccatcacacgagtctacccgtgtgtgttagtacacgctagtgtcttcttgtcatcttgtaaactttcaaatccttctgagtattcagccatctgtgaaaagagactttgaaaattataactttttggtacccaaaggctcgatttttttctatttttgccaattaaaccctaaaattctttggttccaacaatgatccgattcgttttgttgcaaaacaggcaaggcaagactcgtttagccaaatactatgttcccctcgaagattctgagaaacacaaggtcgaatacgaggttcatcgattggtggttaatagagatccaaaatttaccaatttcgttgagtttcgtacgcataaggtaatttacaggcggtatgccggattgttcttctccttgtgtgttgacataaccgataacgagttggcatacttggaatgcatccatttatttgtggagatattggatcatttcttcagcaatgtttgtgagcttgacttggttttcaattttcacaaggtctatctgatactcgatgaattcattcttgctggagagcttcaagaaacaagcaaaaaggctataatagagagaatgggagagctggagaagctagagtaaagatgattctgcatgaaacagagattagtgcaatttgtgttgaattttctccatttgttgcttttctttttctgtgtgtgatattattaatttgtgtgcaatttgaaaactgaatacatggtgtccctttactcctgttttcctttgctacaatattgactaccaaaaatagagctgtgggacagtttttttaaggattgttgatatatatttgaagttaaaagtattatcgatgttaaaaatttatttattgataattatatatatatttaaaataatgttcttttaa

SEQ ID NO: 3030 - DNA, 740 bp, Leymus cinereus x Leymus triticoides
gctgtcgcgcgaattctcaagcgtggtcgtcatcatcatcaccgagcatgatccgtttcattctgctacagaaccggcaggggaagacgcggctggccaagtactacgtcccgctcgaggactcggagaagcacaaggttgagtatgaggtgcatcggctcgtcgtcaacagggaccccaagttcactaacttcgttgagttccgtacgcacaaagttatctacaggagatatgcaggactatttttctcaatatgtgtagatatcacggataatgagttggtatacctggaatgtatccacttatttgtggagatattggaccatttcttcagcaacgtgtgtgaacttgatttagtatttaacttccacaaggtttacttgatattggatgagtttattctcgctggagagctgcaagaaacaagcaaaaaggcgattatagagagaatgggtgaacttgagaagctggattaagaagaaactgtcttgccagcgtgcatggggagataactaaacgcaagagcaatacccgttccttctgccatgctggagaattttctccgtttgtacaattctcttgtagctgctatatgattacccctggttcatcaactttatttatggctgctttctagaaagaactttatgatggttgcttggtgggttttttggcggatcgttctgtaactatgtgccatcgaattccttgccatcttagcgcatttcattaaaaaaaaa

SEQ ID NO: 3031 - DNA, 809 bp, Lolium multiflorum
tcgagcggccgcccgggcaggtacgcggggccgactcattgcgatcccctcccagctcccaagctccaatctcgcgacttctcaaccgacatcatcatcgcccagcatgatccgattcatcctgctgcagaaccggcaggggaagacgcggctggccaagtactacgtcccgctcgaggactcagagaagcacaaggtcgagtacgaggtgcatcggctggtggtcaacagggatcccaagttcaccaacttcgttgagttccgtacacataaagttatctacaggagatatgcaggactgtttttctcaatatgtgtggatatcaccgataatgagttggtatacttggaatgtatccacttatttgttgagatattggaccatttcttcagcaacgtgtgtgaacttgatttagtgttcaacttccacaaggtttacttgatattggatgagtttattcttgctggagagcttcaagaaacaagcaaaaaggcgatcatagagagaatgggtgaacttgagaagctggattaagaagaaacagtttacccagcgtgacaactaagcgcaagagcaaaacatcgccatgctggagaattttctcccttgtacaattctttgtagctgtatgtgtgattatccttgttcctctacattttggacggctacatagtggggttagttgcagattgttctgcaacttggtttgtgaaatttccggttgaccatcaatgcttctcgtgttgatacatgcaacgttgttctgttgcaccatccagcggctgaacaatctggtgccaaggatggc

SEQ ID NO: 3032 - DNA, 847 bp, Zea mays
acatgtttttaccgattaatcgtgattaaacggaaatcggcgggggctggtttttgaggggttaccggtttggtgcgttttcatttccccgccgcctccagatcacgactctgtccttcccaattctcaggcaaccccgtcgtcttccgccatgatccggttcatcctgctgcagaaccggcaggggaaaacacggctggccaagtactatgtcgctctcgaggactccgagaagcacaaggttgagtacgaggtgcatcggctcgtggtcaaccgggaccccaagttcaccaacttcgtcgagttccgcacgcacaaagttatatataggagatatgcaggactttttttctctatatgtgtggacatcaccgacaacgaattggcatacttggaatgtatccatctgtttgttgagatattggaccatttcttcagcaatgtgtgtgaacttgatttagtatttaatttccacaaggtttacttgatattggatgagttcattcttgctggagagcttcaagaaacaagcaaaagggcaattatagagaggatgggcgagcttgagaagctggaatgaaaagaaacaatggtgtagtgtacattagcaatttagcataggtccggagctagttctgcccaatcgacaaattacctccatatttttcacaattctttgtacctgttgtgcatcatctttgcttcacttaaacctttatcaagccgtgaatcggtgtatgtctttttaacgtttcctgaggttactgagggtttttgaactgcatgtgaggattttagtttgatggcaaagcgaaagatccaccgcatgaagaaaggatatgtgtct

SEQ ID NO: 3033 - DNA, 930 bp, Medicago truncatula
aataacaataataataacgtcatcgtactccattgttgaaatcttgtttttcttcttctcttcagctgagagctaacattcttctccttattcgcaattcaaatcaaatgatccgattcattctgttgcagaatagacagggtaaaacccgtttagccaaatactatgttcctcttgaagattccgagaaacacaaggtcgaatacgaggttcatcgccttgtcgtaaatagagatcccaaatacactaatttcgttgagtttcgtacacacaaggtaatataccggagatatgctggactgtttttctcactttgtgttgacatcactgataatgagttggcatatttagagtgcatccatttgtttgttgaaatcttggatcacttcttcagcaatgtctgtgaactcgatttggtatttaacttccacaaggtctaccttatacttgatgaattcattctagcgggtgaactgcaagaaacaagcaagaaggctatcattgaaagaatgggggagcttgaaaaactagagtgaaacattacatttcagcagagtcacgacagggagactatgatgatttgctattgcaattggcgcgattcttgtattttaattgtgatacagaattttgacttttttcccacccttgagccatgtattatgtacacttccaaggtttcttaaatctcgtgttaatatattgtagacattcagaaagttggggttttaagtacccctttttcattatctgtgtgttctgttaaaacaatccattgtgcttctttgtagttagcaaaacaccagagatatagaactgtataattttacttcccccgtctcacaatgagtgatacacttgctcatttcacttgttaaggaacaactacaaatgaaaaaaaaagaaaatagtaatcttattacaccagta

SEQ ID NO: 3034 - DNA, 758 bp, Medicago truncatula
tgagagctaacattcttctccttattcgcaattcaaatcaaatgatccgattcattctgttgcagaatagacagggtaaaacccgtttagccaaatactatgttcctcttgaagattccgagaaacacaaggtcgaatacgaggttcatcgccttgtcgtaaatagagatcccaaatacactaatttcgttgagtttcgtacacacaaggtaatataccggagatatgctggactgtttttctcactttgtgttgacatcactgataatgagttggcatatttagagtgcatccatttgtttgttgaaatcttggatcacttcttcagcaatgtctgtgaactcgatttggtatttaacttccacaaggtctaccttatacttgatgaattcattctagcgggtgaactgcaagaaacaagcaagaaggctatcattgaaagaatgggggagcttgaaaaactagagtgaaacattacatttcagcagagtcacgacagggagactatgatgatttgctattgcaattggcgcgattcttgtattttaattgtgatacagaattttgacttttttcccacccttgagccatgtattatgtacacttccaaggtttcttaaatctcgtgttaatatattgtagacattcagaaagttggggttttaagtacccctttttcattatctgtgtgttctgttaaaacaatccattgtgcttctttgtagttagcaaaacaccagagatatagaactgtataa

SEQ ID NO: 3035 - DNA, 1271 bp, Cucumis melo
ctattttggatgattcgttcctttgatgctctcacagaccaagccgaagggggagaaaattcaagcccagtggtattgaacattcaaaacaccaattcgcccgcaattttgtgctccgaattccgcttccctttcatcgatcttccttcctcattttcaacaatgatccggttcatacttttgcagaacaggcagggcaaaacccgtctcgctaagtattatgttcctcttgaggaatccgagaagcacaaggtcgagtatgaggttcatcgattggtggttaatagagatcccaagttcacaaatttcgtcgagttccgaacacacaaggtcatctatagaagatatgcaggattatttttctctctttgtgtggacataacagacaacgagttggcctacctcgagtgtattcatttgtttgtggagattctggatcatttcttcagcaatgtgtgtgagctcgacttggtttttaattttcacaaggtctatctgatacttgatgaatttattcttgcgggagaactccaagaaacaagcaaaaaggcgataattgaaagaatgggggaactggaaaagctggagtgaagatagtacacattagagagctaagactgcaatttatttttcgtggccgaatttattgtgttgatgatttgagtttactttgtcccccccaagtatagttgtccgtgtgatcttgttgcgacaaatagaacaaagaaaagttgaacaaaatttgaggtccctgcatctctcttgcatagtttttgaacatttcagaacagaagccgtctataaatagtgaaatctacagaatccattattgttgatatatttctagaatcaaagttgttatctcattaatttattacattcagaaaatagactatctttattttaacatctttattttggatatctgtgatctgaaatcaaacatcatcatcataaaatcaacaagaatatctagggacacttgtgcctgccaccatgtgtggtcatattagcgtagcagggacaaacatcgtagttgcctgaagtgcctggcggaacgcattgacagcgagcgcaacaggttccacatgccctcttacagatcttctgcctcgacgataatcggcaccttgcatcacaagctttgccacaatctatctcttgaggaagagggttatccacctgagttgtgataatcatttggcctgattccataaggagcatagcaaaagcaatgagaagcataacaaacacaagacctttagttgctg

SEQ ID NO: 3036 - DNA, 863 bp, Pennisetum glaucum
gaccgaaaagaacagaaacgaaaaatcctcctcatttcgtccaccgcccccgaatcgtcgtgctcctgttcttctcgattgtcaagcattcacatcgtcctccaccatgatccggttcatcctgctgcagaaccgtcaggggaagacgcgactcgccaagtactacgttccgctcgaggactcggagaagcacaaggtcgagtacgaggtgcatcggctcgtggtcaaccgggaccccaagttcaccaacttcgttgagttccgcacacacaaagttatctacaggagatatgcaggacttttcttctcaatgtgtgtggatatcaccgacaatgagttggcatacttggaatgtatccatttgtttgttgagatattggaccatttcttcagcaatgtttgtgaacttgatttagtatttaacttccacaaggtctacttgatattggatgagtttattcttgctggagaactgcaagaaacaagcaaaaaggcaataatcgagcgaatgggtgagcttgataagctggaatgaggctgtgggggaagaggcgactgctgcggtgccccatggctgcttaccatctgtacaataatttgtaggtgttgtgcattatactttcgttgttccccatttcagatttcattggttggatgaatggtccatgccatcactatgtctcaaggactgttgcttacctgagattgcttgctagttacagaaagttcagtgttggtagtttctcagtgcggcaaggaaaaaaaattgtaccgtgttgagctctatatagagtatataaatgcagatattgtgactgaaaagcagacctcatggcgtatttggcttttttcagactgtgtag

SEQ ID NO: 3037 - DNA, 893 bp, Avena sativa
cagacccggcagaccaagaaacacaaacccgactcatcttccgttcccctcccagctcccaagctccaatctcacgacttctcaaccgtcaacgtcatcgcccaacatgatccggttcatcttgctgcaaaaccggcagggaaagacgcggctggccaagtactacgtcccgctcgaggactcggagaagcacaaggtcgagtacgaggtgcatcggctggttgtcaacagggaccccaagttcaccaacttcgttgagttccgcacacacaaagttatctacaggagatatgcaggactctttttctcaatatgtgtggatatcaccgataatgagttggtatacttggaatgtatccacttatttgtcgaaatattggaccatttctttagcaacgtgtgtgaacttgatttagtgttcaacttccacaaggtttacttgatattggatgagtttattcttgctggagagcttcaagaaacaagcaaaaaggctatcatagaaagaatgggtgaacttgagaagctggattaagaagaagcattgtactccagcatgcatggagagataactaagggcaagagtgaaatcatttccttccttaaccatgtcggagatttttcttcttttgtacaattatttgtagctgttgtggggtcttggttcatctacatttttccattccagagaaattttcttcttttgaacaattctttgtactccctcctgtccatattaatggcctcaactttatctagattacatatgtatcttgttaagtatttagactagatgcattcacaaagttaagaacattaatatggactcttaatatggaccggagggatgtaactcggttatcattatgtggaatttaaagccatgtttgtgc

SEQ ID NO: 3038 - DNA, 996 bp, Citrus sinensis
ataaaaatcaaccagaccagctactgcttacgcggaaggaagaaaaaacactatcgtgatcgcgcactcaattttcgtcgttgtcaaattttcattcaatctatcaacaatgatccggttcatattgttacagaacaggcaaggaaagactcgtctcgccaagtactatgttcctctcgaggattccgagaaacacaaggtcgaatacgaggttcatcggttggtggtcaacagagatcccaagtttactaatttcgttgagtttcgtacgcacaaggtaatctacaggcggtatgctggattgtttttctcgctttgtgtcgacataacagataatgaattggcatatttggagtgcatccatttatttgtggagatattggatcatttcttcagcaatgtctgcgagctagatttagtatttaattttcacaaggtttatctaatacttgatgaattcattcttgctggggagcttcaagagacaagcaagagggcaatcatagagcgaatgggggaactggagaagctagaatgaagagttatgatttagtaaagggtgttaaagtgaagtttggtttttccttttcacatttttccatttgatggattggttctattataatttgtttacctattttttgcacagctaatctttctctagtattctcagaaatcgaaaacccaatcctacggttgtattatcattaattgtacgaataacttgcgatttgctgtcattgtttgcgaggcaatcctcactgagtaaccagtaaaagatgcatgcttgaagctgttgtccgtttatcattagttgacttcatttagaagatattcatggcttagagtattttaagagttagttcatctgtcgacttcattggatgttgtttgggtgtgtctctaatcctgtgcgaggaatctaatttctgcattgagcctttttttttttttttgccaaatgcatatcaaccaaccagcggacatctctagcaa

SEQ ID NO: 3039 - DNA, 597 bp, Arachis hypogaea
aaagtaaagtgagtttcatttcattcatcaattgcagtttctcatcgtagattttgagtttctactgcttcctctctcaaattccttacatcgctcaacatgatccgattcattctgctgcagaacaggcaggggaaaacccgtttggcgaaatactatgtccctctcgaggattccgagaagcacaaggtcgaatacgaggttcatcgcctcgttgttaatcgagaccccaaatacactaacttcgttgagtttaggactcacaaggtaatatataggagatatgctggcttgttcttctctctatgtgttgacattactgataatgagcttgcttacttggagtgcatccatctatttgtggagattttggatcacttctttagcaatgtgtgtgagcttgacttggtcttcaacttccataaggtatatcttatacttgatgaattcattctagcgggtgaattgcaagaaactagtaaaaaggctatcatagagagaatgggggaactagaaaaacttgagtaaaatattacaatacattggcagtttggagtatttgatgattttggcccatgtatctcagcataattcttg

SEQ ID NO: 3040 - DNA, 986 bp, Oryza sativa
atttggtcaaaaatatagaagagatggctgacacaagggagacatttcagcaggtgtaaacccaaccaggcgaccaaccttccaaaaccaagagaaaatcgaaaagaaaaaaagaacgcatctttcctgcctttcctcctcccaaagctccaaatcgcgccccgccccccaaatccacgagcaccagcgatcgccgtcatcctccgccatgatccggttcatcctgctgcagaatcggcaggggaagacgcggctggccaagtactacgtcccgctcgaggactcggagaagcacaaggtcgagtacgaggtgcatcggctggtggtcaaccgggatcccaagttcaccaacttcgttgagttccggacgcataaagttatatacaggcgatatgcaggactgtttttctcaatgtgtgtggatatcactgacaatgagttggcatacttggaatgcatccacttgtttgtcgagatattagatcatttcttcagcaatgtgtgtgaactcgacttagtatttaatttccacaaggtttatttgatattggatgagtttattctcgctggagaacttcaagagacaagcaaaagggcaataatagagcgaatgggtgagcttgagaagctggaataagaagaaacggtgtacactagcgtacatgggcagatgatcaagagtgttgccatctctttctctgccgtgccaagacattgctctgcattttgtacaattctttgtagctattgtgttatacctagctcacctacattttcaccggctgttcatctgtgtaagtctcctttgttgcttggtgaggctactacacactgctagattgttctgttgattaccatggaatcagtcatctttgtgcatttgcttgaagtaatcatcattatagcaatctcttttttttcacctgtctgattgggagtctgatcttttgatgctgaatcaataatatgactgttttaagcaatct

SEQ ID NO: 3041 - DNA, 1377 bp, Secale cereale
tttatgtttttatgtgatcacggcatcaaaaagaaaatctgaatttttccacgaaagccggctcaaaaatatttgatcttaggtgtatttccctctgaaatattattgttcgggtgcgaccggactactaccaatcaattttttggaacttatttatagacttgtagaaaccctctacgtcacagctatttctccgtaccaaacccaacaaaccaagcaacacaaatctgattcattcccctcccaagctccaatcccgcgaattctcgagcgcggtcgtaatcatcatcacccagcatgatccgtttcatcctgttacagaatcggcaggggaagacgcggttggccaagtactacgtcccgctcgaggactcagagaagcacaaggttgagtatgaggtgcatcggctggtcgtcaacagggaccccaagttcactaacttcgttgagttccgtacgcacaaagttatctacaggagatatgcaggactatttttctcaatatgtgtagatatcacggataatgagttggtatacttggaatgtatccacttatttgtggagatattggaccatttcttcagcaacgtgtgtgaacttgatttagtatttaacttccacaaggtttacttgatattggatgagtttattctcgctggagagctgcaagaaacaagcaaaaaggcgattatagagagaatgggtgaacttgagaagctggattaagaagaaactgtgtcgccagcgtgcatggggagataactaaacgcaagagcaaaccccattccttctgccatgtcgacgatttttctccgtttgtacacttctgttgtagctgttatatgattacccctggttcaccaactttctttatggctgccttctagaaattgctgctttctacaaaaaatatattatgatggttgcttggtggggttcgttgtggatcgttctgtaactatgggattccttgccatctttgcccatttcattaagggcgtgtttggttcaagttgtaaacaattcatgcatcgcatatacttctcaacctagcctggttcagcaaaaaaggctctaatgcgccatctgcaagttgtttggttgcctgcatctagggtccttgcattaggtaatacacaagtgcactttgtcctgcagtggcccaagcggcacatgaacacggcgtacatggtgtgcttatcttgtaccctagttgtcgatgaactaggtgaagatgatgaagttcttcagcttcaacccaaactgacgatccaccttagcaccttccattttaacaccttcaatcttgtcattgtcaacactgctgtctttgtgctttcgcacttagttggagtaagctagttcggttgcaaaaaa

SEQ ID NO: 3042 - DNA, 724 bp, Silene vulgaris
ttaaaatgatccgattcattttgctgcagaatcggcaaggaaagacgcggcttgctaagtattatgttcctcttgaagattccgagaagcataaagtcgaattcgaggttcatcgattggttgttaacagagatccaaagttcaccaatttcgttgagttccggacgcacaaggttatctacagacgttatgcagggttatttttctccatgtgtgttgatatcacagataatgagttagcctaccttgaatgcatccatctttttgtggagatattggaccactttttcagcaatgtgtgtgagctggacttggtattcaacttccataaggtttacctgatacttgatgaattcattctcgcgggagagcttcaggaaactagtaaaaaggctatcattgagagaatgggcgaacttgagaaactcgaatgagtctgagtttaaggaaatctgctgcctcatcgttaatgaaatgatgtttaaattcatttttagctatttgccatgatttccattggatgtgtttgtactttacaccttgtaatctcattataggaacaaaaatgtgtcgcctttgtacatccttctgtgatcgtagttgagtgttcttttactgatgaatccgtggtactctccattgaatcgtgttttgtaaaaccttgtgctactactattttttgcgtagtttcttttgttattttgtatattacatttacaaaagt

SEQ ID NO: 3043 - DNA, 1048 bp, Sorghum bicolor
atataactgagacttttgagcaagtatacagcaaagccgcgatccggaagaacagagaaacgaaaactcgtactcatttctcccctcgctcccatatcacgccgctgcccttctcaattctcaggcatccccgtcgtcctccgccatgatccggttcatcctgctgcagaaccggcaggggaagacgcggctggccaagtactacgtcccgctcgaggactccgagaagcacaaggtcgagtacgaggtgcatcggctcgtggtcaatcgggaccccaagttcaccaactttgtcgagttccgcacacacaaagttatctacagaagatatgcaggactttttttctctatgtgcgtggacatcactgacaatgaattggcatacttggaatgtatccatttgtttgtcgagatattggaccatttcttcagcaatgtgtgtgaacttgatttagtatttaacttccacaaggtctacttgatactggatgagttcattcttgctggagagcttcaagaaacaagcaaaagggcaattatagagaggatgggcgagcttgagaaactggaatgaaaagaaacaacggtgtggtactgtggtgtacattagcataggtctggagctagttctgcccaattgacaagttacttccatatttttaacgattctttacctgttgtgcatcatctttgcttcacttaacctttctcaaactgtgaatcggtcgatgtggcttttttacgtttcctgagattaccgacggatttttaacttcatgtgaggattttaattccatggcaaagcaaaggatccactgtctgaagtgatctgataagtggccacttttgactccactaacctgagtaggcaaaaattttggattttggatactatagcactttcgtttgtttgtgataaatattgtccaattatagactaattagggttaaaagattcatctcgtgatttacaggcaaactatgtaattaatttttattttcgtttaaatttaatactccgtgcatgtaccgtaaaattcgatatgac

SEQ ID NO: 3044 - DNA, 930 bp, Glycine max
gtggtaatttgaatgttcaaagttgaatcaaagtcaagttaaagggcaaaacctgataaccgcaaaattaaaaattgaaaattaaaatttaaaacagatgttgaaagtaaagtcggtggtatgattcatcattctctttcagtttttggcattgaagaatctgagatcggaaaattcacctctccaacccccaatcccatcgttgcaaatgatccgattcattctgttgcagaacaggcagggcaagacccgtcttgccaaatactacgttcctctcgaggattccgagaagcacaaggtggaatacgaggttcaccgcctcgtcgtaaacagagaccctaaatacacaaatttcgtcgagtttcgtacgcacaagataatatacaggcgatatgctgggttgtttttctcaatctgtgttgatatcactgataatgagttggcgtatttagagtgcatccatttgtttgtggaaatattggatcacttcttcagcaatgtctgtgagcttgatttggtttttaacttccacaaggtctatcttatacttgatgaattcattctagcgggtgaactgcaagaaacaagcaagaaggctattattgagagaatgggggaactggaaaaactagaatgaaaaatcattagttttctgctgtcatattgatttggagatttcgatgatttactcatgcccttggcttaatgcttgtattttaattgtgataaagaattttgaaaatctcttccgatgagccatgtattaagtgccctttacatatgcttcttattcttattcgtatccggtttatgtttatatgtataagacatttataaaatcagggttttcagtaacctttatgttactgtctctgttttgtttcacttttctttctcttctaataaatttctttgctcttcttagtagtt

SEQ ID NO: 3045 - DNA, 1024 bp, Glycine max
taagttatttcaaggagtttttttataaaaaaaaaattgaacttaacatgcataagggtgttattatttttgaaaggcgtggtaatttgaatgttcaaagttgaatcaaagtcaagttaaagggcaaaacctgataaccgcaaaattaaaaattgaaaattaaaatttaaaacagatgttgaaagtaaagtcggtggtatgattcatcattctctttcagtttttggcattgaagaatctgagatcggaaaattcacctctccaacccccaatcccatcgttgcaaatgatccgattcattctgttgcagaacaggcagggcaagacccgtcttgccaaatactacgttcctctcgaggattccgagaagcacaaggtggaatacgaggttcaccgcctcgtcgtaaacagagaccctaaatacacaaatttcgtcgagtttcgtacgcacaagataatatacaggcgatatgctgggttgtttttctcaatctgtgttgatatcactgataatgagttggcgtatttagagtgcatccatttgtttgtggaaatattggatcacttcttcagcaatgtctgtgagcttgatttggtttttaacttccacaaggtctatcttatacttgatgaattcattctagcgggtgaactgcaagaaacaagcaagaaggctattattgagagaatgggggaactggaaaaactagaatgaaaaatcattagttttctgctgtcatattgatttggagatttcgatgatttactcatgcccttggcttaatgcttgtattttaattgtgataaagaattttgaaaatctcttccgatgagccatgtattaagtgccctttacatatgcttcttattcttattcgtatccggtttatgtttatatgtataagacatttataaaatcagggttttcagtaacctttatgttactgtctctgttttgtttcacttttctttctcttctaataaatttctttgctcttcttagtagttagtaaaacacttaata

SEQ ID NO: 3046 - DNA, 871 bp, Trigonella foenum-graecum
agaataacgtcgtcgtactccattgttgaaatcttcttgttcttctcttcagctgagtgctaatatctttctccttaatcgcaattcaaatgatccgattcattctgttgcagaacagacagggtaaaacccgtttagccaaatactatgttcctcttgaagattccgagaaacacaaggtcgaatacgaggttcatcgcctcgtcgtaaatagagatcccaaatacactaatttcgttgagtttcgtacacacaaggtaatatacaggagatatgctggactgtttttctcactttgtgttgacatcactgataatgagttggcatatttagagtgcatccatttgtttgttgaaatcttggatcacttcttcagcaatgtctgcgaactcgatttggtttttaacttccacaaggtctaccttatacttgatgaattcattctagcgggtgaactgcaagaaacaagcaagaaggctatcattgaaagaatgggggagcttgaaaaactagagtgaaacattacatttcagctgagtcacgacggggagattatgatgatttgctattggaattggcgcgattcttgtattttaattgtgttacagaattttgttttatccccacccttgagccatgtattatgtacacttccaaggtctcttaaatttcgtgttaatatgttgtagacattcagaaagttggggttttaagtaaccctttttcattatgtgtgttctgttaaaacaatccattgtgcttctttgtagttagcaaaacaccaaagatatagaaccttataattttacttccccgtctcacaatgagtgatacacttgctcatttcacttgttaaggaacaactacaaat

SEQ ID NO: 3047 - DNA, 1272 bp, Citrullus lanatus
tattttggctgcttcgctcccttgatcctcctcccacccagccgacgaggagaaattttgaacctgccagccagtggtacagtttcaaaacagcaattcgctggcaactttgatctccgaattcggccgccgatattcaatttgagctgctttcgtcgatcttccttcctcattttcaagaatgatccggttcatacttttgcaaaacaggcagggcaagacccgtctcgctaagtattatgttcctcttgaggaatccgagaagcacaaggttgaatacgaggttcatcgattggtggttaatagagatcccaagttcacaaattttgttgagttccgaacacacaaggtcatctacagacgatatgcaggattatttttctctctttgtgtggacataacagacaatgagttggcctacctcgagtgcattcatttgtttgtggagattctggatcatttcttcagcaatgtgtgtgagctcgatttggtttttaattttcacaaggtctatctgatacttgatgaatttattcttgctggagaactccaagaaacgagcaaaaaggcgatcattgaaagaatgggggaactggaaaagctggagtgaagatagtacatgttagagagctaagactgcaatttggttttcatgacaaaatttattgtgttactgattccagtttactttgtttccccatcgtatatttgtccgtgtggtcttgttgtgataaatagatcaaagaaaaaatttaagtcccctgcatctcccttgcatagtttttgaacatttcagaacatctataaatagtgaaatctacagaattcattcttgttgatatacttctagaatcaaagttgttatctcattaatttatgacattcagagaaaagaccgtcttgattttaacatctttatttgggatatctgtaatctgaaacccaacatcatcatcatagaaccagaagaatgtctagggacacttgtgcctgccaccatgtgtggtcatattggcatagcagggacaaacatcgtagttgcctgaagtgcccggtggaacacattgacagcgaccacaacaggttccacatgccctcttgcagaccttcggcctcgacgataatcggcacctcgcatcacaagcctccccacactatctcgcgaggaagagggttatccacctgagttgattaccatttggcctgattccataaggagcagcatagcaaaagcaatgagaagcatagcaaacacaagacctttagtcgctg

SEQ ID NO: 3048 - DNA, 1137 bp, Triticum aestivum
attcttagttaccctcaacctgacaccataagcaaccgagtcgtttgatgattacatgggtatgagctttgacagaactagttccctcgtgccgaattcggcacgaggaaagaattcacagaagttaaattaacgcatgcaagagcaatactggcgtggttggagaggaagccgaggcaccacttttcaacggtgaacccacccacagctcattctgcataacccaacaaaccaagcaacacaaatccgattcattcccctcccaagctccaatcccgcgaattctcaagcgtggtcgtcatcatcatcacccagcatgatccgtttcatcctgttgcagaatcggcaggggaagacgcggctggccaagtactacgtcccgctcgaggactcagagaagcacaaggttgaatatgaggtgcatcggctggtcgtcaacagggaccccaagttcactaacttcgttgagttccgtacgcacaaagttatctacaggagatatgcaggactatttttctcaatatgtgtagatatcacggataatgagttggtatacttggaatgtatccacttatttgtggagatattggaccatttcttcagcaacgtgtgtgaacttgatttagtatttaacttccacaaggtttacttgatattggatgagtttattctcgctggagagctgcaagaaacaagcaaaaaggcgattatagagagaatgggtgaacttgagaagctggattaagaagaaactgtgtcgccagcgtgcatggggagataactaaacgcaagagcaaaacccattccttctgccatgtcgaagaattttctccgtttgtacaattctgttgtagctgttattatgattacccctggttcaccaactttatggctgccttctagaaatggctgctttctagaaaaaacattatgatggttgcttggtggggttcgttgtggatcgttctgtaactaggtgccatggaattccttgccatctttgcgcatttcattagcaatcatgatggcagtcttttttccaatcattagagcatgcatgtctagagaacccacgatgtttgaagcaatctgttgcactattccttgggctaaagatcgcaatgatgtcgtttcatc

SEQ ID NO: 3049 - DNA, 630 bp, Hevea brasiliensis
gtttctcttcgcaattgaaaccgagattttgatctttctttcctttggcagatccgattcatacttctgcagaacaggcaaggcaagactcgtcttgccaaatactatgttcctctcgaggattccgagaaacacaaagtcgaatacgaggttcatcggttggtggttaacagagatcccaagttcacgaattttgttgagttccgaacacacaaggtcatctacaggcggtatgctggattatttttctcactgtgtgttgatataacagataatgaattggcatatttagagtgcatccatttatttgtggagatattggatcatttcttcagcaatgtttgtgagctagatttggtattcaactttcacaaggtttatttgatacttgatgaattcattcttgctggggaactccaagaaacaagcaagaaggcaatcatagagagaatgggggaattggagaagctcgagtaaacacgttctgtagttagagcatttagagatttcatttttccttgttcttccgcccagctttgttttgttctggttctgcatttattcgtttgttcatttggtaaaaccattacttcgcttgtaatatttgaaaatcaaggcggaaatttccac

SEQ ID NO: 3050 - DNA, 1421 bp, Phaseolus coccineus
aagtgataattggaagtgtttattcgaaattaatttgaatgttgaaacttgaagaaagtgaagtatgggcaaaacccttgtctctctcgtctgcgtcattacacgctagctgcatcgcaataacaaaataaaaataataaaaataaataaataaataaaagagagagagtttcaaagtaaagtcgttggaatgatcatcttcttcgtctctcgcacttcacattgaacgaagaagctcagatacattccacaattcacctctttcagcaaccctaattcatcgtcgcaaatgatccgattcattctgttgcagaacagacagggcaagactcgtcttgccaaatactacgttcctcttgaggattccgagaagcacaaggtcgaatacgaggttcatcgactcgtcgtaaacagagaccctaagtacaccaatttcgtcgagtttcgtacgcacaagataatatacaggcgatacgctggcttatttttctcactctgtgttgatatcactgataatgaattggcatacttagagtgcattcatttgtttgtggaaatactggatcacttcttcagcaatgtgtgtgagcttgatttggtttttaacttccataaggtctatcttatacttgatgaattcattctagcgggtgaactgcaagaaacaagcaagaaggctatcattgagagaatgggggaattagaaaaactggagtgatgcattaattttctgcagtcataaaagtttggaggtttcgttgacctgctcttgcccttggcgtaattcttgtatttcaattgtgatacagaattttgaaaatattttttcttgagccgtgtaatcggtaccctttacctacgcatcttactcggcttatgtttatatttgtaagacattcatcaaatcagggttttcactagcctttcttttattgtctatttctgttttttttttctttgctcgtcttgacagtttgtaaaacacttaatggaatataaccggacaattgtagtatataagcaatgaaaatcgattgactttgatggtacagatgagccatcagggaacaaatactggtgttttattttcagttagatgatgctagtgtcctgcaaaatgaaaaaagatttgggggcaatccttctaagtttgatgtcttgctacactagttctgtgctgctctctacgtcttgcaatgaattagacacatactatcggttggggatatcttagtgcaaataaagagttttgttctacttttaacatgaagggtgtagctctagaagctgcgcgtgtagaaatataaaacaatgaatcgtatttatgttgctcatcatgactttacaatcgatttggcagtcacattgtcgcactacttgggagtgtgtctctaatttcttcacataatgaagggagatga

SEQ ID NO: 3051 - DNA, 1420 bp, Phaseolus coccineus
aagtgataattggaagtgtttattcgaaattaatttgaatgttgaaacttgaagaaagtgaagtatgggcaaaacccttgtctctctcgtctgcgtcattacacgctagctgcatcgcaataacaaaataaaaataataaaaataaataaataaataaaagagagagagtttcaaagtaaagtcgttggaatgatcatcttcttcgtctctcgcacttcacattgaacgaagaagctcagatacattccacaattcacctctttcagcaaccctaattcatcgtcgcaaatgatccgattcattctgttgcagaacagacagggcaagactcgtcttgccaaatactacgttcctcttgaggattccgagaagcacaaggtcgaatacgaggttcatcgactcgtcgtaaacagagaccctaagtacaccaatttcgtcgagtttcgtacgcacaagataatatacaggcgatacgctggcttatttttctcactctgtgttgatatcactgataatgaattggcatacttagagtgcattcatttgtttgtggaaatactggatcacttcttcagcaatgtgtgtgagcttgatttggtttttaacttccataaggtctatcttatacttgatgaattcattctagcgggtgaactgcaagaaacaagcaagaaggctatcattgagagaatgggggaattagaaaaactggagtgatgcattaattttctgcagtcataaaagtttggaggtttcgttgacctgctcttgcccttggcgtaattcttgtatttcaattgtgatacagaattttgaaaatattttttcttgagccgtgtaatcggtaccctttacctacgcatcttactcggcttatgtttatatttgtaagacattcatcaaatcagggttttcactagcctttcttttattgtctatttctgtttttttttctttgctcgtcttgacagtttgtaaaacacttaatggaatataaccggacaattgtagtatataagcaatgaaaatcgattgactttgatggtacagatgagccatcagggaacaaatactggtgttttattttcagttagatgatgctagtgtcctgcaaaatgaaaaaagatttgggggcaatccttctaagtttgatgtcttgctacactagttctgtgctgctctctacgtcttgcaatgaattagacacatactatcggttggggatatcttagtgcaaataaagagttttgttctacttttaacatgaagggtgtagctctagaagctgcgcgtgtagaaatataaaacaatgaatcgtatttatgttgctcatcatgactttacaatcgatttggcagtcacattgtcgcactacttgggagtgtgtctctaatttcttcacataatgaagggagatga

SEQ ID NO: 3052 - DNA, 1026 bp, Brachypodium distachyon
ccaaatatatagccttccccggacggaccccagaagcgaagcaaaggctctttgtttctgcccccaaaaatcgttctgtaaatcaacccaacccgattcctaatctgatttcgatatgatccggttcatcctgctgcagaaccggcaggggaagacgcgcctggccaaatactatgtgccgctcgaggattccgagaagcacaaggtcgagggcgaggtgcaccggctggtggtcaaccgggaccccaagttcaccaactttgtcgagtttcgcacccacaaagttatctacaggagatatgctggactattttttgcaatttgtgtggatatcactgacaatgagttggcatacttggaatgcatccacttgtttgttgaaatattggaccatttcttcagcaatgtatgtgagcttgatttagtatttaattttcacaaggtttacctgatattagatgagtttattcttgctggggagctgcaggagacaagcaaaaaggcaatcatagaaaggatgggcgaactggagaagctggactaaagataaattctctgcagagagagccattccgtcctcctgtttgaggatttctacaatcgtagctcatgtgcataaatatctaaaatttgtccgacatgcctgacaagaatgttgtactgttggtccattgtcgttagtattaatttgctgctcttatgatcatggtctcattgcttcttggccaacaaactgcttgtagaattgatgtgtggtctacatgaggatatatcctaagttgtaaggctagagtcatgtcatgcaaaagaaaagaatggtatccattattcgacattgccatctggaactagggtgcgtttttttattggaaggccgagagatgagctcattgcctgtttgattgaaggtgtataacctgtgtacggtgagattaccaacccacccatgtataaattacatacagccatggctctcacgtggaatctgttcgatgttctgaaaaacacaaatagcgattctttgat

SEQ ID NO: 3053 - DNA, 787 bp, Cleome gynandra
ttcgggtattcaactgctcagaaaattcaaagccagagctgagaaaacaaaagaaaacggaagaaagtgtgagaaaaaaattcatttgatttttcttctcccgtctaccgagaagttctgcggaaatctctgttcgttgaaagccagaggatatgatccgattcatcttattgcagaacagacaaggtaagactcgtcttgccaagtattatgttcctctcgaggattctgagaaacacaaggtcgaatacgaggttcacaggttggtggtgaatcgggacccgaagttcacgaattttgtcgagtttagaacccacaaggtaatataccgacgatatgcgggattgtttttctcgctatgtgtcgatataacagacaatgaattggcgtacttggagtgcatacatttattcgtggagatattggatcatttcttcagcaatgtgtgtgagctagatttggtgtttaattttcataaggtatatttgatactagatgaattcatcctagccggggaacttcaagaaacaagcaaaagggcaatcattgaaagaatggcagaactggagaagctagagtgattaaaatttctcaagatctgattcctacatggtaaatcttttgctttctcccgagattcttatttctccctcctgtgatctcttttaaacgtgtgagactggtttgatgacggcaggcattttatttaacgaaatatgatgcatatatcatgtttgtttctgttgttatggtcagatgagttttattgaacttagtctgcaattgc

SEQ ID NO: 3054 - DNA, 712 bp, Cleome spinosa
aaacagagactgctgagaaaattcgaacccagaggagagcccagaaaacgaaagaaaagggaagaaaggggcagaaaaatcatttgatttgtcttctctgattaccgagaagttctgcggaaatctctgctcattcgttgtcccctgaaaattccaagaaaatgatccggttcatcttgttgcagaacagacaaggtaagactcgtcttgccaagtattatgttcctctcgaggattccgagaaacacaaggtcgaatacgaggttcacaggttggtggtgaatcgcgaccccaagttcacgaattttgttgagtttagaacacacaaggtaatataccggcgatatgcggggttgtttttctcgctgtgtgttgacataacggacaatgagttggcgtacttggagtgcatccatttattcgtggaaatattggaccatttcttcagcaatgtctgtgagctagatttggtttttaatttccacaaggtttatttgatacttgatgaattcatcctagccggggaacttcaagaaacaagcaaaagagcaatcatcgaacggatggcggagcttgagaagcttgagtgatcgaaatttcctcacgtcgtcagtcctccagggatttccggcttctccctcatctgtgtatcgtcgttttctcttctctcttttaacatgtgtgggctggctggtttgatgacgatgatgat

SEQ ID NO: 3055 - DNA, 850 bp, Vigna unguiculata
ataacagagcgtttcaaagtaaagtcgttggtatgatcatcttcttcgtctctcgcatttgagataaattgcacaaattaccctctccggaaccctaaatcatcgtcgcaaatgatccgattcattctcttgcagaacagacaaggcaagacccgtcttgccaaatactacgttcctctcgaggattccgagaaacacaaggtcgaatacgaggttcatcgcctcgtcgtaaacagagatcctaagtacactaatttcgtcgagtttcgtacgcacaagataatatacaggcgatacgctggcttgtttttctcactctgtgttgatatcactgataatgaattggcatacttagaatgcattcatttgtttgtggaaatactggatcacttcttcagcaatgtgtgtgagctcgatttggtttttaacttccataaggtctatcttatacttgatgaattcattctagcgggtgaactgcaagaaacaagcaagaaggctatcattgagagaatgggggaactggaaaaactggagtgatacattaattttctgcagtcgtagcagtttggaggtttcgatgacatgctcttgcccttggcgtaattcttgcatttcaattgtgatacagaattttcaaaatattttttcttgagccgtgtattcagtaccctttacctacgcatcttattcggcttatgtttatatttgtaagacgttaatcaaatcagggttttcaatagcctttcttttattgtcgatttctattttgtattttttttttaatttatttgctcgtcttgacagtttgcaaaacacttaatagaatataagtgggcaattgtagtgt

SEQ ID NO: 3056 - DNA, 915 bp, Vigna unguiculata
gggtctctcgtctgcgtcgtcattacacgctagcagcatcgcagaaacaaaataacaataataaataacagagcgtttcaaagtaaagtcgttggtatgatcatcttcttcgtctctcgcatttgagataaattgcacaaattaccctctccggaaccctaaatcatcgtcgcaaatgatccgattcattctcttgcagaacagacaaggcaagacccgtcttgccaaatactacgttcctctcgaggattccgagaaacacaaggtcgaatacgaggttcatcgcctcgtcgtaaacagagatcctaagtacactaatttcgtcgagtttcgtacgcacaagataatatacaggcgatacgctggcttgtttttctcactctgtgttgatatcactgataatgaattggcatacttagaatgcattcatttgtttgtggaaatactggatcacttcttcagcaatgtgtgtgagctcgatttggtttttaacttccataaggtctatcttatacttgatgaattcattctagcgggtgaactgcaagaaacaagcaagaaggctatcattgagagaatgggggaactggaaaaactggagtgatacattaattttctgcagtcgtagcagtttggaggtttcgatgacatgctcttgcccttggcgtaattcttgcatttcaattgtgatacagaattttcaaaatattttttcttgagccgtgtattcagtaccctttacctacgcatcttattcggcttatgtttatatttgtaagacgttaatcaaatcagggttttcaatagcctttcttttattgtcgatttctattttgtattttttttttaatttatttgctcgtcttgacagtttgcaaaacacttaatagaatataagtgggcaattgtagtgta

SEQ ID NO: 3057 - DNA, 690 bp, Cyamopsis tetragonoloba
cgagatttcaaaattcagttcttcattccctcaagttcaaatcgatttctgcatcgctagaaatgatccgattcatcttgttgcagaacaggcaaggaaaaacccgtctagccaaatactacgttcctctcgaagattccgaaaagcataaggtcgaatatgaggttcatcgcctcgttgtaaacagagaccccaaacatacgaatttcgttgagtttcgaacccacaagataatctacagaagatatgctggcttgtttttctctctttgtgttgacatcactgataatgagttggcttatttagagtgcatacatttatttgtggaaatattggatcacttcttcagcaatgtctgtgaactcgatttggtttttaacttccacaaggtctatcttatacttgatgaattcatcctagcgggtgaactacaagaaacaagcaagaaggctatcattgagagaatgggggagctggaaaaactagaatgaaacattaacgtcgtggcagaatcataatggtttggagattctgatgatatgctcatgcacttggcacagttcttgtaattcatttgtgatacagaattttgaaaatcttttgccttgagccatgtattcagtacattttacgtaggcttcttccttggcttgtgtttatataatgaagacattcttaagatccctcgtg

SEQ ID NO: 3058 - DNA, 761 bp, Cynodon dactylon
tcctccctctccttcgatcccaaatcgcgcccaagttcttccgagttctcaagcgtcatcgtcgacgctcaccatgatccggttcatcctgctgcagaacaggcaggggaagacgcggctggccaagtactacgtcccgctcgaggactccgagaagcacaaggtcgagtacgaggtgcaccggctcgtggtcaacagggaccccaagttcactaacttcgtcgagttccgcacacacaaagttatctacaggagatatgcaggactgtttttctcaatgtgtgtggatatcactgacaatgagttggcatacttggaatgtatccattcgtttgtggagatactggaccatttcttcagcaacgtttgtgaacttgatctagtatttaacttccacaaggtttacttaatactggatgagtttatccttgccggagagcttcaagaaacaagcaaaagggcaattatagagaggatgggcgagcttgagaagctggaataaggacagtttagttatttagtggtgtacattgtgtagcgggatataagcagtaattggtttgtcctgcattcctgccctaccaacaaatccacttttttttttgtacaattctttgtagctgttgtgcaaccatcagttttgcactttttgcggactgcaaatatgtgtaacgttccctggttgaggtttgtgacagattgttaaataccccttccacatttggtggaccccatttgagttttggcgaagtaaaatacag

SEQ ID NO: 3059 - DNA, 957 bp, Setaria italica
acagcaaaccagccttcacgcccccgatcagaaacagaaacgaaaaatcctcctcatttcgtcccccgccctcgaatcgcgcccctgttcttcccgattctcaagcattcacatcgtcctccgccatgatccggttcatcctgctgcagaaccgccaggggaagacgcggctggccaagtactacgtcccgctcgaggactcggagaagcacaaggtcgagtacgacgtgcatcggctcgtggtcaaccgggaccccaagttcaccaacttcgtcgagttccgtacacacaaagtcatctacaggagatatgcaggactctttttctcgatgtgtgtggatatcaccgacaatgagttggcatacttggaatgtatccatctgtttgtcgagatattggaccatttcttcagcaatgtttgtgaacttgatttagtatttaacttccacaaggtctacttgatattggatgagtttattcttgctggagagcttcaagaaacaagcaaaagggcaattatagagaggatgggcgagcttgagaagctggaatgagaagaaaaaaaaaatgttgtgatgtacattagcctaggtcgcgatataatcagtgccgagcctgttctgccctatattcaagtcaccttcatttttatgtacaattctttgtacctgttgtgctattatctttacttcatttgaacctttcacgaactgcgagcctgtaagtgttattttatcattttgagaggttaatgacggattttttgagccaccttccatgtgaagatatgaatctgatctcatgcaaagctacagaccatcactgtttgatcttttaagtgcacagttttaacactactgatcattgtctgctactgagagtaagagtttgctcttatgtctatggtgaaagatcggtgctatcaagataattttaatgagtgaacctttgtgtgtg

SEQ ID NO: 3060 - DNA, 860 bp, Lotus japonicus
ggatcatcgtccctttgcatttgcatttgcagttgcagttgaaaacaacctcagcggggctacgtcgtttcccccaaatccctaaattgcaaatcgatttctatatcaaatgatccgattcattctgttgcagaatcgccaggggaagacccgtttagccaaatactacgttcctctcgaggattccgagaagcacaaggtcgaatacgaggttcatcgcttagttgtaaacagagaccccaagtacaccaatttcgttgagtttcgtactcacaagataatatacaggcgatatgctggcttgtttttctcgctctgtgttgacatcactgataatgagttggcttatttagagtgcatccatttatttgtcgaaatattggatcacttctttagcaatgtgtgcgagctggatttggtttttaacttccacaaggtctatcttatacttgatgaattcattctagcgggtgaactgcaagaaactagcaagaaggctatcattgagagaatgggggaactggaaaaactagagtgaaatattacatttctgcagaatcatagtggttgggagattctcacaattttctcatgcacttggcatgattcttgtgtttcaattgtgattcagaattttgaaaatattttcccttgagccatgtattcagcacgctctgcctaggcttcttactcggcttgtgttaatacattgaagacattcacattcatatgatcaggttttcttgtaacctttattccattgtctcttttgtttgttaaagagtttctttgcacttcttggtggtttgtaacattccagagaaaaataactttaataactataatgtataagcataaca

SEQ ID NO: 3061 - DNA, 952 bp, Eragrostis curvula
  misc_feature (47)..(48): n is a, c, g, or t
  misc_feature (814)..(815): n is a, c, g, or t
  misc_feature (821)..(821): n is a, c, g, or t
  misc_feature (826)..(826): n is a, c, g, or t
  misc_feature (841)..(841): n is a, c, g, or t
  misc_feature (845)..(845): n is a, c, g, or t
  misc_feature (847)..(847): n is a, c, g, or t
  misc_feature (850)..(850): n is a, c, g, or t
  misc_feature (862)..(862): n is a, c, g, or t
  misc_feature (864)..(865): n is a, c, g, or t
  misc_feature (869)..(869): n is a, c, g, or t
  misc_feature (874)..(874): n is a, c, g, or t
  misc_feature (878)..(878): n is a, c, g, or t
  misc_feature (885)..(885): n is a, c, g, or t
  misc_feature (887)..(888): n is a, c, g, or t
  misc_feature (891)..(891): n is a, c, g, or t
  misc_feature (904)..(904): n is a, c, g, or t
  misc_feature (907)..(907): n is a, c, g, or t
  misc_feature (909)..(909): n is a, c, g, or t
  misc_feature (916)..(916): n is a, c, g, or t
  misc_feature (919)..(919): n is a, c, g, or t
  misc_feature (921)..(921): n is a, c, g, or t
  misc_feature (924)..(924): n is a, c, g, or t
  misc_feature (932)..(932): n is a, c, g, or t
  misc_feature (936)..(936): n is a, c, g, or t
gcgggctgcgccctgcgccaaacgggggacagagtattgctcttccnnaaaaaaaaagaaaagaaaaagaaaaatagagtattgcccttccttctcccaaacccaaactgacggcagaatcagcctaaagcctcgctcgattcccgagctattgacgaaatgatccggtttttactgctgcagaacaggcaggggaagacgcggctggccaagtactacgtcccactcgaggattcggagaagcacaaggttgagtacgaggtgcatcagctggtggtcaatcgggaccccaaattcaccaacttcgtcgagtttcgcacgcacaaagtcatctacagaagatatgcaggattgtttttctccatatgtgtggatataactgacaatgagttggcatacttggaatgcatccacttgtttgtcgaaatattggatcatttcttcagctacgtctgcgagcttgatttagtttttaattttcacaaggtctaccttatattagatgagtttattcttgctggagagctgcaagaaacaagcaaaaaggcaattattgagcggatgggtgaactagagaaactggaatgagaatgcacgggaagaggaatctggcagccactcctgttcccgtgttgttcaatttgtacaattcgttgtaaattttccttgttttccattcgggattgaccagttgggagttcatgaaaggccgtatattcctttttctttcggcgaatgtgagtgcgattacttgccaactacggtgaaatttacaaaaaaaaaaaaaaaaaaaaaaaaaaaaaaagtccccggnnttaaanccccngcttaaccccaaggnaatncncgncccccggcgggncnnccanagggnaaancccccancnngtnggaggcaaacctngantnttcttanggncnccnaaaaagcngggnaaactcgaagccgggt

SEQ ID NO: 3062 - DNA, 756 bp, Tropaeolum majus
aacattgcccaaaatgaaatagactggaattgaagaaattgaatattgacgattaaagagtgatttttctacattttccgagccttttggttttcttcatctgcgcgcaatttgtcaattgatcttcaatttgttttcaaaatgatccgattcatactgctacaaaacagacaaggcaagactcgtctcgccaagtactacgttcctttggaggattctgagaaacacaaggtcgaatatgaggtccatcgtttggtggtaaacagagatccaaaatttacgaatttcgtcgagtttcgtacacacaaggttatctatcggcgatatgctgggctgttcttttcattgtgcgttgacataacggataatgagttggcatatttggagtgcatccatttatttgtggagatactggaccatttcttcagcaacgtgtgtgagctagatttggtatttaattttcataaggtttatctgatacttgatgaattcattcttgctggggagcttcaagaaacaagcaagaaggcaattatcgagagaatgggggagctagataagctagattgaagaatgtcctgtaccaaaagagagtttaaaagcatgcacttccaatccgagtctaacactgcagttgttataagctggtgcggattttctatatccactgtactatgaaaaaattcttgaaataactttactgtttatagcttgttgtgtgtggttgtgtactgtgtgatcaatggcttcttatta

SEQ ID NO: 3063 - DNA, 705 bp, Avena sativa
ttgagaagaggaaacgaagggggttcttattctctctcccgaacctaaatcgctttccaaatcgctccccgattacgaatctgatcttacgacatgatccggttcatcctgctgcagaaccggcaggggaagacgcggctggccaagtactacgtcccgctcgaggattccgagaagcataaggtcgagtacgaggtacaccggctggtggtcaatcgggaccccaagttcaccaatttcgtggagtttcgcacacacaaagttatctacaggagatatgctggactattttttgcaatttgtgttgatatcacggacaatgagttggcatacctggaaagcatccacttgtttgttgagatattggaccatttcttcagcaacgtctgtgagctagatttagtatttaattttcacaaggtttacctgattttagatgagtttattcttgctggagagctgcaagagacgagcaaaaaggcaataatcgagaggatgggtgaactggagaagctggactaagagccgatgcagccattctaacctctgcttgcagaatgtacacagttatcatactcctatgtctgtacaattctgtatagttctttgtttgtttatccccggtgtgttgtgagtttgctggtgctagaacttgtaagaggccaacaacagtattttcaaaccaaatataatcgtatttattta

SEQ ID NO: 3064 - DNA, 872 bp, Elaeis guineensis
attcggtaccgggaaaagccctcgtccacctttctctctctctctcgccttccaacgggaaattcccttctctggcctctcgcgtcctccttacgatatgatccgcttcatattgctgcagaatcggcagggcaagacgcgcctggccaagtactatgtccccctcgaggattctgagaagcacaaggttgagtacgaggtccatcggcttgtggttaacagggatcccaagttcaccaactttgttgagttccggacacacaagattatttacagaagatatgcaggacttttcttttcaatgtgtgtcgatatcactgacaatgagttagcatacttggagtgcatacatttatttgtggagatactggatcattttttcagcaatgtgtgtgaactagatttggtatttaacttccacaaggtatatctcatattggatgagttcattcttgctggggagcttcaagaaacaagcaagaaggctattattgagaggatgggggagttggaaaagcaagaatgaaaacagggttaggagaagactggaaattcattcttgaattgttactgatatatactgtatcctgcagtccagttctggagctggtctggctattgcatctaagagaattggagggagaacaaaaaagaggtgttacttgtttaacagttattgattagtgtaccgtgtcagttgtgggcctgcatgattccttcattatgtatactatcatattttttgtcactgtatgtcatgtttcattttatgtactatctcgagatgcatatgaaattggattaggctttgtggctgtttaatctactggtcagatctatattgagtttatatgataatgagattgtgaaaa

SEQ ID NO: 3065 - DNA, 824 bp, Elaeis guineensis
ctgccattgccaacctaaacctgttccgtaagagccgcacggcgacttaccgagcgcaaaacaccagttgatccaataagcttcgacacgtaatgttacaggtgggagaagccagaggaagcgagtccaaggtccaacaacaagagggctcggcatatcaaacgaagactctcgactccgagatcggaaccaggaaaagccctcgtccggcctccatctcccctctcccgtctccccggaaatctcctctctctattctctctcgaacgatatgattcgcttcatattgctgcagaatcggcagggcaagacgcgcctggccaagtactacgtccccctcgaggattccgagaagcacaaggtagaatacgaggtccaccgattggtggtcaacagggatccgaagttcaccaatttcgttgagttccgcacgcacaaaattatctacagaagatatgcaggactcttcttttcaatgtgtgttgatatcactgacaatgagttagcatacttggaatgcatccatctatttgtggagatactggatcattttttcagcaatgtgtgtgaactagatttggtatttaattttcacaaggtatatctcatattggatgagttcattcttgctggtgagcttcaagaaacaagcaaaaaggcaattattgagaggatgggggagttggaaaagcaagaatgaaaactggataaagagaagactgggaatccatactggaattgttattggtatacactgtaccagtccaattttggagctggttacatcatcattgcacctaagaggattgggaggaaaacaaaac

SEQ ID NO: 3066 - DNA, 1342 bp, Cajanus cajan
gagccaactgagaagggtaatttgaacgttgaaagtcaagtaagggcattgtcattagacgctagctaaagaaaattagaaataaaaacaaagtaaagtggttcgtggttgtttgatcatctcttgcagttggcattgcaattgcaactgagaacgctaaattcgcctttcctccaccctcgcaaatgatccgattcattctgttgcagaaccggcaaggcaagactcgtcttgccaaatactacgttcctctcgaggattccgagaaacacaaggtcgaatacgaggttcaccgcctcgtcgttaacagagaccctaaatacactaatttcgtcgagtttcgtacgcacaagataatatacaggcgatatgctggtttgtttttctcgctgtgtgttgatatcactgataatgagttggcgtatttagagtgcatccatttgtttgtggagatattggatcacttcttcagcaatgtctgtgaactcgatttggtttttaacttccacaaggtctatcttatacttgatgaattcattctagcgggtgaactgcaagaaacaagcaagaaggctatcattgagagaatgggggaactggaaaaacttgagtgatacattatttttagcagtcatagcggcttggagatttcgatgatttgctcatgcatttcacataattcatgtatttcaattgcgtacagaattttgaaaatcctttcccttgagctatgtattcagtattctttacttacgcttcttactcgggttatgtttatatattgaagacatttataaaatcagggttttcagtagcctttcttgtattggtcttttgttttgtttcttttctattttcaaatttctttgcacttttggtaattaggaaaaaagttgacggaaatatcactggataattgtaatatataagcaatattaattttgttggtacagatgaactaccaagtaacaagtgctgtatttataagtttgtgtcccggctaatgagaagatttgagcgtgatcctttcttgttttgagtaaatagtacatgcattgatagtgtaaagaatttttattgtaaccaatcagaaattatgtatagtaattttgttgatttctatgttaactatcccaaatgttactaacataatttctgattgattaacaacataaaaaaattatttacactctcagctcatagaaattaaactctacaagttgcaggtcctgctacaatgtattaaacatctgtgttttctcgcaatttcactagatcaatttcctagtcctatagcagcgtgtaaactctttgctacttttatcttaacagccgtagcaat

SEQ ID NO: 3067 - DNA, 822 bp, Populus trichocarpa
agacgatttatctgtatgatgtagttacacgctagatctctcactctcgcctcctttcctgaggcatctattcaacctcggagactccctgcgaagacgaaagaaattcacgagaaaaatcaaacatttctgctctcatccctctctagattcgctctctgcaaataataattcgtggaatttcttcgttaattcctctttcgatccttctaacaatgatccggtttatactgctgcaaaatagacaaggcaagactcgtctcgccaaatactatgttcctctcgaggattccgagaagcacaaggtcgaatacgaggttcatcgattggttgttaatagagatcccaaattcacgaattttgttgagtttcggacacacaaggtcatatacaggcggtatgctggattgtttttcgcactgtgtgtcgacataacggataatgaactggcttatttggagtgcattcatttatttgtggagatattggatcatttctttagcaatgtgtgcgagctagatttggtgtttaactttcacaaggtttatctgatacttgatgaattcattcttgccggggagcttcaagaaacaagcaagagggcaatcatagagagaatgggagagctggagaagctggagtaagcatctgttctgcagtgaagagtgtttatgagtgtcaatttggtcttccattttttccctcctgtgtttgtttgccttgttctttattgttcagctgttatttctttacccattttgcacaagccagttctcaccttgtaacattacagattttagacagaaattgcttcttttatcc

SEQ ID NO: 3068 - DNA, 1029 bp, Populus trichocarpa
atcgagaaagaaaattagacgtcaagtatcagacgatttatctgtatgatgtagttacacgctagatctctcactctcgcctcctttcctgaggcatctattcaacctcggagactccctgcgaagacgaaagaaattcacgagaaaaatcaaacatttctgctctcatccctctctagattcgctctctgcaaataataattcgtggaatttcttcgttaattcctctttcgatccttctaacaatgatccggtttatactgctgcaaaatagacaaggcaagactcgtctcgccaaatactatgttcctctcgaggattccgagaagcacaaggtcgaatacgaggttcatcgattggttgttaatagagatcccaaattcacgaattttgttgagtttcggacacacaaggtcatatacaggcggtatgctggattgtttttcgcactgtgtgtcgacataacggataatgaactggcttatttggagtgcattcatttatttgtggagatattggatcatttctttagcaatgtgtgcgagctagatttggtgtttaactttcacaaggtttatctgatacttgatgaattcattcttgccggggagcttcaagaaacaagcaagagggcaatcatagagagaatgggagagctggagaagctggagtaagcatctgttctgcagtgaagagtgtttatgagtgtcaatttggtcttccattttttccctcctgtgtttgtttgccttgttctttattgttcagctgttatttctttacccattttgcacaagccagttctcaccttgtaacattacagattttagacagaaattgcttcttttatccttcgttttccattgcctctgtgtctcactctgcctttatggagtgagtttgtgtgaggttactggggtgttcatctcatgttctttcttataacattctggatgtctataaacaatttgcaatcgtcatctcctgtaactcgttaaactcgttcaaattgtacttttatttcaagta

SEQ ID NO: 3069 - DNA, 888 bp, Populus trichocarpa
ggtgttacacgctagatctcactctcctcctttcctttgacatattgaaccttggaggctcccttcctctcaagacgaaagaaattcacgagaaaaatcaaacatttctacacctccatccctctccagattaacgctgcttgaaaataattcgtgaaacttcttcgttaattcatcgttcgatctttctctaacaatgatccgatttatactcctgcaaaacagacaaggcaagactcgtctcgctaaatactatgttcctcttgaggattccgagaagcacaaagtcgaatacgaggttcaccgattggttgttaatagagatgctaaattcacgaattttgttgagtttaggacacacaaggtgatatacaggcggtatgctggattgtttttttcgctgtgtgtcgacataacggataacgaattggcttatttggagtgcattcatttatttgtggagatattggatcatttcttcagcaatgtgtgtgagctagatttggtgtttaactttcacaaggtttatttgatacttgatgaattcattctcgctggggagcttcaagaaacaagcaagagggcaatcatagagagaatgggagagctggagaagctggagtaagcatctgttctgcagcgaagagtgtccgagtgtcaatttggtcctccattttttcttcctgtatttgcatgtctcgttctttattgctcagcagttatttctatacccatctagcacagccagctcataacttgcaatagtggacatttttgccagaaattgcttcttttatccttcggttcccattgtctctgtgtctcattctgcctttcatttccatggatttcatgttagtataacattctggatgtctagaaacaatt

SEQ ID NO: 3070 - DNA, 1029 bp, Populus trichocarpa
atcgagtcatcaaccgagagagaattcaacttcaagtatcacacgatttatctgtatacggtgttacacgctagatctcactctcctcctttcctttgacatattgaaccttggaggctcccttcctctcaagacgaaagaaattcacgagaaaaatcaaacatttctacacctccatccctctccagattaacgctgcttgaaaataattcgtgaaacttcttcgttaattcatcgttcgatctttctctaacaatgatccgatttatactcctgcaaaacagacaaggcaagactcgtctcgctaaatactatgttcctcttgaggattccgagaagcacaaagtcgaatacgaggttcaccgattggttgttaatagagatgctaaattcacgaattttgttgagtttaggacacacaaggtgatatacaggcggtatgctggattgtttttttcgctgtgtgtcgacataacggataacgaattggcttatttggagtgcattcatttatttgtggagatattggatcatttcttcagcaatgtgtgtgagctagatttggtgtttaactttcacaaggtttatttgatacttgatgaattcattctcgctggggagcttcaagaaacaagcaagagggcaatcatagagagaatgggagagctggagaagctggagtaagcatcttttctgcagcgaagagtgtctgagtgtcaatttggtcctccattttttcttcctgtatttgtatgtctcgttctttattgttcagcagttatttctatacccatctagcacagccagctcataccttgtaatagtggacatttttgccagaaattgcttcttttatccttcggttcccattgtctctgtgtctcattctgcctttcatttccatggagtactgttaattcccatcatctttcagttgatggcatagaacggctctgtgttcaggttaataagggtgctattttcatgttagtataacattctggatgtctagaaacaattataactctc

SEQ ID NO: 3071 - DNA, 815 bp, Papaver somniferum
tttttttagttactttcttctctctctaaattctaaaagcttgctgtgcctctgtaaacttcctcgctgtttatatttcctttcctcgctttgaaaatgatccgatttatattgctacagaacagacaaggtaagactcgtcttgccaagtattatgttcctctagaagaatctgagaaacacaaggttgaatatgaggtgcaccgtctggtagttaacagggatcctaaattcaccaattttgttgagtttcgtacacacaaggttatctacaggcgatatgcagggttgttcttttcaacgtgtgtggacatcacagataacgagttggcttacttggagtgtatccatctatttgtggagatactggaccatttcttcagcaatgtttgtgagctagatttggtttttaactttcacaaggtttatttgatactcgatgaattcattcttgctggggagctccaagagacaagcaagaaggcaatcattgagagaatgggggagttagaaaagcaagagtgagaaatggttgaggaaaagaatgagtcgtggtgcatttctttctattccacagccttctgcagttatatgttctcttagaatgaacaaaattgtgtgagattacgccattattgacgtaagaagccagctgaccttgaaatggtgagctggttgctgcagagagattattattatgggcgatcccatgagttgaaaggtccttgtaatttgtattgtatatctgtacttgaatagagttgcatcactaacaggaagctctcagttgttatcccttgattttgttgcaaaaa

SEQ ID NO: 3072 - DNA, 845 bp, Rhizophora mangle
aatttcaacgttcgtacttagctgccattgctaagaaatatatgagtaagatgagttcaacataaattcggagaagaaaaagatttttgctgtccggggccttggattcacgcaatctgctactagcaatttgcttcaatttttccgtttgttctgacaataattacaaatgatccggttcatagttctgcagaacaggcaaggtaagactcgtctcgctaaatactatgttcctctcgaggattccgagaaacacaaggtcgaatatgaggttcatcggctggtggttaatagagatcccaagttcacgaattttgttgagttccgaacacataaaataatctacaggcgatatgctggtttatttttctcgttgtgcgttgacataacagataatgaattggcttatttagagtgcatccatttatttgtggagatattggatcatttcttcagcaatgtatgtgagctggacctggttttcaattttcacaaggtttatcttatactcgatgaattcattcttgctggggagctccaagaaacaagcaagaaggctatcatagagagaatgggagaactggagaagctggagtaaatattgttggcgaatggtgttcatcgatggatttggaaatgaggggtttctctttcttttttgttttatcttcattgatgccatgcacggatggcttttgggatacttaccagggatatgcctttaacagctaagtgggactaaaaacttttttcttttgttttattatttatttttttttaaaaaccaaaaacaaaatgaaaaaaagaacactgctaagtaaatggaagttcggactttcattggc

SEQ ID NO: 3073 - DNA, 955 bp, Glycine max
gtcattacacgctagcaaagctgcagcgcaaaaagaaaattaaattaaaaataaaaaagaaaacagagatgttgaaacttgaaagtaaagtcgttggtaggatcatcatctctttgagttgccattgaagaagaagctcagatcggaaaaattcacctctccaatcccaatcccatcgttgcaaatgatccgattcattctgttgcagaacaggcagggcaagacccgtcttgccaaatactacgttcctctcgaggactccgagaagcacaaggtcgaatacgaggttcatcggctcgtcgtaaacagagaccctaaatacacaaatttcgtcgagtttcgtacgcacaagataatatacaggcgatatgctgggttatttttctcactctgtgttgatatcactgataatgagttggcgtatttagagtgcatccatttgtttgtggaaatattggatcacttcttcagcaatgtctgtgagctcgatttggtttttaacttccacaaggtctatcttatacttgatgaattcattctagcgggtgaactgcaagaaacaagcaagaaggctatcattgagagaatgggggaacttgaaaaactagaatgaaaaattacttttcagcagtcatatcaatttggagatttcgatgacttactcatgcccttggcttaattcttgtatttcaattgtgatacagaattttgaaaatcttttccgttgagccatgtattcaatgccctttaccttcgcttcttattcggcttatgtttatatttgtaagacatttataaaatcagggttttcagtagcctttctgttactgtctctgttttgtttcactttttataaatttatttgctcttcttggttgttagtaaaacacttaatggaaatgtaattggatgattgtagtatataagcaatgcaaaacgattaattttgatggta

SEQ ID NO: 3074 - DNA, 1095 bp, Glycine max
tttggctcgtctgcgtgcgtcattacacgctagcaaagctgcagcgcaaaaagaaaattaaattaaaaataaaaaagaaaacagagatgttgaaacttgaaagtaaagtcgttggtaggatcatcatctctttgagttgccattgaagaagaagctcagatcggaaaaattcacctctccaatcccaatcccatcgttgcaaatgatccgattcattctgttgcagaacaggcagggcaagacccgtcttgccaaatactacgttcctctcgaggactccgagaagcacaaggtcgaatacgaggttcatcggctcgtcgtaaacagagaccctaaatacacaaatttcgtcgagtttcgtacgcacaagataatatacaggcgatatgctgggttatttttctcactctgtgttgatatcactgataatgagttggcgtatttagagtgcatccatttgtttgtggaaatattggatcacttcttcagcaatgtctgtgagctcgatttggtttttaacttccacaaggtctatcttatacttgatgaattcattctagcgggtgaactgcaagaaacaagcaagaaggctatcattgagagaatgggggaacttgaaaaactagaatgaaaaattacttttcagcagtcatatcaatttggagatttcgatgacttactcatgcccttggcttaattcttgtatttcaattgtgatacagaattttgaaaatcttttccgttgagccatgtattcaatgccctttaccttcgcttcttattcggcttatgtttatatttgtaagacatttataaaatcagggttttcagtagcctttctgttactgtctctgttttgtttcactttttataaatttatttgctcttcttggttgttagtaaaacacttaatggaaatgtaattggatgattgtagtatataagcaatgcaaaacgattaattttgatggtacaaatgacctactagtgaacaagtgttgtatatgtttcatttcagttagatgagtgctaggtgtcctgtgaaatgaaaatatttttttcgtgatagtttcaagttgcaggtcttgctacagt

SEQ ID NO: 3075 - DNA, 661 bp, Saccharum officinarum
aatcacgctcctgcccttctcaattctcaggcatccccgttgtcctccaccatgatccggttcatcctgctgcagaaccggcaggggaagacgcggctggccaagtactacgtcccgctcgaggactccgagaagcacaaggtcgaatacgaggtgcatcggctcgtggtcaaccgggaccccaagttcaccaacttcgtcgagttccgcacacacaaagttatctacagaagatatgcaggactttttttctctatgtgcgtggacatcactgacaatgaattggcatacttggaatgtatccatttgtttgttgagatattggaccatttcttcagcaatgtgtgtgaacttgatttagtatttaacttccacaaggtcttcttgatactggatgagttcattcttgctggagagcttcaagaaacaagcaaaagggcaattatagagaggatgggcgagcttgagaagctggaatgaaaagaaacaacggtgtggtgtacattagcataggttgggagcgctattctgcccaatcgacaagttacctccatattttttacaattctttgtacctgttgtgcatcatctttgcttcacttaacctttctcaaactgcgaatcagtgtatgtgtctttttaacgtttcctgagattaccg

SEQ ID NO: 3076 - DNA, 629 bp, Panicum virgatum
  misc_feature (13)..(13): n is a, c, g, or t
  misc_feature (482)..(482): n is a, c, g, or t
catttcttccccngcgcccgaatcgcgcccctgttcttcccgattctgaagcatcaacatcgtcctccgccatgatccggttcatcctgctgcaaaaccggcaggggaagacgcggctggccaagtactacgtcccgctcgaggactcggagaagcacaaggtcgagtacgaggtgcatcggctcgtggtcaaccgggaccccaagttcaccaacttcgtcgagttccgtacacacaaagtcatctacaggagatatgcaggtctttttttctcaatctgcatggatatcactgacaatgagttggcatatttggaatgtatccatttgtttgtcgagatattggaccatttcttcagcaatgtttgtgaacttgatttagtatttaacttccacaaggtctacttgatattggatgagtttattcttgctggagagcttcaagaaacaagcaaaagggcaattatagagaggatgggcgancttgagaagctggaatgaggagaaattggatgggatataatcagggacaagcctgttctgccctatcaacgagtcacttatattttgtttgtacagtgctttgtacctgttgtgctattatccttgctccatttgaacccttcagaa

SEQ ID NO: 3077 - DNA, 500 bp, Tripterygium wilfordii
gccaaagaatgatccgattcatacttcttcagaacaggcaaggcaagactcgtctggccaagtactacgttcctctcgaggattcagagaagcacaaggtcgaatacgaggttcatcggcttgtggtgaacagagattccaagttcacgaatttcgttgagtttcgtacacacaaggtaatctacaggcggtatgctggattgttcttttccctctgcgttgacataacagataatgaattggcttatttggagagcatccatctatttgtggagatattggatcattttttcagcaatgtgtgcgagctagatttggtgttcaatttccacaaggtctatttgatacttgatgaattcattctcgctggggagctccaagaaacaagcaaaaaggcaatcatagagagaatgggagaactggagaagctggagtgaacagttatgtttagtacagcatgtctgagtacatcttagattctgagcattactactgtcttc

SEQ ID NO: 3078 - DNA, 828 bp, Allium cepa
cctaattttccgaaactttgttgaaattgaatttcaacacgaaacccgcatccaaaataagcatttttcttcttcattgctatatcctttgagcgaagacgcttcaagctagaaatgatccgcttcatattgcttcagaacaggcaaggaaagactcgattagcgaaatattatgtcccacttgaagagtcagagaagcataaagttgaatacgaggttcatcgtttggtggtcaatagagatcccaagttcacaaattttgttgagttccgcacgcacaaagtgatttataggagatatgctggactgtttttctcaacgtgtgttgatattactgataatgaactagcatacttggagtgcatccatttatttgtggagatattagatcattttttcagcaatgtgtgcgaacttgatttggtctttaattttcataaggtatatctgatactggatgagttcatccttgctggtgagttgcaagaaactagcaagagggctattatagagagaatgggagagctggaaaaacaagaatgagatttgattcgaaaattgaacattggtgtctaacttttgttaaaaggccggaatccctttttaaattaccgaaaggactgtatcatcctattcattttttccttgagctttttaccattgtgaattatgttttactgtgtttacactaacttttatatttgatgtatacaatgaaccttcaatagtcaaataaatttgtatttgaggttgtatgcatgaggatctcatcaacttctacgttctgtaaacaagtgaaatgtattctacaattatttctttacctaa

SEQ ID NO: 3079 - DNA, 889 bp, Zostera marina
tcggggtagtatttaatttatcgaagacccccaaatttcaactcacatttccttcccatctaacatcgacgacacctgccgccgcgatctgccgattttcatcccggagaaatgattcgattcattctgcttcagaacagacagggaaaaacccgtcttgcaaagtactacgtacctttcgaagaatcagagaagcacaaggtggaatacgaggttcatcggctggtggtaaacagagatcccaaatttactaactttgtcgagttccgcacacacaaagtcatttacagaagatatgctggattatttttctcaatgtgtgtggatatcactgataatgagctagcatacttggaatgtatccatttatttgttgagatattggatcatttcttcagcaacgtttgtgaactggatttagtttttaatttccacaaggtgtatctcattcttgatgagttcattcttgctggtgaactgcaagaaacaagcaagaaggcgattatagaaagaatgggtgagttagaaaaacaggaatgaacagcttctatattcattgtcacacgaaggacagtagaagttggatatatatcggcaggtagtttagacagaagttgtgtttcatttcttctgttatttcatttcttgtgtgcgtgtaagtaatcatcaatcattaaacttaccctgtattatctttcaaggtgcattcaatttctcattttaactcaaccattgtttcttttccccaaattagcctcaatttattaaatgggaataggaatttatactatctttctaaaaacaaaatgtatggtttgtgtagttatgtatatctttcattcttttgttttgtagaaaacatttatttgatatattattattgtttctg

SEQ ID NO: 3080 - DNA, 731 bp, Acacia harpophylla
gattgtatgcggtcgctcgtctagaaatatttgggacaagaaaattacagaaaaggtaaggatagtacgaaattttcgggcaaggaaagagcagaatcttgaatccctgcccagctgggatcgccgttttgtgttcgggtaatcggtgatcgctggattcatactttaattggaaaatcgatttgtcggctatatttgactggaaatgatccgattcatactcttgcagaacagacaggggaagacccgtctgaccaaatattatgttcctctcgaggaatcagagaagcacaaggtcgaatacgaggttcatcgattggtggtaaaccgtgaccctaaatttacgaatttcgttgagtttcgtacacacaaggtaatctacaggcgatatgctggactcttcttctctctctgtgttgacatcactgacaacgagctggcatacttagagtgcattcatttatttgtggaaatactggatcattttttcagcaatgtttgtgaactggatttagtttttaacttccacaaggtgtatcttatacttgacgaattcattctggcgggtgaactgcaagaaacaagcaagagggcaatcatagagagaatgggggaactggaaaaacttgagtgagacattactgttgtagaatgttatgtgaagattgaagattctttccatgcgcttcttcacctcttttaattgtaactttagaattttgtgatctttt

SEQ ID NO: 3081 - DNA, 1221 bp, Aristolochia fimbriata
ggcttccagtacgtgtagtcacgagtcacgagtcacgaccgacgaccacgagcggaggctttctccggctacgctgttagactgctcttttcaaagtcgaagcgcggaaggagaaaaagagttcagttttttcaatttttagtacgaattccttccgcggctcctaggaatttcttaccttcttgtgagatcggaggcgcccgtttccgatctgtggagatgatccgatttatattgctccagaatcggcaggggaagacgcgtcttgcaaaatattatgttccatttgaagaatccgagaagcataaggtcgaatacgaggttcatcggttggtcgttaacagggaccccaaatttacgaacttcgtcgagttccgtacccacaaagtcatctacaggcgttatgcaggactctttttctcgatgtgtgtggacatcacagataacgaattggcgtacttggagtgtatccatttgtttgtggagatactggatcacttcttcagcaatgtatgtgagctagacttggtgtttaattttcacaaggtgtatctgatacttgatgaattcattcttgcgggggagttgcaggaaacaagcaagaaggcaattatagaaagaatgggggagttggagaagcaagagtgaggagctttgtaaagtggacttaatgatgcggagtggtgcttattcttacctaatggtcatcttgtttgcagtcagattttttcctggtttgtctatttttgtaagaaggaaagaaaaatgcttttgtgtgtcattcaatttttgtttccaagagatgaaccggcctccaggctccagcaagtacttgctacatcgaatgtatgggacaattgttgttgtatgctattaacttctaaatgctttaccggtgtttgtccaaacagagctttcctatgcctggctattttcatatgccaaaataaactgcgacttcggaaaccgattccttgaaagtgtacagatgttatttggtcagaatccccgatcgattcaatgctgtaagcctaaatagcttaaatggattcaatgctgaaattttatttaagtttatttgacgagaaagtaacagtagaagccaacagagtaaaatcatcaacacatgtcacagttcgttgtgcatattgcaatcctatatatgtaagatcttacaagtgattcagcagctagccttgtattttaagatcttttgattcg

SEQ ID NO: 3082 - DNA, 849 bp, Coffea canephora
tgagatggtggttttgaacgctattccccggcccgtctgcgatttagtcaacagttagcggctttgaccttggacttgtcttcccaaagttccccttttctcaagttgctgcccttcgatttgcctccctcctccatctccgtcgcccggtttcgtctccagctccatcaacattgtcctaaaaaatgatccgattcatattgcttcagaacaggcaaggcaagactcgtctcgccaagtactacattcctctcgaggaatccgagaagcacaaagtcgagtacgaggttcaccgtttggttgtcaacagagatccgaaattcaccaactttgtagagttccgcacccacaaggtgatctacaggcgatatgcaggattgtttttttccttgtgcgtggatataacagataatgaattggcttatctcgagtgtatccatttatttgtggagatacttgatcatttcttcagcaacgtatgtgagctagatttggtcttcaattttcacaaggtatatctcatattagatgagttcattcttgccggagaacttcaagaaacaagcaagaaggctatcatagagcggatgggtgaattggaaaagcaagagtaaagattaatttgtggcacatttttcatgagctcgagaatacagtctcccccttttgtcccccaattcgccaaatatttggtcaaattttaccatatttgtgaatagtgccccagttgtattcctgttgcgatgtctgcattttttaaatcgtccaagacaaccctaccactaggttttgtgaagatattttgacgttgcttggttgtctaattgattgcgaagttccagtttattc

SEQ ID NO: 3083 - DNA, 726 bp, Eschscholzia californica
caaatgcagaaataaaccgaacgctttttcttcttcagaaccctagattttcgatctgtaaattcatcgtcgtccttcgagattcatcatttctctctcttcatctcactccgagcaatgatccgattcatattactgcaaaacaggcaaggcaagactcgtcttgctaagtattacgttcctttggaggaatcggagaagcacaaagtcgaatacgaggtccatcgtttggtcgttaatagggatcccaagttcacaaatttcgttgagtttcgtacgaacaaggttatttacaggcgttatgcaggattatttttctccatgtgtgttgatatcacggataatgagttagcatacttggaatgcattcatttgtttgtcgagatattggaccatttcttcagtaatgtatgtgagctagatttggtattcaactttcacaaggtttatctgatacttgatgaattcattctggctggagagctccaagaaacaagcaagaaggcaattatagagagaatgggggagttggaaaagcaagagtgagattgaaattatgcaaagaaaaatattcagaaggctagacttcggatttatggtgcatctatgttcaatcattcctgcaatctgatgaggaaaactatgcagattttcttctgttcttattttatgtttttatatgcgtgagggtgttcttaaagagtcacttcagtttcaacatatttt

SEQ ID NO: 3084 - DNA, 1047 bp, Eucalyptus grandis
aaagccaaaaaaaaaagaaaagaatagaaaaacaaaattaagctaccaatctgccaccggcgataatcaaagccgcccgacgaccgtatttgcaagaaaatttcaacgttcaaatcgagctctgctccatccaaatcccatcgaaatccctatctgaagctgaagctgaagctgaagctgctgccgctcgctcctcctcgcctttcctcgtcgcgagctgctctccgctccgcgaatctcctccggcgaccgtcgtgtaaaaaatgatccgattcatactgttgcagaaccggcagggcaagacccgcctcgccaagtactacgtccccctcgaggactccgagaagcacaaggtcgagtacgaggttcatcggttggtggtcaacagagatcccaagttcaccaattttgtcgagtttcggacgcacaaggttatttacaggcgatatgctggactatttttctcgctctgtgttgacataacggataatgagcttgcatacttggagtgcattcacttatttgtagagattttggatcacttcttcagcaatgtctgtgaactagacttggtattcaactttcataaggtatatctgatacttgatgaattcatccttgccggtgaaatccaagaaacaagcaagagggcaattatagagagattgggggaacttgagaagctagagtgatggtcctcttaccatctaaaagaaatcttgaagtgggaaattggatattctgcctcccttccctcctcctggttgcactgcagtgcactgcagttcggtgtagctattttttctagagacgtgctattgtgctgtgattggttttgtccacattgtttgtcgagacatgctattcaaaatttactttgcatactattcgtgattgcttccggttattgcactttgtggaagtgtatccttgtcatttgaggatcatttgacgagtcatccgtgctcaattccaaacttcatgggagagaggcccacacgttacgtaattcatcttttatcctcacaggtgcaagactgtgatcat

SEQ ID NO: 3085 - DNA, 680 bp, Fagopyrum esculentum
cgtcgcatcccgttgttgtagccggcgaagaacgaaaataacaagctgttgaaacgcgtttattctcattcgagtttgtaaattcgatttcgaaatcgaaaccttaggtgttacaatgatccggtttatattgttacaaaacaggcaaggcaagactagacttgccaagtattatatcccccttgaagattccgagaagcacaaagttgaatacgagatccatcggttggtggttaacagagaccctaagtttaccaattttgtggagtttcgaactcataaggtcatctacagacgctacgctggattgtttttctccatgtgtgttgacatcactgataatgagctagcatatctggaatgtattcatctttttgtggagatattagatcacttcttcagcaatgtttgtgagcttgatttggtattcaacttccataaggtttaccttatacttgatgaattcattcttgctggcgagctacaagaaacaagcaaaagggcgattatagagagaatgggtgaattggagaagctcgagtgagagattattgtgtataaacattatggatataactttagcttccggtttcccccattcgaatttaagtgtaaactgtaaacctatggatttttgtatcatttgctttgtcaacaatccaactctttctggatggaga

SEQ ID NO: 3086 - DNA, 686 bp, Fagopyrum esculentum
gtcgcatcccgttgttgtagccggcgaaaaacgaaaataagaagctgttggaacgcgtttattcccattccagtttgtaaattcgatttcgaaatcgaaaccttaggtgttacaatgatccggtttatattgttacaaaacaggcaaggcaagactcgacttgccaaatattatattccccttgaagattccgagaagcacaaagttgaatacgagatccatcgcttggtggttaatagagaccctaagtttaccaattttgtggagtttcgaactcataaggtcatctacagacgctacgctggattgtttttctctatgtgtgttgacatcactgataatgagctagcatatctggaatgtattcatctttttgtggagatattagatcacttcttcagcaatgtttgtgagcttgatttggtattcaacttccataaggtttaccttatacttgatgaattcattcttgctggcgaactacaagaaacaagcaaaagggcgattatagagagaatgggtgaattggagaagctcgagtgagagattattgtgtataaacattatggatataacttcagcttccggttttcctcattcgaatttatgtgtaaaatgtaaacctgtggatttttgtatcatttactttgtcaacaatccacctctttctggatggagaatttatt

SEQ ID NO: 3087 - DNA, 876 bp, Linum usitatissimum
ggcaggagaactggaggaggagttttttcattccttctttcttccttcagccatctgaaacctcgggtcttccctcgtcgacggtggttgaggtgtccaaaaaatgatccggttcatacttctgcagaacaggcaaggaaagactcgtctcgccaagtactatgtacctctcgaggatactgaaaaacacagagtagagtacgaggttcatcgactggttgtcaatcgagatcccaagttcacgaatttcgttgagttcagaacacacaaggtcatctaccgacggtatgctggactgttcttctccctatgcgtggacataacagataacgaattggcttacttggagtgcatccatttgtttgtggagatattggatcatttcttcagcaacgtgtgtgagctagacttggtgtttaacttccacaaggtttacctgatacttgatgagttcattcttgctggagagctccaagaaacaagcaaaagagcgattatagagagaatgggagaactagagaagctggagtaaatatgttgcattcttgtttgaagagtgttttgtgtcaattttactgtgactattgtctttgccattacttggtttggtaatgttatgaacctctagtttcccatctggatatcaggcatgtttgtaatcattggggaaacagacggtgcaacttttgtaggtatattaaatccctggcatactgaatggtagctgtgttttctttcatttctcaccactttaagagatccaacaaccacccttcccgtcactgtgtgtatcaattgcagagttggttgcgggtggaagtagtgtatcattttctcttaaccgaatgccagaaactgagttccttttttttattg

SEQ ID NO: 3088 - DNA, 763 bp, Linum usitatissimum
ggacggttgagagagagaagaaaaggagaaagaatcaggagaagggagtattttcattctttctttcttctgccatctgaaacctcgggtcttccctcgtcgacggcggtcgaggtgtccaaaaaatgatccggtttattcttctgcagaacaggcaaggaaagactcgtctcgccaagtactatgtgcctctcgaggataccgaaaaacacagagtagagtacgaggttcatcgactggttgtcaatcgagatcccaagttcacgaatttcgttgagttcagaacgcacaaggtcatctaccgaaggtatgctggactgtttttctccctatgtgtggacataacagataacgaattggcttacttggagtgcatccatttgttcgtggagatattggatcatttcttcagcaatgtgtgtgagctagacttagtgtttaacttccacaaggtttatctgatacttgatgagttcattcttgctggagagctccaagaaacaagcaaaagagcgattatagagagaatgggagaactggagaagctggagtaaatatattgcattgttgattgaagagtgttttctgtgtcaattttacccaattgtgtgactattgtctttgccatttctttgcttggtatgatatgaacatccagtttcctatctggttatcaggcatgtttgttatcattggggaaacagacgatgcgacttttgtaggtatatcaaatcattggcatactgaatgtcagctgtgtttt

SEQ ID NO: 3089 - DNA, 682 bp, Zingiber officinale
gcacgaggagcaaacgtatccgtcaaagcgaagatctcgcgcttgctcgtctccagcgaccgacgacgatatgatccgattcattctgctgcagaaccggcaggggaagacgcgtctggccaagtactacgtacccctcgaggattctgagaagcacaaagtcgaatacgaggttcatcggttggtggtcaatagggatcccaaattcaccaatttcgttgagttccgcactcacaaagttatttatagaagatatgcgggactcttcttttcactgtgtgttgatatcactgataatgagttagcatacttggagtgcatccatctatttgtggagattctcgatcatttcttcagcaatgtttgtgagctagatttggtttttaacttccacaaggtttatctcatattggatgagtttattcttgctggagagattcaagaaacaagcaagagggcgataattgagaggatgggtgaattggaaaaacaggaatgagaaccggccatgcaacatttcactctgatggcataaatcactaaagctgtaccctcagtattagtatgttttcaggaagaaaagcggcgtgttgttgaacagttaggccatcgttgattgcaaggatatgtaattaccagatattttgtcagccttggatatgagcgtttggtgattggaccg

SEQ ID NO: 3090 - DNA, 522 bp, Panax ginseng
ctcctcaactgtttctgctcccctttttagaaaatgatccgattcatattgcttcagaacaggcaggggaagactcgtctcgccaagtattacattcctctagaggaatccgagaagcacaaagttgaatacgaggttcatcggttggttgtgaatagagatcccaagttcacaaatttcgttgagtttcgtacccacaaggtcatctacaggcgatatgctggattatttttctcactgtgtgttgatataacagataatgaattagcatatttagagtgcattcacttgtttgtggagatattggatcacttctttagcaatgtgtgtgagctagatttggtatttaactttcacaaggtatatctgattctggacgagttcattcttgctggggaactccaagaaacaagcaagaaggcaatcatagaaagaatgggggaattagaaaagcaggagtgataatcaaaggacgaagatacatgtggtgtatataggggggcaattgcccctctaaatatt

SEQ ID NO: 3091 - DNA, 810 bp, Mimulus guttatus
aaagaatttctgcaatttcaacagctgaatttgatctctctctctctctctctctctctctctctctctctctctctctgtctgtctctctctacaatgatccgattcatattattacagaacaggcaaggcaaaactcgactcgccaagtactacgtccctctcgaggaatccgagaagcataaggtcgagtacgaggttcatcggctggttgtgaacagggatcccaaattcaccaactttgtggagttccgaacccacaaggttatctacaggcggtacgctggtttattcttctcactgtgcgtcgacattaccgacaatgagttagtttatttggagtgcattcacttatttgtggagatacttgatcatttcttcagcaacgtgtgcgagctcgatttagtttttaatttccacaaggtgtacctaatactagacgagttcatacttgctggggaactccaagaaacgagcaagaaggcgatcattgagagaatgggtgaattggaaaagcaggaataatgattatttcaatcagcaacgcccgatcaggccagattcgtgtaactatttgctaaacatagtcgagtcttgtttaagatattcggaaatattgtttgtaaaatttgctgttggcaaactgttctttttgttggtgagttaaatggtcaattcgtggaaattcattcaatttgtgcgttcatgtttacgcatcatctgattatattgtgtgttattcttttaattgtgtgtgttttccttaatacatcatcataagacattatttggtaaatatttagataaaca

SEQ ID NO: 3092 - DNA, 1748 bp, Mimulus guttatus
taaagcttcaaaagaatttctgcaatttcaacagctgaatttgatctctctctctctctctctctctctctctctctctctctctctctgtctgtctctctctacaatgatccgattcatattattacagaacaggcaaggcaaaactcgactcgccaagtactacgtccctctcgaggaatccgagaagcataaggtcgagtacgaggttcatcggctggttgtgaacagggatcccaaattcaccaactttgtggagttccgaacccacaaggttatctacaggcggtacgctggtttattcttctcactgtgcgtcgacattaccgacaatgagttagtttatttggagtgcattcacttatttgtggagatacttgatcatttcttcagcaacgtgtgcgagctcgatttagtttttaatttccacaaggtgtacctaatactagacgagttcatacttgctggggaactccaagaaacgagcaagaaggcgatcattgagagaatgggtgaattggaaaagcaggaataatgattatttcaatcagcaacgcccgatcaggccagattcgtgtaactatttgctaaacatagtcgagtcttgtttaagatattcggaaatattgtttgtaaaatttgctgttggcaaactgttctttttgttggtgagttaaatggtcaattcgtggaaattcattcaatttgtgcgttcatgtttacgcatcatctgattatattgtgtgttattcttttaattgtgtgtgttttccttaatacatcatcataagacattatttggtaaatatttagataaacaacttacatatgatttataatattcatcaggtgtatttgactgtgccgaaatttcgaaattgtcactaacaagaacatataattatttttgcaaacatttatattgaaactaattaatacataactcccccccaaaaaaaaaagaacaaacaatggttctaaagtagaagcatataattgacagtaatttatccatttcagaatcgctggttgcacggcagctgaaattgcggtacgttttcagggtagaatacagctccgtttctctcaaatcccaaacgaagattttcttgatgcgttgtattattatgatattgttgatgatggtgtttcttcacatttaaagacgaattcatagccataatattatgctggtgctgatgcggactcgaaaactgttgatatttggaggctagtgcagcgtgcacgtgcgggaatatagtatgagcatagttcaccatggaaggcgcatctcttcctcctccgttataccatgtctgaagctgtgacgtaaaactgctgttgagagtttgcggtatttgtacctgtaataataaaaaaaatcagtcgtctttcatgatcataacaaagtctgccgtgtaagtttctgagcaaaatcatagcaaacaataatcataagtaaattgcagattagctatttatctgaaaatgcatcatcgacacaatttactgattttttcttttataatttttttttttaatttttcaagaaaatcacctgttgtggtgctaaagctgaattatgagcatggaaagtagaggaatagccattctggggcggcggtaagaaaaacatggccgaatgattttgcgcctgcatgtgaaattgttcgttaatatgtacagctccattgacgctttttcttccatccaaaccacatactccgctacccaaagccaaaaaatcg

SEQ ID NO: 3093 - DNA, 948 bp, Phalaenopsis aphrodite
aagaactcgagcctgcaactacttctcccggcggaaaactaagatttgctagccctttttcatcggcttctcttccaacgaatatctttttcccctctttgcatttataatgatccggtttattctgctccagaacaggcagggcaagacccgcctggctaagtactatgtccctctcgaagaatcggagaagcataaggtcgagtatgaggttcatcgcttggtggtaaacagggatcccaagttcaccaattttgtggagttccgcacgcacaaagttatatacagaagatatgctggccttttcttttcaatgtgtgttgatataaccgataatgaattagcatacttggaatgcatccatttatttgtggagatattggatcatttcttcagcaacgtatgtgagctggacttggtatttaattttaacaaggtttatctgatattggatgagtttattcttgctggggagctacaagaaacaagcaagaaggccatcattgagagaatgggggaactagaaaagcaagaataaggtgtgtgagcaacataaaaccattggagttagttccctttttggccgctcgtttaaattctctccattttaccacatgatttatgtattttgaaatcataagactgcaatctccaatcatatgcttgactattgagatttttaacagcactattttaggtttatagaatattctatattttatactgcaaacgaatttgaaacgatgcaggttttgtgattgaatcgttcctgtgaatccggttaagaaatcgggagatttacatgtatgccttataattcttatacatttacatatctaacacctaatcatataaacttcaatttttgcatacacatgacatgaatgcagatgtgccggagggggccgtcataatccgcgagcacatctgcattcatgtcatgtgtag

SEQ ID NO: 3094 - DNA, 829 bp, Plantago ovata
ggggagctcacatttcacaattcgatcgatcttttggggctttcttcactcgacaatctcgcgaaaatgatccggttcatattactgcaaaacaggcaagggaaaactcgattggccaagtattacattcctctcgaggaatccgagaagcacaaggttgagtacgaggttcatcggttggtcgtgaatagggatcctaaattcaccaactttgttgagttccggacccacaaagttatctacaggagatatgcagggctattcttttcgctatgtgtggatataacggataatgagttagcttatttggagtgcattcacttatttgtggagatactggatcatttcttcagcaacgtctgtgagcttgacttggtatttaatttccacaaggtttatctcatattagatgagtttatcctggccggagaactgcaagaaacaagcaagaaggcaatcatagagagaatgggggaattggaaaagcaggagtgaagtttatccttgtaagatctttggaattcttgtttgtaaagaatgttgtcataccaactatatatttgatttctgagtttatggccgcttctcaatgattacagtattgcttaactccttctccatgaggagaagaaaagatatttgtgcatgaccccgtgtcagtgttactttttagtttttagtatatgatgatacaagatcaactgctctctatgctgctatcgaattagtaattgttgtaattataaatggcgctgcatctataattgtgtgcatgttagagatagtaaaaaataagatgtgagggttgcatatgtatgcagcacagagc

SEQ ID NO: 3095 - DNA, 741 bp, Tabernaemontana elegans
gcgtttagttttctgcagctccgtcgatatcgttgaaaaatgatccgattcatattgcttcagaatcggcaaggaaagactcgtctggccaagtactacattcctcttgaggaatccgagaaacataaagtggaatacgaggttcaccggcttgttgtgaacagagatccgaaatttaccaactttgttgaattccggacccacaaggttatttacaggcgatatgctggattgtttttttcactctgtgttgatataactgacaatgaattagcttatcttgagtgcattcatttattcgtggagatacttgaccatttcttcagcaacgtatgtgagctagatttggtattcaattttcacaaggtatatctcatactagatgagttcattcttgccggggaactccaagaaacaagcaagaaggctattatagaaaggatgggagaattggaaaagcaagagtagatattaattgtagcagaatttagaggacctcgagaatatatgctgccttcattatctgcctccctttccccacctgcacgaaaaatgctttcgtctactactagtcaattcaacagcgattttattttttgccatatgctgcaaatagttcacctgttgtatgtctatttgcaatgtgaatttccccccgatgtctgtgcgatcatttaaagagtgtatctcatttgtaggctgtgcagatatattttcaatctgatgagtgtagagtattgc

SEQ ID NO: 3096 - DNA, 755 bp, Valeriana officinalis
gacctggtggctggtgctcgcacattccaacttgcgaagacgactctttctccctcatagtctcataccaaacaacaacgtttcatctttttgttgctttgtaatttgtaattgtgtgcttcttcgctccctcttgttcccaaaatgatccgattcatattgcttcaaaacaggcaagggaagactcgtctcgccaagtattacgttcccctcgaagaatcggagaagcacaaggtcgaatacgaggttcatagactggttgtgaatagagatcccaagttcaccaactttgttgagttccgcacacacaaggttatctacaggcgatatgctggattgtttttctcactttgtgttgatataaccgataatgagttggcttatttagaatctatccatttatttgttgaaattttggatcatttcttcagcaacgtttgcgagctcgatttagttttcaactttcacaaggtgtatttgatactcgatgagttcattcttgccggggaactacaagaaacaagcaagaaggcaatcatagagcggatgggggaattggagaaacaggagtgaggatgatatatgatgtgctgcacttaggagcagtgctttcggccttttcctacattaagttagttgctttttgttcttgttgtgtagaaaaaaagtttaacaagtggaaccaagagagcagtttgattgagtgttttttgtactacacctagtaatcttgaatctgtgacattttagctggg

SEQ ID NO: 3097 - DNA, 860 bp, Zostera marina
ggggaactcacatttccttcccatctaacatcgacgacacctgccgccgcgatctgccgattttcatcccggagaaatgattcgattcattctgcttcagaacagacagggaaaaacccgtcttgcaaagtactacgtacctttcgaagaatcagagaagcacaaggtggaatacgaggttcatcggctggtggtaaacagagatcccaaatttactaactttgtcgagttccgcacacacaaagtcatttacagaagatatgctggattatttttctcaatgtgtgtggatatcactgataatgagctagcatacttggaatgtatccatttatttgttgagatattggatcatttcttcagcaacgtttgtgaactggatttagtttttaatttccacaaggtgtatctcattcttgatgagttcattcttgctggtgaactgcaagaaacaagcaagaaggcgattatagaaagaatgggtgagttagaaaaacaggaatgaacagcttctatattcattgtcacacgaaggacagtagaagttggatatatatcggcaggtagtttagacagaagttgtgtttcatttcttctgttatttcatttcttgtgtgcgtgtaagtaatcatcaatcattaaacttaccctgtattatctttcaaggtgcattcaatttctcattttaactcaaccattgtttcttttccccaaattagcctcaatttattaaatgggaataggaatttatactatctttctaaaaacaaaatgtatggtttgtgtagttatgtatatctttcattcttttgttttgtagaaaacatttatttgatatattattattgtttctgcactgt

SEQ ID NO: 3098 - DNA, 569 bp, Brassica juncea
agagttttctccgattccttaatttggcaaacgcggaaagccagcgaaggtctttcgacggcaagaagcaaaactttggatgcgtgttcttgtctcgcgatttcacgaatagtaatgatccgattcatattgttgcagaacagacaaggcaagactcgtcttgcaaagtactatgttcctctcgaggagtccgagaaacacaaggttgaatacgaggttcacagattggttgtcaatcgcgactcgaagttcaccaatttcgtcgagtttagaacgcataaggttatatacaggagatatgcagggttgtttttctcattgtgcgttgacataacagacaatgagttggcttaccttgaatgtatccacttgttcgtcgagattctggaccatttcttcagcaatgtctgtgagcttgatttggttttcaacttccacaaggtgtacttaatactcgatgaattcattctggctggagagcttcaagaaacaagcaagcgggcgatcattgagaggatgtcagaactggagaagcttgagtgatgaggttgggagattctatgattgat

SEQ ID NO: 3099 - DNA, 752 bp, Olea europaea
tctcatctttgacttctcaactgtaaatttcagatttctaaaatttttctgcggtttcaattttgcgaaattttttgctcaatcgatctcgccaaaatgatccggttcatactgttgcagaacaggcaaggaaaaactcgactagcaaaatattacattcccctggaggaatctgagaaacacaaagtcgaatacgaggttcatcgattggttgttaatcgggatcccaagttcaccaactttgtggagttccgaacccacaaggttatctacaggcgatatgctggattatttttctcactgtgtgtagatattaccgataacgagttagcttatttggagagcattcacttatttgtggagattctggaccattttttcagcaatgtgtgcgagctggatctagtgttcaattttcacaaggtatacctcatactagatgagttcatacttgccggagaactccaagaaactagcaagaaggcaatcatagagagaatgggagaattggaaaagcaggagtaaaatttgtgtcatggactattacttatatttttgctcatatgatgtttgttctgatgctataggatctttgttgatgacatttgcaataattttgtttgtgcaaggatgttttgtattcttatgtccagaatgagtgtattgattgaatgattgggaactttcactaaatatttggaccgaaatttgtacatcccttttgacaaatttatatgataactccttgtatc

SEQ ID NO: 3100 - DNA, 569 bp, Ambrosia trifida
caaacattcgaccttgttttgtctagttttcagaccaattcaacaagcgcctgcaaattctccattgacctaaccaacaatgatccgattcatactccttcagaacaggcaaggaaagactcgtctggccaagtattacattcctcttgaagaatcagagaaacacaaggtcgaatatgaggttcatcggttggtggtcaatagagatccaaagtttactaacttcgttgagttccgtacgcacaaagttatctataggcgatatgctggactgttcttctcactctgtgttgatataaccgataacgagctagcatatttggagtgcatccacttatttgtagaaatactggatcacttcttcagcaatgtgtgtgagctggatttggtcttcaacttccataaggtgtatctgatactagatgagttcattcttgctggggaactccaagaaacaagcaagagggcaatcatagaaagaatgggagagttggaaaagcaagagtgagatgggttttatttttcgatatcttgagatttgtgtaatttgtgttctgttctgttatgtt

SEQ ID NO: 3101 - DNA, 823 bp, Amorphophallus konjac
aatgatcaggttcatactgcttcagaacaggcaggggaagacccgcctcgcaaagtactatgtcgctctcgaggattcggagaagcacagggtcgagtatgaggtccaccgcctcgtggtgaacagggatcccaagttcaccaactttgtcgagtttcgcacacacaagataatctacaggagatatgctggattgtttttctcgatgtgtgttgatatcacagataatgagttggcataccttgagtgcatccatctatttgtggagattttggatcatttcttcagcaacgtctgtgagcttgatctggtatttaactttcacaaggtttatttgatccttgatgagttcatacttgctggagagcttcaagaaaccagcaagaaggcaatcatcgacagaatgggtgagttggaaaagctggagtgagctccagaaagaaagacggcgggcactaaatttagggttggcttgtggaaataaggcactcggtacagagccgtggttgccgccatgctgttgtttgctcacacttcttggtccgattatcggcacgagggggatcggagatgatgatgcttcttgtgcaccgcagcaccttcttgtgcattttttgtttgttaagatcttgagaagtttgtttgttatatcccttgattttatggctcaagtttgtgcacacactcttgtgcattttgtttgtggtcatctgagaaatttgattcgatttgttatatcccctgatctgatctgatagcttaagaatgctgccgtcggtttttatccagggaaattattatctccagtaagttatccatcaat

SEQ ID NO: 3102 - DNA, 828 bp, Amsonia hubrichtii
gtgtttgttttctgcagctccgtcgatattgtgggaaaatgatccgattcatattgcttcagaacaggcaaggaaagactcgcctggccaagtactatataccgcttgaggaatccgagaagcataaggtcgaatacgaggttcaccggctagttgtgaacagagatccgaaattcaccaactttgttgagtttcggaaccacaaggttatttacaggcgatatgctggattgtttttctcactgtgtgttgatataactgacaacgaattagcttatcttgaatgcatccatttattcgtggagatacttgatcatttctttagcaacgtatgtgagctagatttggtattcaattttcacaaggtatatctcatattagatgagtttattcttgctggggaactccaagaaacaagcaagaaggctattatagaaaggatgggagaattggaaaagcaggagtagagattaaattggcagctgattttacaggtccatgagaacatacgctgccttcatcgtctgcctatccttctcacttgccccagaaatgctctcatctattagtaatcaatcctccagcgattttttgccatactctgcaaatagtgcacctgttgtatttttccttgcaatgtgaattgaccttttatcttcatctttttctttgggcaactgtttgagattgtatcttgtaggctgtgcagattgaactgactagtataaagtattgcatgtcttgggaatttcccaagtttgtttagtataatcactaattcttttagaacaacttgtgtgtggttttcttagatcatagatgtgcagg

SEQ ID NO: 3103 - DNA, 706 bp, Brassica juncea
cttgtgttgtgattccgggaataatgatccgattcatattgttgcagaacagacaaggcaagactcgtcttgcaaagtactatgttcctctcgaggagtccgagaaacacaaggttgaatacgaggttcacagattggttgtcaatcgcgactcgaagttcaccaatttcgtcgagtttagaacgcataaggttatatacaggagatatgcagggttgtttttctcattgtgcgttgacataacagacaatgagttggcttaccttgaatgcatccacttgtttgttgagattttggaccatttcttcagcaatgtctgtgagcttgatttggttttcaacttccacaaggtgtacttaattctggatgaattcattcttgctggagagcttcaagaaacaagcaagcgggcgatcattgagaggatgtcagaactggagaagcttgagtgatgaggttgggagattctatgattgatagtcaagaatgaaaatgagcagtatgagtcttccgttttgctcctttctgttatgttctgcctaccttaaacacaccttttcattttgattgattaaaaacctctaatggtaaacaaaacatttatttggacaactcaaagaaagaatatgatggtctgagacattgtgttcagatgcaattgtcttctttcgcactgatataaaagaaaaccaaatcatgtattgtt

SEQ ID NO: 3104 - DNA, 756 bp, Brassica juncea
aagcgagtgagatctgaatcgagataattgggttacatctccggtctgatcgctcgtgaaatctgcagagaaaatgatccgattcatattattgcagaacagacaagggaagactcgtcttgccaagtactatgttcctctcgaagaatccgagaaacacaaagtcgaatacgaggttcataggttagtggtgaaccgcgacgcaaaattcaccaatttcgttgagtttagaacacacaaggtgatatacaggcgttacgctggactgtttttctccgtgtgcgtggacataacggacaatgagttggcttaccttgagtgcatccatttgtttgtggagattttggatcatttcttcagcaatgtctgtgagcttgatttggtcttcaacttccacaaggtgtacttgatacttgatgaattcattcttgctggagagctccaagaaacaagcaaaagggctatcatcgagaggatgtcagagctcgagaagctagagtgattgatgattgtttctcaaaaagctgggggttattgtttaagatgttttcggtgtattcttttccttggcgtgtccagagatttgatatggctttgttgagttgaagacaacaatggtgatgttaagtttgtaaaaggatataaaacgattctgttgagatcaccattcaaatttgttgtctttcaactagtgaggttacttgctagttatcacagccactaacgtatgtataaagaaaatgtttggtatgagca

SEQ ID NO: 3105 - DNA, 630 bp, Brassica oleracea
aggctgccgaagatcttacggaaccttggatgcgtttgcttgtgttgtgtgattccgggaataatgatccgattcatattgttgcagaacagacaaggcaagactcgtcttgcaaagtactatgttcctctcgaggagtccgagaaacacaaggttgaatacgaggttcatagattggtggttaatcgcgactcaaagttcaccaatttcgtcgagtttagaacgcataaggttatatacaggagatatgcagggttgtttttctcattgtgcgttgacataacagacaatgagttggcttaccttgaatgcatccacttgttcgttgagattttggaccatttcttcagcaatgtctgtgagcttgatttggttttcaacttccacaaggtgtacttaatactggatgaattcattcttgctggagagcttcaagaaacaagcaagcgggcgatcattgagaggatgtcagaactggagaagctcgagtgatagaggttgggatattatatgatagtcaagaatgaaaatgagcagtatgagtcttcctttttgctcctctctgttatgttctgtctaccttaaacacacaccttttcattttgatttattaaaactctaatgataaac

SEQ ID NO: 3106 - DNA, 840 bp, Brassica rapa
gaccggaaaaaataataattgaatcgaccattccaataagtgttctgccgaagatcttacggaaccttggatgcgttttcttgtgttgtgaatccgggaataatgatccgattcatattgttgcagaacagacaaggcaagactcgtcttgcaaagtactatgttcctctcgaggagtccgagaaacacaaggttgaatacgaggttcacagattggttgtcaatcgcgactcgaagttcaccaatttcgtcgagtttagaacgcataaggttatatacaggagatatgcagggttgtttttctcattgtgcgttgacataacagacaatgagttggcttaccttgaatgcatccacttgtttgttgagattttggaccatttcttcagcaatgtctgtgagcttgatttggttttcaacttccacaaggtgtacttaattctggatgaattcattcttgctggagagcttcaagaaacaagcaagcgggcgatcattgagaggatgtcagaactggagaagcttgagtgatgaggttgggagattctatgattgatagtcaagaatgaaaatgagcagtatgagtcttccgttttgctcctttctgttatgttctgcctaccttaaacacaccttttcattttgattgattaaaaacctctaatggtaaacaaaacatttatttggacaactcaaagaaagaatatgatggtctgagacattgtgttcagatgcaattgtcttctttcgcactgatataaaagaaaaccaaatcatgtattgttactgcaattcatgatggtttaggtttttatgaatttcactaaaagcattgccttt

SEQ ID NO: 3107 - DNA, 927 bp, Brassica rapa
aaaacagttgacaaaagaaattgaaaatgatattaaaaatttgtggtatagttagaattcctcctttgtctaaggtttgttcaaagcgagagagatctgaatcgaagcaaaattgggttacatctccggtctgatcgctcgtgaaatctccagagaaaatgatccgattcatattattgcagaacagacaagggaagactcgtcttgccaagtactatgtccctctggaagaatccgagaaacacaaagtcgaatacgaggttcataggttagtggtgaaccgcgacgcaaaattcaccaatttcgttgagtttagaacacacaaggtgatatacaggcgttacgctggactgtttttctccgtgtgcgtggacataacggacaatgagttggcttaccttgagtgcatccatttgtttgtggagattttggatcacttcttcagcaatgtctgtgagcttgatttggtcttcaacttccacaaggtgtacttgatacttgatgaattcattcttgctggagagctccaggaaacaagcaaaagggcgatcatcgagaggatgtcggagcttgagaagctagagtgattgatgattgtttctcaaaaagctgggtgttattgtttaagatgttttcggtcattcttttccttggcgtgtccagagatttgatatggctttgttgagttgaagacaacaatggtgatgttaagtttgtaaaaggatataaaacgattctgttgagatcaccattcaaatttgttttgtctgagaatatgctatctgagaatatcctgttgagatcaccattcaaatttgttgtctttcaactagtgaggttacttgctagttaccacagccattaacgtatgtataaagaaaatgtttggtatgagcatatgctatctgagaatatcctaaaccaaat

SEQ ID NO: 3108 - DNA, 782 bp, Musa acuminata
gggggggtcaaggcgaagaaagacgcatcagcttttcctctcctgcgctctctccggcgacgacgagatgatccggttcatactgctccaaaaccggcagggcaagacgcggctggccaagtactacgtccccctcgaggactctgagaagcacaaggtcgaatacgaggttcatcggctggtagtcaacagggatcccaaatacaccaattttgtcgagttccgcacacacaaagttatttacagaagatatgcaggactcttcttttcaatgtgtgttgatatcactgataatgagttagcatacttggagtgcatccatttatttgtggagattcttgatcatttcttcagcaatgtctgtgagcttgatttggtattcaacttccataaggtatatctcatattggatgagtttattctggctggggagattcaagagacgagcaagagggcaattattgagagaatgggggagttggaaaagcaagaataagaatttggtttgtgaaatcggggccccaaagcttcggttttgtaccttcattaattagttcatgccagaggacagtaattttttttgctagtttgtgctataagatactacatgcctgtttatcgtcacctattattggagaataatagtcccttcgtacggtggactatgatatgcccatgcagcaagtactgtagttgttgcccctttggattgattagtgtcaaatgttttaagtgtgcctcttgaacccatttgtattttatcagtcaaaatgttgctccaa

SEQ ID NO: 3109 - DNA, 742 bp, Brassica napus
ggatgcgttttcttgtgttgtgaatccgggaataatgatccgattcatattgttgcagaacagacaaggcaagactcgtcttgcaaagtactatgttcctctcgaggagtccgagaaacacaaggttgaatacgaggttcacagattggttgtcaatcgcgactcgaagttcaccaatttcgtcgagtttagaacgcataaggttatatacaggagatatgcagggttgtttttctcattgtgcgttgacataacagacaatgagttggcttaccttgaatgcatccacttgttcgttgagattttggaccatttcttcagcaatgtctgtgagcttgatttggttttcaacttccacaaggtgtacttaattctggatgaattcattcttgctggagagcttcaagaaacaagcaagcgggcgatcattgagaggatgtcagaactggagaagcttgagtgatgaggttgggagattctatgattgatagtcaagaatgaaaatgagcagtatgagtcttccgttttgctcctttctgttatgttctgtctaccttaaacacaccttttcattttgattgattaaaaacctctaatggtaaacaaaacatttatttggacaactcaaagaaagaatatgatggtctgagacattgtgttcagatgcaattgtcttcttttgcactgatataaaagaaaaccaaatcatgtattgttactgcaattcatgatggtttaggtt

SEQ ID NO: 3110 - DNA, 653 bp, Brassica napus
acggaaccttggatgcgtttgcttgtgttgtgtgattccgggaataaatgatccgattcatattgttgcagaacagacaaggcaagactcgtcttgcaaagtactatgttcctctcgaggagtccgagaaacacaaggttgaatacgaggttcatagattggtggtcaatcgcgactcgaagttcaccaatttcgtcgagtttagaacgcataaggttatataccggagatatgcagggttgtttttctcattgtgcgttgacataacagacaatgagttggcttaccttgaatgcatccacttgttcgttgagattttggaccatttcttcagcaatgtctgtgagcttgatttggttttcaacttccacaaggtgtacttaatactggatgaattcattcttgctggagagcttcaagaaacaagcaagcgggcgatcattgagaggatgtcagaactggagaagctcgagtaatgaggttgggatattatatgatagtcaagaatgaaaatgagcagtatgagtcttcctttttgctcctctctgttatgttctgtctaccttaaacacacaccttttcattttgatttattaaaactctaatgataaacaaaacatttatttggacaactcaaagaaagaatatgatgg

SEQ ID NO: 3111 - DNA, 793 bp, Brassica napus
gttcaaagcaagagagatctgaatcgaagcaaaatttggttacatctccggtctgatcgctcgtgaaatctccagagaaaatgatccgattcatactattgcagaacagacaagggaagactcgtcttgccaagtactatgtccctctggaagaatccgagaaacacaaagtcgaatacgaggttcataggttagtggtgaaccgcgacgcaaaattcaccaatttcgttgagtttagaacacacaaggtgatatacaggcgttacgctggactgtttttctccgtgtgcgtggacataacggacaatgagttggcttaccttgagtgcatccatttgtttgtggagattttggatcacttcttcagcaatgtctgtgagcttgatttggtcttcaacttccacaaggtgtacttgatacttgatgaattcattcttgctggagagctccaggaaacaagcaaaagggcgatcatcgagaggatgtcggagcttgagaagctagagtgattgatgattgtttctcaaaaagctgggtgttattgtttaagatgttttcggtcattcttttccttggcgtgtccagagatttgatatggctttgttgagttgaagacaacaatggtgatgttaagtttgtaaaaggatataaaacgattctgttgagatcaccattcaaatttgttgttctttactaactaggttgaggtttacttgtctagttatctacagcctactaacgtatagttaataaaagtaaaattggtttaggtattaggagtactaattagttg

SEQ ID NO: 3112 - DNA, 825 bp, Brassica napus
ctaaggtggggggcagtttcgtgaaagttcaaagcgagagagatccgaatcgaagaaaattgggttacatctcaggtctgatcgctcgtaaaatctccagagaaaatgatccgattcatattattgcagaacagacaagggaagactcgtcttgccaagtactatgtccctctcgaagaatcggagaaacacaaagtcgaatacgaggttcataggttagtggtgaaccgcgatgccaagttcaccaatttcgttgagtttagaacacacaaggtgatatacaggcgttacgctggactgtttttctccgtgtgcgtggacataacggacaatgagttggcttaccttgagtgcatccatttgtttgtggagattttggatcacttcttcagcaatgtctgtgagcttgatttggtcttcaacttccacaaggtgtacttgatacttgatgaattcattcttgctggagagcttcaagaaacaagcaaaagggcgatcatcgagaggatgtcagagctcgagaagctagagtgatgattgtttctcaataagctgggggttattgtttaagatgttttcggtcattcttttccttggcgtctccagagacttgatatgctttgttgagttgaagacgacagacaatggtgatgttaagatttgtaaaaggatataaaacgattccgttgagatcactattcaaaatttgttttatctgtaagaagattttctttcaactagtgaggttacttgctagttatcacagccatcaacgtatagtaataaaagtaaattgtttaggtatgagctatattgttaataagt

SEQ ID NO: 3113 - DNA, 740 bp, Flaveria ramosissima
aagatttgacccaacatcgacttctctgtatattcagaccaattcaacaagcacaaatcaactgcaaaatcaccatcgtttcgttctcctgcttcattgacgcaataatgatccgattcatacttcttcagaacaggcaagggaagactcgcctcgctaagtattatattcctctcgaagaatcagagaagcacaaggttgaatatgaggttcatcgattggtggtgaatagagatccgaagttcactaacttcgttgagttccgtacacacaaagtcatctacaggagatatgctggactgttcttctcactctgtgttgatataactgataatgagctagcatatttggagtgcatccacttatttgttgaaatactggatcacttcttcagcaacgtgtgtgagctagatttggtcttcaacttccataaggtgtatctgatactagacgagttcattcttgctggggaactccaagaaacaagcaagagggcgatcatagagagaatgggggaattggaaaagcaagagtgacatgtcatttctttctttgttgtgtgttcataagcatgattttatcggtcaatagttcgtcttgagattgaacatgtaatttgtgttttgattgtgtttgggttttactatttttcatgcatctatctagtctagtgaaattaagactaatttttgttatgtatggtatcttacatggtattgctgcagtacattacatatcta

SEQ ID NO: 3114 - DNA, 1026 bp, Vitis vinifera
gtcaaaaccccaatcttcattcaaatcaacggtcagacctgacaataaccgtcacaataagctttcgttcttggcttcctgggaaaaaaaaggagagaaataacagagcaaagcttgaaaaaaaaaaaaaaaaaaaccccattttaattttactcaataatgatccgattcatattgttgcagaacaggcagggaaagactcgattagccaagtactacgttcctttcgaggaatctgagaaacacaaggtcgaatacgaggttcatcggttggtggtcaacagagatcccaaacatacaaactttgtagagttccgtacacacaaggtcatctacaggcgatatgctggattgttcttctcattgtgtgttgatatcactgataatgagttagcatatttggagtgcatccatctctttgttgagatattggaccatttcttcagcaatgtgtgtgagctagatttggtatttaactttcacaaggtatatctaatacttgatgagttcattcttgctggagagctccaggaaacaagcaagaaggcaataatagagagaatgggggagttggagaagcaagaatgagaatgggggatctccactcagtcgtcttattttgttgttcatccaatctgtttctttgcttcaagaactctcgcagctttgtaatgtcggaaaatggatctgtctcttgttctccagcatttttcttatttggtatgtgagcaccagggaggtgttggctctcggagttactaaaaggttcatttttatggttttgtgtatggtacatggggtttgtgcataaacattgttttgattcatttcccttcaaaatgattctaggctcattgttgggtccatgtgcttgtgaattgatgaatcatcttgggcataattgcctgtttgctctgtcctatttgaatattagggattccatgtcttttaatagggagtgctctgctcttatgccatatttggaatagaggacgaaaatgagaaatcaatttcattcccattcat

SEQ ID NO: 3115 - DNA, 695 bp, Guizotia abyssinica
attttcggaccaattcaacgagacgaagcacctgcagaacctccattgtttcattctcctgcttcatcgacgcgacaatgatccgattcatacttcttcagaacaggcaaggaaaaactcgccttgctaagtattacattcctctggaagaatcagagaagcacaaggttgaatatgaggttcatcgattggtggtgaatagagatccgaagttcactaacttcgttgagtttcgtacacacaaagttatctacaggcgatatgctggactattcttctcactctgtgttgatataactgataatgagctagcgtatttggagtgcatccatttatttgtagaaatattggatcacttcttcagcaacgtgtgtgagctagatttggtctttaacttccataaggtgtatctgatactagatgagttcattcttgctggagaactccaagaaacaagcaagagggcgatcatagaaagaatgggggagctggaaaagcaagagtgaaatgtgttttatttgttgtgttcatacgcttggaattattttgggtcccatatttgtcttaagattggacatataatttgtgttttggtcatgtttgggtttctcctttctcatacattttactgatggatggttgtaatactcttataattctttttagatttattattaaatcgatataaatttaat

SEQ ID NO: 3116 - DNA, 666 bp, Lippia dulcis
cctaaaattgcatcaattttcaatataaacattcctgggtttcaacagttggatcttgggctttcaatcgatctctccaagatgatccgattcatactgttgcagaacaggcaagggaaaactcgactggccaaatattatattccgctcgaggaatccgagaagcataaggttgagtatgaggttcatcggctagttgtgaatagggatcccaaattcaccaactttgtggagtttagaacccacaaagttatctacaggcgatatgctggattatttttctcactatgtgtagacattaccgataatgaattggcttacttggaatccattcacttatttgtggagatactcgatcatttcttcagcaatgtctgcgagttggatttagtatttaatttccacaaggtgtacctcatacttgatgagttcatacttgctggggaactccaagaaacaagcaagaaggcgatcatagagagaatgggggaattggaaaagcaagagtaaagattctttcaatctgtcaatgcggatgactgagttcaatcaagccatattctttgtaacatgttgaaattagtagctgtattttacattaagctgactgtttgtaaagaatgctgtgtgcctgagtgttttttttgattggtgaatttatggcta

SEQ ID NO: 3117 - DNA, 815 bp, Lippia dulcis
cattattgaattgaaatgagggattcgcagacaattttccaacaatagtcaatatagggaccaaatcaaccaaagcaattaatcccctctacttcaaaatcgtactattgttcgttgcggagctcgcatcaaatctcgaaaaatgatccgcttcatactattgcagaacaggcaagggaaaactcgattggccaaatactacattcctctcgaggaatccgagaagcataaggttgagtacgaggttcatcgtttggttgtcaatagggatcccaaattcaccaatttcgtggagttccgaacccacaaggtcatctacaggcgatatgctggtttgtttttctcgttgtgtgtagacattacagacaatgaattggcttatttggagagcattcacttatttgtggagatactggaccattttttcagcaatgtgtgtgagctagatctcgtatttaatttccacaaggtatatctcatactagatgagttcatacttgctggggaactgcaagaaacaagcaagaaggcaatcatcgagagaatgggagaattggaaaagctggattaatggttgcttggcagctcttgcatcgggttactcaatactgatattcagctaaaaccggctcctgcgtctcttgcattgggttatatatttatcatttgaggttttcaacttcttgtttgtaaagaatgccctaaaaattatccttgatttgtaagttttatttacatgcttgttgattaagagctctgtaggaaatggaaaaggatacaatctgcacttgataaatttgatgatgaaatattaa

SEQ ID NO: 3118 - DNA, 894 bp, Papaver somniferum
ccagctgattcctgcgaaacttccattggcagaggaacagaagacggaaaagatctaaaccagaacaaaatcagaaacacattttgttctccttacaaaccctagattctcgtaacgtgcgagattttcacctttttacgacaatcatttctccttgttctagaaatgattcgtttcatattgttgcaaaatagacaaggcaaaactcgtcttgcaaagtactacgttcctctagaggaatctgagaagcacaaggttgaatacgaggttcatcgtctggtggttaatagggatcccaagtacacgaattttgtcgagttccgtacaaacaaggttatctacagacgatatgcaggactgtttttctccatgtgtgttgatataacggataatgagttagcatacttggagtgcatccatttatttgtcgaaatattggatcatttcttcagtaatgtttgtgagctagatttggttttcaatttccataaggtatatctaattctcgatgaatttattctggctggagagctccaggaaacaagtaaaaaggctatcattgagagaatgggggagttggaaaagcaagagtgagaagcctacgttcaagatgagcttgctgtcctgttgttgtgcatcacagttcagtcctatctgcaatttgttaattcgattgtataagtaattaaatgatatgaatgtcaaacaggacttatttattcttgtgtctcaggcagtattattgttattattattcagagtaaatcaagtacaaatgtctatttcttccaccttgatgtatatacatgttggtgaaatgtcgttattatttctgcttaatggtttcttccgactaaattccatttgcattctatgaagatgcgttgaattgga

SEQ ID NO: 3119 - DNA, 851 bp, Papaver somniferum
gcattttcgatccaaccccatgaatcagctgattcctgcgaaacttccgttggcagaggaacagaagactgaaaagatctaaaccagaacaaaatcagaaacacatttgttcttcttataaaccctagattatcgtaacctgccgaatctgttcaccgacaatcatttctccttgtcctagaaatgattcgattcatattgttgcaaaacagacaaggcaaaactcgtcttgcaaagtactacgttcctcttgaggaatctgagaagcacaaggttgaatacgaggttcatcgtctggtggttaatagggatcccaagtacacgaattttgtcgagttccgaacaaacaaggttatctacagacgatatgcaggactgtttttctccatgtgtgttgatataacagataatgagttagcgtacttggagtgcatccatttatttgtcgaaatattggatcatttcttcagtaatgtttgtgagctagatttggttttcaatttccataaggtatatctaattctcgatgaatttattctggctggagagctccaggaaacaagtaaaaaggctatcattgagagaatgggggagttggaaaagcaagagtgagaagcctatgtacaagatgagcttgctgttctgttgttgtgcatcacagttcagtcctctctgcaatttgtttattccattgtataagtgattaagtgataggaacgtcaaacaggacttctttattcttgtgtcccaggcagtattattaatcaagtacagatgtctgtttcgtccgccttgatgtatacacttgttggtgaaatgtcattattatctctgctcaaaaaaaaaaaaaa

SEQ ID NO: 3120 - DNA, 902 bp, Papaver somniferum
ggaagaagcatgctggataaatttttgggttgctgatagcattttcgatctaaccctctacgaatcagattccagagaaaccttccatcggcagaggaacagaagactgaaaagatctaaaccaaaagaaaatcagaaacacatttgttctccttacaaaccctagattctcgtaacctgccaattttttctcctttttacgacaatcatttctccttgttctagaaatgattcgattcatattgttgcaaaacagacaaggcaaaactcgtcttgcaaagtattacgttcctcttgaggaatctgagaagcacaaggttgaatacgaggttcatcgtctggtggttaatagggatcccaagtacacgaattttgtcgagttccgtacaaacaaggttatctacagacgatatgcaggactgtttttctccatgtgtgttgatataacggataatgagttagcgtacttggagtgcatccatttatttgtcgaaatattggatcatttcttcagtaatgtttgtgagctagatctggttttcaatttccataaggtatatctaattctcgatgaatttattctggctggagagctccaggaaacaagtaaaaaggctatcattgagagaatgggggagttggaaaaacaagagtgagaagcctatgttcaagatgagcttgcttcctgttgttgtgcatcacagttcagtccgctctgcaatttgtttattcgattgtataagtgattaagtgataggaacgtcaaacaggacttctttattcctgtgtctcaggcagtattattattcaagtacagatgtctatttcttccgccttgatgtatatacatgttggtgaaatgtctattattatctctgccgaatggtttcttccgaactaaa

SEQ ID NO: 3121 - DNA, 790 bp, Raphanus sativus
gagagagagagatctgaatcgaaagaaattgggttacatctccggtctgatcgctcgtgaaatctccagagaaaatgatccgattcatattattgcagaacagacaagggaagactcgtcttgccaagtactatgtccctctcgaagaatccgagaaacacaaagtcgaatacgaggttcataggttagtggtgaaccgcgacgcaaaattcaccaatttcgttgagtttagaacacacaaggtgatatacaggcgttacgctggactgttcttctccgtgtgcgtggatataacggacaatgagttggcttaccttgagtgcatccatttgtttgtggagattttggatcatttcttcagcaatgtctgtgagcttgatctggtcttcaacttccacaaggtgtacttgatacttgatgaattcattcttgctggagaactccaagaaaccagcaaaagggcgatcatcgagaggatgtcagagctcgagaagctagagtgatatgattgtttctcaaagagctggggttattgtttaatagatgtcttggtcactcttttccttggcgtgtccagagatttgatattctttgttgagttgaagacgacaatggtgatgttaagattatttgtaaaaggatataaaacgactctgttgagatcactatccaaaatttgctttatgtgagattttctttcaactagtgaggttacttgctagttaccacagccattaaggcatgtataaagaaaatgtttgatttgagtatatgataagatcctaaacca

SEQ ID NO: 3122 - DNA, 832 bp, Raphanus sativus
tttttggaaatcagtaaatgtattagtttgtctaaagaaagtctgtttcgtgaaaattcaaagcgagagagagagatctgaatcgaaagaaattgggttacatctccggtctgatcgctcgtgaaatctccagagaaaatgatccgattcatattattgcagaacagacaagggaagactcgtcttgccaaatactatgtccctctcgaagaatccgagaaacacaaagtcgaatacgaggttcataggttagtggtgaaccgcgacgcgaaattcaccaatttcgttgagtttagaacacacaaggtgatatacaggcgttacgctggactgttcttctccgtgtgcgtggatataacggacaatgagttggcttaccttgagtgcatccatttgtttgtggagattttggatcatttcttcagcaatgtctgtgagcttgatctcgtcttcaacttccacaaggtgtacttgatacttgatgaattcattcttgctggagagctccaagaaaccagcaaaagggcgatcatcgagaggatgtcagagcttgagaagctagagtgatatgattgtttctcaaaaagctgggtttattgtttaacatgttttggtcattcttttccttggcgtgtccagagatttgatattctttgttgagttgaagacgacaatggtgatgttaagattatttgtaaaaggatataaaacgattctgttgagatcactatccaaaatttgctttatgtaagattttctttcaactagtgaggttacttgctagttaccacagccattaaggtatgtataatgaaaatgtttgatatgtgta

SEQ ID NO: 3123 - DNA, 519 bp, Salvia sclarea
ctactagaccttggctgtcactcaaaattaattcttcaaaaatgatccggttcatactactgcaaaacaggcaagggaaaactcgattggccaaatactacattcctctcgaggaatccgagaagcataaggttgagtacgaggttcatcgtttggttgtgaatagggatcccaaattcaccaatttcgtggagttccgaacccacaaggtcatctataggcgatatgctggattatttttctcgttgtgtgtagacattacagacaacgagttggcttatttggagagcattcacttatttgtggagattctggaccattttttcagcaatgtgtgtgagctagatcttgtatttaatttccacaaggtatatctcatactagatgagttcatacttgctggggaactgcaagaaacaagcaagaaggcaatcattgagagaatgggagaattggaaaagctggactaaagaatgttgggcagtgcataggaggtcaatcaggctgcacaatactctt

SEQ ID NO: 3124 - DNA, 946 bp, Sarracenia psittacina
ggggaaaattcgaacctgcgactcggtttcaaaaaaaaaaaattcaaacctgcgacttcttcgtcttcacgccttcaccaaaattgatttttgttcatctttttcacaccgttgtcgtctgatcttcgctcgctgcacacaaaaggcttgatcgttgcccgctttcttctactttgattctgcgatctgttcaaaaatgatccgtttcatactactccagaacaggcaggggaagacgcgtctcgccgagtattacattcctctcgaggaatccgagaagcacaaggtcgaatacgaggttcatcggttggttgtgaacagagatccaaagttcaccaatttcgttgagtttcgaacgcacaaggttatctacaggagatatgctggattatttttttcattgtgtgtcgatataacggataatgagttggcctatttagagtgtattcacttgtttgtggagatattggatcattttttcagcaacgtttgcgagctagatttggtgtttaattttcacaaggtgtatctgatactagacgagttcattcttgctggggagctccaagaaacaagcaagagggcaattatagagagaatgggagagttggaaaagctggagtgaagaattatgatacaggcagagcatgttcagctctaggatggaccctcccccttctaccccaagcttttactttcggccttcggtccatcaagaattaagttcaaaaaccaactttttccggcttaatttgtctactcaatattgcctttctgagtttggtatttgttgtttaaatcaattcattgacttctgttacacgcatattacataatttgtgcattcttttgtaatttgtgtacattgtatccgaattctccttacttttgatagtaatgggggccgacttgggtcgatcaactcttagccttcgcttggtaatgg

SEQ ID NO: 3125 - DNA, 776 bp, Helianthus annuus
cctgcaaaacctccattgattcatcctcctccagcttcattgacacaacaatgatccggttcatactccttcagaacaggcaaggtaagactcgtctcgcgaagtattacattcctctagaagaatcggagaagcacaaggtcgaatatgaggttcatcgattggtggtgaatagagatccgaagtttactaatttcgttgagtttcgtacacacaaagttatctataggcgatatgctggactgttcttctcactatgtgttgatataactgataacgagctagcatatttggagtgcatccatttatttgtagaaatactggatcactttttcagcaacgtgtgcgagctagatttggtcttcaacttccataaggtgtatctgatactagatgagttcattcttgctggggaactccaggaaacaagcaagagggcaatcatagaaagaatgggggagttggaaaagcaagagtgaggtgtgatttctttgttgtggtgtgttcataagctcggttttatttttccgcatcttgagattgaatgtgtaatttgtgtttttatcatatttgttaagtgttattaaacacaagttttactgcttactaaaggtcaacgtataacggatcttatattgatggttgcagtaagtcgcgaattatattttaattttcttctacttgtaagtacattcttataaaggtttttaacagtcattggttttgtcctagtcacttttgggttcatgtttgaaaagtggtatgtttgggttatg

SEQ ID NO: 3126 - DNA, 1084 bp, Utricularia gibba
gagcgattcagatttgtatttgggaatcctcatctcgtcgataatgatcagattcatactgttgcagaacaggcagggtaaaactcgcctcgctaaatactacattcctctggaggaatccgagaagcataaagtcgagtacgaggttcatcgtttggttgtcaatagagatcccaaattcaccaacttcgttgagtttcgaacccacaaagttatctacaggagatatgcgggtttattcttctcactgtgtgtagacatcactgacaacgaactggcctatttggagagcatacacttgttcgtagagatactcgatcatttcttcagcaatgtgtgcgagctggatttggtcttcaatttccacaaggtttatctgatattggatgagttcattcttgctggtgagttgcaagagaccagcaaaaaggcgatcatcgagagaatgggagagctggagaagcaggagtaggagcatcagatcacaccattgttgtagttcattgactttcctgcatctttctgcagctgcgttgttagagggtgaagaagtgttcaaaagactacaggatcatcatctatgcgctatgtcttgattactattgacatctacaaagcacccttcttttcaaaaagtgataaaacaaaggcgttggcctgcagttgatccggtgaaaactgatgggtggttagaagaaccggaaacctgactggaacgagggctggtagtgaaccatgatcagcagcagcagtaacactagaaacggaggtacagccgtgctccagttctcggcgggtgtctcttgctgctccggcggcactcccgcgttgttctggacgtagcttcggcccagcgccaccgcgttggatagcagaatcaccaccatcggcaacaggatgagaccgatcttgaatccggtcttcttgctctccacccgctcttccaattcgccggaggattctaagtacaacaaagttatcaccagcacgcagaagacgaccagcggcagtggcggcggcgatattgtctcgtctctcctgcttaccccggggcttcttcctgctaagaacctgagacacgcaa

SEQ ID NO: 3127 - DNA, 643 bp, Vinca minor
gttttctgcagctcccttcgatatttgtggaaaaatgatccgattcatattgcttcagaaccggcaaggaaagactcgtctggcgaagtactacattccgctcgaggaatccgagaagcataaggtcgaatacgaggttcaccggctaatcgtgaacagagatccgaaattcaccaactttgttgaattccggacgcacaaggttatttacaggcgatatgctggattgtttttctcgctatgtgttgatataactgacaatgaattagcttatcttgagtgcatccatttgttcgtggagatacttgaccatttctttagcaatgtatgtgagctagatttggtgttcaattttcacaaggtatatctcatattagacgagttcattcttgctggggaactccaagaaacaagcaagaaggctattatagaaaggatgggagaattggaaaagcaggaatagagataaaaatttgcagcttcgcaaatgctatcatctatcactagtttaattccagctttttttttattgccatatgctctgcaaatggtgaccctgttgtatttctctttgcaatgtgaatttatttttatcatttattttttcttttggccgattgttttgaagtgtgtatcttgtagg

SEQ ID NO: 3128 - DNA, 894 bp, Mimulus guttatus
attccaaaagttaaataaaatcataagaaaataaactaaagagtatttttcaacagttcaatagtataatcgatttttttcaaatccatagacgcagaagaatagattaatgtcagctcaaacaattcaatccattttcagttactcagacattcctaggtttgttctttgctgaatctattcatcttcgaaaatgatccgattcataatactacagaatcggcaaggcaaaactcgattggccaaatattacgttcctctcgaggaatccgagaagcacaaggttgagtacgaggttcatcgacttgttgtgaatagagatcccaaattcaccaactttgttgagttccgaacacacaaggttatctacaggcgatacgctgggttatttttctctctgtgtgtagacattacggataacgagttagcttatctcgagtccattcacttatttgtggagatactcgatcactttttcagcaatgtgtgcgagctagatttagtgtttaatttccacaaggtatatctgatactagatgagttcatacttgctggggaactgcaagaaacaagcaagaaggcaatcatcgaaagaatgggggaactcgaaaagcaggagtaaggatttaatcaagcaggagtaactagaactgcggtgctaaagactttgaaaatcttgtctgtaaagaatgtttgtgtaccaatatttcttcggtttaatgatttcattttttagtataatcaacattttaaattaataaatattttcttaatttttggtactttgctaatgggcctagtggaataaactatgggccgagatgactttgttaatagttcgatgtatcacatttgggcttttaattaccactaaattacaacattacattttat

SEQ ID NO: 3129 - DNA, 1092 bp, Brassica juncea
aataatgggcgaatccacaaagctgccgaagatctaacggaaccttggatgcgttttcttgtgttgtgattccgggaataatgatccgattcatattattgcagaacagacaaggcaagactcgtcttgcaaagtactatgttcctctcgaggagtccgagaaacacaaagttgaatacgaggttcatagattggtggtcaatcgcgactcgaaattcaccaatttcgttgagtttagaacgcataaggttatatacaggcgctatgcaggcttgtttttctccttgtgcgttgacataacagacaatgagttggcttaccttgaatgcatccacttgtttgttgagattttggaccatttcttcagcaatgtctgtgagcttgatttggttttcaacttccacaaggtgtacttaattctggatgaattcattcttgctggagagcttcaagaaacaagcaagcgggcgatcattgagaggatgtcagaactggagaagttacagtgatgagattgggagattaaatgttagtcaagaaggaaaatgagcagtatgcgtgttctgttttgcccttttcttttatgttcggtctaccacattttgtttttgcattttgatttattaaaccgcaaatggtaacagaacatacatttggactgatcaaagaaagaaactgatggtatgagtgggacattgtattgaaaatacctgtcgtcctttaacaaaaaagagtggactggattaactgatgatgtcaaaatctgaaagaggaaacataaaacaacagtacaagattattctcaccgtttaaacgacgacataaaagtcatccatctatgaattgactgactctccccattcatttggaaaaaaaagacaaataataatacaacagcacatcttttcaccaatttgatcaccatcatcaatgtccaaattgcagagcatcatcgacggccaaagccaatgaagcagcagcaccaacatatgtgtgtggagttaacctcaaaagctgagatttcgcttcttcaggcaaatccaagcctttgataaactcttgtatgctctcttcattcacagctcttcctct

SEQ ID NO: 3130 - DNA, 2172 bp, Lactuca sativa
attttatttgaccagaaaagaaatagccaggcatcttaaacttccacaaaactgcgggggcctttttagaactttttctagcaatttggtcttcagtagtcgaaaattcacccttcaacttgaagcatttcgcaattcccccgactttgaagaaccgatcatttccttcttactgctcgaatcgcgcgataatgatccgattcattctgcttcagaataggcaagggaagactcgtctcgctaagtattacattcctcttgaagaatccgaaaagcacaaggtcgaatacgaggttcatcgattggtcgtaaacagagatcccaaattcactaactttgttgagtttcgtacacacaaagttatatacaggagatatgctggactttttttctcactttgtgttgatataacggataatgagcttgcttatttggagggcatccatttatttgttgaaatactcgatcacttcttcagtaatgtctgtgaactagatttggtcttcaacttccataaggtgtatctgattctagacgagttcattcttgctggtgaatttcaagaaacaagcaaaaaggcaatcatagagaggatgggagaattggaaaagcaggagtgagatgcgttttgtctagtgatcttcttggaatatctgtattttcatacatttttgattttattcatgagtattgtattgtaccttttgattttcgtaaatgaaatatttgaaaccttttgagggatacaactttcattgcatgaagtacaaataattactaaattaccatatattgttactcttactatatttacacaagttaacaagaacaattttcagaagcttattgcaaggcttgtttgttagatatacgtatgccatttacactggtgacgtcagctttaataaaatgacatatgtaaacatgaacccaacatctctttcgtgaattgttgatcccatgagtagtgatgatgtcagcttcttttggaggtggttccacgtgtaaattttctactggttgtaattctgaagttttgttgaatgtttgagccaatgcaaatagagcctcagctacttcttcttcatcttttgtacaatcttttgatttttgagtttcagtttctcgttttttcatcgctgtaaacgtagttatataaacccattatatagaatggcaatatataaataaataaataaaatattgggaaagatgatcgatttcaccaaatataccgatagaattcaatcttctaagcttctctttctttgatgatttactcaagaaaacgttgtgatccaaacctatttcgataatggatgagttaattcttgatcatgtagtgtttcttttacatatactgaagattgaagaagagttggtttgaaatttaaaggaaagacgttaaatatgtgaaagaatggggatacaaagttgttacctgtgtgtcgcatatgagttgataatcgacttgatcctccatgacctttgtccatttctgaaattatgttaatttggaagatcaaatacaatgtcaaacacagaaatttggattgcagttaataatcaaactctatcgatcatcaaaaaaccatttcgaaaatgtgagaaagtaatcagaaaattttagatttcaatttctgatcaattggtagaaaacgcttttgtgctcagagaatcacgttcttcatgaaataaagcgatcagtctctttctcacacacagtgatctgatgatgtagagatgcacacgcaaaggaagaaattcaagagctacactggatctcacatttcatatacaaaatttcagaaagaaagagacatgatttgctcaatacatgaaagaattacgcaactgtaagccaaattcatacaacaatggaaggttattaaaaaaactaattaaaaaaaaaaaggaacagagaactcacatctggaatggatggagaagaacagaatcagcaatttaccagatagaaaggaatatggtgaaatttgcagtgaagaatgatggttttttatggtgtaatcaaatcaaataaaatcaacgcattgatggaagatcaatatcgcatcattaaaatcatatattagattattctctcactaacagtagatgatatctccatgatttgtaacagatgatgaataatgagaggaataagaaacagaa

SEQ ID NO: 3131 - DNA, 752 bp, Nicotiana benthamiana
actcaaattactagtttctacgaattaattgagactcaaaaaaatcttgtgcaacttttccaagtgtttcatcagctctcttttgcctacagatcctctgtaaaaatgatccgtttcattttgcttcaaaacagacaaggaaagacacgtctggccaagtattacatccctctcgaggaatccgagaagcacaaggttgagtacgaggttcatcggttggtggtgaatagagatcccaaatttaccaattttgttgagtttcgtacccacaaggtaatatacagaagatatgcaggattatttttctcactctgtgttgatatcactgacaatgagttggcttatttggagtctatccacttgttcgtggagattttggatcactttttcagcaatgtctgcgaactagatttggttttcaatttccacaaggtatatctgatattagatgagtttattcttgctggggagctccaagaaacaagtaagagggcaattatagagagaatgggggaattggaaaagcaggagtgaagtttttcatgcttgctcaagatagacgcttgtccgttgtagtttggacccctcttcattctggccgtatttactgcattagaaactctgtaccttgttaatacctgaatgtcggttgtgtctcatttatctctaaatttattcattcatacattcaaagatgattttgtgttgcagaagaacttcataggcagtgttgctgattcattcttagttat

SEQ ID NO: 3132 - DNA, 850 bp, Olea europaea
gcgaacttcaaaagttttggcaaacactcctctgaggtcctcgcagacagcttcgtcttcaacctttggcttcatcacaaaaaacaaaagctgcactgaaactgcatttgattttataatcaaacataaaattctacgtgattcgaattgcacgatatttctccccaattgatcaaaatgatccgattcatactattgcaaaacaggcaaggaaaaactcgattggccaaatattacattcctcttgaggaatccgagaaacacaaagtcgaatacgaggttcaccggttggttgtaaacagagatcccaaatttactaattttgttgagttccgaactcacaaggttatctataggcgatatgctggattgttcttctcactgtgtgttgacatgactgacaatgagttggcttatctggaatccattcacttgtttgtggagatactggatcattttttcagcaatgtctgtgagctagatttggtatttaattttcataaggtatatcttatcttagacgagttcatacttgctggagaactccaagaaacgagcaagaaggcaatcatagagagaatgggggaattggaaaagcaggaatagggtttcatgtggtggacaattaacaatctttttgagccatttatcaacatcactcggagaacacaaaaacgctacttattgtgatgattgtcgtctgatcagtactgcttccttcttatttcttttgcacccattgttttcctaattccgacaaggagaccttgtttacaatcccggaaatgcatttgtttgtaaatttctttggttttcttgtaacgatggtttgttgaacctaagcaaatga

SEQ ID NO: 3133 - DNA, 1074 bp, Amborella trichopoda
agagaggaagggagggccctcatttgcgaaattttctttctcctccaaaacttctcaggggcttttctcctgctattttcctcgagaatccggtcatcaatctgcccgtttgaagccaaaggtggttccccttctctctttagggctcttggatctgaatcagcttcatccttggccttttagtctaaggagcaggcatttttggtgcccttattctattactgtcctttttccgaataagcagcaagagttgtgctggtccttgttataatccaccatgatccggtttatattgcttcagaacaggcaagggaagacccgtcttgcaaaatactatattccactggaggagtctgagaagcacaaggttgaatatgaggttcaccgattggtcgtaaacagggaccccaaattcacaaactttgttgagtttcgcactcacaaggttatttacaggcggtatgcgggattgtttttctccatgtgtgttgatatcactgataatgagctagcatacctggagtgcatacatttatttgtggagatcttggatcacttcttcagcaatgtgtgtgagctggatttggtatttaatttccataaggtatacttgatcctggatgaatttatacttgcaggggagctgcaagaaacaagcaagagggcaatcatagagagaatgggagagttggaaagacaggagtgagaagcacagatttgaaggagtattgtagaggcttgggcgtgtttcattcttctactggtttccatcttgtattttgtgttcatttgatttcaccattttgactgatttcatgtctaagctttttctattcaagttttggaaatctgtttacactgttcaagttatcaagcttataacatttatatgtcatgtcaccgagcctaccttgttgtgtagcctcaagtgatggatcgttccaatgacatttttatggccctcggagatgtaaacagctttggtagtttgtatttggaaattctagtttctaaggacatgatgaaatgaatcacttagtaaaattgtgaaagtaaaattgtgaaatgagtaaa

SEQ ID NO: 3134 - DNA, 1077 bp, Amborella trichopoda
gggattttagagaggaagggagggccctcatttgcgaaattttctttctcctccaaaacttctcaggggcttttctcctgctattttcctcgagaatccggtcatcaatctgcccgtttgaagccaaaggtggttccccttctctctttagggctcttggatctgaatcagcttcatccttggccttttagtctaaggagcaggcatttttggtgcccttattctattactgtcctttttccgaataagcagcaagagttgtgctggtccttgttataatccaccatgatccggtttatattgcttcagaacaggcaagggaagacccgtcttgcaaaatactatattccactggaggagtctgagaagcacaaggttgaatatgaggttcaccgattggtcgtaaacagggaccccaaattcacaaactttgttgagtttcgcactcacaaggttatttacaggcggtatgcgggattgtttttctccatgtgtgttgatatcactgataatgagctagcatacctggagtgcatacatttatttgtggagatcttggatcacttcttcagcaatgtgtgtgagctggatttggtatttaatttccataaggtatacttgatcctggatgaatttatacttgcaggggagctgcaagaaacaagcaagagggcaatcatagagagaatgggagagttggaaagacaggagtgagaagcacagatttgaaggagtattgtagaggcttgggcgtgtttcattcttctactggtttccatcttgtattttgtgttcatttgatttcaccattttgactgatttcatgtctaagctttttctattcaagttttggaaatctgtttacactgttcaagttatcaagcttataacatttatatgtcatgtcaccgagcctaccttgttgtgtagcctcaagtgatggatcgttccaatgacatttttatggccctcggagatgtaaacagctttggtagtttgtatttggaaattctagtttctaaggacatgatgaaatgaatcacttagtaaaattgtgaaagtaaaattgtgaaatga

SEQ ID NO: 3135 - DNA, 767 bp, Artemisia annua
gtggtatcaacgcagtactccgacgggggaacgcagaagaatcaatctcaaaatcaaaatcaaaatcaaccttcaaaacatcaaatttcaaacaatcagctagaaaatgatccgattcattctgcttcaaaacaggcaaggcaagacccgtttagcgaaatattatatccctcttgaagaatctgaaaaacacaaagttgaatacgaggttcatcggttggtggtaaacagggatcctaaatttaccaactttgttgagttccgtacccacaaagttatctacaggcgatatgctggactatttttctcactttgtgtcgatattaccgataatgaactagcatatttggaaggcatccacttatttgttgaaatacttgatcacttcttcagtaatgtatgcgagctagatttggtctttaacttccataaggtctatctgatattagatgaatttattcttgccggggaattccaagaaacaagcaagaaggcaattatagagaggatgggggaattggagaagcaggagtaaagtgcaatttttctggtggtttcttcttagctcgtgtattctttctggaaatcgtcggtttatgtttagatcttctttggcattctgtattctcatacattaaagatcgttcatagtcaatgaattatcattttctttgtgtgtttttttaatgtaattgattttattcataaccatcacaccttttatttctgtaaatgatatgttgtaaacaatatccttcctttcaaac

SEQ ID NO: 3136 - DNA, 818 bp, Centaurea maculosa
  misc_feature (174)..(174): n is a, c, g, or t
  misc_feature (336)..(336): n is a, c, g, or t
  misc_feature (339)..(339): n is a, c, g, or t
  misc_feature (351)..(351): n is a, c, g, or t
  misc_feature (354)..(354): n is a, c, g, or t
gcgggggacctcaacccaaattagtcgaaaattcatccttcaaacttcaaactttccccaatttccaagagattttgaagaatcggtgatcaatttccttctgatactgcttgaaatcactcgataatgatccgattcattctgcttcaaaacagacaagggaagactcgtctngctaagtattacattcctcttgaagaatctgaaaagcacaaggtcgaatatgaggttcatcggttggttgtaaacagagatcccaagttcactaacttcgttgagtttcgtactcacaaagttatctacaggcgatatgcggggctgtttttctcactttgngtngatataaccganaangagctagcttatttggagggaatccacttatttgttgaaatacttgatcactttttcagcaacgtctgcgaactagacttggtctttaacttccataaggtgtatctgatattggatgagttcattcttgctggggaattccaagaaacaagcaagaaggcaatcatagagaggatgggtgagttggaaaagcaggaatgaaatgcatgctactcgtctcttctatttccagaaatcgactacaacttttgttctgctcttcttcagctctctcaacattttgtgtatgaaattaaagcttccatttcgatgatccatacttgatcaaaaaccattttctttcaatgtagtagtcattgttctacggtttgcattttgtaaatgaaatattgtttactaagacttgcgctaaaaagaggctgcttcaattcatgttaaaaacgaaactttgtgacactttcatt

SEQ ID NO: 3137 - DNA, 825 bp, Centaurea maculosa
gcgggggaggcgaacccaaaattggtcgaaaattcatccttcaaacttcaaacttttccccaatttccaaagagattttcaagaaatcggtgatcaatttccttcttactgcttgaaatcacgcgataatgatccgattcattctgcttcagaacagacaagggaagactcgtctcgctaagtattacattcctcttgaagaatctgaaaagcacaaggtcgaatatgaggttcatcggttggtggtaaacagagatcccaagtttactaactttgttgagtttcgtactcacaaagttatctacaggcgatatgctgggctgtttttctcactttgcgttgatataaccgataatgagctagcttatttggagggaatccacttatttgttgaaatacttgatcactttttcagcaacgtgtgcgaactagacttggtctttaacttccataaggtgtatctgatattagatgagttcattcttgctggggaattccaagaaacaagcaagaaggcaatcatagagaggatgggtgagttggaaaagcaggaatgaaaatgcatgctacttgtctcttctatttccagaaatcgactacaacttctgtctgcccttcttcagttctctcaacattttgtgtatgaaattaaagcttccatttccatgatccatacttgatcaaaaaccattttctttcaatgtagtcattattctacggttgcattttgtaaatgaaatattgtttactaagacttgcgctaaaaagaggctgcttcaattcaatgttaaaaatgctacttggtgacactttcattgcacaagg

SEQ ID NO: 3138 - DNA, 1062 bp, Ceratodon purpureus
gccagctctgctctcattcaagtcttgccatcgccggagcacttgatcgtcccgtatcgtcaacgtcggaggttcggcaaccatgattcgatttatacttttgcagaaccggcagggcaaaactcgccttgctaaatattacattccgctggaggactctgagaagcacaagctggagtatgaggttcacaggctggttgtgaacagagatccgaagttcaccaatttcgtagagtttcgaacacacaaggtcatttatcgacgttatgctggccttttcttctcaatgtgtgtcgacatcacggacaacgagctagcttatcttgaaagtattcatctttttgtggagatactagatcatttcttcagcaacgtttgtgagctggatttggtcttcaactttcacaaggtatatttgatattggatgagtttattcttgctggcgaattgcaagaaaccagcaaaaaggcaatcattgaaagaatgggcgaactggagaagcaggactagcccttgtccttatcatttttgatgtggtttcttccacagcttaagaaactcagaaagtcgattcttgttttgacaaaggcacctttgttatagagttttaggtcctaaccatttgacgttgtgtgaaacttacgtattgtaatattatagagcaatttttttcataatagacatgatgtactttatgggggcagttcagacttgtagttgggtttgaacaggcaggtcgagcttgtagagtgacttggggcttcagacatcaggttattagatctagagttcttactctggaatataggcaaaacatccattttctgaatggaatttctttgtggcagtctctgccatgggagtaggagagacagtccgtgttgactctggagctttgttcctggctcataattcggttctcctatattttccccacttcaattctaatatctggagtatccagagaaatttaaagttcgacagggcttgttgagtttgtcgatgctaagatttttatatttcttcacaatactcgagctgtcacaagttggttgcctctc

SEQ ID NO: 3139 - DNA, 821 bp, Ceratodon purpureus
acgaggctcgccatctagaagaagcggtctgatcacctcaacccagtttccggagcaatgattcgatttattcttctgcagaatcggcagggcaaaactcgcctggccaaatattacattccgttggaggattctgagaagcacaagcttgagtatgaggttcacaggctggttgtaaacagagacccgaaattcacgaattttgtagagtttcgaacacacaaggtcatttatcgacgttacgctggccttttcttctcaatgtgtgtggacatcacggacaacgagctggcttaccttgaaagtattcatctttttgtggagatattggatcattttttcagtaatgtgtgtgagctcgatttggtgttcaatttccacaaggtatatttgatactagacgagtttattcttgccggcgaattgcaagaaacgagtaagaaggcaattattgaaagaatgggagagctggagaagcaggattaaatagattcctttcattttctttcacagtactttcattcagaaactccattcttttttttgacgtaggatctgtactggtttcacattccctgcatttgaattttgtgaaacctgcgccttgtattattagagcagattttagcgataggcaagattcttttttgggcagtaaggtttgtgcaggctagcggtacttagatgaattcttcgttgaacctgccgcgttagatgagatcatgattctgaaagtccatgttactgctacacagtcgaatcctagtaacaacaatcaaatctaaagtttcacgttccaagacctctactttgagaatgac

SEQ ID NO: 3140 - DNA, 719 bp, Cichorium intybus
ggcggggggtgaggcagattggtcgaaattctcccttcgacttcaacttttcccaatttccagacttcgaagaaccgacagaaataactcgatcatctccttcttactgcccgaatcacgcgataatgatccgattcattctgcttcaaaacaggcaagggaagactcgtctcgccaagtattacattcctctcgaagaatccgagaagcacaaggtcgaatacgaggttcaccgattggtcgtaaacagagatcccaaattcactaactttgtcgagtttcgtacacacaaagttatctacaggcgatatgctggattgtttttctcactttgtgttgatataaccgataatgagcttgcctatttggagggtattcacttattcgttgaaatacttgatcatttcttcagtaacgtttgtgaactggatttggtcttcaacttccataaggtgtatctgattctagacgagtttattcttgctggagagttccaagaaacaagcaagaaggctatcatagagaggatgggagaattggaaaaacaggagtgacatggattttttcagtggtcttcgactttctgtattattttcatacattttggttttattcatgactattgtaccttttgatttttgtaaattgaaccttttgaagaatacaaatttcattgcgtaaaattaaattactataatttatagtggtgctcttgaaaa

SEQ ID NO: 3141 - DNA, 809 bp, Cirsium arvense
aaaattggtcgaaaattcatccttcaaagttcaaagctttcgcattttccaagagattttgaagaatcggcagaaacaactcgatcgttttcttcttgaattacgcgataatgatccgattcattctgcttcagaacaggcaagggaagactcgtctcgctaagtattacattcctcttgaagaatctgaaaagcacaaggtcgaatacgaggttcatcggttggtcgtaaacagagatcccaaattcactaacttcgttgagtttcgaacacacaaagttatctacaggcgttatgctggactgtttttctcactttgtgttgatataaccgataatgagctagcgtatttggagggaatccacttatttgttgaaatccttgatcactttttcagcaacgtatgtgaactagatttggtctttaacttccataaggtgtatctgatattagacgagttcattcttgctggggaattccaagaaacaagcaagaaggcaatcatagagaggatgggggagttggaaaagcaggagtgaaatgcatgatgtggtatttctagtacaacttctgtttggtcttcttcaacattttgtgcttctatttccatgattcatactttatcaaaaaaaaaccatttcctttcaatggattttattcgtgattatttgtaaatgaaatattgtataccaagaggcttcaatgactacattacatgtactgttcggtgaaaaaagaaaaaagtaccgactgcaaatatctgtccccccaaactctaacaatacaaaagttgacgctttcgctccatt

SEQ ID NO: 3142 - DNA, 757 bp, Cirsium arvense
aaattggtcgaaaattcatccttcaaacttcaaacttttccccaatttccaaagagattttcaagaaatcgttgatcaatttccttcttactgcttgaaatcacgcgataatgatccgattcattctgcttcagaacagacaagggaagactcgtcttgctaagtattacattcctcttgaagaatctgaaaagcacaaggtcgaatatgaggttcatcggttggtggtaaacagagatcccaagtttactaactttgttgagtttcgtactcacaaagttatctacaggcgatatgctgggctgtttttctcactttgcgttgatataaccgataatgagctagcttatttggagggaatccacttatttgttgaaatacttgatcactttttcagcaacgtgtgcgaactagacttggtctttaacttccataaggtgtatctgatattagatgagttcattcttgctggggaattccaagaaacaagcaagaaggcaatcatagagaggatgggtgagttggaaaagcaggaatgaaatgcatgctacttgtctcttctatttccagaaatcggctacaacttctgtctgctcttcttcagttctctcaacattttgtgtatgaaattaaagcttccatttccatgatccatacttgatcaaaaaccattttctttcaaggtagtccattattctacggttgcattttgtaaatgaaatattgtttactaagagtctaagacttgcgctaaaaa

SEQ ID NO: 3143 - DNA, 899 bp, Cynara scolymus
gggaaggttcatgtgacggcacttgcacatgggttagtcgatcctaagagacggggatgacggtgaaggcaaattggtcaaaattcatccttcaagttcaaagctttcgcaatttcaacgaaattttgaagaatcgtcagaaacaactcgatcgttttcttcttactgcttgaatcacgagataatgatccgattcattctgcttcagaaccggcaagggaagactcgtctcgctaagtattacattcctcttgaagaatctgaaaagcacaaggtcgaatacgaggttcatcggttggtcgtaaacagagatcccaaattcactaacttcgttgagtttcgtacacacaaagttatctacaggcgatatgctggactgtttttttcactttgtgttgatattacagataatgagctagcgtatttggagggaatccacttatttgttgaaatcctcgatcactttttcagtaacgtctgtgaactagatttggtcttcaacttccataaggtgtatctgatattagacgagttcattcttgctggggaattccaagaaacaagcaagaaggcaatcatagagaggatgggggagttggaaaagcaggagtgagatgcatggtgctatttctagaaatcaagtacaatttctgtttggtcttcttcagctctctgaacattttgtgtatgaaagttccatttccatgattcatgcttgatcgaacaccattttctttcaacggatttcattcgtgattattgtatatgaaatacggtataccaagacttcccctaaaagaggattcagtgactacattacatttactggtctagggtgttaatatgaactggtgactttcatgcacaaggtaggtatatgaattgcattttcatgtcta

SEQ ID NO: 3144 - DNA, 761 bp, Solanum melongena
gtcatttaaaattttcttgtctggcacctcagttctgaccctgggcttttaccagtttttacaaattgaagaatcaaacagactttttcaagtgtttcctcagctctggaaaaatgatccgttttatattgctccagaacaggcaaggaaagactcgtttggccaagtattatatacctctcgaggaatccgagaagcacaaggtggaatacgaggttcatcggttggtggtgaatagagatcccaaattcaccaactttgtcgagttccgtacccacaaggtaatatacagaagatatgcaggattatttttctcactttgtgttgatatcaccgacaacgagttagcttatttggagtccatccacttgtttgtggagattttggatcactttttcagcaatgtctgtgaattggatttggttttcaatttccacaaggtatatctgatattagacgagtttattcttgctggggagctccaggaaacaagtaagagggcaattatcgagagaatgggagaattggaaaagcaggagtgaagatttctgtgcttgctcaagagtcaaaacacacactttttcatttgccttcatgacctgcacttctcttgtggctggctgtatttactgcattagtgattctgtatcccgttgataccttcattttattgtgcctcattttatttttatatacaagattattgattcatacatttaaaggtagtttgcaagtttaagtatgaatatctctatcttttg

SEQ ID NO: 3145 - DNA, 595 bp, Fraxinus spp
ggttccagaaaggtgcaaaggagagtctacatgtactatgattgttcaaccttttggcttcattacacgaaacaaaagctgcaattaaactgcatttgaattttcaatttttcgtgattcgaattgcacaatctttctccccaatcgatcaaaatgatccgcttcataatattgcaaaacaggcaaggaaaaactcgattggctaaatattacattcctcttgaggaatccgagaaacacagagtcgaatacgaggttcaccggttggttgtaaacagagatcccaaatttactaattttgttgagttccgaacacacaaggttatctataggcgatatgctggattattcttctcactgtgtgttgacattacagacaatgagttggcttatttggaatccattcacttgtttgtggagatactggatcattttttcagcaatgtctgtgagctagatttggtatttaattttcataaggtataccttatattagatgagttcatacttgctggagaactccaagaaacaagcaagaaggcaatcatagagagaatgggggaattggaaaagctggaatagggtttcatgtggt

SEQ ID NO: 3146 - DNA, 740 bp, Gerbera hybrid cultivar
agttcaaactcttcgcatttccatagcgtttgaagaatcggcaaagaaactcgatcgttttcttccaactgcttgaatcacgcgataatgatccgattcattctgcttcaaaacaggcaagggaagactcgtctggctaagtattacatgcctcttgaagaatcggaaaagcacaaggtcgaatacgaggttcatcggttggtcgtaaacagagatcccaaattcactaactttgttgagttccgtacacacaaagttatctacaggcgatatgctggtctgtttttctccctttgtgttgatataactgataatgagcttgcatatttggagggcatccacttatttgttgaaatactcgatcacttctttagtaacgtgtgcgagctagatttggtcttcaacttccataaggtgtatctgatattagatgagttcattctggctggggaattccaagaaacaagcaagaaggcaatcatagagagaatgggagagttggaaaagcaggaatgaaatgcatttttccggtggttggttgttcatgagctcaatttctgtttttgtcagtaaaacttttcatttccgtcgttcataaattgatcaaaaatcattttttaatgttttcgtgattataagttgattttgttagtcactattgtatggatgcatgttgtaaaggagatgatgttatgttggactactatttggtgacggaatacaacttttgcacaaaaaaa

SEQ ID NO: 3147 - DNA, 782 bp, Ipomoea batatas
ggggattgacgcgtgagagtttttacgccagtctcgatcgtcgactctgaactctgacttctcgtcgcagtcggacccgaatctccagccaccgctctcccggcggcggaggagggaaggaaaaagcttctgatttccttttagcgcgagcttgaatcaactcaagcacttgctttgtgccagtttatactctgaaaatgatccgattcatactgctccagaaccggcaaggtaagactcgattggccaagtattacattcctctggaggaatccgagaagcacaaagtcgaatacgaggttcacagattggttgtgaacagagatcccaaattcaccaacttcgtcgagttccggacctacaagataatctacaggcgatatgcgggattgtttttctcgctctgtgttgatataacagacaatgagttggcttatttggagtgcatccacttatttgtggagattttggatcacttcttcagcaatgtttgcgagttagatttggtttttaactttcacaaggtatatctgattctggatgagttcattcttgctggggagctccaggaaacaagtaagaaggccatcatagagagaatgggtgaactggaaaagcaggaatgaagccgccctgttttcacttttatctggcatcaacaatatatggcacctctgttgtcaccagactgaattttattgaataccatttacccatctgattttttcttgtgcttattgtaattctgtttgattgccagcatttgtaaaggaggttgaata

SEQ ID NO: 3148 - DNA, 867 bp, Ipomoea nil
gattgagtttttacgccagtctcgatcgtcgactctgaactctgacttctcgtcgcagtcggacccgaatctccagccaccgctctcccggcggcggaggagggaaggaaaaagcttctgatttccttttagcgcgagcttgaatcaactcaagcacttgttttgtgctagtttatactctgaaaatgatccgattcatactgctccagaaccggcaaggtaagactcgattggccaagtattacattcctctggaggaatccgagaagcacaaagtcgaatacgaggttcacagattggttgtgaacagagatcccaaattcaccaacttcgtcgagttccggacctacaagataatctacaggcgatatgcgggattgtttttctcgctctgtgttgatataacagacaatgagttggcttatttggagtgcatccacttatttgtggagattttggatcacttcttcagcaatgtttgcgagttagatttggtttttaactttcacaaggtatatctgattctggatgagttcattcttgctggggagctccaagaaacaagtaagaaggccatcatagagagaatgggtgaactggaaaagcaggaatgaaggctcatggcaccctgttttcacttttatctggcatcaacaatatatggcacctctgttgtcaccagactgaattttattgaataccatttacccatctgattttgtctttgtgcttattgtaattctgtttgattgcccagcatttgtttgcactttacatgtaaaggaggttgaatactgaaattacaagtcttctgagttttgtaatctcatctgaaagaaccagtttgccaatgctcacacaatattg

SEQ ID NO: 3149 - DNA, 783 bp, Actinidia deliciosa
  misc_feature (223)..(223): n is a, c, g, or t
  misc_feature (605)..(605): n is a, c, g, or t
  misc_feature (613)..(613): n is a, c, g, or t
  misc_feature (624)..(624): n is a, c, g, or t
  misc_feature (628)..(628): n is a, c, g, or t
atcgtcttatgatcttcgctcgcttcacgtaaagcctcggattgttgcaatttataaaatgatccggttcatactgcttcaaaacaggcaggggaagactcgtctcgccaagtattacattcctctcgaggaatccgagaagcacaaggtcgaatacgaggttcatcggttggttgtgaacagagatcccaagttcaccaattttgttgagttccgcacccanaaggttatatacagaagatatgctggattatttttctcattgtgtgttgatataacggataatgaattggcatatttggagtctatccacttatttgtggagatattggatcattttttcagtaatgtctgtgagctggatttggtatttaattttcacaaggtatatctgatattggacgagttcattcttgctggggagctccaagaaacaagcaagagggcaattatagagagaatgggggagttggaaaagctggagtaaaggacaatgttgctggcagagcacggtcagattctgattttgtttccatctatcctttacctcctttgggggattaatttgtttacctatttaaactgaatgacttcgtatgacttcncttcctgncttttctatgncttntctatatcttgaacgtgcctctgccttgtgtatttcttgtgtgacatgatcaattcattgccatatattacagatggacaagattgtttgtgcatatatcattatgttggtgagcctgttaaatcaattgattggctcctattatacaaaaaaaa

SEQ ID NO: 3150 - DNA, 712 bp, Lactuca sativa
cgggagtttttcgtagtcgaaaattcacccttaaacttgaagcttttcgcaattcccccgactttgaagaaccgatcatttccttcttactgctcgaatcgcgcgataatgatccgattcattctgcttcagaataggcaagggaagactcgtctcgctaagtattacattcctcttgaagaatccgaaaagcacaaggtcgaatacgaggttcatcgattggtcgtaaacagagatcccaaattcactaactttgttgagtttcgtacacacaaagttatatacaggagatatgctggactttttttctcactttgtgttgatataacggataatgagcttgcttatttggagggcatccatttatttgttgaaatactcgatcacttcttcagtaatgtctgtgaactagatttggtcttcaacttccataaggtgtatctgattctagacgagttcattcttgctggtgaatttcaagaaacaagcaaaaaggcaatcatagagaggatgggagaattggaaaagcaggagtgagatgcgttttgtctagtgatcttcttggaatatctgtattttcatacatttttgattttattcatgagtattgtattgtaccttttgattttcgtaaatgaaatatttgaaaccttttgagggatgcaactttcattgcatgaagtacaaataattactaaattaccacccaaca

SEQ ID NO: 3151 - DNA, 1279 bp, Marchantia polymorpha
gttggtggtggtggcggcggaggacgacgctcaagaagtaggcagcaagaactcgtcggcaggaaggtgtatcgtgggactcgtggaaggccgagaggaggggacggtcaggactgagaaggcaggacaggaggagcggggcgggagagaccgcagtgactcggaagcgcctcgttgcagccatgattcgtttcattctactacaaaatcgtcaaggaaagaccaggcttgcaaaatactacgtcccccttgaggattctgaaaagcacaagctggagtatgaggttcaccgattagtggtcaacagagacccaaagtttacaaacttcgtggagttccggacacacaaggttatttacaggcgctatgcaggtctctttttctccatgtgtgtggacataaccgacaatgagttggcatatcttgagagtattcatctctttgtagaaatactggatcatttcttcagcaatgtctgtgaactggacttggttttcaatttccataaggtgtacctaattcttgatgagttcatcttggccggtgaattgcaagaaacgagtaaaaaggctattatcgaacgaatgagtgaattggaacgtcaagaatagcgaaatcctacatttttcttcttgatacatcttcacattcttgggattatgacaatagggaagtgtagtgtatattttttttaaccgtggtcatttaaattcattctaattctttggtgtcgtcagtagggtctggtccaagcacaagcttctgtacaagtaggccacagataaagaatcacggagtagcgagcttttgtttgcaacaaaatgtctaccaccggactgatatcaatgtacagattgatcgattgaggcaatgcttttctcctgaaaggaccttgtttggactgtatcagaatatcagggaaactcattcactgatgagtctcattcagcagtggacaaattgagtaccacgatcggttcaatctgccttgtctcgggacttgatgtgaacggctggacctcagtccgacttgatagttaatgtgtataccacaaaccttctgtgatatactactgaggagccttgaagatacctgttgatgtgaatctgtgtcggaactttcccacattcgcaatttgacattttaagtgtaaaagtcttggcctctggaggaatagaatgtgctttgtaagatttattatgtctttagaacaaggagaggattttgaaatacctacctttcatgattctaaggcgcttatcggtgcatcatcataag

SEQ ID NO: 3152 - DNA, 688 bp, Orobanche aegyptiaca
cgatctatcaaaaatgatccggttcatgctactacagaacaggcaaggcaaaactcgactggccaagtattacattcccctcgaggaatccgagaagcataaggttgagtacgaggttcatcgtctggttgtcaacagggatcccaaattcactaactttgtggagttccgaacccacaaggttatctacaggcgatatgccgggttatttttctcattttgtgtagacatgacggacaatgagttagcttatttggagtgcattcacttgtttgtggagatattggatcatttcttcagcaatgtatgcgagctagatttggtgtttaatttccacaaggtgtacctcatattggatgagttcatacttgctggggaactccaagaaaccagcaagaaggcaatcatagagagaatgggggaactggaaaagcaggaataatgattctttctatcagtaacaactatgatatgtcaatgaagccatattttttgtatcattacaaaatatagagctctgtttgttgctacacctatttgaatctcgttgtaaaggttactgtttgtgccaaagtgtgagtttatggttgcatttgtggatagaggtttattggtgatctcattatattatgtactatttcttgatggcaatttcttcaatacacattatatgtatggtgaaaacatc

SEQ ID NO: 3153 - DNA, 858 bp, Capsicum annuum
caaaaactaaggtgaaaattctggggtagcacatcagtgctgaccattttctacgaattaaagaatcaaagagactttctccaacttttttcaagtgtttaatcagctcctttgcctacagatcctcttaacaaaatgatccgtttcatattgcttcagaacagacaaggaaaaactcgtttggctaagtattacatacctctcgaggaatccgagaaacacaaggtcgaatacgaggttcatcggttggtggtgaatagagatcccaaattcaccaattttgttgagttccgtacccacaaggtaatatacagaagatatgcaggattatttttctcactttgtgttgatatcacggacaacgagttggcttatttggagtccatccacttgtttgtggaaattttggatcactttttcagcaatgtttgtgagctggatttggttttcaatttccacaaggtatatctgatattagatgagtttatccttgccggggagctccaggaaacaagtaagagggcaattatcgagagaatgggagaattggaaaagcaggagtgaagatttccgtgcttgctcaagagtcaagacagacactttcctttgccttcatcgtctgcactgtacttctcttctggctggctgtatttactgcattagagattctgtattcttgttgataccttcatgttgctgtgcctcatttatttgtatacaagatttccttcattcataagtacatctaaaggcagtttacttttgcaaaagaacttatcaacccatgtcatttttctccatgtaccaattcacgaagcaaaatgatattggtgaattttagtcttggctgttgctgaa

SEQ ID NO: 3154 - DNA, 911 bp, Physcomitrella patens
gtcaaagctcgctcaccatcgctcgtgccctcgcgcgcaatctctcgcatctgcgcaattggcagtggaagctcatcgacagacaccgcatcacagtccagtaaccatgattcgatttatacttcttcagaaccggcaagggaaaactcgcctggctaagtattacattccgttggaggactcggaaaagcacaagctggagtatgaggttcacaggttggtcgttaacagggatccgaagttcaccaattttgttgagtttcgaacacacaaggtgatttatcgacgttatgctgggcttttcttctcactgtgcgttgatattacggacaacgagctggcgtatcttgaaagtattcatttgtttgtggagatattggatcatttttttagcaacgtctgtgagctggatttggttttcaatttccataaggtgtatttgatattggatgagttcattcttgctggtgaattgcaagaaaccagcaaaaaggcaattattgaaagaatgggcgaactggagaaacaagactagattttatccttccagtttttggtttgagtttcatctcacagcttagaaagtcggtatgtcttctgggttgggcgtgagaagtttttggtctcaactcttcatcgttgtgtgaaccttgcttgctacaagattaaagaacagattcttttagttgtagacatgatgtatttctattcaagtttcagtaggtaggttaagcctataaagacgaggcaggatcatcagcttactagattaaagattcattttcagaatggagacaagagacccaatttgtgaattgttactgtggcatgttgcctttatagcaagaggaaaattgtgttgcttctgaagtgttttttcttgtttataattcaaatcaaccatgttattc

SEQ ID NO: 3155 - DNA, 836 bp, Raphanus sativus
  misc_feature (5)..(5): n is a, c, g, or t
  misc_feature (10)..(10): n is a, c, g, or t
ggggnaaatnacttgaaaatatttaattaaattgaggattcccaaaagtgttaattgggcgaacccgcaaagctgccgaagatctcacggaacctcggatgcgttttcttttgttgtgattccgggaaaaatgatcaggttcatattattgcagaacagacagggcaagactcgtcttgcaaagtactatgttcctctcgaagagtccgagaaacacaaggttgaatacgaggttcatagattggtggtcaatcgcgactcaaagttcaccaatttcgttgagtttagaacgcataaggttatatacaggcgatatgctgggttgtttttctcattgtgcgttgacataacagacaatgagttggcttaccttgaatgcatccacttgttcgttgagattttggaccatttcttcagcaatgtctgtgagcttgatttggttttcaacttccacaaggtgtacttaatactggatgaattcattcttgctggagagcttcaagaaacaagcaagcgggcgatcattgagaggatgtcagaactggagaagcttgactgatgagattatatgatattcaagaatgaaaacgagagcagtaggagtcttccgacttccgtttagctcctttctgttatgctctgtctacgttaaacacacacctttttcatttttactcattaagacctctaatggtaaacagagaacatatatttgggcaactcaaagaaagaatatgattggtctgagacactgtgttcagacttcagatacagtttgtcttctttcgcactgattaaacagaataaaaaaaataaaaaatcatgttttgtactgt

SEQ ID NO: 3156 - DNA, 764 bp, Raphanus sativus
  misc_feature (29)..(29): n is a, c, g, or t
  misc_feature (748)..(748): n is a, c, g, or t
aagtgttaaattgggcgaacccgcaaagntgccgagaagatcttacgttttcttgtgtttgtgattccgggaataatgatccgattcatattattgcagaacagacaaggaaagactcgtcttgcaaagtactatgttcctctcgaggagtctgagaaacacaaggttgaatacgaggtccatagattggtggtcaatcgcgactcaaagttcaccaatttcgttgagtttagaacgcataaggttatatacaggcgttatgctgggttgtttttctcattgtgcgttgacataacagacaatgagttggcttaccttgaatgcatccacttgttcgttgagattttggaccatttcttcagcaatgtctgtgagcttgatttggttttcaacttccacaaggtgtacttaatactggatgaattcattcttgctggagagcttcaagaaacaagcaagcgggcgatcattgagaggatgtcagaactggagaagcttgactgatgagattatatgatattcaagaatgaaaatgagagcagtaaggagtcttccgtttagctcctttctgttatgctctgtctacccccttaaacactcaccttttcattttcattcattaagacctctaatggtaaacagaacatatatttggacaactcaaagaaagaatatgattgtatgagacattgtgttcagatacaattgtcttctttagcactgattaaacagaaagaaaaaaaacaantaatgttttgttactg

SEQ ID NO: 3157 - DNA, 758 bp, Raphanus sativus
gaagatcttacgttttcttgtgtcttgtgattccgggaataatgatccgattcatattattgcagaacagacaaggaaagactcgtcttgcaaagtactatgttcctctcgaggagtctgagaaacacaaggttgaatacgaggtccatagattggtggtcaatcgcgactcaaagttcaccaatttcgttgagtttcgaacgcataaggttatatacaggagatatgctgggttgtttttctccttgtgcgttgacataacagacaatgagttggcttaccttgaatgcatccacttgttcgttgagattttggaccatttcttcagcaatgtctgtgagcttgatttggttttcaacttccacaaggtgtacttaatactggatgaattcattcttgctggagagcttcaagaaacaagcaagcgggcgatcattgagaggatgtcagaactggagaagcttgattgatgagattatatgatattcaagaatgaaaatgagagcagtaggagtcttccgtttagctccattatgctctgtctacgttaaacacacacccttttcatttttattcattaagacccctaatggtaaacaaaacatatatttggacaactcaaagaaagaatatgattggtctgagacattgtgttcaaatacagtttgtcttctttcgcactgattaaacagaataaaaaaaaatcatgttttgtactgtaattcatgatggtttagggtattgaatgagatcatcca

SEQ ID NO: 3158 - DNA, 854 bp, Carthamus tinctorius
  misc_feature (832)..(832): n is a, c, g, or t
  misc_feature (836)..(836): n is a, c, g, or t
cgctatgcgggggcttttctgaacttcaaatcattgtagtcaatagtcttgttctcagacggtgaaagccaaaattggtcgaaaattcatccttcaacttcaagttttcccaatttccaaagagatttcgaaagaatcggtgatcatttccttctgatactgcttgaatcacgcgataatgatccgattcattctgcttcagaacagacaagggaagactcgtcttgctaagtattacattcctcttgaagaatctgaaaagcacaaggtcgaatatgaggttcatcggttggtcgtaaacagagatcccaagttcactaacttcgttgagtttcgtactcacaaagttatctacaggcgatatgcggggctatttttctcactttgcgttgatataaccgataatgagctagcttatttggagggaatccacttatttgttgaaatacttgatcactttttcagcaacgtgtgcgaactagacttggtctttaacttccataaggtgtatctgatattagatgagttcattcttgctggggaattccaagaaacaagcaagaaggcaatcatagagagaatgggtgagttggaaaagcaggaatgaaatgcatgctacttgtctcttctatttccagaaatcgactacaacttctgtctgctcttcttctgtttactcaacattttgtgtatgaaattaaagctccatttccatgattcatacttgatcaaaaaccattttctttcaatgtagtcattatcctacggttgcattttgtaaatgaaatattgtttactaagacttgtgctaaaaagaggctgctacaattcnatgntaaagaggtaacttggtg

SEQ ID NO: 3159 - DNA, 985 bp, Solanum phureja
aaacaaggtgaaaattcttctctggcacctcagttctgaccccttggggcttttgctagtttttacaaattaaagaatcaaagagatttctccaacttttttcaattgtttctccagctattttgcctgcagatcttctgaacaaaatgatccgttttatattgcttcagaacaggcaaggaaagactcgtttggctaagtattatatacctcttgaggaatccgagaagcacaaggtggaatatgaggttcatcggttggtggtgaatagagatcccaaattcaccaactttgttgagttccgtacccacaaggtaatatacagaagatatgcaggattatttttctcactttgtgttgatatcacagacaatgaattggcttatttagagtccatccacttgtttgtggagattttggatcacttcttcagcaatgtctgtgagctggatttggttttcaatttccacaaggtatatctgatattagatgagtttattcttgctggggagctccaggaaacaagtaagagggcaatcattgagagaatgggagagttggagaagcaggagtgaagatttctgtgctttgctcaagagtcgaaacaaacactttccttttccttcatcatctgcacttctcttccggctggttgtatttactgcattagacattctgtatcctgttgataccttcatgttgatgcggcctcatttaatacaagatttgttcattcatacatttaaaggtagtttgcaagtttaaatatgaatgtctcttatcttttcccagtttaaatatgaatatctttatcttttgtcaactccagaggctatattgttgttgaaagtgggaaaaagagttattacaatacgaaatttctttatttttactggccatcgtactgtgggacaacttatatttgcccttcattcagagggagctccaactcgaagtataatagaaagtaattttatagtcaaaa

SEQ ID NO: 3160 - DNA, 737 bp, Nicotiana tabacum
ggactcaaattactagtttctacgaattaattgagaatcaaagaaatctgggcaacttttccaagtgtttcatcagctcgcttttgcctacagatcctctgtaaaaatgatccgtttcattttgcttcaaaacagacaaggaaagacacgtctggccaagtattacatccctctcgaggaatccgagaaacacaaggttgagtacgaggttcatcggttggtggtgaatagagatcccaaatttaccaattttgttgagttccgtacccacaaggtaatatacagaagatatgcaggattatttttttcactctgtgttgatatcacagacaatgagttggcttatttggagtccatccacttgttcgtggagattttggatcactttttcagcaatgtctgcgaactagatttggttttcaatttccataaggtatatctgatattagatgagtttattcttgctggggagctccaagaaacaagtaagagggcaattatagagagaatgggggaattggaaaagcaggagtgaagattttcatgcttgctcaagatagacgcttttccgttgtagtttggacatcttttctgtctggctgtatttactgcattagaaattctgtgcttatgttaatacctgaatgtcgctgtgcctcatttatctccaaatttattcattcatacattcaaaggtgattttctgttgcaaaaaaacttcataggcagtgttaccg

SEQ ID NO: 3161 - DNA, 807 bp, Solanum lycopersicum
aaaggtgaaaattcttctctggcacctcagttgtgaccctgagggctttttgctggtttttacaaattaaagaatcaaagagattttttcaattgtttctacagctgttttgcctgcagatcttctgaacaaaatgatccgttttatattgcttcagaacaggcaaggaaagactcgtttggctaagtattatatacctcttgaggaatccgagaagcacaaggtggaatatgaggttcataggttggttgtgaatagagatcccaaattcaccaactttgttgagttccgtactcacaaggtaatatacagaagatatgcaggattatttttctcactttgtgttgatatcacagacaacgagttggcttatttagagtccatccacttgtttgtggagattttggatcacttcttcagcaatgtctgtgagctggatttggttttcaatttccacaaggtatatctgatattagatgagtttattcttgctggggagctccaggaaacaagtaagagggcaatcatcgagagaatgggagagttggagaagcaggagtgaagaactccgatgctttgctcaagagtcaaaacaaacacttgccttttccttcatcacctgcacttctcttccggctggctgtatttactgcattagacattctgtatcctgttgataccttcatgttgatgtggcctcatttaatacaagatttgttcattcatacatttaaaggtagtttgcaagtttaaatatgaatgtctctatctattcccagtttaaatatgaatatctttatcttttgt

SEQ ID NO: 3162 - DNA, 898 bp, Tragopogon dubius
aatgtttgcagacggcgatcgacgaagagggcaaaattggtcgaaaattcacacttcaaacttatcacaatttccaccagaggttttccagaatctgcagaaagaactcgatcgtctccttctcacagcttgaatcacgcgataatgatccgattcattctacttcagaataggcaaggtaagactcgtctcgccaagtattacattcctcttgaagaatccgaaaagcacaaggtcgaatacgaggttcatcgattggtcgtaaacagagatcccaaattcactaacttcgttgagtttcggacacacaaagtgatctacaggcgatacgctggattgtttttctcactttgtgttgatataaccgataatgagcttgcttatttggagggtatccacttatttgttgaaatactcgatcatttcttcagtaatgtttgtgaactagatttggtcttcaacttccataaggtgtatctgatattagacgagttcatacttgcgggggaattccaagaaacaagcaaaaaggctatcatagagaggatgggagaattggaaaagcaagaatgattttcttgtgtattttgggcaaatgacataaaagccactatcttatcggacttttacctgaaaagccactattaaatctttttaacctttgaaacaatattttaatatcaacaaatgaaacttgatgacctgttggtgcaaaattcaaaaaaaaaaaatcatgtagtgtatttttaggtgaaagcctgtaatatagtggtttttgtgacatttgtctgtgtattttcatacatttatgttattatatttggttttgttgatgaggattgaattttgtaaatgaaatgtttggaacttttttatgaatgcacaactttgattgaac

SEQ ID NO: 3163 - DNA, 823 bp, Triphysaria pusilla
caattctatcatctcagctttgctcagtttcagtcgttgaaaagctttcgagactttgcgattcctaagtggtgctcaaactattcttcgaaaatgatccggttcatgttattgcagaacaggcaaggaaaaactcgtttggccaaatattatattcctctcgaggaatctgagaagcataaggttgaattcgaggttcatcgattggttgtgaatagggatcccaaattcaccaactttgttgagttccgaacccacaaggttatctacaggcgatacgctggtttgtttttctcattttgtgttgacattacggacaacgagttagcttatttggagtcaattcacttgtttgtggagatacttgatcattttttcagcaatgtgtgcgagctggacttagtgtttaatttccacaaggtgtatctcatattagatgagttcatacttgctggcgaactgcaagaaacgagcaagaaggcgatcatcgagagaatgggggaattggaaaagctggagtaaagatatgatacgtggtgtttaggaggtaaattgagctgatctacttgtaacctatataaaaccaaactatctgtctcgtgttttgcttgtgccatgccatgtgaataagaacacttagttgagcttctttatgattttgataaacttgtttgtaatgagaattgtgtaccaaatatgttcttgattcttgatttagttattttgggttctggaaattcagtgcttatgccttctatgaaagggagaaaaatgtattagatttggatttttatcgtattacactgaaatattattgtttgga

SEQ ID NO: 3164 - DNA, 849 bp, Allium cepa
atttcagcttgcttccaaatatcaatgatccgcttcatattgcttcagaacaggcaaggcaagactcgactagcgaaatactacgttcctcttgaagaatcagagaagcataaggttgaatatgaggtccatcggttggtagtaaatagagatcccaaattcaccaattttgttgagttccgcacacacaaagtcatctacagaagatatgctggacctttttctccatgtgtgttgacatcactgataatgagctggcatatttggagtgcatccatctatttgtagagatattagatcattttttcagcaatgtatgcgagctcgacttggtcttcaatttccataaggtatatctgatactcgatgagttcatccttgccggcgagttgcaagaaaccagcaagagggccatcatagagagattgggggagctggagaaacaagaatgagggtttgattctattgcctcagttcggcttgaataatactgtgcttgctatttgagttttgctttttatgtcaagaagagatttacttgatctgaatctttgttcattatttagctgatatatctttacagaatatcgctctcgtgtattatgtctcgtgtacagtgaaccttgtggaggctcaaatgtttgcagctgataaactggttcagctgactagatggcaatctttgttgtaaatgagaccttatgtttatttaataacagatttttaatcttcatcggacttgcatgtacgaagtgagtggttgaagagtgaatatagtgtataaatatgagttggtggcatgtaacgtagagaatcccttgtcttataaatgtttggcaattcatatgg

SEQ ID NO: 3165 - DNA, 692 bp, Antirrhinum majus
  misc_feature (650)..(650): n is a, c, g, or t
tcaaatctcgcgaaatgatccggttcatattgttacagaacaggcaaggcaaaactcgattagctaaatattacattcctcttgaagatctgagaagctaaggtcgaattcgaggttcatcgattggttgttaatagagatcctaaattcaccaattttgttgagtttcggacgcataaagtgatctacaggcgatacgctgggttgtttttctcgctgtgcgtagacattacggataacgaattagcttatttggagtgtattcacttgtttgtggagatactggatcatttcttcagcaatgtgtgcgagctcgatttagtgtttaacttccacaaggtttacctcatattagatgagttcatacttgctggggaactccaagaaacaagcaagaaggcaatcatagagagaatgggtgaactggagaagcaagagtgaaaagttttgtccagcaatgtctatgatgtcaatcaagccacatcgcgtgtaagattacaaaaaaaacacgagcattattcgaggtgctaagcctggaggagtcttaaatatcttgtttgtaaagaatgttgtatgccaaatgttctttgattggttgagttcatgattgcaagtccagtgactttacaaactctttttcttgtccgganattatcagatatttatgcatgatttgattatgttattgactg

SEQ ID NO: 3166 - DNA, 596 bp, Bupleurum chinense
tccaatatagtttgacagacgcgcacacacactgctccatctaaaaaatcgctcttcgattcatcaaaaatgatccgattcatcttgctccaaaaacaggcagggaaagactcgtctcgccaagtattatgttcctcttgaagaatcagagaaacacaaagttgaatacgaggttcatcgattggtgtgaatagagatcccaagttcactaatttcgttgagtttcgaacgcacaaggttatctacaggagatatgctggattgtttttctcactgtgtgttgatataactgacaatgaattagcatacttagagtgcattcatttgtttgtggagatactagatcacttcttcagtaatgtctgtgagctagatctagtatttaattttcacaaggtatacttgattctggatgaattcattcttgctggtgaacttcaagaaactagcaagaaggcaattatagaaagaagtggggaactagagaagcaggattgaagacctaaattttgctagcacatgatgtatatgggagcagtcatctcccttgtattattaggtaaaaaagtaaattttacagcacctccagtattata

SEQ ID NO: 3167 - DNA, 714 bp, Mimulus guttatus
tctttctctgttaattattgcagatccgattcataatactacagaatcggcaaggcaaaactcgattggccaaatattacgttcctctcgaggaatccgagaagcacaaggttgagtacgaggttcatcgacttgttgtgaatagagatcccaaattcaccaactttgttgagttccgaacacacaaggttatctacaggcgatacgctgggttatttttctctctgtgtgtagacattacggataacgagttagcttatctcgagtccattcacttatttgtggagatactcgatcactttttcagcaatgtgtgcgagctagatttagtgtttaatttccacaaggtatatctgatactagatgagttcatacttgctggggaactgcaagaaacaagcaagaaggcaatcatcgaaagaatgggggaactcgaaaagcaggagtaaggatttaatcaagcaggagtaactagaactgcggtgctaaagactttgaaaatcttgtctgtaaagaatgtttgtgtaccaatatttcttcggtttaatgatttcattttttagtataatcaacattttaaattaataaatattttcttaatttttggtactttgctaatgggcctagtggaataaactatgggccgagatgactttgttaatagttcgatgtatcacatttgggcttttaattaccactaaattacaacattac

SEQ ID NO: 3168 - DNA, 721 bp, Mimulus guttatus
tctttctctgttaattattgcagatccgattcataatactacagaatcggcaaggcaaaactcgattggccaaatattacgttcctctcgaggaatccgagaagcacaaggttgagtacgaggttcatcgacttgttgtgaatagagatcccaaattcaccaactttgttgagttccgaacacacaaggttatctacaggcgatacgctgggttatttttctctctgtgtgtagacattacggataacgagttagcttatctcgagtccattcacttatttgtggagatactcgatcactttttcagcaatgtgtgcgagctagatttagtgtttaatttccacaaggtatatctgatactagatgagttcatacttgctggggaactgcaagaaacaagcaagaaggcaatcatcgaaagaatgggggaactcgaaaagcaggagtaaggatttaatcaagcaggagtaactagaactgcggtgctaaagactttgaaaatcttgtctgtaaagaatgtttgtgtaccaatatttcttcggtttaatgatttcattttttagtataatcaacattttaaattaataaatattttcttaatttttggtactttgctaatgggcctagtggaataaactatgggccgagatgactttgttaatagttcgatgtatcacatttgggcttttaattaccactaaattacaacattacattttat

SEQ ID NO: 3169 - DNA, 446 bp, Manihot esculenta
gttttgatttcgtttggcagatccgattcatacttctgcagaacagacaaggcaagactcgtctcgccaaatactatgtacctcttgaagattccgagaagcacaaagttgaatacgaggttcatcggttggttgtcaacagagatcccaagttcacgaattttgttgagttccgaacacacaaggtcatatacaggcggtatgcaggattatttttctcactgtgtgttgatatcacagataatgaattggcatatttagagtgcatccacttatttgtggagatattggatcatttcttcagcaatgtttgtgagctagatttggtatttaactttcacaaggtgtatctgatacttgatgaattcattcttgctggggaactccaagaaacaagcaagaaggctatcatagagaggatgggggagttggagaagctcgagtaa

SEQ ID NO: 3170 - DNA, 842 bp, Musa acuminata
cgagcaccggtcaccaaattagaaattgatcgaacgagaatcgaccatcgggtcaaggcgaagaaagacgcatcaacttttcctctcctgcgctctctccggcgacgacgagatgatccggttcatactgctccaaaaccggcagggcaagacgcggctggccaagtactacatccccctcgaggaatctgagaagcacaaggtcgaatacgaggttcatcggctggtagtcaacagggatcccaaatacaccaattttgtcgagttccgcacgcacaaagttatttacagaagatatgcaggactcttcttttcaatgtgtgttgatatcactgataatgagttagcatacttggagtgcatccatttatttgtggagattcttgatcatttcttcagcaatgtctgtgagcttgatttggtattcaacttccataaggtatatctcatattggatgagtttattctggctggggagattcaagagacgagcaagagggcaattattgagagaatgggagagttggaaaagcaagaataagaatttggttcgtgaaatcggggccccaaagcttcggttttgtaccttcattaattagttcatgccagaggacagtaatttttttgctagtttgtgctataagatactacatgcctgtttatcgtcacctattattggagaataatagtcccttcgtacggtggactatgatatgcccatgcagcaagtactgtagttgttgcccctttggattgattagtgtcaaatgtttgaagtgtgcctcttgaacccgtttgtattttatcagtcaaaatgttgctccaaatgctgatgcgtcgtt

SEQ ID NO: 3171 - DNA, 468 bp, Nicotiana benthamiana
gatccgtttcattttgcttcaaaacagacaaggaaagacacgtctggccaagtattacatccctctcgaggaatccgagaagcacaaggttgagtacgaggttcatcgattggtggtgaatagagatcccaaatttaccaactttgttgagttccgtacccacaaggtaatatacagaagatatgcaggattatttttctcactctgtgtcgatatcacagacaacgagttggcttatttggagtctatccacttgttcgtggagattttggatcacttcttcagcaatgtctgcgaactagatttggtattcaatttccacaaggtgtatctgatattagatgagtttattcttgctggggagctccaagaaacaagtaagagggcaattatagagagaatgggggaattggaaaagcaggagtgaagattttcgtgtttgctcgagatagacacttttctgttgta

SEQ ID NO: 3172 - DNA, 667 bp, Arabidopsis lyrata
ttctccattagatttccagagaaatgatccgtttcatattattgcagaacaggcaaggtaagactcgtcttgccaaatactatgttcctctcgaagaatcagagaaacacaaagtcgaatacgaggttcataggttagtggtgaatcgcgacgcaaaattcaccaacttcgttgagtttagaacacacaaggtaatatacaggcgttatgctggattgtttttctccgtgtgcgtggacataaccgacaatgagttggcttacctggagagtatccatttgtttgtggagatactagaccatttcttcagcaatgtttgtgagctagatttggtgtttaatttccacaaggtttacttgatactcgatgaattcattcttgctggggagctccaagaaacaagcaaaagggcaatcatcgaaaggatgtcagaactcgagaagctacagtgatgactgttaggaatcactttctacttggttaacgcatgcctaccagatgtttcttggcatgttcggagatttgcaatactttgttgagttgttagacaatggtgtagtgttaacattgtgaatgaatatagagtgattctgcgaaagatcattcatccaacatttgtttatctgtgagattttcatttcaactagtgatgttactatttatttcg

SEQ ID NO: 3173 - DNA, 832 bp, Arabidopsis thaliana
cttaaaaactccatctttttgactggatagtttggctgctttacgaacctgttttcaacaaaggtcgtgaaaattcaaagtgagatctgaaagaagaaaattcctctgatcgctcacgatttctcctgaattctccattagattttgcagagaaaatgatccgattcatattattgcagaacagacaaggtaagactcgtctagccaaatactatgtccctctcgaagaatccgagaaacacaaagtcgaatacgaggttcatagattagtggtgaatcgcgacgccaaattcaccaacttcgttgagtttagaacacacaaggtgatatacaggcgttatgctggattgtttttctctgtgtgcgtggatataaccgacaatgagttggcttacttggagagtatccatttgtttgtggagatattggaccatttcttcagcaatgtttgtgagctagatttggtgtttaatttccacaaggtgtacttgatactcgatgagttcattcttgctggggagctccaagaaacaagcaaaagggcaatcatcgaaaggatgtcagaactcgagaagctacagtgatgacggttaagaatcacattctacttggttaactgcgtacctgccagatgtttcttggcatgttcagagatttgctatactttgttgagttgttagacaatggtgtagcgtttacattgtgaatgaagaatttagagtgattctgctaaagatctctcatccaacattttgtttacctgtgagattttcatttcaactagtgatgtactatttgtttcgtagaactatgataccacacatgctttgag

SEQ ID NO: 3174 - DNA, 875 bp, Cryptomeria japonica
  misc_feature (780)..(780): n is a, c, g, or t
  misc_feature (849)..(849): n is a, c, g, or t
tgcaggcccaggcctgcttcgggaggcaaggggatatcctgtgtaattatcaagcttattccgttcatacaactggaattgaattttctcgggcaccatgatccggttcatattacttcaaaacagacaaggaaagacccgtctggccaagtactatattccactggaagaatcagaaaaacacaagcttgagtatgaggtgcaccgactggttgtcaacagggaccccaagtttacaaactttgtcgagttccgcactcacaaagtgatttataggcggtacgcaggcctgtttttctcaatgtgtgtggatatcaccgataatgagctagcatatcttgaaagcattcatttatttgtggagatactggatcatttcttcagtaacgtatgcgagcttgacttggtattcaattttcacaaggtatacttgatactagacgagtttattcttgcaggggaattgcaagaaacaagtaagaaggcaatcattgagagaatgggggagctggaaagacaggagtgagaatcgtggtcgctccaagtattatcttgaaggttttgatatttgattttattctgtcaccaatgatagttgggggttgttgatttgctttacgttgcagggtgtgcagtagactgttactgcttttactcttttttttgtacaatggtaatgactaattagggattttcattgttccctctttatggagtttgcattagacttcctacttctggggaagaggattaatacactccatcgattcatttttttcnaaaaattctgtgttccaaaggatctgagttctttttttccttggaagatgttacttgatataaagctgncttataataggacgcccaatttatac

SEQ ID NO: 3175 - DNA, 1019 bp, Physcomitrella patens
gttgcaatcttcctctgcatctcgtgttcacgcgcaattcccagcggcgcttatgcaggacgagctgctctcggcccgcgtaacgtttctagaatcatgattcggtttatacttctgcagaatcggcagggaaaaactcgccttgccaagtattacattccactggaggattctgaaaagcacaagctggagtatgaggtagttcataggctggttgttaatagggatccgaagttcactaatttcgtagagttccgaacacacaaggtcatttatcgacgttatgctggccttttcttttcaatgtgcgttgatatcacagacaacgagctggcctatcttgaaagcattcatttgtttgtggagatattggaccatttcttcagcaacgtctgtgagctggatttggtcttcaacttccacaaggtgtatctgatattagacgaattcattctcgctggagaattgcaagaaaccagcaaaaaggcgattattgaaagaatgggcgagctggagaagcaggattaaccattgtccctttggtttttggtttgaaatctaccacatagcttgaagatcagaattttttttcttttcttagtgggagcaatttgagggttttaggtccccaccattttacgtcgtgtgaagcttgcctgttgtaagatttctagcagggtcgtctaataatagacacggtgtactttatggtataggtaagatttcttgtcatattttgagtaggcaggctgagcttgtagagaaagttgaggatcaatcatcaagttactagaccttggatcatacctaagcaagaaggcgacagatccatttcctgatctgcattagttcacggcagtccatgctatgggagcagaggagaaagcattgcgtttggagcgatgtctctggctcattttattcgaagccaccacgtaattgctgagttcaatttagtctgctgggctaatgtgcactgagatgaagttgaatcacaacattctatgctgggttggatg

SEQ ID NO: 3176 - DNA, 692 bp, Raphanus sativus
ggcgaacccgcaaagctgccgagaagatcttacgttttcttgtgtcttgtgattccggggaaagaatgatccgattcatattattgcagaacagacaaggcaagactcgtcttgcaaagtactatgttcctctcgaggagtctgagaaacacaaggttgaatacgaggtccatcgattggtggtcaatcgcgactcaaagttcaccaatttcgttgagtttagaacgcataaggttatatacaggcgatatgctggattgtttttctcattgtgctttgacataacagacaatgagttggcttaccttgaatgcatccacttgttcgttgagattttggaccatttcttcagcaatgtctgtgagcttgatttggttttcaacttccacaaggtgtacttaatactggatgaattcattcttgctggagagcttcaagaaacaagcaagcgggcgatcattgagaggatgtcagaactggagaagcttgattgatgagattatatgatattcaagaatgaaaatgatgagtaggagtcttccgtttggctcctttctgttatgctctgtctaccttaaacacacaccttcccgtttttattcattaagacctctagtggtaaacagagaacatatatttggacaactcaaagaaagaatatgattggtctgagacattgtgttcagatacag

SEQ ID NO: 3177 - DNA, 789 bp, Valeriana officinalis
gtcgtgttgaaaactactccgttttccttatattttatgaagatggatggtcacatctacagctagtatcattcatctgagtctgcagaatccatctgttaacattctgctctcggttttgcactagataccttgaaagatgatccgtttcctgctgcttcagaacaggcaaggaaagactcgtctcgccaagtattacattcctctcgaggaatccgagaagcacaaggttgaatacgaggttcatcgattggtcgtaaatcgagatccaaagttcactaatttcgttgagtttcgaactcacaaggttatatataggagatatgcaggattatttttctctctgtgtgttgatataacagataacgagctcgcatatttagagtccattcacttgttcgtcgaaattttggatcatttctttagcaatgtctgcgaactagatttggttttcaattttcacaaggtatatttgatactggatgaattcattcttgctggggaacttcaagaaacaagcaagaaggcaatcatagagaggttgggagagctagaaaagctggactgattttttctctttttgtaagttatgtttgatacaactccatttttcaacttttatacagctcaagtactactgttagtctgttatagtattgtgttattatgtactctagtaaacagtcttaatgttgagttgtacaaaaagcatttatatgaaactatatcacattgatgtaatgtaattgccttctttttttcataataaatatgtttacaattccaaaa

SEQ ID NO: 3178 - DNA, 640 bp, Primula obconica
ggccattacggcgaaaatcggctgcagtctttctctctctctcatcagcttccccaattcaatttcaaagtccttttttcttccaaattgcgttatcacgatccggtttatacttctccagaatagacagggaaagactcgtcttgctaagtactacattccccttgaagaatccgagaaacacaaggtcgaatacgaggttcatcgtttggttgtgaatagggatccaaaattcaccaactttgtggagttccggacccacaaggttatctataggcggtacgctggattatttttctcactatgtgttgacataacggataacgagttggcttatttggagagcattcacttatttgtggagatattggatcactttttcagcaatgtctgtgagctagatttggttttcaattttcacaaggtttatctgatattggatgagtttatacttgctggagagctccaagaaaccagcaaaagggcaattattgagagaatgggggagttggagaaacttgattaaagccgatgttttcgttggatggttatgctctgatagattgaagttgtttctctgtctcatacatatctcgggttttgtcgtcctttttcttctattttgtccgacatgtctgcg

SEQ ID NO: 3179 - DNA, 768 bp, Sarracenia psittacina
ttcaaacctgcgactccttcgtcttcacgccttcaccaaaattgattcttgttcatctttttcacaccgttgtcgtctgatcttcgctcgctgcacacaaaaggcttgatcgttgcccgctttcttctactttgattctgcgatctgttcaaaaatgatccgtttcatactactccagaacaggcaggggaagacgcgtctcgccaagtattacattcctctcgaggaatccgagaagcacaaggtcgaatacgaggttcatcggttggttgtgaacagagatccgaagttcaccaatttcgttgagtttcgaacgcacaaggttatctacaggagatatgctggtatattttttcattgtgtgtcgatataacggataatgagttggcctatttagagtgtattcacttgtttgtggagatattggatcatttttcagcaacgtttgcgagctagatttggtgtttaattttcacaaggtgtatctgatactagacgagttcattcttgctggggagctccaagaaacaagcaagagggcaattatagagagaatgggagagttggaaaagctggagtgaagaattattttcggccttctaccccaagcttttattttcggccttcggtccatcaagaattaagttcaaaaaccaactttttccggcttaatttgtctactcaatattgcctttctgagtttggtatttgttgtttaaatcaattcattgacttctgttacacgcatattacataatctgtgcattc

SEQ ID NO: 3180 - DNA, 921 bp, Vaccinium corymbosum
ccgtgtaaatcacaagtacgcagtctttcacccactcctacggaaaattccaacctacgactctcctgatttcttatcaaaaatcgatcgtccttcatccttttccctccttcctcctcgttcgatcttcaatcgctgctgataattctttgatcttctttacaaaatgatccggttcatactgctgcagaacaggcaaggaagactcgactggcaaaatactacattccccttgaggaatccgagaagcacaaggtcgaattcgaggttcatcggttggttgtgaacagagatcccaagttcactaatttcgttgagttccgtacacacaaggttatctacaggagatacgctggattgtttttctcattgtgtgttgacataacggataatgagttggcatatttggagtctatccacttgtttgtggagatattggatcacttcttcagcaatgtttgcgaactagatttggtgtttaattttcacaaggtatatctgatactggatgagttcattcttgccggggagctccaagaaacaagcaagcgggcaattatagagagaatgggggagttggaaaagctggagtgatgaagtatagctgagcatgttcacggccttctatcctcggtgcctcaacctttgtatttcttttgtgacatgtgccgcggttgtttgatttctctcatacatggacaagattgtgatattgctgatgttgttgagttcatatgatcacattgttttacgagttctctattgttttttcccccaattatgtagtattcttttgttagcagcacttcttctggagaggataaatggagttttgagttggttgaactcatttttcagttaaaatttctcactattaaaatctctctgccaaggaatctacactacatattatacaagctt

SEQ ID NO: 3181 - DNA, 719 bp, Bupleurum chinense
ccagtctatacacgagcctcttctccgattcctagaaaatgatccgattcatatgcttcaaacaggcaaggaaagactcgtctcgccaagtattatgttcctcttgaagaatcagagaagcacaaagttgaatatgaggttcatcggttggttgtgaatagagatcccaagttcacaaattttgtagagtttcgaacccacaaggttatctacaggcgatatgctggattgtttttctccctatgtgttgatataactgacaatgagttagcatatctagagtgcattcatttgtttgtggagatactggatcacttcttcagcaatgtgtgtgagctagatttagtttttaactttcacaaggtatacttgattctggatgagttcattcttgctggggaacttcaagaaactagcaaaaaggcaatcatagaaagaatgggggaattggagaagcaagattgatatagcaaatgatgcatatggacccaaaccctcttgtattttggaaattaggaattctacttgtatcttttgcaaattggaattctacagaaccttcagtattatataagtcacatatttgtgctagttttctgcaatacattggacccccataattttcttatttttttcatttgtgtaaaatctgataccgtacctagtgcaaatatcagtgattttgatgtgtgattaagtctgttaaatcaattacggat

SEQ ID NO: 3182 - DNA, 609 bp, Gnetum gnemon
ctgaatatggtcgttgtttttgaccagatctacatagattctcgaagcaactccgctctcaaatgttggaatttaattgtccagggaaggtttgaagatccaattcgttaatctcgcagataccagtcatcggcttagccttcagaactctgcatttgcaaaaacatgatccgattcatactgctgcagaacaggcaaggcaaaacccgcctggccaaatactatattcctctggaggattctgagaaacacaaacttgaatatgaggtgcacaggcttgtagtaaatagggatcccaagttcacaaactttgtggagtttcgaactcataaggtgatatacagacgttatgctggactatttttttcaatgtgtgttgacataacagataatgaactggcatatctggaaagcatccatctattcgttgagatccttgatcattttttcagcaatgtttgtgagcttgacctcgtatttaattttcaaaaggtctatttgattttggacgaattcattcttgctggagagttgcaagaaacaagtaaaaaggcaatcattgagagaatgactgagttggaaaggcaggaatgagaaactctcttgttg

SEQ ID NO: 3183 - DNA, 980 bp, Pinus pinaster
ctagcgttcttgtcgttgtaaggacttactgattggtttaactcaaacctcgttgctgacattttaaaacatttcacgtgtacagcaccgttgctctcgagctcctgtcgtttgaagccaaggagagaagcccgtgtcgcgacttcttgtccctggaaccggatccgttcgttctcaggcaccatgatccgatttatattgcttcagaacagacaaggaaagacccgccttgccaaatactacattccactcgaggaatcggagaaacataaactcgaatacgaggtgcatcggctggtcgttaacagagacccaaaattcacgaattttgtagagtttcgaacacacaaggtgatttacaggcgatatgcaggcctctttttctccatgtgtgtggacataactgataatgaactggcttatttggagagcattcatttatttgttgagatattggatcatttcttcagcaacgtatgtgagcttgacctagtattcaattttcacaaggtatatttgatattggatgaatttatccttgcaggggagttgcaagaaacaagtaaaaaggcaattattgaaagaatgactgagttggaacggcaggagtgagaagcttgcatgatccaagtgtgacatctcctaagctttgatgttcaacctgaattctatagtgctgacagtagttgggttcatttgttctcttccggcacatgtaatagatttttttccctgctctttttcaattgaaattttacattaccaacggtagtgagggtttgccatctgttttcctcccttttatgggatttgtaataaattttgttcttgtagatgtctgaaaatatagcacacaacacctgtacatttttgtgtaagatatgtgcaccctaaagagtctggacattaatacacaatagacttgctttgctggttgaattatagcagggcatgcagcctctgtacaagaagtttttttt

SEQ ID NO: 3184 - DNA, 672 bp, Petunia hybrida
atcgaagccagcatctgcactggtctgcttcatcgaacacgctctcttccatcgatcctctcaaaatatgatccgtttcatagtgcttcagaacaggcaaggaaagacccgtttagccaaatattacattcctctcgaggaatctgagaaacacaaagtggagttcgaggttcatcggttggtggttaatagagatcccaaattcactaacttcgtcgagttccgtacccacaagattatatacagaagatatgcaggattgtttttctcactctgtgttgatattactgacaacgagttggcttatttggagagcatccacctctttgtcgagattttggatcactttttcagcaatgtctgtgaactagacttggtttttaacttccacaaggtatatctgatattggatgagtttattcttgccggggaacttcaagaaacaagcaagaaggcaattatagagagaatgggggagttggaaaagcaggaatagagatttatgtggtagctccagataaacacctttgcctccaaagtttgaaccttttcttctgctggctgtaatttttctgttaaatatctcaatgttcttgtgcctcacttgtccatttctacgtggatcttctctttcatttttatatgtaaaggaggttttctttttgctagaaa

SEQ ID NO: 3185 - DNA, 1072 bp, Pinus taeda
ttgtaaggacttattgattggtttaactcaaacctggttgctgacattttaaaacatttcacgtgtacagcaccgttgctctggagctcctgtcgtttgaagccaaggagagaagccagtgtcgcgacttcttgtcctggaaccggatccgttcgttctcaggcaccatgatccgatttatattgcttcagaacagacaaggaaagacccgccttgccaaatactacattccactcgaggaatcggagaaacataaactcgaatatgaggtgcatcggctggtcgttaacagagaccctaaattcacgaattttgtagagtttcgaacacacaaggtgatttacaggcgatatgcaggtctctttttctccatgtgtgtggacataactgataatgaactggcttatttggagagcattcatttatttgttgagatattggatcatttcttcagcaacgtatgtgagcttgacctagtattcaattttcacaaggtatatttgatattggatgaatttattcttgcaggggagttgcaagaaacaagtaaaaaggcaatcattgaaagaatgactgagttggaacggcaggagtgagaggcttgcgtgatccaagtatgacatctcctaggctttgatgttcaacctgaattctataatgtcgacagtagttgggttcatttgttctcttctggcacatgtaatagattttttccctgctctttttcaattgaaattttacattaccaacagtagtgagggtttgccatctgttttcctcccttttatggggtttgtaataaattttgttcttgtagatgtctgaaaaatatagcacacaacacctgtacattcttgtgtaagagatgtgcaccctaaagagtctggacattaatacacaatagacttgctttgctggttgaattatagcagggcatgcagcctctgtataagagttattttttgttctttcaatctcaatgcacacacattcatgaagctacattcatagtttgttttgttagatattttaaattacatctagtcatcttagaccaaaaaaaaaaaaaaaa

SEQ ID NO: 3186 - DNA, 1403 bp, Pseudotsuga menziesii
cttcagtcggccagttggttccacccgttctcgctaacactaccgaagcaccccgagttcaaaaacctctaaagcataaaccatcgtcatgttatcggttgcaaggggtttataaaaaaccgtgagacggttgaacattctttgtgataccatgacttctcgcctcctatacggtgttaggagaataggtggtcaacacttgcagccaccccgtttacactattagtaggttcccgcctccttatgatttattgataacatatccttttggccagtatcattcatattccgcagggaataaaatatagagtttgagtctattttctgcctgactgcctccgcttgctagcacatatagatattatcagatggttcgccggcgataaatatgtctgctccttgaccttacaccaccgtgaagagaagtcgaggaagcgggtgaaggagcctctcattcgaacgcaagaagagaagcccgtgtcgttctacggtctctgcaaacggatccgttcgttctccggcgccatgatccgattcatattgcttcaaaacaggcaaggaaagacccgccttgccaaatactatattcccctcgaggaatcggagaaacataaactcgaatatgaggtccatcggctggttgttaacagagaccctaaattcacgaattttgtagagtttcggacgcacaaggtgatttacaggcggtatgcaggcctctttttctccatgtgtgtggacataactgataatgagctagcttatttggagagcattcatttatttgttgagatattagatcatttcttcagcaatgtatgtgagcttgatctagttttcaattttcacaaggtatatttgatactagatgaatttattcttgcgggggagttgcaggaaacaagtaaaaaggcaatcattgaaagaatgactgagttggaacggcaggagtgagaatatttcttgatccaattaacacatctcctaggttttgatattcaacctgaattctataatgtcgacaatagttgggttcatttgttctcttccgtaacatgtaatagattttttcctgcttatttccgactgaaattgttatgttaacaatagtagtgagggttttccgtctgttttcctccctcttatggagcttgtaataaatattgttcttgtagatgtgtgaaaagtacgcacgttcatttttgtgtaaattatgtgcacttttggagtcgaatccactatagaaagtgctcacttttacaagtgaagtttgtatcacttgctctgcaggttgaattctagaaggacatgcaacctctgtgtataagagtacttttaaaaaaaatatttccttcatgtagacagattcgttttggtacattcatagtttgatttgtcagaac

SEQ ID NO: 3187 - DNA, 621 bp, Selaginella moellendorffii
gaagagcaagacgaccaagaggattggcgcgcgcctggacgaaatgattagattcatcctcttgcaaaatcgccaggggaagactcgtctcgccaagtactatgtcccgctcgaagactccgagaagcaaaagctccagtatgaggtgcacaggctcgttgtcaatcgcgatccaaagttcacgaatttcgtagagtttcgcacacacaaggtgatctatcgacgctacgccgggctcttcttctcaatgtgtgtggatatcacggataacgagctggcctacctcgagagcatccacctctttgtggagatcctagaccatttcttcagcaacgtttgcgagctagatctggttttcaacttccacaaggtttacttgatcctcgacgagttcattcttgctggcgagttacaagaaaccagcaaaaaggcaataatcgagcggatggcagaactagagcggcaggagtgaccatcatctcaaaagacaataggcagcctccgggctcgcacaaaggcatcgagtttatcccaaaactcgagaactgccgtgcggtcctggtgcctcttgtgcttgctcagctgtttagcaaacaaagaagagtaagaaggcattcgttt

SEQ ID NO: 3188 - DNA, 1173 bp, Picea glauca
ttacctcaaatctcctagctgacattttaaaacagtttacgctggacagcagaggggctttggagctcttgacatttgaaggcaaggagagaagtccgtgtcgtgtcttcttgtccctgcaaacggatccgttcgttcccagccaccatgatccgattcatattgcttcaaaacaggcaaggaaagacacgcctagccaaatactacatcccactcgaagaatcggagaaacataaactcgaatatgaggtgcatcggctggtagttaacagagaccctaaattcacaaattttgtagagtttcgaacacacaaggtgatttacaggcgatatgcaggcctctttttctccatgtgtgtggacataactgataacgagctagcttatttggagagcattcatttatttgttgagatattggatcattttttcagcaatgtatgcgagcttgacctagtattcaattttcataaggtatatttgatactggatgagtttattcttgcaggggagttgcaagaaacaagtaaaaaggcaatcatcgaaagaatgactgagttggaacggcaggagtgagaagcttgcttgatccaatgaagacatctctcacctaggctttgatgttcaacctgaattctataatgccgacaatagatgggttcatttgttctcttctgtcacacgtaatagatttttttccttctctttttcaactgaaattattacgttaccaacagtagtgagggtttgccatctgttttcctctcttttatgcagcttgtaataaatcttggtcttgtagacgtgtgaagaataaagcacacaatacctgttcatttttgtataagatatgtgcaccctaaagagtcggggcttgaatacactatagaaggtgttcactgctaaaagtgaagtttgtaccatttgctttgtaggttgaattctagcaggacatacaacctttgtgtataagagttattttttgtttttttaatctcaatgtaacagattcatgaagctacattcatagtttgttttgttagatattttaaattacttttagtcatcttccaccaaaatgcagctgttctggaatgttgtagactctattcctgaagttgaatttgttttgctgagtgatgagaggtcttcgttggttgtttctccatggtg

SEQ ID NO: 3189 - DNA, 1105 bp, Picea glauca
tcaaagtgctcgtgtcggtataatgttttattgattgatttacctcaaatctcctagctgacattttaaaacagtttacgctggacagcagaggggctttggagctcttgacatttgaaggcaaggagagaagtccgtgtcgtgtcttcttgtccctgcaaacggatccgttcgttcccagccaccatgatccgattcatattgcttcaaaacaggcaaggaaagacacgccttgccaaatactacatcccactcgaagaatcggagaaacataaactcgaatatgaggtgcatcggctggtagttaacagagaccctaaattcacaaattttgtagagtttcgaacacacaaggtgatttacaggcgatatgcaggcctctttttctccatgtgtgtggacataactgataacgagctagcttatttggagagcattcatttatttgttgagatattggatcattttttcagcaatgtatgcgagcttgacctagtattcaattttcataaggtatatttgatactggatgagtttattcttgcaggggagttgcaagaaacaagtaaaaaggcaatcatcgaaagaatgactgagttggaacggcaggagtgagaagcttgcttgatccaatgaagacatctcccacctaggctttgatgttcaacctgaattctataatgccgacaatagatgggttcatttgttctcttccgtcacatgtaatagatttttttccttctctttttcaactgaaattattacgttaccaacagtagtgagggtttgccatctgttttcctctcttttatggagcttgtaataaatcttggtcttgtagacgtgtgaagaataaagcacacaatacctgttcatttttgtataagatatgtgcaccctaaagagtcggggcttgaatacactatagaaggtgttcactgctaaaagggaagtttgtaccatttgctttgtaggttgaattctagcaggacatacagcctttgtgtataagagttattttttgtttttttaatctcaatgtaacagattcatgaagctacattcatagtttgttttgtttgatattttaaattacttttagtca

SEQ ID NO: 3190 - DNA, 1035 bp, Triticum aestivum
ctggcgtggttggagaggaagccgaggcaccacttttcaacggtgaacccacccacagctcattctgcataacccaacaaaccaagcaacacaaatccgattcattcccctcccaagctccaatcccgcgaattctcaagcgtggtcgtcatcatcatcacccagcatgatccgtttcatcctgttgcagaatcggcaggggaagacgcggctggccaagtactacgtcccgctcgaggactcagagaagcacaaggttgagtatgaggtgcatcggctggtcgtcaacagggaccccaagttcactaacttcgttgagttccgtacgcacaaagttatctacaggagatatgcaggactatttttctcaatatgtgtagatatcacggataatgatttggtatacttggaatgtatccacttatttgtggagatattggaccatttcttcagcaacgtgtgtgaacttgatttagtatttaacttccacaaggtttacttgatattggatgagtttattctcgctggagagctgcaagaaacaagcaaaaaggcgattatagagagaatgggtgttccagcgtgcatggggagataactaaacgcaagagcaaaacccattccttctgccatgtcgaagaattttctccgtttgtacaattctgttgtagctgttattatgattacccctggttcaccaactttctttatggctgccttctagaaaaaacattatgatggttgcttggtggggttcgttgtggatcgttctgtaactaggtgccatggaattccttgccatctttgcgcatttcattagcaatcatgatggcagtcttttttccaatcattagagcatgcatgtctagagaacccacgatgtttgaagcaatctgttgcactattccttgggctaaagatcgcaatgatgtcgtttcaccacttgggaatagtatcacagatcgtcaaaacaccttatcttacttatcttattagatggttcagagcgtctcaagctgtaaacatacatataca

SEQ ID NO: 3191 - DNA, 1058 bp, Abies balsamea
acgagattcaagtgctctggtcggtttaagtatgtattgattggtttacctcaaccttccttgctgacattttaaaacattttatgctgtacagcaccggggctttgttgctcttgtcattcgaaggcaaggagagaagcccgtgttgttctacggtcttcttgtccctgcaaacggatccgttcgttctcagccgccatgatccgattcatattgcttcaaaacaggcaaggaaagacccgccttgccaaatactacattcccctcgaggaatcggagaaacataaactcgaatatgaggtgcatcggttggtcgttaacagagatcctaaattcacgaattttgtagagtttcgaacgcacaaggtgatttacaggcggtatgcaggtacttttttctccatgtgtgtggacataactgacaatgagctagcttatttggagagcattcatttatttgttgagatattggatcatttcttcagcaatgtatgcgagcttgatctagtattcaattttcacaaggtatacttgatactggatgaatttattcttgcaggagagttacaagaaacaagtaaaaaggcaatcattgaaagaatgactgagttggaacggcaggagtgagaagctagcttgatccaattaacaatctgctaggctttgatattcaacctgaattctataatggcaacaatagttgggttcatttgttctcttccggcacatgtaatagattttttttcatgctcttttcaactgacattattgtcaccaactgtagtgaggggtttccatctgttttcttcctttttatggagcttgtgataaatcttgttcttgtagatgtgtgaagaataaagcacacaacacccattcatttttgtgtaaaatatgtgcaccctaaagagtctggacttcaatccactatagaaggtgcccgcaatgaagattgtaccaattgctttgcaggttgaattctagcaggacatgcagcctctgtgtataagagttattttttgtttttaattcattcctgtacaccgaatcgtaaagtt

SEQ ID NO: 3192 - DNA, 720 bp, Podocarpus macrophillus
gtaaaattcagtaggcagactatagaaaattgaatgcttataatatttttatctaagagaatttttcgagaggaggggagaggagacgaaggagacttgttcttcgtaattcaaacctattgaatttccggaattgtttgtgatctgccttttgcagatacgatgatccggttcatattgcttcaaaacagacaaggaaagactcgccttgccaagtactacattccgctggaggaatccgaaaaacacaagcttgaatatgaggttcatcgactggttgttaacagagaccccaagttcacaaactttgttgagtttcgcacccacaaagtgatttataggcggtatgcaggtctttttttctctatgtgtgttgatattaccgataatgagctggcctatttggagagtattcatttatttgttgagatactggatcatttcttcagcaatgtatgcgagcttgacttggtattcaattttcataaggtatacttgatactagatgaatttattcttgcaggggaattgcaagaaacaagcaagaaggcaatcattgagagaatggctgagcttgaacgacaggattgagatatctttagattcaataaggtgttgtaggggtaggataaagatctggtcaactctttcaatttatgtcagcaccttttatgaaaaaagcttgttatgatcattatataatttgaataatgaatcgat

SEQ ID NO: 3193 - DNA, 892 bp, Pteridium aquilinum
ggagaaacagtccgacaacaaaatacaaagtctgttgaagaactttttttctgcatgtttggatctgagaccgtaaggacattgtgtcgcgcttcagcttcttccccgccatgattcgcttcattttacttcagaaccggcaaggcaaaacacggcttgccaaatattatattcctctagaagactcagagaagcacaagcttgagtatgaggttcacaggctagttgtaaacagagatcctaaattcaccaactttgtagagtttcgaaccaacaaagtcatttaccgaagatatgcaggtctttttttctccatgtgcgtggacatcactgataatgagcttgtttatttggagagcatccatttatttgtggagattttggatcatttcttcagcaatgtttgcgaacttgacttggtctttaactttcacaaggtttatctgattttggatgagtttattcttgcgggtgaattgcaagaaactagtaaaaaggcaatcattgagaggatggccgagttggagcggcaagaatagctactgaagaaatcattatattcttttgtcagaaacaatggtattgattggcttcatcaaggccgggctactttaaggatgccagcagatctaaagaacctgtctttaacatgcttgaaataacatggaacagttttgaagcttttgacattttgtaaatgagcggtccatggaggacgttttggggtgtattctatgtttgcttcagaagctacaagcatttgattaatttttcatgacagtctttctttccatacgacatacacatgcacacacgcgtgcacacacacacatacatatatgtatgtttctttattcaatagtaaaagttgcatttgaatatcaaaaaagaa

SEQ ID NO: 3194 - DNA, 1113 bp, Sarracenia psittacina
gggggattctcgttgtccgctgcttccctgttattttccaaccagactctcaactgaagcaaatcgatcgttcttcgtcttcctggcgccctcgttgcatgaaaattgatcttttctttctttctttacccacttctactgcgttattctgaaaaatgatccgattcatattgctccagaacaggcaagggaagacccgtctcgccaagtattacattcctctcgaggaatccgagaagcacaaggtcgaatacgaggttcatcggttgatcgtgaatagagatcccaagtttaccaatttcgttgagtttcgcatgcacaaaattatctacaggcgatatgctgggttgtttttctcaatctgtgttgatataacggacaatgagttggcgtatttggagtgtattcacttatttgtggagatattggatcatttttttagcaatgtttgtgagctagatttggtattcaattttcacaaggtatatcttatattggatgagttcatccttgctggggagctccaagaaacaagcaagagggtagttatagagagaatgggggaattggaaaagcaggagtaaagagtgaatttgcagccgaggcttgtttcgatgcattaactaatttctctttgtgggttgttgttatatttttttccttgtttggcttaatttgtgtagtcgattttacaacaggttggttatcagaaggttgaacctgaaagactgctttcttcgttttctacatctctagcatacgttttcttcatgttccacctctaaatatgtggtatttgttatctaaatttatacattggtccgcatactttttgagttcatgcagagatcgattgatcaatatgaaactcgagagtagatagttgatcaccgccactttgtcctggaggctctttgaccggggagggcttactatgtaacctttctcccatctcctatccgactcaaccgaccgggggtgggatttatttaggaggaaacatcgctatttctttcttcctgtccttgattatggctattggatatatcctttaaggcttcttgtgtaattataccatagatgatccatatcatagagaagtctaccttgaac

SEQ ID NO: 3195 - DNA, 627 bp, Selaginella moellendorffii
ctagccaagaagagcaagacgaccgcgcgcctggacgaaatgattagattcatcctcttgcaaaatcgccaggggaagactcgtctcgccaagtactatgtcccgctcgaagactccgagaagcaaaagctccagtatgaggtgcacaggctcgtcgtcaatcgcgatccaaagttcacgaatttcgtagagtttcgcacacacaaggtgatctatcgacgctacgccgggctcttcttctcaatgtgtgtggatatcacggataacgagctggcctacctcgagagcatctacctctttgtggagatcctagaccacttcttcagcaacgtttgcgagctagatctggttttcaacttccacaaggtttacttgatcctcgacgagttcattcttgctggcgagttacaagaaaccagcaaaaaggcaataatcgagcggatggcagaactagagcggcaggagtgaccatcatctcaaaagacaataggcagcctccgggctcgcacaaaggcatcgagtttatcccaaaactcgagaactgccgtgcggtcctggtgcctcttgtgcttgctcagctgtttagcaaacaaagaagagtaagagggcattcgtttttctcgcgat

SEQ ID NO: 3196 - DNA, 875 bp, Platanus occidentalis
acaaagcaaaattaagaaagcacatttggtcgttttcttttgtgcgcaagatcctcgttccctttccatctctctattacccatttttctctctcgatctctccaacaatgatccgatttatattactacagaacaggcaaggcaagacccgtctcgccaagtattacgttcccctcgaggaatctgaaaagcacaaagtggaatacgaggttcatcggttagtggtcaacagggatcccaagttcaccaatttcgtagagttccgtacacacaagattatctacaggcgatatgctggattgtttttctcaatgtgtgttgacatcacagataatgagttagcatacttggagtgtatccatttgttgtggagatactggatcatttcttcagtaatgtgtgcgagctggatttggtgtatctgatactcgatgaattcattctcgctggggagctccaggaacaagcaagaaggcaatcattgagagaatgggcgagttggaaaagcaagagtgagggttgattatgtgaaggatgtgcaggagctcgctttagcaggttacttgttcaattcactttatctgctcatccactttcaaagttgatttccagtctcctaacatcagaaagaggacaacaagaacaaataggaatcttggtctttctttttttttttcattatgaattttgaattgtgaattgtggtggtgtgggtattcgttcttcaagtcagctgagtaccaaacgtcttatacatgtgcgtggctgaatgtgatacgtgctcatttttagagtttcttgtaatttcatatgtatctcttggtgtttgtatgctaaacagaatttacagaatcccgtttgtaaagtgctttag

SEQ ID NO: 3197 - DNA, 696 bp, Nicotiana benthamiana
gcagctcggctctgaactcgagttcgagtgttgtttacgactcaaaaatcaaaacgatcatctgtaactcctccgactcgtcagagatgatccgttccatagtgcttcagaacaggcaagggaagacccgtttggccaaatattacattcctctcgaggaatccgagaagcacaaggtcgaacacgaggttcatcggttggtggtgaatagagatcccaaattcaccaactttgtggagttccgcacccacaagattatatacagaagatatgcagggttgtttttctcactctgtgttgatattactgacaacgagttagcttatctggagagcatccacttgtttgtcgaaattttggatcacttcttcagcaacatctgtgaactagatttggtttctaacttccacaaggtatatctgatattagatgagttcattcttgctggggaacttcaagaaacgagtaagaaggcaattatagagagaattggggagttagaaaagcaggagtagagatttctgctgtagctaccgcctacagataagcaccttccccttgcctccaaagtttacaccttctttcttctggctgtatttccctgttaaacatctatatgttcttgtacttcagttatcttttcgaacgtggatcatttctttcattcttacatgtaaaggaggtcttctttttgct

SEQ ID NO: 3198 - DNA, 548 bp, Arnica chamissonis
tcttcagaacaggcaaggaaagactcgcctcgctaagtattacattcctcttgaagaatcagaaaagcacaaggtcgaatacgaggttcatcgattggtggtgaatagagatccgaaattcacaaatttcgttgagttccgtacccacaaagttatctataggcgatacgctggattattcttctcactttgtgttgatatgactgataacgagctagcatatttggagtgcatccacttatttgtagaaatacttgaccatttcttcagcaatgtgtgtgagctagatttggtcttcaacttccataaggtgtatctgatactagacgagttcattcttgcgggggaactccaagaaacaagcaagagagcaatcatagagaggatgggggagttggaaaagcaagagtgaaactgggattctttgttttcttccattactaatttgattggagattgaacatgtatgtaattcttcaagtgcttttgtgtgaaactgctataaataaaaacaaatagatatttaaatgagtgtgtttaaacgaaac

SEQ ID NO: 3199 - DNA, 643 bp, Momordica charantia
gtcaaaaccgcatttccaactttgtgcgctgaattcggcctccgaaaatcaattcgagctcgtttcgtggatcttcattcgccgtcttcaagaatgatccggttcatacttttgcaaaacaggcagggcaagactcgtctggctaagtactatgttcctcttgaggaatccgagaagcacaaggtcgaatacgaggttcaccgattggtggtgaatagagatcccaagttcacaaatttcgttgagttccgaacacataaggtaatctacagacgatatgccgggttatttttctctctttgtgtggacataaccgacaatgagttggcatatctcgagtgtattcatttgtttgtggagattttggatcacttcttcagcaatgtttgtgagctcgatttggtttttaactttcacaaggtttatctgatacttgacgaattcattcttgctggagagctccaagaaacaagcaaaaaggcgattattgaaagaatggggagctggaaaagctggagtgaagatagtgcatgttagagagctaagattgcaatttattttccatgacagaatttattatattgctgatttcagtttgatttgttttcccatagtatatttgtctgtatggtattgttgtgat

SEQ ID NO: 3200 - DNA, 667 bp, Eutrema halophilum
cctcttctctgtttccagatccgattcatattattgcagaacagacaagggaagactcgtctcgccaaatactatgttcctctcgaagaatccgagaaacacaaggttgaatacgaggttcataggttagtggtgaatcgcgactcaaagttcaccaacttcgtcgagtttagaacacacaaggtgatatacaggcgttacgctggattgttcttctccgtttgcgtggacataacggacaacgagctggcttacttggagtccatccatctgtttgtggagatattggaccatttcttcagcaatgtttgtgagcttgatttagtgtttaatttccacaaggtgtacctgatactcgatgaattcattcttgctggggagctccaagaaacaagcaaaagggcgatcatcgaaaggatgtcagaactcgagaagctagattgatgagcatttctcaagaagctagagtgcttgtcgagatgtttatgtcattcttgcgtggccggagatttacattttttttttctcgagttgaagacagttgtggtattaagattgcaaaggatataaatttaatctgctgagatttacattccatgtttatctctgtgagatcttcatttcaaggttactatttatcagacatgaaattttgtataaatctatt

SEQ ID NO: 3201 - DNA, 538 bp, Eutrema halophilum
tccatatcgtatcctcttttccagatccgattcatattactgcagaacagacaaggcaaaactcgtcttgccaagtactatgttcctctcgaggagtccgagaaacacaaagtcgaatacgaggttcatagattggtggtgaatcgcgactcaaagttcacaaatttcgttgagtttagaacgcataaggttatatacaggcgctatgctggattgtttttctcgttgtgcgtcgacataacggacaatgagttggcttaccttgaatgtatccacttgttcgtcgagattttggatcatttcttcagcaatgtatgcgagcttgatttggtgtttaatttccacaaggtatacttaatactcgatgaattcattcttgccggagagcttcaagaaacaagcaagcgggcaatcattgagaggatgtcagagcttgagaagctggactgatgacattgggaaattcaatgattttcaagaaggaaaatcagcaataggagtcttctgatttgctcttttctgtcatgttctgtctaca

SEQ ID NO: 3202 - DNA, 403 bp, Persea americana
catgatccgattcatcttgcttcagaacaggcaaggaaagacgcgccttgccaagtactacgtcgcccttgaagaatccgagaagcacaaggtcgaatacgaggtgcatcggttggtggtgaatagagatcccaagttcaccaactttgtcgagttccgtacacataagattatctacaggagatatgcagggttgtttttctcgatgtgtgttgatatcacagacaatgaactagcatacttggagtgtatccatttgtttgtggaaatattggatcatttcttcagcaatgtgtgcgaactggatttggtatttaatttccaaaaggtgtatctcatactggatgaatttattcttgctggggagctgcaagaaacaagcaaaaaggcaatcattgataga

SEQ ID NO: 3203 - DNA, 776 bp, Arachis hypogaea
aaagtaaagtgagtttcatttcattcatcaattgcagtttcacatcgcagattttgagtttctactgcttccttctctcaaattccttaagtaaattacatcgttcaacatgatccgattcattctgctgcagaacaggcaggggaaaacccgtttggcgaaatactatgtccctctcgaggattccgagaagcacaaggtcgaatacgaggttcatcgcctcgttgttaatcgagaccccaaatacactaatttcgttgagtttaggactcacaaggtaatatataggagatatgctggcttgttcttctctctatgtgttgacattactgataatgagcttgcttacttggagtgcatccatctatttgtggagattttggatcacttctttagcaatgtatatcttatacttgatgaattcattctagcgggtgaattgcaagaaactagtaagaaggctatcatagagagaatgggggaactagaaaaacttgagtaaaatattacaatacattggcagtttggagattttgatgatttgcgcatgtatctcagcataattcttgtaattcaattgtgatacagaattccgaaaatatttttccttgagtaatgtgtttagtaaatcaataccctaccttcaacctaggctttgttggcttgtgtttatataaagaagtcatttcacaaatatcatgttctttaataacctttctatcattgaataataactaaagaattataacataagcatctgaaaaagttagtgaagg

SEQ ID NO: 3204 - DNA, 653 bp, Triticum aestivum
  misc_feature (421)..(421): n is a, c, g, or t
  misc_feature (560)..(560): n is a, c, g, or t
  misc_feature (570)..(570): n is a, c, g, or t
  misc_feature (576)..(576): n is a, c, g, or t
  misc_feature (601)..(601): n is a, c, g, or t
  misc_feature (623)..(623): n is a, c, g, or t
  misc_feature (634)..(634): n is a, c, g, or t
  misc_feature (640)..(640): n is a, c, g, or t
cggaaaaccacggccggcgttcctgcttctctacccggtccgaattgctgaccggatcaacccgagaccttgcaggattatcgatctgattgcggcatgatccgcttcatcctgctgcagaaccggcaggggaagactcgactggccaagtattacgtcccgctcgaggactcggaaaagcacaaggttgaatacgaggtacaccggctcgtggtcaatcgggaccctaagttcaccaacttcgtcgagtttcgcacacacaaagttatctacaggagatatgctggactgtttttttcaatatgtgtggacataactgataatgaattggcatacttggaatgcattcacttgtttgtcgagatattggccatttctttagcaatgtttgtgagctcgatttagtgtttaatttcacaangttacctgatactagatgaattaatcttgctggggagctgcaagaaacaagcaaaaaggaataattgacgaatgggtaactggagaactggatacaagacaagaaatctccgctgtttgatcaattgataatcttcagngttaattgcncccggntcttcgctaaacttatccatcgtancaagatgatatacacaggtatnaactctcaaanaattcncaaaaaaaaaaaa

SEQ ID NO: 3205 - DNA, 672 bp, Sequoia sempervirens
tcaaaacagacaaggaaagacccgtctggccaagtactatattccactggaagaatcagaaaacacaagcttgagtatgaggtgcaccggctggtcgtcaacggggaccccaagtttacaaactttgtcgagttccgcactcacaaggtgatttataggcggtatgcaggcctgtttttctcaatgtgtgtggatatcactgataatgagctagcatatcttgagagcattcatttatttgtggagatactggatcatttcttcagtaatgtatgtgagcttgacttggtattcaattttcacaaggtatacttgatactagacgagtttattcttgcaggggagttgcaagaaacaagtaagaaggcaatcattgagagaatgggggagctggaaagacaggagtgagaaacgtgttggatccaagtattatcttaaagggtgcgctggagattctgttactacttttactcattcttttgcttgtacaatggtaatgactagttacggattttcattgttctctctatatggagtttgtattagacttcctacttctggggaagaggattaatacactccgttggattcattttttctaaaaattctgcattccaaagaacctgagttctttttttctacttggaagatgtaaacttgatataagggttg

SEQ ID NO: 3206 - DNA, 1456 bp, Vitis vinifera
ggagagtaaggtgggaatgtgaaagacgcgatggtgtagatgattacgtggaaacctttatcacatacatcgcattcggaacgacgtcgtttccatgtttacagcgaatagtacaccttggcgctcggcagcagcaccaaatcgcattctaacgcacgacccgaaacggaaccacgtacacttgaagtttcgaaacccaaaagaaagacagcaaggacgaccgtcatcggatctcggaggttcaccgtttgttctgtgtgcctctgcagccaagtctttggagaatgatccgattcataattctacagaacaggcagggcaagacccgcctcgccaagtactatgttcctcttgaagaatccgagaagcacaaggtcgaatacgaggttcaccgattggttgtcaaccgggatcccaagttcactaacttcgttgagttccgtacacacaaggtaatctacaggcgatatgctggattatttttctcactgtgtgttgatatgacagataatgagttggcatatttagagtgcatccatctgtttgtggaaatactggatcatttcttcagcaatgtgtgcgagctagatttggtatttaatttccacaaggtttatcttatacttgacgaattcattcttgctggggagctccaagaaacaagcaaaaaggaaaaataaaaatttactttcatattggcaatacacctttttcttttagttatgagcaataataagctttaaatacgctcacgaaaagatgacactacaaaggttctggattacttgcctctgcagctgatagcattccattaatcctcctcctggtttccatattttggcggatcaccaccccatcacatgcccacttccctccccacttcatcaggcgaagttgagcaccaagttgaaagtatgaaagaaaaaagggaaaagaatgaaataatatcccagtttaaagatgctcgttgcagagtaactgcaatggcagggcactgtcggaacggaacccaccaccattctcatctaagcctgaagggagatggttgtgctgccttttggccctggcaggtgacagggatgaagtgatggcaatgagttgctgctgctgttgctgtgagattggcgcatatttggggcctagtacttctagtgatgaactgggagggagaatggcttgagcatattggattggaggggttgggtcatgtcttccattttgccaatttggaatatgggatgcagaaatacccgccggtctgtattgagttgccagctgagcccacatcctttgttgctgttgatgttgctgctgctgctgctgttgttgctgctgttgttttgagcctgaaagggccatatgaggggatccacataaattgttgctgagatatggagatagctgcagctggacctataatcaaccattatactgtcaagatgagatgctagacaat

SEQ ID NO: 3207 - DNA, 665 bp, Curcuma longa
tatccgtcaaagcgaagatctcgcgcttgctcgtctccagcgaccgaggacgatatgatccgattcattctgctgcagaaccggcaggggaagacgcgtctggccaagtactacgtacccctcgaggattctgagaagcacaaagtcgaatacgaggttcatcggttggtggtcaatagggatcccaaattcaccaatttcgttgagttccgcactcacaaagttatttatagaagatatgcgggactcttcttttcactgtgtgttgatatcactgataatgagttagcatacttggagtgcatccatctatttgtggagattctcgatcatttcttcagcaatgtttgtgagctagatttggtttttaacttccacaaggtttatctcatattggatgagtttattcttgctggagagattcaagaaacagcaagagggcgataattgagaggatgggtgaattggaaaaacaggaatgagaaccggccatgcaacatttcactctgatggcataaatcactaaagctggaccctcagtattagtatgttttcaggaagaaaagcggcgtgttgttgaacacttaggccatcgttgattgcaaggatatgtaattaccagatattttgtcagccttggatatgagcgtttggtgattggatca

SEQ ID NO: 3208 - DNA, 601 bp, Adiantum capillus-veneris
cttcgatgacagcttacgtttcggcctgcctctgattctctcacaaccggggcaggccttgtttgcttggatctgtggttcatcgcgcttcagcttcttctacttctccttccccgccatgattcggttcattttgctgcagaaccggcaaggcaaaacacggcttgcgaaatattatattcctttagaggattctgagaagcacaagctagagtatgaggttcatcggttggttgtaaacagagatcccaaattcacaaattttgtagagtttcgaacacacaaagtaatttaccgaagatatgcaggtcttttcttctccatgtgtgtggacatcactgacaatgaacttgtctacttggaaagcatccatctctttgtagaaattctggatcatttcttcagcaatgtgtgtgaacttgacttggttttcaattttcacaaggtgtatctgatattggacgagtttatccttgctggcgaactgcaagaaactagtaaaaagctatactactcattttaggccagtgatatttattgatgcagattgtgtctgaagttgcattgtcggcaatcattgagaggatggctgagctggagc

SEQ ID NO: 3209 - DNA, 614 bp, Festuca arundinacea
ggcacgaggctacgtcccgctcgaggactccgagaagcacaaggtcgagtacgaggtgcaccggctggtggtcaatcgggaccccaagttcaccaacttcgtggagtttcgcacgcacaaagttatctacaggagatatgctggactatttttcgcaatttgtgtagatatcacagacaatgagttggcatacttggaatgcatccacttgtttgttgagatactggaccatttcttcagcaacgtctgtgagcttgatttagtatttaattttcataaggtttacttgatattagatgagtttattcttgctggagagctgcaagagacaagcaaaaaggcaataatagaaaggatgggcgaactggagaagctggactaagtaactcgaccgatggagccattccaacctctgctttgagaagttacgccagttatcatattatgttatgtacaatcttgtatagttgttctatttttattgccggtgtattctgagttcactggtatgggaactttgtggaaggctaacagcagtaatttttatccaaatataatgataaacaacaatctgttcatccaaatttgttgcagttgttattcaaccgttttgt

SEQ ID NO: 3210 - DNA, 531 bp, Cephalotaxus harringtonia
agtttacaggttactctggcaccatgatccggttcatattactcaaaacagacaaggaaagactcgtctggccaagtactatattccactggaagaatcagaaaaacacaagcttgaatatgaggtccaccgattggttgttaacagagaccccaagtttacaaactttgttgagttccgtacccacaaggtgatttataggcggtatgcaggcctgtttttctctatgtgtgtggatatcaccgataatgagctagcatatctggagagcattcatttatttgtggagatactggatcatttcttcagcaatgtatgcgagcttgatttggtattcaattttcacaaggtatacttgatactagatgagtttattcttgcaggggaattgcaagaaacaagcaagaaggcaatcattgagagaatgggtgagctggaacgacaagagtgagaaacatgtctgatacaaaaatattatcctaaagtgatgattgggggatattgatttacttcactctacagggtggttgc

SEQ ID NO: 3211 - DNA, 808 bp, Brassica napus
ggatcccattatctctgggggcactggagaagttggctcgtatgccaattccttcattcggcaaacgcagaaaagcagtcgaaggtctttcgacggcaagaagcaaaacattggatgcgtgttcttgtctcgtgatttcatgaataataatgatcctattcatattattgcagaacagacaaggcaagacccgtcttgcaaattactatgttcctcttgaggagtctgagaaacacaaagtcgaatacgaggttcacagattggtggtaaatcgcgactcgaagttcaccaatttcgttgagtttagaacgcataaggttatatacaggcgctatgcaggcctgtttttctccttgtgcgttgacataacagacaatgagttggcttaccttgaatgtatctacttgttcgtcgagattttggacaatttcttcagcaatgtctgtgagcttaatttggttttcaacttccacaaggtgtacttaatactcgatgaattcattctcgctggagagcttcaagaaacaagcaagcggcgatcattgagaggatgtcagaactggagaagctagagtgatgagattgggagattaaatgttagccaagaaggagaatgagcagtatgcgtcttctgttttgctcttttctttatgttcggtctaccacattttctttttgcattttgatttattaaaccgcaaatggtaacaaaacatatatttggactgatcaaagaaagaaactgatggtacgagtgagacattgtattcgagatacccgtcttctttcagactgattaaaaaaaaaa

SEQ ID NO: 3212 - DNA, 710 bp, Catharanthus roseus
tctgacgtttgacttctcttccttgaattttccagccagctctctccccttttctctctctgagacggtcgcgtttggttttctgcagctccttcaaaaaaattgggggaaaatgatccgattcatattgcttcagaacaggcaaggaaagactcgcctcgccaagtactacattccgcttgaggaatccgagaaacataaggtcgaatacgaggttcaccggctagtcgtgaacagagatccgaaattcaccaactttgttgaattccggactcacaaagttatttacagacgatatgctggattgtttttctcactgtgtgttgacataactgacaatgaattagcttatcttgagtgcatacatttgtttgtggagatacttgaccatttctttagcaatgtatgcgagctagatctggtattcaattttcacaaggtatatctcattttagatgagttcattcttgctggggaactccaagaaacaaagcaagaaggctattatagaaaggatgggagaattggaaaagcaggagtagagatcaaatttggcagctgaatttacaggaaatcgggaatagatctctgcctctccttccacagttgccggaaaagtgccattgttattattagtcattattccgataattttttggccatactgcacatagtgtccctgttgtattttcctttggaatgtgaatcta

SEQ ID NO: 3213 - DNA, 649 bp, Cichorium intybus
tgatccgattaatacgtttttgagaacaggtcaggaaagactcgactcgccaagtattacattccatcttgaagagtccgaaaagcacaagggcgaaaactaggtttatcgattggtcatacatagagatccgaagttctgtaatttcgtcgagatccgtacacgtaaagttatctacaggcgatatgctggactctttttctcactttgagttgatatagcggacaatgagctggcttatttggagtgtatacatttatttgtagaaatactcgatcactttttcagcaatgtgtgtgagctagatttggtcttcaacttccataaggtgtatttgatactagacgagttcattcttgctggggaacttcaagaaacaagctagagggcaattatagagagaatgggggagttggaaaagcaagagtaaagtgtgatttcttggtttggtggaatttttttttttttttcttaaatcactttggaaattggacatatatatctttctagatcatgtttgggtctctcgtttctcataaatgttagcgaaattcgatggtattctggtgaaatgaatagaagtttaaatgccccaagtggttttaatgagaaacaaacagtcgaataaaaccaacaaattaaaaggccg

SEQ ID NO: 3214 - DNA, 376 bp, Lippia dulcis
gaaaaatgatccggttcatactgttgcagaacaggcaaggcaaaactcgattggccaaatactacattcctctcgaggaatccgagttgcacaaggttgagtacgaggttcatcgtttggttgtgaatagggatcccaaattcaccaattttgtagagttccgaactcacaaggtcatctacagacgatatgctggtttatttttctcgttgtgtgtagacattacggacaatgagttggcttatttggaaagcattcacttatttgtggagatactggatcactttttcaccaatgtgtgtgagctagatctcgtatttaatttccacaaggtgtatctcatactagatgagttcatacttgctggggaactgca

SEQ ID NO: 3215 - DNA, 612 bp, Taraxacum officinale
ttcaaactgttatcgtacactttcttagcgtttcttgaccattaagacagaactcgatcagaacattcttactgctggattcacgcgataaagatcggattaattcgagcttcagaactcggcaagggaagactcgtctcgacaaggactacatccctcttgaagaaactgaaaagcacacggtcgaatacgaggttcatcgccaggccgtaaacagagatcccaaattcactaactttgttgagtttcgaacacacaaagttatctacaggagatatgctggactgtttttctcactgtgtgttgatataactgataatgagcttgcctatttggagggaatccatttatttgttgaaatactcgatcatttcttcagtaacgtttgtgaactggatttggtcttcaacttccataaggtttatctcattttagacgagtttattcttgctggtgaattccaagaaacaagcaaaaaggcaatcatagagaggatgggagaattggaaaaacaggaatgacattcattttttttttgttgtggtggtctttatcgactttctgtatttttaaacatcttggttttattcatgactatattgtaccatttga

SEQ ID NO: 3216 - DNA, 1392 bp, Sorghum bicolor
ccggcgcgcgcactcaaaagggcgggaaatttttccgcgcgctcccgccgctctcccctgtataaatcccaattgccccacaccttcgatcctctttctcagtccccaatccccaccaccaccgtctccagtccaccaccgcttcccttcaaatgggccgcaagggtcgcaaggctagggtttcgcgcgacgccgacgccgacggcagcgaggatgagagggccgccgccgccgctcctgccgccactgcgggcaagagcctctacgagatcctgggagttgagaagactgcttcacaacaagaaataaagaaggcatatcacaaattggcgttgcgcctccacccagataagaatcctggggatgaggaagccaatgagaagtttcagcagctgcagaaggttatatccattcttggtgatgcagagaaaagagctttatatgatgagactggcatcactgatgatgacgcactggtgggagcagctgcagacaatcttcaggagtacttcagaacaatgtacaagaaggtcaccgaggctgacattgaagaatttgaagctaaatacagagggtcagattctgagaaaaaggatttgaaggagctctacacaaaatataagggcaacatgaacaggcttttctgctcaatgatttgctcagaaccaaagcttgactcccaccgcttcaaggatataattgatgaggcaattgctgaaggtgagctgaagtcaactaaggcgtatgagaaatgggctaaaaagatctcagagatggagccaccaacaaatccgttagagaggagagtgaagaagaagaagaatagtgagaatgatctgatcctggccatctcacagcgcagggctgagcggaaaaaccagttcaattccatcctttcgaacatcatgtccaagtgcgactccaaggcaagcagctcggagcccacggaagaggagtttgagcgggcgcgacagaggcttgagagcaaaagggccaagaggcgcaagtgatgctgctgccagccttcaatgccatacgctgaacatcgtctgaagctttaggtgtgatgtgattttaccagcatgcaagtgatgggtctgagccagtttgagcgtgtcaggttgtgtatcatatcccttgtcctctgggacaatacagtaggttgtatgccgagagggaagctttacctgaacttcaatttcgtagcatctggcaagtactagtagattgtaatgtaatgtttattctgaagtgagctgccttcgagaagctggtcccacttagaaggctccttattagccagtttgagtttattgattcgccatggatacataacaggaaaaaatttacataatctcttaccgtgtgtttggttgggggttgggtgggttg

SEQ ID NO: 3217 - DNA, 1349 bp, Saccharum officinarum
gctcgctcccgccgctctcccctgtataaaatcccaatcgccccggaccttcattcctctttcccagtccccactccccaccaccaccgcctcccttcaaatgggtcgcaaggctagggtttcgcgcgacgccgacgccgacgctgatggcagtgaggatgagagggccgctccagccgccaccgtgggcaagagcctctacgagatcctgggagttgagaagactgcttcacaacaagaaataaagaaggcatatcacaaattggctctgcgcctccacccagataagaaccctggggatgaggaagccaaagagaagtttcagcagctgcagaaggttatatccattcttggtgatgcagagaaaagagctttatatgatgagactggcatcactgatgatgatgcactggtgggagcagctgcagacaatcttcaggagtacttcagaacaatgtacaagaaggtcaccgaggctgacattgaagaatttgaagctaaatacagagggtcagattctgagaaaaaggacttgaaggaactctacacaaaatataagggcaacatgaacaggcttttctgctcaatgatttgctcagaaccaaagcttgattcccaccgcttcaaggatataattgatgaggcaattgctgaaggtgagctgaagtcaactaaggcgtatgagaaatgggctaaaaagatctcagagatggagccaccaacaaatccgttagagaggagagtgaagaagaagaatagtgaggagaatgatctgatcctggccatctcacagcgcagggctgagcggaaaaaccagttcaactccatcctctcaaacatcatgtccaagtgcgactccaaggcgagcagctcggagcccacggaagaggagtttgagcaggcgcggcagaggctggagagcaaaatggccaagaggcgcaagtgatgctgcctgccagccttcttgccctatgacgaacatagtctgaagctttgggtgtgatctgattttgccagcacgcaagtgatggttctgagagccagtttgagcgtgttaggatgtgtatcatatctcttgtcctctgagacagtacagtaggttgtgtgcttatcggcttatcgccttgcctagagggaagctttatctgatcttcaatttcgtagcatttggcaagtactagtagattgtaatgtaatgtttactctgaagtgagctgcctgcgagaagctggtcccacttggacggctccttattagccagtttgaggtttggcagcggatgcatgcattcctagtttagtacatatatataatcgggctagcagctagccgattatcttcttgttcgc

SEQ ID NO: 3218 - DNA, 1326 bp, Panicum virgatum
ctccaggcaaatgggccgcaagggcaggaaggctagggtttcccgcgacgccgacgccgacggcagcgaggaggagggggccgccgctccggccgccaccgggagcaggagcctctacgagatcttaggggttgagaagactgcttcacaacaagaaataaagaaggcatattacaaattagctcttcggcttcacccagataagaatcctggtgatgaggaagccaaagaaaagtttcagcagctgcagaaggtgatttccattcttggagatgcagaaaagagggtgttatatgatgagacaggcattgctgatgatgatgcactggttggagaagctgcagacaatctccaggagtacttcagaacaatgtacaagaaggtcactgaggctgacattgaagaatttgaagctaaatatagaggatcagattctgagaaaaaggacctgaaggatctttatacaaaatacaagggcaacatgaacaggcttttctgctcaatgatttgctcagaaccaaagcttgactcccaccgtttcaaggatataatcgatgaggcaattgctgaaggtgagctgaaatcaactaaagcatatgagaaatgggctaaaaagatctccgagatggagccaccaacaaatccgttagagaggagagtcaagaaaaagaggaaaactgaggagaacgatctggtcctagccatctcgcagcgcaggatggagcgtaaaaaccagttcaactccatcctctcatccatcatgtccaagtgcgaccccaaggcgagcagctcggagcccacagaagaggagtttgagcaggcgcggcagaggctggagagcaagagggccaagaaacgcaaatgatgctgctgccagtctccttgccctgtgcggctgtgcaaccatcatctggttgtagcatcaggatgtagccaaactgattgcaaaatactagggtagattaccatctgggtttcttttcttcttctgagctagtgcagtaggtttgtatgtttatggccattgccgggagggaagcttagctggaatctgaaagtccgaatttcgtagcatctgcaactggattggttatttttgtactgagctgcgtgcaagtcatctgctgaatgtcatgcttgactctgacaacttggccccacatggtcgcctcaatgaacagcaattgtgagccatggagtggtgcctataaggtggctaggcactttgaccgctcttacagaggtattacccaaattgatggggtgcctagtgttaagagaatacagatgtggcatagtgtgttagtccactctgcgttactccaa

SEQ ID NO: 3219 - DNA, 1578 bp, Zea mays
ggggcgtgcacactgcagacttacaacggcgggaaattttccgctcgctcccgccgccgctctcccgtgtatatcccagtcgcctgcgacctccgttcctctttcccagtcgccccccagtccatcaccacttctccattcctctttcccagtgcccccagtccatcaccacatccgttcaaatgggccgcaaccgcaagggccgcaaggctagggtttcgcacgacgccgacgccgacgccgacgccgatggcagcgaggatgagagggccaccactgcgggcaggagcctctacgagattctaggagttgagaagaccgcttctcaacaagaaataaagaaggcgtatcacaaattggctctgcgcctccacccagataagaatcctggggatgaggaagccaaagagaagtttcagcagctgcagaaggttatatccattcttggagatgtagagaaaagagctttatatgatgagactggcatcactgatgatgatgcactggtgggagaagctgcaaacaatcttcaggagtacttcagaacaatgtacaagaaagtcacggaggctgacattgaagaatttgaagctaaatatagagggtcagattctgagaaaacggacttgaaggaactctacacaaaatataagggcaacatgaacaggcttttctgcgcaatgatttgctcagaaccaaagcttgattctcaccgcttcaaggatataattgacgaggcgattggtgaaggtgagctgaagtcaactaaggtgtatgagaaatgggctaaaaagatctcagggatggagccaccaacaaatccgctagagaggagagtgaagaagaggaagaacagtgaggagaatgatctgatactggctatctcacagcgcagggctgagcggaaaaaacagttcaactccatcctctcgaacatcatgtccaagtgtgactccaaggcgagcagctcggagcccacggaagaagagtttgagcaggcgcaacagaggctggagagcagaagggccaagaggcgcaagtgatgctgctgccagccttcttgccctatgctgaacattgtctgaagcttttggtgtgacctgattttaccagcatgcaagtgatgtttctaagacccagctcagtttgagcgtgtcagggtggggtgtgtgtcatatctcttgtcctctcacgatacactatgtcgtatggttatcggcttatcaccttgccgagagggaagctctatctgaacttttaattccgtagcatttggcaagtactagtagattgcaatgtaatgtttattctacggtgagctgcctgccagaagctggtcccacatgcaagggtccttaattattatccagtttgagaatgcagtttattgattctcgatggatactatgagcaaacaggttaagtgatggtctgagctttgttgtttcccaacccatacttaaagttcttgggagtacaatgatgagcatcgtaagaggataggtaaactgttgatctatagtaaaaatcattaacacctgcatctcttcgaatgagatgtgattgaatctaatatga

SEQ ID NO: 3220 - DNA, 1927 bp, Panicum virgatum
ccacctcccgtcgggggcgtttattcgtcgcgctttgtgattgaaattcatccaatcgcggagctgagcgcctctgtcgtccttcgcctcctttggctccggcaccgccctccaccgtcgtaacccttaactaatctcgccatcgcggtgtctgcctaccctcgccgtcttcttctcgccttttcgccgccggccaccgcccacccagaatcgtaccctgcccagcggccctctgccgatcgaaccattgcccgcacccgtcctccgccgccccccggtcccctcctcttctgtaacaggaggcggtcccgcttcccgctcacctccacgcgcgtggcggtcctccgcgccggctggccggcccacctcagccaacgcccaacgcctgtataaagggcaggaaaaaaaatcgactcccacacggagtcgaagctaccaattccctcccagcgcgcgacacccaaaagggcgggaaaattttccgcgcacccgcgctgccttcccctgtataaattccccaatcgcctccgccattctttccggttccccattcccccattcctcagtcacccccgccgccaccgatccaccaccgcctccaggcaaatgggctgcaagggcaggaaggctagggtttcccgcgacgccgacgccgacgccgacggcagcgaggaggagggggccgccgctccggccgccaccgggagcaagagcctctacgagatcttaggggttgagaagactgcttcacaacaagaaataaagaaggcatattacaaattagctcttcggcttcacccagataagaatcctggtgatgaggaagccaaagaaaagtttcagcagctgcagaaggtgatttccattcttggagatgcagaaaagagggcgttatatgatgagacaggcattgctgatgatgatgcactggttggagaagctgcagacaatctccaggagtacttcagaacaatgtacaagaaggtcactgaggctgacattgaagaatttgaagctaaatatagaggatcagattctgagaaaaaggacctgaaggatctttatacaaaatacaagggcaacatgaacaggcttttctgctcaatgatttgctcagaaccaaagcttgactcccaccgtttcaaggatataatcgatgaggcaattgctgaaggtgagctgaaatcaactaaagcatatgagaaatgggctaaaaagatctccgagatggagccaccaacaaatccgttagagaggagagtcaagaaaaagaggaaaactgaggagaacaatctggtcctagccatctcgcagcgtaggatggagcgtaaaaaccagttcaactccatcctctcatccatcatgtccaagtgcgaccccaaggcgagcagctcggagcccacagaagaggagtttgagcaggcgcggcagaggctggagagcaagagggccaagaaacgcaaatgatgctgctgccagtctccttgccctgtgcggctgtgcggccaacatctggttgtagcatcaggatgtagccaaactgattgcaaaatactagggtagattaccatctgggtttcttttcttcgtctgagctagtgcagtaggtttgtatgtttatcgccattgccgggagggaagcttagctggaatctgaaagtccgaatttcgtagcatctgcaactggattggttatttttgtactgagctgcgtgcaagtcatctgctgaatgtcatgcttgactctgacaacttggccccacatggtcgcctcaatgaacagcaattgtgagccatggagtggtgcctataaggtggctaggcactttgaccgctcttacagaggtattacccaaattgatggggtgcctagtgttaagagaatacagatgtggcatagtgtgttactccactctgcgttactcca

SEQ ID NO: 3221 - DNA, 1351 bp, Setaria italica
cgtctcacggcgctcgcactcgaaagggcgggaaaattttcggcgccgccgcgccgccctcccctgtataaaatccccaatcgcctccgcccttcttcccggttccccaatcccccattcctcaccagtcaccactgcagccaccgatccaccaccgcctcccgtcgaatgggccgcaagggcagaagggctagggtttcccgcgacgccgacgccgacgccgatggcagcgacgaggagaggggcgccgccgccgccgctccggccgccaccgggagcaagaccctctacgagatcctaggggttgagaagaccgcttcacaacaagaaataaagaaggcatattacaaattagctcttcgtcttcacccagataagaatcctggggatgaggaagccaaagagaaatttcagcagctgcagaaggtgatttccattcttggagatgcagagaagagggcattatatgatgagactggcattgctgatgatgatgcgctggttggagcagctgcggacaatcttcaagagtacttcagaacaatgtacaagaaggtcactgaggctgacattgaagaatttgaagctaaatacagaggatctgattctgagaaaaaggacttgaaggatctttatacaaaatataagggcaacatgaacaggcttttctgctcaatgatttgctcagaaccaaagcttgattcccaccgcttcaaggatatagttgatgaggcaattgctgaaggtgagctgaaatcaactaaagcatatgagaagtgggctaaaaagatctctgagatggagccaccaacaaatccattggagaggagagtgaagaaaaagaggaaaagtgaggagaacgacctgatcctagccatctcgcagcgcagggcggagcggaaaaaccagttcgactccatcctctcgtccatcatgtccaagtgcgaccccaacgcgagcagctcggagcccaccgaagaggagtttgagcaggcgcggcagaggctggagggcaagagggccaagaaacgcaagtgatgctgctgccatcctcttcttgccctgtgccgaacatcatctgttttagcatcaggatgtagccaaactgattgcaataccatctgggtgtcttctcttctcctctgggctagtacagtaggtttgtatgttcatcgccattggcgggggggggggggggggggaagctttagctgttactccgaatgtccaagtttcgtagcgtctggcaactggttattttgtactgagctgcgtgcaagagtcgttatggtaaatgccatggttgacactgacaatctggtcccacatggaagactcattgcgtttgggc

SEQ ID NO: 3222 - DNA, 1191 bp, Panicum virgatum
tttcgcgcgacgccgacgccgatggcagcgaggaggagtgggccgccgctccggccgccaccgggagcaagagcctctacgagatcttaggggttgagaagactgcttcacaacaagaaataaagaaggcatattacaaattagctcttcggcttcacccagataagaatcctggggatgaggaagccaaagagaagtttcagcagctgcagaaggtgatttccattcttggagatgcagaaaagagggcattgtatgatgagacaggcattgctgatgatgatgaactggttggagaagctgcagacaatctccaagagtacttcagaacaatgtacaagaaggtcactgaggctgacattgaagaatttgaagctaaatataggggatcagattctgagaaaaaggacctgaaggaactttatacaaaatacaagggcaacatgaacaggcttttctgctcaatgatctgctcagaaccaaagcttgactcccaccgtttcaaggatataatcgatgaggcaattgctgaaggtgagctgaaattaactaaagcatatgagaaatgggctaaaaagatatccgagatggagccaccaacaaatccgttagagaggagaatcaagaaaaagaagaaaactgaggagaacgatctgatcctagccatctcgcagcgcagggtggagcgtaaaaaccagttcaactccaacatctcatccatcatgtccaagtgcgaccccaaggcgagcagctcggagcccacggaagaggagtttgaacaggcgcggcagaggctggagagcaagagggccaagaaacgcaagtgatgctgccagcctccttgcccagtgcggctgtgctgaaccatcatctggttatagcatcaggatgtagccaaactgattgcaaataactagggtagattaccatctgggtttcttttcttctcctctgagctagtacagtaggtttgtatgtttatcgccattgctgggcgggaagctttagctgctggaatctttttcgcgaccgttagctgctggaatctggaagtctgagttccgtagcatctggcaactggattggttattttggtaccgagctatggccctgtttgggggagctggagcttctccaaaagctccattttggaaagctccaccggctaattcaaaaagctacttttcagag

SEQ ID NO: 3223 - DNA, 1466 bp, Oryza sativa
gtgatctctcacctccggtgtacaagcattttccatcgaaccctccatccccatggcgggtggttcattcgacgagacgccgccaacgccaaatcccggcgcgaaccaaaaagcgcgggaaaaatttccccgcacccgcgccatctccacctataaagatctcgccgccgcagccgccttctcctctacactactagtcctcttcaccccgccgcttccaccagatgggccgcaagaggagggctagggtttcccgcgacggcgacggcgaggaggaggaggagcccgcgccggtcgccgcagagagcaagagcctctacgagatcttaggggttgagaggacagcttcacagcaggaaataaagaaggcttatcacaagttggccttacgtcttcatccagacaagaatcctggagatgaggaagccaaggagaaatttcagcagcttcagaaggtgatatctattcttggggatgaggagaaaagggcattatatgatgagactggaattgctgatgatgatgcactggttggagaagctgcagacaatcttcaagagtacttcagagctgtttacaaaaaggttactgaggctgatattgaagaatttgaagctaagtacagagggtcagattctgaaaaaaaggacttgaaggatctatatacaaaatttaaaggcaacatgaacaggcttttttgttcaatgatttgctcagatccaaagcttgattcccatcgctttaaagatataattgatgaggcaattgctgaaggtgagctgaagtcaacaaaagcatatgataaatgggccaagaagatctccgagattgaacctcccacaaacccattagagagaagagtgaagaagaacaagaagaagagcgaggagaacgatctgatcctcgcgatctcacagcgcagggcgcagcggaaggaccggttcgactcggtgctctcatccatcatgtccaaatgtgacccaaaggggagcagcagctcggagcccacggaagaggagtttgagcaagctcgtcagaggctcgagaaaaagcgttccaagaaccgcaaatgattcgccttgcagcctcccttgtggcttgtgcaattctgtttcatcgagtttgttaaccaggcctatctttgacagatcagattgtctgatattctgatccctagtatctatgtgagattggctgcttctgttgtggtgcaagttcaggctggaatctgaacttcctgctcttttgctgaaactggggccgatctttagcatcactgcatatgtgtataatcaaaatcttaaatgtttcctggatgtgaacttgtgatctagtttctgtataagttaatccagtagctgtcttgagtttttacgcctgtaaacgatataaacaagaatgcatcatcaacagggacgagaggcgggtttgcaatctcgttttggggttgaattgtgaggcacagc

SEQ ID NO: 3224 - DNA, 1483 bp, Brachypodium distachyon
caccaacacagttctctcaacgaacaaaaacagcatatccgacgtggcagatttcatctctgctcagccccggcagggcagcagcacaacattctgatcgctgccaccacgccacgcgacgggagttcgccaatttccggcgcgcgggaaaacttcccgctctcgcggctcggctcgccggcctctataaggtacccatcaccacgggcctccgcttgttccacttcgcattttccccaattcgcctcacaccaaatgggccgcaagagaaaggctagggtttccgacgactgcgacggcgccgacatgaacggggaagaggcggccgccggccccgctgacgcgcagagcaagagcctctacgagatcttaggggttgagaggacagcttcacaacaggagataaaaaaggcatatcacaagttggccttgcgccttcacccagataagaatcctggagatgaggaagccaacgaaaaatttcagcagctgcagaaggtgatatctattcttggagacgaggagaaaagggcattgtatgatgagactggcatcactgatgatgatgcactggttggagaagctgcagacaatcttcaagagttcttcagaacactgtataaaaaatttactgaggctgacattgaagattttgaagctaagtacagagggtcagattctgagaaaaaggatttgaaggacctctatacaaaatttaagggcaagatgaacaggcttttctgttcaatgatttgctcagatgccaagcttgattcccaccgctttaaggacataattgatcaggcaattgctggaggtgagctgaagtccaccaaatcatatgagaaatgggctaaaaagatatctgagatagagccacccacaaatccactaaaacggagagtgaagaaaaagaaaagcgaggagagcgatctcatactggcgatctcacagcgcagggcggaaaggaaggatcggttcgactctgttctctcatccataatgtccaaatgcgactccaaggcgagcagcagctcagagcccactgaggaagagtttgagcgtgcgcggcagaggctggagaagaagcgtgccaaagggcgcaaatgatgcagatgtgccgaaggttatggttgggctgatgaccctgttttgaggaaaacaagcagtggagtggagcgaggcgcagtactacaaactcgtactagcaagtagatgttctctgaatctctgatgtgatccccatgaatggaatcctcgtcataccggtaggatggtatggcttgatacttgctttgtgattcatgtcgtaatggaagatgatgatgggtcggtctattgagacgcgtctcttttctttacgaatctactcttggtacctgctgtcgtaacaaatggcaaatacaagctacatttcttttgtggcaaagacagttcgatttgccatgatgccatatgtttcaaacagaagaaatgaagctaa

SEQ ID NO: 3225 - DNA, 1025 bp, Pennisetum glaucum
ctctaccgctccagccgccaccgggagcaagagcctctacgagatcctaggggttgagaagaccgcttcacaacaagatataaagaaggcctattacaaattagctcttcgtcttcacccagataagaatcctggggatgaggaagccaaagagaaatttcagcagctgcagaaggtgatttccattcttggagatgcagagaagagggcattatatgatgagactggaattgcggatgatgatgcactagttggagcatctgctgacaatcttcaagagtacttcagaacaatgtacaagaaggtcactgaggctgacattgaagaatttgaagctaaatacagaggatctgattctgagaaaaaggacttgaaggatctttatacaaaatataaaggcaacatgaacaggcttttctgctcaatgatttgctcagaaccaaagcttgattcccaccgcttcaaggatataattgatgaggcaattgctgaaggtgagctgaaatccactaaagcatatgagaagtgggcaaaaaagatctctgagatggagccaccaacaaatccgttagagaggagagtgaagaaaaagaagaacagcgaggagaacgatctgatcctagccatctcgcagcgcagggcggagcggaaaacccagttcaactccatcctctcatccatcatgtccaagtgcgaccccaaggcaagcagctcggagcccacggaagaggagttcgagcaggcgcggcagaggctggagagcaggagggccaagaaacgcaagtgatgctgctgccatccttcttgctctgtgccgaacatcatttgtttaagcatcaggatgcagccaaaactgattgcaataccgtctgtgtcttctgtcttctctcttcctaggctagtacagtaggtttgtgtgtttatgccattggctggagggaagcttaagctctgtgactatgactctgaaaatccaaatttcgtagcatctggcaactggttattttgtaatatactgagctgcg

SEQ ID NO: 3226 - DNA, 1236 bp, Secale cereale
gactttttgatcgcttctggtgggtaccggtacgggagtccgccaatttccgtcgcgcgggaaaatttcccgcactcgcgctcgcgcctcgcccgctataagaaagaatcgcaccaccacggtctcctgctccacttcccccacttccgccgcctcccaccgaatgggccgcaagaggagggctagggtttccagcgacagcgacggcgacgacggcgagatgaacggccaagagcccgccgacgcgcagagcaagagcctctacgagatattaggggttgagagcacagcttcacaacaggagataaaaaaggcatatcacaagctggccttgcgtcttcacccagataagaatcctggagatgaggaagccaacgaaaaatttcagcagctgcagaaggtgatatccattcttggagaccaggagaaaagggcattgtatgatgagactggaattactgatgatgatgcactggttggagaagctgcagacaatctccaagcgtacttcagaacagtgtacagaaaggtcacagaggctgacattgaggaatttgaagctaagtacagagggtcagaatctgagaaaaaggatttaaaggaactctacacaaaatttaagggcaacatgaacagactcttctgctcaatgatttgctcagatgccaagcttgattctcaccgcttcaaagatataattgatcaggcaattgctgaaggcgagctgaagtccaccaaagtgtatgcgaaatgggctaaaaagatctctgagatagagccacccacaaacccattggagaggagagtgaagaaaaagaagagccaggagagcgacctcatcctggcgatctcgcaacgcagggagcagaggaaggagcggttcgactctgttctgtcatccataatgtccaagtgtgacgacagcaaggccagcagctcagagcccactgaggaggagttcgagcgcgctcggcagaggcttgagaagaagcgcaccaaggggcgcaaatgatatgaatcttgacatgcatgcaggtcaggctaccttggccatcaggcccttcaagaaaaaattgagtgtcgagtgggagtggagtggaggggttgtgttgcaactctagtgctgctttgttttatgagtgggcgtgtgtataagtaactgaatgcaagtgtggtgtggttttagatgtgaacaactgtcgaagtgtcctgtcccatgaatgaaatgaaatcctt

SEQ ID NO: 3227 - DNA, 1292 bp, Triticum aestivum
ctttctggtgggagggaagggacggttaccggtacgggaaacgccgaaacgggagtccgccaatttccggcgcgcgggaaaatttaccgcacttgcgctcgcgcctctataagaaagaaagaatcgcgtcaccacggtctcctgctccacttcccccacttccgccgcctcccaccgaatgggccgcaagaggagggctagggtttccagcgacagcgacggcgacgacgtcgagatgaacggccaagagcccgccgccgccgccgacgcgcagagcaagagcctctacgagatattaggggttgagagcacagcttcacaacaggagataaaaaaggcatatcacaagttggccttgcgtcttcacccagataagaatcctggagatgaggaagccaatgaaaaattccagcagctgcagaaggtgatatctattcttggagaccaggagaaaagggcattgtatgatgagactggaattactgatgatgatgcactggttggagaagctgcagacaatctccaagcgtacttcagaacagtgtacagaaaggtcacagaggctgacattgaagaatttgaagctaagtacagagggtcagactctgagaaaaaggatttaaaggaactgtacacaaaatttaagggcaacatgaacagacttttctgctctatgatttgctcagatgccaagcttgattctcaccgcttcaaagatataattgatcaggcaattgctgaaggcgagctgaagtccaccaaagtgtatgcgaaatgggctaaaaagatatccgagatagaaccacccacaaacccattggagaggagagtgaagaaaaagaagagccaggagagcgacctcatcctggcgatctcgcagcgcagggaacagaggaaggagcggtttgactctgttctgtcatctataatgtccaagtgtgacgacaacaaggcgggcagctcagagcccacggaggaggagtttgagcgtgctcggcagaggctcgagaagaagcgcgccaaggggcgcaaatgatatgaatcttgacatgcatgcaggtcaggctaccttggtcgtcaggcccttcgagaaaaaatgggtgttgagtggagtggagtggagggattgtgtcgcaactctagtgtcgctttgttttatgagtgggcgtgtgtataagtaactgaatgcaagtgtggtgtggttttggatgtgaacaactgtggaagtgtcctgtcccatgaatgaaatgaaatcctcggcatgccggcatggccaggtgatagtctgttta

SEQ ID NO: 3228 - DNA, 1276 bp, Triticum aestivum
atcgcttttctggtgggagggaagggacggttaccggtacgggaaacgccgaaacgggagtccgccaatttccggcgcgcgggaaaatttaccgcacttgcgctcgcgcctctataagaaagaaagaatcgcgtcaccacggtctcctgctccacttcccccacttccgccgcctcccaccgaatgggccgcaagaggagggctagggtttccagcgacagcgacggcgacgacgtcgagatgaacggccaagagcccgccgccgccgccgacgcgcagagcaagagcctctacgagatattaggggttgagagcacagcttcacaacaggagataaaaaaggcatatcacaagttggccttgcgtcttcacccagataagaatcctggagatgaggaagccaacgaaaaatttcagcagctgcagaaggtgatatctattcttggagaccaggagaaaagggcattgtatgatgagactggaattactgatgatgatgcactggttggagaagctgcagacaatctccaagcgtacttcagaacagtgtacagaaaggtcacagaggctgacattgaagaatttgaagctaagtacagagggtcagactctgagaaaaaggatttaaaggaactgtacacaaaatttaagggcaacatgaacagacttttctgctctatgatttgctcagatgccaagcttgattctcaccgcttcaaagatataattgatcaggcaattgctgaaggcgagctgaagtccaccaaagtgtatgcgaaatgggctaaaaagatatctgagatagaaccacccacaaacccattggagaggagagtgaagaaaaagaagagccaggagagcgacctcatcctggcgatctcgcagcgcagggaacagaggaaggagcggtttgactctgttctgtcatctataatgtccaagtgtgacgacaacaaggcgggcagctcagagcccacggaggaggagtttgagcgcgctcggcagaggcttgagaagaagcgcaccaaggggcgcaaatgatatgaatcttgacatgcatgcaggtcaggctaccttggtcgtcaggcccttcgagaaaaaatgggtgttgagtggagtggagtggagggattgtgtcgcaactctagtgtcgctttgttttatgagtgggcgtgtgtataagtaactgaatgcaagtgtggtgtggttttggatgtgaacaactgtggaagtgtcctgtcccatgaatgaaatgaaatcctcggcatgccggcat

SEQ ID NO: 3229 - DNA, 2271 bp, Sorghum bicolor
atgaggtaaaagcaccactaaatgtctaatagattcattagataaattcaaggaaacaaggtgaaggtggattgaaaaggagcaggggaaaaaaaactcggaaatgtcttgccccggaccaaaggcagttatgaacggtgaagtcgatgatggtgaaccagtttgtctccactcccctggcgtcgaccccgaccggagcggagcgcgcgcgggcgcacagacaccggacacgaccgagcacggagcgacgcagtagcgcagcgccgcacggccacgcgcccacgccccaatcctgccgggccgcgtcgccgactcgcgccgcctgttgccattcgcctctgcagatccggcaccgcgcgcggctcctcgccgagttgttcccggcggcgcatcagaaggctgtctcctgggatcagttactcgcgtggctcgcacgacactcggggagggactctgacctggtaccaaacagcatctgcatcttctccgcccccaggctttggatctggccttcgtctcagttcggcgagctgccaaggacagctttgatttggtgcccaaagtgatgtagtgtgagaggcagaggctgacttcttgagagcgcgatgagcagccagggaggattcggtacggggagccccaagtccttccgctaccccagaggcggcggcgacttcgatctcgagtccgggtccccccgcaagggacgcaagcccaagaaccctcacctggagacctcgatcgtcatgaggatccgctacttctacgaggcgcaccccgtggccgtggccctcctcctcctctccttcggcctcagcgtcctcatcctcctctccgtgtatgagacccggttcaggacgatgaggagcggcggcgcgtggtccagtgacggcggggagtacccatttccgaagctccggaacctcgtcatggtggctgggcattccatctacacgagctcgagatgcggggagactgagagtgagaattcctggttcttggagccgtaccagaagcaccctggacaggcggccaccttcctggctcacatcaaggagggggtggggatcgtggccagggatgagggggcgcttctgttgttcagcggcggggagacgaggagagatgctggcccgaggagcgaggcacagagctattgggctattgccgagtccaaaggatggtttggaaatgatgagagtgtaaggagccgagcactcactgaggagcatgcacgagatagttttgaaaacctcctatttagtgtgtgccgtttcagagagctcactggaagatacccacaaaacataactgttgttagttatgatttcaaggaggaacggtttgcacaattgcacagaaccgcactcggattcccagaaggaagattcttcttcacaggtacaccagctactccttctgcaagggaggctgctctgaaaggcgaagcagctgtccgttctcagttcctggaagatccatatggatgtctaggatctcttcatgtaaagaggctgaagagggacccgttccaccgtaccattccataccctgatggctgcccagagctgaagggtttgttttcctattgtggcccggtgccttactccgggcacctcccctggactgagtagctagtgtaatgtacatcaatctttgatcgagctccccactgtcactgcacgattccagcaccctttgcactgaccttgttctgaattgatggaaacatattcaaccttgccttcttcattagggagaggattgcttttgcaatacaagtaaatgttacactatcaatatatatacttttaatctttttgtttctcctcgataacttgtctattgtctttactcacaattcaaacttctgaatctgctcttacacgtacaccgtattctgtggtgcaatgcaagcaacgaagaacttccccttgcagctgaagttctgaaccttctctgtcaagaaaacctgaacatcccatgaacaaaatttgtactctctgatatcctgctgttcttccaatactgatccctcgctgcttttccagtttttcagaccagttacattcacttccaccaatcttataatattgcaaaaagctgtatactttcatttaacttataagccgtacttatcttataagccatactttttctaccaagctgtacttatcttcacccatgacttttcatcacccatgacttttcagacctgcaaacgtgctcttgcgtatcagttttcttttacataatatattctatactttg

SEQ ID NO: 3230 - DNA, 1897 bp, Setaria italica
gacatggtccagccagaccaagtcagctgtgtctgtgaaccccggtttcgctcccctgcgtcgaccccggccggagcgcgcgcagagcggcagaggagacagcggaagcccgagcaacgccggcgtccgcccctcccattagtgccgcccggccacgccacgcccccatcctgctacctgctggcccgcgtcgccacccctcccgccagattctcctgctgcatctcctccctcggcgccgcctgctatccattcgcctcggcagatccggcccggcgcgcgactgctcaccgatttgttcccggcggcacctcaaaggctgcctcccgggatcggttactcgcgtggctcgcacgacacccgcggatcttgatttggtaccaaacagcatcatacctgcatcttctcgagcccaagctttggatctgggcttcttctcagttcaccgaaggacagcttgatgcgctgcccgcgtgataccgagaggccgagttcttgagcgcgatgagcagcagccagggattcggtccggggagccccaagtccttccgctaccccagaggcgtcgacttcgacctcgagtccggggtctcccgcaagggccgcaagcccaagaacccgcacctcgaggcctcgatcgtgatgaggatccgctacttctacgaggcgcaccccgtggccgtcgccctcatcttgctgtccttcggcctcagcgtcctgatcctcctctccgtgtacgagacccggttcaggacgatgaggagcggcggcgcgtggtcgagtgaggttggggagtatccgttcccgaacctccggaacctcgtcatggtggccgggcattcgatttacacgagcgccagctgcgggaagactgaccgtgaggattcctggtttttggagccgtaccagaagcaccctggtcaggcggccacgttcttggcgcatatcaaggagggcgtggacattgctgcgagggacgagggcgcgctgctgttgttcagcggtggcgagacgaggaaggatgccgggccgaggagtgaggcgcagagctattgggcgattgcggagtccaaaggctggtttgggaatgatgagagtgtaaggagccgggcactcactgaggagcatgcccgagatagttttgaaaacctcctgtttagtgtctgccgtttcagagaactcactggaagatacccacaaaacataactgtcgtaagctatgatttcaaggaggaacggtttgcgcaattgcacagaacagcgcttggattcccagaaggaagatttttcttcacaggtaccccagcaacgcctgctgcaagggaggctgctctgaaaggtgaagccgctgtgagggctcagttcctggaagatccctatggatgcctaggctctctccacgtgaagaggctcaagagggacccatttcaccggaccatcccataccctgatggctgcccggagttgaagggtctgttctcctattgcggcccggtgcctttctccgggcacctcccatggactgaatagttgcatgaatctttttggatcagactcctgccaccgcacaattccaacattcttcaccctgttacgaactgaactgatgtctgacggggaagagaagattttacactagtgagaattgttttcgcaaaatagaagcatgaaacatgatcaatatatagatttttttcctctttttttcttcttcctttcctgcctgtgctccccttcccctcccctggtgacttgaggcaccactgaaactttgaaagtgtttgcacacgtgttatgtagaaagaactctccttgcagccgaacctgcgcctgtgatgtgataacctggatatcctatgaacagtcgtactaattgattgatgtcctgctgtttttg

SEQ ID NO: 3231 - DNA, 2182 bp, Pennisetum glaucum
cccgcgcgcggagtggcagaggtgacagcagacgccagagcaacgccggcatccgcctctcccagtaacgccgccccgccacgcccccagattgtcctgcggcatcttgctcccacggcgccgaccaccatccatccggcccagcgcgcggctgcttacggatttgttcccggtggcacctcaaaggtaggatctttacttccaaggtcactggaccagccccacgatttgatgcgcaattgcgctaactggcgccccatttctcgtccccgcgggctgcctcccgttactcgcgtggctcgcacgacacccgcagatcttgatttggtaccagacagcatcgttcctgtacctgcatattctcgagcccgagctttagatctcggctttcagttcaccgaaggacagcttgatgcgctgcccgcgtgataccgagaggccgagttcttgagcgccatgagcagcagccagggattcggtccgggtagccccaagtccttccgctaccccagaggcgtcgacttggacctcgagtccggggttccccgcaagggccgcaaactcaagaaccctcacctggaggcctcgatcgtgatgaggatccgctacttctacgaggcgcaccccgtggccgtcgcccttatcttgctgtcattcggcctcagcgtcctgatcctcctgtccgtgtatgagacccggttcaggacgatgaggagcggcgccgcgtggtcgagtgaggttggggagtatccgttcccgaacctccggaacctcgtcatggtggctgggcattcgatttacacgagttcgagctgcggcaagactgaccgcgaggattcctggtttttggagccgtaccagaagcacccaggccaggcggccacgttcttggcgcacatcaaggagggcgtggacatcgcttcgagggacgagggtgcgctgctgttgttcagtggtggcgagacgaggaaggatgctggaccaaggagtgaggcacagagctattgggcgattgcggagtcgaaaggctggttcgggagtgatgagactgtaaggagccgggcactcactgaggagcatgcccgagatagttttgaaaacctcctgttcagtgtttgccgtttcaaagaactcactggaagatatccacaaaacataaccgttgtaagctatgatttcaaggaggaacggtttgcgcaattgcacagaacagcgcttggatttccagaaggaagatttttcttctcaggtaccccagcaacacctgccgcgagagatgctgctctgaaaggtgaagccgctgtgagggctcagttcctggaagatccctatggttgcctaggctctctccacgtgaagaggctcaagagggacccatttcaccggaccattccataccctgatggctgcccggagttgaagagtttgttctcatattgtggcccggtgcctttctctgggcacctcccttggactgaatagttccatgaatcatcactcatcagactcctgccatggcacagatttgcatcatttgtggaatgaccttgttctgaactgatggggaagagaagatttacactagtgataattttttggccacataatgacgtaatagaagcatgttacatgatcaatacggaatatataggttttccttctttctttcctgcctgcctgccccctccccctggtgacttgtctcttttctctggtcaccaatgaaaagaaatttggtggaagtgtttgtacacaagttctgtaccattaggaggaaattaaggacttaagggtgcgagagggtgcctagtggttgaagacacggactttgtgtatcaaaaagataattcctaagagcttacatctgcttgcaagttaatatgacctatctttagtatttgcatttcattgacatgcagagtccagagagagaaagttgcaagaccagtctgttggcattgtcttcacaatccaggactccaaggttgccatggctgcacctgacatcaacccaactgtatttttcatcagattgaagcttcgaagcacggctgaaactgatgcacgcatgaatggatcatgggaagaaaatgtgcagccaagcaactcttaggattgaaatagccaatgtgcatccaaatctgtgctggagttctggagattgtagctgatcgtgcatttg

SEQ ID NO: 3232 - DNA, 1507 bp, Leymus cinereus x Leymus triticoides
  misc_feature (101)..(101): n is a, c, g, or t
  misc_feature (1195)..(1195): n is a, c, g, or t
  misc_feature (1208)..(1208): n is a, c, g, or t
  misc_feature (1263)..(1263): n is a, c, g, or t
  misc_feature (1274)..(1274): n is a, c, g, or t
  misc_feature (1291)..(1291): n is a, c, g, or t
  misc_feature (1369)..(1370): n is a, c, g, or t
  misc_feature (1381)..(1381): n is a, c, g, or t
  misc_feature (1400)..(1400): n is a, c, g, or t
  misc_feature (1409)..(1409): n is a, c, g, or t
  misc_feature (1416)..(1416): n is a, c, g, or t
  misc_feature (1432)..(1432): n is a, c, g, or t
  misc_feature (1434)..(1434): n is a, c, g, or t
ccgctctaaattctctcctgcactccatcacctcctagatccgcccgccccgaggcggagttctggagagctcgatgagcagccaggggttcggtcccggnagccccaagtccttccgctaccctagagccgactacgatctcgagtccgggatcccccgcaagggccgcaagcccaagacctcgcatctcgatgcccctgcccccctcagctcggcgctgatgaagatccggtacttctacgaggcgcaccccgtcgcggtcgccctcatcctgctgtctttcgggctgagcgttctgatcctcctgtccgtgtacgagacccggttcaggacgatgaggagcggcagcaacgaggtcggggcgtacccgtttccggacctccgcaacctcgtcatggtggccggccattcgatatacacgagcgcgagctgcgggaagatcgaccgcgaggattcgtggttcttggagccgtaccagaagcaccccggtcaggcggccaccttcttggcgcatatcaaggagggggtggagatcgcggcgagggatcagggcgcgctcctgttgtttagcggtggggagacgaggaaagatgcagggccaaggagcgaggcgcagagctactgggctattgcagagtcgaaaggctggtttggaaatgatgatagtgtaaggagccgggcactcacggaggagcatgcacgagatagttttgaaaatctcctattcagcgtttgccgtttcagagaactcactggaacatacccacagaatataactgtcgtaagctatgattttaaggaggaaaggtttgcacaactgcacagatcagcacttgggttcccagaagaaaggttcttcttctcaggtaccccagctacagctacagcaaaggaggcagctctgaaaggtgaagcctctgtcaggtctcagttccaagaagatccatatggatgcgttggttctcttcgtgtaaagaggctcaagagagacccatttcatcgtaccattccgtaccccaatggctgccctgaattgaagggtctattctcctattgcggtatggtgccatactctgggaaccttccttggactcagtagcggagaagggcatgatgtttggatcaaacttctactctcactgtaaaatcccagcattcttgtttcgcccctgtttctaagctgacagaataganatccccattcctntcttctgtgcgagggagaagagaagatctaagctacactagttagattgttttcntcacggaagcntgccacatgctccatanacattttttttctcacttctcccaggtctccactgaaaactgtgaatttgttagtacacatgctctgtaaactagcannggaagcaagtnaacttataatttgtaattncagcttganctgcacnagtaaaaactggaaancntatgaacatgtatccatgtaatatcctggtattcttccattggaaaaaaaggctgttttcgttttaaaaaaaa

SEQ ID NO: 3233 - DNA, 1613 bp, Brachypodium distachyon
ttcgtccgtagatagactttttcctctccacctccaccatcgcgttcctgtaccttgcctcttccacgcggatccattcctaatcctcccccacgctgctctcatgctctgacgcaccaaagctccaatccagcccaatgcggctctaagatctctcccatataccaccaccaccaccaccaagatccgccccgaggcggggttcttgtgagctcgatgagcagccagggattcggtcccgggagccccaagtcgttccgctaccctagagctgactacgatctcgagtccgggatcgcccgcaagggccgcaagccaaagaaccagcacctcgactcgcctggcgccctgagctccgtcctgatgaagatccgcatcttctacgaggcgcaccctgtcgcggttgccctcatcctgctgtctttcgggctaagcgtcctgatcctcctgtccgtgtacgagacccggttcagagcgatgaggagcggcatcaatgaggtcgggtcgtatccatttccggacctccgcaaccttgtcatggtggctgggcattcgatttacacgagcgcgagctgcggcaagcttgaccgcgaggattcgtggttcttggagccataccagaagcaccccggtcaggcggccacgttcttggcgcatatcaaggagggggtggacatcgctgcgagggatcagggcgctctcctgttgtttagcggtggggagacgaggaaagatgcagggccgaggagcgaggcgcagagctactgggcaattgcagaatcgaaaggctggtttggaaatgatgagagtgtaaggagccgggcactcaccgaggagcatgcacgagacagttttgaaaacctcctattcagcatttgtcgtttcagagaactcactggaacatacccacaaaacataactgtcgtaagctatgattttaaggaggaaaggtttgcgcaattgcacagatccgcgctcgggttcccagaaggaaggttcttcttcacaggtaccccagctacacctacagcaagggaggctgctgtgaaaggtgaagcctctgtcaggtctcagttccaagaagatccatatggctgcctaggttctcttcatgtaaagaggctcaagagagacccatttcatcggactatcccctaccctgatggctgccccgagttgaagagcctgttctcctattgcggtccggtgccttactctggtaaccttccttgggatcaatagtggggaaagacaagatgtttacatcatgttcacgtcgaacatatagtctcaccataaaatctcaatgctcttgttttgcacctgatttgaagctgacagaatagatatctccaatcctgtcatctgtgcgagggagaagagaagatctaagctacactagttagattgttttcataatggaaacatgtcccatggtcgatatatagttcatttttcttgtctcgggtatccactaaaactgtgaatttgttaatacacatgttctgtacaactagcaacggaagcaaatgaactgagaatttgtgtttgaggaagaatcttctgtgctgtgctggtaactatgcaattttagtgcctcttggctgcataat

SEQ ID NO: 3234 - DNA, 2000 bp, Oryza sativa
attatccctattgttttcttctctcattaagacatatcatctcgaagtttttttaacctttagatatatggtctaaattatttttcttttttttctctcataaaaccacatcatcttattttatatttaaatcatcattctgcatactatttaaatttaaatcgcatcgagttatataacatatgttgtttaagctagtgttattgttatcattgtaactctcgtaataacacgcgagatgaaattatatgtgagttcaatgataaatgttaaataacaacaaatagttaaatatctcatcccatctcccatcccattcccagtttcctctcctcgcctctgctctcttcccccgttaaggcaggcgatcctgatcccctctccatccgccggcggccgacgcgggggcgcggaggcgcgcacgcacgcacggcggtgtggacggctcctctccttgccggagcccggcctccttccctgtgcggcctcctcgccccgccggcgagcctctctgctcgaatcgaaccggaggtataccccattcctgcctcgtagccctctctctccctccctccctccctcgctccggcgccgcttcatgcgccggcgagacctggatcgggaggaagactcggatcgagccggtggggcgcgatgaacagccagggattcggtccgggcgggagccccaagtcgttccgctaccctagggcggacttcgatctcgagtccgggatcgcccgcaagggcttacgcaagcccaagaaccacgacgcccccggtttgctcacctccacgctgatgaagatccggtacttctacgaggcgcaccccgtcgcggtcgccttcatcctgctgtccttcgggctcagcgtgctgatcctcctgtcggtgtacgagacccggttcaggatgatgcggggttcttcgggtgaggtcggggagtatccgctcccggagctccgcaaccttgtgatggtggccgggcattcgatttacacgagcgagagctgcgggaagattgatcgcgaggactcttggttcttggagccgtatcagaagcaccccggtcaggcggccacgttcttggcgcatatcaaggaaggcgtgggtatcgccgcgagggatgagaaggcgcttctgctgttcagcggcggcgagacgaggaaagatgcggggccgaggagcgaggctcagagctactggactatcgcggattcgaaaggctggtttggaaatgatgaaagtgtaaggagacgggcactcaccgaggagcatgcacgtgatagttttgaaaacctcctatttagcgtttgccggtttagagaactcactggaagttacccgcaaaatataactgttgtaagctatgattttaaggaggaaaggtttgcgcaattgcacagatctgctcttggattccctgaagggagattcttcttcttaggtacccctgctacactgactgcaagggagtctgctgtcaagggtgaagccgctgttagatctcagttccaggaagatccttatggatgcttaggttctcttcatatgaagaggcttaagagggatccatttcaccgtgccattccatatccgaatggttgccctgagctgaagggtctgttctcatactgtggtctggtgccttaccctgggcagcttccttggacccaatagctcgaaggatatacgaaccttggactatacaaccttctttcattgcctcggctctgaagtctgaactgacaaaataactacttgtgaaatgtgatgtattcttcctgaatcctgactaagaccacatttacattagtgagattgtttttttgtaacggtgtatatcacatgatcaatatatgttttttcagtgtgatttggcatctctgtactaggaaacttgaaattattagtgaaaacaatgttctctctctgtttttttttaaagataaatgttctcaatctactggacattgtaaactgtattacctggtatgtat

SEQ ID NO: 3235 - DNA, 1518 bp, Hordeum vulgare
cccgggctgcaggaattcggcacgaggctttttctcccaagctgctctgatgctctgaccctccccgagctccaacccggccgatccagtgccgctctaaatcctctcctccactccatcaccacctagatccgcccgccccgggggagggcggagttccggcgagctcgatgagcagccaggggttcggccccgggagccccaagtcgttccgctaccctagagccgactacgatctcgagtccgggatcccccgcaagggccgcaagcccaaggcctcgcatctcgacgcccctgcccccctcagctcggcgctgatgaagatccgcttcttctacgaggcgcaccccgtcgccgtcgccctcatcctgctgtcattcgggctcagcgttcttatcctcctgtccgtgtacgagacccggttcagaacgatgaggagcggcggcgatggggtcggggcgcacccgcttccgggcctccgcaacctcgtcatggtggccggccattcgatatacaccagcgccagctgcgggaagatcgaccgcgaggattcgtggttcttggagccgtaccagaagcaccccggccaggcgtccaccttcttggcgcacatcaaggagggggtggagatcgcggcgagggatcagggcgcgctcctcttgtttagcggtggggagacgaggaaagatgcagggccgaggagcgaggcgcagagctactgggctatcgcagagtcggaaggctggtttggaaatgatgatagtgttaggagccgggcactcactgaggagcatgcacgagatagttttgagaatctcctatttagtgtttgccgtttcagagaactcactggaacatacccacagaatataactgttgtaagctatgattttaaggaggaaaggtttgcgcagctgcacagatctgctctcgggttcccagaagaaaggttcttcttctcaggtaccccagctacagctacagcaaaggaggcagctctgaaaggtgaagcctctgtcaggtctcagttccaagaagatccatatggatgtgttggttctcttcgtgtaaagaggctcaagagagacccgtttcaccgtaccattccttaccccaatggctgccctgaattgaagggtctattctcctattgtggcatggtgccatactctgggaaccttccttggactcagtagcggagaagggcatgatgtttggatcaaacttttgctctcactgtaaaatcccagcatttttgtttcgcccctgttttcaagctgacagaatagatatgcccattcctgtcctctatgcgagggagaagagaagatctatgctacactagttagattgttttcgtcacgaaggcatgccacatgctccatatatacagattttttttctcacttctccctggtctccactgtaaactgtgaatttgttagtacatgtgctctgtaaactagcaatggaagcaagtgaacttttaatttttaattgcagcttgaactgcacaag

SEQ ID NO: 3236 - DNA, 1680 bp, Hordeum vulgare
gactttttcccctaccatcctgcacggtacctccgtctctttctcccccgatcccttcttctcccaaggcagctctgatgctctgaccctccccgagctccaacccggccgatccagtgccgctctaaatcctctcctccactccatcaccacctagatccgcccgccccgggggagggcggagttccggcgagctcgatgagcagccaggggttcggccccgggagccccaagtcgttccgctaccctagagccgactacgatctcgagtccgggatcccccgcaagggccgcaagcccaaggcctcgcatctcgacgcccctgcccccctcagctcggcgctgatgaagattcgcttcttctacgaggcgcaccccgtcgccgtcgccctcatcctgctgtcattcgggctcagcgttcttatcctcctgtccgtgtacgagacccggttcagaacgatgaggagcggcggcgatggggtcggggcgcacccgcttccgggcctccgcaacctcgtcatggtggccggccattcgatatacaccagcgccagctgcgggaagatcgaccgcgaggattcgtggttcttggagccgtaccagaagcaccccggccaggcgtccaccttcttggcgcacatcaaggagggggtggagatcgcggcgagggatcagggcgcgctcctcttgtttagcggtggggagacgaggaaagatgcagggccgaggagcgaggcgcagagctactgggctatcgcagagtcggaaggctggtttggaaatgatgatagtgttaggagccgggcactcactgaggagcatgcacgagatagttttgagaatctcctatttagtgtttgccgtttcagagaactcactggaacatacccacagaatataactgttgtaagctatgattttaaggaggaaaggtttgcgcagctgcacagatctgctctcgggttcccagaagaaaggttcttcttctcaggtaccccagctacagctacagcaaaggaggcagctctgaaaggtgaagcctctgtcaggtctcagttccaagaagatccatatggatgtgttggttctcttcgtgtaaagaggctcaagagagacccgtttcaccgtaccattccttaccccaatggctgccctgaattgaagggtctattctcctattgtggcatggtgccatactctgggaaccttccttggactcagtagcggagaagggcatgatgtttggatcaaacttttgctctcactgtaaaatcccagcatttttgtttcgcccctgttttcaagctgacagaatagatatgcccattcctgtcctctatgcgagggagaagagaagatctatgctacactagttagattgttttcgtcacgaaggcatgccacatgctccatatatacagattttttttctcacttctccctggtctccactgtaaactgtgaatttgttagtacatgtgctctgtaaactagcaatggaagcaagtgaacttttaatttttaattgcagcttgaactgcacaagtaaaaactggaaaccctctgaacatgtatccatgtgctatcctggtattcttccattgtggaaaaaaacagaggttgttttcgtttttgagacaggagctttgggaatatgttaatggtctatatgtgctagcc

SEQ ID NO: 3237 - DNA, 1715 bp, Triticum aestivum
ccgcgggatgggtgagcaaagtttgaggacggggtccatggctccatctaccacgaagtagccaactatctgaaccatcgaatcttccacggctagactttttcccctccaccatcctgcacggtaccttcgcctctttctcctccggtcccttctatcttctcccacgctgctctgatctccgacctcctgccccgagctccaatccgaccgatccaatgccgctctaaatcctctcctccactccaccaccacctagatccggccgccccgaggcggcggagctccggagagctcgatgagcagccagggattcggccccgggagccccaagtccttccgctaccctagagccgactacgatctcgagtccgggatcccccgcaagggccgcaagcccaaggcctcgcatctcgacgcccccgcccccctcagctcggcgctgatgaggatccgcttcttctacgaggcgcaccccgtcgcggtcgccctcatcctgctgtccttcgggctgagcgtcctgatcctgctctccgtgtacgagaccaggttcaggacgatgaggagcggcggcaatgaggtcggggcgcacccgcttccgggcctccgcaacctcgtcatggtggccggccattcgatatacaccagcgcgagctgcgggaagaccgaccgcgaggattcgtggttcttggagccgtaccagaagcaccccggccaggcggccaccttcttggcgcacatcaaggagggggtggagatcgcggggagggatcagggcgcgctcctcttgtttagcggtggggagacgaggaaagatgcagggccgaggagcgaggcgcagagctactgggctattgcagagtcggaaggctggtttggaaatgatgatagtgtaaggaaccgggcactcactgaggagcatgcacgagatagttttgagaatctcctatttagcgtttgccgtttcagagaactcactggaacatacccacagaatataactgtcgtaagctatgattttaaggaggaaaggtttgcacaactgcacagatctgcactcgggttcccagaagaaaggttcttcttctcaggtaccccagctacagctacagcaaaggaggcagctctgaaaggcgaagcctctgtcaggtctcagttccaagaagatccatatggatgtgttggttctcttcgtgtaaagaggctcaagagagacccgtttcaccgtaccattccttaccccaatggctgccctgaattgaagggtctattctcctattgcggcatggtgccatactctgggaaccttccttggactcagtagcggaaaaaggcatgatgtttggatcaaacttctactctcactgtaaaatcccagcattcttgtttcgcccctgtttctaagctgacagaatagatatccccattcctgtcttctgtgcgagggagaagagaagatctaagctacactagttagattgttttcgtcacggaagcttgcccacatgctccatatatacagattttctatttctcacttctcccgggtctccactgaaaactgtgaatttgttagtacacatggtctgtaaactagcagtggaagcaagtgaacttataatttgtaattccagcttgaactgcaccagtaaaaactggaaaccttatgaacatgtaccatgtaatatcttggtattcttccattgtgaaaaaaa

SEQ ID NO: 3238 - DNA, 1698 bp, Panicum virgatum
ccacttgttttgggctcgtttctttagtcttgagcaacacaagttttctgttgaccgaccggctcccatcccttgtctctgcctctctcctcctctcttggccggggccccctcttctcgcggcgagccggcgaccactgggcgagcggcggcgccatccccgacgtcttcgccggcgacgagcgcccgctaggtgttccctccccttcccttcctgctgggcgaaacggatcaccctaaatgtaagcaagctacgcgctttgtatccggatctgggtcggtccgcccctgcgtgctgcccaagtgatcttgtgaggcggagttcttgcgcgggatgagcggccaggggttcggtccggggagccccaagtccttccgtaccccaccagagccgtcggcggcgacttcgacctcgaggccgggatctcccgcaagggccgcaagcccaagaacccgcacctcgaggcctccgtcgcgatgcggctccgccacttctacgaggcgcaccccgtggccgtcgccgcctccctgctcgccgccgggctcgccgccctggtcctgctctccgtgcacgaggcccggtcccgggcggcgaggcccggcggtgcgtgggccggggaggagtacccgctcccgagcctccggaacctcgtcatggtggccggccactcggtctacaccagcgccacctgcgggggcaccgaccgcgaggagtcctggttcctggagccgtaccagaggcaccccggccaggcggccacgttcgtcgcgcacatcaaggagggcgtcgacattgcggccagggacgacggcgcgctgctcctgttcagcggcggcgagacgaggaaggacgccgggcccaggagcgaggcgcagagctactgggcgatcgccgagtccaaaggctggttcgggaacgatgagagtgttaggagccgggcactcaccgaggagcatgcccgagacagttttgaaaacctcctgttcagtgtttgccgtttcagagaactcactggaagatacccacaaaacataacagttgtaagctatgatttcaaggaggaacggtttgcgcaattgcacagaacagcactcggattcccagaaggaagatttttcttctcaggtaccccagcaacacctgccgcaagggaggctgctctgaaaggtgaagccgccgtcagggctcagttcctagaagatccatatggatgcctaggctctctccacgtgaagaggctcaagcgggatccatttcatcgtaccattccataccctgagggttgcccggagttgaagagcctgttctcctattgtggcgcagtgccgttccctggtctgctcccttgggctgaatagttatatgaaggatcagactgctgctgccgctgcacaattccaacatagagcacttgccctgtgccaatgatcttgttctcaactgacggggaagaggatatttacactagcgacaattgtttttgcaaaatagaagtaatggtacatgaccaatatatagattttcctcttcttttttttccttccctgttgtacacgtgttatgtagaaagaactttccttgtagctgaacctgcgcctgttgtgataatctgggtataccatgaacattggtactaattgatatcctgctgtttttgcaaaaatactgatccttcagagttaagtgtacatgaatgc

SEQ ID NO: 3239 - DNA, 1473 bp, Triticum aestivum
ccccgagctccaatccgaccgatccaatgccgctctaaattctctcctctactccaccaccacctagatccggccgccccgaggcggcggagctccgcagagctcgatgagcagccagggattcggccccgggagccccaagtccttccgctaccctagagccgactacgatctcgagtccgggatcccccgcaagggccgcaagcccaaggcctcgcatctcgacgcccccgcccccctcagctcggcgctgatgaggatccgcttcttctacgaggcgcaccccgtcgcggtcgccctcatcctgctgtccttcgggctgagcgtcctgatcctgctctccgtgtacgagaccaggttcaggacgatgaggagcggcggcaatgaggtcggggcgcacccgcttccgggcctccgcaacctcgtcatggtggccggtcattcgatatacaccagcgcgagctgcgggaagaccgaccgcgaggattcgtggttcttggagccgtaccagaagcaccccggccaggcggccaccttcttggcgcacatcaaggagggggtggagatcgcggggagggatcagggcgcgctcctcttgtttagcggtggggagacgaggaaagatgcagggccgaggagcgaggcgcagagctactgggctattgcagagtcggaaggctggtttggaaatgatgatagtgtaaggaaccgggcactcactgaggagcatgcacgagatagttttgagaatctcctatttagcgtttgccgtttcagagaactcactggaacatacccacagaatataactgtcgtaagctatgattttaaggaggaaagatttgcacaactgcacagatctgcactcgggttcccagaagaaaggttctttttctcaggcaccccagctacagctacagcaaaggaggcagctctgaaaggcgaagcctctgtcaggtctcagttccaagaagatccatacggatgtgttggacctcttcgtgtaaagaggctcaagagagacccgtttcaccgtaccattccataccccaatggctgccctgaattgaagggtctattctcctattgcggtatggtgccatactctgggaaccttccttggactcagtagcggaaaaaggatgtttggatcaaacttccactgttcacagtaaaatcccagcattcttgtttcgcccctttttctaagctgacagaatagatatccccattcctgtcttctgtgcgagggagaagagaagatctaagctacactagttagattgttttcgtcacgaaagcatgcccacatgctccatatatacagatttttttctcacttctcccgggtctccactgaaaactgtgaatttgttagtagcagtggaagcaagtgaacttataatttataattccagcttgaactgcaccagtaaaaactggaaaccttatgaacatgtaccgtgtaatatc

SEQ ID NO: 3240 - DNA, 1925 bp, Secale cereale
tttttttttttaaggcggcgttgaactatcatttatatttgaaattgaaatgatcaaattctacaaaaagaataagtgacacacaaccctactgccaaaaactgcggcggtaggaaaatggtgggattctattatttttttcaaactagtcagatcggtctaaacttcccccaaaaaataataatcaaaacacaaaaattgaccggcacccgcgcggatgggtgagcaaaggtttgaggacagcgtcatggctccatctaccacgaactagccaactatgtgaatcatcgaatgttcgacgggtagactttttcccctccaccgtcctgcactgcacggtgacttttgcgtcttcctcctccgatcccttctatcttctcccacggtgctctgatctccgacctccccgagctccaatccgaccgatccaatgccgctctaaattctctcctacactccaccaccaccaagatccgcccgccccgggggaggcggagttccggagagctcgatgagcagccaggggttcggcccggggagccccaagtccttccgctaccctagagccgactacgatctcgagtccgggatcccccgcaagggccgcaagcccaaggcctcgcatctcgacgcccccgcccccctcagctcggcgctgatgaagatccgcttcttctacgaggcgcaccccgtcgcggtcgccctcatcctgttgtccttcgggctgagcgttctgatcctcctgtccgtgtacgagacccggttcaggacgatgaggagcggcgaccttgaggtcggggcgcacccgcttccgggcctccgcaacctcgtcatggtggccggccattcgatatacaccagcgcgagctgcgggaagaccgaccgcgaggattcgtggttcttggagccgtaccagaagcaccccggccaggcggccaccttcttggcgcacatcaaggagggggtggaggtcgcggcgagggaccaggacgcgctcctgttgttcagcggtggggagacgaggaaagatgcagggccgaggagcgaggcgcagagctactgggctattgcagagtcggaaggctggtttggaaatgatgatagtgtaaggaaccgggcactcactgaggagcatgcacgagatagttttgagaatctcctatttagcgtctgccgtttcagagaactcactggaacatacccacagaatataactgtcgtaagctatgattttaaggaggaaagatttgcacaactgcacagatctgcactcgggttcccagaagaaaggttcttcttctcaggcaccccagctacagctacagcaaaggaggcagctctgaaaggcgaagcctctgtcaggtctcagttccaagaagatccatatggatgcgctggatctcttcgtgtaaagaggctcaagagagacccgtttcaccgtaccattccttaccccaatggctgccctgaattgaagggtctattctcctattgcggcatggtgccatactctgggaaccttccttggactcagtagtggaaaacaacatatgatgtttggatcaaacttctactctcactgtaaaatcccagcattcttgtttcgcccctgtttctaagctgacagaatagatatccctattcttgtcttctgtgtgagggagaagagaagatctaagctacagtagttaggctgttttcatcacgaaagcatgcgcacatgctccatatatacagttttttttctcacttctcccaagtctccactgaaaactgtgaatttgttagtacacatgctctgtaaactagcagtggaagcaagtgaacttataatttgtaattccagcttgaactgcaccagtaagaactacagtagaaaccttttgaacatgtatccatgtaatatcctggtattcttccatttt

SEQ ID NO: 3241 - DNA, 1623 bp, Triticum aestivum
cccacgcgtccgactttttcccctccaccatcctgcacggtacctttgcctctttctcctccggtcccttctatcttctcccacgctgctctgatctccgacctcctgccccgagctccaatccgaccgatccaatgccgctctaaatcctctcctccactccaccaccacctagatccgcccgccccgaggcggcggagctccggagagctcgatgagcagccagggattcggccccgggagccccaagtccttccgctaccctagagccgactacgatctcgagtccgggatcccccgcaagggccgcaagcccaaggcctcgcatctcgacgcccccgcccccctcggctcggcgctgatgaagatccgcttcttctacgaggcgcaccccgtcgcggtcgccctcatcctgctgtccttcgggctgagcgttctgatcctcctgtccgtgtacgagacccggttcaggacgatgaggagcggcggcaatgaggtcggggcgcacccgcttccgggcctccgcaacctcgtcatggtggccggccattcgatatacaccagcgccagctgcgggaagatcgaccgcgaggattcgtggttcttggagccgtaccagaagcaccccggccaggcggccaccttcttggcgcacatcaaggagggggtggagatcgcggcgagggatgagggcgcgctcctcttgtttagcggtggggagacgaggaaagatgcagggccgaggagcgaggcgcagagctactgggctatcgcagagtcggaaggctggtttggaaatgatgatagtgtaaggaaccgggcactcactgaggagcatgcacgagatagttttgagaatctcctatttagcatttgccgtttcagagaactcactggaacatacccacagaatataactgttgtaagctatgattttaaggaggaaaggtttgcacaattgcacagatctgcacttgggttcccagaagaaaggttcttcttctcaggtaccccagctacagctacagcaaaggaggcagctctgaaaggtgaagcctctgtcaggtctcagttccaagaagatccatatggatgtgttggttctcttcgtgtaaagaggctcaagagagacccgtttcaccgtaccattccctaccccaatggctgccctgaattgaagggcctattctcctattgcggcatggtgccatactctgggaaccttccttggactcagtaccggaaaaaggcatgatgtttggatcaaacatctactctcgctgtaaaatcccagcattcttgtttcgcccctgtttctaagctgacagaatagatatcccgattcctgtcttctgtgcgagggagaagagaagatctaagctacactagttagattgttttcgtcgcggaagcttgccacatgctccatatagacagattttctatttctcactcctcccggatctccactgaaaactgtgaatttgttagtacacatggtctgtaaactagcagtggaagcaagtgaacttataatttgtaattccagcttgaactgcaccagtaaaaactggaaaccttatgaacatgtaccatgtaatatcttggtattcttccattgtg

SEQ ID NO: 3242 - DNA, 623 bp, Triticum aestivum
gatcgtcggagcagagagagacttcctcgcctccatcccatcccgccgccgccgtctctacggtcgctaataagccgccgcatccagggatggagatgaagaagatcgcctgcgccgtcctcgtcgccgcctcggccaccgtggcgctggccgcggaggcgccggctccgtctcccaccagcggctcctccgcggtcgcacccgccatcgtcggggccgccgtggcctccttcttcgcgtactacattcactgagccgccggacgaggagccggagccggagggaagagaccaaggtggggggagagacttggctgcgctgcgctgctctgctgctcccgcgcattcccgatgcgtgggcgtgctctgattgggcacggcggtggcagtggcaaccttcgtcttcctttgttggttttttccttcctccttcaactgaattcaattaacgaatggtacgctgatcacaattaaattggtgcctgtaattgtcttcctcaatgaggatcaaactgtacaatgctgcaatttcggacaattaaaattcattaacaacagtaaagtgtgcttggcaaatataaatacctaagggagggatcccgcttttaccctaaaaaaaaaaaa

SEQ ID NO: 3243 - DNA, 406 bp, Eragrostis curvula
acgcgcagagccagctcgctagccaacccagcagctcgctcgctcgtccttcttcctcgcctccgttccgtttcgtttcacaagggatccatggagatgaagaagatcgcatgcgccgtcctcgtcgccgcctcggccaccgtggcgctcgccgcggaggccccggccccggcccccaccagcggctcgtccgccgtcgcgccggccgtcctcggcgccgccgtggcctcgttcttcgcctactacctgcagtaaggcgccgggccgggcgccgcgaggaggagcaagaagtgaagaggggtgatcaacgctgatcagaacgcgcgcgcgcccattccgatgcacgcgtgtgtttggattggatactctttggccacctttcttcttttcccccctcttctttatc

SEQ ID NO: 3244 - DNA, 466 bp, Eragrostis curvula
agcacgaggaagggacgcgcagagccagctcgctagccaagaaagcagccagccagctcctcgctcgcccttcttcctcgcctccgttccgtttcgtttcacaagggatccatggagatgaagaagatcgcctgcgctgtcctcatcgccgcctcggccaccgtggcgctcgccgcggagggtccggccccggcccccaccagcggctcgtccgccgtcgcgccggccctcctcggggccgccgtggcctcgttcttcgcctactacctgcagtaaggcgccgggccgggccggcgccgcgaggaggagcaagaaggaagggaagaggggtgatctagcgaacgcgcgcgcgcattccgatgcacgcgtgtgttggattggatacactttggccacctttcttcttcttctcttcccccctcttctttatcctaatttaacgaattgatgtctgcgatgcaccagt

SEQ ID NO: 3245 - DNA, 570 bp, Pennisetum glaucum
agcaatcaatttcgagggcgcagaggcaagaacaagaaaagcagcagcagcagccaccaagctcgccgcagctcttcttgttgctcgcctccgttccgtcgcctcgcagaagagaagggacatggagatgaagaagatcgcctgcgccgtcctcgtcgccgcctcggccaccgtggctctcgccgcggacgccccggccccggcccccaccagcggatcctccgccgtcgcgcccgccctcggcgccgcgctcggcgccgccgtggcttccttcttcgcctactacattcagtgagccgccggccgcccggcccggaggaggggaggaagagacggaggggagacatggccgcgctgattccttgacgcgtctttgtcttcttcgtttccccccttgtccttctgctttaatttaacgaattgattgatgatgtcgctgatgatgccaccagtttaacctggtgccttgttatttgttcttcaatcccttcgacttcgagagaggggtcgacacttgtaccattgcttgccatttgtttcgatcaattcaacaattcgattactatttaa

SEQ ID NO: 3246 - DNA, 838 bp, Sorghum bicolor
tcccaggcaaagcgacgggagcacagagccagctagcagccgcgagaagcagccagctcgctcgccgcgcccgccgccttcttcctcgcctccgttccgccgcgccgtctctacggttgctaagccgccgccgcatccagggatggagatgaagaagatcgcctgcgccgtcctcttcgccgcctcggccaccgtggcgctcgccgcggaggctccggctccggcccccaccagcggctcctccgccgtcgcacccgccgtcggcgccgcactcggggccgccgtggcctccttcttcgcctactacattcagtgagccggccggccgcgcccagagggaggaggaggaggaggaggaagagacgaaggggaggagacatggctgcgctgatcccaacacgcgcgcgcattccgatgcgtgggcgtgttctgattcgacactcctttgtcttcgtttctttgttctcttccttaatttaacgaattcattgatgcaccaagtttaatttggtgccttgttatttgttcgtccctttagagagagggatcgacacttgtaccattgcttgccatttatttggatcaattcaacaattcgatttaaccatcgcgtatatatgtgtgatttggatgaacgttgccctgatggtgatgaggttttgggttcacggcgttttgttatgccttaacatgttgaggatgtgctggtcgtatgatctaaacttctagttgatacggtagcattttcgtcgctgtgtttttaattttgtaaatagtctatatttagtgtattcgatatgatgagagttaaactttatcgagagcaattgaaattccg

SEQ ID NO: 3247 - DNA, 627 bp, Saccharum officinarum
ttattttgatgatcccggtcgacccacgcgtccgcacagagccagccagcagccgagaagcagccagctcgctcgccgcgcccgccgccttcttcctcgcctccgttccgccccgccgccgcgccgtctctacggttgctaagccgccgccgcatccagggatggagatgaagaagatcgcctgcgccgtcctcgtcgccgcctcggccaccgtggcgctcgccgcggaggctccggctccggcccccaccagcggctcctacgccgtcgcacccgccgtcggcgccgcactcggggccgccgtggcctccttcttcgcctactacattcagtgagccgcccggccgcgcccggaggaaggaggaggaggaagagacgaaggggagacatggctgcgctgatcccaacacgcgcgcgcattccgatgcgtgggcgtgttctgattcgacacgacgacgcacctctgtcttcttttctttgttcctctcttttccttaagcgaattgattgatgtcgctgatgcaccagcttgatttggtgccttgttatttgttcttcccttgagagagggatcgacacttgtaccattgcttgccatttttctggatcaattcaacaattcgattt

SEQ ID NO: 3248 - DNA, 654 bp, Panicum virgatum
agcaggcgagcaagctcgaggcgacagaggcaagccaagaaaagcagcagcagcagcagccagccagccaagctcgccgcggctcttcttgctcgcctccgttccgttcccgagcttcgcacaagggatggagatgaagaagatcgcctgcgccgtcctcgtcgccgcctcggccaccgtggcgctcgccgcggacgccccggcgccggcccccaccagcgggtcctccgccgtcgcgcccgccgtcggcgccgcgctcggggccgccgtggcctccttcttcgcctactacattcagtgagccgccgccgccggccggccggcccggggtgaggaggaagagaccaggggggtgacatggcggcgccgattccgaacaccgcgcgcgcgttccgatgcgtgcgtgggtttcgatttgacacggctttgtcttctttttcttctctctccttgatttaacgaattgatcgatgtcgctgatgcaccagtttgatttggtgccttgctatttgttctccgatcccttcgagggagagggaccgacacctgtaccattgcttgccatttgtttggatcaattcaacaattcgatttaatcatcgcgtcgatgcgtgcttaacctgcaatagatgttgcccagaagttttttttttc

SEQ ID NO: 3249 - DNA, 597 bp, Panicum virgatum
gcaagctcgaggcgacagaggcaagccaagaaaagcagcagcagccagccaagctcgccgccgcggctcttcttgctcgcctccggccgttccgttcccgtcccgccgagcttccgcagaagggatggagatgaagaagatcgcctgcgccgtcctcgtcgctgcctcggccaccgtggcgctcgccgcggacgccccggccccggcccccaccagcgggtcctccgccgtcgcgcccgccgtcggcgccgcgctcggggccgccgtggcctccttcttcgcctactacattcagtgagccgctggaacggccggcccggcgggaggaggacgaggaggaagagaccagggggagacatggcggctctgattccgaacaccgcgcgcgcattccgatgcgtgcgtgggtttcgatttgacacggctttctcttcttcttctccccccctctccttgatttaacgaattgatcgatgtcgctgatgcaccagtttaatttggtgccttgttatttgttcttcaatcccttcgagagagggaccgacacctgtaccattgcttgccatttgtttggatcaattcaacaattcgatttaa

SEQ ID NO: 3250 - DNA, 539 bp, Setaria italica
cccaggcaagcaagcaatttcgaaggcgcagaggcaagccaagaaaagcagcagcagccaagctcgccgcagctcttcttgtcgctcgcctccgttccgtcgtttcgcagaagaagggatggagatgaagaagatcgcctgcgccgtcctcgtcgccgcctcggccaccgtggcgctcgccgcggacgccccggctccggcccccaccagcgggtcctccgccgtcgcgcccgccctcggcgccgcgctcggggccgccgtggcttccttcttcgcctactacattcagtgagccgccggccggccgaccggaggaggaggagaaagagacggaggggaggcatgatggcggccgccggtctttgtcttcttctttttcccccccttcttcttctgcttaatttaacgaattgattgatgatgtcgctgatgcaccagtttaatttggtgtcttgttatttgttgttcaatcccttcgagagagggatcgacacatgtacttgtcatttgtttggatcaattcaacaattcgatttaat

SEQ ID NO: 3251 - DNA, 1537 bp, Zea mays
ccactcccactgagcaactcaaaaaggccaaaacccttccccaggggccgtctcgctagtcgctactcactgtaccgcaccgccgccgccgtctcgcacacggggcacaggacgcgcgcgatcccctcgagtccggattgccatggccaccacggcgttcgccgccgccaggttcttccccgcccacctcgactcctccccacgcatcgcgccccaccgcgtcgggcccaccgcgaatctctccttctcaccgctttccgccaactcctcgtccctgcgccgcctccattccccctgcccatccggccccgggggtaggctgcccccgccgccgcgatcgtacggcggcgccggcggatctggcgacgccgcgaactccggtggcggcgaaggccgccgcggaggcatcctcgggctcctcctcgccgggtgggccgcccgcgtcgctgcggacccgcagttccctttcaaggtgctcatggaggagctcgtcggcgtcaccgcttgcgtgcttggcgacatggcctcccgccctaacttcggcctcaacgagttggacttcgtcttctccacgctcgtcgtcggatccatcctcaacttcgtcctcatgtacctcctcgcccccaccgccggcgtcgccgccgccgcgtcgtccgccgcgtccgcgctccccagccacatgttcgagcccggcgcgtactccctcggctcccgcgtcgccacgatcatgtccaagggcgccaccttcgcggtggtcgggttcgcggccgggctcaccggaaccgcgatctccaacgggctgatcgcgatgcggaagcgcatggacccggcgttcgagacgcccaacaagccgccgcccacgctgctcaacgcggccacctgggcgctccacatgggtgtcagcagcaacctgcggtaccagacgctgaatgggatcgagtacctgctcggcaaggtcgcaccggcgccggtgttcaaggtgtccgttgttgctctccgctgcatgaacaacgtgctgggtgggatgtccttcgtgctgcttgccaggctgaccggggcgcagaaatcagacaagccagcgacggtcgcggaagagaaggagaggttgatagctgtgggcaatgccgcagcagatgccatcaacgaggcgaggcatggagagggtaagtaggtggtagaggagagagacgagtaagttgatggtgcatcatctcagactcgtttgctggttcttggacatagaccaagaaactcacctagtcacctgtagagttggttggaataaggagtggagtgaggttcagaacttcttttttaaaaaactctgtttgtggtttatcggtgttgatgatgacatgcttagtgatggtagaataaagtttttttttcctctcatgctcatttgatcgttgactcgatgggtagcctgtttgttaaataccttcagtttttgcatgcagtatatatgattctgaatggtactatgatgtacagatgagaggactcagtgacccaaaggggatttgttgatgatcta

SEQ ID NO: 3252 - DNA, 2127 bp, Panicum virgatum
ctacttcactacaccaacccccaaaaccctccccccccatccgaggccgtcccgcaccgcactaccagccacctcccgcgccgcgccgccgccgccgtctcgcacgcgcggcagaggacgcgcgcgatcccctcccgaccaccaccagatcgcgccatggcctccacggccttcgccgccgccaagttcctcccggcccacctcgactcctccccgcgcatcgcgccacaccgcgccggccccaccgcgaatctctccttcgccccgctttcctcctctccctcctccgcggcgtcgctcctccgcctccgatccccgtcgccgtccggcccgggaggcaggctgcccccgcccccgcgctcgtacggcggcggcggatctggcgacgccgcggactccggcggcggcgacggccgccgcgggggcatcctcggcgtcttcctggccggctgggccgcccgcgtcgccgcggacccgcagttcccgttcaaggtgctcatggaggagctcgtcggcgtcaccgcctgcgtgctcggcgacatggcctcccgccccaacttcggcctcaacgagctcgacttcgtcttctccacccttgtcgtcggatccatcctcaacttcgtcctcatgtacctcctcgcgcccaccgccggcgtcgccgccgccgcctcgtccgccgcctccgcgctccccagccacatgttcgagcccggcgcctactcgctcggctcccgcgtcgccaccctcgtgtccaagggcgcgaccttcgcgatggtcgggttcgcggccgggctcgccggcaccgcgctctccaacgggctcatcgcgatgcggaagcgcatggacccggagttcgagactcccaacaagccgccgcccacgctgctcaacgcggccacctgggcgatccacatgggcgtcagcagcaacctgcgttaccagactctgaacggggtcgagtacctgctcggcaaggtcgcgccggcgccagtgttcaaggtgtccgtcgttgctctccgctgcgtgaacaacgtgcttggtggcatgtccttcgtgttgcttgccaggttgactggatcgcaaagatcagataaaccagcgacggctgcagaagagaaggaacggttgatagctgtgggcaatgccgccgcagatgccatcagtgaggcaaaggacgcagagggtaagtaaaggggatgggtagaggagggtgcaagtggatgcatgcatgctctgcgcctgagcttcgtttgcggcttcttggaataggccaagaaacctgtagatgataagtgggttggaataaggagtgaggctcaaaacattttcttcaatctgtttgcagtgatgacatgcttagttgatcttagaataaagtttttcgttcttgtccttttgatcgttgactcaatgcgtagcctgcttgccatacctgaagttgtttgatttgcatgcaatctatgatccttaatgatcctatgatgtaaagacgagtggattcatgacccaaaatctaagaacttgatgctgtctagtttcttcatgtaaccaaattagtggctaaaatcaaatgttggaaaccaattcttttgttgaatagacatctaaatctgctgttttgtcaatggctgtgatatgtcattatagtaaagttgatgcaataaggccatggtgtcatgcgaaaatggtgcctgggtctaagatgtttgctggaactacatttcggtacatttatttgtagttgtgttcatgtaaaaattgattctaattcttaaagatcaagtgggaaaagatttgttggttttaactcgagtgagtgtataattgtttgctcattggcacattgtcatccttggcattgcaaattgaatcgaggattcaaagttgtaaaaagccagtggaagtagacctgaaactccaatggtcctggaagcaatgctatagctgtgtatgtattagttattgcttggacatatatttttctagtgctaatcagcagcctttacctttctccaaaaaaatttaaatacagggcctcgtattgcttgtttctgtggctgtgcagccgttgctctcacctctcagacttgtaaacgtcggtagaatcaagagttaagagttaattcc

SEQ ID NO: 3253 - DNA, 1503 bp, Setaria italica
atccgcctcactacttcactacaccaacccccaaaaccctcccccatctgaggcctcgtcccaccctagccacctcccgcaccgccgccgtctcgcacgcgcgcgatcccctctcctcgcccaccagatcgcgccatggcctccacggcgttcgccgccgccaagttcctcccggcccacctcgactcctcgccgcgcatcgcgccgtaccgcgcggtccccaccgcgaatctctccttcaccccgctctcctcctcggcgtcgctcctccgcctccgatccccgtcgccgtccggcccgggaggcaggctgccaccgcctccgcccccgcgctcctacggcggcggcggatctggcgacgccgcggactccggcggcggcgacggcgatggccgccgcgggggcatcctcggcgtcttcctggccgggtgggccgcccgcgtcgccgcggacccgcagttcccgttcaagctgctcatggaggagctcgtcggagtcaccgcctgcgtgctcggcgacatggcctcccgccccaacttcggcctcaacgagctcgacttcgtcttctccaccctcgtcgtcggatccatcctcaacttcgtcctcatgtacctcctcgcgcccaccgccgccgcctcgtccgcagcctccgcgctccccagccacatgttcgaggccggcgcctacacgctcggctcccgcgtcgccacgctcatgtccaagggcgcgaccttcgcgatggtcgggttcgcggccgggctcgccggcaccgcgatctccaacgggctcatcgcgatgcggaagcgcatggacccggcgttcgagactcccaacaaggcgccgcccacgctgctcaacgcggccacctgggcgctccacatgggcgtcagcagcaatctgcgttaccagactctgaatgggatcgagtacctcctcggcaaggtcgcgccagttcccgtgttcaaggtgtctgttcttgctctccggtgcatgaacaacgtgcttggtggcatgtccttcgtgttgcttgccaggttgactggagcgcaaagatcagataagccagcgacggttgcagaagagaaggaaacgttgatagctgtgagcaatgccgccgcagatgccatcagtgaggcgaaggaaggagagggtaagtaagtgggtagaggagggattagagagcaaatcgaaggaagctgtgtgggccgagtgccattcggcaacccacctgtaataaagtactgatgttagtcatcgccacaggacttgtgctgctactagcattagcattagcattgcttgaatttgttgctgccatatacttgtggagatcaggaagtggatcagaaaaatagaacaaacaaaacgtcaagaactgtcaatcgagaaagggaagggaagggaaggggcgaccggccaacaaccaagctgaagaaaaacaatgtttgccggcttgccgctgagctgaaggagagtcacggagcttcttcagttctgtttttc

SEQ ID NO: 3254 - DNA, 2347 bp, Panicum virgatum
cttaacagaccatcgagatggttttgtcaagtgtgtaatttgtaaagtatgctagatggagaacggtcatccttaaccagaccatcgtttgcaatatgcggagctcatccgtttcccttgcttctcatttttctcgtccgtggtaagaacagaggattaccgcgtggtaagttgttttcaagaacttctctgtttctcaattatatgtgatgctatcatcatactctcacaaacacatcttacaagaaacccctctacctcaatcattactaatcatgcgatggtcttgcaggccaaaaccggaaaagactaataaactatcccgtgacattttttcatccaaacaatatcttctgacagtatcggaacccagccgttttcgaaaaatacagggaatgaagccggcgacccaagatgctcccagttccgcgtactgttcggccaagcgccaggttgcaccagcagcgatctcgcggcaggcgtgtaggtggacaggtggtcgcccgagcccgcgcgggaggcctgcggggccagggcgcacttggtgcaagtccccaccaggccaccaccaactccttccccctctcaccagacccggaggacccaccccctcacgacttcactacaccaacccccaaaaccctccccccatccgaggccgtcccgcactaccaagccacctcccgcaccgcgccgctgccgccgccgccgtctcgcacgcgcggcagaggacgcgcgcgatcccctcccgcccaccaccaccagatcgcgccatggcctccacggccttcgccgccaccaagttcctcccggcccacctcgactcctccccgcgcatcgcgccccaccgcgccggccccaccgcgaatctctccttcgcgccgctttccccctcttcctcctccgcggcgtcgctcctccgcctccgatccccgtcgccgtccggcccgggaggcaggctgcccccgcccccgcgctcgtacggcggcggcggatctggcgacgccgcggactccggcggcggcaacggccgccgcgggggcatcctcggcgtcttcctggccggctgggccgcccgcgtcgccgcggacccgcagttcccgttcaaggtgctcatggaggagatcgtcggcgtcaccgcctgcgtgctcggcgacatggcctcccgccccaacttcggcctcaacgagctcgacttcgtcttctccaccctcgtcgtcggatccatcctcaacttcgtcctcatgtacctcctcgcgcccaccgccggcgtcgccgccgccgcctcgtccgccgccgccgcgctccccagccacatgttcgagcccggcgcctactcgctcggctcccgcgtcgccaccctcgtgtccaagggcgcgaccttcgcgatggtcgggttcgcggccgggctcgccggcaccgcgctctccaacgggctcatcgccatgcggaagcgcatggacccggagttcgagactcccaacaagccgccgcccacgctgctcaacgcggccacctgggcgatccacatgggcgtcagcagcaacctgcgttaccagactctgaacggggtcgagtacctgctcggcaaggtagcgccggcgccagtgttcaaggtgtccatcgttgctctccgctgcatcaacaacgtgcttggtggcatgtccttcgtgttgcttgccaggttgactggatcgcaaagatcagataagccagcgacggctgcagaagagaaggaacggttgatagctgtgggcaatgccgccgcagatgccatcagtgaggcaaaggacgcagagggtaagtaaagcgggtagaggagggtgcaagtggatgcatgtatgctctgcgcctgagcttcgtttgcggcttcttggaataggccatgaaacctgtagatgataagtgggttggaataaggagtgaggctcaaaacattttcttcaatctgtttgtggtgatgacatgcttagttgatcttagaataaagtttttctctcttgtccatttgatctttgactcaatgggtagcctgcttgccatacctgaagttgtttgatctgcatgcaatctatgatccttaatgatcctatgatgtaaagacgagtggattcatgacccaaaatataagaacttgatgatgtctagtttcttcatgtaaccaaaccagtgcctgtaacttctgttcaattgttggaaaccaattcctttgttgaatagacatcaaaatctgatgtgctttattctgctgctttggcaatggctgtgatatgccaaaatctaagatgtttgttgtaactacatttcgatacatttctttgtagttgtgttcatgtaaaaatcgatt

SEQ ID NO: 3255 - DNA, 1604 bp, Panicum virgatum
gccgggctcgccggcaccgcgctctccaacgggctcatcgccatgcggaagcgcatggacccggagttcgagacccccaaaaccctccccccatccgaggccgtcccgcactaccaagccacctcccgcaccgcgccgctgccgccgccgccgtctcgcacgcgcggcagaggacgcgcgcgatcccctcccgcccaccaccaccagatcgcgccatggcctccacggccttcgccgccaccaagttcctcccggcccacctcgactcctccccgcgcatcgcgccccaccgcgccggccccaccgcgaatctctccttcgcgccgctttccccctcttcctcctccgcggcgtcgctcctccgcctccgatccccgtcgccgtccggcccgggaggcaggctgcccccgcccccgcgctcgtacggcggcggcggatctggcgacgccgcggactccggcggcggcgacggccgccgcgggggcatcctcggcgtcttcctggccggctgggccgcccgcgtcgccgcggacccgcagttcccgttcaaggtgctcatggaggagatcgtcggcgtcaccgcctgcgtgctcggcgacatggcctcccgccccaacttcggcctcaacgagctcgacttcgtcttctccaccctcgtcgtcggatccatcctcaacttcgtcctcatgtacctcctcgcgcccaccgccggcgtcgccgccgccgcctcgtccgccgccgccgcgctccccagccacatgttcgagcccggcgcctactcgctcggctcccgcgtcgccaccctcgtgtccaagggcgcgaccttcgcgatggtcgggttcgcggccgggctcgccggcaccgcgctctccaacgggctcatcgcgatgcggaagcgcatggacccggagttcgagactcccaacaagccgccgcccacgctgctcaacgcggccacctgggcgatccacatgggcgtcagcagcaacctgcgttaccagactctgaacggggtcgagtacctgctcggcaaggtagcgccggcgccagtgttcaaggtgtccatcgttgctctccgctgcatcaacaacgtgcttggtggcatgtccttcgtgttgcttgccaggttgactggatcgcaaagatcagataaaccagcgacggctgcagaagagaaggaacggttgatagctgtgggcaatgccgccgcagatgccatcagtgaggcaaaggacgcagagggtaagtaaagcgggtagaggagggtgcaagtggatgcatgtatgctctgcgcctgagcttcgtttgcggcttcttggaataggccatgaaacctgtagatgataagtgggttggaataaggagtgaggctcaaaacattttcttcaatctgtttgtggtgatgacatgcttagttgatcttagaataaagtttttctctcttgtccatttgatctttgactcaatgggtagcctgcttgccatacctgaagttgtttgatctgcatgcaatctatgatccttaatgatcctatgatgtaaagacgagtggattcatgacccaaaatataagaacttgatgatgtctagtttcttcatgtaac

SEQ ID NO: 3256 - DNA, 1720 bp, Setaria italica
cgtggacaggtggtcgcgcgcacgcagggcgcacttggtacgagtccccaccaagccaccaactccggcgccctcccaccaaacgcccgcctcactacttcactacaccaacccccaaaaaacctcccactctgccacctcccgcaccgccgccgtctcgcacgcgcgacagaggacgcgcgcgatcccccctctcctcgcccaccagatcgcgccatggcctccacggcgttgggcgccgccaagttcctccacctcgactcctccccgcgcatcgcgccgcaacgcgcgatccccaccgcgaatctctccttctccccgctgtccgcctcctcctcctcctcctcctcgccgtcgctcctccgcctccgatccccgtcgccgtccggcccgggaggcaggctgccaccgcccccgcccccgcgatcctacggcggcggcggatctggcgacgccgcggactccggcgccggcgacggtgatggcagccgcgggggcatcctcggcgtcttcctggccgggtgggccgcccgcgtcgccgcggacccgcagttcccgttcaaggtgctcatggaggaggtcgtcggcgtcaccgcctgcgttctcggcgacatggcctcccgccccaacttcggcctcaacgagctcgacctcgtcttctccaccatcgtcgtcggatccatcgtcaactttgtcatcatgtacctcctcgcgcccaccgccgccgcctcgtccgtggcctccgcgctccccaattacatgttcgagcccggcgcctacacgctcggctcccgcgtcgccacgctcttgtccaagggcgcgaccttcacgatggtcgggttcgcggccgggctcgccggcaccgctctctccaacgggctcatcgcgatgcggaagcgcatggacccgtcgttcgagactcccaacaaggcgccgccgacgctgcttaacgcggccacctgggggctccacatgggcggcagcagcaatctgcgttaccagactctgaatgggatcgagtacgtcctcggcaaggtcgcgccggcgcccgtgttcaaggcgtctgttgttgctctccggtgcatcaacaacgtgcttggtggcatgtccttcgtgttgcttgccaggttgacaggagcgcaaaaatcagataagccagcgacggttgcagaagagaaggaaacgttgatcgctgtgggcaatgctgccgcagatgccatcagtgaggcaaaggaaggagagggtaagtaagtgggtagaggagagtgcagttggatggatgcgtgcatgcttgcgtcgtgcatcaactgatcttcctttgctgctgcttgacatagaccaacaaacatgtagacgataagtgagtgggttggaataaggagtgaggctcgaacattttcttcagtctgtttgtggtttcttggtatcgccggatgacatgcggacgacatgcttagttgatcttagaataaagtttctctcttgttcatttgatctttgactcaatggatagcctgcttgccgtacctgaagttgtttgatttgcatgcaatttatgatcctgaatgaccctatgatgtaaagatgagtgaactcatgacccagaaaaaaaaaacttgatgctacctagtgtttccatgtaacccagccagtggcaaaatgcaggctgaagcttttgctcaaattgaaccgtggattcaaatttgtagttctggtggaa

SEQ ID NO: 3257 - DNA, 1857 bp, Brachypodium distachyon
cggcaacgtatacaaattgcgggcactcctcccattctccaccaaaccatccgcaccgaagagaaaagaaaccacaccaacccccaaaaccctttcccgcatctcgccgccgccaccaactccaccgccgcggggatcgccatggcctccacggccttcgccgccgccaagttcctcccgtcagcccacctcgactcctccccgcgcctctcccagctccgcgccgccccgaccgccaacctctccttctccccgctccccacctcctcctcttcctcgctcctgacgctccgatccccttgcccgtctggcccaggagggaagctgccccctcccccgcgctcctacggcggcggcggcggatctggcgatgccgcggactcagggggcgacggcggccgtggtggcatcctcggcatgttcctcgccggctgggcggcccgcgtcgccgcggatccccagttccccttcaaggtgctcatggaggagctcgtcggcgtcaccgcctgcgtgctcggcgacatgtcctcccgccccaacttcggcctcaacgagctcgacttcgtcttctccaccctcgtcgtcggatccatcctcaacttcgtcctcatgtacctcctcgcccccaccgcgggggtctccgccgccgtctccgccctccccagccacatgttcgaggcgggaccctactccgttggctctcgcgtcgccaccctcgtctccaagggcgccactttcgcggccgtcggcttcggggctgggctcctcggcaccgcgatctccaacgggctcatctccctcaggaagcgcatggacccggcgttcgagactcccaacaagccgccacccaccatgctcaacgccgccacctgggcgctccacatgggcatcagcagcaacctgcggtaccagaccctcaatgggttcgaataccttcttggcaaggccgccccggctccggtgttcaaggtctccgttattgccctacggtgcatgaacaacgtgcttggtgggatgtcctttgtgatgctcgcgaggctgactggcgcgcagaagtcggataagccggcgacctccgtttcggaagcaaaggagagattgatagctgagggagatgccattgctgcgaatgttggcgctgagggaagggatgtagaggggaagtaattggatatacatgcgagggtaagtaagtggatgcatccttgcttgcttgcgccgtgcatcgcccaagcctcatttgctgcttcttgacatgaggcaagaaacttgtagatgatgagtcggtcggtcggttggtaataatgagtgaggcttgaaacattttttgttcagttggtccgtggtgttcatggtgatacgcgatgacatgcttagttgatcctagaataaagctttttaccttggctgcttgcttgctcatttgatcattggcttaactgtgagcttatacttcgcaataacaccagttgcttgatttgcatgcttgttctgataccaatctgcactataccccaaatctgtgcactggagttgtaaggatgaagctctgaatgacatatctgacagtcaaccagactaattcgcgcgatgagaccacatggtcaagccaacaacaacaacgggtcaaggcaactgggatgtattgatttgtatttcagttttcttttgaccaatttgcaattcacatagcatagcatgtagcagtgttgtggacggcctgttgattattgtgataaatacccgtaacaagcgagtagtattacgatttcgatccttaaattagatcaagcgctgatgctgtttagtccaagtgtgtggctgtctctgtcgaatatatttcttggttaatactat

SEQ ID NO: 3258 - DNA, 1409 bp, Brachypodium distachyon
caccaacccccaaaaccctttcccgcatctcgccgccgccaccaactccaccgccgcggggatcgccatggcctccacggccttcgccgccgccaagttcctcccgtcagcccacctcgactcctccccgcgcctctcccagctccgcgccgccccgaccgccaacctctccttctccccgctccccacctcctcctcttcctcgctcctgacgctccgatccccttgcccgtctggcccaggagggaagctgccccctcccccgcgctcctacggcggcggcggcggatctggcgatgccgcggactcagggggcgacggcggccgtggtggcatcctcggcatgttcctcgccggctgggcggcccgcgtcgccgcggatccccagttccccttcaaggtgctcatggaggagctcgtcggcgtcaccgcctgcgtgctcggcgacatgtcctcccgccccaacttcggcctcaacgagctcgacttcgtcttctccaccctcgtcgtcggatccatcctcaacttcgtcctcatgtacctcctcgcccccaccgcgggggtctccgccgccgtctccgccctccccagccacatgttcgaggcgggaccctactccgttggctctcgcgtcgccaccctcgtctccaagggcgccactttcgcggccgtcggcttcggggctgggctcctcggcaccgcgatctccaacgggctcatctccctcaggaagcgcatggacccggcgttcgagactcccaacaagccgccacccaccatgctcaacgccgccacctgggcgctccacatgggcatcagcagcaacctgcggtaccagaccctcaatgggttcgaataccttcttggcaaggccgccccggctccggtgttcaaggtctccgttattgccctacggtgcatgaacaacgtgcttggtgggatgtcctttgtgatgctcgcgaggctgactggcgcgcagaagtcggataagccggcgacctccgtttcggaagcaaaggagagattgatagctgagggagatgccattgctgcgaatgttggcgctgagggaagggatgtagaggggaagtaattggatatacatgcgagggtaagtaagtggatgcatccttgcttgcttgcgccgtgcatcgcccaagcctcatttgctgcttcttgacatgaggcaagaaacttgtagatgatgagtcggtcggtcggttggtaataatgagtgaggcttgaaacattttttgttcagttggtccgtggtgttcatggtgatacgcgatgacatgcttagttgatcctagaataaagctttttaccttggctgcttgcttgctcatttgatcattggcttaactgtgagcttatacttcgcaataacaccagttgcttgatttgca

SEQ ID NO: 3259 - DNA, 2779 bp, Saccharum officinarum
aaacccgggccgactcacgcgtccgtgcaggtgtaaccgtgtaagtgccctgcactcaatcgtttccgagtggaggttttgcctttctcgccgcatccgactccgccatgccaccatagatccagctagggcggcgtcgttgcgttcaatcctgtgcgagagaacgcgaaatcgccgccggcttgatattggccagggctttctccgcccaattgcatcaggtttcgctgccattcgcagcgactgtgctccagttcagggggaaaggaatcttatctgctgaatcccggagctccggggatggatcttgacatggacgactacatagacccctacgaggaggccgaggccgaggctgccgcggcgcaggacgacgactccgacgaccccgacgaggacgactcggacgcggagagcgactacgaggagaagtcgttcggcctcctcaagtccggcaagcaccgggtgcgcaacccggacggcaccttccgctgccccttctgccccggcaagaagaagcagggttacaagatcaaggacctcctccagcacgccgacggcatcggcgtctccagcaagcaccgccgccacggccgcgagcgcgccaaccaccgcgccttcgcgcgctttgtccgcaccgatccggactttgcggaagacctcgtcggtatcactggcattcaaggcgccattacaaccacccctgctgataagaatggcagtgccaatggcgacgggaaggcccaggctaatggagatactgctggatccagttccgtggcggcgaaagtgggtccgccgcaggaggttgagaggtttgcttggccgtgggcttgtgttcttgcagccggggcagggttcaatcctgaggagtttgctgatagagtagccatgtttagtttggttgaggttgtgcctttgtttgtcgatgagatggaagtcaccgaaacctttgcaatcgtgaggtttaccaacgattggagtggattcaatgacgcgcttacgcttgagaaccatttcggtgtcaataagctagggaagaaggaatttgagacgagagatagtggtctgggttccgtggtaggagatggtgctgaaggtgaggtcaaggtttatgggtgggttgcccgagctgaggactatgatgcaacgagtgtggtaggaagattcttgagaaagcacaccgtcctgaaaacaatagatgaggtttccaagactgaattagagaaatcaggggagatggtggcaatactggcatcccagatcgaggaaaagaaccgatacttgcaggatttggagacaaagaagaatgcgacagaactctcaatctcaaggcttgaggaggacaacaggaaactgcatgaggcatacaatgaagaaatgcgcaatcttcatcgcagggctcgtgaaaatgctctgcggattttccaagagaatgaaaacttgaggattgacttagaaaataagaggagagaactgaacttacgagctaaggagcttgaaaaaatgtcagctgagaatgctaatgacaggaagacactcgatgatgagaagcagaaggcaaaatatgataatagtgaacttgagctagctagcatagagcagcagagggctgatgcagatgttctgaagctattggccgaccaggagagggaaaaggaagatgtacttgctagaatgcttcagctagaaaaggagctgcatgagaagcagcagcttgagctcgaagtagaacggttgaatggtacactccaagtgatgaaacatttagagggagatgatgacgggggagatatccatgagaagatggagaagctgagtgtaagatttgagcgtgaaaagaagcgcctggaggatttgagtggggatctcgtgagaaaagagcgtgaaagtaatgatgagctacaagaagcccgaaaagaactgataaagggtttggaagaagagttagatgggcagacagctattgggatcaaaaggatgggggaactcaatgaaaagcctttcctaaatgcatgtaagagaaaatatggaaagggtgaataccagataaaagcagcagagctggtcacaaattggcaggaggaactaaagaagccatcctggcatccttttaagatggttgaggttaacggagaaaataaggaaattctggttgacgatgatgcaaaactgaagcacctgtggattgagtacggcgacgatgtgtgtaatgcggtgaagactgcactgatggagataaacgagtataacccaagtgggaggtatgttgtgcccgagctctggaacttcaggaaaggcagaaaggcgacgatgaaggaggtgctcaagtacctgttcagtcagatagacacgacgaccaagcgcaggaggggctgagcctaggcgcccacaggtcgtgaatccaataagtggcgcctttacgctgttttgtcagtcgtgtgctcctcgatcccctagttagtggtagtctggcataataagtgctcgtaatcaaggcttagctatgcatcatgttcatatgcttgtgcatgtggtgctgttgccgcaggcgtcctaaaaccaatgtgattgttgaactgaccactgagtaatctttcgcgctgctattattgttcaggtgtaaatagttagtgcctgccccctgcatggctttctcgtgtgtgtaatcatctaaccgttcatgtgtaatcattgaatcgtgccgccttataatcaacgaatcatgccaccttataatcagtagaggttttctatcttcagagctgtcccccccccc

SEQ ID NO: 3260 - DNA, 2821 bp, Sorghum bicolor
gaaaaagttacagagcgagccctcgaaccccggtcctagggacggctccaaagcggtggaagtagcagtggcattttcttctgtcccgtgcgctctccccagtcccccacgcccaaaaccccaagtgcctttctcgccgcttccgactccgccatgccaccatagatccagctagggcggcgtcgttgcgttcaatcctgtgcgagagaacgcgaatcgccgccggcttgatattggccagggctttctccgcccaattgcatcaggtctcgccgtcatttgcagcgaccgtgctctaattggggcgaaaaggaatcttatctgctgaatccccgagctccggcgatggattttgacatggacgactacatagacccctacgaggaggctgaggctgaggctgccgcgggcgaggacgacgactccgacgaccccgacgaggacgactcggatgcggagagcgactacgaggagaagtcgttcggcctcctcaagtccggcaagcaccgggtgcgcaacccggacggcaccttccgctgccccttctgccccggcaagaagaagcaggggtacaagatcaaggacctcctccagcacgccgacggtatcggcgtctccagcaagcaccgccgccacggccgcgagcgcgccaaccaccgcgccttcgcgcgctttgtccgcaccgatccggacttcgcggaagacctcgtcggtatcactggcattcaaggtgccattacaaccacccctgctgataagaatggtggcagtgccaatggcgacgggaaggccaaggctaatggagatactgctggatccagttccgtggcggcgaaagtgggtccgccacaggaggttgagaggtttgcttggccgtgggcttgtgtgcttgcagccggggcagggttcaatcctgaggagtttgctgatagagtagcggtgtttagtttggttgaggttgtgcctttgtttgttgatgagatggaagtcacagaaacctttgcaatcgtgaggtttaccaatgattggagtggattcaatgacgcgcttacgcttgagaaccattttggtgtcaataagctagggaagaaggagtttgagacgagagacagtggtctaggttccgtggagggagatggcggcaaaggtgaagtcaaggtttatgggtgggttgcccgagccgaggactatgatgcaacgagtgtggtaggaagattcttgagaaagcacaccgtcctgaaaacaatagatgaggtttccaagactgaattagagaaatcaggggagatggtggcaatactggcatcccagatcgaggaaaagaaccgatacttgcaggatttggagacaaagaagaatgcgacagaactctccatctcaaggcttgaggacgacaacaggaaactgcatgaggcatataatgaagaaatgcgcaatcttcatcgcagggctcgtgaaaatgctatgcggattttccaagagaatgaaaacttgaggattgacttagaaaataagaggagagaactgaacttacgagctaaggagcttgaaaaaatgtcagctgagaatgctaatgacaggaagacactcgatgatgagaagcagaaggcaaaatatgataatagtgaacttgagttagctagcatagagcagcagagggctgatgcagatgttctgaagctattggctgaccaggagagggaaaaggaagaggtacttgctagaatgcttcagctagaaaaggagctgcatgagaagcagcagcttgagcttgaagtagaacggttgaatggtacactccaggtgatgaaacatttagagggagatgatgacgggggagatatccatgagaagatggagaagctgagtgtaagatttgagcatgaaaagaagcgcctggaggatttgagtggagatctcgtgagaaaagagcgtgaaagtaatgatgagctacaagtggcccgaaaagaactgataaagggtttggaggaagagctggatgggcagacagctattgggatcaaaaggatgggggaactcgatgaaaagcctttcctaaatgcatgtaagagaaaatatggaaagggtgaataccagataaaagcagcagagctagtcacaaattggcaggaggaactaaagaagccatcctggcatccttttaagatggttgaggttaacggagaaaataaggaaattctggttgacgatgatgcaaaactgaagcacctatggattgagtacggcgacgatgtgtgtaatgcggtgaagactgcactgatggagataaacgagtataacccaagtgggaggtatgtagtgcccgagctctggaacttcaggaaaggtagaaaggcaacgatgaaggaggtgctcaagtacctgttcagtcagatggacacgacgaccaagcgcaggaggggctgaggaggcgccccgaggccgagaagccaataagtagcgcctttacgctgctctgtcagtcgtgtgctgctcgatcttctagttagtggtagtctggcataataagtgttcgtaatcaaggcttaggtatgcatcatgttcatgctgttgccgggcaggcgtcctaaaaacctatgtgatcgttgaactgactactgagtaatctttcgtgctgctattattgttcgggtgtaaatagtttggtgcctgctccttcgtggctttctcgtgtgtgtaatcatttgaccgttcatttgtaaatcattgaatcatcatgctgccttataatcagtaggggctttctatcttcagagctgatgagaatgatctaaaaagtaaagtgttatgtctagcagtc

SEQ ID NO: 3261 - DNA, 2914 bp, Zea mays
atttaataatttgctaaatctgagttttttagtaaccagggtagatatgatagtaaagattgttcagctcgacgcaaacgacaaaaccatcttgaaaatggcagaaagaaaaaattcagaaggagccctcgaatcccggtcctaggaaccgtctgtcaacgcggtcggggtacttgagtgcctttttcttctctcacgtgcgcccctaaaccccagtgtgctgtgctaatggggatcgaacgccctgcgcttaaatcctcgggtagaactctcgcctcttccgactccgccataccaccaatagatccagctatggcggtgtagtcgaattcaatcctgtgcgagaaaacacgaaatcgccgctggctcgatattggccagggctttctccgcccaactgcatcttgcagcgactgtgctccagttcgggggaaaaaaaggaaccgtatctgcttgaatccctgcgctccggggcggggatggatcttgacctggacgactacgtggacccctacgaggaggccgaggccgaggctgccgcggcggaggacggctccgacgaccccgacgaggacgactcggatgcggagagcgactacgaggaggagtcgtttggcctcctcaagtccggcaagcaccgggtgcgcaacccggacggcaccttccgctgccccttctgccccggcaagaagaagcaggggtacaagataaaggacctcctccagcacgccgacggcatcggcgtctccagcaagcaccgccgtcacggccgcgagcgcgcgaaccaccgcgccttcgcgcgctttgtccgcaccgagccgtcatttgcggaagacctcgtcggtatcactggcattcaaggtgccattaaacccacccctgctaatagagatggcagtaccaatggcgacgggaaggccaaggctaatgtagatactgctggatccagttctgtggcggcgaaagtgggtctgccgcgggaggttgagaggttttcttggccgtgggcttgtgtccttgcggctggggcagggttcaatactgaggactttgctggtagagtagccatgtttagttcggttgaggttgtgcctttgtttgtcgatgaggtcgaagtcgcagaaacctttgcagttgtgaggtttaccaatgattggagcggattcagcgacgctcttacgctggagaaccatttcagcatcaataagctagggaagaaggaatttgagatgagagataatggtataggttccgtggagggagatggtggcgaaggtgaggtcaaggtttatgggtgggttgcccgagctgaggattatgattcgccgagtgtggtagggagattcttgagaaagcacaccgtcctgaaaacaatagacgaggtttccaagactgaattagagaaatcaggggagatggtggcaatactggcatccaagatcgaggaaaagaaccgacacttgcaggatttggaaacaaagaagaatgcgacagaactctccatctcaaggcttgaggaggacaacaggaaactacatgaggcatataatgaagaaatgcgcaatcttcatcgtagggctcgtgaaaatgctttgcggattttccaagagaatgaaaacttgaggattgacttagaaagtaagaagagagaactgaacttgcgagctaaggagcttgacaaaatatcaactgagaatgctaacgacaggaagacacttgataatgagaagcagaaggcaaaatacgataacagtgaacttgagctagcaagtatagagcagcagagggctgatgcagatgttctgaagctattggctgaccaggagagggaaaaggaagatgtacttgctagaatgcttcaactagaaaaagagctgcatgagaagcagcagcttgagctcgaagtagaacggttgaatggtacactccaagtgatgaaacatttagagggagatgatgacgggggagatatccatgagaagatggagaagctgagcgaaagatttgagcgtgaaaagaagcgtctggaggatctgagtggggatctcgtgagaaaagagcgtgaaagtaatgatgagctacaagaagcccgaaaagaactgataaagggtttggaggaagagctaaatggacggacagctatcgggatcaaaagaatgggggaactcgatgaaaagcctttccaaaatgcatgtaagacaaaatacggaaaggatgagtacgagatcaaagcagcagagctagtcacaagttggcaggatgaactaaagaagccatcctggcatccttttaagatggttgaggttaacggagaaaataaggaaattctggatgacgatgacacaaaactgaagttcctgtggatcgagtacggcgatgatgtgtgcaatgcggtgaagaccgcactgatggagattaacgagtataaccctagcgggaggtatgttgtgccggagctctggaactttaggaaaggccggaaggcgacggtgaaggaggtgctcaagtacctgttcagtcagatggacacgacgacgaagcgcaggaggggctgaggaggtgccttctatgttgttgcatcagtcgtgtgctgctcgatccccaagtggcagtctggcataggagatgcccctcttgtgtagtgaaatctggcacgataaagtgcccgcgatccaggcttgggtatgccttatgcatcatgttcatatgcttgtgcatgtggtgctgttgccgcaggcgccctagcctaacctgtatgattgttgagatgagtagtctttcttgctgctgttactcccttcgcccctcaatgtctctgaataaatcaattcctaaagttatcataaaatcgagcttttttaatcagactttttaaagtttaactgaacttatagaaaagagtcaggatttatga

SEQ ID NO: 3262 - DNA, 2809 bp, Setaria italica
gcccccaaaaccccaggactggaatggaatgcaggtgttaatccttgcccagtaaagctgttgcctttctcgccgatttccgccatgccaccataaatccagcgagggcggcgtcgttgcgttcaatcgtggtgcgtgagaacgcgatttcgcccgggctttacatagggcgggggtttctccccccaatttcatccagtttcgctgccatttggagcgatcgtgctccagttcgggggaaggaatcgtctctgttgaatccctgagctccggggatggatcttgacatggacgactacatcgacccctacgaggaggccgaggccgaggccgccgcggaggccgccggattagcggaccccaaatccgaggactccgacgacgactccgaggacgactcggacgcggagagcgactacgaggagcaatccttccgcctcctcacatccggcaagcaccgggtgcgcaacccggacggcaccttccgctgccccttctgccccggcaagaagaagcaggggtacaagatcaaggacctcctccagcacgccgacggcatcggcgtctccagcaagcactgccgccacggccgcgagcgcgcgtctcaccgcgccttcgcccgctttgtccgcaccgatccgtccttcgcggaagaccttgtcggtatcactggcatcctcggtgccattaagcccgcccctgctaacgccaatggcagtggaagtgccaccgcggaggcgaaagccaatgttggtcctacgggatccagttctgcgccggcggagaacgtggggccgccacgggaggttgagaggtatgcttggccatgggcttgtgttcttgcagccggtgcagggttcaatgctgaggagtttgctggtagagtagccatgtttagttttgttgaggttgtgcctttgtttatcgatgagatagaaggcatggaaacctttgcaatcgtgaggtttaccaatgattggagtggatttaatgatgcgcttacgctagagaaccattttagtgtgaataagctggggaagaaggaatttgagactaggaatagtggtctaggtgctgcagagggggagggcggcgaaggtgaggtaaaggtttatgggtgggttgcccgagagggggattacaatggagggactgtggtgggaaggttcttgaggaagcgtaccatcctgaaaacaatagatgaggtctccaaaactgagttagagaagtcaggggagatggttgcaagactggcatctcagatagaggaaaagaaccgatacttgcaggatttggagacaaagaagaatgcaacagaactctcgatctcacggcttgaggaggacaacaggaagctacacgaggcgtacaatgaagaaatgcgaaatcttcatcgcagggctcgtgaaaatgctctgcgaattttccaagaaaatgacaacttgaggcaagaattagaaaataagaggagagaactgaattcacgagctaagcaacttgaaaagctgtcagctgagaatgctaacgactggaagacactcgatgatgagaagcagaaggcgaaagatgataatagtgaacttgagttagccagtatagagcagcagagggctgacttcgatgttctgaagctattggatgaccagaagagggaaaaggaagatgtattcgcaaggatgctccaactggaaaaggaactgcatgagaagcagcaacttgagctcgaagttgcacggttgaatggtacactccaagtaatgaaacatttggagggagatgatgatggtgatattcatgagaagatggagaagctgagtgaaagattagagcgtgagaagaaacggctggaagatttgagtggagatcttgtgaggaaagagcgtgaaagtaacgacgagctacaacaagcccggaaagaattgattatgggcttggaggacgagctaaatgggcgggcagctattgggataaaaagaatgggagaacttgatgaaaaaccatttcaaaatgcatgtaggaggaaatttggaaacgatgattaccaggtcaaagcagcagagttgatcacaaattggcaggaggaactgaagaagccatcctggcatccttttaaggttgttcaggttaatggagaagataaggaagttctagatgatgatgatgcaaagctgaagttcctgtggattgagtatggtgatgacgtgtgcaatgcggtgaagaccgcgctgatggagataaatgaatacaaccccagtggtcggtatgttgtgcccgagctgtggaacttcaggaaaggccggaaggcgacgacgaaggaggtgctcaagtaccttttcgggcagatggagacgacaaccaagcgcaggaggggctgatgaggtgccctaggccgcctgactgcaaagccaataagtagtcgtgcatgcgcgccattggtgccatcgtggggccctgtgctgctcgatcccctcctgacataggagatgtatcctctgtgttaatgttccattgcgtaacgacattacaagcgtatgtgatgtgtggaagcatgtggttgtgctgttgccgcttcaggccgtaaaaactgatgtgatcggtgaactgaataataccaacccgtggctttcgtgccctacttaggtgtctgtatattgtgcaggtgtacatatgcagtagtgcaagtgatagcctgcttggcctttatcttgtgtgctatcatctgacctttcatgcgtaatcggttaatcatgctgcatattttcagcatttgtaccgtaatttaggtacttggtgttggtttgatgatact

SEQ ID NO: 3263 - DNA, 2202 bp, Sorghum bicolor
gtctggcgacttctcgttttctcctatcggaagtcggaaccttccagaatcgtggagaccggacggaactagaacttgctccctctctctctctctcctctttatacttgcccctccctcgacgattcgccaaatggtccggaacgaacaccgccagccgattcgaatccgacgatcccgatcgatccaccttcccgatcgcacgccaatcagcacccgccgccgccgcgatggcggacgaggcgaaggcgaagggcaacgcggcgttcgcggccggccgcttcgaggaggctgtccagcacttcagcgacgccatcgtgctcgcgcccgacaaccacgtcctctactccaaccgctcggcggcgtacgcgtcgctcgggcgctacgcggaggcgctaggcgacgccgagcggaccgtggcgctgaagccggactgggccaagggctactcccgcctcggcgccgcgcacctgggcctcggcgacgcgcccaaggccgtcgaggcgtacgagaaagggctcgcgctcgagccgtccaatgaggcgctcaagtccggcctcgcccaggcgcgccaggccgcgtcggcgccgagacgtccggtgggctccggggcggacgccgtcggcaagatgttccagggccctgagctatggaccaaggtcgccgcggatcccaccacgcgtggctacctcgaccagccggacttcgttcagatgctgcgggaggtgcagcggaaccccagcagcctgaacagctacctttctgaccaacgaatggttcaggtgctcaccctcatgctgggcatcaagctccagaaccagagcaatggggcgcctgagccggccgcagcgcaatcgaacccgccgccaccaaagcagcagccagaggcgcaggcaagggaactggagccggagccggggccggagcccgagcctatggaggtaacagaggaggagaaggaacggaaggagaggaaagcgtcggcgcagaaggagaaggaagccggcaacgccgcttacaaaaggaaggattttgataccgcgatccagcactacacaaaggccatggagctcgatgatgaggacatctcctacatcaccaatcgtgctgctgtttatcttgagatgggaaagtatgatgaatgcattaaggactgtgataaggctgttgagagaggaagggaactacatgctgatttcaagatgatctcgagggcactcaccagaaaaggaactgctcttgccaaacttgctaaatcatcacaagactatgatgctgccattgagactttccagaaggcgttaactgagcatcggaacccagataccctgaaaaaactaaatgatgcagaacgagcaaagaaggagctggagcaacaagagtactatgacccaagaattgctgacgaggagagagaaaaaggtaatgagttctttaagcagcagaaatatccagaagcagtgaagcattacactgaagctctcaggagaaaccccaaagacccaagggtatacagcaatagggctgcctgttacaccaagctgggggcgcttcctgaaggtttgaaagatgctgagaagtgcattgagctagattccacattctccaagggatacacaaggaaaggtgctatccaatttttcatgaaagaatatgacaaagcgctggaaacttatcaagctggcttaaagcatgacccgaaaaaccaggagttacttgatggtgtaaggaggtgtgttgaacagatcaacaaggcgagcaggggcgaactcagcgaggaggaactgaaagagagacagaacaaagccatgcaggaccctgaaatccagaacatccttactgatccgatcatgcggcaggttttgactgatttgcaggagaaccctcgggctgcccaggcgcacctcaagaaccccggagtgatgcaaaagatccagaagctcgtcagcgcagggatagttcagatgaagtagaagtagacagtggctggaatgtccgggttcagaactgggatctgtgctggaaatgctatgaacctgatcatcattgtttcgcattttggaaactgaatcggtttgtgtggtcatggctgttaattatccatatggtttacaagatgaattcgtgcccttttccccccctgaattgccgtgtgaagaggaagagtattcagtctcctcgcactcgagcagtttctagatt

SEQ ID NO: 3264 - DNA, 2171 bp, Setaria italica
tcggtgatcggtctcgcgacttcccgttttctcccgccctccggaaccttccagaatctccgagaccggacgggactagaacccggtcgtcctcccccgtctttatactcgcccccctcctcgacgatcccaccaaaaggcccgaaaagcgcacgccaaccgatccgaaacagacggtctcgatcgttccacctccccgatcgcacgccaatcagcacccgccgccgccgccgcgatggccgacgaggcgaaggcgaagggcaacgcggcgttctcggccggccgcttcgatgaggcggcccggcatttcggcgacgccatcgcgctcgcgcccgacaaccacgtcctctactccaaccgctcggcggcgtacgcgtcgctcgggcgctactccgaggcgctcgcggacgccgagcggaccgtcgcgctgaggcccgactgggcgaagggttactcccgcctcggcgccgcgcgcctggggctcggcgacgcgcccggggccgtcgaggcgtacgagaaggggctcgcgctcgacccgtccaacgaggccctgaagtccggcctcgcccaggcgcgccaggccgcgtcggcggcgcgccgccccgggggctccggcgcggacgccttgggcaaggtgttccagggccccgagctctggagcaagatcgccgccgaccccaccacgcgcggctacctcgaccagccggacttcgtgcagatgctgcgggaggtgcagcggaaccccagcagcctgaacacctacctctctgaccagcgcatggtccaggtgctcaccctcatgctgaacatcaacatccagcacaagagcaatggggcgtctgagccggcgtcagcgcaatcggcccctcagacgccaaagcagcagccggaggcgaaggcaagggagccggagccggaacctgagcccgagccgatggaggtgacagaggaggagaaggagcggaaggagaggaaggcggcggcgcagaaggagaaggaagcgggcaacgccgcttacaagaagaaggatttcgatacggcgatccagcactacacaaaggccatggagcttgacgacgaggacatctcctacatcaccaatcgtgctgctgtttatcttgagatgggaaagtatgacgagtgcattaaggattgtgataaggctgttgagaggggaagggaactacatgctgatttcaagatgatctcgagggcactgacccgaaaagggactgctcttgccaaacttgccaagtcatccaaagactatgatgttgccattgagacttttcagaaggcgttaactgagcaccgaaacccagataccctgaagaaactgaacgaggctgaacgagcaaagaaagagctggagcaacaggagtactatgatccaaaaattgctgatgaggagcgagagaaaggtaatgagttcttcaagcagcagaaatatccagaagcagtgaagcattacactgaagcactcagaagaaacccaaaggacccaagggtatacagcaacagggctgcttgttacaccaagctcggagccctacctgaaggtctaaaagatgctgagaagtgcatagagctagatcctacattctccaagggatacacaaggaaaggtgcgatccaattcttcatgaaggaatatgacaaagcactggaaacttaccaagccggcctaaagcatgatccgaagaaccaggaattgcttgatggtgtaaggaggtgtgttgaacagatcaacaaggcaagcagaggcgaactcagtgaggaggaactgaaagagagacagaacaaagctatgcaagaccctgaaatccagaacatcctgactgatccaatcatgcgacaggtgttgaccgatttgcaggagaacccaagggctgcccaggcgcacctcaagaaccccggagtgatgcaaaagatccagaagctcgttagcgcagggatagttcagatgaaatagactgttgctgctaggtccggattcagagttgagacctctactgaatataccgtgatcgcattttggcccccctgaaccgggtcgtgtaagcatagcttggtcatggcggtgttaacgttccatgtgattttccactcaacatgcttcagatccgtccttgtttttatcccggaatgcttgtgagagtaggaagggtgtt

SEQ ID NO: 3265 - DNA, 2184 bp, Panicum virgatum
cacactaccatcgatggtgatcggtcttgcgacttcccgttttctcccgccctccggaaccttccagaatcgcggagacccggacggtactagaacgcgcgcctcctctcccgtcatattttactcgctcccacctcctcgacgatccctccaaattaaaagcccggacggcgcacgccaaccgatccggaaccgacgctcccgatcgttccacctccccgatcgcccgccagatcagcacccgccgccgccgccgccgcgatggccgacgaggccaaggccaagggcaacgcggcgttcgcggccggccgcttcgaggaggcggcccggcacttcggcgacgccatcgcgctcgcgcccgacaaccacgtcctctactccaaccgctcggcggcgcacgcgtcgctcgggcgctactccgaggcgctcgccgacgccgagcggaccgtcgcgctcaggcccgactgggccaagggctactcccgcctcggcgccgcgcacctgggcctcggcgacgcgcccgctgccgtcgaggcgtacgagaagggcctcgcgctcgacccctccaacgaggccctcaggtccggcctcgcccaggcgcgccaggcggcggcgacgcggcgcccgggggcttccggcggggacgccctcggtaaggtgttccagggccccgagctgtggaccaagatcgccgccgaccccaccacgcgcgcctacctcgaccaaccggacttcgtgcagatgctgcgggaggtgcagcggaaccccggcagcctcaacacctacctctccgatccccgcatggtccaggtgctcaccctcatgctcaacatcaagctccagccccagagcaatggggcgtctgagccggcggcagctcctcagacgccgaagcagcagccggaggcaaaggcaagggagcctgagcccgaacctgagcccgagccgatggaggtgatagaagaggagaaggagcggaaggagaggaaggcggcggcgcaaaaggagaaggaagcgggcaacgccgcttacaaaaagaaggatttcgataatgcgatccagcactacacaaaggccatggagcttgacgacgaggacatctcctacatcaccaaccgcgctgctgtttatcttgagatgggaaagtatgatgagtgcatcaaggattgtgataaggctgttgaaaggggaagggaactacatgctgatttcaagatgatctcgagggcactgaccagaaaaggaaccgctcttgctaaaacttgcgaagacatccaaagattacgatgttgccattgagactttccagaaggcgttaactgagcaccgaaacccagataccctgaagaaactgaatgatgctgaacgatcaaagaaggagctggagcagcaagaatactatgatccaaaaattgctgatgaggaaagagaaaaaggtaatgagtttttcaagcagcagaaatatccagaagcagtgaagcattacactgaagctctcaggagaaacccaaaggacccgaaggtatacagcaacagggctgcttgttacaccaagctgggagcccttcctgaaggtctaaaagatgctgaaaagtgcatagagctagaccctacattctccaaaggatacacaagaaaaggtgctatccaatttttcatgaaggaatatgacaaagcgctggagacttaccaagctggcctaaagcatgatcccaagaaccaggaattgcttgatggtgtaaggaggtgtgtcgaacagatcaacaaggcaagcagaggtgaactcagcgaggaggaaatgaaagagagacagaacaaagctatgcaggaccctgaaatccagaacatcctgactgatccgatcatgcgacaggtcttggccgatttacaggagaacccacgggctgcccaggcgcacctcaagaaccccggagtgatgcagaagatccagaagctcgttagcgcagggatagttcagatgaagtagtctgtagctgcaaagtccggattcagagttgagacctttgctgaaaataccgtgatctcattttggccactgcatagcttggtcgtccatatgatttcccactagacaatgttccagatttgtgtgggttttttttccggaatgcctgtggaagtgtgaagagagttccgtctctcgcattcgagcatatggttgcg

SEQ ID NO: 3266 - DNA, 2395 bp, Oryza sativa
tacaggacagagtgaaattgctaaccagcttgtggggtaactactccattccaaaagacaacccatacactgatgacagtgacttagaactagaagtttgggcattgggtcttagaaacccgtggagatgcagctttgattccgcgaggccttcctacttctaccgtgccgatgttggtcagattcaggcattcagcacatggtatatttcagaatatgtatatagctatgttaaaatttcagaatatcttctactggtagtcgccgtgcaatctcgcgagttcccggctttctcccaccctccggaatcttccagaaccgttgagatcgcgcgactcttgagaaccgtgacctttatatactttctccccctcgacgcccccgtccaaacacgcaccaagccaccaaccgattccgatccaacgatctcgatcgcccgctccgcttcgcttcccgatcgatcagccccgccgccgcgcgcgatggccgacgaggcgaaggccaagggcaacgccgcgttctccgccggccgcttcgaggaggcggcggcgcacttcaccgacgccatcgcgctcgcgcccgacaaccacgtcctctactccaaccgatcggcggcctacgcctcgctccaccgctacccggaggcgctcgccgacgccgagaggaccgtcgcgctcaggcccgactgggccaagggttgctcccgcctcggcgccgcgcgcctcggcctcggcgacgccgcgggcgccgtggcggcctacgagaaggggctcgccctcgagccgtcgaacggggcactcaaggacggcctcgcccatgcccgccaggcgcgccgcccggcgccggcgtccggcgccggcgccatcggcaaggtgttccagggccccgagctctggagcaggatggccgccgaccccaccacgcgcccctacctcgaccagccggatttcatgcggatgctgcgcgacgtgcagcggaatcccagcagcctcaacaactacctctccgatccccggatggtccaggtgctcagcctcatgcttaacctcaggctaccgaacaatgacgcgcctccgcggccgccggcgcagtcgactccgccgcctccgccgcagcagcagcagcaccagccggagacgaaggcgagggaacctgaacccgagcccgagccgatggaggtgacagaggaggagaaggagcggaaggaaaggaaggccgcagcgcaggaggagaaagaagcgggcaacgccgcttacaagaaggattttgagacggcgatccaacactacacaaaagccatggagctcgacgatgaggacgtctcctacctcaccaaccgagccgccgtttaccttgagatgggaaagtatgatgagtgcatcaacgactgtgataaggctgttgagaggggaagggaacttcatgctgatttcaagatcatctctagggcactgaccagaaagggaactgctcttgctaagattgctaagtgcttcaaagattatgatgttgccattgagacttaccaaaaggctctgactgagcacagaaacccagataccctgaagaaactgaatgatgctgaaatagcaaagaaggagctagagcagcaagagtactatgatccaaaaatagctgatgaggagcgagagaaaggtaatgaattcttcaagcagcagaaatacccagaagcagtgaagcattacagtgaagctctcaggagaaaccccaaggatccaagggtatacagcaacagggccgcctgttataccaagcttggagcaatgcctgaaggtctcaaagatgctgaaaaatgcattgaactagatcctacattctccaagggatacacaaggaaaggtgcaatccaatttttcatgaaagaatatgacaaagcactggaaacctatcaggccggcctaaagcatgacccgaacaaccaggagttgcttgatggtgttaggagatgtgtccagcggatcaacaaggctagcagaggggaactgagccaggaggaattgcaagaaagacagaacaaggctatgcaggacccagaaatccagaacattctgaaggatcctatcatgcagcaggtgttgaccgacttccaggagaatccgaaggctgctcaggcgcatctcaagaaccccggagtgatgcagaagatccagaagctagtaagtgcagggatagtccaaatgaagtagacatgctgaaagggccagggatagagtaatctgatcggtgtgcctggaaacttctgaatgcaaaattcgtcgtcgaatttttgtacagtacaatcgtgtttatgcaaattccgattggtcatggctgagccgaatttccatactgctgatcttttactttggacacgaccctataaccgattttaacc

SEQ ID NO: 3267 - DNA, 1961 bp, Triticum aestivum
cgacgatctcgagccgcccacatcccgatcgatcccaacccaagcggaagcagccggccaatcaaccaatcgcgatggccgccgacgaggccaaggcgaagggcaacgcggcgttctcggcgggccgcttcgaggaggcggcgggccacttcggcgacgccgtcgcgctcgcccccgacaaccacgtcctcttctccaaccgctcggcggcctacgcctcgctccaccgctacaaggaggcgctcgccgacgccgagcggaccgtcgcgctcaggcccgactgggccaagggctactcccgcctcggcgccgcgcgcctcgggtcgggggacgccgcgggcgccgtcgaggcctacgagaagggcctcgccctcgacccctccaacgccgccctcaaggacgggctcgcccaggcccggtcggccctcccccgccgcccggcctccggcgccgacgccattggcaagattttccagggggccgacctctggagcaagatcgccgccgaccccaccacgcgcgcctacctcgaccagcccgacttcatgcagatgctgcgcgatctgcagcggaaccccggcaacctcaacaactacctctccgacccccgcatgatgcaggtgctcagcctcatgctcaacatcaaggtccagaaccagaacaatgacgcctccgagccggcgccggcgccgacgccggccaagtcgtccccgccgccgccacagaagcagcccgagaccaagccgagagagccggagcccgaacctgtggagatgaccgacgaggagaaggaacggaaggagaggaaggcggcggcccagaaggagaaggaggcggggaacgccgcttacaaaaagaaggatttcgagacggcgatccagcactacacaaaagccatggagcttgacgacgaggacatctcctacctcacaaaccgcgccgccgtttaccttgagatgggacagtacgatgattgcattaaggattgtgacacggctgttgagaggggaagggaacttcgtgctgacttcaagatggtttcgagggcactcacaaggaaaggaactgctcttgctaaacttgccaagtcttccaaagactacgatgttgccattgagactttccagaaggctctgactgagcatcgaaacccagataccctgaaaagactaaatgatgctgaacgagcaaagaaggagctcgagcaacaagagtactatgatccaaaaattgctgacgaggagcgagagaaaggtaatgagttctttaagcagcaaaaatacccagaagcagtgaagcattacactgaagcgctcaggagaaacccgaaggatccgaaggtttacagcaacagggctgcctgttacaccaagctgggtgccatgcctgaaggtctcaaggatgccgagaagtgcatcgagctagatcctacattctccaagggatacaccaggaagggtgcaatccagtttttcatgaaagaatacgacaaagcaatggaaacttatcaggaaggcctaaagcatgatccgagtaaccaggagctgcttgatggtgtaaagagatgtattcagcagatcaacaaggcgaacagaggcgaacttaccccggaggaactgaaggagagacagggcaaggctatgcaggaccctgaaatccagaacatcctgacggaccctgtcatgcggcaggtgttgattgatttccaggagaatccaagggctgctcaggagcatctcaagaaccctggtgttaagcaaaagatccagaagctcgtgagcgcagggatagtccagatgaagtagacctaaatgctgagtgtcggaggtttagttagttggttgacattttcttgtccggggtcaattttcctccggatttgggtttgtgtaaaagtacatttcgtggtggttcttaattggcttgcttgtgatgtgatacttcacctcgtccgaaatttg

SEQ ID NO: 3268 - DNA, 4084 bp, Brachypodium distachyon
ccgtcgagaaccttctccccctttataattccccccttcagaaaagctgctcctcaacgcgaagttaagccaatcgatacgaatccgacgatctcaacggtccccatcccgatcgatcgcaagccaagcagccgcaatcgcgatggcggacgaggcgaaggcgaagggcaacgcggccttctcggcgggccgcttcgaggaggcggcgggccacttcggcgacgccattgcgctcgcgcccgacaaccacgtcctctactccaaccgctcggcggcctacgcctcgctccaccgctacaaggaggcgctcgccgacgccgagaggaccgtcgcgctcaagcccgactgggccaagggctactcccgcctcggcgccgcgcacctcggcctccgggacgccggcaaagccgtcgaggcctacgagaaggggctcgcccttgagccctccaatacggccctcaaggatggcctcgcccaggcccgcctggccctcccgcgcccccgccccccggggttcggcgccgacaccatcggcaaggtgtttcagggaccggacgtctggagcaagattgccgccgaccccaccacgcgcgcctacttggaacagccggacttcatgcagatgctgcgcgatgtgcagcggaaccccggcagcctcggcaactacctctccgatccccgcatgatgcaggtgctcaccctcatgcttaacatcaggccccagaacgagaaccagtacaatgaagcatccgagccggcggcgtcgcagtccgcgtccccgccgccacagcaacagcagcagcataagcccgagacgaggtcgagggagccggagcccgagactaagtcaaaggatccggagcccgaaccgatggagatgactgaggaggagaaggagcggaaggagaggaaggtggcggcgcagaaggagaaggaagcggggaacgccgcttacaagaaaaaggatttcgagacggctatcgaacactacacaaaagccatggagctcgatgacgaggacatctcctacctcacaaaccgcgccgcagtttaccttgagatggcaaagtatgacgagtgcattaaggattgtgatatggctgttgagaggggaagggaactacgtgctgatttcaagatgatatcgagggcactgaccagaaaaggaactgctcttgccaaacttgctaagtgctccaaagactacaatgttgccattgaatctttccagaaggctttaactgagcatcggaacccagacaccctgaaaagactaaatgatgctgaacgagcaaagaaggagctcgagcaacaagagtactatgatccgaaaatagctgatgaggagcgagagaaaggtaatgagttcttcaagcagcaaaaatacccagaagcagtgaagcattacactgaagcgctcaggagaaacccacaggacccaagggtatacagcaacagggctgcttgttacaccaagctgggtgccatgcctgaaggtctgaaagatgccgagaaatgcatcgagctagatcctacattctccaaaggatacacaaggaaaggagctatccaattttttatgaaagaatacgacaaagcaatggagacttaccaggtgggcctcaagcatgatccgagtaaccaggagctgcttgatggtgtaaagagatgtattcaacagatcaacaaggcaaacagaggcgaacttaccccggaggaactgaaagagagacaggacaaggctatgcatgatcctgaaatacagaacattctgacagaccctgtcatgcggcaggtgttgattgatttccaagagaatccaaggtctgctcaggatcacctcaagaaccctggagtgaagcagaagatcatgaagctagtaagcgcaggaatagtccaaatgaagtagctggaagggtcagaggtttagttgatttgtacctagaaacatatgttcaggcaaaaatttgctgtgagctttttcaacatatgggggtaatttcactctggcagatcggtttgtgtcgcttcgtgctgatgttccatgttcggcataggctgacatgtgtgcaaggcatctcgtcaggaacttgctgtaatcatggtttggaaaattgtaggcagcgagactactcgcccaccgagctgaactacgaaattgttggtgatcagttagaccagcgaaaatgcagggtttggttccagtctgttcatcctctcctatccagctgctctttctgttctgatcttttagccataaatcatcccaaagccgcccatggcaacacatccagctcagtgtatacatacatgatttgtgatgttctcgaagaaacatgatctgtgatattaactccatcagcttcagctttcagcaccaacaatgacacagtagtgaaacaattagtaatgtgcggaaatgttcaacacattaacaaaacgaagcaacagcggtgtaaacaggaaacaaaattagtaacgaactgttttctcttctctgaaacttggcaaggtcatgatgacactaacagcttgaaaaaattataacatgatcaagtccgaaaacaaatggtaaatcccgttcgacactacaaagctacaatacacctttgatgtcctattcacctgctcaaccgtcaccatgtatatgtacgcaaacgaaaaaattaagcagcagcttcctcttttgctgcagagagctggttctgaatatgctgtgggacaacatcaaacttggcaagctgcatcgtgtaggatgcgcgccccttggacattcctctcagagtgctgacatactggaacatctcggcgagaggcacgaaagcatcaaccacctgcactcaacaccgcatttcagacaacacattctgctaacaaggagtctaattgcacaaataactatgacaaaaaaaggttattgaatggcagatgcttggctatagctgctgacgacggatgtaaagtgaggatgagttggttataaacaatattgtactcctcccgtcccaaaataagtgacgtgtattcttatacaaatccacgtcacttatttccggacgaagggagtagtatggacatgtattttttttttttgcctgtcaaagttcctaattttttagaagtcaaataaaaaaagtatcatacttccattttgctcaaaattactgatatatttggtgatagtcaaaacagtagtagaaggccataaatggagataatgtactgcttaataccttaagtccacctggtttatccccgaagctgttaacttgtcctcttctagagttcaaatcaccaatcacatcacccaaatgctcctcaggggtaattacttcaaccctcattacaggttccaggagtcttggaccagctttcctcaatccttcacggaaggcccccctggctgcaatttggaatgcaaggacacttgaatcgacatcgtggtacgagccatcaaccagcactgctcgtaaatccacgaccgggtaaccagcaaggacaccattgggcaagctttcttcaattcccttcatcactcctggtacatattcttttggcactgcccctccctttatttcactcttgaattcatacccacttccagcctccatgggttcaaaccgcacaataatatctgcaaactgccctgatccaccagattgctttttgtggacatactgtacctctgcaatcttcgaaatactttcacggtagttgacttgtggagctccaacatttgcctcaacctgtccatcagtatgtatgcatgagagttccaagttaaatgagtgagaatgcagaactcttttcaggttaagggagttatgacccaaaatcttgtggtacgaagttcaggagtgctcaataagatatttggagtaagaatgatgaaaagaatataggtacccagtatacatgatacacgaactagcagagtttactatttttttgtgtgacttcttatagctggtgaaaaaagggatagtgcaagcacacaaaggaaacaatgtgcttcatagatctagtgtagagagtagattatgttggttgatgatctaattcacagaacttgtattcctccgtc

SEQ ID NO: 3269 - DNA, 2147 bp, Secale cereale
ttccaatccgacgatctccagccccccgcatcccgatcgatcgcaacccaagcggaggcagccggccaatcaatcaatcaatccatcgcgatggccgccgacgaggccaaggcgaagggcaacgcggcgttctcggccggccgcttcgaggaggcggcgggccacttcggggacgccatcgcgctcgcccccgacaaccacgtcctcttctccaaccgctcggcggcctacgcctcgctccaccgctacaaggaggcgctcgccgacgccgagcgcaccgtcgcgctcaagcccgactgggccaagggctactcccgcctcggcgccgcgcgcctcgggtccggggacgccgcgggcgccgtcgaggcctacgagaaggggctcgccctcgacccctccaacgccgccctcaaggacgggctcgcccaggcccgattggccctcccccgccgcccggcctccggcgccgacgccattggcaagattttccaggggcccgacctctggagcaagatcgccgccgaccccaccacccgcgcctacctcgaccagcccgacttcatgcagatgctgcgcgatctgcagcggaaccccggcaacctcaacaactacctctccgacccccgcatgatgcaggtgctcagcctcatgcttaacgtcaaggtccagaacaagaacaatgaggcctccgagccggcgccggcgccgacgccggcaaagtcgtcctcgccgccgccacagaagcagcccgagaccaagccgagggagccggagcccgaaccagtggagatgactgacgaggagaaggagcggaaggagaggaaggcggcggcccagaaggagaaggaggcggggaacgccgcttacaaaaagaaggatttcgagactgcgatccagcactacacaaaagccatggagcttgacgacgaggacatctcctacctcacaaaccgcgccgccgtttaccttgagatgggacagtatgatgattgcattaaggattgtgatacggctgttgagaggggaagggaacttcgtgctgacttcaagatggtctcgagggcactcacaaggaaaggaactgctcttgctaaacttgccaagtcttccaaagactacgatgttgccattgagactttccagaaggctctaactgagcatcgaaacccagataccctgaaaagactaaatgatgctgaacgagcaaagaaggagcttgagcaacaagagtactatgatccaaaactagctgatgaggagcgagagaaaggtaatgagttctttaagcagcaaaaatacccagaagcagtgaagcattacactgaagcgctcaggagaaacccgaaggatcctaaggtatacagcaacagggctgcctgttacaccaagctgggtgccatgcctgagggtctcaaggatgccgagaagtgcatcgagctagatcctacattctccaagggatacaccaggaaaggcgcaattcagtttttcatgaaagaatatgacaaagcaatggaaacttaccaggaaggcctaaagcatgatccgagtaaccaagagttgcttgatggtgtaaagagatgtattcagcagatcaacaaggcgaacaggggtgaacttaccccggaggaactgaaggagagacagggcaaagctatgcaggaccctgaaatccagaacatcctgacggaccctgtcatgcggcaggtgttgatcgatttccaggagaatccaagggaagctcaggagcatctcaagaaccccggcgtgaagcaaaagatcctgaagctcgtgagcgcagggatagtccagatgaagtagaccaatgctgagagcactgccggagcttagttggttgattgtgtagaaaacattgctgtgagcttttcatgtgggtttgtgtaaaaagtacatttcgtggttcttaaatgccttgcatgtggtgtaccttgttttgaatttggttttccttagcgtagtcactgtttgctcaaatttttaaggcctcgtaatcaattaaagttctcaacttgaaattggatcatatgattttgacccggttaacaatttctcaaaaggaaaaaaaaaaaaaaaaagaaaaaaaaaagaaaaaaataaactactgtgtgtactacactctctctgta

SEQ ID NO: 3270 - DNA, 2748 bp, Panicum virgatum
atgcatgggcggtgcgccctggaacgcggacgcgtggggcgtgagctggtgcggcggctcgtcggctcgcgcggccggccggttgcacggtgcagcagccgtttcaatgcttcggcgtcagccgccgccgcggagtgggagtgtgaggtgggccgggttgggctggctgggccatggaaatttttgtctctaaaatccacgaccgttcttgggctggacctcgagatctttacctatcgcggcctttggcccattttagtcggctcatcaacttagcgaagcccacacattcgggcagagagcagcccatttatgtgtccgctttccacttcaggaggcgtaaatttgtccgagtatatttcgaccgggtcttctcctacgttggcctaatcctcctgctcggccactccgtggcggcggaaccttcgagaactcttgagaattaggggatccaacgccgcggggctcctcccagttttataaaatctcaactgggctctcccccttaatccccatcaaacccccagacttttccgccagcgccatcctcagccagccgccaagccttcgagaaccctccggagctcgctagatccgatcggacccggcgcgggctgccgccatggcggacgaggcgaaggccaagggtaatgcggcgttctccgccggccgcttcgaggaggcggcgcggcacttctcggacgccatcgcgctcgccccgggcaaccacgtcctctactccaaccgctccgccgcgctcgcctcgctccaccgctactcggacgcgctcgccgacgcgcagaagaccgtcgagctcaagcccgactgggccaagggctactcgcggctcggcgccgcgcacctcggcctcggcgacgccgccagcgccgtcgccgcctacgagaaggggctcgcgctcgaccccaccaacgagggcctcaaggcggggctcgaggacgccaggaaggccgccgccgccccgccgcgccgcgggccgtccgggcccgacgccatcggccagatgttccagggccccgagctgtggagcaagatcgcggccgaccccaccacgcgcgcctaccttgaccagccagactttatgcagatgctgcgcgaggtgcagaggaacccaagcagcctcaacatgtacctctccgatccccgcatgatgcaggtgctcagcctcatgcttaatatcaagatccagagacccgaggcctccgagccgtcgcagtctaccccgccgccgccgccgcagcagcagcagacgacgcctcctgagacgaaggcgagggaggttgagccggagccagagccagagccgatggatttgactgatgaggaaaaggaacggaaggagaggaaagcagctgctcagaaggagaaggaagcaggtaacgcagcttacaaaaagaaggactttgagacggcgatccagcattacaccaaagccttggagcttgacgacgaggatatttcctatctgaccaaccgagcagcagtctacattgagatgggaaagtacgatgaatgcattaaggactgtgatcaggctgtggagagggggagagaacttcgtgctgatttcaagatgatctcaagggcactgacaagaaaaggaactgctctagtcaaacttgctaagagctctaaggattttgatattgccattgagacctttcagaaggctctaactgagcaccggaatccagacacacttaaaaagttaaatgaggctgagaaggcaaagaaagagttggagcaacaagagtactatgatccaaagttagctgatgaggagagagagaagggtaacgagttcttcaagcagcaaaaatacccagaagcaataaaacattacacggaggctcttaggagaaacccaaaggatcctagggtatacagcaatagagctgcgtgctacaccaagttaggagccatgcctgaaggtcttaaagacgcagagaagtgtcttgagctagatcccaccttcagcaaagggtacacacggaaaggtgcaattcaattcttcatgaaggaatatgacaaggccatggaaacctaccaggctggcctaaagcatgatcctaataaccaggaactgcttgatggtgttaggaggtgtattgaacagatcaacaaggccaacagaggagaaataagccaggacgaattgcaagaaagacagaataaagctatgcaagacccagaaatccagaacatccttacagatcctatcatgcgacaggtgctaattgatttccaggagaaccccagggccgctcaggagcacctgaagaaccctggagttctgcagaagattcagaaactcgtaagcgctggaatagtccagatgagataatgatgcgattgtacccacctgtttgtgtcttgtgctgggcttgttaattcacatgcccccgttcgtatctttcaaaaatgtagccgcggcaaaggttcatcaacttattgggggctagtgtcgtcctcttcccattggattgtaagggcagttgtcattggattattcatgtttgtggtgctgagttataggcgacgtcgttttttcttgatcctaatcatacatcgccaccctacatgaaccggagctgggttccgcagaatttgtaacaaacagcaagtccctgctttgatggcatattccaatccgccatccgtatcgttttttcttgatcctaatcatactgtagcaatttagtgtctaatcataatcataatttaattagg

SEQ ID NO: 3271 - DNA, 2169 bp, Panicum virgatum
ctccgtggcggcggaaccttcgagaactcttgagaattaggggatccaacgccgcggggctcctcccagttttataaaatctcaactgggctctcccccttaatccccatcaaacccccagacttttccgccagcgccatcctcagccagccgccaagccttcgagaaccctccggagctcgctcgatccgatcggacccggcgcgggctgccgccatggccgacgaggcgaaggccaagggtaatgcggcgttctccgccggccgcttcgaggaggcggcgcggcacttctcggacgccatcgcgctcgccccgggcaaccacgtcctctactccaaccgctccgccgcgctcgcctcgctccaccgctactcggacgcgctcgccgacgcgcagaagaccgtcgagctcaagcccgactgggccaagggctactcgcggctcggcgccgcgcacctcggcctcggcgacgccgccagcgccgtcgccgcctacgagaaggggctcgcgctcgaccccaccaacgagggcctcaaggcggggctcgaggacgccaggaaggccgccgccgccccgccgcgccgcgggccgtccgggcccgacgccatcggccagatgttccagggccccgagctgtggagcaagatcgcggccgaccccaccacgcgcgcctaccttgaccagccagactttatgcagatgctgcgcgaggtgcagaggaacccaagcagcctcaacatgtacctctccgatccccgcatgatgcaggtgctcagcctcatgcttaatatcaagatccagagacccgaggcctccgagccgtcgcagtctaccccgccgccgccgcagcagcagcagcagacgacgcctcctgagacgaaggcgagggaggttgagccggagccagagccagagccgatggatttgactgatgaggaaaaggaacggaaggagaggaaagcagctgctcagaaggagaaggaagcaggtaacgcagcttacaaaaagaaggactttgagacggcgatccagcattacaccaaagccttggagcttgacgacgaggatatttcctatctgaccaaccgagcagcagtctacattgagatgggaaagtacgatgaatgcattaaggactgtgatcaggctgtggagagggggagagaacttcgtgctgatttcaagatgatctcaagggcactgacaagaaaaggaactgctctagtcaaacttgctaagagctctaaggattttgatattgccattgagacctttcagaaggctctaactgagcaccggaatccagacacacttaaaaagttaaatgaggctgagaaggcaaagaaagagttggagcaacaagagtactatgatccaaagttagctgatgaggagagagagaagggtaacgagttcttcaagcagcaaaaatacccagaagcaataaaacattacacggaggctcttaggagaaacccaaaggatcctagggtatacagcaatagagctgcgtgctacaccaagttaggagccatgcctgaaggtcttaaagacgcagagaagtgtcttgagctagatcccaccttcagcaaagggtacacacggaaaggtgcaattcaattcttcatgaaggaatatgacaaggccatggaaacctaccaggctggcctaaagcatgatcctaataaccaggaactgcttgatggtgttaggaggtgtattgaacagatcaacaaggccaacagaggagaaataagccaggacgaattgcaagaaagacagaataaagctatgcaagacccagaaatccagaacatccttacagatcctatcatgcgacaggtgctaattgatttccaggagaaccccagggccgctcaggagcacctgaagaaccctggagttctgcagaagattcagaaactcgtaagcgctggaatagtccagatgagataatgatgcgattgtacccacctgtttgtgtcttgtgctgggcttgttaattcacatgcccccgttcgtatctttcaaaaatgtagccgcggcaaaggttcatcaacttattgggggctagtgtcgtcctcttcccattggattgtaagggcagttgacattggattattcatgtttgtggtgctgagttataggcgacgtcgttttttcttgatc

SEQ ID NO: 3272 - DNA, 2001 bp, Hordeum vulgare
tccgccagccgattccaatccgtcggtctccacatcccgatcggtcgcaacccaagcggaagcagccagccggcccaatcgcggcgatggcggccgacgaggccaaggccaggggcaacgcggcgttctcggcgggccgcttcgaggaggcggcgggccacttcggggacgccatcgcgctcgcccccgacaaccacgtcctcttctccaaccgctcggcggcctacgcctcgctcggccgctacaaggaggcgctcgccgacgccgaccgcaccgtcgcgctcaggcccgactgggccaagggctactcccgcctcggcgccgcgcgcctcgggttgggggacgccgcgggcgccgtcgaggcctatgagaaggggctcgccctcgagccctccaacgcggccctcaaggacgggctcgcccaggcccgctcggccctcccgcgccgcccggcctccggcgccgacgccattggcaatattttccagagccccgacctctggagcaagatcgccgccgacccctccacccgcgcctacctcgaccagcccgacttcatgcagatgctgcgcgatctgcagcggaaccccggcaacctcaacaactacctctccgacccccgcatgttgcaggtgttcagcctcatgcttaacgtgaaggtccagaaccagaacaatggggcttccgagcccaaatcgccggcgccggcgcccttcaagtcgtccccgccgcctccacagcagcaacagaagcagcccgaggccaagccgagggagccggagcccgaaccggtggagatgaccgatgaggagaaggagcggaaggagaggaaggcggcggcccagaaggagaaggaggcggggaacgccgcttacaaaaagaaggatttcgagacggcgatccagcactacacaaaagccatggagcttgacgacgaggacatctcctacctcactaaccgcgccgccgtttaccttgagatgggacagtatgatgattgcattaaggattgtgacacggctgttgagaggggaagggaacttcgtgctgacttcaagatggtctcgagggcactgacaaggaaaggaactgctcttgccaaacttgccaagtcttccaaagactacgatgttgccattgagaccttccagaaggctctaacggagcatcgaaacccagacaccctgaaaagactaaatgatgctgaacgagcaaagaaggagctcgagcaacaagagtactacgatccaaaactggctgatgaggagcgagagaaaggtaacgagttctttaagcagcaaaaatacccagaagcaattaagcattacaccgaagcgctcaggagaaacccaaaggatcccaaggtatacagcaacagggctgcctgttacaccaagctgggtgccatgcccgaaggtctcaaggatgccgagaagtgcatcgagctagatcccacattctccaagggatacaccaggaagggcgcgatccagtttttcatgaaagagtacgacaaggcgatggaaacttatcaggaaggcctgaagcatgatccgagtaaccaggagctgctcgatggtgtaaagagatgtattcagcagatcaacaaggcgaacagaggcgagctcaccccggaggaactgaaggagagacagggcaaagctatgcaggaccctgaaatccagaacatcctgacggaccctgtgatgcggcaggtgttgattgatttccaggagaatcccaaggctgcgcaggagcatctcaagaaccccggcgtgaagcaaaagatccagaagctcgtgagcgcagggatagtccagatgaagtagaccaaggctgaggagtgtcggagtttagttagttgatcgtggaaaaacattgctgtgagctttttcatgtgatgcagtacattgggggttaatttgcctccagatttgggtttgtgtaaaagtacatttcgtggttgttcttaaatggcttgcatgtgatgtgatactctct

SEQ ID NO: 3273 - DNA, 2398 bp, Panicum virgatum
cccccagacttttccgcgagcgccctcctgacctccggccttcccagccgccaagccttcgagaaccctccggagctcgctcgatccgatcgcaccccgcgcgggctgccgccatggccgacgaggcgaaggccaagggtaatgcggcgttctccgccggccgctacgaggaggcggcgcggcacttctcggacgccatcgcgctcgccccgggcaaccacgtcctctactccaaccgctccgccgcgctcgcctcgctccaccgctactccgacgctctcgccgacgcgcagaagaccgtcgagctcaagcccgactgggccaagggctactcgcggctcggcgccgcgcacctcggcctcggcgacgccgccagcgccgtcgccgcctacgagaaggggctcgcgctcgaccccaccaacgagggcctcaaggcggggctcgaggacgccaagaaggccgccgccgccccgccgcgccgcgggccgtccgggcccgacgccatcggccagatgttccagggccccgagctgtggaccaagatcgcggccgaccccaccacacgcgcctaccttgaccagcccgactttatgcagatgctgcgcgaggtgcagaggaacccaagcagcctcaacatgtacctctccgatccccgcatgatgcaggtgctcagcctcatgcttaacatcaagatccagagacccgaggcctccgagccgtcacagtctaccccgccgccgccgccgcagcagcagcagcagacgcctcctcctgagacgaaggcaagggaggttgagccggagccggagccagagcctatggatttgactgatgaggaaaaggaacggaaggagaggaaagcagctgctcagaaggagaaggaagcaggtaacgcagcttacaagaagaaggactttgagaccgcaattcagcactacactaaagccttggagcttgacgatgaggatatttcctatctgactaaccgagcagcagtctacattgagatgggaaagtacgatgaatgcattaaggactgtgataaggctgtggagagggggagagaactccgtgctgatttcaagatgatctcaagggcactgacaagaaaaggaactgctctagtcaaacttgctaagagctctaaggattttgatatcgccattgagacctttcagaaggctctaactgagcaccggaatccagacactcttaaaaagttaaatgaagctgagaaggcaaagaaagagttggagcaacaagagtactatgatccaaagttagctgatgaggagagagagaaaggtaacgagttcttcaagcagcaaaaatatccagaagcaataaaacattacacggaggctcttaggagaaacccgaaggatcctagggtatacagcaatagagctgcatgctacaccaagttaggagccatgcctgaaggtcttaaagacgcagagaagtgtcttgagctagatcccaccttcgcaaaagggtacacacggaaaggtgcaattcaattcttcatgaaagaatatgacaaggccatggaaacctatcaggctggcctaaagcatgatcctaataaccaggaactgcttgatggtgttaggaggtgcattgaacagatcaacaaggccaacagaggagaaataagccaggacgaattgcaagaaagacagaataaagctatgcaagacccagaaatccagaacatccttacagatcctatcatgcgacaggtgctaattgatttccaggagaaccccagggccgctcaggagcacctgaaaaaccctggagttatgcagaagattcagaaactcataagcgctggaatagtccagatgagataatgatgcgattgtacccacctgtttgtgtcttgtgctgggcttgttaattcacatgccccgttcgtatcttccaaaaatgtagccgtggcaaaggttcatcaacttattgagggctagtgtcgtccttttcccattggagtgtaagggcagttgacattggattattcatgcttgtggtactgagttataggcgacgtcgttttctattgatcatcctaatcgtacagtcttgctacatgaacggatgaaccggagctgggttcggcaggatctgcaacaaacagcaagttcctgctttgatggcatgatccaatcagccatctgagccaggggacaaggttgaatgtgtatgtattcaaggttgcggtggaccagcctgatagcctgaatgttttggtgcgctggaaacatgcgagggcaaattgtccggcatggaggaggctgccggagtggccgctaggggtggtaatagccatgctctcttcgcaattctacttggtacttaatctttttatagtttaagattagagctcgggtttgcc

SEQ ID NO: 3274 - DNA, 5369 bp, Oryza sativa
tccttctatagatgaccacataacatctgcatgatgcaataaattaaatagtttttaccatttatagtattatcttcagatttgattattaaaacatttgccaccgaaagttctacaagaatgtacgaaaaaaccacaaacggcattgtgtgcaatatgtaattctttacatttctaaagatatgtgaagctacctgtcttccatccaagaaacgctgtataggtcacctaagcaggtgatgtactcggaaggaggcgatggttccattcctgggcagtacgtcccccaactactctcttctgcattagacgctgttgtgacataaatattaaggtcctctggcatcaaaccttcgaaaatactgccactttcacacgcttctacatatataacctgcacaaatatattgcttattccatccaaggaggctcttccacaaataagtaaccaagaaaaatcttaccattttagcgtaagtattggaggcatgtttttcttgtaacaccttcatgaagtcagcagcataaagatatggcagattgggcataccaagaactccaggacccccatgatcagagtagaagataaatatgtggtcatttggtttgctatctatgaccttcctactacccccagtaactgcagttttattgcccaagagaaccgcgtaaaagttttttgcagtgacttcgtctccagtgtaatcctggaattatagagtgtgttatcttcatcaaacttagagaaaaaggtcaatatatatgttatgcacttgtgccatgtacacgcaaatctgaagccacctgaagctaataaagaagtgcaaaagggtaaataattggacataagaccctaacagtcctctctccagcccgaggaacgaataacagtgaggcagtacggcatcgtgtaataccttcggaactcctgcataaacatcttcaccctgtggatgattgacaataacccctggtctcgggttaagtatattattggcaatgtcgtcatacataaacacgacaatgttctcctcctttagccctcccttccgtaatatctggtatgcatggcatacatcagcctgcaaagtgcaaacacacccaaaaaaaaaaaaacatcaaacctcaagcaaacagtccttggagaaataaaccatttgttggtctcaattccttctaaatttgaaacgaaacaatataaatacaaacttgctatgagcctgtctctttctgctacatatatttcagtaaaaattaatcactgaagtattagccactaaatatttcagctgatatttctttcgtattaaattgatccctccattttaaactcatcatatgttgtgccattttttttctcaatctgtcttaaacatggatattactagaacttagaacccagaaaaaattgaaaacttcaaattcgtttgcttatccagaattatattgctgctcacgccattttcttccttgaaatgagtctaggcatcagtctgttgaacttcctgacaaaaagactaagtacaacttggatagcgatgtgtgcaaatcatgctgagattgaactactagcactctgcagtccgcacacactcacatgatcaaacgtacatagatcaaggcgcatcgtcaggggtttgacaccatcgcaaccttggtagcatggacaatttggaaggagagaaacaatagagttttcaatcaaaccagcagatcttgggtggacatcgctcgggccatgacaggcgaagctgatctttgaaggctggctagggcagccattcctagcgtagtaatccatgcggatagggaggggtcgccaaatgattttggagattaggctttagtactcttgatcctctcctgtatcccatccccatcttgttttgcttttgttcccgccttatacataaactttatttcttcttaatacaatgatgtgctccttgcgcattcccaaaaaaaagatcctggggctgctttcagtagttcacttctcatcaagcccaaatcgttaacttattgctcagttaatttctttttttttgacggaaaattgctcggttaatttcagtactgaaggcaaaccttttcgttttcaaaagctaaaaaccgaaaattttggagcattgaagtactcatggcacgacaaattgaacatataaatctttaaattcatgaatactaaagatctcgttacgaatgatctgaacgactttcagaaacggctgcccatagctacacagcctcacagcagttccacgctgcatcatcatccaagccccccaaatcgagctccagacgcgcacgaactaagcgacggcgaagccgacgacactggagtactggacccgtgcgcttacctggtgcctgtagttaccgtagccggaggagcccgcgacgagcaccgcccacctcgtcccgacgccgtccttctcctcctcctcggtgccctcgctgccgcgcggcacggtggccacctcctcctccaccacctcccccggcatccgaatcaccggctcccacgtccgcttggctccggcccccgccgcggccgccgacagcgccaagagcaacgcgaagcaccaccgcgccgccatatccctcccctcttctccgcgcgcgacaataccacgcctacgactctacgggacaccgaggtggttgaagggaagcaccgaagtaggcgccgcgccatgccgccatgcaaggagggtagcctgcggcgcggacgcgtggggcgtgaggtggacaggtggcgccgccgccgcttcgtcgtcttctgcagccacggcaaccgccgcccgccgcctcggcgtgcgtggcccagcccaactaaaacaagtcaagccgcgaagttaacacgggccggaccaactgatgagaaaccagcccagcccacattggagactgtacggcggacaaagcggagagttacatcacgctaaagagttcgcttccatgaggagaaagcgtaataagcgttaatagtactaagcggaagcttcgagaacccttgagagagatccgacggcccacgccacgccgcaacaatcatagtggtcgccgattttataaaacttcatcttctccgagaccttaatcccccatctaaccccagacttttcctcccctcctccctctcctccggccccgccgccagagcccttccagaagcttccggagcccgcgccgccgatctgatcgccgccgcgtgccatggccgacgaggcgaaggcgaagggtaatgcggccttctcggccggccgctacgaggaggcggcgcggcacttcactgacgccatcgcgctcgccccggggaaccacgtcctctactccaaccgctccgccgcgctcgcctcggtccaccgctactccgaggcgctcgccgacgccgagaagaccgtcgagctgaagcccgactgggctaaggggtactcccgcctcggagccgcccacctcggcctcggcgacgccgcgagcgccgtcgccgcctacgagaagggcctcgccctcgaccccaccaacgagggccttaaggccggcctcgccgatgccaagaaggcggccgccgccccgccgcgccgcccgccgcccagcggcgttgacggcataggccagatgttccaggggcccgagctctggaccaagatcgcctccgacccgaccacgcgcgcatacctcgagcagcccgacttcatgcagatgctgcgggatgtgcagaggaaccccagcagcctcaacatgtacctctccgatccccggatgatgcaggtgctcggcctcatgcttaacatcaagatccagagaccagaggcctctgaatcgtcgcagcccagctcgtcgccgccgtcgcagccgcaggagcagcccgaggcgaaggcgagggaggtggagccagagcctgagccggagccgatggaggtgaccgatgaggagaaggagcggaaggagaggaaatcgtctgctcagaaggagaaggaagcggggaacgcagcttacaagaaaaaggacttcgagaccgcgatccagcattacacaaaagccatggaacttgatgatgaggacatttcctatcttaccaaccgtgcagcggtctacattgagatgggaaagtacgatgaatgcattaaggactgtgataaggctgtggagaggggaagggaacttcgtgctgatttcaagatgatctcaagggcactgacaagaaaaggaacagccctagccaaacttgctaagacctctaaggactatgacattgccattgagactttccagaaggctctaactgagcatcggaatccagacactctaaaaaagctaaatgaggctgagagggcaaagaaagagttggagcaacaagagtactatgatccaaagttagcagatgaagagagagagaaaggtaatcagcttttcaaggagcaaaaatatccagacgcggtaaagcattacactgaggctatcaggagaaatcctaaggacccgaaggtgtacagcaatagggctgcatgctacaccaagttgggagccatgcctgaaggtcttaaagatgcagagaagtgcattgaactagatcccaccttctccaaagggtatacaaggaaaggtgcaattcagtttttcatgaaagaatatgacaaggcaatggaaacttaccaggccggtttgaagcatgatccgaataacccggaactgctggacggtgtgaaaaggtgtatcgaacagatcaacaaggccaacaggggtgatttgactcaggaagagattcaggaacgacagaacaaggctatgcaggatccagagatccagaatattcttacagatcccatcatgcgacaggtactggtcgatttgcaggagaaccctagggcttctcaggagcatcttaagaaccctggagtgatgcagaagattcagaagcttgtaagcgctggaatagttcaaatgagatagtcgaccaaagcaagaagcgctgttcgtgtctatgttcattgctccttactttttttccatgctcagtctttgtggacttaagatttacacagtttggggctaatcttcattctcaattggattatgtgagtgcagcgtgtcactggattattagtggttatggcatccgtgctacagctgcacgtgcaaacgtatgtctctatttgttagtcctaaacattttccctaccgaatgaaaatagagccataagaggtgcagaaatagtcgattgcttttatttactgggtctagtaaagtgcatatattcgagcgttcaattttttatcggttttggtcatgggtctggccattccttaatttttcaggtttcatttgtgattgccgaacatgatctgcgttttgaatctctagc

SEQ ID NO: 3275 - DNA, 2346 bp, Setaria italica
tcggctactccgtggcggaaccttcgagaactcttgagagttgaggatccaacgccgctgggctcctcccagttttataaaatctcgccttaatccccatcaaagccccagacttttccgctagcgccctcctccggccctccccagccgccaagccatctagaaccctcctccggagctcgatccgatcggacccggcgcgggctgctgccgccatggccgacgaggcgaaggcgaagggtaatgcggcgttctcggccggccgcttcgaggaggcggcgcggcacttctcggacgccatcgcgctcgccccgggcaaccacgtcctctactccaaccgctccgccgcgctcgcctcgctccaccgctactccgacgcgctcgccgacgcgcagaagacggtcgagctcaagcccgactgggccaagggctactcgcggctcggcgccgcgcacctcgggctcggcgacgccgccagcgccgtcgccgcctacgagaaggggctcgcgctcgaccccagcaacgggggcctcaaggcggggctcgaggacgccaagaaggccgccgccgccccgccccgccgcgggccgtccgggcccgacgccatcggccagatgttccagggccccgagctgtggagcaagatcgcggccgaccccaccacgcgcgcctaccttgagcagcccgactttatgcagatgctgcgcgaggtgcagaggaaccccagcagcctcaacatgtacctctccgatccccgcatgatgcaggtgctcagcctcatgcttaacatcaagatccagagacccgaggcctccgagccgtcgcagtctaccccgccgccggagcagcaccagcaacagcaggcgccgcctcctgagacgaaggcgagggaggtggagccggagccggagccagagccgatggatttgactgatgaggagaaggaacgcaaggagaggaaagcagctgctcagaaggagaaggaggcaggtaacgcagcttacaagaaaaaggactttgagacggcgatccagcattacaccaaagccttggaacttgacgatgaggatatctcctatctgactaacagagcggcagtctacattgagatgggaaagtatgatgaatgcattaaggattgtgacaaggctgtggagaggggaagagaactccgtgctgatttcaagatgatctcaagggcactgacaagaaaaggaactgctctagtcaaacttgctaagagctctaaggattttgatgtcgccatagagacctttcagaaggctctaactgaacatcggaacccagacactcttaaaaagttaaatgaggctgagagggcaaagaaagagttggagcaacaagagtactatgatccaaagttagctgacgaggagagagagaaaggtaatgagttcttcaaggagcagaaatacccagaagcaataaagcattacacggaggctctcaggagaaacccgaaggatcctaaggcttacagcaacagagctgcctgctacaccaagttaggagccatgcctgaaggtcttaaagatgcagagaagtgtctcgaactagaccccaccttcaccaaagggtacacacggaaaggtgcaattcaattcttcatgaaagaatacgacaaggccatggaaacctatcaggctggcctaaagcttgatccgaataaccaggaactgcttgatggtgttaggaggtgcgttgaacagatcaacaaggccaacagaggtgaaataagccaggacgaattgcaagagagacagaataaagctatgcaagacccagaaatccagaacatccttacggatcctattatgcgacaggtgctaattgatttccaggagaaccccagggccgctcaggagcacctgaagaacccaggagttatgcagaagattcagaaactcgttagcgctggaatagtccaaatgagataataagaacgatgcggctgtgcacacctgtttgtgccattgtgctgggcttgttaatccacatgcccccggtcatatatctttcaaaaatgtagccgtggcagaagaatcaagttattggggggctagcgtctttttccctattggattgttgacattggattattcatatttgtggtactgaattataggtggcgacgtgttttcttatcctaagcatttcactcctgctccatgaaccgaaggtgggtgctagtctgctagagtagttgtagtcttgtagaaccatttccttctagccaatcaatagcaaagttcctgcttagatggcatatatgttcgtgttccctttatagctttatatactctgctgccttccatttcatgcgat

SEQ ID NO: 3276 - DNA, 1245 bp, Saccharum officinarum
cccacgcgtccggacagatctgtccgatctctctcccgagtccactccaagccttttcctccgccttctcgcgatggcgccgccgcgccgcgctctccttgccctcgccgctctcctcctcctctccctctcccttgccgccgccgccttccagtccgacgagctcctcctcaacgacgacgacgagttcgagggcgtcggcgcccgcccctccgctccctccccgccggcggccccggcggtctcctcttcccgccgcagatccgcggacgcgccgttgcccggggcaggcgagtccaacgcagtgcagttcacgctcgagcacgaccttggcggcggcaagggcttcgtcccagctggaaccttctcggcccgactcaagaccttcgcccacggcacgcagaccctcactaagcttcgctttacaaggaatgatttaactgaggatgataaagtggcgttcaaaaaactgctccaggaagatggcttttatacaattaggctgccatctaatgtgttggacactacaaagaaacataatgttgtttcttcaatcaaagctagatgcattccacgtgacagtttggatgaacacattgttatccacatggatggtgtaaatattttggcagtcaattatggctctgttggtggatgccaataccctaggccaatgaaattgccatcaaaatggacattcagctcttacactatcctaaagactgctgaacaggcaccaagaaccccatcatttgcagatcagttaatagaagctgacaatggtcttggcgaagtaatgaaaccacctgagaaatctttctgggctaaatattggatgtacatcattccgcttggtcttatagtcatgaatgctgttacggcagctgccaacataccagaggaagctgcaggccagggccaacctggagcacaacgggcacctgctgctgctgccgggaggagaagatgatggctacctctatgtttttccatactattgaacctgtctacctggccagaagaactggagctgatacttacacgactcatcatacaacagtgcactgatcggctttctttcttttccctggctgtattgagctgctctgtttatagcagaatcaccttcaatggtgtggttaaacacatttgttgttgattaatcaatctttaacacagttcgaattgtatgttttgatattaagtaagtttgatatatgaaatttgaatgctggatgcattatt

SEQ ID NO: 3277 - DNA, 1341 bp, Sorghum bicolor
taaaattgatttttttggcatgaaaacctcgaccgatctgtccgactccgatctctctccgagtccactccaagccttttcctccgccttctcgccatggcgccgccctgccgctctctactcgccctcgccgctctcctacttctctctctttcccttgccgccgccgccttccagtccgacgagctcctcctcaacgacgacgacgagttcgagggcgtcggcgcccgcccctccgttccctccccgccggcggccccggcgatctcctcctcccgccgcagatccgcggacgcgccgttgcccggggcaggcgagtccaacgcagtgcagttcacgctcgagcacgaccttggcgacggcaagggcttcgtcccagctggaaccttctcggcccgcctcaagaccttcgcccacggcacgcagaccctcactaagcttcgctttacaaggaatgatttaaatgaggatgataaagtggctttcaagaaactgcttcaggaagatggcttttatacaattaggctgccatctaatgtgttggacactacaaagaaacataatgttgcttcttcaatcaaagctagatgcattccacgtgacagtttggatgaacacattgttatccacatggatggtgtaaatattttggcagtcaattatggctctgttggtggatgccaataccctaggccaatgaaattgccatcaaaatggacattcagctcttacactatcctgaagactgctgaacaggcaccaagaaccccatcatttgcagatcagttaatagaagctgacaatggtcttggcgaagtaatgaaaccacctgagaaatctttctgggctaaatattggatgtacatcattccgcttggtcttattgtcatgaatgctgttacggcagctgccaatataccagaggaagctgcagggcagggccaacctggagcacaacgggcacctgctgctgctgccgggaggagaagatgatggctgcctctatgttttcccataccacagattcaggggtaatggtaggagattgaacctgtctgtacctggccagaagaactggagctgtacttacacgactcatacaatagtgcgctgatgggctctttctttcttttccctggttgtattgagctgctctgtttatagcagaatcaccttcaatggtgtggttaaacacatttgttgttgagaagctgcaatcaatctttaacacagttcaaattgtatgttttgatattaagtagtttgatatacggaatttttgtgctggatgcatagttagatcacccttatttcgtaataacgtaagttgtttccatggcc

SEQ ID NO: 3278 - DNA, 1513 bp, Panicum virgatum
gcccaacctagtatccagccagccgttggcccaagccctgcccggccctagaccgccgatgtccatgcgtgtccgtgaaaatctccccgatctctcgcccaagtccactccaagcctcgccgtccgcctccgccctctcctcgcccgccatggcgccgccgcgccgcgctctcctcgccctcgcggccctcctcctgctctccctctccctcaccgccgccgccttccagtccgacgagctcctcctcaacgacgacgaggagttcgagggcgtcggcgcccgccccgcctccccctccccttccccgccggcggccccggcggtctcctcctcccgccgccgatccgcggacgcggcgtcggcgggggccggagagtccaacgccgtgcagttcgccctcgagcacgacctcggcgccggcaaggggttcgtccccgccggaaccttctctgctcgcctcaagacctccgcccatggcacgcagactctcacaaagcttcgctttacaaggaatgagttgactgaggatgaaaaagatgcatttaaaaaattgcttcaggaagatggcttttatacaattaggcttccatctaatgtgttggactctacaagaaaaaacaatgttgtttcctcaatcaaagctagatgcattccacgtgacagtttggatgaacacattgttatccatatggatggtgtaaatgttttggcagttaactatggttctgttggcggatgtcagtacccacgtccaatgaaatttccatcaaaatggacattcagctcttatactattctgaagactgctgaacaggcaccaagaaccccatcatttgtggaccagttattagaagccgacaatggacttggtgaagtgatcaaaccacctgagagatctttctgggctaaatattggatgtacattattcctcttggtctcattgtcatgaatgctgttacggcagcagcaaacataccagaggaacaagcagcagggcaggggcaacctggagcacgagcaccagctgctgctgcaaggagaagatgattgctgttatgttttttaatttttgccatgtcatagattaatggtgattggacaggagacgaacatttgtttgcattgacgttgccagaaggaaaactggagctacacctacatgagtcataggattgcttggtgaaggctccctacttttagctagtattgagaagttcgccattagcatattggccatacatggtgcggttgaacactctggtggatacaaactgcaaatcaaactttaaccagtgcaagctgtatttgttgatgtcaagtggccgttatttgtccattttgaatcctgtatgtgtttcttacagagcatccttattttgtactaatggaagttgttatttgattagccaatttatgatgttttgtagctagcaaatatatttacacgtattagacatgactattgttagatggttagcaatttcatttggatcgataaaatagacctcttc

SEQ ID NO: 3279 - DNA, 1861 bp, Setaria italica
cccatgcgtccatgaaaatctcaccgatctgtctgatctctcgcaagtccactccaagcctcgccgtcctccgccgccctctccctctcctcgccatggcgccgccgcgccgcgctctcctcgccctcgcggccctcctcctcttctccctctacctcacagccgccgccttccagtccgacgagctcgtcctcaacgacgacgaggagttcgagggcgtcggcgcccgcccgtcctccccctcccagccggcggccccggcggtcccctcctcccgccgccgatccgcggacgcggcgtcggcagcggtcggcgagtccaacgccctgcagttcacgcttgagcacgacctcggcgttggcaaggggttcacccccgccggaaccttctccgctcggctcaagacctccgcccatggcacgcagactctcacaaagcttcgcttcatgaggaatgagttaactgaggatgataaagatgcattcaaaaaattgcttcaggaagatggcttttatacaatcaggctgccatctaatgtgttggaccctacaagaaaagacaatgttgtttcctcaatcaaagctagatgcattccacgtgacagtttggatgaacacgttgttatccacatggatggtgtaaatattttggcagttaattatggttctgttggtggatgccaatacccacgacaaatgaaatttccatcaaaatggacattcagctcttatactattttgaagactgctgaacaggcaccaagaaccccatcatttgtggaccagatgttagaagctgacaatggacttggtgaagtgatgaaaccacctgagaaatcattctgggctaaatattggatgtacattattcctcttggtctcattgtcatgaatgctgttacggcagcagcaaacataccagaggagcaagctgcaggccagggccaacctggagcacaacgagcatccgctgctgctgcaaggagaagatgattgttgtttctatgtgttttcggtgtcagatcaatggagaatgaacaggagacagctcgtacaatagcatggtgaccggatcccattctgtactgagaagtttcccattagcatagtggcctttgaagctgcagttgaacactcatttgttggtagcaactttaaccagtgcaacctgtatttgatgatgtaaagtgactttatttgtccattttgaatcctatgtgttgtttatagatcatccttattttgtaccgatcgaagtggtcacttgattagccaatattctcgtgtttctcgagtgccacatggacattgctgtatgaagctgcgcaaactgtggcaagatgttttgtagctaccaaatatatgtacacgtattagacatgacattgtgagagtttgcaatttcatatggatcaaggaaaaaggctcttcaaaatagacacggcaagtttagtcctggcaactggtgtacctcaattttcctaaatagattggatagacgcaaaataaattggcattactacgtatttagcctgaaattataacaagaaatcatcgaagctgcaacaagttttagccttccatcatcaaaaattcaaaatagcaaattcagtagccaaacgttgctgaacttattgcagctgttctgaacttgaatatagactattcctgaacccctcaaaactctgaagggcacctagaagtgcttcaaacaacgcaaaccaatatctgcggccaaagatgcaaaggaaaatgaggaagaattgctacaggaaattgcaagaagactgcaagaggggaactcccaatctttttgcaaagagaagtcctgcttgccaaatgccaattgcagatggacgggg

SEQ ID NO: 3280 - DNA, 1273 bp, Pennisetum glaucum
gcccaagtccactccaagcctcgccgtcttccgccgcgctcttcctctcctcgccatggcgccgccgcgccgcgctctcctcgccctcgccgctctcctcctcttctccctctacctcacatccactgccttccagtccgacgagctcgtcctcaacgacgacgaggagtttgagggcgtcggcgcccgcccctccgcgccgtccccgccggtagccccggcggtctcctcctcccgccgccgatcggcggactcggcgtcaccaggcgccggcgagcccaacgccctgcagttcacgctcgagcacaacctcggcggcggcaaggggttcacacccgccggaatcttctccgctcggctcaagacctcagcccacggcacgcagactctcacaaaacttcgcttcacgaggaatgagttaactgaggatgacaaagatgcatttaaaaaattgcttcaggaagatggcttttatacaatcaggttgccatctaatgtgttggaccctacaagaaaagacaatgtggtttcctcaatcaaagctagatgcattccacgtgacagtttggatgaacacattgttatccacatggatggtgtaaatattttggcagttaattatggttctgttggtggatgccaatacccacgaccgatgaaatttccatcaaaatggacattcaactcttatactattttgaagactgctgaacaggcaccaagaaccccatcatttgtggaccagttgttagaagctgacgatggactcggtgaagtgatgaaaccacctgagaaatcattctgggctaaatattggatgtacatcattcctcttggtctcattgtcataaatgctgttacggcagcagcgaacataccagaggagcaagctgcaggccagggtcaacctggaggacaacgagcacccgctgctgctgcaaggagaagatgattgttttttctatgtttttccggtgtcagatcaatgatgaatgaacaggagacagctcatacagtagcatggtgatcggatcccattccgcattagcatagtggcctttgaagctgcagttacactcatttgttggtagcaactagcaactttaaccagtgcgacctgtatttgctgatgtaaagtgactttatttgtccattttgaatcctatgtgttgtttatgcattgctgtatgaagctgcggaaactgtggcaagatgttttgtagctaccaaatatatttacacgtattaaacatgacattgtgagagttaacaa

SEQ ID NO: 3281 - DNA, 1645 bp, Sorghum bicolor
atttttcaataagatcgagtggaagctttcaagcagctaccttgaagcccatatgctaccaaacaaacctgacgcagcaccttaacctgaaactcctttataatagacccacaaccacacataccaaacctcattccaagctcgatctcttcattcattcattcattcatagtctgcctcccaaaacacctgcctcgcgcgtggcagcaagcacagcacgatgatcaccacagcgcacagccggcagcagcaccatgccttcgagaagagccctggcaacaaccacatgaagagcatcgacaggaagctgcagcaggccatgaatcaagcggccagcaagtacatgcagaggatctaccctctgggcatccagaggagcagctccaacctcacattgtcgtcgctctcgctgtcgcagaactccaacgactcctccatcagcagctccaactccagctgggagcccaaggtgcctctgctctatggcggcaccttcagcccctggggcgaggtgatggtgtcccgggagatgaggcgagaggacgatgacaaggtcagtgaccatgacgtcgaaggaggtgaggaggacttcgactgcagtgaaccagggagcttgcataggtgcagctggatcaccaagaacagtgacgaggcgtacattcagttccacgacgagtgctggggcgtccctgtgtacagcgacaaccggctgttcgagcttctgtcgctgtcagggatgctgatcgaccacaactggacggagatcctgaagcggcgagacatgtacagggaggcgttcgccgacttcgaccccagcgaggtggcgaggatggacgaggacgacgtcgcggagatcagcggcaacagggagctgaggctcgccgagtgcagggtccggtgcatcgtggagaacgccaagtgcatccagaaggtggccagggagttcggctccttcagcggctacatgtggggccacgtgaaccaccggccggtggtgggcaagtaccggcaccacaagtacatcccgttccggacgcccaagtcggaggcggtgagcaaggacctcgtccgccgcgggttccgcctcgtcggccccgtcatcgtctactccttcatgcaggccgccggcatggccatcgaccacctcgtagactgcttccgattccacgactgcgtccgcctcgccgagcgctcctggggcatcaccaacgtcgccgcatagccagccctccggcccctcgtccgtccatggctccaagttttttacacctttttcttggtgttgtttttttttcctttttttttttgtttcgagatccggggtaactcttgaattgtgtgtgaaattatgtagagtatatatgctaagttatgatgtaataagtctattaactctctgccaatgaaaagtagtgctggattagtaggactgcaatgtaactagcttcaggcttctgcaagactgcaacagtagtgataagtcctttgtttgtggcatataaaaaagagattgttgtttgccaaatgcaaatttaagatcttcagttcagcaggtgctttctagataacttgtacaaatttctttttcaaaccaatttcaggcgggccaagttttaccttattgacaaagatggtttgcttcgcc

SEQ ID NO: 3282 - DNA, 1210 bp, Panicum virgatum
cctcttcttagtttgcctcccaaaaaaaaaaacacttagcgcccctcctcgcggcaacacgatgctcaccacagcacacagccggcagcatcatcacgccttcgagaagagccctagcagccacatgaagaacctcgacaggaagctgcagcaggccatgagcaatgcgaccagcaagtacatgcagaggatctaccctctgggcatccagaggagcagctccaacctcacattgtcgtcgctctccctgtcgcagaactccaacgactcctcgctcagcagctccaactccagctgggagcccaaggtgccgcttctgtatggcggcaccttcagcccctggggcgatgtgctggtgtctctggagatgaggagagaggaggacgacaaggccagtgaccacgacgttgaagggggtgaggacttcgattgcagcgagccggggagcttgcataggtgcagctggatcaccaagaacagtgatgaggcgtacgttcagttccacgacgagtgctggggcgtccccgtgtacagcgacaaccgcctcttcgagcttctgtcgctgtccgggatgctcatagaccacaactggaccgagatactcaagaggcgagacatgtacagggaggtgttcgccgacttcgaccccagcacggtggccaagatggacgaggacgccgtcgccgagatcagcggcaacaaggagctcaggctggccgagtccagggtccggtgcatcgtcgagaacgccaagtgcatccagaaggtggccaaggaattcgggtcgttcagcgggtacatgtgggggcacgtgaaccaccggccggtggtgggcaagtacaggcaccacaagtacatcccgttccggacgcccaagtcggaggcggtgagcaaggacctcgtccgccggggcttccgcctcgtcggccccgtcatcgtctactccttcatgcaggcagccggcatggccatcgaccacctcgtcgactgcttccgcttcccggagtgcgtccgcctcgccgagcgatcctggggcatcaccaacatcgccgcgtagccgccggccggccggtcgtcggaggcgtgctcggtcgctcggcgctccatttttttttttttacaccttctggtgtgacttccttcaagtgtgtgtgaactgtaaagtagtacagtaaatgctaagttatgatgtgataattttattctcttt

SEQ ID NO: 3283 - DNA, 1774 bp, Panicum virgatum
gagttatcccctttgagttaccaaagaggcaattattgacaccaagtatcaggaaggaatgagccatgaaaactggaggaccatccatgtagcatgcacccccaatctcaaaccaccaacaatttccactcactaaactatcaaaaccatcacacattttcaataagatcaggtggaagctttcaggcagctaccttgaagcccatatgctaccaaacaagctcaggacgcaacaccttaaccctctcaaccctttataatagacccacagccacacataccaaacctcacaaactcatttcaaaccctcttcttagtttgcctcccaaaaaaaaacacttagcgcccctcctcgcggcaacacgatgctcaccacagcacacagccggcagcatcatcacgccttcgagaagagccctagcagccacatgaagaacctcgacaggaagctgcagcaggccatgagcaatgcgaccagcaagtacatgcagaggatctaccctctgggcatccagaggagcagctccaacctcacattgtcgtcgctctccctgtcgcagaactccaacgactcctcgctcagcagctccaactccagctgggagcccaaggtgccgcttctgtatggcggcaccttcagcccctggggcgatgtgctggtgtctctggagatgaggagagaggaggacgacaaggccagcgaccacgacgttgaagggggtgaggacttcgattgcagcgagccggggagcttgcataggtgcagctggatcaccaagaacagtgatgaggcgtacgttcagttccacgacgagtgctggggcgtccccgtgtacagcgacaaccgcctcttcgagcttctgtcgctgtccgggatgctcatagactacaactggaccgagatactcaagaggcgagacatgtacagggaggtgttcgccgacttcgaccccagcacggtggccaagatggacgaggacgccgtcgccgagatcagcggcaacaaggagctcaagctggccgagtccagggtccggtgcatcgtcgagaacgccaagtgcatccagaaggtggccaaggaattcgggtcgttcagcgggtacatgtgggggcacgtgaaccaccggccggtggtgggcaagtacaggcaccacaagtacatcccgttccggacgcccaagtcggaggcggtgagcaaggacctcgtccgccggggcttccgcctcgtcggccccgtcatcgtctactccttcatgcaggcagccggcatggccatcgaccacctcgtcgactgcttccgcttcccggagtgcgtccgcctcgccgagcgatcctggggcatcaccaacatcgccgcgtagccgccggccggccggtcgtcggaggcgtgctcggtcgctcggcgctccaaattttttttttacaccttctggtgtgacttccttcaagtgtgtgtgaactgtaaagtagtacagtaaatgctaagttatgatgtgataattttattctctttcctccaattacgggcaccggaagcaatcacgcgattcaactgctccgatgtaggggaccacccatcgccgatgcgctcgcgggatgagacgcgattgcgtcgagccggcggccatgggatggcaaggcgggagcaatgaacgtgctgcgtgccatgagtccatgacatgagatgctgcagattctgatgaattggaagcaatccaggaaacatgaaaattgcgaaaaaaagaaaagaaaaaaaacgaaatcctgaggaact

SEQ ID NO: 3284 - DNA, 1333 bp, Panicum virgatum
aaccctcttcgtagtttgcctccaaaaaaaaacacttagcgcccctcctcgcggcagcacgatgctcaccacagcacacagccggcagcatcatcatgccttcgagaagagccctagcagccacgtgaagaacctcgacaggaagctgcagcaggccatgaacaatgcgaccagcaagtacatgcagaggatctaccctctgggcatccagaggagcagctccaacctcacattgtcgtcgctctccctgtcgcagaactccaacgactcctcgctcagcagctccaactccagctgggagcccaaggtgccgctgctgtatggcggcaccttcagcccctggggcgatgtgctggtgtctctggagatgaggagagaggacgacgacaaggccagtgaccacgacgttgaagggggtgaggaggacttcgattgcagcgagccggggagcttgcataggtgcagctggatcaccaagaacagtgatgaggcgtacgttcagttccacgacgagtgctggggcgtccccgtgtacagcgacaaccgcctcttcgagcttctgtcgctgtccgggatgctcatagaccacaactggacggagatactcaagaggcgagacatgtacagggaggtgttcgccgacttcgaccccagcacggtggcgaagatggacgaggacgccatcgccgagatcagcggcaacaaggagctcaagctggccgaggccagggtccgttgcatcgtcgagaacgccaagtgcatccagaaggtggccaaggaattcgggtcgttcagcgggtacatgtgggggcacgtgaaccaccggccggtggtgggcaagtaccggcaccacaagtacatcccgttccggacgcccaagtcggaggcggtgagcaaggacctcgtccgccggggcttccgcctcgtcggccccgtcatcgtctactccttcatgcaggccgccggcatggccatcgaccacctcgtcgactgcttccgcttcccggagtgcgtccgcctcgccgagcggtcctggggcatcaccaacatcgccgcgtagccgccggccggccggtcgtcggcggcgtgctcgctcgctcgctcggcgctccaattttttttttacaccttcttctggtgtcactttcttgaagtgtgtgtgaaatgtagagtagtaaatgctaagttatgatgtaataattttattttctctttaaacttgaaaagttctccagtagtagtactgaaataggggctgcaacaggcttgtgtaacaataaggtttttttctaagatttttttaccaaatattaattcaggttgttgagcttag

SEQ ID NO: 3285 - DNA, 1259 bp, Panicum virgatum
gcccctcctcgcggcagcacgatgctcaccacagcacacagccggcagcatcatcatgccttcgagaagagccctagcagccacgtgaagaacctcgacaggaagctgcagcaggccatgaacaatgcgaccagcaagtacatgcagaggatctaccctctgggcatccagaggagcagctccaacctcacattgtcgtcgctctccctgtcgcagaactccaacgactcctcgctcagcagctccaactccagctgggagcccaaggtgccgctgctgtatggcggcaccttcagcccctggggcgatgtgctggtgtctctggagatgaggagagaggacgacgacaaggccagtgaccacgacgttgaagggggtgaggacgacttcgattgcagcgagccggggagcttgcataggtgcagctggatcaccaagaacagtgatgaggcgtacgttcagttccacgacgagtgctggggcgtccccgtgtacagcgacaaccgcctcttcgagcttctgtcgctgtccgggatgctcatagaccacaactggacggagatactcaagaggcgagacatgtacagggaggtgttcgccgacttcgaccccagcactgtggcgaagatggacgaggacgccatcgccgagatcagcggcaacaaggagctcaagctggccgaggccagggtccgttgcatcgtcgagaacgccaagtgcatccagaaggtggccaaggaattcgggtcgttcagcgggtacatgtgggggcacgtgaaccaccggccggtggtgggcaagtaccggcaccacaagtacatcccgttccggacgcccaagtcggaggcggtgagcaaggacctcgtccgccggggcttccgcctcgtcggccccgtcatcgtctactccttcatgcaggccgccggcatggccatcgaccacctcgtcgactgcttccgcttcccggagtgcgtccgcctcgccgagcggtcctggggcatcaccaacatcgccgcgtagccgccggccggccggtcgtcggcggcgtgctcgctcgctcgctcggcgctccaattttttttacaccttcttctggtgtcattttcttgaagtgtgtgtgaaatgtagagtagtaaatgctaagttcggaaatgatctacatattttgactagagaagtcaaactttataaactttgactaataattagttaaattatatgtataattagtttataaaatttatgtcaatacatatgta

SEQ ID NO: 3286 - DNA, 1359 bp, Pennisetum glaucum
gtttcaaaccctcttcgtagtttttgcctcaagaaaacaccaccagcctgcctcctgcctcgtggcagcagcacacacgatgctcaccaccgcacacagccggcagcaccatgccttcgagaggagccctagcagccacaccaagaacctcgacaggaagctccagcaggccatgaacaatgcggcgagcaagtacatgcagaggatctaccctctggggatccagaggagcagctccaacctgacattgtcgtcgctctcgctgtcgcagaactccaacgactcctcgctcagcagctccaactccagctgggagcccaaggtgccgctgctctatggcggcaccttcagcccctggggcgaagtcatggtgtctctggagatgaggagagaggacgacgacaaggccagtgaccatgacgttgaaggaggtgaggaggatttcgattgcagtgagcccgggagcatgcataggtgcagctggatcaccaagaacagcgatgaggcatacgttcagttccacgacgagagctggggcgtccctgtgtacagcgacgaccgcctcttcgagctgctgtctctctccgggatgctcattgaccacaactggacggagattctcaagaggcgagacatgtacagggaagtgttcgccgacttcgaccccagcacggtggcgaagatggacgaggacgccatcgccgagatcagcggcaacaaggagctcaagctcgccgagtgccgtgtccggtgcgtcgtcgagaacgccaagtgcattcagaaggtggccaaggaattcgggtcgttcagcgggtacatgtgggggcacgtgaaccaccggccggtggtgggcaagtacaggcaccacaagtacatcccgttccggacgcccaagtcggaggcggtgagcaaggacctcgtccgccgcgggttccggctcgtcggccccgtcatcgtctactccttcatgcaggccgccggcatggccatcgaccacctcgtcgactgcttccgcttcccggagtgcgtccgcctcgccgagcgctcctggggcatcaccaacgtcgccgcgtaggggtagccgcgcgcccggccggccgccgtcggtcgacggcgtgcttggtgctttgctcgatcgctcggcgctccaaaaattttacaccatttttttgggtgtgtttcgatttggtaacgctttgaagtgggtgtgaaatatgtagagtatactaagttatggttacggtgtaataattttattttattttttttctctttgcacatgaaaagtacagtggtagtactgaagtaggacagcgacaggcttgtgtaacaataaggttttttgttaagaaaattttt

SEQ ID NO: 3287 - DNA, 1368 bp, Eragrostis curvula
ggcaaagacaaagcaggcttgtgtgaacgcattatttcaaccagcggagggacaggcaccctcttacagtttgcctccaaaaccacccgcctccagggacaatgctcaccacagcacacagcaggcagcaccatgcatttgagaagagccccagccacatgaaaaacctagataggaagctgcaggaggccatgagccatgctgcaggcagcaagtacatgcagaggatatatcctctgggcatccagaggagtagctccaacctcacattgtcatccctctccctctcacagaactccaacgactcctcactaagcagctccaactccagctgggaaccaaaggtgccgctgctatatggtggcacattcagcccctggggtgatgtgcttgtgtctctggagaggaggagagaagatgacaaggttagtgaccatgacgttgaaggtggggaggaagagtttgactgcagtgagccagggagcttacacaggtgcagttggatcaccaagaacagtgatgaggcatacgttgagttccacgacgagtgctggggcgtccctgtgtacaatgacaaccgtctcttcgaattgctggcactgtcagggatgctcatagaccacaactggacagagatactcaagaggagagaaatgtacaggaaagtgtttgcggactttgatcccagcgtggtggcaaagatggatgagaatgatattgtggagataagcggcgacaaggagctcaagctagcagagtgcagggtgaggtgcattgtggagaacgccaagtgcattcagaaggtggcaaaggaattcgggtcattcagcggttacatgtgggggcatgtgaaccaccgaccagtggtgggcaagtataagcaccacaagtacatcccatttaggacacccaagtcagaggcagtaagcaaggaccttgtccggcgaggtttccgcctcgtcggccccgtcatcgtctactccttcatgcaggccgctggcatggtcatcgatcaccttgttgactgtttccgcttcccagagtgtgtacaccttgctgagcgctcatggggcattaccaatgtcgcagcatagccatcagctagttgatggcttgctcgttgttgcaaaaagttttatacattttttgtgttatttttcttttcctttctattggatgtgacaatgcctgaattgtgcactgtgtggagttgtaggacactgctaagttatgtatgcaatgtttcctttttgtcttcccacttgaaaagtagcagtaggactgtaactagtttgcacaggaatatcattttgtctgggccaatttaggcttcatatcagaatagaaacctctgtttccaggcccata

SEQ ID NO: 3288 - DNA, 1807 bp, Oryza sativa
gccaggacacaacacctcaaccttcagaccttataataccccaagaacccacaaccacacattgcaaaaccacccattctccttgaatcttgcctccaaaaactcttgccacttagcattcacaatgctcaccacatcatcacatagcaggcaccaccatgcatttgagaggagccccaaccacagcatgatgaagaacatagcagacaggaacaagcatgatcttcttcagagtgccatgaaccatgcagcaagcaagtacatgcagaggatctaccctctggggatccagaggagcagctccaacctcacactctcatcactctccctgtcacagaactccaatgattcttcactcagcagctcaaactctagctgggagcccaaggtgcccctgctgtatggtggcacatttagcccctggggtgatgtgcttgtgtccctggagaggaggagggaagaagatgatgacaaggttagtgatcatgatgttgaggggggagaagaggattttgattgcagtgagcctgggagcttgcataggtgcagctggatcaccaagaacagtgatgaggcgtacgttcagtttcacgacgagtgctggggtgtcccagtgtacaacgacaaccgtctgttcgagctgcttgcgttgtcaggcatgctcatcgaccacaactggactgagatactcaagagaagagacatgtacagggaagcgttcgcggacttcgatcccagcacggtggcgaagatggacgagaacgacgtcgcggagatcagcggcaacaaggagctcaagctggccgagtgcagggtccggtgcatcatcgagaacgccaaatgcattcagaaggtggcgaaggagtttgggtcgttcagcggatacatatgggggcacgtgaaccaccggccgacggtggggaggtacaagcaccacaagtacatcccgttccggacgcccaagtcagaggcggtgagcaaggacctcgtccgccgcggcttccgcctcgttggccccgtcatcgtctactccttcatgcaggcctccggcatcgtcatcgaccacctcgtcgactgcttccgcttccctgaatgcctccacctcgccgaccgctcctggggcattaccaacgtcgctgcctaatgacaaaaaaaaaaaaaaaaaccttgaacttttctgccgctcgcgagctcgacagtgttgcaaatagcttagctgtgttcattgcatgttgcagcggccagcaaagctgctacactatactaaaatattgggcgaggcgggtgcaccgtagatgcagtagtgcagttgaacaagccgaagacttttggtgtggcaaatcaaacctcaaattcaaattcccccacttgaaaatttctttttgtttggtttttcactctggggattggcgatgcttggatgtattgtgtagtagggtagggctaagtttttttttttttggttgctcactcccacttggaaagtggtgtagtgagttgttagtggatggtttgtaagaataagttaagatttccttctgtttgggcttaactggggtgttgcatgagaatggagcccacaatgaactcacatgttcagcagaataggttgctccatgtgtcaatgggtggcatttctccgaagattcttggtttacattagcccattttgtatgaatattaagtgtttacgtttaccaccccaacaaggaggtgccacaactttctttttagtgctaatttgatatatctcctggtacttaaacattagagaggtattgaaatatggtatctccttaaaaaatct

SEQ ID NO: 3289 - DNA, 2396 bp, Sorghum bicolor
ttttttttttttttttttttttttttgcgcggtctgtcaactaaccagtattctcaaccaggtgctgattgagtgattgatgcagggctagtagctcccaggacggctccagcactccccagttcattctgccaacggtgcctggcgacctgagcgaggagcatgcgagattgccctcctccgtcctcgtcatctccatcgccatcgtctgccgtatggccaagctgggctgcttccccgctctgctccccggcaagaggaagaagacccgcaagatcgccgatgccaacaaggccagcggcaacgaatgtcccaaggtgaagccggtcgagttcaccgacgcgacgcttggcatcgggggatgcgtggagagtgtcgccctcgtgccccgcgacgtgaaggtcgtccccgtggaggaccgcaataaggaagctcatcaattggtgtcggtgaaggggagcgatctgtcaggtttcgacttccacttccacgaggccaacaagtccaacctccgttccgacagtgacgtggcactggacaccgcggtcgaaggtgcggtggcggacccgtcgtcgccgaaactgaagcggtcgtgctccaacatcgagactaagcggcctggctcgcgtgccgcgcccgagatgccggcccggtcgcgctcctacggcgatctgggcaatctgatcaccggcctcgccatggagacgacggcgacgccacacagcgcgccggacccggaggcgagcccggcgtcggtgaagacgtcgcgcaccgccgaccgcgtgatgctgaagaagcggtcgtccagccaggtgctgccctcgcgcagccggaagctctggtggcggctcttcctctggagccaccgcaacctacacaagccgcggtcgccgcgcacggcccaccaagcagcgtgctcgcctggccgccacggcgggtacacctcggacacgttcgaggagggcccggccgctgaccgcaaggacaagaaggtcatggtcgacgactcgccgccaccgtccgtgcccaaccagtgggtagccttctgcgccgagaactccatccacgaccgcatcagcgcgtgggtgagcagcatcgagagcgagcctccgttccacatcgccgaggaggacgacaactacgatggagaagacgacgaggagcacggcggcgagtgtgcgtcggaacggccgcgtcacctcgagctcggggagccatcctcagggaagggcggccacggcaaatccaagcgcagcgcagcggccgacgaggtcgtccaggccaacaccatcgtgcagtccctgaacgccttctcgtcggtggcgcacatctcagggatgggcctcaaggtgatgccgatgatcgcgcccttctcaaccctccgggcagttaacctctccagcaacttcatcgttcatatctcccctggatcgctgcccaagggcctgcactctcttgatctgtctaggaacaagattgccaacgtcgagggcctccgggagctaaccaagctacgtgtgctcaacctcagctacaaccggatttcacggattgggcatggtctgtccaactgcacggcgatccgggagctgtacctggcgggcaacaagatcagcgacgtggagggcctgcaccggctgctcaagctggcggtgctggacctcagcttcaacaagatcacgactgccaaggcgctggggcagctggtggccaactaccactccctcctggcgctcaacctcgtgggcaacccggtgcaggccaacgtcggcgacgacgcgctgcgccgggcggtcacggggctcctcccgagccttgcctacctcaacaagcagcccgtgaagccgcagcgcagcgcacgggaggtggccacggacagcattgcgcgcgccgcgctcggcggctcgtgcagtcggagcagccggaagaagacgtcgcggcggctcacgcagagcccacgctcgtcgtccttgaccaggggccgtggtggcggcggcgcctcacccacaccaagaaacccatctcgtcgtcgttgaccaggggatcggaaccaactgcatgcgtgctggccgtggcttgagaggatttgtcaggcactacgattgggcacggtgatgaggtcaaactgaatcggtgggacaaacctaagtatgatgtgagaaaattaccatggaccacataatgtacatacttgttagggagagattgcttagattgatgttgtgctcgatgtatctttgtagcggcgaaacaacaatttgtgcttggttgaagatgagatccaatgtcacactgattgttctctcttgtgtgctttatatctatccaactatatttatctgtatctgcactataaagaagcgaataaatataaatagcctcttaccatatttttt

SEQ ID NO: 3290 - DNA, 652 bp, Sorghum bicolor
tgctcgtatagatacgcgcagcagatctctcttcggtcatcctctacgcgagcggccgcttcacccatccagccccgcaccgccgcacgacgtcgccggaaccggagaagggaggggggaacgcaagatggacaaggccaataagctcagcgccggagccggggagaagacggccaagaacaggagccacggatccacggcgctgttcgtcgcggtggactacgccttcctgctcgccttcgccggcttcctcgcctacctcgtcgggtcgcggatccttccctccgccgccggctccgcctagaccggtccgcgttcgtggatctctctcttctttcttccacctttttggtttttttttcttggagccgatggcggtgagagcaccgagatcttgccgggcggccgggtggctctcgtctcgatctgacgccgctcccgcgatgtaatccggacacattttgatgagacgagaactagcggtgtttcttggcaatttgcctggtaatgtgacaaatctttgctttgttcagttgctactatccctgctcgtgtgctgagtttgcttgggcattgatctcgcgtttgtgtggcaatctgtgatgcctccttgctactgatgaacgccaactgaaaggtaaatccatcagct

SEQ ID NO: 3291 - DNA, 580 bp, Zea mays
acaaatgagagataagcatatcagatctcttcgatcatcctgcagatctctattcgaccgcggcgaaccagtgaaccgccacttcgcccatccaggctccagccccgcaccgcgcgagtgcacaacgtcgccggaaccggagaaagtgagggggagctggagatggacaaggacaataggctccgcgcccgagcgggggagaaggcgtccaagagcaggagccacgggtccacggcgctgttcgtcgcggtagactacgccttcctgctcgccttcgccggcttcctcgcctacctcgtcgggtcgcggatcctcccctccgccgtcagcttcgtctagaccggcccgcgttcgtggatctctctcttttttccttccacttttttttgttgttgttgtttgcttggagccaatggtggcgagagaaccgagatcttgccggccgggtggttctcgtttcgatctgattgccgctcatgcgatgtaatccgaccgcattttgacgagaagagaactagcggtgcttcttggcagttcgcttggtaatgagacaaatctttgcctgttcagttgctagtgc

SEQ ID NO: 3292 - DNA, 476 bp, Cynodon dactylon
ggccgggggtgaccgtcggcccagatccaaatcacgccgccgacgcttctccgatctcctccgtaccacttcgccggagcggaggtggagagagagagatggacgcagcaaagaagctcagcgccagagcgggggagaaggtgaccaagaataggagccacgggtcgacggcgctgttcgtggcggtggactacgccttccttctcggcttcgccggcttcctcgcctacctcgtcagctcccggatcctcccgtccgtggccaccgccgtgtagatcggttgtccaccattcttgcttccgttcctacgcttttgttcggatccgatcttttctcgggcagtggctctcgtctctctgttcctgtcttcctgatgcccgctgtgtaatctgatttccctctgtaatgagttgagaacttactactcggtttcttgaaattgctccgtcactgatgccagcacgaatgtcttgtcc

SEQ ID NO: 3293 - DNA, 825 bp, Sorghum bicolor
tccccctccatcacatcacggtcacggcgcctccaactccaagcgccgcctccgcctcgaaaactcttcttccccgcgcgcgctgcagcaggcggcccgaccggcgtgtggacctctcgcccgcccccgcctgccggtttccgcgatggctgccgcttcctttccaccagcatcttcctccggcggctgggacttcacttgtaaccttgaagttgattatgggtctgaagaaaatgcatccatcgtctacaaaacgttagcggttgacaaggagttgcagcctgacaaggtgaagagggaaatgactctatcaggcagcaagctggccgtgcactttgcagccgtggaggcccggttcctgcgagcatcgttcagtgcatttgtggatcttatgggactcgtcacgaagcttgtcgaggaatatggtgtggccatggaagagcattcttgaatcttgatgaacaatctcataccgacttgttcgcttgagcttatctgtcaaatgtgtcagccgttcagcagcgtttttctctcacaacaaatcagcgaggagtactttcagccatggcttattagcattgcggagttgattttagtccgcctgtgaggactttggacagtctgtaccagtggaattgctcttgattttgtcaagtgaatgtatcattgtatttgaccttgattggtccaatcctatttagagcagtgaatcattttcggcatactattgtgaaatgaactttcatgcaacgttaaggcaaaatgtacaaataagaacaggttgtaatctgttgtgaaaaatcatacgaacacttctaagacccg

SEQ ID NO: 3294 - DNA, 860 bp, Panicum virgatum
ctcgagctgggctgtcacgtgctacgacacaataggcccatccagaacaagatgaggccccatgcccatctcaaatgagcgtgcgctaacccggcccacctagccagtagtccgatccggcggactccccccactcccagccgccagccccgacgcgacgcctcgccgccggcttcgcgacctcaactccgagcgccgcctccccctcgaatcgaatacttgtctgtcgtctggagggctgcgcccaggcgtccgaacggcgtgccgcgtctggacctctcaattccacataccgcccgcccgcccggtgccgcgatggctgccgcttccgttccaccagcatcttcctccggcggctgggacttcacctgcaactttgaagttgattatgagtctgaggaacatgcatccatagtctacaaaacgttagcagttgacaaggagttgcagcctgacaaggtcaagagggagatgactctatcaggcagcaagcttgccgtgcactttgcagcagtagaggctcggtttctgcgatcatcgttcagcgcatttgttgatcttatgggacttgtgacgaagcttgtcgaagaatatggtgtggccaaggaagggcattcttgaagaacaatttcatgcacggcagtacagcactgtctgagtccgttttagtccatatggttggacagtctgtatcagtggaaatgcttttggtttgtcaagatagtgtatcagtgtatttgagcttgattagtccaaccgtacttagaacagtgactttttttttgcacattcaactttacttaaagtcagcaacattaaacaaaaatgcacagataacaacatgtattccatcgtgaata

SEQ ID NO: 3295 - DNA, 635 bp, Setaria italica
gagcgccgcctccccctcgaaaactcatctcccgcgctgcgcccaggccgccaaccggcgtgccgcgtgtggacctctcgctccatagaccgacaccgcccgcccgctgccgcgatggctgccgcttcttttccaccagcatcttcctcaggcggctgggacttcacctgtaactttgaagttgattatgggtctgaggaacaagcctccataatctacaaaacattagcagttgacaaggagttgcagcctgacaaggtcaagagggagatgactctatcaggcagcaagcttgccgtgcactttgcagcagtagaggcccggtttctgcgagcatccttcagcgcatttgttgatctgatgggacttgtgacgaagcttgtcgaagaatatggtgtggccaaggaagggcattcttgaagaacaatctcatgcacggcacgcttgtgagcactttggataatctgtaccagtggaaatgcttttaggtttggcaagctaaggtatcagtgtatttgctcttgattagtccagccctatttagaacagtgaattttttttctgcatattcatgtgaattcaactttacagcattaatgtgaaatccacagataagaacaggtcacatcccgttg

SEQ ID NO: 3296 - DNA, 1903 bp, Panicum virgatum
tcggcagcctgactcgccagaaaaattcaccacatcccgttagacttcgcaaactcgccaaccaaaactccccatggcggcgcaggcgctgccgttcctccggtggagccggagcgccgcctccctccgcgcgcgctcctccaccacagccgcgccgcaccgcctcttctcgaccctccgccgccccgccgcctgctgcgaggccggctccaaggtcatgctcaaggggatggactactcggaactcgagaattgggtgcaggcgcaggggtttcggccaggccagtccatgatgctgtggaaatgcctatacgggaacaacgtttgggctcattgtcacgacgagctagctggtttaaacaaggacttcaggaagatgataaccgagcatgctgatctcaaggcattaactgtgaaggacattctcactgcatcagatggaacccgtaagatactgttctctcttgaagatggtccagtgattgaaacagttatcattccttgcgctaggggcaggacaactgtctgtgtttctagtcaagttggttgtgccatgaactgtcagttttgcttcactgggaggatgggtttgagaaaacatctgtcaacagctgaaattgttgagcaggctgtgtttgctcgtaggctattctctgatgaatttggagcaattactaatgttgtatttatgggcatgggtgaaccatttcacaatattgacaatgtaataaaagcctcagcaataatggttgacgatcaaggtcttcattttagtcctcgcaaggttactgtatccacaagtggtcttgtccctcagttaaaacgcttcctccgtgaatccaattgctccctggccgtcagtcttaatgcaacaacggacgaggttagaaattggataatgcccataaacagaaagtacaatcttaacatgcttcttggcaccttaagggaggaactttgcctcagaaagaattacagagttctatttgaatatgttatgctttctggagtgaacgacagtatggatgatgcaaagaggcttatcgagctcgtccaagggatcccttgcaagatcaacctcatctctttcaatccccacagcggttcccaattcaagcccacacccgatgagaagataatcgagttccgaaacgttttaattcaaggcggccttatagtttttgttcggctcagcagaggggacgatcagatggctgcctgcgggcagcttggagagcctggagactaccagctgcctctgctccgtgtacctgagaaattccaggtcgccttgtgaattgtgacgcgcggtgagcaacttgatgaacacgcagttcccggaagttatgccatctccgaagaccgatctggaattttgcgatatggtatcgacgctgttggtccttcatctgagcctggatatgtaagaacacattttgacatgggcacatgatgcttctgccgatccgtggtgtatcctaatcgagcatttgataagaatataaactgggttgtagcaagttgtgttacatttcgcactctcgtaccaacgccgtccgactcaggaaagctaaagcattgcgtcgtgcggctttggtctttgggtgcgtgacacttggcgtttacgcgtagcccatcctgcggtctgagtctgaatcggcaaagctaaattctgctgttactggtcattcgaaaagcttggcttggattttggattactggcgatcaggattcaggagtggcagaaaagaatctcggaacgcctgcaaggcttggcttgccggagcgagataccttaacccctaagtgcagtctcaatgcagacgtagagttttaagcctcaaagactatcacaagaaactatgcttcccaatgcaaagtgtattactttggtttatatggt

SEQ ID NO: 3297 - DNA, 2129 bp, Brachypodium distachyon
atccagccactctgaaaaagtcccaaccgcggacggccgcggtactgtggaccagcccggagttccgatggcggcgcctcctctcggccctctcctcagatggggcgcctcctctctccgcgtccactctgcctctcctccgacgcggcgcctcttctccgccctccgacgaccctcggctgtcgtccgctgcgaacctggctccagggtcatgctcaagggaatggattacccggaactggagaaatgggttcagtcacagggatttcgaccggggcaggctatgatgctgtggaaatgcctctacgggaacaacgtctgggctcattgtcacgacgagctggctggcttgaataaggacttgaggaaaatgatatgcgagcttgctgatctcaaggcattaactgtgaaagacattattactgcgtccgatggaacaagaaagatactgttctctcttgagaacgcctcggtgattgaaacagttgtcattcctaacgccaggggtaggacaacggtctgtgtttctagtcaagtgggctgtgccatgaattgtcagttttgcttcactgggaggatgggtttgagaaagcatttgtctacagctgagatagttgagcaggctgtgtttgctcgtaagctattttcagatgaatttggatccattacaaatgttgtatttatgggcatgggtgagccattgcacaatgtagacaatgtaataaaagcatcagctataatggttgatgagcagggccttcagtttagtcctcgcaaggttactgtctccacaagtggtcttgttccacagataaaacgcttcctccatgaatccaagtgcgatctggccgtgagtcttaatgcaacaactgatgaggttagaaactggataatgcccattaacagaaagtacaatcttaacttgcttcttggcactttaagggaggagcttcgtttgagaagaaagtccatagtgctatttgaatatgttatgcttgctgaagtgaatgacagcatggacgatgcgaagaggcttacagagctggttcatggtatctcctgcaagatcaacctcatctctttcaacccccacagtgggtcccaattcaagcccacaccagatgagaaaattatcgagttccgtaacattttaatccaatctggccttacagtaatggttcggctaagcagaggggatgatcagatggctgcctgcgggcagctaggagagcctggggactatcagctgccgctgctccgtgtacccgacaaatttcaggttgccttgtgatgctacatattggagtacactagtacagtcattagtaaaaacaggtcttggagaacagcttgacaaagaagacaaggtagtaatatgcatgtaatcaggatagtcatacagctccgctgccaacctgaagtcatgatctccctgagccaacctgaagtcatgatatccctgagccaatctgacgactgtaaaaaaaaatcccgaatggcgtctatatttggatggcaagttggcacgaacagtttgtatttttgttttttccactttgatgcaaggagggctaggtatcaaataaagacgagacttgagcgcgtgacatctgggcatttagcatagttccaaaagactcgaatctacccattgctgatcttggttcagcgtgacgtgcaggaatgacagaaagacaactaaggcctacatgtttgccttgctcgggataccttaaccattaaggtgcgcatgccatgccaccacctgaccagcctaatgagaaaaagaaacaaaagagcaaagcgatctacaagccccaccaatcaaagtgctttgcaaaagtaattccattgaaccgcacctattgggcgcctttagcactaatctgctgccaaattggtatacgcaggttacacgcctacacctgctccctgctttagcagaagctcgcttagatttggacatcccagaaaaaagagaaaacagaagacgaatcctgtgactttctaaaaggtcttcgttcactttttaatgggtatttgagtcaggtttgatggcatcttcagatagttgatggtaaatgcaggattttatatgatataaaatagattaaatgagtagcgagagc

SEQ ID NO: 3298 - DNA, 1612 bp, Secale cereale
cagaaccataccaaaccaacaattcctatggcggcgctgcctcttctccggtggggcgcctcctccctccacgcccactcctctcctcccccgccgcgacgcctcttctccgctctccgacgcccccctgctgccgcccgctacgagccaggctccagggtcatgcttaaggggatggactacccagagctcgagaaatgggtgcagtcgcaaggattccgaccgggacaggccatgatgctgtggaaatgcctctacgggaacaacgtctgggcgcattgccacgacgagttggctggcttgaacaaggacttgaggaaaatgataagtgatcatgctgatctcaaggcattaactgttaaagacattattactgcatccgatggaacccgaaagatactgttctctcttgaagatgcctctgtgattgaaaccgttgtcattcctagcgccaggggccggacaacggtctgtgtttcaagtcaagtgggctgtgccatgaattgtcagttttgcttcactgggaggatgggtttgagaaagcatttgtctacagctgagatagttgagcaggctgtttttgctcgtaagctattttcagatgaatttggttctgttacaaatgttgtatttatgggcatgggcgagccgttgcacaatgtagataacgtaataaaagcatcatctataatggttgatgagcagggccttcagtttagtcctcgcaaggttactgtatccacaagtggtctcgttccagagataaaacgcttcctcagtgaatccaattgtgatctagctgtgagtcttaatgcaacaactgatgaggttaggaattggataatgcccattaacagaaagtacaatcttagcacgcttcttggcactttaagggaggaacttcgtttgagacccaagtccatagtgctatttgagtacgtcatgcttgctggagtgaatgacagtgtcgatgatgcgaagaggcttacagagctggttcgtggtattccctgcaagatcaacctcatctctttcaacccccatagtggatcccaattcaagccgacgccagatgagaaaattatcgagttccgcaacacgttaatccaatccggccttaccgttatggtgcgactaagcagaggcgatgaccagatggctgcctgcgggcagctaggagagcctggtgactatcagctaccgctactccgtgtacctgagaaatttcaggccgccttatgaagctaaatacgtagtgctcgtacagtagtaaagcaggtgcctgggaacaacttgacaaagacaaggcagtaatatgcgtgtaatgaggataaaacacatcttcctgagccagccttacgaccgtcgagcattttctgaattttgatggcaagtgctgaacagttgatctgttattgtaacccgtgttctgattaacatacatctctcgttttctgcaagaaaacaaaaaaaaaaaaaacgaaaaaaaaaaaacaaaaaaaaaaaacaaaaaaaacaaaaaacaaacaacaacaacaacacacacacacacacacacacacacacaatgacacacgatagatacagtcacgcactagacaccgaccgtcag

SEQ ID NO: 3299 - DNA, 1443 bp, Triticum aestivum
gcgctgcctcttctccggtggggcgcctcctccctccacgcccacttctcccctaccccgccgcgacgcctcttctccgctctccgacagccccctgccgccggccgctacgagccaggctccagggtcatgcttaaggggatggactacccagagctcgagaaatgggtgcagtcgcaaggattccgaccgggacaggccatgatgctgtggaaatgcctctacgggaacaacgtctgggcgcattgccacgacgagctggctggcttgaacaaggacttgaggaaaatgataagtgatcatgctgatctcaaggcattaactgttaaagacattattactgcatcggatggaacccgaaagatactgttctctcttgaagatgcctctgtgattgaaacagttgtcattcctagcgccaggggccggacaacggtctgtgtttcaagtcaagtgggctgtgccatgaattgtcagttttgcttcactgggaggatgggtttgagaaagcatttgtctacagctgagatagttgagcaggctgtgtttgctcgtaagctattttcagatgaatttggttctattacaaatgttgtatttatgggcatgggcgagccgttgcacaacgtagataacgtaataaaagcatcatctataatggttgatgagcagggccttcagtttagtcctcgcaaggttactgtatccacaagtggtctcgttccagagataaaacgctttctcaatgaatccaattgtgatctggccgtgagtcttaatgcaacaactgatgaggttaggaattggataatgcccattaacagaaggtacaatcttagcacgcttcttggcactttaagggaggaacttcgtttgagacctaagtccatagtgctatttgaatacgtcatgcttgctggagtgaatgacagcacggatgatgcgaagaggcttatggagctggttcacggtattccctgcaagatcaacctaatctctttcaatccccatagtgggtcacaattcaagccgacgcccgatgagagcattatcgagttccgcaacatgttaatccaatccggccttaccgttatggttcggctaagcagaggcgatgaccagatggctgcctgcgggcagctaggagcgcctggtgactatcagctaccgctgctccgtgttcctgagaaatttcaggtcgccttatgaagctaaatacgtagtgctcgtacggtagtaaaacagatgcctgggaacaacttcaggaagacaaggcagtaatatgcgtgtaatgaggataaaaccacgctgattctttcaggtcaagcatctttctgagccagccttacgaccgtcgagcattttctgaattttgatggcaagtgctgaacagttgatctgtgctgattgtaacccatgttctgattaatatacatctctcgt

SEQ ID NO: 3300 - DNA, 1939 bp, Panicum virgatum
  misc_feature (24)..(24): n is a, c, g, or t
  misc_feature (87)..(87): n is a, c, g, or t
  misc_feature (242)..(242): n is a, c, g, or t
  misc_feature (757)..(757): n is a, c, g, or t
  misc_feature (1430)..(1430): n is a, c, g, or t
  misc_feature (1451)..(1451): n is a, c, g, or t
  misc_feature (1525)..(1525): n is a, c, g, or t
  misc_feature (1646)..(1646): n is a, c, g, or t
  misc_feature (1818)..(1818): n is a, c, g, or t
  misc_feature (1928)..(1928): n is a, c, g, or t
cttcgcaaactcgccaaccaaaantccccatggcggcgcaggcgctgccgttcctccggtggagccggagcgccgcctccctccgcncgcgctcctccaccacagccgcgccgcaccgcctcttctcgaccctccgccgccccgccgcctgctgcgaggccggctccaaggtcatgctcaaggggatggactactcggaactcgagaattgggtgcaggcgcaggggtttcggccaggccantccatgatgctgtggaaatgcctatacgggaacaacgtttgggctcattgtcacgacgagctagctgatatgtgtcatttgatgtattgtcaaatgttaactgaatggatgtgaccccctttacctttaaaacccttaaggtttaaacaaggacttcaggaagatgataaccgagcatgctgatctcaaggcattaactgtgaaggacattctcactgcatcagatggaacccgtaaggatgttacagatactgttctctcttgaagatggtccagtgattgaaacagttatcattccttgcgctaggggcaggacaactgtctgtgtttctagtcaagttggttgtgccatgaactgtcagttttgcttcactgggaggatgggtttgagaaaacatctgtcaacagctgaaattgttgagcagctgtgtttgctcgtagctattctctgatgaatttggagcaattactaatgttgtatttatgggcatgggtgaaccattcacaatattganaatgtaataaaagcctcagcataatggttgacgatcaagtcttcattttagtcctcgcaaggttactgtatccacaagtggtcttgtccctcagttaaaacgcttcctccgtgaatccaattgctccctggccgtcagtcttaatgcaacaacggacgaggttagaaattggataatgcccataaacagaaagtacaatcttaacatgcttcttggcaccttaagggaggaactttgcctcagaaagaattacagagttctatttgaatatgttatgctttctggagtgaacgacagtatggatgatgcaaagaggcttatcgagctcgtccaagggatcccttgcaagatcaacctcatctctttcaatccccacagcggttcccaattcaagcccacacccgatgagaagataatcgagttccgaaacgttttaattcaaggcggccttatagtttttgttcggctcagcagaggggacgatcagatggctgcctgcgggcagcttggagagcctggagactaccagctgcctctgctccgtgtacctgagaaattccaggtcgccttgtgaattgtgacgcacggtgagcaacttgatgaacacgcagttcccggaagttatgccatctccgaagaccgatctggaattttgcgatatggtatcgacgcngttggtccttcatctgagccnggatatgtaagaacacattttgacatgggcacatggtgcttctgccgatccgtggtgtatcctaatcgagcatntgataagaatataaactgggttgtagcaagttgtgttacatttcgcattctcgtaccaacgccgtccgactcaggaaagctaaagcattgcgtcgtgcggctttggtctttgggtgcgtgncacttggcgtttacgcgtagcccatcctgcggtctgagtctgaatcgccaaagctaaattctgctgttactggtcattcgaaaagcttggcttggattttggattactggcgttcaggattcaggagtggcagaaaaaatctcggaacgcctgcaaggtttggcttgccggngcgagataccttaacgcagtctcaatgcagactccactcgtagagttttaagcctcaaagactccatcataagaaactatactttccaatgcaaagtgtattactttganttatatggtgt

SEQ ID NO: 3301 - DNA, 3155 bp, Sorghum bicolor
aggggtggccgagtcccgagtgggagtatggagcccgcccgtgcggaacagagaggcaggcggcggtctacagattcttcgatcacacatcccgccatgtcgggaggagataaaataagctcggcctctgccttctggcttctggcgagcctggcctcttcgtgctagacgaaacacgctacggcgtcttctccaaccactatctttcgatttatttacaagcagtattttcctttgatttttcatcgagcacagtttccatttctaggcttgtagcgaccagtcggtacaaattactgctaaatttggccttggcctattgttttacttttacgggcgcaacaaatatcattcatttctgctttttgtgtctctataaagtttgtctaaaggtggtgtcgccattgcagcactagcactggttccagctactctcacgagcaacgagcagcgagcagcgtggtgaggttgaccaggaccccttccggatcctgaaataaggccaccgctcgtttcctctcaccgccccctcccttcactccctccctgtccctcccttcccccttgcatttagcctcccgcggttctggagccgcgggccattcccaaccatcgttgcggtggtggccggtattggccgagacccatgggcatccaggtcgcggcggtcgtgaccccgccgccgtgctcttccccttcctcctcgccctcgtccacctctccggcgtcgccttcgtcctccgccattgccacgtcgccgcggcatgccgttcttggcgtcaggctggcgaggagccagtcgtcgctggctggctgcaacgccggtcttattggccggcggcgcggcgggcagcacgcgatcaggcgcgctctcagcgcgagcatcgacagcgtcgggagcgacggcggggacgatgaggagttcctgaggaggatccaggagctcgcggcggggcagcacccgggcggcgccggcgggtggccggcgagcgtggagcggagcgcgagcagcgtcgggctcccgctgtccctgcggatgctcaagcggaggaagcagcagcagcagcagctggagcaggggcggtgggacgagcggctgatcgactgcgccggcgagtccgcgcgcgccgcggtggggcgcgccttctcctcgatggtgctcatcatccgggagctccagagcttcacgctgcagatgcgggagtcgctcctgtacgaggacctgcagggcgtgctggcgcgcgtccacgccgagatgcacgcctccttcgtctggctcttccagcacatcttcgccggcaccccggcgctaatggtctccctcatgctgctcctcgccaacttcaccgtctactccatgggcgacagcgtcgcggccgctgccaccttccgccctcccagcagcgtcgtggagatggtggacactacccagcagccggagcaatcccattcgcactcccagcagcagcggttcgacacccccgcgctcaagactttctccaccggccgcacggcctcggtgggcggaaacggcgacgggggtggcaaggtgcggccggttgccggcgccaccggcgacggccagtcggacgagtcgtcgtaccgacaaagcggagcggtggtgccgcaggacgtgtcgcagtcgcaagcaacgccactgggcgcgggcgccggctccggctcggaggcgtccgtgtccgagtccgactcaatggccgtggaggaggcagcacaacaacagacagtacaagacgagctggtcatctggaaacggatctccgatgaagccacaaggatgcaggcgagcgtgcgtgcagaggagctgatggacccggaaattctagagcagctcgtcgcgccggtggaggcgccgaagccagacgtggcctactcgtcggagcacgtggcgacggctcagagatacgagcaggccgtgtccgaggagcccaacagctcgctgctcctggctaactttgcgcagttcctgtaccaggtgcagggcgacctcgacagggcggagcacttcttcaagcgggcggtgcgcgcggagccggcggacgcggaggcgctggggcggtacgcggcgttcctgtggcaggcgcgcaacgacctcgcggccgcggaggagacgtaccaggaggccatcgccgccgaccccggcaacgcgcaccacgcggcagcctacgcgcacttcctgtggaacacgggcggtgaggacacatgctacccgctcgactgaccgccgctactaccgtccagcacagatcatctcatcggtgcctcccataaaaaacttgtgaaaacaaaaacaaagagaaatgatccctccgccgctccactccactccctcggcaagagtgcacgctcttctgacggcatgtggccacccgggcagctgagctagactacaagtgaagctgaagctgatacacttcgcgttactgaaaccgttcgtttgctttagcctctagtaggcatcttctcttcctgtggttgctcgttttggggtaagtagctagtgtggagcaatggccaacgggactgaatccgcggctcgctgctgcttcccgatctggaaaacccggcgactgcgagttgagaagaggccgggaacggcggcagcggccggttgtctgtgggtccgtccacttggcgtcgcatggatgtttgtatactggcacttttgcacggtgtcgcgagatttgcgagatgccactttgttcagtggagcaggaaagtatatatatctatacttatatatactagcagcaatttgcttcttgtaactgtgcagatcaataaactgtataagaagccctccattttttcactcaagtggcagtatgcttgtaggaccaaatgtccacttcctttcgtgaaaaaagatgaacagtgaggcaccgatgacaagtgagtacattactacatgattctctcattctggaactttggagtcgtatctggacgtgaacctgtgctgtgtagtagaccggagagatcattagggaagccatgtgaaccgggggttgcggcagttgaccattggtgggccgtgttgcgcatgcaaaacagcagggaattgttaagtacaatttgcgctgccctcatgcttttataagactactactacggtcaccgaatccgatcaaattccg

SEQ ID NO: 3302 - DNA, 3425 bp, Zea mays
acaccttcctaaatttaggttcttttatcttgaaaaacgggactcagattaggttttgggaggaccgctggttggggttgcaacctttaatgacccaatatccatcgttgtataatatagcgcgcaaaaagagtgctactgtagcgtcggttttcgaaacggttccgcttaatgtttcttttcaaagagcattggtgggtgaaaacctgaggttatggcatctgttggttctcagagtagctcaggttgagctaagtggggaaaatgatatgttcaaatgggatttatctgtgacgggtcttttctcggtcaggtcaatgtatagagcactccttaacaataatcatgtgacttataataagactctctggtctttgaaggtacctttgaagataaaaatatttatgtggtatttaattagaggggtggttttaacaaaagataatcttctgaggcgtaattggcatggtgatagaaagtgtgccttttgtcactcggatgaatcgattcaacacttgttttttgcttgtcactatgctcagttcatatggaggttagttttttggagtttgggtttcaatcaaccgagatcagttagacacgcttttgggaattggctttttgggatgccttcgaaaactaaacatttgattatttcaggtgttgctgctatatgctgggctatctggataagtagaaatgatttagtttttgacaaaaaacccatgttaacatgcttgcaggtactcttcagggcgacgcattggtttaggacgtgggctgttcttcataaacaagaagagggtatccaaataaaggaagcttgtcgacggttagagtgcacggctctacagatttttgctcagcatggatggaggtttacaaatcgaattacttcgtagttttgtctatggattgtgtgtctttttctggttatcaaaccatggtcttctatggtgtgtttcgggaggtctgtccctccatatgtggctagtcgtgtgactacttcatgtaaaaacttttggtgtattggctaatcctccaaaagaggagaagctggacaagtatccattatctaaaaaaataaagtttgcctaaaagttggtgtcgccattgcagcactagcactggtaccagctactctcacgagctgcgtgctgaggttgactccttcccgatcctgaaatataaggctaccgctcgtttcctctctctccccgactccccctcccttccatctcttcccttgcatttagcctcccgcggttcaggaggcgcgggccattcccaaccatcgttgcagtggtggcaggtattggcctgtcgagacccatgggcattcaggtcgcggcggtggtgaccccgccgccgtgctcttccccctcctcctctccggcgtcgccttcgtcctcggccattgccacgtcgccgcggcacgccgttcttggcgccaggctggcgaggagccagtcgtcgctggcttgctggaacgccggtcttggccggcggcgcggcgggcagcacgcgatcaggcgcgctctcagcgcgagcatcgacagcgtcgggagcggcggcggggaggacgaggagttcctgaggaggatccaggagctcgcggcgggtcagcacccgggcgccggcggctgcgggtggccggcgagcgtggagcggagcgcgagcagcgtcgggctgccgctgtctctgcggatgctcaaacggaggaagcagcagcagcagctggagcaggggcggtggaacgagcggctgatcgactgcgccggcgagtccgcgcgcgccgcggtgggccgtgccttctcctcgatggtgctcatcatccgggagctccagagcttcacgctgcagatgcgggaggcggtcgtctacgaggacctgcagggcgtcctggcgcgcgtccacgccgagatgcacgcctccttcgtctggctcttccagcacatcttctccggcaccccggccctcatggtctccctcatgctgctcctcgccaacttcaccgtctactccatgggcgacagcgtcgcggcggctgccagcctcgtcccaccaccccaggcagccgtggagatggtggacatccagcagcaaccggagcaacagcaatcccattcccagcagcggttcgacacccccgcgctcaagacgttctccactggccgcacggcctcagtgggtggaaacggcgacgggggcggcaaagtgcggccagttgccggcgccaccggcgacggccagtcggacgagtcgtcgcatcggcaaaacggagcggtggtgctgccgcaggacgtgtcgcagtcgcaggcgacgccactggcgtccgtgtccgactcgatggccgtggaggatgcacaagcgcaacagactgtacacgacgacgagctggccatctggaaacggatatccgatgaagccgccaggatgcaggcgagcgtgcgtgcagaggagctgatggacccggaaaccctggagcagctcgtcgcgccggtggaggcgccaaagccagacacggtccactactcgccggagcacgtggccacggcgcagaggtacgaacaggccctgtccgaggagcccaacagctcgctgctcctggcaaactttgcgcagttcctgtaccaggtgcagggcgacctcgacagggcggagcacttcttcaagagggcggtgcgcgcggagcccgcggacgcggaggcgctggggcggtacgcggcgttcctgtggcaggcgcgcgacgacctcgcggccgcggaggagacgtaccaggaggccatcgccgccgaccccggcaacgcgcaccacgcggcagcctacgcgcacttcctgtggaacacgggcggtgaggacacatgctacccgctcgactgatgcgtgcgtgcgtgcgtccaccgccgctagcgtccagcacagatcatcggtgccctgccctcccataaaaacttcaaacgaaaagaaagagaaaatggtcactccgccgccctgctgaccgctgtccactccactccctcggcaagtccaggctcttctcacggcatgtgcttcagcggccgctcgggatttcctcttcctctgtgattgctcgttttggggtaagtagtgtggagcaatggccaacggaaatccgcggctcgctgctgcttcccgatctggaaacccggccggcgactgcgagttgagaggccgggaacggcggcagcgctcggttgtcggtggggcccgtccacttggcgtcgcacggatgtttcctggtggcacttttgcacgttgtcgtcgagatttgtgagacgccgctttgttcagtggagcaggaaagtatgcatacttatatactggcagcgatttgcttcttgtaactgtgtctgtgtagatcaataaaatgtataagaagctctccattttttttcattcaa

SEQ ID NO: 3303 - DNA, 2718 bp, Setaria italica
caatatagatattcaggtgtgctccgtctccataccctgcacacacgttgatgatgccagaggggagccgtctgtacagaactgagaggcaggcggtggtctacagattcctcgagctcagcacacacacatcccgggggaaggaggtaataggctggctctatggccttcatcatctccaatcatttccctgtattttcaatccttcgatttttttttcatcttggtacagtttccatttgtagcgacgcgacaacaccaattcctactaaatttggcctgtgcctattgttttacggaggagaaaaaatatcatttgttcctgctccgggtgtctataaagttttgtctaaaggtggcgtcgccattgcggcactagcagtggcactagctggggaggttgaccgagactccttccggatcctgaaataaggccaccgctcgtttcccctcccttcactcccttcccttgcattttagcctcccgcggttctggagccgcgggccattcccaaccatcgttccggtggtggccggtattggccgagacccatgggcatccaggtcgcggcggtcgtcacgccgccgccgtgctcttcttccccctcgtcctcctccccggcgtcgccttcgtcctcggccattaccacgtcgctgcggcatgccgcgccaggcgtcaggctggcgaggagccagtcgtcgctggcgggctggagcgccggcctcgccccgcggcgcgccgggcagcacgcgatcaggcgcaccctcagcgccagcattgacagcgtcgggagcgacggcggggacgacgaggagttcttgaggaggatccaggagctcgcggcggggcagcacccgggcgccggcgggtgcgggtggccggcgagcgtggagcggagcgcgagcagcgtcgggctgccgctgtcgctgcggatgctcaagcggcggaagcagcagcagcagcagctggagcaggggcggagggacgagcggctcgtggaccgcgccggcgagtccgcgcgcgccgcggtggggcgcgccttcgcgtcgatggtgctcatcatccgggagctccagagcttcacgctgcagatgcgggaggcgctcttctacgaggacctgcagggggtcctggcgcgcgtccacgcagagatgcacgcctcctttgtctggctcttccagcacatcttctccggcaccccggcgctcatggtctccctcatgctgctcctcgccaacttcaccgtctactccatgggcgacagcgtcgcgaccgccgccacgatcccgcctccccaggccgccgtggcggccgtcgagatggtggacacccagcaaccggagcaatcccattcttcccagcagcggttcgaccccgccgcgctcaagacgttctccattggccgcacggcctcggtgggcgggaacggcgacgggggcggcaaggtgcggccggtcgccggctccaccggcgacggccagtcggacgagtcgtcgtacagacaaagcggaacggtcttgcctcaggacgcgtcacagcaggcgacaccactgggcgccggctcggaggcgtccgtgtccgactcaatggccgttgaggatgtacaggacgagctggtcatctggaagcggatatccgatgaagccaccaggatgcaagcgagcgcgcgtgccgaggagctgatggacccggaaattctggagcagctcgtcgcgccggtggaggcgccgaagctggacgtggagtactcggcagagcacgcggccacggcgcagagatacgagcaggccgtgtccgaggagcccagcaactcgctgctgcttgccaacttcgctcagttcctgtaccaggtgcaaggcgaccacgaccgggcggagcacttcttcaagcgggcggtgcgcgcggagccggcggacgcggaggcgatggggcggtacgcggcgttcctgtggcaggcgcgcaacgacctcgcggccgcggaggagacgtaccaggaggccatcgccgccgaccccggcaacgcgcaccacgcggcggcctacgcgcacttcctgtggaacactggcggtgaggacacatgctaccccctcgactgatgccgccgctaccgtgcaacacagatcatcggtgcctcccataaaacccaaacacaaaaagaaagaaaaagatcactccgccactccactcccttccttcggcaagtccacgctcttctcgcggcatgtgctttgggcggtcacccgggcggcaacctgcaatgctacaacaagtgaggctgaagctgatacacttcgcactgctagaatcgttcgtttgcttgaggcatgttctctcttccgatcccgtggtctctcgttttggggcaagtagtggagcaacgggcaacggaaacccgcggctcgccgctgctgcttcccgagctggaaacccggcggctgcgacgagttgaaacgccgggaacggcggcaacgcgcggttgtcggttgcgccgggggatgggggtccatccgtccacttggcgtcgcgtgtcgagactcgagaggcggcgtggatgtttgtactggcactatgcaccacggtgccgtcgagatttgcgagacgccgctctgttttcagtggagcaggtggaaagtatatacaccagcagcaatttgcttcttgtaactgtgcagatgaataaactgtataagaagctcttcattcccccacccccaatg

SEQ ID NO: 3304 - DNA, 682 bp, Saccharum officinarum
ctcgttcctgcatctctgcgcctccccggacacaatcgacttcgccggctagccccgccggcgacgacaggcacagtggagcacggaggaggaagtactctgctgtgaatgggaaatgccatgaacaaagacaaagttcatgataaggaaactcacggaacaagtactgatataactgaaaagacgtctgtggaaaaggtgaagggtccagatctgcttgagcgagcaaaggaagagatcgaggctcttgccggagctgttcatactaagatggagcaccattccagtccccatgagaagaaggaagaatcacataaggaagataaggaggggagcctgcacaatataaaaacacacacgaatgaaactcatggaacaagtgctgacataaatgagaacacaccagtcgacaaagtcaaaggcccgaatgtgtttgagcgtgccaaggaagagattgaagctattgtggaagctatccatccgaagagtggatcagacagtaagtgaagactgagacccctggggctgttttgccttaactggctgtagaagccttaacatgaggtcatgagctatcagatagacacatgatttcaaagatgtccacccaggtggtgttttgtatacgcgttccggagctttaaaagctaagagctgacttgtttgtaactgttttcagttg

SEQ ID NO: 3305 - DNA, 976 bp, Sorghum bicolor
aaagccccaaacgtgcggtgtctcttgatcttgcatctctgcacctccccggacaatggattttgccggcagccccgccggcgacgacaggcacagtggagcacggaggaggaagtaccctgctgtgaatgggtaattccacgaacaaagacaaagttcatgacaaggaaactcacggaacaagtagcaatataactgaggagacgtctgtggaaaaggtgaaggctccagatctgcttgagcgagcaaaggaagagatcgaggctcttgccggagctgttcatactaagatggagcaccattccagtccccatgagaagaagggagaatcacataaggaagacaaggaggggagcctgcacaatataaaaacacacacgaatgaaactcacggaacaagtgatgacataaatgagaacacaccagtcgacaaagtcaaaggcccgaatgtgtttgagcgtgccaaggaagagattgaagctattgtcgaagctatccatccgaagagtggatcagacagtaagtgaagactgagacccctggggctgttctgccttaaactggctgcagaagccttaacatgaggtcatgagctaccagatagacacatgctttcaatgacgtccacccaggtggtgttttgtatacgcgttctggagctgtaaaagctaagagctgacttgttttgtatgctacactgttctccgttgtgccattgtggtttgtttgagcagaggtgtgtaggttcaacgtggaattgtgatgcttcaggcctcgtttgtttggcctggattgaggctgggaactattctagctaatcaatgttaatacaaataagtcttatcattctaggtggaaccgttcctgagtaaacgaatgagccctaaattgttgtgcttgacagggcatacttgttttgccaactcaccatgctcccgaagttgtaataagaagagtaatcatgaaatagaacgta

SEQ ID NO: 3306 - DNA, 891 bp, Sorghum bicolor
aaacgtgcggtgtctcttgatcttgcatctctgcacctccccggacaatggattttgccggcagccccgccggcgacgacaggaccaacttgagacatggtgttcgcttgatcttggcacagtgtaggccgtaggaatgattgattcctatcagcgctcatgcttcaattcacgatatagagaaaggaaaaaacgcctattggatggatgaattggtcatttggttgtgtccgtaaccgagctccgagcattacatcagtttgcgttaccgaatttggtgatatatctgtaacatatggcggggctcccagattcactgcctcgagaatagatgaaaaaaactagattctaagatgagcacccttgctgattctgaaatatccaactagagcactggtttcttccctatgcaacctatgctctgtagtggcgacgggagttctttcattttcaggcacagtggagcacggaggaggaagtaccctgctgtgaatgggtaattccacgaacaaagacaaagttcatgacaaggaaactcacggaacaagtagcaatataactgaggagacgtctgtggaaaaggtgaaggctccagatctgcttgagcgagcaaaggaagagatcgaggctcttgccggagctgttcatactaagatggagcaccattccagtccccatgagaagaagggagaatcacataaggaagacaaggaggggagcctgcacaatataaaaacacacacgaatgaaactcacggaacaagtgatgacataaatgagaacacaccagtcgacaaagtcaaaggcccgaatgtgtttgagcgtgccaaggaagagattgaagctattgtcgaagctatccatccgaagagtggatcagacagtaagtga

SEQ ID NO: 3307 - DNA, 833 bp, Setaria italica
ctgggccgaggaatataccattgcttcctccattctcccttcccccaacgtgcgctgttctgcgcctccaggagacgatcgacttcgccggcgacccttgccggcggcgacagctagccacaggcacagtggagtgctgaggtggaagcactctgctgtgaatgggaaatgccatgaataaagacaaagttcatgacaaggagactcacggaacaagcagcgatataaacgagaatacatctgtggacaaggtgaagggtcctaatctacttgagcgagcaaaggaagagattgaagctctcgccggagctgttcatactaagatggaacaccattccagtccccttgaaaaggatgaatcgcataaggaagacaaggaggggagcctgcagaaaataaaaacccacacgaatgaaactcatggaacaagtgctgacataagtgagaacacaccagtcgacaaagtcaaaggcccgaatgtgtttgagcgtgccaaggaagagatcgaagctattgctgaagctatccatccgaagaagggatccggcagtaattgagttgtcgtcttcactggctgcaaaaacattgacatgagtatagcggtatagccagatggatgcatatactttccgacatatccacccagtggtcttttgtatacgcgctctggagctgtaagagctaagagctgacttgtgtgcatgctacactgtttttcgctgtgctattgtggtttgtttcttaccagaggcaatgtaaaaaccccgaatatggaattgtgatgctgaaattattgcgcttgacaatgtattactccctccgtttttatttat

SEQ ID NO: 3308 - DNA, 840 bp, Pennisetum glaucum
gggatttgggccgggccgagaacataccattgcttcctccatttccccttcccaacgtgcgtttctgaacctgccctcatctctgtgcctcccggagacgatcgacttcgccggcgaccctcgccggcagcgacagcgaaccgaaggcacagtggagtgctaggtagaagcactctgaatgggaaatgccatgaataaagataaagttcatgacaaggagactcacggaacaagcagcgatataaacgagaatacgtctgtggacaaggtgaagggtcctaatctgcttgagcgagcaaaagaagagatcgaagctcttgccggatcagttcacactaacatggagcaccattccagtccccatgaaaagaaggatgacaaggaggggagcctgcagaagataaaaacccacacgaatgaaactcatggaacaagtgctgacataaatgagaacacaccagtcgacaaagtcaaaggcccgaatgtgtttgagcgtgccaaggaagagattgaagccattgctgaagctatccacccaaagaagggatctgacagtaagtgagttgacctgggggaggcttcgtcttcactggctgccaaaacattgacatgagtatagccagatggatgcatatactttccaacatatccgcccagtggtcttttgtatacacgctctggagctgtaagagctaggagctgacttgtgtgcatgctacaatgtcttttcgctgtgccattgtggtttgttgcttacctgaggcaatgtaaaaataccccaatatggaactgtgatgctgaaattattgcgcttgacaatgtattatctcacttcaccaa

SEQ ID NO: 3309 - DNA, 777 bp, Panicum virgatum
tgcatctcggcacctcccggagacgatcgacctcgccgcgccggcgaccgtcgccggcgacgccatctagccacaggtacagtggagtgctgaggtggaagcactctgctgtgaatggggaatgctatgaataaagacaaagttcatggcaaggagactcacggaacaagcagcgatataaacgagaatacatctgtggacgaggtgaagggtcctaatctgcttgagagagcaaaggaagagattgaagctctcgccggggctgttcataccaagatggagcaccaatccagtccccatgaaaaggaggatgaatcacataagaaagacaaggaggggagcctgcaggaaataaaaacccacacaaatgaaactcatggaacaagtactgacataagcgagaacacaccagtagacaaagtcaaaggcccgaatgtgtttgagcgtgccaaggaagagatcgaagctattgccgaagctatccatccgaagaagggaccagacagtaagtgagtgatcctgggggaatcatcaccttcactggctgcaaaaacaataacatgagctataaccagatgaatgcatttacgctttggagctgtaagagctttgtttgtttgctacactatttttcgttgggccattgaggtttttctgcctaacagagaggcatgtaaaagtaccgaatgtggaattgtgatgcggaaattatgtaaaaatactgaatgtggaattgtgatgcagaaattattgtgctcgacaatatgttggttcacc

SEQ ID NO: 3310 - DNA, 3787 bp, Sorghum bicolor
gctgtgtctcattatttgaccaccactactacgagtacgagtaccccaccaggaggccaccaccaccttcccctgctgcatgttcactgcctgcctcagtgcctctcctagtctcctctcccgtccggccatcccctctcctctcttccaagttccaacgcagctcaccactacttctcctcatcgtccctccagttcatcgtctccgtctgcagggcttaaatactacaacaaagcgattgcggcggtggcggccggctcagcgatttctccaccaggaccatcaccgctgccttcttggcctcttgggcggcggcactgcggcattgtcggtccagagcagcgctggttcctgaactgggcgcttgcgctgagctctccctgccctgctgccggaggcaatgaggaggagcggccgtgcctgctccgttcttgcgtcgctcctgctgctgctgtggctgggcgtcgccgccgcgcagaaggcctcgtcttggaagacattgagcggcaaggctccagcaatcgtagccaagggtggattttccgggctattccccgattcaagcgaatatgcttatcaatttgctctggtcgctagctcgccggatacaatactgtactgcgatgtgcggctgaccaaggatgagattggcatttgcctgccggacatcaggatggataactgcacaaacattccagatttctatgcgcagggtcagaagagctacctcgtcaatggtgtgcctacctcgggatggttctcggtggactacaatggcactgagcttggacaagtaactctcaagcagtcaatcaattctcggacgcccagatttgattcaagtttctttgcgctacttgctgttgaagatgtgcagtccaagttcaaacctccaggaatttggctcaatgttcagcatgacagtttctacagccagttcaatctaagcatgaggaattatatcatttctgtatctaagcgtgttgttgccaattatatctcatcacctgaagtgagcttcctcaccagcatacttggaagaattagcaacaaaacaaagcttgtgttccgctttcttgatgagagcactctcgagccatctatgaaccagacatatggctccatgatgaaaaatcttacatttgttaagacatttgcatctgggatacttgtcccaaagagttatatttggcctaattcaccagacaattatctgcaaccatacacttcagttgttgatgatgctcataaagcaggcttggaaatctatgctgctgattttgcaaatgattttctgctcagttacaaccacagctatgatcccttagcagaatatctctcattcattgataatgatgtcttctcagttgatggtgtattgactgatttccctgtcacagcatcagaggcaattggatgttttaccaatttaaacaaaagcaacactgatcatggaaagcctttaattatatcacacaatggtgctagtggggattacccagggtgcactgatctagcttatcaaaaagcagttgatgatggtgcagatgtcattgattgccctgttcaagtgaccaaagatggaataccaatatgcttgtcttccattgacctaatgaccgatactactattgcaagatcgcaattcatctctcagactgccacgataaaggatattcagattgcaccaggggtttttagtttcaacctcacctgggatgacattgtaaagaacctgaaacccaaaatatccaccccatggaccaacttcaaattggaccgaaatccgagatataggaatgcaggaaagttcgtgaggctatcagactttttggagttcacaaaagataaagatttgtctggaatcatgatcagtgtagagcatgctgccttcctggcaggggaacttgggtttgacatggtcgacaaagttatcaaagccctcgacgatgctggttaccatgaacaaactgcccagaaagttatgattcagtcagccgatagttcagttctagagaagttcaaggagcaaacaaagtatgaccttgtgtacatgatcaacaaagaagtcggggacgctgcaccttcctcgctcgcggacattaaaaagtttgctagtgccgtttccgttgatactagctctgtcttccctgaaacccactacttcacagtgtatgaaaccaatcttgtccagacactgcagtcggcaggcctctcggtctacgtttatactcttatgaacgagtttccgtctcagccatacgacttcttctcagatgctacagcgcagattaatgcctatgtcaagggtgctctcgtggatgggctaatcacggatttccctgctacagctcgaagatacaaggtgaacagttgcatgaacatggggaacaatacgccgaatttcatggcccctgttcatcccggtgatctcatgcaaagcattagcaggagtgcgcagccaccagcattggctcccattccgcccttgaccgagtccgatgtggcacagccgcctttgcctcctgccagatcaaacagcagtacagttccgacgcaatcacccgcgagcaggacgcatgcctgtgctgctcacatcccagtccttgtcacactggcaatactttgcacttggcgttccctggtctgagcttgcaatgcaggcagagctggagcaccgatctactaatcagatattcttccccacctgtagcagtagttcgtttgttcagtgaatttgcatctaggggtctgatgcggaatgcctatgacactcctgtgagctctccctgctgacatttcagtacatatatactatgtgggatgggtaatatattttccatttcttcttctcaagactattgaccatgtcctcacaaagaaattaggctatggtcatatgtaagcaagtaagcaactcagattgcatagttgtatgctatctgtttgagcctatgagccatgaactgttatgttctgaacggctgagaaatatgaaaggatggatgtgtttccgggtggacttgtgatctcttactaatctgaataggtgtgttctttcatgtgcgccgtactatgcaggtgctggtgctcctgacttggcagttgttaagttggcatacaatgtcgatgagttcttccttctccaggcttcggacgatatttgcccctgcaatcctacagtctgctgattcggaggccacgttaagttggcatgccctcatccaggtcgtttacccagaggccagagctgagcttgctggaacttgcagttgagtcaggtaggcctcattataatcagatccacctgccactctaccagtgaatcagtgattctacttgccagttgccggtcttggataccagaggcattgcgtgatgtccatgactccatggtaaccagaggcacttgtgtgatgtccatgactccatggtaaccataggcctaagcgccaaggcctactaggctaccaggacctcgattggcaattactccattcatcacccatattttgatttgccgaaaacgacctgcaaatctggttctgatctcatcaccagcattgttcatgataagataagcacagtgatggacagccacatgcacgtgataaggagatgttcggtttgcactttgcacctagtcccttttgagggtaaaatcttatcttctttcttacttgtgtgatctccgtcatcttcttttcctcacaaaaggtcagcaacttggccattaacctgccatgagccatcatggcccccttgtaatcccttcgaggcggcggg

SEQ ID NO: 3311 - DNA, 2652 bp, Setaria italica
gagatgagggcctgccatgtctgttccgttctcgcgcagctcatgctgctgtggctgggcgtcgccgccgcgcagaaggccacttcttggaagacattgagcggcaaggctccagcaatcgtagccaagggtggattttcagggctgttccctgattcaagcccagatgcttatggatttgtgcagtattctagctcgccggatacagtgctatactgtgatgttcggctaaccaaggatgaggttggcttgtgcctgccggacataaagatggacaactgcacaaatattgcagatatctatgcacagggtcagaagagctaccttgtcaatggcgtgcctacatcaggatggttctctgtagactacaataacactgagcttggacaagtgtctctcatccagtcaatcgcttcccggtcacccagatttgattcaaatttctatccaccacttgctgtcgaagatgtgcggtccaaattcaaacctcctggaatttggctcaatgttcagcatgacaggttttacagccagttcaatctaagcatgaggaattatatcatttctgtatctaagcgtgttgttgtcaattatatctcatcacctgaagtgagcttcctcaccagcgtacttggaagagttagcaaaaagacaaagcttgtgttccgctatcttgatgagagcactctcgaaccatctatgaaccagacgtatggttccatgttgaagaatcttacatttgtcaagacatttgcatccgggatacttgtcccaaagagctatatttggcctacttcggcagataattatctgcagccgcacacttcagttgtcaatgatgctcataaagctgggttggaaatttatgccgctgattttgcaaatgactttatgatcagttacaactacagctacgatcccttagcagaatgtctgacgttcattgataatggtgtgttctctgttgatggtgtactgactgatttccctgttacaccatcagaggcaattgggtgttttaccaatttaaacaaaagcaacacagatcatggaaaacctcttattatttcccacaatggtgctagtggggactaccccggttgcactgatctagcttatcaaaaagcagttgatgatggcgcagatgtcattgattgccctgtccaagtgaccaaagatggagtgctagtatgcatgagttcagttaatctaatggatgatactactgttgcaagatcgcaatttgcctctcagacggcagtgatcaaagaaattcagagtgcgcgaggagtctttacgttcaacctcacttgggatgacattgtaaagaatctgagacccataatatctaccccattatccacctacagaatggatagaaatccgaggtacaggaatgcaggaaagttcatgagactatcagactttttggacttcacaaagaataaggatttatcaggaatcatgatcagtatagagcatgccacttttgtggcagaggaacttggatttgacatggttgatacagttatcaaagcccttggcgatgctggttacaacaatcaaactacccagaaagttatgattcagtcgacgaatagttcagttctagagaagttcaagcagcaaacaaagtacgatcttgtgtacatgatcaacgaagaagtcagggatgccacaccttcttccctcgtggacatcaaaaagtttgctagtgccgtatccgttgataccagctctgttttccctgaaccccaccatttcacaatgtacaagaccaatcttgtccagacactgcagactgcgggtctctcggtctatgtttacactctcatgaatgagtttgtgtctcagccatacgacttcttcgcagatgcgacagtgcagatcaatgcgtatgttaagggcgcgggagtggacgggctgatcactgattttcctgccacagctcgaagatacaaggtgaacagttgcatgaacatgggcaacagcgcgccgattttcatggcccctcctcgtgctggcgatctcatgcaaatcatcagcaaacttgcgcaaccaccagcattggctcccatgccgctcctcacagactcggacgtggcggagccgcccctgcctcccgccagatcaaacagcagcacagctccaacacattccggcgcaaccaggatgcatgctcatgctacgcacatcccggtccttgtcacactggcggtgcttttcgcttggtgttccctggtctgagattgcaatgcaagtcacgctcgtcattcgagttggacacagcgccaatctactaatcaaatattcttctctccacctgtagcagactagccttagttcatttgttcagtgaatatgcatttgggggcacatgacacttctctgagttgcccatgctgacgtttcagtacatacatgtaagacggggaagatattgcccatgtcttcttctcaagctctggacaaagtaagggctatgatctagtgtaagcaactcagatggcatagttctctacaatctgagcctatgagccatgactgttctgtcctgaaaggctgaggaatatgaaagttgcgaacacaatccctgaattatgatggtgttacacatgagatggatgtgtttccggattacctgcgcgttct

SEQ ID NO: 3312 - DNA, 2652 bp, Sorghum bicolor
cctcgccgcgccgcgcttccttctcgactcccatgtcccgtcttctcctcccaatttcacgcctccgcttataaataccggcattccggggcacccggcctcgacaagcccaccacgccgcccccccactccacccgcctagggctccgcgccgtccccgaggacaggaggacgcgggcattgccgatccaaacgcgccgccgcgtcaacttttcccgccaactcacctccgccgccgcgtgaactcgcctccgccgccgctccgaaactgattatggatctgctaaggcatcccttcaagggagttgtcactgatatcaaaggaagggccacttggtacaagcatgattgggttgcaggagtccactctggctttaggatattggcacctaccatgtatatcttctttgcctctgctcttcctgtcattgccttcggagcacaactgagcacagcaacaaatggtatactcacaacagttgaaacattggcatcgactgcgatatgtggcatcatacattcaattcttggagggcagcctttactgattgttggagttgctgaaccaactattatcatgtacacttatctctacaactttgccaagaatcaacaagctctgggtgagaagctatatttggcgtgggctggatgggtctgcatctggactgccatcatgttgtttcttttggcaatgttcaatgcttccaacgttattagcagatttacaagggttgcaggagaactttttggcatgttaatcactgttctgttcttgcaagaagctatcaagggaatgattagcgaatttagtgtgcccgaagatgctgacagcagttcaccaatataccaattccagtggctgtatgtcaatggcctacttggtgtcatattttcaattggcttgctgtatactgcattgaggaccaggcgggcaaggtcatggctatatggcataaggcggcttagaagctttatagctgattacggcgtcccacttatggtgattgtgtggacagcattgtcgtatacactgccaggcaagctgccttcaggagtccccaggaggcttttctctccacttccctgggagtcaagttcacagggacactggaccatagcaagggatttgttttccgtccctccagcgtatatacttgcagccattctgcctgctttgatggttgcaggactttacttctttgatcatagcgtagcttcacagttggcacagcaaaaggagtataatttgaagaagccttctgcctaccactatgacattttggtccttggaatcatggtcctgctgtgcggtttgcttggcatccctccatctaatggagtccttcctcagtctcccatgcacacaaaaagtcttgctgtccttaagaggcagttgctaagcaaaaagatggttgatactgccaaggatagcatagggagaagtgctaccactttggaaatatatggcaagatggaagaaattttcatcgaaatggatagcgaacagaatactggttctgttgacaaggagttgaagaactttaaggatgctgttctgcaagaaggcaatgaagaagggaaattggctagagaatttgaccctcggaaacatatagaagcccacttgccggttcgagtgaatgaacagagattgagtaatctgctgcaatccatattggttggtggttgtgttggagctatgccagttatcaggatgataccaacatcggttctctggggttactttgcctacatggccattgacagtctaccagggaatcagttctgggagaggatacagcttttgttcgttgcagaaagccgactctacaaggttcttgaaggtccccatgcatcttttgtggagtcagtggttcccaaaacaataaccatcttcacgatctttcagttggtttacctcctaatatgctttggaataacatggataccgatagccgggatcctgttcccagtgcctttctttctaatgattctcatcaggcagtatctcctccccaaattttttgatcccatcgtcttgagggaactcgatgcagctgagtatgaagaacttgatgggatcgcccttgaacacaatctggaagatgaagtatctgaggtagcaagctgtcctagccgtcctgatgcagagatattggatgaactcacaaccaatcggggagaggtaaaacacagaacttcaagcctgcgtgaagaaagaccaattcaggtaacaatgagcacacatatggttgctacaaatgcggttcagccaagcctgtgaagacataaagtgttttttttttctgtagagggatgatcctcaagctgcattccgttgatgtgaatactgttgctatgtaatgtactgctactactactgctagtgttgtacttgggtttttgacccaaacgcatctgtggggaaggtgtaatttgtaagaactggtgtttatagcgtagactacataggagcgacaggaaggggaagggccgaaagggaacgaggtagaataattatcaatgcagagtctcatatttgttgaatagactgtagtaaccaagtccttcagtacatgatcatcaatgcagagtctcatatttgttgagtttacatttagcttgctctcttggactgcaatcgcgtca

SEQ ID NO: 3313 - DNA, 2297 bp, Panicum virgatum
atggatctgctaagaagtcccttcaggggagtcattgctgatgtcaaaggaagggcagcctggtacagacatgattgggttgctggactccattctggcttcaggatattggcacctaccatgtatatcttctttgcctccgcacttcctgtgattgcctttggagagcaactgagcacggcaacaaatggtagactcacaacagttgaaacattggcatctacggcgatatgtggcatcgtacattcaattcttggagggcagcctttgttgattgttggagttgccgaaccaactattatcatgtacacttatctctacaattttgccaaaaagcagcaaggtctgggagagcaactatatttagcgtggaccggatgggtctgcatctggactgccatcatgttgtttcttttggcaatgttcaatgcttccaatgttattagcagatttacaagggttgcaggagaactttttgggatgttaatcactattttgttcttgcaagaagcaatcaaggggatcataggtgaatttagtgttcctgaagatacagacagcagctcaccaatacaccaattccagtggctgtatgtcaatggcctacttggtgtcatattttccattggcttgctgtacaccgcattgaggaccagacgagcaaggtcatggttgtatggagtaggatgtcttagaagcttcatagctgattatggtgtcccacttatggtaattgtgtggacagcattgtcatataccttgccaagcaaggtgccgtcaggagtccccaggaggctgttgtctccacttccctgggagtcaagttcattgggacactggaccatagtggaggatttgatttctgtccctccggagtatatatttggagccattgtgcctgctctgatggttgcaggactttacttctttgatcatagtgtagcttcacagttggcgcagcaaaaggagtataatttgaagaagccttctgcctaccattatgacatttttgtccttggagtcatggtcctgctctgcggtttgattggcatacctccatctaatggagtccttcctcagtctcccatgcacactagaagtcttgctgtccttaagaggcagttgctaagcaaaaagatggttgatactaccaaggagagcatagggaaaagtgcaaccagtttggaaatatatggcaagatgcaagaagttttcatcaaaatggacagtgaacagaatgctgattctgttgataaggaattgaagaactttaaggatgctgttctgcaagaaggtgatgaagaagggaaattggctagagaatttgaccctcggaaacatatagaagcccacttgcctgttcgagtgaatgaacagagactgagtaatctgctgcaatccatattggttggtggttgtgttggagctatgccagtcatcaggatggtaccaacatcggttctctggggttactttgcttacatggccattgacagtctaccagggaatcagttctgggagaggatccaacttttgttcatcacggaaagccgacgctacaaggttcttgaaggtcctcatgcgtcttttgtggagtctgtgcctcctaaaacaatagccatcttcacgatctttcagttgctttacctcctgatatgcttcggcataacatggatacccatagcgggtatcctgttcccagtgcctttcttccttatgatactcatccggcagtatctcctcccaaagttttttgacccaatcttattgagagaattggacgcagctgagtatgaagaacttgacggcgtcccccacgaacacacactcgaggatgaagtatctgaggtaggaagttgcattagccgtcctgatgctgagatattggatgaactcacaactaatcgcggagagctaaagcatagaacttcaagcctacgtgaagaaagaccggttcaggttccttcaaatgccgttcagccgagcctgtgaagatagggaagtgtttttattgtagaaagtgatgatcctcaagctgcagtccgttgaggtgaatattgttgccatgtaatgtactactaatggtgttgtacttgggcttttaaccccaacgcatctgtgtggagggtgtaatttgtaaggaaaggtagatagcgtaaactagggagtgattggaaagagtaagaagagagaacagatgcaagatagtcttcgtatatgaaagggaaattggggaaacgaagtactccttatcaaatatcattatttaaatagactgtacggatggcccttgcctc

SEQ ID NO: 3314 - DNA, 4161 bp, Panicum virgatum
atttaccgttcctgcgtgcatgctgcctataaacggccttcaaaattcgtcatgcaactattagttgtggtgatagggatacggaaataaacgtgctgaacagtacgtgcagaggccacaataatcccttcatctgaaaaaaaagatacgctgaacagtaatgcattgtttagtcagttgcccctaagcatcactgattaaaacgacgtctgaattactgccggccacctgatgcaaactcgttctgttgttcggagggatcaatctgtttgtcagcttaccctgctgtcacctgtcagtaatctttcaaaaaaaagatatataagagtaaatatatatcatgctacttgtattatatgttatatttatatactaggcgttgacggaatggctattggccagctgcagatgccgccattggccagatagccacacaaataatcaagcgggacgagacgctcgcatcacaggccaagtccaacccggcaggctgcatggtcccgagtgccccgataaaagagagatcccgatcccgatcccgatcccgagcccctgcactcccttctcccctcgcgctcccttctggccagcgctgccgccggccctaggccattgcgccctctccacctcgcgccgcacgccgcacgccgtcgcccgtgcgcacggaagcagcgcacaacgctactgtcgggccgggcgcccaccaggcctcttctgctccccggcgtcaccccttgccgtgcctcgtcgttcgcctgtgtcgccacgcccctctgctcgcgagcctgtggccccgcacgccctctgcagttgcggtgcccctgctccccgtcgccccgcctactcgccggcctcctccctcctaagcgcgcccctgcatgcgcaggtgcagccctgcatcgcccctgcacggcatcgctgcccaggcctgttcgctggtcccgaacagacaagcgccacccgcttccggcttcgattctcgccaccacggtgcgtccccggtgcacgtaagattatggatatgctaagaagtcccttcaggggagtcattgctgatgtcaaaggaagggcagcctggtacagacatgattgggttgcaggactccattctggcttcaggatattggcacctaccatgtatatcttctttgcctctgcacttcctgtgattgcctttggagagcaactgagcacggcaacaaatggtagactcacaacagttgaaacgttggcatctacggcgatatgtggcatcatacattcaattcttggagggcagcctttattgattgttggagttgccgaaccaactattatcatgtacacttatctctacaactttgccaagaaacaacaaggcctgggagagcaactatatttagcgtggactggatgggtctgcatctggactgccatcatgttgtttcttttggcaatgttcaatgcttccaatgttattagcagatttacaaggatcgcaggagaactttttgggatgttaatcactattttattcttgcaagaagcaatcaaggggatcataagtgaatttagtgttcctgaagatgcagacagcagctcaccgatacaccaattccagtggttgtatgtcaatggcctacttggtgtcatattttccattggcttgctttacactgcattgaggaccaggcgagcaaggtcatggttgtatggagtaggatgtcttagaagcttcatagctgattatggtgtcccacttatggtaattgtgtggacagcattgtcatataccctgccaagcaaggtgccgtcaggagtccccaggaggctgttgtctccacttccctgggagtcaagttcactgggacactggaccatagtggaggatttgatttctgtccctccggcgtatatatttgcagccattgtgcctgctctaatggttgcaggactttacttctttgatcatagtgtagcttcacagttggcgcagcaaaaggagtataatttgaagaagccttctacctaccattatgacatttttgtccttggagtcatggtcctactctgcggtttgattggtatccctccatctaatggagtccttcctcagtctcccatgcacacaagaagtcttgctgtccttaagaggcagttgctaagcaaaaagatggttgatactgccaaggagagcatagggaaaagtgcaaccagtttggaaatatatggcaagatgcaagaagttttcatcaaaatggacagcgaacagaatgctgattctgttgataaggaattgaagaactttaaggatgctgttctgcaagaaggtgatgaagaagggaaattggctagagaatttgaccctcagaaacatatagaagcccatttgcctgttcgagtgaatgaacaaagactgagcaatctgttgcaatccatattggttggtggttgtgttggagctatgccagtcatcaggatggtaccaacatcggttctctggggttactttgcttacatggccattgacagtctaccagggaatcagttctgggaaaggatccaacttttgttcatcgcggaaagccgacgctacaaggttcttgaagatcctcatgcatcttttgtggagtctgtgcctcctaaaataatagtcatcttcacgatctttcagttggtttacctcctgatatgcttcggcataacatggatacccatagcgggtatcttgttcccagtgcctttcttccttatgatactcatcaggcagtatctcctcccaaagttttttgacccaatcttattgagggaattggacgcagctgagtatgaagaacttgacggtgtcccccatgaacacacactcgaggatgaagtatctgaggtaggaagctgcattagccgtcccgatgctgagatattggatgaactcacaactaatcgcggagagctaaagcatagaacttcaagcctacgtgaagaaacaccagttcaggttccttcaaatgccattcagccgagcctgtgaagatagggaagttactgtaggaagtgatgatcctcaagctgcagtccgttgaggtgaatactgttgccacgtaatgtactactgatggtgttgtacttgggcttttaacccaagcgcatctgtgtggaaggtgtaatttgtaaggacaggtagatagtgtaaactagggagtgattggaaagagcaagaagagaggacagatgcaagatagtcttcggatatgaaagggaaattggctgaaccgaaatgaagtagaaccatatcaaatatcattatttaaatagactgtacggatggaccttgcctcgttttgttattaagttactcgtacgtagctttgctcctcttcaactgtgcaaatcgtgtcagactgtactaacattcaggttgcttttgggcacaaagtgcgcgtgagtgtgaagactaacaacgacgaacataactgcatgctccgcagactgatgagcagtcgagcaggttgcgttgtcaagcacgccgcggcccaggcaccagtggttcggctcggctagggccctcacctgcgggttattctgcccgccggcctcgttagctgttacgggcggcgcaagtccatatgggccaatttgacgagagcgggcctttccttcttgatcgaccggctgctgctgctacgtagaggcctgctcgcagtgggcctatcctttgacaaaaaaaagatgataaagatggtcatgaatcaaattacaaaagcagcgcctgttgactagtgccaagtgatcaaagcatttaatcctcaactaagatgtacttatccaagaacccttagcctgatctgttatatctccacgtcactctaaacgctgttatacaacaaagggatacaaatcttctacggtacttcaccctacagtttggtcactgacgtggaggtctgaccccgcatggaagtgacagaagaacccagttccaataaagaaacccctcctttgatcaggttcagattttttattttacctggctgcccgcctaaattattgctgacccagcccggatgttcctttcgcccggatcagcactccagatcacctccaggtccgaaagcgtctcgtcgctgctttccaggcagctcgtttttacttcctcctggaaagagacgcgactggtgtagcagt

SEQ ID NO: 3315 - DNA, 2027 bp, Setaria italica
attatggatctactaaggaatcccttcaagggagtcatcgctgatatcaaaggaagggcagcttggtacaggcatgattgggttgcaggactccgttctggatttaggatattggcgcctaccatgtatatcttctttgcctctgcacttcctgtcattgccttcggagaacaactgagcacggcaacaaatggtatactcacaacagtagaaacattggcatctacggcgatatgtggcatcatacattcaattcttggagggcagcctttgttgattgttggagttgccgaaccaactattatcatgtacacttatctctacaactttgccaagaagcagcaaggcctgggagagcagctatatttggcgtgggctggatgggtctgcatctggactgccatcatgttgtttcttttagcaatgttcaatgcttccaacgttattagcagatttacaagggttgcaggagaactttttgggatgttaatcactgttttgtttttgcaagaagcaatcaaggggatcataaatgaatttagtgtgcctgaagatgcagatagcagctcgccaatataccaattccagtggctgtatgtcaatggcctacttggtgtcatattttccattggtttgctgttcactgcattgagaaccaggcgagcaaggtcatggctttatggagtagggtggcttagaagcttcatagctgactacggtgtcccacttatggtaattgtgtggacagcattgtcatataccctcccaagcaaggtgccatcaggagtccccaggaggcttttctctccacttccctgggagtcaagttcgctgggacactggaccatagtgaaggatttgttttctgtccctccggcatatatatttgcagccattctgcctgctctgatggttgcaggactttacttctttgatcatagcgtagcttcacagttggcgcagcaaaatgagtataatttgaagaaaccttctgcctaccattatgacattttggtccttggaatcatggtcctgctctgcggtttgattggcatccctccatcaaatggagtccttcctcagtctcccatgcacacgaggagtcttgctatccttaagagacagttgctaagcaaaaagatggtcgatactgccaaggagagcatagggaaaagtgctactagtttggaaatatatggcaagatgcaagaagttttcatcgaaatggatagcgaacagaatactgattctgttgacaaggagttgaagaactttaaggatgctgttcttcaagaaggtgatgaagaggggaaattggctggagaatttgaccctcggaaacatatagaagcccacttgcctgttcgagtgaatgaacagagactgagtaatctgctgcaatccatattggttggtggttgtgttggagctatgccagtcatcaggatgataccaacatcggttctctggggttactttgcctacatggccattgacagtctaccagggaatcagttctgggagaggatgcaacttttgttcattgcagaaagccgacactacaaggttcttgaaggtcctcatgcatcttttgtggagtcggtgcctcccagaacaataaccatcttcacagtatttcagttggtttacctcctgatatgcttcggcataacatggataccgatagcgggtatcctgttcccagtgcctttcttccttatgatactcatcaggcagtatctcctgccaaagttttttgatccaatcgtattgagggaactggacgcagctgagtatgaagaacttgatggcgtcccccacgaacacactctggaggatgaagtatccgaggcaggaagctgcattagccgtcgagatgctgagatattggatgagctcacaaccaaccgcggagagctaaagcacagaacttcaagcctgcgcgaagaaagatcggttcaggtaaataatgggcatgcagatggtaccacaataggtgttacaaggggattagagatgatttagtg

SEQ ID NO: 3316 - DNA, 3103 bp, Panicum virgatum
cggccaggcggccacggtcgcctcggcagtgatgccgttgcggagccggtcagcaccagccgggcgccccgcgccccggccgcggcctcctctcctcgctcgcctcctcggccacgtgctgggtggacccccgcaggcgcggggtcagcagcgggcccggtccaagtgtcacggcttgaccccacttgtcggtgagcgagagcgagcagacgtcacgcctaccccactcgtcagtgaccgaggcggagtcgagggagagcagaattgatggggagcgcgtcctcctcccttctcttctctcccctgcgcttggcatcgccttcgcctccctcctcccatgcctcccatctcctcccaatttgacgcgctcgcttataaataccggcattcgcgggactcgcgtagcccaccaccacgccgcggcccggaccgccgcctccgtccgcctagggttccgcgctgcgccgacgaggactcggcattaccgatccaaacccgctcgccaactcgcccggcctccgccgccgccgccgctccgcaaccgattatggatctgctaagaagtcccttcaggggagtcattgctgatgtcaaaggaagggcagcctggtacagacatgattgggttgcaggactccgttctggcttcaggatattggcacctaccatgtatatcttctttgcctctgcacttcctgtgattgcctttggagagcaactgagcacggcaacaaatggtagactcacaacagtcgaaacattggcatctacggcgatatgtggcatcatacattcaattgttggagggcagcctttgttgattgttggaattgccgaaccaactattatcatgtacacttatctctacaactttgccaagaagcagcaaggcctgggagagcaactatatttggcgtggaccggatgggtctgcatctggactgccatcatgttgtttcttttggcaatgttcaatgcttccaatgttattagcagatttacaagggttgcaggagaactttttgggatgttaatcactgttttgttcttgcaagaagcaatcaaggggatcataagtgaatttaatgttcctgaagatgcagacagcagctcaccaatacaccaattcccgtggctgtatgtcaatggcctacttggtgtcatattttccattggcttgctgtacactgcattgaggaccaggcgagcaaggtcatggttgtatggagtaggatgtcttagaagcttcatagctgattatggtgtcccacttatggtaattgtgtggacagcattgtcatataccctgccaagcaaggtgctgtcaggagtccccaggaggctgttgtctccacttccctgggagtcaagttcactgggacattggaccatagtggaggatatgatttctgtccctccggcgtatatatttgcagccattgtgcctgctctgatggttgcaggactttacttctttgatcacagcgtagcttcacagttggcgcagcaaaaggagtataatttgaagaagccttctgcctaccattatgacatttttgtccttggaatcatggtcctgctctgcggtttgattggcatccctccatctaatggagtcctacctcagtctcccatgcacacaagaagtcttgctgtccttaagaggcagttgctaagcaaaaagatggttgatactgccaagaagagcatagggaaaagtgcaaccagtttggaaatatatggcaagatgcaagaagttttcatcgaaatggacagcgaacagaatgctgattctgttgataaggaattgaagaactttaaggatgctgttctgcaagaaggtgatgaggaaggaaaattggctagagaatttgaccctcggaaacatatagaagcccacttgcctattcgagtgaatgaacagagactgagtaatctgctgcaatccatattgattggtggttgtgttggagctatgccagtcatcaggatggtaccaacatcggttctctggggttactttgcttacatggccattgacagtctaccagggaatcagttctgggagaggatccaacttttgttcatcgcggaaagccgacgctacaaggttcttgaaggtcctcatgcgtcttttgtggaatctgtgcctcctaaaacaatagccatcttcacgatctttcaattggtttacctcctgatatgcttcggcataacatggataccgatagcgggtatcctgttcccaatgcctttcttccttatgatactcatcaggcagtatctcctcccaaagttttttgacccaatcttattgagggaattggacgcagcagagtatgaagaacttgacggcgtcccccacgaacacacactggaggatgaagtatctgaggtaggaagctgcattagccgtccggatgctgagatattggatgaactcacaactaatcgtggagagctaaagcacagaacttcaagcctacgtgaagaaagaccggttcaggttccttcaaatgccgttcagccgagcctgtgaagatcgggaagtgttttttctatagaaagtgatgatcctcaagctgcagttgttgaggtgaatatcgttgccacgtaatgtactactgatggtgttgtacttgggcttttaacccaaatgcatctgtatggaaggtgtaatttgtaaggacaggtagatagcgtaaactaggagtcattggaaagagtaagaagagtgaacagatgcaagataatcttcggatatgaaagggaaattggctgagaaccgagtagaaccatatcaaacatcattatttaaatactgtacggagggcccttgcctcgttttgttgttaaactgctcctcttcgactgtgcaaatcgtgtcagactgtactaacattcaggttgcttttgagcacaaagtgcgcgtgaatgtggcgattaacaacgaagaacatagctgaacatgctcagctgactgatgagcagccgagcaggtcgtattgtccagcacgcagtgttagtctaagcagtaatccccccatcgaaaaagaaagtgattctaggaattttaggacaaattaagagtgtgtttagttgg

SEQ ID NO: 3317 - DNA, 2656 bp, Brachypodium distachyon
agtagccgcgtgtcacggcggcctcgagaagccaaccgcgccgctcgtaacacacccgccgccgcctagggttctccgctcccgcgccgaggagaagccggcattgccgatccgacccgccgttccccctgccgccgccgcccttaaccgtcgatggatttactaaggaaccccttcaagggagtcgtcgccgatgtcaaagggagagcatcttggtacaaggacgactgggttgctgggctccgtgctggtttcaggatattggcccctaccatgtatatcttttttgcctctgcactccccgtcatcgcctttggagagcagctgagcagagaaacaaatggtatgctgagcacagttgaaacattggcatccaccgcgatatgtggggtaatacattcgattcttggagggcagccattgttgattgttggagttgcagaacctaccattatcatgtatacgtatctctacaactttgccaaggaggaggcaggtttgggagaacagctatatttggcttgggctggatgggtctgtatttggactgctatcatgttgttttttctggcaatgttcaatgcttccaatgtgattagcagatttacaagggttgcaggagaactatttgggatgttgatcactgttctgttcctgcaacaagcaatcaagggaattgtaagtgagttcagtttgcctaaagcggctgaaattgttgaccgcagttcactgatatatgatttccagtggatatacgtcaatggcctgcttggtgtcattttttcaattggcttgctatacactgcattgaagagtaggcgggcaaggtcatggctgtatggcataggatgccttagaagcttcattgccgattatggtgtcccgctaatggtgattgtgtggacagcattatcgtacacactaccaagcaaagtcccttcaggagtgcctcggaggctcttcagtccacttccctgggagtcaagttcactgggacattggaccgtagcaaaggatctgttttctgtccctccggcatttatatttgcagccatcgtgcctgctttgatggttgcagggctttatttctttgaccacagtgtagcttcacagttggcgcagcaaaaggagttcaatttgaagaagccttctgcctaccattacgacattttggtacttgggttcatggtactactatgtggtttgattggcatccctccatcaaatggagtacttcctcagtccccaatgcatacaagaagccttgctgtcctcaagggtcagttgatgcgcaacaagatgctccaaactgccaaagagggcatgacgaaccgtgctagcagtttggaaatatatggcaagatgcaggaagttttcatccaaatggatagagaaaagaatactgattctgttgacaaggagttgaagagtttgaaggatgctgtgctgagagaaggcgacgaagaaggaaaattggctggagaatttgatccaagaaaacatatcgaagcccatttgcccgttcgggtaaatgaacagagactgagtaacttgctgcaatccttactggttggtggctgtgttggggctatgccagttatcaagatgataccgacttctgtcctctggggttactttgcttacatggcaattgatagcctacctggtaaccaattttgggaaaggataaagcttctgttcatcggatcaacccgacgctacaaggtcctggaaggtccacatgcatctttcgtggagtcagtgccttcaaaaacaatatctgtcttcacgatcttccagctggtctatctcttgatatgcttcggcacaacatggataccaatagcagggatcctcttcccagtgcctttctttctcatgattctcatcaggcagcacctactcccaaagtttttcgatcccaatcacttgagggaactagacgctgcagagtatgaagaacttgaaggggtccagaacgaacacacgctggaggaagatggctctatttcaggaagctgtgacagcaggaacgatgccgagattctggatgaactcacaacaaaccgtggagagctaaagcacagatccgtaagccaccgtgaagaaaggcaccttcaggtgcattcaaacgccgttcagccaagcgtgtgaagataggaaaatacctccagtactgtagctttccagcttattctatcagaagtgtagaatatatccccagctagcagttcattgctgatggaacatgatattgtcgattaatttgtataatactgtagcaaaagttttgcgcccataagccatgattaattgtgtgtggtaagtaagatcgggcgattagcagaagacaatatataaggggcaacacggtgaaaaaaatataggatatgaaaagcggaactgtgcgctaggatagtacagtgtatgagtttgcgatggaagattagcacgttaggtaacgctgcgaatccgttgttctgtgaactgtaagttgccggttgtacttaggtggttctgtttgactgcaacaaaattgatatttttatgagaagcagtaaattaactttttgatcggcctccgttttgatcctttgttctcaatatctttttctgatgataatcatggcctgtaattttatttttctaaatcaag

SEQ ID NO: 3318 - DNA, 3307 bp, Oryza sativa
tcgccctcgattataaataccccctcccccgccgcggcggcgcagaaacccgcgtctccgccaccaccctctaactctagggtttcgctcccgcgccgtcgagcggccagcattgccgccgccgccgcggccgccgcaaccccgcgcgccatcgatttgctcgacgactgatcttctgcttagtctcgagctgagtacagctgatggatctactaaggactccctttaagggagtcgtcgctgatatcgaaggccgagtagcttggtacaagcatgactgggttgctggattccgctctggcttcaggatattggcacctaccatgtatatcttctttgcctctgccctcccagtcatcgccttcggagcgcaactgagcagagaaacaaatggtatactcaccacagtagaaacactggcatctactgcattatgtggcatcatacattcaattcttggagggcagcctctgttgatagttggagttgcagagccaactataatcatgtacacgtatctctacaactttgccaagaaccagcaagctctgggggaacgactgtatttagcatgggctggatgggtctgcatctggactgcgctcatgttgtttcttctggcaatgttcaatgcttctaatgttattagcaggtttacaagggttgcaggagaactttttgggatgttgattactgttctgttcctgcaacaagccattaaaggaattatagaggaattcaaggtgcctagagatgcagaccatagttcacctatatatcaattccagtggctgtatgtcaacggcctgcttggtgttatcttttcaattgggctgttatacactgcattaaggtcaagaagggcaaggtcatgggtgtatggtcaagggtggctcagaggcttcattgctgattatggtgtcccacttatggtgattgtttggacagcattctcgtacacgttaccaaaggatgttccttcaggagttcctaggaggctgttcagtccacttccctgggagtcgagttcactgcaacattggacggtagcaaaagatctgttttcagttcctccagcatacatatttgctgccattctgccggctttgatggttgcaggactttacttctttgatcatagcgtggcttcacaattggcgcaacaaaaagagtttaacttgaagaaaccctctgcctaccattatgacattttggtcctcggattcatggtcctgctttgtggtttgatcggcatccctccatctaatggagtacttcctcagtctccgatgcatacaagaagccttgcagtccttaaggggcagctgctacgcaaaaagatggttcaaactgccaacgaaggcctgatgaatcgtgctagcagtttggaaatctatggcaagattcaaggggttttcatcgagatggactgcgaaaaaaatactgattctgttgacaaggagttaaagagcttgaaggatgctattctgcaagaagttgataaagaagggacattggctgaagaatttgaccctataaaacatattgaagcacatttgcctgttcgagtgaatgagcagagactaagtaacttgctgcaatccttattagttggtgcttgtgttggagctatgccagtcatcaagatgataccgacatcggtcctctggggttactttgcttatatggctattgacagtctacctggcaaccagttttgggaaaggttaagacttatattcatcccatcaagccgacgctacaaggttcttgagggtccccatgcctctttcatggaatcagtgccttcaaaaacaattactgtcttcacgatcttccagttggtttacctcttgatatgcttcggcattacgtggataccaatagcagggatcctgttcccgctgccattcttccttatgattcttatcaggcagcatgtcctcccaaagttttttgagccaaatgaccttcgggaattggacgcagctgagtatgaagagcttgaaggtgtccaccacgatcacacgctggaggatggtgaatctgattcaggaagctgtggcagccgtgacgacgctgagatatttgatgagctgacaactaaccgtggagagctaaagcacagaacttccagccaccgtgaagaaaggcacctgcaggtgcattcaaacgccattcaacccaggtgtggagatactgaaaacttgtccgagtgctaatgaatttctgcttattctgtcggatgagtatattataggcgtatatagcacttcctcaagcagcggtccgttgtattatatacataatacattcatactttcatatacatcgtactgtagctggagatcggccgtacgatatgacatgcttgtacgttgtcaacttgtcacattgtgcatgcagtaaacagaagcaactggattttactgaaggtctgtaaggctgtgtgacatgtagatttcaatgttctctagcctgtgaattgttgctcctagattgttctgtttgattgtaaaattgcatggcaatcaatatggaatatagatgtggagtttgggctttcaatgcagtagcacttgatgtttcgtttgatctggcataagcttttagcgttttatttatatagaaaacactcgtgcaaaaagtaagtggatggactcccaagatggtcatgtccaacttgaggaagaggaagaagacggggaagacggggttgccgaagacgaggttgaactcggcggtgagagagaagggcgtgcggcgcaggcatgggagccgaggggcccgacattgacgcggacggagatggagaatgggaggctggggcagtgggctagaggaggagatggtggagacaacgaaccgaagagcgctcacgcgagtcaccgctggtagagagatcggactggaaaggcagcctgagcatcccgattggtacgttgccccgcatcaatggtcgtcatcgtggaatttgatcgatgccatgaaggtcgatgggtgcgtgccggggagagggccgtcacggccgtcaacctccactccagtgccgcctgggcctctccgcatgctgtcgcggcctggtcaactagctgagagagagataagggaagtggagagtttgactagtgggttccacaccgtttttcaccccgagttgtcacattggtatgtcacatggataaaaatgaagtggcaaatagttaaattttcgtttacaaccaatgctatgtatatcatcggtcaagaaataatacttttccctatgtcggtactagctatactctcctaccgatcatctatatga

SEQ ID NO: 3319 - DNA, 2453 bp, Triticum aestivum
acgagggtccggcattgccgatcggacccgcgcgccgcgtcctcctacccctcgcgcccgccgccgacgccgcctgctcaccgctagctgatggatctactagggaaccctttcaagggggtcgtcgccgatgccccagggagagcgtcttggtacaaggacgactgggttgcagggctccgaactggcttcaggatattggcacctaccatgtatatattctttgcctctgcactccctgtcatctccttcggagagcagctgagcaacgaaacagatggtatcctaagcacagttgaaactctggcatctacggcgatatgtgggataatacacgctattcttggagggcaacccctcctgattgtcggagttgccgaacctaccattataatgtacacgtacctttacaagttcgccaagaagcagccagatctgggagaacagctatatttggcttgggctggatgggtctgcatttggactgctatcatgctctttctgttggcaatgttcaatgcttccaatgttataagcagattcacgagggttgcaggagagctttttggtatgcttatcaccgtcctcttcctgcaacaagctatcaagggaattgtaagcgagttcagtatgccgaaagatgatgagatttctgaccccagctcacccatataccagttccagtggatttatgtcaatggcctacttggtgttatattttccattggcttgctgtacactgcactgaagactaggcgtgcaaggtcatggctgtatggcataggatggcttagaagcttcattgccgattatggcgtaccgctgatggtgattgtgtggacagcattttcatttacactaccaagcaaagtcccttcaggagtgcctaggaggctcttcagtccacttccctgggagtcaatctcactgcgacattggaccgtagcaaaggatttgttttctgttcctccaacatatatatttgcagccatcgtgcctgctttgatggtcgcaggactttatttctttgatcacagtgtagcttcacagttggctcagcaaaaggagttcaatttgaagaagccttctgcctaccattatgacattttggtacttggattcatggtcctactatgtggtttgcttggcattcctccatcaaatggagtacttcctcagtccccaatgcatacaagaagccttgctgtcctcaaggggcagttgctacgcaaaaagatgcttcaaactgccaaagagggcatgtcaaaccgtgcgagcagtttggaaatctatggcaagatgcaggaagtgttcatccaaatggatagcaaccagaatgctaattctgttgacaaggacttgaagagcttgaaggatgctgtgctgtgggaaggtgacgaagaagggaagttggctggagaatttgatcctagcaaatatatcgaagcacatttgcctgttcgcgtgaacgaacagagactaagcaacctgctgcaatccttacttgttggtggttgtgtgggagctatgccggttatcaagatgataccaacttcggtcctctggggttactttgcctacatggccattgatagcctacctgggaaccagttttgggaaaggttgcagcttctgtgcattggagcaagccgacgctacaaggtcttggaaggcccacatgcatctttcgtggagtcagtgccttcaagaacaatatctgcctttacggtcttccagtttgtgtatctcttgatatgcttcggcataacatggataccagtagcagggatcctcttcccgctgcctttcttcattatgattctcatcaggcaacacctactcccaaagttctttgagcccaatgacttgcgggaactggacgcagccgagtacgaagaacttgaaggtgtcccacatgaacaaatactggaggaagatggctcaaattcaggaagctgtgacagcagagacgactctgaaatattggatgagctcacaacaaaccgtggagagctgaagcacagatccgtaagccatcctgaagaaaggcaccttcaggtccactcaaatgcagttcagccaagcgtgtgaagatggaaaaaacgtcccgaggtccaaggctttgatggtgattctgtcagaagtgtagattatggtgaaggcattgttcatttccgaatacgccattgtccagtaatgtgcatggtactgtagctagcgcttatccggtaagctgtgatcgtgtacgctaggaagtaaagctcaggtgattagcagtgagagcagactgaagaaagtgtattggatatggaagggggaacttgccagaatagtactactagtaatggttacaagtaggcagattagccctttaggtattgccaagactgtttgttgctccgtgacctgttgcctgtgtaaaaatcgcttgctctgtctgagtgtaaagggtt

SEQ ID NO: 3320 - DNA, 2589 bp, Hordeum vulgare
ggcaccacaccacaccacaacagctgcttccaccgccgcgccgaggagccacccggccgcgcaccgcaccgcttccttcctcctccttgccccgccgcccgttcggatcaccgctcatggatctactgaggaaccccttcaagggagtggtcgcagatgtcaaagggagagcgccttggtacaaggacgactggcttgcagggctccgagctggcttcgggatattggcacctaccatgtacatattctttgcctccgcgctccctgtcatcgccttcggagagcagctcagcaacgaaacaaatggtattctcagcacagttgaaaccttggcatctactgcaatatgcgggataatacatgcgattcttggagggcagccgatgatgatcgttggagtcgcggaacctactattataatgtatacgtatctctacaacttcgccaagaagcagccaggtctgggagaacggctatacttggcttgggctggatgggtctgcatttggactgctatcatgttgtttctcttggcaatgttcaatgcttccaatgttataagcagattcacgagggttgcaggagaactttttgggatgttgatcaccgttctcttcctgcaagaagctatcaagggaatcgtgggcgaattcagtatgccgaaagatgctgagatatttgaccgcagttcgccgatataccagttccaatggatatatgtcaatggcctacttggggttatcttctcaattggcctgctatacagtgcactcaagactaggcgggcaaggtcatggctgtatggtataggatggcttaggagcttcattgccgattatggtgtcccgcttatggtgatcgtgtggacggcattttcgtacgcgctaccgagcggggtcccttcaggagtgcctaggagactcttcagtccacttccttgggagtcaagttcattgggtcattggaccgtagcaaaggatttgttttctgtccctccggcatatatatttgcagccatcgtgccagctttgatggttgcgggactctacttctttgatcatagtgtagcttcacagttggctcagcaacaggagttcaatctgaagaaaccttccgcctaccattacgacattttggtacttggattcatggtcctactgtgtggtttaattggcattcctccagcaaatggagtacttcctcagtcccccatgcatacaagaagccttgctgtcctcaaggggcagctaatgcgcaaaaggatgcttcgaactgccaaagaaggcatgtcgaaccgtgcaagcagtttggaaatctatggaaagatgcatgaagtgttcatcgaaatggataataaacaggatgctgattctgttgacaaggacttgaagagtttgaaggatgctgtgctgcgtgaaggcgacgaggatggaaaattggctggagaatttgatccaagaaaacatattgaagcacatttgcctgttcgtgtcaacgaacagagactaagcaacctgctacaatccttgctggttggtggctgtgttggagctatgccggttatcaagatgataccgacttcagtcctctggggttactttgcctacatggccattgatagcctacccgggaaccagttttgggaaaggatacaacttttattcgttggagcaagccgacgctacaaggttttggaaggtccccatgcatcttttgtggagtcggtgtcttcgagaacgatatatgtctttacgatctttcagattgtgtacttcttgatatgtttcggcacaacatggataccgattgccgggatccttttcccgctacctttcttcctcatgattctcatcaggcagtacctgctccccaagttttttgagcccaatgacttgcgggaactggacgcggctgagtacgatgaacttgaaggggtccaacatgaacacacattggaggaagatggctccatttcaggaagctgcgacggcaggattgacgctgagatattggatgaactcacaacacaccgtggggagttgaaacacagggttgtgagccatcgtgaagaaagacaccttcaggtccattcaaatgccgttcagccaagcgtgtgaagatagaacaatggcccaggaccgaccgaggatttcatcaatgattctatcggaaatgaggagggaaatcctcaggcagtcgttctttgccgactgcactattatctttccgtgataatatgcacggtactggtagtatagcactttccataagacaggtagcagtgagagcagcagactgaaggaagtattgccggaatagcaacggtgaggagtagaaagattagctgagttggtattggaggaaaactgtccctctgtgatctgttgttgcttgtgtgcctggctttgttctgtttgagtgtaccatgttaaaagtattgcttgataagcaacggcaccgggatttctctccccgccaccaactaccggagtggcatgcaccgaagcatccacgggttcgccggtgaagcttgatagatgagactagccttagccgccgtacgaaataagtcgataatgcaataacacc

SEQ ID NO: 3321 - DNA, 2621 bp, Hordeum vulgare
ttgggcaccacaccacaccacaacagctgcttccaccgccgcgccgaggagctacctacccggccgcgcaccgcaccgcttccttcctcctccttgccccgccgcccgttcggatcaccgctcatggatctactgaggaaccccttcaagggagtggtcgcagatgtcaaagggagagcgccttggtacaaggacgactggcttgcagggctccgagctggcttcgggatattggcacctaccatgtacatattctttgcctccgcgctccctgtcatcgccttcggagagcagctcagcaacgaaacaaatggtattctcagcacagttgaaaccttggcatctactgcaatatgcgggataatacatgcgattcttggagggcagccgatgatgatcgttggagtcgcggaacctactattataatgtatacgtatctctacaacttcgccaagaagcagccaggtctgggagaacggctatacttggcttgggctggatgggtctgcatttggactgctatcatgttgtttctcttggcaatgttcaatgcttccaatgttataagcagattcacgagggttgcaggagaactttttgggatgttgatcaccgttctcttcctgcaagaagctatcaagggaatcgtgggcgagttcagtatgccgaaagatgctgagatatttgaccgcagttcgccgatataccagttccaatggatatatgtcaatggcctacttggggttatcttctcaattggcctgctatacagtgcactcaagactaggcgggcaaggtcatggctgtatggtataggatggcttaggagcttcattgccgattatggtgtcccgcttatggtgatcgtgtggacggcattttcgtacgcgctaccgagcggggtcccttcaggagtgcctaggagactcttcagtccacttccttgggagtcaagttcattgggtcattggaccgtagcaaaggatttgttttctgtccctccggcatatatatttgcagccatcgtgcctgctttgatggttgcgggactgtacttctttgatcatagtgtagcttcacagttggctcagcaacaggagttcaatctgaagaaaccttccgcctaccattacgacattttggtacttggattcatggtcctactgtgtggtttaattggcattcctccagcaaatggagtacttcctcagtcccccatgcatacaagaagccttgctgtcctcaaggggcagctaatgcgcaaaaggatgcttcgaactgccaaagaaggcatgtcgaaccgtgcaagcagtttggaaatctatggaaagatgcatgaagtgttcatcgaaatggataataaacaggatgctgattctgttgacaaggacttgaagagcttgaaggatgctgtgctgcgtgaaggcgacgaggatggaaaattggctggagaatttgatccaagaaaacatattgaagcacatttgcctgttcgtgtcaacgaacagagactaagcaacctgctacaatccttgctggttggtggctgtgttggagctatgccggttatcaagatgataccgacttcggtcctctggggttactttgcctacatggccattgatagcctacccgggaaccagttttgggaaaggatacaacttttattcgttggagcaagccgacgctacaaggttttggaaggtccccatgcatcttttgtggagtcggtgtcttcgagaacgatatatgtctttacgatctttcagattgtgtacttcttgatatgcttcggcacaacatggataccgattgccgggatccttttcccgctacctttcttcctcatgattctcatcaggcagtacctgctccccaagttttttgagcccaatgacttgcgggaactggacgcggctgagtacgatgaacttgaaggggtccaacatgaacacacattggaggaagatggctccatttcaggaagctgcgacggcaggattgacgctgagatattggatgaactcacaacacaccgtggggagttgaaacacagggttgtgagccatcgtgaagaaagacaccttcaggtccattcaaatgccgttcagccaagcgtgtgaagatagaacaatggcccaggaccgaccgaggatttcatcaatgattctatcggaaatgaggagggaaatcctcaggcagtcgttctttgccgactgcactattatctttccgtgataatatgcacggtactggtagtatagcactttccataagacaggtagcagtgagagcagcagactgaaggaagtattgccggaatagcaacggtgaggagtagaaagattagctgatttggtattggaggaaaactgtccctctgtgatctgttgttgcttgtgtgcctggctttgctctgtttgagtgtaccatgttaaaagtattgcttgataagcaacggcaccgggatttctctccccgccaccaactaccggagtggcatgcaccgaagcatccacgggttcgccggtgaagcttgatagatgaaactagccttagccgccgtacgaaataagtcgataatgcaataacacctccatgtttaatggagagtgttact

SEQ ID NO: 3322 - DNA, 2652 bp, Oryza sativa
gattataaatagccgcacatcacgggggccttgaggtttgaggagccaaccccgccccgcgccgccccgccgcggccgcgtcgtctcctccgccacctccacgtctagggttcccctccgccgtcagcattgcccgccggagcttctggttagtattgagtggaattcagctgatggaactactaaagattccctttaagggtgtcgtcgctgatatcgaaggccgagcagcttggtacaagcatgattggcttgagggattccactctggcttcaggatattggcacctactatgtatatattttttgcctctgccctcccagtcatagccttcggaacgcaactgagcagagaaacaaatggtatactcaccacagtagaaacactggcatctactgcaatatgtggcatcatccattccattcttggagggcagcctctgttgatagttggagttgcagagccaactataatcatgtacacgtatctctacaactttgccaagaaccagcaagctctgggggaacgactgtatttagcatgggctggatgggtctgcatctggactgcgatcatgttgtttcttctggcaatgttcaatgcttctaatgttattagcaggtttacaagggttgcaggagaacttttcgggatgttgatcactgttctgttcctgcaacaagctattaaaggaattatagaagaattcaaggtacctggaggtgtcgaccatagttcacctatatatcgattccagtggttgtatgtcaacggcctacttggtgtaatcttttcaattgggctgttatacactgcattaaggtcaagaagggcaaggtcatgggtgtatggtcaagggtggctcagaggcttcatttctgattatggtgtcccacttatggtgattgtttggacagcattatcgtacgcattaccaaaggatgttccttcaggagttcctaggaggctgttcagtccacttccctgggagtcaagttcactgcatcactggaccatagcaaaggacctgttttctgttcccccagcatacatatttgctgccattctgccagctttgatgattgcaggactttacttctttgatcatagcgtggcttcacaattggcgcaacaaaaggagtttaacttgaagaagccctctgcttaccattatgacattttggtcctcggattcatggtcctgctttgtggtttgattggcatccctccatctaatggagtacttcctcagtccccgatgcatacaagaagccttgctgtccttaaggggcagctgctacgcaaaaagatggttcaaactgccaacgaaggcctgatgaatcgtgctagcagtttggaaatctatggcaagatgcaaggggttttcattgagatggactgtgaaaaaaatactgattctgttgacaaggagttaaagagcttgaaggatgctatgctgcaagaaggtgataaagaagggacattggctgaagaatttgaccctataaaacatattgaagcacatttgcctgttcgagtgaatgagcagagactaagtaacttgctgcaatccttattagttggtgcttgtgttggagctatgccagtcatcaagatgataccgacatcggtcctctggggttactttgcttatatggccattgacagtctacctggcaaccagttttgggaaagaataagacttatattcatcccatcaagccgacgctacaaggttttggagggtccccatgcgtctttcatggagtcagtgccttcaaaaacaattactgtcttcacgatcttccagttggtttacctcttgatatgcttcggcataacatggataccaatagcagggatcctgttcccgttgccattcttccttatgattcttatcaggcagcatgtcctcccaaagttttttgagccaaatgaccttcgggaattggatgcagctgagtatgaagagcttgaaggtgtccaccacgatcacacgctggaggatggtgcatctgattcagaaagctgtggcagccgtgacgatgccgagatattagatgagctgacaactaaccgtggagagctaaagcacagaactttcaaccaccgtgaagaaaggcacccgcaggcgcatacaaaagccgttcagcccaggtgtggagatacagaaaactggtccgagtgctaaagaatttcggcttactgtcggatgggtatacgataggcatatatagcacttcctcatacattcctactttcctatacatcgcactgtagcaggagatcggcggccgtatgatatgatatgcttgtcagttgtcacattgtgcatggagtaaacagaagcaactggattttacgatgttctctagcctgtgaaatgttgctccttgattgttctgttcgattgtaaaattgcatggcaaatcagatgtggggagtagcacttcatgtttcgtttgctatggcataaacttttagcctttttattattgacaaaattggttatatagcatcgaaccaattttgcctataacttactgtagcacgcagacgcaggagctcacatcctagggaaggatgggaacatgcacagtgcgcacggaaaacggagtaatctattagcgtgtgattaattaagtatttta

SEQ ID NO: 3323 - DNA, 2482 bp, Secale cereale
acgagggtccggcattgccgatcggaccagcgcgccgcgcccttctcacctcctacccctcgcgcccgccgccgccgcgcgttcaccgctagctgatggatctactgatgaacccttttaagggggtcgtcaccgatgtcaaagggagagcgccttggtacaaggacgactgggttgcagggctccgaactggcttcaggatattggcacctaccatgtatatattctttgcctctgcactccctgtcatctccttcggggagcagctgagcaacgaaacagatggcatcctgagcacagttgaaactttggcatctacggcgatatgtgggataatacacgctattcttggagggcagcccctgctgatcgttggagttgccgaacctactattatcatgtatacgtatctctacaagtttgccaagaagcagccagatctgggagaagggctatatttggcttgggctggatgggtctgcatttggactgctatcatgctctttcttctggccatgttcaatgcttccaatgttataagcagattcacgagggttgcaggagagctttttggtatgcttatcaccgtcctcttcctgcaacaagctatcaagggaattgtaagcgagttcagtatgccgaaagatgatgagatttctgaccccagctcacccatataccagttccagtggatttatgtcaatggcctacttggtgttatattttccattggcttgctgtacactgcactgaagactaggcgtgcaaggtcatggctgtttggcataggatggcttagaagcttcattgccgattatggtgtaccactgatggtgattgtgtggacagcattttcatttgcactaccaagcaaagtcccttcaggagtgcctaggaggctcttcagtccacttccctgggagtcaatctcactgagacattggaccgtagcaaaggatttgttttctgtccctccaacatatatatttgcagccatcgtgcctgctttgatggtcgcaggactttatttctttgatcacagtgtagcttcccagttggctcagcaaaaggagtttaatttgaagaagccttcggcctaccattatgacattttggtacttggatttatggtcctactatgtggtttgcttggcattcctccatcaaatggagtacttcctcagtccccaatgcatacaagaagccttgctgtcctcaaggggcagttgctacgcaaaaagatgcttcaaactgccaaagagggcatgtcaaaccgtgcgagcagtttggaaatctatggcaagatgcaggaagtgttcatccaaatggatagcaaccagaatgctaattctgttgacaaggacttgaagagcttgaaggatgctgtgctgcgggatggtgacgaagaagggaaattggctggagaatttgatcctagcaaatatatcgaagcacatttgcctgttcgcgtgaacgaacagagactaagcaacctgctgcaatccttacttgttggtggctgtgttggagccatgccggttatcaagatgataccgacttcggtcctctggggttactttgcctacatggccattgatagcctacctgggaaccagttttgggaaaggttgcagcttctgtgcattggagcaagccgacgctacaaggtcttggaaggcccccatgcatctttcgtggagtcggtgccttcaagaacaatatctgcctttacggtcttccagtttgtgtatctcttgatatgcttcggcataacatggataccagtagcagggatcctcttcccgctgcctttcttcattatgattctcatcaggcaacacctactcccaaagttctttgagcccaatgacttgcgagaactggacgcagctgagtacgaagaacttgaaggtgttccacatgagcaaacactggaggaagatggctcaaattcaggaagctgtgacagcagagacgactctgaaatattggatgagctcacaacaaaccgtggagagctgaagcacagaaccgtaagccatcctgaagaaaggcaccttcaggtccattcaaatgcagttcagccgagcgtgtgaagatggaaaaacgtcctcaggtccaaggctatgatggtgattctgtcagaagtgtagattatcgtgaagccattattcatttccgaatacgccattgtccagtaatgtgcatggtactgtagctagcgcttatccgataagccgtggtcgtgtacgctaggaagtaaagctcaggtgattagcagtgagagcagactgaagaacgtgtattggatgtggaagggggaacttgccagaatagtaccagtagtaattacaagtaggctgattagccctttaggtattgccaagactgttgcctgtgtaaaatctagcttgctctctgtctgagtgtaaagggctaaaactttccttgagaaggagcaaatcttccccgtgtcctgcct

SEQ ID NO: 3324 - DNA, 2433 bp, Hordeum vulgare
gctagctgatggatctactagggaaccctttcaagggagtcgtcgcggatgtcaaagggagagcatcttggtacaaggacgattgggttgcagggctccgaactggcttcaggatattggcacctaccatgtatattttctttgcctctgcactccctgtaatctccttcggagagcagctgagcaacgaaacagatggtatcgtaagcactgttgaaactttggcgtctacggcgatatgtgggataatacactcgattcttggagggcagccactgttgatcgttggagtcgcagaacctactattatcatgtatacgtatctctacaagtttgccaagaagcagccagatctgggagaacggctatatttggcttgggctggatgggtctgcatttggactgctatcatgctgtttcttttggcaatgttcaatgcttccaatgttataagcagattcacgagggttgcaggagagctttttggtatgttgatcactgtcctgttcctgcagcaagctatcaagggaattgtaagtgagttcagtgtgccgaaagatgatgagatttctgaccccagctcacctatataccagttccagtggatttatgtcaatggcctacttggtgttatattttccattggcttgctgtacactgcactgaagactaggcgtgcaaggtcatggctgtatggcgtaggatggcttagaagcttcattgccgattacggtgtaccgctgatggtgattgtgtggacagcattgtcatttacactaccaagcaaagtcccttcaggagtgcctaggaggctcttcagtccacttccctgggagtcaatctcactgagacattggaccgtagcaaaggatttgttttctgtccctccaacatatatatttgcagccatcgtgcctgctttgatggtcgcaggactttatttctttgaccacagtgtagcttcacagttggctcagcagaaggagtttaatttgaagaaggcttctgcctaccattatgacattttggtacttggattcatggtcctactatgtggtttgcttggcattcccccatcaaatggagtacttcctcagtcccccatgcatacaagaagccttgctgtcctcaaggggcagctgctacgcagaaagatgcttcaaactgccaaagagggcatgtcaaaccgtgcgagcagtttggaaatctatggcaagatgcaggaagtgttcatccaaatggatagcaaccagaatgctaattctgttgacaaggacttgaagagcttgaaggatgctgtgctgcgggaaggtgacgaagaagggaaattggctggagaatttgatcctagcaaacacattgaagcacatttgcctgttcgtgtgaacgaacagaggctaagcaacctgctgcaatccttacttgttggtggctgtgttggagctatgccggctatcaagatgataccgacttcggtcctctggggttactttgcctacatggccattgatagcctacctgggaaccagttttgggaaaggttacagcttctgtgcattggagcaagccgacgctacaaggtcttggaaggcccccatgcatctttcgtggaggcggtgccttcaagaacaatatctgcctttacggtcttccagtttgtgtatctcttgatatgcttcggtataacatggataccagtagcagggatcctcttcccgctgcctttcttcattatgattctcatcaggcaacacctactcccaaagttctttgagcccaatgacttgcgagaactggatgcagctgagtatgaagaacttgaaggcgtcccacatgaacaaacactggaggaagatggctcaaattcaggaagccatgacagcatagacgacgctgaaatgttggatgaactcacgacaaaccgtggagagctgaagcacagatctgcaagccatcctgaagaaaggcaccttcaggtccattcaaatgcagttcagccgagcgtgtgaagatggaaaaacgtcccgatgtccgaggctttgatgacgattctgtcagaagtgtagattatcctgaagccattgttcatttccgaatacgccattgttcagcaatgtgcattgtactgtagctagcgcttttccggtaaggcgtgatcgtgtacgctaggaagtaaagctcaggtaattagcagtgagatcagactgaagaaagtgtattggatatggcaggggaacttggcagaatagtattagtaatggttagaagtagaaagactgttgctccgtgacctgttattgcaagactgttgctctgtgacctgttgcctgtgtaaagtccagctttctgtgtctgaatgtaaaatgccaggcataagaatttcttgagaaccagtgaatctattctgccgcgtgttctggctgcattttgatg

SEQ ID NO: 3325 - DNA, 2457 bp, Triticum aestivum
cctcctacccctcgcgcccgccgccgacgccgcgtgctcatcgctagctgatggatctactagggaaccctttcaagggggtcgtcgccgatgtccaagggagagcgtcttggtacaaggacgactgggttgcagggctccgaactggcttcaggatattggcacctaccatgtatatattctttgcctctgccctccctgtcatctccttcggagagcagctgagcaacgaaacagatggtatcctgagcacagttgaaactttggcatctacggcgatatgtgggataatacactctattcttggagggcagccactgttgatcgttggagttgccgaacctactattattatgtatacctatctctacaagtttgccaggaagcagccagatctgggagaacagctatatttggcttgggctggatgggtctgcatttggacttccatcatgctctttctgttggccatgttcaatgcttccaatgttataagcagattcacgagggttgcaggagagcttttcggtatgcttatcaccgtcctcttcctgcaacaagctattaagggaattgtaagcgagttcagtatgcccaaagatgatgagatttctgaccccagctcacccatataccagttccagtggatttatgtcaatggcctacttggtgttatattttccattggcttgctgtacactgcactgaagactaggcgtgcaaggtcatggctgtatggcataggatggcttagaagcttcattgccgattatggtgtaccactgatggtgattgtgtggacagcattttcatttgcactaccaagcaaagtcccttcaggagtgcctaggaggctcttcagtccacttccctgggagtcaatctcactgcgacattggaccgtagcaaaggatttgttttctgtccctcctacatatatattcgcagccatcgtgcctgctttgatggtcgcaggactttatttctttgatcacagtgtagcttcacagttggctcagcaaaaggagtttaatttgaagaagccttcggcctaccattatgacattttggtacttggatttatggtcctactatgtggtttgcttggcattcctccatcaaatggagtacttcctcagtccccaatgcatacaagaagccttgctgtcctcaaggggcagttgctacgcaaaaagatgcttcaaactgccaaagagggtatgtcaaaccgtgcgagcagtttggaaatctatggcaagatgcaggaagtgttcatccaaatggacagcaacatgaatgctaattctgttgacaaggacttgaagagcttgaaggatgctgtgctgcgggaaggtgatgaagaagggaagttggctggagaatttgatcctagcaaatatatcgaagcacatttgcctgttcgcgtgaacgaacagagactaagcaacctgctgcaatccttacttgttggtggttgtgttggagctatgccagttatcaagatgataccaacttcggtcctctggggttactttgcctatatggccattgatagcctacctgggaaccagttttgggaaaggttgcagcttctgtgcattggagcaagccgacgctacaaggtcttggaaggcccacatgcatctttcgtggagtcagtgccttcaagaacaatatctgcctttacggtcttccagtttgtgtatctcttgatatgcttcggcataacatggataccagtagcagggatcctcttcccgctgcctttcttcattatgattctcatcaggcaacacctgctcccgaagttctttgagcccaatgacttgcgggaactggatgcagctgagtacgaagaacttgaaggtgtcccacatgaacaaatactggaggaagatggctcaaattcaggaagctgtgacagcagagacgactctgaaatattggatgagctcacaacaaaccgtggagagctgaagcacagaaccgtaagccatcctgaagaaaggcaccttcaggtccactcaaatgcagttcagccaagcgtgtgaagatggaaaaaacgtcccgaggtccgaggctttgatggtgattctgtcagaagtgtagattatggtgaaggcattgttcatttccgaatacgccattgtccagtaatgtgcatggtactgtagctagcgcttatccggtaagctgtgatcgtgtacgctaggaagtaaagctcaggtgattagcagtgagagcagactgaagaaagtgtattggatatggaagggggaacttgctagaatagtactactagtaatggttacaagtaggcagattagccctttaggtattgccaagactgtttgttgctccgtgacctgttgcctgtgtaaaaatcgcttgctctgtctgagtgtaaagggttaaaactttgcttgagaagcagtaaatcttgcgcgtgtcctggct

SEQ ID NO: 3326 - DNA, 2461 bp, Triticum aestivum
gctcatggatctactgcggagccccgtcaagggagtggtcgcggatgtcaaagggagagcgccttggtacaaggacgactggcttgcaggccttcgagctggcttcgggatattggcccctaccatgtatatattcttcgcctccgcactccctgtcatcgcattcggagagcagctcagcaacaaaacaaatggtattctcagcacagttgaaactttggcatctacggcgatatgtgggataatacatgcgattcttggtgggcaacccatgatgatcgttggagtcgcagagcctactattatcatgtacacgtatctctacaactttgccaagaagcagccagggctgggagaacggctatatttggcttgggctggatgggtctgcatttggactgccatcatgctgtttctcttggcaatgttcaatgcttccaatgttataagcagattcacgagggttgcaggagaacttttcgggatgttgatcaccgttctctttctgcaagaagctatcaagggaatcgtgagtgagttcagtatgccgaaagatgctgagatctctgaccgcagttcggctacttaccagttccagtggatatatgtcaatggcctacttggtgtcatcttctcaattggcctgctatacagtgcactcaagactaggcgggcaaggtcatggctgtatggcataggatggattaggagcttcatcgccgattatggtgtcccgcttatggtgatcgtgtggacagcattttcgcacgcactaccgagcggtgtcccttcaggagtgcctaggaggctcttcagcccacttccctgggagtcaagttcactggggcattggactgtagcaaaggatttattttctgtccctccagtatatatatttgcagccatcgtgcctgctttgatggttgctggactttacttctttgatcatagtgtagcttcacagttggctcagcaacaggagttcaatttgaaaaaaccttctgcctaccattacgacattttggtacttggattcatggtcctactatgcggtttgattggcattcctccagcaaatggagtactccctcagtcccccatgcatacaagaagccttgctgtcctcaaggggcagttaatgcgcaaaaagatgcttcaaactgccaaagagggcatgtcgaaccgtgcaagcagtttggaaatctatggcaagatgcatgaagtgttcattgaaatggataataaacaggatgctgattctgttgacaacgacttgaagagcttgaaggatgctgtgctgcgtgagggcgacgaggatggaaaattggctcgagaatttgatcctagaaaacatatcgaagcacatttgcccgttcgcgttaacgagcagagactaagcaacctgctgcaatccctactggttggtggctgtgttgcagctatgccggttatcaagatgataccgacttcggtcctctggggttactttgcctacatggccattgatagtctacccgggaaccagttttgggaaaggatacaatttttgtgcattggagcaagccgacgctacaaggtcttggaaggtccccatgcatcattcatggagtcggtgtctcggagaacgatatatgtcttcacgatcttccagattgtgtatttcttgctatgcttcggcacgacatggataccaatagccggaattctcttcccgctgcctttcttcctcatgattctcattaggcagtacctactccccaagttctttgagcccaatgacttgcgggaactggacgcggcggagtacgaagaacttgaaggggtccaacatgaacacacactactggaggaagatggctcgttttcaggaagctgcgacagcaggatcgacgctgaaatattggatgagctcacaacacaccgcggagaactgaagcacaggattgtaagccatcgtgaagaaaggcaccttcaggtccattcaaacgccgttcagccaagcgtctgaagatagaacaatggcccgaggaccgacggaggatttcgcccatgattctatcagaaatggggagggaaatcctcaggcagcagctctttgccgaatgcactattattgttcgctgatatgcatatggtactgtagcatggcttttcccaaaagccatgattgtgtatggtacgaagtagctaggctcaggcaatttagcagtgagagcagcagattgaaggaagtattggatatgaaaggggacttgccggaataccaatggtgaggagtagaaagattagcccatttggtattgcaggaaaacctgtcgctctgtgacctgtcgttgcatgtgtgtgcttagcttggtctgtttgagattaaaaagttacaagtattgcttgagaagcagtggatgatgtgtgctctggctgtaatgttggtgccttttgttcaagttctttcacgttttcg

SEQ ID NO: 3327 - DNA, 2885 bp, Triticum aestivum
gataccacaccgcgtcgccgccgccgccgccttttggggcaccacaccagctgtttctaccgccgcgccgatcgaggagagcccgccgcttcctcccttcatcctagccagccccgccgcccgccgcctcgcgtttggatcaccgttgaggctgtttccctcatcagctcatggatctactgcggagccccttcaagggagtggtcgcagatgtccaagggagagcgccttggtacaaggacgactggcttgcaggcctccgagctggcttcgggatattggcaccgaccatgtacatattcttcgcctccgcgctccctgtcatcgccttcggagagcagctcagcaacgaaacaaatggtattctcagcacagttgaaactttggcatctacggcgatatgtgggataatacacgcgattcttggagggcagccaatgatgatcgttggagtcgcggagcctactattatcatgtatacgtatctctacaactttgccagaagcagccaggtctaggagaacggctatatttggcttgggctggatgggtctgcatttggactgctatcatgctgtttctcttggcaatgttcaatgcttccaatgttataagcagattcacgagggttgcaggagaacttttcgggatgttgatcaccgttctctttctgcaagaagctatcaagggaatcgtgagtgagttcagtatgccgaaagatgctgagatctctgaccgcagttcggctacttaccagttccagtggatatatgtcaatggcctacttggtgtcatcttctcaattggcctgctatacagtgcactcaagactaggcgggcaaggtcatggttgtatggcataggatgtgttaggagcttcattgctgattatggtgtcccactcatggtgatcgtgtggacggcattttcgtacacactaccgggcggtgtcccttcaggagtgcctaggaggctcttcagtccacttccctgggaatcaagctcactggggcattggaccgtagcaaaggatttgttttccgtccctccggcatacatatttgcagccatcgtgcctgctttgatggttgcaggactttacttctttgatcatagtgtagcttcacagttggctcagcaacaagagttcaatttgaagaaaccttctgcctaccattacgatattttgttacttggatttatggtcctgctatgtggtttgattggcattcctccagcaaatggagtacttcctcaatcccccatgcatacaagaagccttgctgtcctcaaggggcagctgatgcgcaaaaggatgcttcgaactgccaaagagggcatgtcgaaccgtgcaagcagtttggaaatctatggcaagatgcatgaagtgttcatcgaaatggataacaaacaggatgctgattctgttgacaaggacttgaagagcttgaaggatgctgtgctgcgtgaaggcgacgaggatggaaaattggctggagaatttgatccaagaaagcatatcgaagcacatttgcccgttcgtgttaacgagcagagactaagcaacctgctgcaatccttactggttggtggctccgtcggagctatgccggttatcaagatgataccaacctcggtcctctggggttactttgcctacatggccattgatagcctaccagggaaccagttttgggaaaggatacaatttttgtgcattggagcaagccggcgctacaaggtcttggtaggtccccatgcatcattcgtggagttagtgtctccgagaacgatatatgtctttaccatcttccagattgtgtatttcttgatatgcttcggcacaacatggataccgatagcggggatcctcttcccgctgcctttcttccttatgattctcatcaggcagtacctactccccaagttctttgagcccaatgacttgcgggaactggatgcggcggagtacgaagaacttgaaggggtccaacatgaacacacactggaggaagatggctctatctcaggaagctgcgacagcaggatcgacgctgaaatattggatgaactgacaacacaccgtggggagctgaagcacagggttgtaagccatcgtgaagaaaggcaccttcaggttcactcaaacgccattcaaccaagcgtctgaagatagaacaatggcccaaggaccgaccgaggatttcaccgatgattctatcagaaatgagggaaatcctcaggcagtagctctttgccggatgcaccattattgttggctgatatgcatatggtactgtagtatagcttttcccataagtcaggcaatttagcagtgagagcagcagattgaagaaattactggatagcaatggtgaggagttgaaagattagctcgtcaggtattgccgcaaaactgttgctctgtgacctgttgttgcctgtgtgtgcttattagcttcctttgtttgagcgtacgagtttgaaaatattgctcgagaatctatggatgccgtgtgttttggtgcctgttgttgccggtgtgtgcttagcttgctctgtttgagtgtaaaaagttttagtttgaaatgatgctctaattaacaaccgaatggcttcgattttaatgaacatgtcacatcattttcaaacaaatattacagtttgctgctgtttcctatcttggtaaggctgcccattgcccgggccttctcccggagaacaaacttctgcgtcttccccgtcgaggtcttgggcagatcctcctcgaacaccaccgtcttgggcgccatgtagtgcggcagcctctgccggcagaagcccatgatctctgcctccgtggcgccggcgccgtccttcagcttcacgaatgcgcatggcgtcct

SEQ ID NO: 3328 - DNA, 1359 bp, Setaria italica
agatccttcgccacccaaatccggcgaaccgcccggccgcgccagccaatccccacctcaaataactcccggcgcccgcggccgcggcccccaccccggtaacccgagggaaataacaaacccgcaaatccacacgccaccgcgcggccagccaccgccgcacgaacgaacccagcggcaaaaacgggcgcgatccccaccgccccgcgggccgccgcggcgtcggcggcggcggcaatggaggtcgcctcctcgtcctccgcctcgccttccgcgccgccgccgccggcatcatctaagccggcgctccggctcaaccccgcggccgtcctcctccgccgcctccccaccccgaccccgaccaccgcgacccccgtcaccgcgtcagcgtcccccgagcggcccggcggcgcggccaacccgctcgtcgccttcctctcctccctcatcccctggcgggagcagcggccgccgaagaaacagccggaccaccccgccgcaaccgcatcggcctccgcctccgccgccgcggcacggagggccgccaaggcggcggccgaggaggaggcggaggcgcggcagctggtgggctgcgcggtgccgctgttccggccgtacgtggcgcagctcccgtggcacggcggcgcgcgggcgtggctgtccaagctcttcccccgctacggccactactgcgggcccaactggtccagcggcaaggagaccggctccgtgctctgggaccgccgccccgtcgaccacctcgacttctgctgctactgccacgacatggcctacgacacccacgaccaggcgcagctcctccgcgccgacctcgccttcctccgctgcctcgagagcagccgccagacccccgcacgcgacggcatcgccgccgccgccatctaccgcgctatgtgcatcttcggactcaagacgatcctgatcccgtaccggacgaacctcgtgcggctgcagaccggcccgaattacgccgatttcttcgccgatttcctgaagagggtcgcgtcttcgtcgggcaggccgaccggcggcgagaagcagagattgtgaacggaattgctcgcctgatggtagatggcgccgaattaattaattgggggaatgagatcgtagtaattgtccatagcttgagttcaggtccttgatccacgtatggcgagggaactttgttatccagtctaattggttgattgtagccactgatgataaagttgggattttctactgtgaatatagcgtatttgtaggttcgaacgtgatcgtagcaaatattcaaatgtcctgcccttgactgataagatcagtgcaatatagaactctgcgttcaaaatcaagatc

SEQ ID NO: 3329 - DNA, 4140 bp, Sorghum bicolor
cacggttcccaagtcccaacggcgtgagtcgcgccacgtgttccgcctacctggaggaaaccaaccaatgggcagccaccacaacggcagaggcgcgcatttgaccttccgtgtattcctactatatcttgctggatagacggaccgacatctgggcccggtgcttctcgggcccgcgtggcagtccgtcgatcaagcacacagcgggtgcttgctattaatcgccggctccacccgctcccactcgtctcctcaccaaatcctcctcttcgatctccaggaccaggccggcagaagctgatcgaatccgagtagggttgatacagtttgattcggtgggaggcatggcgtcggagaagcacttcaagtacgtcatccttggcggcggcgtcgcggcggggtacgcggcgcgggagttcgccaagcagggagttaagcctggggagcttgccatcatctccaaggaggctgtggctccttacgagcgtcctgccctcagcaaaggttacctctttcctcagaatgctgcaagactcccaggattttatgtatgtgtgggaagtggtggagagaggctattgccagagtggtactcagagaaaggtattgagctgatccttagtacagaaattgtcaaagctgatctttccaccaagaccctgactagtgcagctggagcaaactttacatatgagatcttgctcattgctactggctcctcggtcataaagctcactgattttggcacaccaggagctgattcaaacaacattctatatctaagggaaattgatgatgctgacaagctggttgcagctatccaggcaaagaagggtggcaaggcagtggttgttggaggaggttatattggccttgaacttagtgcagccctgaagatcaatgactttgatgtcactatggtgttccctgaaccttggtgcatgcctcggctcttcactgccgacattgctgctttctacgaggcttactatactaacaaaggtgtaaaggtcttgaagggcacactagctgttggttttgatgctgatgccaatggtgatgtcactgcagttaaactaaaggatggcacagtacttgaagctgatattgttgttgtcggtgttggaggcagaccattgactactctcttcaaaggtcaagttgctgaggagaagggtggaatcaagactgatgccttctttgaaacaagtgttcctggagtatatgccattggtgatgtggctaccttccctttgaagatgtacaatgagttgaggagagtggaacatgttgaccattctaggaagtctgcagagcaggctgtaaaggcaatcaagggcaaagagtccggtgaaccagttccggagtatgactacctgccatacttctactcccgatcattcgacctggggtggcaattctacggcgacaacgtgggtgaaaccatcctatttggcgacagtgaccccacctccagcaagcccaagttcggctcgtactggatcaaggacggcaaggtcttgggcgccttcctggaaggcgggtcaccggatgagaacaaggccattgccaaggtggcgaaaacccagccgccggtcgctaacctcgaggagctcaagaaggagggcctccagttcgccagcaagatctgagacgctccacgttccatgtacatttccgtgtcatcatttaggttgttcttctggagttctggtcatggttgcaatgttctgctacagatgttgccgtgcatacgtgactacatgatatatcggtttttctgattgtcgtgtctgtacgtgactacactcacacgtgagaaatttgaataaagtctgcagactcagggttcaaatagcacaatttttttttccgcacagatagccctcttgttattactccctctcgcctggtcgctcgcgtgctggcaggcactgaaatggcggcggccaccagctgcctcgcctcatcgcctaggctaacgctgggtgcgagctcgaggcggcggagttggcatccgcgacgtccggcggcgcaccggtgcgccgctgcggtggacgggaggaagactacggtgcagagcaaggcgggggacgcgctggaggtgtgccgggtggtgaacggcatgtggcaggtgagcggcgcgtcgtggggccgcgcgcagccggcggcggccgtggacgccatgctccggtacgcggacggcggcctcaccacgttcgacatggctgacatatgtaaggagatcagattattgtgaggccccgcgtgtcccgttgtggatgtggattaggctctcagctgcccacgttcgttcgcacgaattcatgagcatcttgttgtccagagccacagcagccaggcagtagttgcgatcaaacgtgttcccgtctctaaaaatcccaaaaaatacagcaagactatttttcccccgctggaagatccaagcagccgaaaaagccccaaactcaattcgaggcccgtgggccagcagcgccttatcccttcgccttccgcctccgtggcgcgcgcgctcgcacgaacggaagtcccatgtcgtccaccgcagcgcgcgccgtcccgccggcagccgcggcgccgcctcccctcccacgccgcctgaggcccgcgaggtgcacggccggagccgccgcggcggagacgacggccaccgcggggccgactagggtgacgaccgtcagcaaccgcggggactccctggcgatatgccgggtgctcaacggcatgtggcagaccagcggagggtggggccgcatagaccgcgacgccgctgttgacgccatgctcgcgtacgccgacgccggactctccaccttcgatatggctgaccactatgggccagcagaggatttgtatggcatgttcatcaacagagttaggcgggagcgcccacctgagtttctcgaagaaatcaaggggcttacaaagtgggtaccaccaccggttaagatgacaagaagttatgtcgaggataacatcaacagatccaggaagaggatggatgttgctgcgttggacatgttgcagttccactggtgggaatactcaaatccaggatacttggatgcactaaagcacatcacagacctgaaggaggaaggcaagataaagactgtggccctgacaaacttcgatacagacagactgcaaataattctagaaaatggaatcccagttgtgagcaaccaggttcaacattctatcgttgatatgcgccctcagcagagaatggcagagctttgccagctaactggagttaaacttataacgtatggcacagtgatgggtggtcttttgtctgaaaagtttcttgacaccaatgtatcaataccttttgctggtcctcctctaaataccccatccttgcagaaatataagaggatggtcgatgcttggggtggctggagcctgttccagactttgcttcaaaccttaaagaaggtgtcactgaaacacggtgtttctattgcaacggttgctgtgagatacatactgaaccagacatctgttgcaggttccatggttggtgtgagattgggactctctgaacacatcaaagacaccaacgccatattctcacttgaattggatgaagaggacatgaacagcattactgaagtatcgaagaagggcagaaatttgatggatattattggggattgtggtgacgagtaccgagcttagttgttcatgctgctgctgggctcgtatagacctatacccgtgcccaattttccacagctctaaaattttggctattttgcgcaaagtctagtggctcagagcattgttgaggtaagcctatacctgaatgcctattattcaggtgccagcatgtaacctccagcccaccacggaggaaactctagttataaaactgtaaatacacagcgatgcagatggcttaatgtggtaatttgttcataatcctttttagcaattactgtctcaaaataaatgcatttctgactatgtatctggacaagtgcttatctagatacatagctaaaaatgtattattctgggagacggagtacttatttttttgaacttaaaagagggagtagttattaaacgaactacaaagaccaggtgtttaaccatctcagctggagctca

SEQ ID NO: 3330 - DNA, 1704 bp, Saccharum officinarum
cgtcttctccctccctagtccctccccaaatcctcctctccgatctccaggccggcagaagctgagcggactgactggtcaatcacagtagttcgatcgaatccgagtagggctgatacagttcgattcggcgggaggcatggcgtcggagaagcacttcaagtacgtcatcctcggcggcggcgtcgcggcggggtacgcggcgcgggagttcgccaagcagggagttaagcctggggagcttgcaatcatctccaaggaggctgtggctccttacgagcgtcctgccctcagcaaaggttacctctttcctcagaatgctgcaagactcccaggattttatgtatgtgtgggaagtggtggagagaggctattgcctgagtggtactcagagaaaggtattgagctgatccttagtacagaaattgtcaaagctgatctttccaccaagactctgactagtgcagctggagcaaactttacatatgagatcttgctcattgctactggctcctcggtcataaagctcactgattttggcacaccaggagctgattttaacaacattctatatctaagggaaattgatgatgctgacaagctggttgcagctatccaggcaaagaagggtggcaaggcagtggttgttggaggaggttatattggccttgagcttagtgcagccctgaaaatcaatgactttgatgtcactatggtgttccctgaaccttggtgcatgcctcggctcttcactgccgatattgctgctttctacgaggcttactatactaacaaaggtgtaaagatcttgaagggcacattagctgttggttttgatgctgatgccaatggtgatgtcactgcagttaagctaaaggacggtacagtacttgaagctgatattgttgttgttggtgttggaggcagaccattgactactctcttcaaaggtcaagttgctgaggagaagggtggaatcaagactgacgctttctttgaaacaagtgttcctggagtatatgccattggtgatgtggctaccttccctttgaagatgtacaatgagttgaggagagtggaacatgttgaccattctaggaagtctgcagagcaggctgtaaaggcaatcaagggcaaagagtccggtgaaccagttccggagtatgactacctgccatacttctactcccgatcattcgacctggggtggcaattctatggcgacaacgtgggtgaaaccatcctgtttggcgacagtgaccccacctccagcaagcccaagttcggctcatactggatcaaggacggcaaggtcttgggtgccttcctggaaggcgggtcaccggacgagaacaaggccattgccaaggtggcgaaaacccagccgccggtcgccaacctcgaggagctcaagaaggagggcctccagttcgccagcaagatctgagacgctccccgttccatgtacatttccgtgtcatcatttaggttcttctggagttctggtcatggttgcaatgttctgctacagatgttgccatgcatacgtgactagtacatgatatattcggttttctgattgtgatgtctgtacgtgactacactcacacacgtgagatttgaataaagtctgcaccctcagggttcaactaaaaaaaaaaaaaatagcgaaaaagtatgttgaaataaaatgtatcaaatttt

SEQ ID NO: 3331 - DNA, 1694 bp, Cenchrus ciliaris
  misc_feature (1452)..(1452): n is a, c, g, or t
cctctcctccctgccaaatcctccttgtcttctgcaaagcaatctccctcctccaggcccgctgcacaggcagaggtggactgactgactggtcaccggctcgatcgaatcggagtagtagaggtgcccgatttcagtgggaggggcatggcgtccgggaagcacttcaagtacgtcatcctcggcggcggcgtcgcggcggggtacgctgcccgggagttcgccaagcagggagttcagccaggggagctcgccatcatctccaaggaggcggtagctccttacgagcgtcctgccctcagcaagggttacctctttcctcagaatgctgcacgactcccaggatttcatgtatgtgtgggaagtggtggagagaggcaattgcctgaatggtactcagagaaaggtattgagctgatcctcagcacagaaattgtcaaagctgatctttcaacgaagactttgactagtgcagctggagcaacctttacatatgagatcttgctcattgctactggctcctcagtcatcaagctcactgattttggcacacaaggagctgattctaacaacattctatatctaagggaaattgatgatgctgacaagctggttgcagctatccaggcaaagaagggtgggaaggcagttgttgttgggggaggttatattggccttgaacttagtgctgcactgaagatcaatgattttgatgtcactatggtgtttcctgaaccttggtgcatgcccaggctcttcactgccgatattgctgctttctacgaggcttactatactaacaaaggtgtaaaggttttgaagggcacattggctgctggttttgatgccaatgccaatggtgatgtcactgcagttaagctaaaggatggcacagtacttgaagctgatattgttgttgttggtgttggagccaggccattgactactctcttcaaaggtcaagttgctgaggagaaaggtggaatcaagactgatgctttctttgaaacaagtgttcctggagtatacgccattggcgatgtcgctaccttccccttgaagatgtacaatgagttgaggagagtggaacatgttgaccattctaggaagtctgcagagcaggctgtaaaggcaatcaagggaaaggagtccggggagtcagttcccgagtacgactacctaccgtacttctactcccgatcattcgacctggggtggcaattctacggcgacaatgttggcgagaccatcctgttcggcgacagcgacccaacctccagcaagcccaagttcgggtcgtactggatcaaggatggcaaggtcttcggcgccttcctggagggcgggtcgccggacgagaacaaggccatcgccaaggtggctaagacccagccgccagtcaccaacatcgaggagctcaagaaggagggcctccagttcgccagcaagatntgagacgctctctgttccagtgtgttccatgtacatctcgcgtcatcgtttaggttgctctcgtgtgtttatggtcgcagcgcgctctacaacggcagacgttgtcatgcgtacttgacaccacatgacattcggtttgtgattgtaatgtttgaactacacacacacgaatacacttggtgtaccacttgagactttgaataaaagcctatagcctcggggttcaagaggcacagtttata

SEQ ID NO: 3332 - DNA, 1697 bp, Pennisetum glaucum
tcctccctccccaaatcctccttgtcttctgcaatctccctccagcccccgcccgcttcacaagcagaggtggactgactgactgactgactggtcaccagttccattgatcggagtagtacaggtgattagcgcccgatttcggtgggggagggcatggcgtccgggaagcacttcaagtacgtcatcctcggcggcggcgtcgcggcggggtacgcggcccgggagttcgccaagcagggagttaagccaggggagctcgccatcatctccaaggaggcggtagctccttatgagcgtcctgccctcagcaagggttacctcttccctcagaatgctgcaaggctcccaggatttcatgtatgtgtgggaagtggtggagagaggcaattgcctgaatggtactcagagaaaggtattgagctgatcctcagcacagaaattgtcaaagctgatctttcaacgaagactttgactagtgcagctggagcaacctttacatatgagatcttgatcattgctactggctcctcagttatcaagctcactgattttggcacacaaggagctgattctaacaacattctatatctaagggaaattgatgatgctgacaagctggttgcagctatccaggcaaagaagggtgggaaggcagttgttgtcgggggaggttatattggcctcgaacttagtgccgcactgaagatcaatgattttgatgtcacaatggtgtttccggaaccttggtgcatgcccaggctcttcactgccgatattgctgctttctacgaggcttactatactaacaagggggtaaaggttttgaagggcacattagctgttggttttgatgccaatgccaatggtgatgtcactgcagttaagctaaaggatggcaaagtgcttgaagctgatattgttgttgtcggtgttggaggcaggccattgactactctcttcaaaggtcaagttgctgaggagaaaggtggaatcaagactgatgctttctttgaaacaagtgttcctggagtatacgccattggcgatgtcgctaccttccccttgaagatgtacaatgagttgaggagagtggaacacgttgaccattctaggaagtctgcagagcaggctgtaaaggcaatcaagggaaaggaatctggggagtcagttcctgagtacgactacctgccatacttctactcccgatcattcgacctggggtggcaattctacggcgacaatgttggtgagaccatcctgttcggcgacagtgaccccacctccagcaagcccaagttcgggtcttactggatcaaggacggcaaggtctttggtgccttcctggagggcggatcgccggatgagaacaacgccatcgccaaggtggcaaagacccagccgccagtcgccagcatcgaggagctcaagaaggagggcctccagttcgccagcaagatctgagacgctccctgttgcagtgtgttccgttccgtgtacatctcgcgtcatcttttaggtcgttcttgtgtgttcatgatcacagatgttgccctgcgtcatgacattcggtttctgattgtgatgtctgaactgcacatacccgaatacacttgctgtaccatttgagatttgaataaagcctgcagcccctccaaaccgggttcaaaaaaaaacaaaaaaaacaaagaaaaaaa

SEQ ID NO: 3333 - DNA, 1650 bp, Panicum virgatum
ctcgctccctcccttcccaaatcctccttgtcctctgcaatcgccaaggccaggcccgccgcgcagagtggactgactggtcactggtagctcgatcgatcggatcatcggaggcaggcatggcgtccgggaagcacttcaagtacgtcatcctcggcggcggcgtcgcggcggggtacgcggcccgggagttcgccaagcagggagttcagccaggggagctcgccatcatctccaaggaggcggtggctccatacgagcgtcctgccctcagcaagggttacctcttccctcagaatgctgcaaggctcccaggattttatgtgtgtgtcggaagtggtggagagaggctattgcctgaatggtactcagagaaaggtattgagctgatcctcagcacagaaattgtcaaagctgacctttccaccaagactctgactagtgcagctggagcaacctttacatatgacgtcctgctcattgcaactggatcctcggtcatcaagctcactgattttggcacacaaggagctgattctaacaacattctatacctaagggaaattgatgatgctgacaagctggttgcagctatccaggcaaagaagggtgggaaggctgtggttgttgggggaggttatattgggcttgaacttagtgcagcactgaagctcaatgactacgatgtcactatggtgtttcctgaaccttggtgcatgccccggctcttcactgccgatattgctgctttctacgaggcttactatactaacaaaggggtaaagattttgaagggcacattagctgttggttttgatgccaatgccaatggtgatgtcactgcagttaagctaaaggatggcacagtacttgaagctgatattgttgttgtcggtgttggaggcagaccattgactacactcttcaaaggtcaagttgctgaggagaaaggtggaatcaagactgatgctttcttcgaaacaagtgttcctggagtatatgctattggcgatgttgctaccttccccttgaagatgtacaatgagttgaggagagtagaacacgttgaccatgctaggaagtctgcagagcaggctgtaaaggcaatcaagggaaaggagtccggggaatcagttccagagtacgactacctgccgtacttctactcccgatctttcgacctggggtggcagttctacggcgacaacgtcggtgaaaccatcctgttcggcgatagtgaccccacctccagcaagcccaagttcgggtcgtactggatcaaggacggcaaggtcttgggcgccttcctggaaggtgggtcaccggacgagaacaaggccatcgccaaggtggcgaaaacccagccggccgtcgccagcgtcgaggagctcaagaaggagggcctccagttcgccagcaagatctgagaccgcttcctgcttcattgttccatgtacatctcgcgtcatcatttaggtgttcttgtgtttatggtcgcagtgttctacgacggatgttgccatgcgtacttgaaccacatgacattccgtttctgatcgtgatgtctgaactacacatacacgcacacttgctgtaccacttgagatttgaataaagcttttgtctgcagcctcagggttcaacgagcac

SEQ ID NO: 3334 - DNA, 3479 bp, Setaria italica
ctcctactcccactcgtcttcgtcttcctccttcccaaatcctccttgtcttctgcgatctccctccaggcccgctgcacaggcagagtggactgactgactcgtcaccagttcgatcgatcggagtagtagaggtgattagcgcccgatttcggtgggaggcatggcgtccgggaagcacttcaagtacgtcatcctcggcggcggcgtcgcggcggggtacgcggcccgggagttcgccaagcagggagttaagccaggggagctcgccgtcatctccaaggaggcggtagctccttatgagcgtcctgccctcagcaagggttacctctttcctcagaatgctgcaaggctcccaggatttcatgtatgtgtgggaagtggtggagagaggcaattgcctgaatggtacacagagaaaggtattgagctgatcctcagcacagaaattgtcaaagctgatctttccaccaagactttgactagtgcagctggagcaacctttacatatgagatcttgctcattgctactggctcctcagtcatcaagctcactgattttggcacacaaggagctgattctaacaacattctatatctaagggaaattgatgatgctgacaagctggttgcagctatccaggcaaagaagggtgggaaggcagttgttatcgggggaggttatattggccttgaaattagtgccgcactgaagatcaatgattttgatgtcactatggtgtttcccgaaccttggtgcatgcccaggctcttcactgccgatattgctgctttctacgaggcttactatactaacaaaggggtaaagattttgaagggcacattagctgttggttttgatgccaatgccaatggtgatgtcactgcagttaagctaaaggatggcacagtacttgaagctgatattgttgttgtcggtgtgggagccagaccattgactactctcttcaaaggtcaagttgctgaggaaaaaggtggaatcaagactgatgctttctttgaaacaagtgttcctggagtatacgccattggcgatgtcgctaccttccccttgaagatgtacaatgagttgaggagagtggaacacgttgaccattctaggaagtctgcagagcaggctgtaaaggcaatcaagggaaaggagtccggggagtcagttcccgagtacgactacctgccatacttctactcccgatcattcgacctggggtggcaattctacggcgacaacgtgggcgagaccatcctgttcggcgacagcgatcccgcctccagcaagccgaagttcgggtcttactggatcaaggatggcaaggtcttgggcgccttcctggaaggcgggtcgccggacgagaacaaggccatcgccaaggtggcgaagacccagccgccggtcgccagcatcgaggagctcaagaaggaaggcctccagttcgccagcaagatctgagacgctcccgttccagtgtgttccgttccatgtacatcttgcgtcatcgtttaggttgttcttgtgtgttcatggtcgcagcgttctacaacagatgttgccaggcgtcatgacattcggtttccgattgtgatgtctgcagtctgaactacacatacacgaatacacttgctgtaccatttgagatttgaataaagcctgctgcctcacggttcaacaagcacagtttttgcacagagagtactgccctcgtgttcttatattctctcgctgctagctcgcgtgcgtcgtggcaactggcaagcgctgaaatggccgcggccaccggcttcctcgttccatcggctaggctgacgcccgcggcgagaggagcgaggcggcggcggtgttggcaccggcgtcgcctggcgccgcggtgcgccgccgcggtggatgggaggcaggcgacggtggagagcaaggccggggacgcactggaggtgtgccgggtggtgaacggcatgtggcaggtgagcggcgcgtcgtggggccgcgcgcagccggcggcggccgtggacgccatgctccggtacgccgacggcggcctcgccacgttcgacatggcggacatatcgcgcgccgtctcgccggcggccgcggcgccgcctcccgtcccgcgccgcctgaggcccgcgaggtgcacgggcggcgtcgcggcgacggagacggccaccgcggggccggcgagggtaacgaccgtcagcaaccgcgatgactccctggcgatatgccgggtgctcaacggcatgtggcagaccagcggagggtggggccgcatcgaccgcgacgccgctgtcgacgccatgctcgcgtacgccgacgccggactctccaccttcgacatggccgaccactatgggccagcagaagatttgtatggcatgttcatcaatagagtcaggcgggagcgcccacctgaattgcttgaagaaatcaaggggcttacaaagtgggtgccgcctcccgttaagatgacaagaagttacgttgaggaaaatatcaacagatctcggaagaggatggatgttgctgcattggacatgttgcagttccactggtgggattacacaaatcctggatatttggatgcactaaagcacatcacagacctgaaggaggaaggcaagataaagactgtagctctgacaaacttcgatacagaaagactacaaataattctagaaaatggaatcccagttgtcagcaaccaggttcaacattccatcgttgatatgcgcccacagcaaagaatggcagagctttgccagctaactggagttaaacttataacgtatggcaccgtgatgggtggtcttttgtctgaaaagtttcttgacactaatgtatcaataccttttgctggacctcccctaaatacaccatccctgcagaagtataagaggatggtcgatgcctggggtggctggagcctgttccagactttgctccaaaccttaaagaaggtgtcactgaaacacggagttcctattgcaactgttgctgtgagatacatacttaaccagacatctgttgctggttctatggtgggtgtgagattggggctctccgaacacatcaaagataccaacgccatattctcacttgaattggatgaagaggacatgaacagcatcaccgaagtatcgaagaagggcagaaatttgatggatattattggggattgtggcgacgagtacagagcttagttgctcatgcttctgcttggcgcatatacttgtgcccaattttccatagctctgaaattttgctccaaagtctagcggctcagcgcagttgaggaatgtctattcttttgagtgccagcatgtaacctccttggagccggaggaaaccccagctataaaactgtaaatatacaacgatgcagatgactcatgtgttaatttgttcatagtcctgtctagcgagtattacaatagtacaattatcgtatgttttatcttctcaa

SEQ ID NO: 3335 - DNA, 1694 bp, Panicum virgatum
ggttggtttggtgtattttattaatccccacccgctcccactccaactcgtctccctcccctcgccaaatcctccttgtcctctgcaatcgccaggcccgccgcgcaggcagactggactgactggtcactggtagctcgatcgatcggatcatcggaggcaggtaggcatggcgtccgggaagcacttcaagtacgtcatcctcggcgggggcgtcgcggcggggtacgcggcccgggagttcgccaagcagggagttcagccaggggagctcgccatcatctccaaggaggcggtggctccatacgagcgtcctgccctcagcaagggttacctcttccctcagaatgctgcaaggctcccaggatttcatgtgtgtgtcggaagtggtggagagaggctattgcctgaatggtattcggagaaaggtattgagctgatcctcagcacagaaattgtgaaagctgatctttccaccaagactctgacgagtgcagctggagcaacctttacatatgacatcctgctcattgcaactggatcctcggtcatcaagctcactgattttggcacacaaggagctgattctaacaacattctatatctaagggaaattgatgatgctgacaagctggttgcagctatccaggcaaagaagggtgggaaggcagtggttgttgggggaggttatattgggcttgaacttagtgcagcactgaagatcaatgactatgatgtcactatggtgtttcctgaaccttggtgcatgccccggctcttcactgccgatattgctgctttctacgaggcttactatactaacaaaggggtaaaggttttgaagggcacattagctgttggttttgatgccaatgccaatggtgatgtcactgcagttaagctaaaggatggcacagtacttgaagctgatattgttgttgtcggtgttggaggcagaccattgactactctcttcaaagggcaagttgctgaggagaaaggtggaatcaagactgatgctttctttgaaacaagtgttcctggagtatatgccattggcgatgttgctaccttccccttgaagatgtacaatgagttgaggagagtagaacacgttgaccatgctaggaagtctgcagagcaggctgtaaaggcaatcaagggaaaggagtccggggagtcggttccagagtacgactacctgccatacttctactcccgatccttcgacctggggtggcagttctacggcgacaacgtcggcgaaaccatcctgttcggcgacagtgaccccgcctccagcaagcccaaattcgggtcgtactggatcaaggacggcaaggtcttgggcgcctttctggaaggcgggtctccggacgagaacaaggccatcgccaaggtggcgaaaacccagccggctgtctccagcgtcgaggagctcaaggagggcctccagttcgcgagcaagatctgagactgctccctgtttcattgttccatgtacatctcgcgtcatcatttaggtgttcttgtgtttatggtcgcagtgttctacgacagatgttgccatgcgtacttgaccacatggcattcggtttctgattgtgatgtctgaattacacatatacccactctttctgtaccacttgagatttgaataaagcctgcagcctcagccctcagggttcaacgag

SEQ ID NO: 3336 - DNA, 2417 bp, Panicum virgatum
caggccccctccaataaactcgctccttgagggatatcttaactgacaactggggcccatacccatccaggcccgcgtggcagtcgctcgaccgagcacagggcgggtgccgcggttggtttggtatattttattaatccccacccgctcccactccaactcgtctccctcccctcgccaaatcctccttgtcctctgcaatcgccaggcccgccgcgcaggcagactggactgactggtcactggtagctcgatcgatcggatcatcggaggcaggtaggcatgtccgggaagcacttcaagtacgtcatcctcggcggcggcgtcgcggcggggtacgcggcccgggagttcgccaagcagggagttcagccaggggagctcgccatcatctccaaggaggcggtggctccgtacgagcgtcctgccctcagcaagggttacctcttccctcagaatgctgcaaggctcccaggatttcatgtgtgtgtcggaagtggtggagaaaggctattgcctgaatggtactcggagaaaggtattgagctgatcctcagcactgaaattgtgaaagctgatctttccaccaagactctgactagtgcagctggagcaacctttacatatgacatcctgctcattgcaactggatcctcggtcatcaagctcactgattttggcacacaaggagctgattctaacaacattctatatctaagggaaattgatgatgctgacaagctggttgcagctatccaggcaaacaagggtgggaaggcagtggttgttgggggaggttatattgggcttgaacttagtgcagcactgaagatcaatgactatgatgtcactatggtgtttcctgaaccttggtgcatgccccggctcttcactgccgatattgctgctttctacgaggcttactatactaacaaaggggtaaaggttttgaagggcacattagctgttggttttgatgccaatgccaatggtgatgtcactgcagttaagctaaaggatggcacagtacttgaagctgatattgttgttgtcggtgttggaggcagaccattgactactctcttcaaagggcaagttgctgaggagaaaggtggaatcaagactgatgctttctttgaaacaagtgttcctggagtatatgccattggcgatgttgctaccttccccttgaagatgtacaatgagttgaggagagtagaacacgttgaccatgctaggaagtctgcagagcaggctgtaaaggcaatcaagggaaaggagtccggggagtcggttccagagtacgactacctgccatacttctactcccgatccttcgacctggggtggcagttctacggcgacaacgtcggcgaaaccatcctgttcggcgacagtgaccccgcctccagcaagcccaaattcgggtcgtactggatcaaggacggcaaggtcttgggcgcctttctggaaggcgggtctccggacgagaacaaggccatcgccaaggtggcgaaaacccagccggctgtctccagcgtcgaggagctcaaggagggcctccagttcgcgagcaagatctgagactgctccctgtttcattgttccatgtacatctcgcgtcatcatttaggtgttcttgtgtttatggtcgcagtgttctacgacagatgttgccatgcgtacttgaccacatggcattcggtttctgattgtgatgtctgaattacacatatacccactctttctgtaccacttgagatttgaataaagcctgcagcctcagccctcagggttcaacgagcacagatagccctcttgttctcgtattctctcgccgctcgctcgcgcgcgtcctggcaggcgctgaaatggccaccgccgccgccggctgcctcgttccacggccgacgcccgcggcaagatcgaggcggcggtgttggccccggcggcgtctggtgccgcggtgcgtggcggcggaggccgacgggaggaagacgacggtgcagagcaaggccggggacgcgctggaggtgtgccgggtggtgaacggcatgtggcaggtgagcggcgcgtcgtggggccgcgcggagccggcggcggccgtggacgccatgctccggtacgccgacggcggcctcgccacgttcgacatggcggacatatatgggccagcagaggatttgtatggcatgttcatcaatagagtcaggcgggagcgcccacctgagttgcttgaagaaatcaaggggcttacaaagtgggtgccgcctcccgttaagatgacaagaagttacgttgaggataatatcaatagatctaggaagaggatggatgttgctgcattggacatgttgcagttccactggtatgttattgctcataaagttaccataactgtcataatatttgagtgc

SEQ ID NO: 3337 - DNA, 3242 bp, Oryza sativa
cgctcgctcgtgctggcccacatatcagtgtatgcacatagagtgggtgggaatctccatccgtttgggaacacacaacacaacaactaccacccccactccgctccttccttccttcccgcatttggatttacccccaaatcttctccaagtccaatcgacctcatttcattcgattcatcgatcgctcggcgcggcttagggtttttggcggcagcgatggcgtcggagaagcacttcaagtacgtcatcctcggcggcggcgtcgcagcgggatatgcggcacgggagttcgccaagcagggtgttaagccaggggagctcgccatcatctccaaggaggccgtggctccttatgagcgccctgctctcagcaagggatacctctttcctcagaatgctgcaagactcccaggatttcatgtgtgtgtcggcagtggaggagagaggcttttgcccgaatggtactcagagaaaggcattgagttgatcctgagcactgaaattgtcaaagctgatcttgcctccaagactttgactagtgcagttggagcaacctttacatatgagattttgatcattgcaactggctcctcagtcatcaagctatcagattttggtactcaaggagctgattccaacaacattttatatctaagggaagtagatgatgctgacaagctggttgcagctatccaagcaaagaagggtggaaaggcagttattgtaggaggaggttacattggtctagaacttagtgctgcattgaagatcaatgattttgatgtcacgatggtgtttcctgaaccttggtgcatgcctcgtctcttcactgctgatatcgcggctttctatgagagttactacactaacaaaggagttaagatcgtgaagggtacagtagctgttggttttgatgctgatgctaatggtgatgtcacagcagttaacctgaagaatggcagtgtgcttgaagctgatattgttgttgttggtgttgggggcagaccgctgactactctctttaaaggtcaagttgctgaggagaaaggtggaattaagaccgatgctttctttgaaacaagtgttcctggagtctatgctgtcggtgatgtggccaccttccccatgaagatgtacaatgagttgaggagagtggaacatgttgaccatgctaggaagtctgcagagcaggctgtaaaggcaatcaagggaaaagagtccggcgagtccgttgtggagtatgactatctgccatacttctactcccggtcattcgacctgggatggcaattctacggcgacaacgttggcgacaccatcctgttcggagacagtgacccgacctctgccaagcccaagttcgggtcctactggatcaaggacggcaaggtgttgggtgccttcctggagggtgggtcacctgatgagaacaaggccattgccaaggtcgcgaaaactcagccgcccgttgccaacatagaggagctcaagaaggaaggcctccagttcgccagcaaaatatgagatttttgtagttttgatgtacatttccacatggtactccccctattggttttctgattgtgatgcgtctgtactctgtactcctcttaaatatgggcacttgctatagctgctgagatttgaataaagaagttttctactacagcctttgcctttcacggttcaaagctactggtattgttttgtggaatggcggcggctgctgggctctcgcccaggcttgttgttacgccggggaggagaagccacagccatggacggcggcggatgtgctgcgccgcggcggcggcggcgcagggggagaggaagacgacggtgaggagcaaggagggagacgcggtggagttgtgccgggtggtgaacggcatgtggcaggtgagtggcccgtcgtggggccgctacgagacgcccgccgccgtggacgccatgctccggtacgccgacggcggcctctccaccttcgacatggctgacatttatggaccagcagaggatttgtatggccttttcatcaatagagttcggcgtgagcggccacctgagttgcttgaagaaatcaaggggctaacaaagtgggtaccacctccggttaaaatgaccagaagttatgttgaggataatattaacagatctcgaaagagaatggatgtttctgccttggacatgctgcagttccattggtgggattatgcaaaccctggatatctggatgcactaaaacacatcacagacctaaaggaggaaggtaagataaagacagtagctctgacaaacttcgatacagacaggctgcagataattctagaaaatggtatcccaattgtcagcaaccaggttcaacattctattgttgacatgcgtccgcagcgaagaatggcagaactttgccagcttactggagtaaaacttataacgtatggcacagttatgggtggtctgctgtctgagaagtttcttgacaccaatgtatctataccttttgctggacctcctctgaataccccatctttgcagaagtataagcggatggtggatgcctggggtggctggagcctgttccaggctttgcttcagacgttgaagaaagtatcattgaagcatggtgtttctatatcaactgttgctgtgagatacatactgaaccagacatctgttgcgggttcaatggtgggtgtgagactgggactctctgaacacataaaagacaccaacgccatcttctcgcttgaattagatgaagaggacatgaacagcatcactgaagcatcgaataagggaagaaatcttatggatataataggcgattgtggagacgaatacagagcataattgtgcagagagataaagagagagagaggcagagggggtagaccaatgaggcgtgtgcctgccagttttctggagttctgaaatctgatctgttttgtcatgaacgtagtgtgcagcagctatctgatcttccagtatactactactccagatcagtgtgtaaaccaacctcccaaaagaaagtggcattttataagaactgtacatacacaagacagattataatttgatatgcccattaatacggattcgatttgcgcagttagccaattaaggagtgtcgcatatgctttggttggtcatgtccagggggaggcactgcactatttcatcagcaatcatccacggaaagtggtggtgacagaccgactggcagaatcgtgccc

SEQ ID NO: 3338 - DNA, 1794 bp, Brachypodium distachyon
ctggggcttggccgcttggctgtgcgtgcttccacgtgacgttgcctcgccgtccatcacgagtcttgaacggccaggagcgacccacatccagccaataggaaagatccaccatttcttcgtcttctcggcctgccacattcttcaccaaccccacccccacacaaatccctgcttcgcttctcctcgcagcgagtggttttggtttgctcgactcgactcgatcgttgctagggtttgtttgtttgccagtgggagagagccgccgtccagccatggcgtcggagaagcacttcaagtacgtcatcgtcggcggcggggtctcggcgggttatgcagcacgggagttcgccaagcagggtgttcagccaggggacctcgccatcatctccaaagaggccgtggctccttacgagcgccctgccctcagcaaggcgtacctctttcctcagaatcctgcaagattaccaggatttcatgtctgtgtcggaagtggaggcgagaggctattgcctgaatggtactcagagaaaggtattgagctgatcctgggcactgaaattatcaaagcggatcttgcctccaagactctgactagtgcagccggagcaacctttacatatgagatcttgctgattgctactggctcctcggtcataaagctctctgatttcggcactcaaggagctgattctaacaacattctatatctgagggaagttgatgacgctgacaagctgtatgcagctattcaagcaaaaaagggtgggaaggcagtggttgttggaggaggttacattggccttgaactgagtgcggtattgaagatgaacgaccttgatgtcactatggtgtatcctgaaccttggtgcatgcctcgtctcttcaccgccgatatcgcagctttctatgagagttactatgctaacaaaggagtcaagatcgtgaagggtacagttgccgtgggttttgatgctgatgcaaatggtgatgtcactgcagttaagctaaaggatggcagagtgctcgaagctgatattgttgttgttggtgttgggggcagaccattgactactctcttcaaaggccaagttgcagaggagaaaggtggaatcaagaccgatgcttcttttgaaacaagtgtcccgggggtgtatgccgttggcgatgtggccaccttcccaatgaagatttacaacgacgttaggagagtggaacatgttgaccatgctaggaagtctgcagagcaggctgttaaggcaatcaagggaaaagagtccggtgaggctgttccagagtatgactacctaccgtacttctactccagatcattcgacctatcatggcagttctatggggacaatgtcggcgagaccgtcttgtttggcgacagcgaccccagctccgccaagcccaagttcggctcatactggatcaaggacggcaaggtcctgggtgccttcctggaaggagggtcgccagacgagaacaacgccattgccaaggtcgcgagagctcagccacccgtctccagcgtagaggagctcaagaaggagggtctccagttcgccagcaagatctgactggtctgagccgtgctctcttctgtgtacatcttcatgtcattttagcgattctcgtgtggttgatgtgttacacagatactacctaccatagctcattacacgatactctttctttctgattgtgatgtctgtaccacatatactctctcagctttgagatttcaataaaaatccacagcgtttcgttcgttgcaccgcacagcacagt

SEQ ID NO: 3339 - DNA, 1601 bp, Avena sativa
gccacactcgccaactacccaaatctctcctcttcttcctcctctccacccagtgccccgcccgctcgatcaatcgtcggagaaccaggcagggaggcagccagccatggccacggagaagcacttcaagtacgtcgtcctcggcggcggggtctcagggggctacgcggcgcgggagttcgtgaagcagggcgtgcagccaggggagctcgccatcatctccaaggaggccgtggctccttacgagcgtcccgccctcagcaaggcttacctctttcctcagaatcctgcaagactaccaggattccatgtgtgcgtgggaagcggaggcgagaggctcttgcctgaatggtactcagagaaaggtattgagctgatcctgagcactgaaattgtcaaagctgatcttgccaccaagactctgactagtgcagctggagcgacatttacatatgagatcttggttattgctactggctcctcggtcatcaagctctctgatttcggcacaccaggagctgattcgaacaacattctgtatctaagggaaattgacgacgctgacaagctgcatgcagctatccaagcaaagaagggtggaaaggctgtggttgttggaggaggttacattggccttgagctaagcgcagtattaaagatgaacaatctggatgtcactatggttttccctgaaccttggtgcatgcctcgtctgttcactgccaagatcgcagctttctatgagagttactatactaacaaaggagtcaagatcgtgaagggtacagttgctgttggttttgatgctaacgccaatggtgacgtcactgcagttcagctaaatgatggaagtgtgctcgaagctgatattgtcgttgttggtgttggcggcagaccattgactactctcttcaaaggccaagttgctgaggagaaaggtggaatcaagactgatgcttccttcgaaacaagcatccctggagtgtacgcagttggcgatgtggccaccttcccgatgaagatttacaatgatgtgaggagagtagagcatgtcgaccattctaggaagtccgctgagcaggctgtgaaggcgatcaaggggaaagaggcaggcgaggccgtcccggagtacgaatacctgccctacttctactcgcggtcgttcgacctgtcgtggcagttctacggcgacaacgtgggcgagacggtcctgtttggcgacagcgacccgagctccgccaagcccaagttcgggtcgtactggatcaaggacgggaaggtcctgggcgtgttcctggaaggcgggtcggccgacgagaacagcgccatcgccaaggtcgcgaaggcccagccggccgccgggagccttgaggagctcaagaaggagggcctccagttcgccagcaggatctgatgagtcctgccattttttggagactcgtggcgcgtggttgaagtgtttgctagatttaccatacatacctcatcctacatgatgatagtacaatgtttttattcagtatctgattgtgatgtctgtaccacacatactctgtgcacttgtgaatgttcttctcaataaaacccacggccttacggtc

SEQ ID NO: 3340 - DNA, 1603 bp, Triticum aestivum
ccgcctccggtcagctcgccagatcctacctccacgcgctagggttcgcccgcccgtcgtcgccactcgccagccagccatggcgtccgggaagcacttcaagtacgtcgtcctcggcggcggggtctccggggggtacgcggcgcgggagttcgccaagcagggcgtgcagccgggggagctcgccatcatctccaaggaggccgtggctccttacgagcgccctgccctcagcaaggcatacctgttcccccagaatcctgcaagattgccaggattccatgtgtgcgtgggaagtggaggcgagaggctcctgcctgaatggtactcagagaaaggcattgagcttatcctgagcactgaaattgtgaaagctgatcttgcttccaagactctgactagtgcagctggagcaacctttacatatgagatcttgctaattgctactggctcctcagtcattaagctctctgattttggcactcaaggagctgattctaacaacattctgtacctaagggaaattgacgacgcggacaatctgtatgcagctatccaagcaaagaagggtggaaaggcagtggttgttggaggaggttacattggccttgaactaagcgcagtattgaagatgaacgatcttgatgtgactatggtgttccctgaaccttggtgcatgcctcgtctcttcactgccgagattgcagctttctacgagagttactataccaacaaaggagtcaagatcgtgaagggtacagttgctattggttttgatgctgacgccaatggtgatgtgaccgcagttaagctaaaggacggcagtgtgctcgaagctgatattgttgtcgtcggtgttgggggcagaccattgactactctcttcaaaggccaagttgccgaggagaaaggtggaatcaagaccgatgcttttttcgaaacaagtgtccctggagtgtatgccgttggcgacgtggcgaccttcccgatgaagatctacaacgacgagaggagagtggagcatgtcgaccattccaggaagtccgcggagcaggccgtgaaggcgatcaaggggaaagaggcgggctctgccgtggaggagtacgactacctgccctacttctactcgcggtcgttcgacctgtcgtggcagttctacggggacaacgtcggcgacgccatcctgttcggcgacgccgaccccagctccgccaaacccaagttcgggtcgtactgggtcaaggacggcaagtgcgtgggcgcgttcctggagggcgggtcgccggacgagaacgccgccatcgccaagctcgcgagggcccagccgcccgccgccagccccgacgagctcaaggccgccggcctccagttcgccagcaagatctgatgtggccgtgccgctgaagtgtcacgttgggcattagatttgcaaatacatacatacatacataaacacatagctcactgcacagtacaatttggtcgatgctattgtgatgtctgtatgccacatactctctcagtttctccgcgcctttgaggtttcaataaagcccgcacccctacggtcagttcaataaaaaaaaaaaaaagggcggccgct

SEQ ID NO: 3341 - DNA, 1962 bp, Triticum aestivum
gaaatatactacagtatgaacaaccaaccaaaccaaaccacccactccacccccgaaatccctcggccccgcatcacacccgctccatccatcctctccgtctccgtctccggtcagctcgccagatcctacctccacgcgctagggttcgcccgcccgtcgtcgccactcgccagccagccatggcgtccgggaagcacttcaagtacgtcgtcctcggcggcggggtctccggggggtacgcggcgcgggagttcgccaagcagggcgtgcagccgggggagctcgccatcatctccaaggaggccgtggctccttacgagcggcctgccctcagcaaggcatacctgttcccccggaatcctgcaagattgccaggattccatgtgtgcgtgggaagtggaggcgagaggctcctgcctgaatggtactcagagaaaggcattgagcttattctgagcactgaaattgtgaaagctgatcttgcttccaagactctgactagtgcagctggagcaacctttacatatgagatcttgctaattgctactggctcctcagtcattaagctctctgattttggcactcaaggagctgattctaacaacattctgtacctaagggaaattgacgacgcggacaatctgtatgcagctatccaagcaaagaagggtggaaaggcagtggttgttggaggaggttacattggccttgaactaagcgcagtattgaagatgaacgatcttgatgtgactatggtgttccctgaaccttggtgcatgcctcgtctcttcactgccgagattgcagctttctacgagagttactataccaacaaaggagtcaagatcgtgaagggtacagttgctattggttttgatgctgacgccaatggtgatgtgaccgcagttaagctaaaggacggcagtgtgctcgaagctgatattgttgtcgtcggtgttgggggcagaccattgactactctcttcaaaggccaagttgccgaggagaaaggtggaatcaagaccgatgcttttttcgaaacaagtgtccctggagtgtatgccgttggcgacgtggcgaccttcccgatgaagatctacaacgacgagaggagagtggagcatgtcgaccattccaggaagtccgcggagcaggccgtgaaggcgatcaaggggaaagaggcgggctctgccgtggaggagtacgactacctgccctacttctactcgcggtcgttcgacctgtcgtggcagttctacggggacaacgtcggcgacgccatcctgttcggcgacgccgaccccagctccgccaaacccaagttcgggtcgtactgggtcaaggacggcaagtgcgtgggcgcgttcctggagggcgggtcgccggacgagaacgccgccatcgccaagctcgcgagggcccagccgcccgccgccagccccgacgagctcaaggccgccggcctccagttcgccagcaagatctgatgtggccgtgccgctgaagtgtcacgttgggcattagatttgcaaatacatacatacatacataaacacatagctcactgcacagtacaatttggtcgatgctattgtgatgtctgtatgccacatactctctcagtttctccgcgcctttgaggtttcaataaagcccgcacccctacggtcagttcaatacacatttgttggcataagcttttgtgaggatgcttttgtgtgcccgctctggcgccggcgccgtgatggccaccgccgcggccggccttcctcggcgggggaggtgcgggcggaggcggaggtgcaccgtggcggcggcgatgggcgcgccggaggtggagaaggggaagacggcgacggtgaggagcaaggcgtcgggggacgcgctggaggtgtgccgggtggtgaacgggatgtggcaggtgagcggcgcgtcgtggggccgcgcggcgccggcggc

SEQ ID NO: 3342 - DNA, 1621 bp, Leymus cinereus x Leymus triticoides
  misc_feature (599)..(599): n is a, c, g, or t
accactcctcccaaccccccaaatctctctctctcgccccccttcgcttctcctcttcacccatcctctccgtctccggtcagttcgctagatcctactgccacgtgctagggtttgcgcggccctcgtcaccagccatggcgtccgggaagcacttcaagtacatcgtcctcggcggcggggtctcggggggctacgcggcgcgggagttcgccaagcagggcgtgcagccaggggagctcgccatcatctccaaggaggccgtggctccttacgagcgccctgccctcagcaaggcgtacctgttccctcagaatcctgcaagattgccaggatttcatgtgtgcgtgggaagtggaggcgagaggctcttgcctgaatggtactcagagaaaggtatcgagcttatcctgagcactgaaattgtcaaagctgatcttgcttccaagtctctgactagtgcagctggagcaacctttacatatgagatcttgctaattgctactggctcctcggtcataaagctctctgattttggcacccaaggagctgattctaacaacatcctgtatctaagggaagttgacgacgcggacaanctgtatgcagctatccaagcaaagaaaggtggtaaggcagtggttgttggaggaggttacattggccttgaactaagcgcagtattgaagatgaacaatcttgatgtcactatggtgtttcctgaaccttggtgcatgcctcgtctcttcaccgccgatattgcagctttctatgagagttactataccaacaaaggagtcaagatcgtgaagggtacagttgccgttggctttgatgctgatgccaatggtgatgtcacggcagttaagctgaaggacggcagtgtgcttgaagctgatattgttgtggtcggtgttgggggcagaccattgactactctcttcaaaggccaggttgctgaggagaaaggtggaatcaagactgatgcatttttcgaaacaagtgtccctggagtgtatgccgttggcgacgtggccaccttcccaatgaagatttacaacgacgtgaggagagtggagcatgtcgaccattccaggaagtctgcggagcaggctgtgaaggcaatcaaggggaaagaggcaggctctaccgtggcggagtacgactacctgccctacttctactcgcggtcgttcgacctgtcatggcaattctacggggacaacgtcggtgatgctatcctgttcggcgacgccgaccccagctcggccaagcccaagttcgggtcgtactgggtcaaggacggcaagttggtgggcgcgttcctggagggcgggtcgccggacgagaacggcgccatcgccaagctcgcgagggcccagccacccgccaccagccccgaggagctcaaggccgcgggcctccagttcgccagcaagatctgatgtggttgtgttgttgaagtgttgcatgaacattagattgccatacatacatacatagctcactgcacagtacaattggtcgatgctattgtgatgtctgtaccacatactctcagtttctctgcacctttgaggtttcaataaagcccacacccttacggtcagtgcactacaca

SEQ ID NO: 3343 - DNA, 1623 bp, Avena sativa
caacaaccacaccacaccacacccccaaatccctcctcttcttcctcctctccacccgcccgctcgatcgatcaatcgtcggagaaccaggcagggaggcagccagccatggccacggagaagcacttcaagtacgtcgtcctcggcggcggggtctcagggggctacgcggcgcgggagttcgtgaagcagggcgtgcagccaggggagctcgccatcatctccaaggaggccgtggctccttatgagcgccccgccctcagcaaggcgtacctctttcctcagaatcctgcaagactaccaggattccatgtgtgcgtgggaagcggaggcgagaggctcttgcctgaatggtactcagagaaaggtattgagctgatcctgagcactgaaattgtcaaagctgatcttgcctccaagactctgactagtgcagctggagcgacatttacatatgagatcttggttattgctactggctcctcagtcatcaagctctctgatttcggcacaccaggagctgattcgaacaacattctgtatctaagggaagttgacgacgctgacaagctgtatgcagctatccaagcaaagaagggtggaaaggctgtggttgttggaggaggttacattggccttgagctaagcgcagtattaaagatgaacaatctggatgtcactatggttttccctgaaccttggtgcatgcctcgtctgttcactgccaagatcgcagctttctatgagagttactatactaacaaaggagtcaagatcgtgaagggtacagttgctgttggttttgatgccaacgccaatggtgacgtcactgcagttcagctaaatgatggaagtgtgctcgaagctgatattgtcgttgttggtgttggcggcagaccattgactactctcttcaaaggccaagttgctgaggagaaaggtggaatcaagactgatgcttcctttgaaacaagcatccctggagtgtacgcagttggcgatgtggccaccttcccgatgaagatttacaatgatgtgaggagagtagagcatgtcgaccattctaggaagtctgctgagcaggctgtgaaggcgatcaaggggaaagaggcaggcgaggccgtcccggagtacgaatacctgccctacttctactcgcggtcgttcgacctgtcgtggcagttctacggcgacaacgtgggtgagacggtcctgtttggcgacagcgacccgagctccgccaagcccaagttcgggtcgtactggatcaaggacgggaaggtcctgggcgtgttcctggaaggcgggtcggccgaggagaacagcgccatcgccaaggtcgcgaaggcccagccggccgccgggagccttgaggagctcaagaaggagggcctccagttcgccagcaggatctgatgagtcctgccatttttttggagactcgcggcgcgcgtggttgaagtgtttgctagatttaccatacatacctcatcctacatgatagtacaatgtttttattcagtatctgattgtgatgtctgtaccacacatactctgtgcacttgtgaatcttcttctcaataaaacccacggccttatggtcagtgcgctgcgaaaaaaaaa

SEQ ID NO: 3344 - DNA, 1623 bp, Triticum aestivum
ctcggccccgcatcacacccgctccatccatcctctccgtctccgtctccggtcagctcgccagatcctacctctccgtccgaccgtccgtcgtcgccgctcacgagccggccggccatggcgtccgggaagcacttcaagtacatcgtcctcggcggcggcgtctccggggggtacgcggcgcgggagttcgccaaacagggggtgcagccgggggagctcgccatcatctccaaggaggcagtggctccttacgagcgccctgccctcagcaaggcatacctgttccctcagagtcctgcaagattgccaggattccatgtgtgcgtgggaagtggaggcgagaggctcctgcctgaatggtactcagagaaaggcatcgagcttatcctgagcactgaaattgtcaaagctgatcttccttccaagactctgactagtgcagctggagcaacctttacatacgagatcttgctaattgctactggctcctcagtcattaagctctctgattttggcactcaaggagctgattctaacaacattctgtacctgagggaaattgacgacgcagacaacctgtatgcagctatccaagcaaagaagggtgggaaggcagtggtggttggtggaggttacattggccttgaactaagcgcagtattgaagatgaacgatcttgatgtgactatggtgttccctgaaccttggtgcatgcctcgtctcttcaccgccgagattgcagctttctacgagagttattatactaacaaaggagtcaagatcttgaagggtacaattgctgttggttttgatgctgacgctaatggtgatgtcaccgcagttaagctaaaggacggcagtgtgctcgaagctgatattgttgtcgtcggtgttgggggcagaccgttgactactctcttcaaaggccaagttgccgaggagaaaggtggaatcaagaccgatgcttttttcgaaacaagtgtccccggagtgtatgccgtcggcgacgtggccaccttcccgatgaagatctacaacgacgagaggagagtggagcatgtcgaccattccaggaagtccgcggagcaggctgtgaaggcaatcaaggggaaagaggcgggttccgccgtggaggagtacgactacctgccctacttctactcgcggtcgttcgacctgtcatggcagttctacggggacaatgtcggcgacgccatcctgttcggcgatgccgaccccggctcggccaagcccaagttcgggtcgtactgggttaaggacggcaagtgcgtgggcgcgttcctggagggcgggtcgccggacgagaacgccgccatcgccaagctcgcgagggcccagctgcctgccgccagccccgacgagctcaaggccgccggcctccagttcgccagcaagatctgacgcagccccgccgctgaggtgtcacatttggacattagatttgcaaatacatacatgcataaatagtattattggtcgatgctattgtgatgtctgtataccacatactctctcagtttctccgcgcctttgaggtttcaatcaataaagcccgcgcccttgcggtcggttcagtaaaaaaaaaaaaaaaaaaaaaaa

SEQ ID NO: 3345 - DNA, 1543 bp, Secale cereale
ccgctccatccattccacccgctccgtctccggccagatcgcagcgccagccagccatggcgtccgggaagcacttcaagtacatcgtcctcggcggcggcgtctcgggggggtacgcggcgcgggagttcgccaagcagggcgtgcagccgggggagctcgccatcatctccaaggaggccgtggctccttacgagcgccctgccctcagcaaggcgtacctgttcccccagaatcctgcaagattgccaggattccatgtgtgcgtggggagtggaggcgagaggctcctgcctgaatggtactcggagaaaggtatcgagcttatcctgagcactgaaattgtcaaagctgatcttgcctccaagactctgactagttcagctggagcaacctttacatatgagattttgctaattgctactggctcctcggtcataaagctctctgattttggcactcaaggagctgattccaacaacattctgtatctaagggaaatcgatgatgcggacaacctgtatgcagctatccaagcaaagaagggtgggaaggcagtggttgttggaggaggttacattggccttgaactgagcgcggtattgaagatgaacgatcttgatgtgactatggtgttccctgaaccttggtgcatgcctcgtctcttcactgccgagattgcggctttctacgagagttactataccaacaaaggagtcaagatcgtgaagggtacagttgctgttggttttgatgctgacgccaatggtgatgtgaccgcagttaagctgaaggacggcagtgtgctcgaagctgatattgttgtcgtcggtgttgggggcagaccattgactactctcttcaaaggccaagttgccgaggagaaaggtggaatcaagaccgatgctttcttcgaaacaagtgtccctggagtgtatgccgttggcgacgtggccaccttcccgatgaagatctacaacgacgagaggagagtggagcatgtcgaccactccaggaagtccgcggagcaggccgtgaaggcgatcaaggggaaggaggcgggctccgcggtggcggagtacgactacctgccctacttctactcgcggtcgttcgacctgtcgtggcagttctacggggacaacgtgggcgacgccatcctgttcggcgacgcggaccccgtctcggccaagcccaagttcgggtcgtactgggtcaaggacggcaagtgcgtgggcgcgttcctggagggcgggtcgccggacgagaacgccgccatcgccaagctcgcgagggagcagccgcccgccgccagccccgccgagctcaaggccgccggcctccagttcgccagcagcaagatctgatgtggccgtgctgatctgaagtgttatatggacattagattgtgccatacatacatacatagctcactgcacagtacgattggtcggtgctattgtgatgtctgtaccacatactccctcagtttctccgcaccttttgagatttcaataaagcccacacccctgcggtcagtgcc

SEQ ID NO: 3346 - DNA, 2139 bp, Triticum aestivum
aaaatctataagaatgacattggagttatcataataaaatctatacaagtatcaacaacacaggacaagcgtaaacctaggacttaacgctaacttaacacctacagagtaaccagccgcagcgccacagccaacagctagacttgcgagggcgcctcctccagcccggggcactccagggccatggaagggccctggagtggggcaggctaggcccgctggaaggcccgctggacggccctggacggcccgttgtcaagcccagggatcctggacccaccgcgtggcgcgtctgtcacccccggaccagcgggggagcgcaggggaagtcccagactccacagatccaaacttcggaatgtaattaagaaatcgagagtaaattacttttgtactgttttcattgcggtagagactggatcttccccgcgcttttgccccctcccgagcgtcagctggccccccatagagaacgcctctttttgtcgggtttggctttcagtagccgattcaaataaataataccccccaaatccctcgcctccgctccgtccattccatcctctccgtctccggtcagctcgccagatcctacctccacgcgctagggtttgcgcggccgtccgtccgtccgtcgtcgccaccagccatggcgtccgggaagcacttcaagtacatcgtcctcggcggcggcgtctcgggggggtacgcggcgcgggagttcgccaagcagggcgtgcagccgggggagctcgccatcatctccaaggaggccgtggctccttacgagcgccctgccctcagcaaggcatacctgttccctcagaatcctgcaagattgccaggattccatgtgtgtgtgggaagtggaggcgagaggctcttgcctgaatggtactcagagaaaggcatcgagcttatcctgagcactgaaattgtcaaagctgatcttgcttccaagactctgactagtgcagctggagcaacctttacatatgataccttgctaattgctactggctcctcagtcattaagctctctgattttggcactcaaggagctgattctaacaacattctgtacctaagggaaattgacgacgcggacaatctgtatgcagctatccaagcaaagaagggtgggaaggcagtggttgttggaggaggttacattggccttgaactaagcgcagtattgaagatgaacgatcttgatgtgactatggtgttccctgaaccttggtgcatgcctcgtctcttcactgccgagattgcggctttctacgagagttactatactaacaaaggagtcaagatcttgaagggtacaattgctgttggttttgatgctgacgccaatggtgatgtgactgcagttaagctaaaggacggcagtgtgctcgacgctgatattgttgtcgtcggtgttgggggcagaccgttgactaatctcttcaaaggccaagttgccgaggagaaaggtggaatcaagaccgatgcttttttcgaaacaagtgtccctggagtgtatgccgtcggcgacgtggccaccttcccgatgaagatctacaacgacgagaggcgagtggagcacgtcgaccattccaggaagtccgcggagcaggctgtgaaggcaatcaaggggaaagaggcggggtctgccgtggaggagtacgactacctgccctacttctactcgcggtcgttcgacctgtcgtggcagttctacggggacaacgtcggcgacgccatcctgttcggcgacaccgaccccggctcggccaagcccaagttcgggtcgtactgggtcaaggacggcaagtgcgtgggcgcgttcctggagggcgggtcgccggacgagaacgccgccatcgccaagctcgcgagagcccagccgcccgccgccagccccgacgagctcaaggccgccggcctccagttcgccagcaagatctgatgtggccgtgccgctgaagtgtcacgttgggcattagatttgcaaatacatacatacatacataaacacatagctcactgcacagtacaatttggtcgatgctattgtgatgtctgtatgccacatactctctcagtttctccgcgcctttgaggtttcaataaagcccgcacccctacggt

SEQ ID NO: 3347 - DNA, 1514 bp, Triticum aestivum
gatcctacctctccgtccgaccgtccgtcgtcgccgctcacgagccggccggccatggcgtccgggaagcacttcaagtacatcgtcctcggcggcggcgtctccggggggtacgcggcgcgggagttcgccaaacagggggtgcagccgggggagctcgccatcatctccaaggaggcagtggctccttacgagcgccctgccctcagcaaggcatacctgttccctcagagtcctgcaagattgccaggattccatgtgtgcgtgggaagtggaggcgagaggctcctgcctgaatggtactcagagaaaggcatcgagcttatcctgagcactgaaattgtcaaagctgatcttccttccaagactctgactagtgcagctggagcaacctttacatatgataccttgctaattgctactggctcctcagtcattaagctctctgattttggcactcaaggagctgattctaacaacattctgtacctgagggaaattgacgacgcggacaatctgtatgcagctatccaagcaaagaagggtgggaaggcagtggtggttggaggaggttacattggccttgaactaagcgcagtattgaagatgaacgatcttgatgtgactatggtgttccctgaaccttggtgcatgcctcgtctcttcaccgccgagattgcagctttctacgagagttattatactaacaaaggagtcaagatcttgaagggtacaattgctgttggttttgatgctgacgctaatggtgatgtcaccgcagttaagctaaaggacggcagtgtgctcgaagctgatattgttgtcgtcggtgttgggggcagaccgttgactactctcttcaaaggccaagttgccgaggagaaaggtggaatcaagaccgatgcttttttcgaaacaagtgtccccggagtgtatgccgtcggcgacgtggccaccttcccgatgaagatctacaacgacgagaggagagtggagcatgtcgaccattccaggaagtccgcggagcaggctgtgaaggcaatcaaggggaaagaggcgggttccgccgtggaggagtacgactacctgccctacttctactcgcggtcgttcgacctgtcatggcagttctacggggacaatgtcggcgacgccatcctgttcggcgatgccgaccccggctcggccaagcccaagttcgggtcgtactgggttaaggacggcaagtgcgtgggcgcgttcctggagggcgggtcgccggacgagaacgccgccatcgccaagctcgcgagggcccagctgcctgccgccagccccgacgagctcaaggccgccggcctccagttcgccagcaagatctgacgcagccccgccgctgaggtgtcacatttggacattagatttgcaaatacatacatgcataaatagtattattggtcgatgctattgtgatgtctgtataccacatactctctcagtttctccgcgcctttgaggtttcaatcaataaagcc

SEQ ID NO: 3348 - DNA, 1490 bp, Secale cereale
tcaccagccagccagccagtggcgtccgggaagcacttcaagtacatcgtccgtcggcggcggcgtctcgggggggtacgcggcgcgggagttcgccaagcagggcgtgcagccgggggagctcgccgtcatctccaaggaggccgtggcaccttacgagcgccctgccctcagcaaggcatacctgttcccccagaatcctgcaagattgccgggattccatgtgtgcgtgggaagtggaggcgagaggctcctgcctgaatggtactcagagaaaggtattgagcttatcctgagcactgaaattgtcaaagctgatcttgcctccaagactctgactagttcagctggagcaacctttacatatgagattttgctaattgctactggctcctcggtcataaagctctctgattttggcactcaaggagctgattccaacaacattctgtatctaagggaaattgatgatgcggacaacctgtatgcagctatccaagcaaagaagggtgggaaggcagtggttgttggaggaggttacattggccttgaactgagcgcggtattgaagatgaacgatcttgatgtgactatggtgttccctgaaccttggtgcatgcctcgtctcttcactgccgagattgcggctttctacgagagttactataccaacaaaggagtcaagatcgtgaagggtacagttgctgttggttttgatgctgacgccaatggtgatgtgaccgcagttaagctgaaggacggcagtgtgctcgaagctgatattgttgtcgtcggtgttggggcagaccgttgactactctcttcaaaggccaagttgccgaggagaaaggtggaatcaagaccgatgcttttttcgaaacaagtgtccctggagtgtatgccgttggcgacgtggccaccttcccgatgaagatctacaacgacgagaggagagtggagcatgtcgaccactccaggaagtccgcggagcaggccgtgaaggcgatcaaggggaaggaggcgggctctgcggtggcggagtacgactacctgccctacttctactcgcggtcgttcgacctgtcgtggcagttctacggggacaacgtgggcgacgccatcctgttcggcgacgcggaccccgggtcggccaagcccaagttcgggtcgtactgggtcaaggacggcaagtgcgtgggcgcgttcctggagggcgggtcgccggacgagaacgccgccatcgccaagctcgcgagggagcagccgcccgccgccagccccgccgagctcaaggccgccggcctccagttcgccagcagcaagatctgatgtggccttgctgccgttcttcttggagaattctcgtgcggttgttgatatgtcacatggatactagtagggtaccaatgcatacacagtacacagtacgattgatgctattgttagtgtctgtgccacatactcctgctgcagctgcacgtttgtgattt

SEQ ID NO: 3349 - DNA, 1643 bp, Hordeum vulgare
tgccacgctcttcgacaaccaaccaaccaaaccaaccactccgctccatccatccatccatcctccccgtcttcgtctccggccagttcgttcgccagatcctaccgccacgcgctcgcaagggttcgccgtcgtcaccagccagccagccatggccaccgggaagcacttcaagtacatcgtcctcggcggcggcgtctcagggggctacgcggcgcgggagttcgccaagcagggcgtgcagccaggggagctcgccatcatctccaaggaggccgtggcaccttacgagcgccctgccctcagcaaggcgtacctgttccctcagagtcctgcaaggttgccaggattccatgtgtgcgtgggaagtggaggcgagaggctcttgcctgaatggtactcagagaaaggtattgagcttatcctgagcactgaaattgtcaaagctgatcttgcctccaagactctgactagttcagctggagcaacctttacatatgagattttgctaattgctactggctcctcggtcattaagctctctgattttggcactcaaggagctgattccaacaacattctgtacctaagggaagttgacgacgcggacaagctgtatgcagccatccaagcaaagaagggcgggaaggcagtggttgttggaggaggttacattggccttgaactaagcgctgtattgaagatgaacaatcttgatgtgactatggtgttccctgaaccttggtgcatgccccgtctcttcactgccgagattgcagctttctacgagagttactacactaacaaaggagtcaagatcgtgaagggtacagttgctgttggttttgatgctgacgccaatggtgatgtgactgcagttaagctaaaggacggcagcgtgctcgaagctgatatagttgtcgtcggtgttgggggcagaccgttaactggtctcttcaaaggccaggttgccgaggagaaaggtggaatcaagaccgatgcttttttcgaaacaagtgtccctggagtgtatgccgtcggcgacgtggccaccttcccgatgaagatctacgacgacgtgaggagagtggagcacgtcgaccattccaggaagtccgcggagcaggccgtgaaggcaatcaaggggaaggaggcgggctccgccgtggcggagtacgactacctgccctacttctactcgcggtcgttcgacctgtcgtggcagttctacggtgacaacgtcggcgacgccatcctgttcggcgacgccgaccccagctccgccaagcccaagttcgggtcgtactgggtcaaggacggcaagtgcgtgggcgtgttcctggagggcgggtcgccggacgagaacggcgccatcgccaagctcgcgagggaccagccgcccgccgccagccccgcggagctcaaggccgccggcctccagttcgccaccagcaagatctgaacctcggtgtcctgggtgtatttgttacatggatactagaccaccatacgtacatgcatacatacatagtagctgactacacagtacaattggtcgatgctattgtgatgtctgtgtaccacatactcttcctgcatatttgagttgaggcttcaataaaacccacacccttcctgtcagt

SEQ ID NO: 3350 - DNA, 1640 bp, Hordeum vulgare
gggacaaccaaccaaccaaaccaaccactccgctccatccatccatcctccccgtcttcgtctccggccagttcgttcgccagatcctaccgccacgcgctcgcaagggttcgccgtcgtcaccagccagccagccatggccaccgggaagcacttcaagtacatcgtcctcggcggcggcgtctcagggggctacgcggcgcgggagttcgccaagcagggcgtgcagccaggggagctcgccatcatctccaaggaggccgtggcaccttacgagcgccctgccctcagcaaggcgtacctgttccctcagagtcctgcaaggttgccaggattccatgtgtgcgtgggaagtggaggcgagaggctcttgcctgaatggtactcagagaaaggtattgagcttatcctgagcactgaaattgtcaaagctgatcttgcctccaagactctgactagttcagctggagcaacctttacatatgagattttgctaattgctactggctcctcggtcattaagctctctgattttggcactcaaggagctgattccaacaacattctgtacctaagggaagttgacgacgcggacaagctgtatgcagccatccaagcaaagaagggcgggaaggcagtggttgttggaggaggttacattggccttgaactaagcgctgtattgaagatgaacaatcttgatgtgactatggtgttccctgaaccttggtgcatgccccgtctcttcactgccgaaattgcagctttctacgagagttactatactaacaaaggagtcaagatcgtgaagggtacagttgctgttggttttgatgctgacgccaatggtgatgtgactgcagttaagctaaaggacggcagcgtgctcgaagctgatatagttgtcgtcggtgttgggggcagaccgttaactggtctcttcaaaggccaggttgccgaggagaaaggtggaatcaagaccgatgcttttttcgaaacaagtgtccctggagtgtatgccgtcggcgacgtggccaccttcccgatgaagatctacgacgacgtgaggagagtggagcacgtcgaccattccaggaagtccgcggagcaggccgtgaaggcaatcaaggggaaggaggcgggctccgccgtggcggagtacgactacctgccctacttctactcgcggtcgttcgacctgtcgtggcagttctacggtgacaacgtcggcgacgccatcctgttcggcgacgccgaccccagctccgccaagcccaagttcgggtcgtactgggtcaaggacggcaagtgcgtgggcgtgttcctggagggcgggtcgccggacgagaacggcgccatcgccaagctcgcgagggaccagccgcccgccggcagccccgcggagctcaaggccgccggcctccagttcgccaccagcaagatctgaacctcggtgtcctgggtgtatttgttacatggatactagaccaccatacgtacatgcatacatacatagtagctgactacacagtacaattggtcgatgctattgtgatgtctgtgtaccacatactcttcctgcatatttgagttgaggcttcaataaaacccacacccttcctgtcaaaaaaaaaaaaaaa

SEQ ID NO: 3351 - DNA, 2204 bp, Panicum virgatum
cggtcgtttgctcccacggacggccgtaggagggccacgtggcaccagaattagtcggaatgagcgaagcagcgtttgttttccgggaagcatagctggcaactggcaacacggcggcaggcagtataaaaagtgagcgagcgatcacgcgcagttcccgtctgctctctctctctcttttcgtccgtcgcctgctgctgcttccccgtccggcggtttcattcgcgatcgttgcttctccgatccatcacgtattgacatggcggcggaggccaagcacttcaagtacgtcatcctcggcggcggcgtcgcggcggggtacgcggcgagggagttcggcaagcagggcgtcaaccccggcgacctcgccatcatctccaaggaacccgtggccccgtacgagcgccccgcactcagcaagggatacctcttccctcagaatgccgcaagactgcctgggttccacacgtgtgtggggagcggcggagagaggctacttcctgaatggtactcagagaaaggcattgagctgatcctgagcactgagattgtgaaggctgaccttgcctccaagaccctaacaagtgcagctggggcaaactttacatatgagaccttgctcattgctactggctcctcggtcataaagctcacggactttggcgttcagggagcagaatccaacaacatattgtatctaagggatattgccgatgcggacaagttggtcgcagctatgcaagcaaagaaggatggaaaggctgtgattgttggaggtggttacatagggcttgagcttagtgcagccttgaaaatgaacaactttgatgtcactatggtgtaccctgaaccctggtgcatgccccgtctcttcacctccggtatcgctcatttctatgagggctactactctaacaaaggaatcaagattgtgaagggcacagttgctgctggcttcgaagctgatgccaatggagatgtcactgcagtgaagctgaaggatggaagagtactggaagctgacattgttgttgttggcgtcggcggcaggccattgacggctctcttcaagggtaaacttgcagaggagaaaggtggactcaagacggatgcattcttcgagacaagcgttccgggagtatacgccatcggcgacgtggccaccttccctctgaagctctacaacgagcagcggcgagtggagcacgtggaccacgcccggaagtcagccgagcaggccgtgcgggcgatcaaggccaaggagtccggcgagccggtgcccgagtacgactacctgccctacttctactcccgctcgttcgacatcgcgtggcagttctacggcgacaacgtcggcgacgacgtgctgttcggcgacaacgacccggcctcggccaaccacaagttcgggagctactgggtcaaggacggcaaggtcgtcggcgtgttcctcgagggtgggtcggctgaggagaaccaggccatcgccagggtcgccaggacccagccgccggtggccaacgtcgaggcgctcaagaccgaggggctggagttcgctaccaaagcctgatcaagcaattcggcagatgtaacaaaaacaaaattaattagagactgccaatttgagcatgtatatttcttggcaattctgctttgagcttttcacatcactcggtgcttcttagtagttcaaatagttgctagtccgcactacctaataatctgggcttctgatcgtgatgtgttttggtgaatatcttattcttatcgccatctttctaatgggctcagcagctgctggagattccgacaggaggaaatcatgctcaccccatgaaagcaaccagtttaaaagcacctgaggatgcctagctagatcttcctgtcaggccggcatatctgtgaaaggaagccacagctctgtccggtggattctgacaagatggagtgatcctttgtcggacgtctgacaaactgaatcaggcctaactactactgtcactttccattacccattttctaggtttttagttaggatctgcatttggccccaatctgcatagtgcggactgcggtcattgtctaagtaactgcccggagatgcaacattcgttgttacatcgacacatccgctatagttattgtcgcaatggtgttgagaaataaatatttgcaataatttacaaatataactaaacttgggt

SEQ ID NO: 3352 - DNA, 1439 bp, Secale cereale
gcggcgtctcgggggggtacgcggcgcgggagttcgccaagcagggcgtgcagccgggggagctcgccgtcatctccaaggaggccgtggctccttacgagcgccctgccctcagcaaggcgtacctgttcccccagaatcctgcaagattgccgggattccatgtgtgcgtgggaagtggaggcgagaggctcctgcctgaatggtactcagagaaaggtatcgagcttatcctgagcactgaaattgtcaaagctgatcttgcctccaagactctgactagttcagctggagcaacctttacatacgagattttgctaattgctactggctcctcggtcataaagctctctgattttggcactcaaggagctgattccaacaacattctgtatctaagggaaattgatgatgcggacaacctgtatgcagctatccaagcaaagaagggtgggaaggcagtggttgttggaggaggttacattggccttgaactaagcgcagtattgaagatgaacgatcttgatgtgactatggtgttccctgaaccttggtgcatgcctcgtctcttcactgccgagattgcggctttctacgagagttactataccaacaaaggagtcaagatcgtgaagggtacagttgctgttggttttgatgctgacgccaatggtgatgtgaccgcagttaagctaaaggacggcagtgtgctcgaagctgatattgttgtcgttggtgttgggggcagaccgttgactactctcttcaaaggccaagttgccgaggagaaaggtggaatcaagaccgatgctttcttcgaaacaagtgtccctggagtgtatgccgttggtgacgtggccaccttcccgatgaagatctacaacgacgagaggagagtggagcatgtcgaccattcaaggaagtctgcggagcaggctgtgaaggcgatcaaggggaaggaggcgggctccgcggtggcggagtacgactacctgccctacttctactcgcggtcgttcgacctgtcgtggcagttctacggggacaacgtgggcgacgccatcctgttcggcgacgcggaccccgggtcggccaagcccaagttcgggtcgtactgggtcaaggacggcaagtgcgtgggcgcgttcctggagggcgggtcgccggacgagaacgccgccatcgccaagctcgcgagggagcagccgcccgccgccagccccgccgagctcaaggccgccggcctccagttcgccagcagcaagatctgatgtggccgtgctgatctgaagtgttatatggacattagattgtgccatacatacatacatagctcactgcacagtacgattggtcgatgctattgtgatgtctgtaccacatactctctcagtttctccgcaccttttgagatttcaataaagccgacacccgcgggg

SEQ ID NO: 3353 - DNA, 1749 bp, Setaria italica
cacgcgcagtttccgtctcctttgtctcctcttcctcctcagctccctctcgacgcgagcccagcaagaactccaccatccatccgtcgccctgcctccgtctccgtctccgtccggcgggatcgcgatcgttgacgtattgacatggcggcggaggcgaggcacttcaagtacgtcgtcctcggcggcggcgtcgcggcggggtacgcggccagggagttcgccaagcagggggtcaaccccggcgagctcgccatcatctccaaggaaccggtggcaccgtatgagcgccctgcactcagcaagggatacctcttccctcagaatgccgcaagactgcctgggttccacacgtgtgtggggagcggtggagagaggctgcttcctgaatggtactcagagaaaggcattgagctgatcctgagcactgagattgtgaaggttgaccttgcctcgaagactctgaccagtgcagctggggcaaccttcacatatgagatcttgctcattgctactggctcctcggtcataaagctcacagactttggtgttcaaggagcagaatccaacaacatattgtatctaagggatattgccgatgctgagaaattggtggctgctatgcaagcaaagaaggatggaaaggctgtgattgttggaggtggttacatagggcttgagcttagtgcagccttgaaaatcaacaactttgatgtcactatggtgtaccctgaaccctggtgcatgccccgtctcttcacctctggcattgctcatttctatgagggctactatgctaacaaaggaatcaagattgtgaagggtacagttgctgttggtttcgatgctgatgccaatggagatgtcactgcagtgaagttgaaggatggaagagtactggaagctgacatcgttattgttggcgttggcggcaggccattgacggctctcttcaaaggccaagttgccgacgagaaaggtggactcaagaccgatgcattcttcgagacaagcgttcccggagtatacgccattggcgacgtggccaccttccccctgaagctctacaacgagcagcgtcgagtggagcatgtcgaccacgcccggaagtccgccgagcaggccgtccgggcgatcaaggcgaaggagtccggcgagtcggtgcccgagtacgactacctgccctacttctactcccggtcgttcgacgtggcgtggcagttctacggcgacaacgtcggcgacgacgtgctgttcggcgacaacgacccggcctcggccaagcccaagttcgggagctactgggtcaaggacggcaaggtcgtcggcgtgttcctcgagggtgggtcagccgaggagaaccaggccatcgccagggtcgccagggcccagccggcggtggctgacgtcgaggcgctcaagcaggaggggctcgagttcgctgccaaagtctgaagcaattcgacagatgttaacaaagaagcgtgccaatttgagcttatttcttggcaattctactttggacttttcagatcgctttgatgcttcatagtagttcaaatagttctgttagtgtgattgtgatgtcgagagtagaaccaccgtgttatgacccgaataatatagatgtgatttgtagcatctatgtgcatagtctatcgatcgggttgtgttttggtgaatatcttattcttatcgccatctttccaatgggcttttccttgtgtgaaagttgctgaaggttccgac

SEQ ID NO: 3354 - DNA, 1640 bp, Pennisetum glaucum
ctcccgacgcgagcccagcaggcagcactcgattcgctcgatcgcccatcgcctgcccctctcttcctctctctctccatcgccacgtaccggggcccggtaaagcatggcggcggaggcggaggcgaggcacttcaagtacgtcgtcctcggcggcggcgtcgcggcggggtacgcggccagggagttcgccaagcagggggtcaaacccggggagctcgccatcatctccaaggaaccggtggcaccgtatgagcgccctgcactcagcaagggatacctcttcccccagaatgccgcaagactgcctgggttccacacttgtgtgggcagtggcggagagaggctgcttcctgaatggtactcagagaaaggcattgagctgatccttagcactgagattgtgaaggctgaccttgcctcgaagactctgacaagtgcagctgaggaaatctttacatatgagatcttgctcattgctactggctcctcggtcataaagctcacagactttggcgttcaaggagcagagtccaacaacatattgtatctaagggatatcgccgatgctgacaaattggtggctgctatgcaagcaaagaaggatggaaaggctgtggttgttggaggtggttacatagggcttgagcttagtgcagccttgaaaatcaacaactttgatgtcactatggtgtaccctgaaccctggtgcatgccccgtctcttcacctctggcattgctcatttctatgagggctactatgctaacaaaggaatcaagattgtgaagggtacagttgctgttggtttcgatgctgatgccaatggagatgtcactgcagtgaagctgaaggatggaagagtactggaagcagacattgttattgtcggcgtcggcggcaggccattgacggctctcttcaaaggccaagttgctgatgagaaaggtggactcaagaccgatgcattcttcgagacgagcgttcccggagtgtacgccatcggcgatgtggccaccttccctctgaagctctacaacgagcagcggcgagtggagcatgtcgaccacgcccggaagtccgccgagcaggccgttcgggcgataaaggcgaaggagtccggcgagtcggtgcctgagtacgactacctgccctacttctactcccggtcgttcgacgtggcgtggcagttctacggcgacaacgtcggcgacgacgtgctgttcggtgacaacgacccggcctcggccaagcccaagttcgggagctactgggtcaaggacggcaaggtcgtcggagtgttcctcgagggcgggtcggccgaggagtaccaggccatcgccagggtcgccagagcccagccgccggtggtcaacgtcgaggcgctcaagcaggaggggctcgagttcgctgccaaagtctgaagccattcgacagatgtttaaaagaacagtgccaatttgagcttatttctgggcaaatctctactttggacttctcagatcgcttcggtgatttatattagttcgttcaaatagttctgttagtgtgattgtgatgtcgagagtagaacgacccgaataatatagatgtgatttgtagcatctactccgtatgtgcatagtctatatatgatcggat

SEQ ID NO: 3355 - DNA, 1668 bp, Hordeum vulgare
ctcccaccatccttgtttcctccttcctcctccgcgcccttgctcgcaatttcgtcctcatccgtcggtccatccattgagggaggagatggcgtccgagaagcacttcaagtacgtcatcctcggcggcggcgtcgcggcgggatacgccgcgagggagttcggaaagcagggcgtccagcccggggagctcgccatcatctccaaggagtccgtggctccctatgagcgtcctgcactcagcaagggctacctctttccccagaatgccgcgaggcttccaggattccacacctgcgtcgggagcggcggggagaagctcttgcccgaatggtacacacaaaaaggcattgagctgatcctcagcacggaaattgtcaaggctgatcttgcctctaagacattgaccagtgcagctggagcaaccttcacctatgagaccttgctcattgctactggctcctcgaccataaagctcactgactttggcgtccaaggagcagaatcaaacaacatattgtatctacgggaaattgatgacgccgacaagttggtcgcagctatgcaggcaaagaaggatggaaaggccgtcgttgttggaggtggctacataggacttgagctcagcgcagcactgaagatcaacaattttgatgtcaccatggtgtacccagagccgtggtgcatgccccgtctcttcactgccggcattgctcatttctatgagggttactacgctagcaaagggatcaatatcgtgaagggtactgtggctagtggttttgatgccgatgccaatggagatgttagtgtcgtgaagctgaaggatggaagagtactcgatgccgacatggtcatcgttggagtcggtggcaggccactgacaggcctcttcaaaggccaagttgatgaggagaaaggtggactcaagactgacgcattcttcgaaacaagcgtcgctggtgtatatgccatcggtgatgtggcgactttccccatgaagctgtacgacgagccgaggagagtggagcacgtcgaccatgctcggaaatcggccgagcaggcagtaaaggctatcaaggccaaggagtccggtgagtccgtggcggagtacgactacctgccctacttctactctaggtcgttcgacgtcgcgtggcagttctacggcgacaacgttggcgagacggtgctgttcggggacaacgacccagctgcggccaagcccaagttcggcacctactgggtcaaggacggcaaggtcatcggcgtgttcctagagggcggctccgccgacgagaatcaggccatcgccaaggtcgccagggcccagccgccggtggccgacgtggaggcgctcgccaaggaaggccttgatttcgccacaaagatctgaagattcctctattatctatctacgcgtgtaaatcttgtgtttgtccctcccctgccgatgcttcctagttcctagctcagaaacgtgattcgatttctttttttccttttggagtttgatggtgttgctgtgaccactgtggcaggatttcaataaatttagggccttttgattcgcaagaattttaaaacaaaggaatagggaatatgcagaaataggatggtatgtcctatagtatcctacagaattggaaagaatgtttgatagcacag

SEQ ID NO: 3356 - DNA, 1816 bp, Hordeum vulgare
ccaaccgtgggtcgtctacgtggacagggcccgcgccaaaagcagcggaaacgtacgcggaggtgagggaataaaaagcgagcgaacagccgcgttttcctcccaccatccttgtttcctccttcctcctccgcgcccttgctcgcaatttcgtcctcatccgtcggtccatccattgagggaggagatggcgtccgagaagcacttcaagtacgtcatcctcggcggcggcgtcgcggcgggatacgccgcgagggagttcggaaagcagggcgtccagcccggggagctcgccatcatctccaaggagtccgtggctccctatgagcgtcctgcactcagcaagggctacctctttccccagaatgccgcgaggcttccaggattccacacctgcgtcgggagcggcggggagaagctcttgcccgaatggtacacacaaaaaggcattgagctgatcctcagcacggaaattgtcaaggctgatcttgcctctaagacattgaccagtgcagctggagcaaccttcacctatgagaccttgctcattgctactggctcctcgaccataaagctcactgactttggcgtccaaggagcagaatcaaacaacatattgtatctacgggaaattgatgacgccgacaagttggtcgcagctatgcaggcaaagaaggatggaaaggccgtcgttgttggaggtggctacataggacttgagctcagcgcagcactgaagatcaacaattttgatgtcaccatggtgtacccagagccgtggtgcatgccccgtctcttcactgccggcattgctcatttctatgagggttactacgctagcaaagggatcaatatcgtgaagggtactgtggctagtggttttgatgccgatgccaatggagatgttagtgtcgtgaagctgaaggatggaagagtactcgatgccgacatggtcatcgttggagtcggtggcaggccactgacaggcctcttcaaaggccaagttgatgaggagaaaggtggactcaagactgacgcattcttcgaaacaagcgtcgctggtgtatatgccatcggtgatgtggcgactttccccatgaagctgtacgacgagccgaggagagtggagcacgtcgaccatgctcggaaatcggccgagcaggcagtaaaggctatcaaggccaaggagtccggtgagtccgtggcggagtacgactacctgccctacttctactctaggtcgttcgacgtcgcgtggcagttctacggcgacaacgttggcgagacggtgctgttcggggacaacgacccagctgcggccaagcccaagttcggcacctactgggtcaaggacggcaaggtcatcggcgtgttcctagagggcggctccgccgacgagaatcaggccatcgccaaggtcgccagggcccagccgccggtggccgacgtggaggcgctcgccaaggaaggccttgatttcgccacaaagatctgaagattcctctattatctatctacgcgtgtaaatcttgtgtttgtccctcccctgccgatgcttcctagttcctagctcagaaacgtgattcgatttctttttttccttttggagtttgatggtgttgctgtgaccactgtggcaggatttcaataaatttagggccttttgattcgcaagaattttaaaacaaaggaatagggaatatgcagaaataggatggtatgtcctatagtatcctacagaattggaaagaatgtttgatagcacagaaaaaacaacaaaattttagaaaaagtttttttcgtgagaatagaaaaa

SEQ ID NO: 3357 - DNA, 1529 bp, Secale cereale
caattcgctgctgcgctcgatccatcgaggagatggcgtcggagaagcacttcaagtacgtcatcctcggcggcggcgtcgcggcgggatacgccgcgagggagttcggcaagcagggcgtccagcccggggagctcgccatcgtctccaaggagtccgtggctccgtatgagcgtcctgcactcagcaagggctacctctttccccagaatgccgccaggcttccaggattccacacctgcgtcgggagcggcggggagaagctcttgccggaatggtacacggaaaaaggcattgagctgatcctgagcacggaaattgtcaaggctgatcttgcctccaagacattgaccagtgcagctggagcaaccttcacctatgagaccttgctcattgccactggctcctcaaccataaagctcactgattttggcgttcaaggagcagaatcaaacaacatattgtatctaagggaaattgatgatgccgacaagttggtcgcagctatgcaagcaaagaaggatggaaaggccgtcgttgttggaggtggctacataggacttgagctcagcgcagcactgaagatcaacaatttcgatgtcactatggtgtacccggagccgtggtgcatgccccgtctcttcactgccggcattgctcatttctacgagggttactacgctagcaaaggaatcaatatcgtgaagggtactgtggctagtggttttgatgctgaagccaatggagatgttagtgtggtgaagctgaaggatggaagagtactcgatgccgacattgtcatcgtcggagtaggtggcaggccgctgacaggcctcttcaaaggccaagttgaagaggagaagggtggactcaagactgacacattcttcgaaacaagcgtcgctggtgtatatgccattggtgatgtggcgactttccccatgaagctgtacaacgagccgaggagagtggagcacgtcgaccatgctcggaaatcagccgagcaggcagtaaaggccatcaaggccaaggagtccggcgagtccgtaacggagtacgactacctgccctacttctattcgaggtcgttcgacgtcgcgtggcagttctacggtgataacgttggcgagacggtgctgttcggggacaacgacccagcggcggccaagcccaagttcggcacctactgggtcaaggacggcaaggtcatcggtgtgttcctagagggcggctccgccgacgagaatcaggccatcgccaaggtcgccagggcccagccgccggtggccgacgtggaggcgctcggcaaggaaggcctagatttcgccaccaagatctgaagattcctctatctctatctatctatctacgcgtgtaaattttgtgtttgtccctcccctgccgatgctcactagttcctagctcagaagtgtgattcgatttttcattttggagtttgatggtgttgctgtgaccattatggcagaattcgaataaatttagtacggagtagcatctctggttctaca

SEQ ID NO: 3358 - DNA, 1526 bp, Triticum aestivum
attcgctgctgcgctccatccatcgatccgtcggggagatggcgtcggagaagcacttcaagtacgtcatcctcggcggcggagtcgctgcgggatacgccgcgagggagttcggcaagcagggcgtccagcccggggagctcgccatcatctccaaggagtccgtggctccgtatgagcgtcctgcgctcagcaagggctacctctttccccagaatgccgccaggcttccaggattccacacctgcgtcgggagcggcggggagaagctcttgcccgaatggtacacggaaaaaggcattgagctgatcctgagcacggaaattgtcaaggctgatcttgcctccaagacattgaccagtgcagctggagcaaccttcacctatgagaccttgctcatcgccactggctcctcgaccataaagctcactgactttggcgttcaaggagcggaatcaaacaacatattgtatctaagggaaattgatgacgccgacaagttggtcgcagctatgcaagcaaagaaggatgggaaggccgtcgttgttggaggtggctacataggacttgagctcagcgcagcactgaaaatcaacaatttcgatgtcactatggtgtacccagagccgtggtgcatgccccgtctcttcactgccggcattgctcatttctacgagggttactacgctagcaaaggaatcaatatcgtgaagggtactgtggctagtggttttgatgctgatgccaatggagatgttagtgtggtgaagctgaaggatggaagagtactcgatgccgacatcgtcatcgttggagtcggtggcaggccgctgacaggcctcttcaaaggccaagttgaagaggataagggtggactcaagactgacacattcttcgaaacaagcgtcgctggtgtatatgccatcggtgatgtggcgactttccccatgaagctgtacaacgagccgaggagagtggagcacgtcgaccatgctcggaaatcagccgagcaggcagtaaaggcgatcaaggccaaggagtccggcgagtccgtggcggagtacgactacctgccctacttctattcgaggtcgttcgatgtcgcgtggcagttctacggcgagaacgttggcgagacggtgctgttcggggacaacgacccagcggtggccaagcccaagttcggcacctactgggtcaaggacggcaaggtcatcggtgtgttcctagagggcggctccgccgacgagaatcaggccatcgccaaggtcgccagggcccagccgccggtggccgacgtggaggcgctcggcaaggaaggccttgatttcgccaccaagatctgaagattcctctatctgtcgacgcgtgttaatgttgtgtttgtccctcccctgccgatgcttcctatagttcctagctcagaagtgtgattcgatttttcattttggagtttgatggtgttgctgtgaccactatgacagaattcgaataaatttagtagcatctctggttctgcattcttt

SEQ ID NO: 3359 - DNA, 2202 bp, Sorghum bicolor
atgcttgacagaaagccgccgggatttctcaaaaaaaaaaacgaaaaaaaaaagaaggaaagccgccgggatgggatcatggaggtggttaggtaggttgtctgctcgtgcgcgctgccgccggctagctgatgacggatcacacgcaacgccgttcggcccctagggaccgcgccacgtggcggttgcgcctgcattagtgcgaaacgccagcggggaggaagcggccaatcggggaagcgaagggaacggaaggcagacaggataggtccctctctgcacccccgcccttttttttttccttctccccgcgaagcagggaaagggcgaggcaagcggcggcgtgtataaaaagtgagccaacgaacgcggtcttcgcctcgtcctccgatccgactccattccatttccgcttccccacccgtcgaggatcgtctcccgtcggtcggcgtccttcgcgatcgtctcgtctcgtttcgtttctcctcgcagccagcctgcctgcctgcttgtctgatcgtggggtgggggatggcgaagcacttcaagtacgtcatcctcggcggcggcgtcgcggcggggtacgcggcgagggagttcgccaagcagggcgtcaacccgggcgagctcgccatcatctccaaggaaccggtggccccatatgagcgccctgcacttagcaagggatacctcttccctcagaacgccgcaagactgccaggcttccacacgtgtgtaggcagcggtggagagaggctacttcctgaatggtactctgagaaaggcattgaactggtcctgagcactgagattgtgaaggctgaccttgcctcaaagactctgaccagtgcagctggggatacctttacatatgagaccttgctcattgctactggctcctcggtcataaagctcactgattttggtgttcaaggagcagaatccaacaacattttgtatctgagggatattgcagatgccgacaagttggttgcagctatgcaagcaaagaaagatggaaaggctgtgattgttggaggtggttacatagggcttgagcttagcgcagccttgaaaatcaacaactttgatgtaaccatggtgtaccctgaaccctggtgcatgccccgcctcttcactgctggtattgctcatttctatgagggctactacaccaacaaaggaatcaagattttgaagggcacggttgctgtcggtttcgatgctgatgccaacggagatgtcaccaaagtgaaattgaagaatggaagtgttctcgacgctgatattgttattgttggcgtcggcggcaggccattgacgggtctcttcaaacgccaagttgatgaggagaaaggtggactcaagaccgatgcattcttcgaaacaagtgttgccggagtatacgccatcggcgacgtggccaccttccctctgaagctctacaacgagcagaggagggtggagcacgtggaccacgcccggaaatcggcggagcaggccgtgagggcgatcaaggcgaaggagtccggcgagtcggtggccgagtacgactacttgccctacttctactcccggtcgttcgacgtggcgtggcagttctacggcgacaacgtcggcgacgacgtgctgttcggcgacaacgacccggcctcggccaagcccaagttcggcagctactgggtgaaggacggcaaggtcgtcggcgtgttcctcgagggcgggtcggccgaggagaaccaggccatcgccaaggtcgccagggtgcagccgccggtggccgacgtccaggcgctcaaggagcaggggatcgagttcgctgccaaaatctaagctcttggacaggtgtaaaaagagagagagagaatggtgtcaattttagctgatttcttggcaattttactttgagcttttgcttcgttgtactgtactgtaattcagaatagttgttagtctcctccctaataatttggccttctgatgtgaccaccgtgggatgacgatcctactaataataatgtacgtattatgtgatctgtagcgtctctgttcatagtctagtggaacactatgggatgtttttggagaatatttcattcttcttatgggatagttacgggttgctggagattccgacgacaggaggaatcatggccaccctgaaaagcaaccaaagcatctcgcaggggagagatgttgccg

SEQ ID NO: 3360 - DNA, 1706 bp, Triticum aestivum
ccacgcgtccgaccctgggtcggccacgcggacaggacacggcccgcgccaaaagcagcggaaacgtaagcggccaacggaggtgagggaataaaaagccatcgaacggtcgcgttttcctcccatcttcttctcctcctcccctctcctccgcccttccgtttcttcctcgcaattcgctgctgcgctgcatccatcgatctgtcggggagatggcgtcggagaagcacttcaagtacgtcatcctcggcggcggcgtcgcggcgggatacgccgcgagggagttcggcaagcagggcgtccagcccggggagctcgccatcatctccaaggagtccgtggctccgtatgagcgccctgcgctcagcaagggctacctctttccccagaatgccgccaggcttccaggattccacacctgcgtcgggggcggcggggagaagctcttgcccgaatggtacacggaaaaaggcattgagctgatcctgagcaccgaaattgtcaaggctgatcttgcctccaagacattgaccagtgcagctggagcaaccttcacctatgagaccttgctcattgccactggctcctcgaccataaagctcattgactttggcgttcaaggagcagaatcaaacaacatattgtatctaagggaaattgatgacgccgacaagttggtcgcagctatgcaagcaaagaaggatgggaaggccgtcgttgttggaggtggctacataggacttgagctcagcgcagcactgaagatcaacaatttcgatgtcactatggtgtacccagagccgtggtgcatgccccgtctcttcactgccggcattgctcatttctacgagggttactacgctagcaaaggaatcaatatcgtgaagggtactgtggccagtggttttgatgctgatgccaatggagatgttagtgtggtgaagctgaaggatggaagagtactggatgcggacattgtcatcgtcggagtcggtggcaggccgctgacaggcctcttcaaaggccaagttgaagaggagaagggtggactcaagactgacacattcttcgaaacaagcgtcgctggtgtatatgccatcggtgatgtggcgactttccccatgaagctgtacgacgagccgaggagagtggagcacgtcgaccatgctcggaaatcagccgagcaggcagtaaaggcgatcaaggccaaggagtccggcgagtccgtggcggagtacgactacctgccctacttctactcgaggtcgttcgacgtcgcgtggcagttctacggcgacaacgttggcgagacggtgctgttcggggacaacgacccagcggcgcctaagcccaagttcggcacctactgggtcaaggacggcaaggtcatcggtgtgttcctagagggtggctccgccgacgagaatcaggccatcgccaaggtcgccagggcccagccgccggtggccgacgtggaggcgctcggcaaggaaggccttgatttcgccaccaagatctgaagattcctcttatctattctacgcgtgtaaattttgtgtttgtccctcccctgccgatgcttcctagttcctagttcagaagtgtgattcgatttttcattggagtttgatggtgttgctgtgaccactatggcagaatccgaataaatttagtagcatctctggttctacattcttttaggttac

SEQ ID NO: 3361 - DNA, 3173 bp, Panicum virgatum
gttgcaggagaggaaattacttgtcttccttgtccacattttcgcaagcgctagtgatcacctggcctctttttgttctttataactgttcttgtttgttaatgcataaacaacacatctctaaccacaattcgtttggcggtggctccatacgagcgtcctgccctcagcaagggttacctcttccctcagaatgctgcaaggctcccaggattttatgtgtgtgtcggaagtggtggagagaggctattgcctgaatggtactcagagaaaggtattgagctgatcctcagcacagaaattgtcaaagctgacctttccaccaagactctgactagtgcagctggagcaacctttacatatgacgtcctgctcattgcaactggatcctcggtcatcaagctcactgattttggcacacaaggagctgattctaacaacattctatacctaagggaaattgatgatgctgacaagctggttgcagctatccaggcaaagaagggtgggaaggctgtggttgttgggggaggttatattgggcttgaacttagtgcagcactgaagctcaatgactatgatgtcactatggtgtttcctgaaccttggtgcatgccccggctcttcactgccgatattgctgctttctacgaggcttactatactaacaaaggggtaaagattttgaagggcacattagctgttggttttgatgccaatgccaatggtgatgtcaatgcagttaagctaaaggatggcacagtacttgaagctgatattgttgttgtcggtgttggaggcagaccattgactacactcttcaaaggtcaagctgctgaggagaaaggtggaatcaagactgatgctttcttcgaaacaagtgttcctggagtatatgctattggcgatgttgctaccttccccttgaagatgtacaatgagttgaggagagtagaacacgttgaccatgctaggaagtctgcagagcaggctgtaaaggcaatcaagggaaaggagtccggggaatcagttccagagtacgactacctgccgtacttctactcccgatctttcgacctggggtggcagttctacggcgacaacgtcggtgaaaccatcctgttcggcgatagtgaccccacctccagcaagcccaagttcgggtcgtactggatcaaggacggcaaggtcttgggcgccttcctggaaggtgggtcaccggacgagaacaaggccatcgccaaggtggcgaaaacccagccggccgtcgccagcgtcgaggagctcaagaaggagggcctccagttcgccagcaagatctgagaccgcttcctgcttcattgttccatgtacatctcgcgtcatcatttaggtgttcttgtgtttatggtcgcagtgttctacgacggatgttgccatgcgtacttgaaccacatgacattccgtttctgatcgtgatgtctgaactacacatacacgcacacttgctgtaccacttgagatttgaataaagctgttgtctgcagcctcagggttcaacgagcacagatagccctcttgttcttgtattctctcgccgctcgctcgcgcgcgtcctagcaggcactgaaatggccgccgccgctgctagcggctgtctcgttccacggctgacgcccgcggcgagatcgaggtgtcggtgccggccccggcggcgtctggcgccgcggtgcgtggcggcggacgggaggacgacgacgatgcagagcaaggccggggacgcgctggaggtgtgccgggtggtgaacggcatgtggcaggtgagcggcgcgtcgtggggccgcgcggagccggcggcggccgtggacgccatgctccggtacgccgacggcggcctcgccacgttcgacatggcggacatatcgcgcgccgtctcgccggcggccgcggcgccgcctcccctccctcgccgcctgaggcccgcgaggtgcacggccggcgccgcggcgacggagacggccaccgcggggccggcgagggtggcgaccgtcagcaacagcggggactccctggcgatatgccgggtgctcaacggcatgtggcagaccagcggagggtgggggcgcatcgaccgcgacgccgctgtcgaatccatgctcacgtacgccgacgccggactcaccaccttcgacatggccgaccactatgggccagcagaggatttgtatggcatgttcatcaatagagtcaggcgggagcgcccacctgagttgcttgaagaaatcaaggggcttacaaagtgggtgccgcctcccgttaagatgacaagaagttacgttgaggataatatcaatagatctaggaagaggatggatgttgctgcattggacatgttgcagttccactggtgggattacgcaaatcctggatatttggatgcactaaagcacatcacagacctgaaggaggaaggcaagataaagaccgtagctctgacaaacttcgatacagacagactgcaaataattctagaaaacggaatcccagttgttagcaaccaggttcaacattccatcgttgatatgcgccctcagcaaagaatggcagagctttgccagttaactggagttaaacttataacgtatggcacagtgatgggtggtcttttgtctgaaaagtttcttgacaccaacgtatcaataccttttgctgggcctcctctaaataccccatctttgcagaagtataagaggatggtcgatgcttggggtggctggagcttgttccagactttgctgcaaactttaaagaaggtatcattgaaacatggtgttcctatcgcaactgttgctgtgcgatacatactgaaccagacatctgttgcgggttccatggtaggtgtgagattgggactctccgagcacatcaaagacaccaacgccatattctcacttgaattggatgaagaggacatgaacagcatcaccgaggtatcgaagaagggaagaaatttgatggatattatcggggattgtggcgatgagtacagagcttagttcatgctgctgcttggttgatatacttgttgtgacggaaccgccaaattaaaactctaattaagcgtaatggccgtcatttgaacacattgggctcattatcttaacggcttaatttggcgatcctttcttaaccca

SEQ ID NO: 3362 - DNA, 2139 bp, Oryza sativa
gcccctctcgctgtttgacgaacaagagcgcgccgcgtgggcgccaaaattagttggtttggtgggggaaacgaacggagagagaggaaacgagacggaagcagcaaacctttccttcctccgatcgatcgagctaatgcctcgtcactccatcgtcggttcggtcgtataaaaagcaagcgagcgagagagccgggcctccgccgcgcgctttcctcccttgctcccaccaccacacctgtcctccttcccctccatcgtcgtctccctcctcttgtcccactccgactccgacatggcggccgcgaagcacttcacctacgtcatcctcggcggaggcgtcgccgcgggatacgctgcgcgggagttcgccaagcagggcgtcaagcccggggaactcgccatcatctccaaggaatcggtggctccctacgagcgtcctgctctcagcaagggatacctctttcctcagaatgcagccagacttccgggattccacacctgcgtcgggagcggcggagagaggctcttgcctgaatggtattccgagaaaggtatcgagctgatcctgagcaccgaaattgtcaaggctgatcttgcctccaagacattgaccagttcagctgatgcaacctttacctatgacactttgctcattgccactggctcctcggtcataaagctcactgactttggtgttcaaggagcagaggccaacgacatattgtacctgagggatattgaggacgctgacaagttggtcgcggctatgcaagccaagaaggatggaaaggctgtgattgtcggaggtggctacataggacttgagcttagcgcagccttgaagaccaacaattttgatgtcactatggtgtaccctgaaccttggtgcatgccccgtctcttcacttctggccttgctgctttctacgagggatactacgctaacaaaggaatccatatcataaagggaaccgtggctgttggttttgatgctgatgccaatggagatgttactgcggtgaagctaaagaatggaaacgtgctggaagctgacattgttattgtcggtgtcggtggcaggccactgactcatctcttcaagggtcaagttgcagaggagaagggtggaatcaagactgatgcattcttcgaaacgagcgttcctggtgtatacgccattgccgacgtggccgccttcccgatgaagctatacaatgagattaggagagtagagcatgttgaccatgctcgcaaatcagccgagcaggccgtgaaggcgatcaaggcgaaggaggccggcgagtcggtgccggagtacgactacctgccctacttctactcccggtcgttcgacctctcgtggcagttctacggcgacaacgtcggcgaggatgtgctgttcggcgacaacgaccccacggcggccaagcccaagttcggctcgtactggatcaaggacggcaaggtcgtcggcgtcttcctcgagggcggctcggcggaggagaatcaggtcattgccaaggtcgccagagctcagccgccggtggccgacgtcgaggctctcaagaaggaaggactcgacttcgctgccaaagtctgaacctctctatgcacacgcatttcattttgtggacgctgtgatgctgccatcttttcgattctgagcttcgtagtgattttgttagctccgatcctatatatggaggatttgttttgttctcattgtgaatttgtgatgtagtcactgtggcgaggtcccaataatgtctgtactctgtagcttctgtgattggttgttttctttttaaaaaaacctgtgtatcgtctgtgtttcttttttttttatcacggattaggctgttctttgctagttacttaagaagatttgacaaatgaaatcagaacagttttaggccatcttctttttagctactcaattagagcatgtttggtagggactctaactcttaaatttaacttcaagagccgtgtttggagtggagttgtggagcagtctaaatctagctccacctccctagttcatccagctccattctcatttttggtgaagctgaaactgtttggtcgggcttctgcttcagaatagtgtgagagctaaagctctatcaataaacc

SEQ ID NO: 3363 - DNA, 1545 bp, Panicum virgatum
ctctctctgtttcctctcccgaccgatcgacgacgtccgtccgtcgcctgcctgctgctgcttccccgtccggcggtttcattcgcgatcgttgcttctccgatccatcacgtattgacatggcggcggaggccaagcacttcaagtacgtcatcctcggcggcggcgtcgcggcggggtacgcggcgagggagttcggcaagcagggcgtcaaccccggcgacctcgccatcatctccaaggaacccgtggccccgtacgagcgccctgcactcagcaagggatacctcttccctcagaatgccgcaagactgcctgggttccacacgtgcgtggggagcggcggagagaggctacttcctgaatggtactcagagaaaggcattgagctgatcctgagtactgagattgtgaaggctgaccttgcctccaagaccctgacaagtgcagctggggcaaactttacatatgagaccttgctcattgctactggctcctcggtcataaagctcacggactttggcgttcagggagcagaatccaacaacatattgtatctaagggatattgccgatgcggacaagttggttgcagctatgcaagcaaagaaggatggaaaggttgtgattgttggaggtggttacatagggcttgagcttagtgcagccttgaaaatgaacaactttgatgtcactatggtgtaccctgaaccctggtgcatgccccgtctcttcacctccggtatcgctcatttctatgagggctactactctaacaaaggaatcaagattgtgaagggcacagttgctgctggcttcgaagctgatgccaatggagatgtcactgcagtgaagctgaaggatggaagagtactggaagctgacattgttgttgttggcgtcggcggcaggccattgacggctctcttcaagggtcaacttgccgaggagaaaggtggactcaagacggatgcattcttcgagacaagcgttcccggagtatacgccatcggcgacgtggccaccttccctctgaagctctacaacgagcagcggcgagtggagcacgtggaccacgcccggaagtcagcggagcaggccgtgcgggcgatcaaggccaaggagtccggcgagtcggtgcccgagtacgactacctgccctacttctactcccggtccttcgacatcgcgtggcagttctacggcgacaacgtcggcgacgacgtgctgttcggcgacaacgacccggcctcggccaaccacaagttcgggagctactgggtcaaggacggcaaggtcgtcggcgtgttcctcgagggcgggtcggccgaggagaaccaggccattgccagggtcgcaaggacccagccggcggtggccgacgtcgaggcgctcaagacggaggggctggagttcgccaccaaagtctgatcaagcaattcggcagatgtaacaaaaacaaaattagagactgccaatttgaggagcatatatgtttaatttcttggcaattctgctttgagcttttcacatcactcggtgcttc

SEQ ID NO: 3364 - DNA, 1668 bp, Triticum aestivum
gacaacccacgcgtccggccatgcgtccgcgactggggcacgaggacactgacctggggcaaaatgagtagaacaccttcctctgctcctccctctcctctgctcttccgtttcctcctcgcaatccatccatcgatccgtcggggagatggcgtccgagaagcacttcaagtacgtcatcctcggcggtggcgtcgcggcgggatacgccgcgagggagttcggcaagcagggcgtccagcccggggagctcgccatcatctccaaggaatccgtggctccgtatgagcgccctgcgctcagcaagggctacctctttccccagaatgccgccaggcttccaggattccacacctgcgtcgggagcggcggggagaagctcttgcccgaatggtacacggaaaaaggcattgagctgatcctgagcatggaaattgtcaaggctgatcttgcctccaagacattgaccagtgcagatggagcaaccttcacctatgagaccttgctcatcgccactggctcctcgaccataaagctcactgactttggcgttcaaggagcagaatcaaacaacatattgtatctaagggaaattgatgacgccgacaagttggtcgcagctatgcaagcaaagaaggatgggaaggccgtcgttgttggaggtggctacataggacttgagctcagcgcagcactgaaaatcaacaatttcgatgtcactatggtgtacccagagccgtggtgcatgccacgtctcttcactgccggcattgctcatttctacgagggttactacgctagcaaaggaatcaatatcgtgaagggtactgtggctagtggttttgatgctgatgccaatggagatgttagtgtggtgaagctgaaggatggaagagtactcgatgccgacatcgtcatcgttggagtcggtggcaggccgctgacaggcctcttcaaaggccaagttgaagaggagaagggtggactcaagaccgacacattcttcgaaacaagcgttgctggtgtatatgccatcggtgatgtggcgactttccccatgaaactgtacgacgagccgaggagagtggagcacgtcgaccatgctcggaaatcagccgagcaggcagtaaaggcgatcaaggccaaggagtccggcgagtctgtggcggagtacgactacctgccctacttctactccaggtcgttcgacgtcgcgtggcagttctacggcgacaacgttggcgagacggtgctgttcggggacaacgacccagcggcggccaagcccaagttcggcacctactgggtcaaggacggcaaggtcatcggtgtgttcctagagggcggctccgccgacgagaatcaggccatcgccaaggtcgccagggcccagccgccggtggacgacgtggaggcgctcggcaaggaaggccttgatttcgccaccaagatctgaagattcctctatctatcgacgcgtgtaaattttgtgtttgtccctccctgccgatgcttcctgctactccctccgttccaaattactcgtcgtagttcctagctcagaagtgtgattcgatttttcattttggagtttgatggtgttgctgtgaccactatggcagaattcgaataaatttgtttagtagcatctctggttctacattcttt

SEQ ID NO: 3365 - DNA, 1725 bp, Triticum aestivum
acactgtcatctgttaaaccaggcacagattaaccaccgactactctcgttcgcatggtctccacaccgtgccggtaggttcgtccatcagggcgatgccttttccggcaaactccttcctgatctggtccgacacgtcgaactgcttattgttcctcgcggcgatcctctgctcttccgtttcctcctcgcaatccatccatcgatccgtcggggagatggcgtccgagaagcacttcaagtacgtcatcctcggcggtggcgtcgcggcgggatacgccgcgagggagttcggcaagcagggcgtccagcccggggagctcgccatcatctccaaggaatccgtggctccgtatgagcgccctgcgctcagcaagggctacctctttccccagaatgccgccaggcttccaggattccacacctgcgtcgggagcggcggggagaagctcttgcccgaatggtacacggaaaaaggcattgagctgatcctgagcatggaaattgtcaaggctgatcttgcctccaagacattgaccagtgcagatggagcaaccttcacctatgagaccttgctcatcgccactggctcctcgaccataaagctcactgactttggcgttcaaggagcagaatcaaacaacatattgtatctaagggaaattgatgacgccgacaagttggtcgcagctatgcaagcaaagaaggatgggaaggccgtcgttgttggaggtggctacataggacttgagctcagcgcagcactgaaaatcaacaatttcgatgtcactatggtgtacccagagccgtggtgcatgccccgtctcttcactgccggcattgctcatttctacgagggttactacgctagcaaaggaatcaatatcgtgaagggtactgtggctagtggttttgatgctgatgccaatggagatgttagtgtggtgaagctgaaggatggaagagtactcgatgccgacatcgtcatcgttggagtcggtggcaggccgctgacaggcctcttcaaaggccaagttgaagaggagaagggtggactcaagactgacacattcttcgaaacaagcgttgctggtgtatatgccatcggtgatgtggcgactttccccatgaaactgtacgacgagccgaggagagtggagcacgtcgaccatgctcggaaatcagccgagcaggcagtaaaggcgatcaaggccaaggagtccggcgagtccgtggcggagtacgactacctgccctacttctactcgaggtcgttcgacgtcgcgtggcagttctacggcgacaacgttggcgagacggtgctgttcggggacaacgacccagcggcggccaagcccaagttcggcacctactgggtcaaggacggcaaggtcatcggtgtgttcctagagggcggctccgccgacgagaatcaggccatcgccaaggtcgccagggcccagccgccggtggacgacgtggaggcgctcggcaaggaaggccttgatttcgccaccaagatctgaagattcctctatctatcgacgcgtgtaaattttgtgtttgtccctccctgccgatgcttcctgctactccctccgttccaaattactcgtcgtagttcctagctcagaagtgtgattcgatttttcattttggagtttgatggtgttgctgtgaccactatggcagaattcgaataaatttagtagcatctctggttct

SEQ ID NO: 3366 - DNA, 1944 bp, Zea mays
gcaaagccgccgcccgccgggatggtgtcgtggaggtggttaggtaggccgtgtctgctcgtgcttgctgccgcggagcgtccgctggctagctggatgacggattacacgcaacgcgacgtcgtttggccggggaccgcgcaacgtggaaacagggcgaggcaggacgcctcacgcccgcattagcacgaaacgactagcgggaccaatcggggaagggagtgcgcggaaggccggccctgccttctttttttcccccgcgaagcagggcgaggcaggcagcgtgtataaactgagcgaacgtgagcggtcttcgccttgtcctccgactcttccattccattctattcccgcttccacacgtcggtcggcgcccttcgcgatcgtgtcgtttcttcccgcagcctgcctgcgtgtggggtgatggctaggcacttcaagtacgtcatcctcggcggcggtgtcgcggcggggtacgcggcgagggagttcgccaagcagggcgtcaaccccggcgagctcgccatcatctccaaggaaccagtggccccttatgagcgccctgcactcagcaagggatacctcttccctcagaacgctgcaagactgccaggcttccacacgtgtgtgggcagcggtggagagagactacttcctgaatggtactctgagaaaggcattgaactgatcctgagtactgagattgtgaaggccgaccttgcttcaaagactctgaccagtgcagctgcggaaaccttcacatatgagaccttgctcattgctacgggctcctcggtcataaagctcactgattttggtgttcaaggagcagaatccaacaacatattgtatctaagggacattgcggatgccgacaagttggttgcagctatgcaggcaaagaagggtggaaaggctgtgattgttggaggtggttacatagggcttgagcttagcgctgccttgaaaatcaacaacttcgatgtgaccatggtgtaccctgaaccgtggtgcatgccccgtctcttcactgctggtattgctcatttctatgagggctactatgctaacaaaggaatcaaggttgtaaagggcacggttgctgttggtttcgacgctgatgccaacggagatgtcactacagtgaagttgaagaatggaagtgttctcgaagctgatattgttattgttggcgtcggcggcaggccattgacgcgtctcttcataggccaagctgctgacgagaaaggtggactcaagaccgatgcattcttcgaaacaagtgtagccggggtatacgcgatcggcgacgtggccaccttccctctgaagctctacaacgagcagaggagagttgagcacgtggaccacgcccggaagtccgccgagcaggccgtgagggcaatcaaggccaaggagtccggcgaatcggtggccgaatacgactacctgccctacttctactcccggtcgttcgacttggcgtggcagttctacggcgacaacgtcggcgacgacgtgctgttcggcgacaacgacccggcctcggccaagcccaagttcggcagctactgggtgaaggacggcaaggtcgtcggcgtgtttctcgagggcgggtcggccgaggagaaccaggccatcgccagggtcgccagggcgcagccgccggtggccgacgtccaggcgctgaagcaggaggggatcgagttcgcttccaaaatctgagctcttggaaaggtgtaaaaaaaagaaacattggtaccagttttagctgatttctttggcaattctactttgagccttttcagaccacttgggtgctttgttacacagtagttcagattagttgttagcccctccctaataatttggccttcgatgtgatgttgaaagaaccaccgtgggatgacgatcctattaataatgcatgtgatttgtagcgtc

SEQ ID NO: 3367 - DNA, 2674 bp, Panicum virgatum
tcatgtatgccgcgaacctggacggattatgggcagctcattaaccatgtggctggcgtgtacccgttatcaatcatcaatcaagagatttaattaattcgtgggcgggtggctgcaaggcagtccaggtcgagagcctagctagctcgatgtgctgtgtatttctactgcaagtattggtctctccgactgtttgacaggagacggctggcgtcagctgtgacgtgtgagcgggtggggagtcaaagactggacgcgaccattcacaggccaaagcaaagccgccggcatggagggagtgacgggaagggtagggtaggtagcatggctgctcgtgcagtgccgccgccggctcatcaccgaacgttcggtcgtttcgtttgttcccacggacggccgtgggagcgccacgtggcacgcaccagaattagtcggaagatgcgttttccgggaagcagaggcagagcagacagcagagcaaatggcaacacggaaggcaaggcacctcccgtataaaaagtgggcgaccgaacacgcgcacttcccgtccggtcccctctctgtttcctctcccgaccgatcgacgacgtccgtccgtcgcctgcctgctgctgcctccccgtccggcggtttcgccatcgttgcttctccgatccatcacgtattgacatggcggcggaggccaggcacttcaagtacgtcgtcctcggcggcggcgtcgcggcggggtacgcggcgagggagttcggcaaccagggcgtcaaccccggcgacctcgccatcatctccaaggaacccgtggccccgtacgagcgccctgcactcagcaagggatacctcttccctcagaatgccgcaagactgcctgggttccacacgtgcgtggggagcggcggagagaggctacttcctgaatggtactcagagaaaggcattgagctgatcctgagtactgagattgtgaaggctgaccttgcctccaagaccctgacaagtgcagctggggcaaactttacatatgagaccttgctcattgctactggctcctcggtcataaagctcacggactttggcgttcagggagcagaatccaacaacatattgtatctaagggatattgccgatgcggacaagttggttgcagctatgcaagcaaagaaggatggaaaggttgtgattgttggaggtggttacatagggcttgagcttagtgcagccttgaaaatgaacaactttgatgtcactatggtgtaccctgaaccctggtgcatgccccgtctcttcacctccggtatcgctcatttctatgagggctactactctaacaaaggaatcaagattgtgaagggcacagttgctgctggcttcgaagctgatgccaatggagatgtcactgcagtgaagctgaaggatggaagagtactggaagctgacattgttgttgttggcgtcggcggcaggccactgacggctctcttcaagggtcaacttgccgaggagaaaggtggactcaagacggatgcattcttcgagacaagcgttcccggagtatacgccatcggcgacgtggccaccttccctctgaagatctacaacgagcagcggcgagtggagcacgtggaccacgcccggaagtcagcggagcaggccgtgcgggcgatcaaggccaaggagtccggcgagtcggtgcccgagtacgactacctgccctacttctactcccggtccttcgacatcgcgtggcagttctacggcgacaacgtcggcgacgacgtgctgttcggcgacaacgacccggcctcggccaaccacaagttcgggagctactgggtcaaggacggcaaggtcgtcggcgtgttcctcgagggcgggtcggccgaggagaaccaggccattgccagggtcgcaaggacccagccggcggtggccgacgtcgaggcgctcaagacggaggggctggagttcgccaccaaagtctgatcaagcaattcggcagatgtaacaaaaacaaaattagagactgccaatttgaggagcatatatgtttaatttcttggcaattctgctttgagcttttcacatcactcggtgcttcatagtagttcaaatatccctgaagcaattcataatagttgatagtctgcagcgcactaccaaataatctgggctactctgcactacacaattagtttgtagcatcggtcgggatgtgttttggtgaatatcttattcatatcgccatctttctgatgggctcagctgctggagattccgacaggagggatcatgcgcaccccctgagagcaaccagattagcacctgaggatgcctagctagatcttcctgccaggcatatccctgaatcgaagccacagctctgtccggtggattctgacaagatggagtgatcctttgtcggacgtctgacaaactgaatcaggtccaactactactgtcactttccatttcccatttcctaagtttttagctaggatctgcgcatctggcccaatctgcatatattgtgcagactgcagtcattgtctaatgttgtgtttggtttgggtgtccactgtccaatcctctagccaggcttgtataatgcaccatatataagcttgtttgtgaggaatgtgagtactctatcctgcctgtgatgaatgaattgttaacc

SEQ ID NO: 3368 - DNA, 1449 bp, Saccharum officinarum
ccgactcttcccatccattgcatttccgcttccacccggcgatcgtctcctccgtctgccgcgcgaggaccgtctccgtcggtcggcgtccttcgcgatcgtctcgtttcgtttcagcctgcttgcctgatcgtggggatggccaggcacttcaagtacgtcatcctcggcggcggcgtcgcggcggggtacgcggcgagggagttcgccaagcagggcgtcaacccgggcgagctcgccatcatctccaaggaaccggtggccccttatgagcgccctgcactcagcaagggatacctcttccctcagaacgccgcaagactgccaggcttccacacgtgtgtgggcagcggtggagagaggctacttcctgaatggtactcagagaaaggcattgaactgatcctgagtactgagattgtgaaggctgaccttgcctcaaagactctgaccagtgcatctggggatacctttacatatgagaccttgctcattgctactggctcctcggtcataaagctcactgactttggtgttcaaggagcagaatccaacaacattttgtatcttagggatattgcagatgccgacaagttggttgcagctatgcaagcaaagaaggatggaaaggctgtgattgttggaggtggttacataggccttgagcttagcgcagccttgaaaatcaacaactttgatgtgaccatggtgtaccctgaaccctggtgcatgccccgtctcttcactgctggtattgctcatttctatgagggctactacactaacaaaggaatcaagattgtgaagggcacggttgctgttggttttgacgctgatgccaatggagatgtcaccaaagtgaagttgaagaacggaagtgttcttgacgctgatattgttattgttggcgtcggcggcaggccattgacgggtctcttcaaaggccaagttgatgaggagaaaggtggactcaagaccgatgcattcttcgaaacaagtgttgccggagtatacgccatcggcgacgtggccaccttccctctgaagctcttcaacgagcagaggagggtggagcacgtggaccacgcccggaagtcggccgagcaggccgtgagggcgatcaaggcgaaggagtccggcgagtcggtggccgagtacgactacctgccctacttctactcccggtcgttcgacgtggcgtggcagttctacggcgacaacgtcggcgacgacgtgctgttcggcgacaacgacccggcctcggccaagcccaagttcggcagctactgggtgaaggacggcaaggtcgtcggcgtgttactcgagggcgggtcggccgaggagaaccaggccatcgccagggtcggcagggcgcagccgccggtggccgacgtccaggtgctcaaggaggaggggatcgagttcgctgccaaaatctgagctcttgga

SEQ ID NO: 3369 - DNA, 1707 bp, Musa acuminata
gtcaacagctagttcttcaccccttacagaaatcatggcggagaagcacttcaagtacgtgatcctcggcggcggcgtcgcagcgggatatgcggctagagagtttgcgaagcatggcctcaatccaggagaattggcaatcatatcaaaagaggcggtggctccttatgaacgaccagcacttagcaagggatacctcttccctcagggcgctgcaaggctcccaggctttcatgtttgtgtagggagtgggggagaaagactacttccagagtggtattcagaaaacggaatagaactgattctcagcactgaaatcgtaaaagcagatttggcttccaagactctaaccagtgcagctggtgcaaccttcacatatgatattctgattattgccactggttctactgttataaatctctctgattttggtactcctggagcaaatgctaacaacatattttatctaagggaaattgatgatgctgataagcttgtggcagcaatagagacaaagaagaatggaaaagttgtcattgttggaggaggatacattggtcttgaacttagtgctgttatgaaaatgaacaacttcgatgtcactatggtgtaccctgagccctggtgcatgcctaggctttttacttcagacattgctgctttctatgaaggttattatgcaaataagggagtaaaaatagataaagggacacttgttgttggatttgattctgatgccaatggagatgtaacatcagtgaagttgaaagatggaagagtacttgaagcagacattgtagtagttggtgttggtggtagaccccttacaaaactgttcaaagcccaagtcgaagaggagaaaggtggaatcaagactgactggttcttccaaacaagtgttcctggggtgtatgctgtgggtgacgtagctaccttccccatgaagctatacaacgatataaggagagtcgagcatgtcgatcatgccagaaaatcagcagagcaggctgtcaaggcaatcaaggcaagtgaggaaggtaaagtaatcgatgaatatgattatcttccttacttctattcccgctcttttgatctgtcatggcaattctatggagacaatgtgggagaaacagttatgttcggtgacaacgaccctgcatcagctaaaccaaaatttggctcctactggatcaaagatggaaagctgctgggggctttcctggaaggtggatcaccagatgagaccaagacaatagccaagttagcaaggctgcagccccaagtcacagacctcgaacaactggcaaaggaaggcctctcatttgcttccaagatttgagttgataaaattgttccatcggcttatagatggtctttgttaacctcagaaggtaactgatgtttccttcatgaggttgaatattaatgaactcgattggtctgacgtactcgattgcattacatttatgtatgaatgttatgaccatggcattagattttctttattcgtctgcagataattatgctacgttatgacaacataactggcaagacttaattattggattactcattaggactcgaccaaggtttgagcgtgagaagatcatatgggtcctgacctgaccataattcaggctcttccaaattgtcccaacatttcgtagaaaaccctctaacgattactcctcgatcatttaactgtac

SEQ ID NO: 3370 - DNA, 1515 bp, Manihot esculenta
aaaggaagcagaggagcaactcatcaaatggcggaaaaaaccttcaagtacgtgatcgtcggtggtggcgtcgccgctggatatgcagctagggaatttggcaagcagggggttaagccaggtgaattagccatcatctccaaggaggcggtggctccttatgaacgtcctgcacttagcaaggcatatcttttccctgaaggaactgcaaggcttccaggattccatgtctgtgttggaagtggaggggagaggctagctcccgaatggtacaaagagaaagggatagagttgatccttagcacagaaatagtcgaagcagatcttgctaccaagactctcacaagtgcagctggggaagccttcaagtatcagattttgattattgctacaggttccactgttgtaaaattgtcagattttggcgtccagggagctgatgccaagaatatcttctacttgagggaaattgatgatgctgataagcttgtggaaggaattaaagcaaaaaagaatggaaaggctgtagttgttggagggggatacattggtcttgaacttagtgcagcactgagaattaacaatattgatgtcagcatggtttatcctgagccatggtgcatgcctcgcctttttactgctgatatagctgctttctatgagggttattatgctaataagggagtcaaaattatcaagggaacattcgcggttgggtttaatgctgattccaatggggaggtaaaggaggtgaaacttaaggatggtagggtgttggaagctgatattgttgttgtgggtgttggtgcaattccacttacaaccttattcaaaggacaggttgcagaggacaagggtggaataaagactgatgcatttttccgaacaagtgttcctgacgtttatgcagttggtgatgtcgctactttccctttgaaattgtacaacgagcttagaagagttgaacacgttgaccatgcacgcaaatcagctgagcaggctgtaaaggccattaaatcaagcgaggagggggaaacaattgatgagtatgactaccttccgtacttctactctcgcgcctttgatctctcctggcaattttacggtgacaacgttggtgacactgtgctttttagggacagtgatcaaaaatcaccaaaacccaagtttggatcatactggatcaaagatggaaaggttgttggagcttttcttgaaggtggaagtcctgatgaaaacaaggctattgctaaagttgccagagtccaaccgtctgttcagaatttggatctgctgacaaaggaaggtctttcctttgcttgtaagatttaatgtattttcttatgcatttaatttctgtcaatcctttgacacagcttcgcctgttttatattagaaaatacttcgtattgttgcataaattgtgaggttaaatttgaggacactctgagcattgcagttgtcatctgctttggtggtgatgttgagaacgtgcttgtgcttgtccttgtttag

SEQ ID NO: 3371 - DNA, 1480 bp, Curcuma longa
gatcgctcgggcggagagagagctgagggaagtcgggagactccttctgttgcgagtgttttgctgatttcgataggagacatccagcatggcggagaagcacttcaagtacgtcatcctcggcggcggcgttgctgcgggatacgctgctagagaatttgcaaagcatagcctcaatccaggagaattagcaatcatctcaaaggaggcggtggctccttatgaacgcccagcacttagtaaggcgtatctcttccctcagggtgctgcaaggctcccaggttttcacgtttgcgttggaagtggaggagagagactacttccggaatggtacttggaaaagggaatagagctgatcctcagcactgaaattgtaaaagcagaccttgcttccaagactttgaccagtgcagctggtgcaaccttcacattcgacattttgattgtagccactggatctactgtcataaatctctctgattttggtactcctggagctgatgctaacaatatattgtatctgagggaaattgatgatgctgacaagcttgtggcaaccatccaagcaaagaagaacgggaaggctgtcattgttggaggtggatacattgggcttgaacttagtgccgttatgaagattaacaacttcgatgtcactatggtgtatcctgaaccctggtgcatgccgaggctatttactccagatatcgctgctttctacgaaggttattacgcaaacaagggagtcaaaatagacaagggcacactagtcgtcggatttgattctgacaccaacggggatgtaacatcagtcaagttgaaggatggaagagtgcttgatgcggatattgtaatagttggtgttggtggacggcctctaacaaaactgttcaaaggccaagttgaagaagagaagggaggaattaagactgatgctttctttcaaacaagtgttgctggggtgtatgctgtaggcgacgtagctactttccctttaaaactatacaacgaaacgcgaagagtggagcatgttgatcatgccaggaaatcagcagagcaggctgtgaaggcaatcaaggcaagtgaggaaggtaaagtaattgacgaatacgattatctcccttacttctactcccgctcgttcgatctatcatggcaattctatggagacaatgtgggagaaactgtcatatttggcgacaatgaccctgcatcatcaaaaccaaagttcgggtcttactggatcaaggagggggagttactgggggctttcttggaaggtggatctcctgaaggggctaaggccattgccgagttggcaaggcttcaacctgcagttccagacctcgagcaactggcaaaggaaggtctctcattcgcttcgaagatttgatggtgagaaagttgttcctgtctttatgtcagaattaggcaacttgtggacctattcttaagttttcttatgaaaaaccactggtgc

SEQ ID NO: 3372 - DNA, 1665 bp, Avena sativa
ccgctctccttccgtttcttcctcgctccttcattcattcattcgttcgtccaccggcaccggctgctgcttttgagatcgcagagatggcggccgagaagcacttcaagtacgtcatcctcggcggcggcgtcgcggcgggatacgcggcgaaggagttcgccaaccagggcgtccagcccggggagctcgccatcatctccaaggaatccgtggctccgtacgagcgcccggcgctcagcaagggctacctctttccccagaatgccgcgaggcttccagggttccacacctgcgtcgggagcggcggggagaagctcttgccggagtggtacacagagaaaggcattgagctgatcctgagcacggatattgtcaaggctgatcttgcctccaagacattgaccagtgcagctggagcaacctttacctatgacaccttgctcattgccactggctcctcgaccataaagctcactgacttcggtgtcgaaggagcagaagcaaacaacatattgtatctaagggatatcgaggatgctgacaagttggtcgcagctatgcaagcgaagaaggatgggaaggccgtcgttgtcggaggtggctacatagggcttgagctcagcgctgcactgaagatcaacaatttcgatgtcactatgatatacccagagccgtggtgcatgccccgtctctttactgccggcattgctcatttctatgagggctactacgctagcaaaggaatcaacattgtgaagggtacctatgcaagtggttttgatgctgacgccaatggagatgtttctaaagtcaagctgaaggatggaagagtgctcgatgctgacatcgtcatcgtcggagtaggtggcaggccaatgacaggcctcttcaaaggccaagttgaggaggagaaaggtggactcaagactgacacattcttcgaaacgagcgtggccggtgtgtacgccattggtgatgtggccagcttccccatgaagctctacaacgagccaaggagagtggagcacgtcgaccatgcccggaaatcagccgagcaggccgttaaggcgatcaagggcaaggagtccggcgagacggtggcggagtacgattacctgccctacttctactccagatcgttcgacatcgcgtggcagttctacggcgacaacgtcggcgagtcggtcctgttcggggacaacgacccggcggcggccaaggccaagttcggcacgtactgggtcaaggacggcaaggtcctcggcgtgttcctcgagggcgggtcggccgacgagtaccaggccatcgccaaggtcgccagggcacagccgccggtggccgacctggaggcgctcggcaaagaagggctcgacttcgccgccagatatgaagatatgaagatttgtacattttgtgtttgtgtctacgtttcctagttcttcgctcagcagtgagattttattttttggaacttgatgttgtgagtaatgacaccacttaggcttgattcgaataatgtttttagcatcagtttgattagtcttcttatcgcatccatgtacaaccgcttctacatacgaaggcgcacgcaatacaaaactacccacggagggacaaataaatgtggaactagcgtgcgcggatctaataaaaaccggaaac

SEQ ID NO: 3373 - DNA, 1471 bp, Musa acuminata
taatatactaagttctccttttgcccgttctgcttctacgtatatataggtatatacgcgatcgagctctttcgtccctaattcttctcggataccaattcgctacgcgatcgagttcctccaatcgatccatggcggagaagcacttcaaatacgtgatcctcggcggcggcgttgcagcgggatatgcagctagggagtttgtgaagcttggcctcaacccaggagagctagcaatcatttccaaagagtcggtggctccttatgaacggccagcgctcagcaaaggctaccttttccctcaaggtgctgcaagattaccagggtttcatgtctgtgttggcagtggcggagaaagactgcttccagaatggtatgctgagaaaggcattgagcttatacttggtacggaaattgtaaaagctgatctagcatccaagactcttacaagtgcagctgatgtgatcattaagtacgatattttgatcattgctactggctccacagttataagactttcagactttggcgtccaaggtgcagatgcaaataacatattttacttgcgggagattgatgatgctgataaacttgttgctgcaattcatgcaaagaaagatggaaaggctgtaattgttggaggagggtacattggtcttgagcttggtgcagcactcaaaatcaataatttagatgtcaccatggtgtaccctgagccttggtgcatgccacgtctatttactgcaggaattgctgctttttatgagggttattatgcaaataaagggatcaaaataatcaaagggactgtagcagttggatttgattctgatgcaaatggagatgtaaccgctgtaaggttgaaggatggaagagtcttggaggctgatattgttgttgtcggtgttggtggcagaccacttattacactatttaaaggtcaggtagaagaggaaaaaggtggaattaagactgatggtttcttcaagacaagcattcctgatgtctatgctgtgggagatgtcgctacattccctttaaagctctacaacgaacaaaggagagtcgaacatgtcgatcatgcaagaaaatctgctgagcaagctgtcaaggcaatcaaggcggtagaagaaggcgaatcgatagaggaatacgactaccttccctacttctactcacgctcatttgacttgtcatggcaattctatggagacaatgtcggggacacaatcctctttggagacaatgatcctacctctgcaaaaccaaagtttggtacttactggatcaaggaggggaaggtggtaggcgtgttcctcgaatctggatctcttgaggagaacaaattgatagccaaggtagctaagctccagccaccagtgcaggaccctgaacagctggagaaggaaggtcttgcatttgccagtaaaatctaattatcaagctcaaagatgtgtaaattttctggtat

SEQ ID NO: 3374 - DNA, 1565 bp, Humulus lupulus
gaaaaatcgcattctcatctcggaaaaataaagagagaaaaagtcacagagcacagagcgaagatatcgtctttttgatctcgatttgtctttaatggcagaaaagagcttcaagtatgtaatcgtcggaggtggagtctcggctggatatgcagctagagagttcgccaaacaaggggttaagccaggcgagctagctattatctccaaagaagcggttgctccttatgagcgtcctgctctgagcaaggcttatttgttccccgagtctccggcaagacttccgggtttccatgtgtgtgttggaagtggaggagaaagattgcttcctgagtggtacaaggagaaaggtatagaattgatccttagtaccgaaatagttaaagcagatcttgctgggaaaactcttgtaagcgcagctggggaaacattcaagtatcagattcttgtaattgcaactggttctacagttattaaattgtcagattttggagttcaaggagctgatgccaaaaatattttctacttaagagaaattgatgatgctgataagcttgtagaagcaataaaaacaaaaaagaatggtacagcagttattgttggaggaggatacattggtcttgagcttggtgctgctttgagaattaataatctagatgtcactatggtttaccctgaaccttggtgcatgcctcggcttttcactgctgatatagctgctttctatgagggttattatgcaaataaaggggttaaaattatcaagggaactgttgcaactggtttcagttcgaatgcaaatggagaggtgacagaagtgaaactcaaggatggtagagttctcgaagccgacattgttgttgttggtgttggcggaaggccccttacaacattattcaagggacaagttgaagaggagaaaggtggcattaagactgatgcttttttcaagtcaagtgttcctgatgtgtatgctgtgggagatgtagctactttccctcttaaattgtacaatgagaataggagagttgagcacgtcgaccattctcgcaaatcagctgaacaagccgtaaaggccatcaaggctagtgaggagggaaaatccgttgaggagtatgactaccttccatacttctactctcgatcatttgatctggcatggcagttctatggcgacaatgtcggtgaaactgtacttttcggagacaacaatcctgaattgccaaaggccaagtttggtacatactggattaaggatggcaaggtcattggtgcattccttgaaggtggcaatcccgaggagaatagcgctattgccaaggtggccaagcttcaaccccctgtcgagagcctagaccagcttaaaaaggaaggccttacctttgctagcaagatctgagaaattcttttctttgggtggaagagttaaatgggattggctttgagtttaactacttggtcttctagattgtttttattctcgtgtatttggttttcacagattatattaatttcttactatgaagattatattttgttgaaatgtagtaaattactaaattgtt

SEQ ID NO: 3375 - DNA, 2004 bp, Gossypium hirsutum
tcatgccacgtggctgaatcacgtatacttctaaagatcagccaatgagaagggcagcctagccctttcctataaattaatctgaccaacccactttcacgaacctaatttacaaaaacttgtttaattaccaaaaggttaagagcaaaagacagggcagagtaagctaagctttgatcatcaatggcggagaagagtttcaagtacgtgatccttggcggtggtgtagctgctggatatgcagcgagagagtttgccaagcagggagtgcagcctggtgagctagcaattatttccaaggaggcggtggctccatatgaacgacctgccctgagcaaagcatatctcttccctgagggagctgctagacttcctggtttccatgtctgtgttggaagtggcggagagagattgcttcctgagtggtacaaggaaaaaggaattgaattgatccttagcacagaaatagtgaaagcagatcttcctgccaatactctagtaagtgccgctggagaaacattcaagtatcaaatcttgatcattgcaactggttcaacggttataaaattgacagattttggagtgcaaggagctgatgctaaaaacatcttctacttgagagaaattgatgatgctgataagttggtagaagcaatcaaagcaaagaagaatggaaaggctgttatcgttggtggaggttatattggtcttgagcttggtgcagccttgaaaattaacaatcttgatgtcagcatggtgtacccggaaccatggtgcatgccccggcttttcacctctggcatagctgctttttatgagggttattatgctaataaagggatcaaaattataaagggaacagttgcagttggattcacctctgactccaatggagaggtgaaggaagttcaacttaaggatggcagagttctggaagctgacattgttgtggttggtgttggtggaaggcctcttacagcactatttaaagggcaggttgaagaggagacgggcggaataaagactgatgcttttttcaaaacaagtgttcccacagtatatgctgtgggtgatgtggccactttccctctgaagttatacaatgagttgagaagggttgaacatgttgaccatgcccggaaatctgccgaacaggctgtaaaggccatcaaggggcttgagaaggggcaatcagtcgacgaatatgactacttaccgtacttctattcccgttcctttgacctagcatggcaattctatggcgacaatgttggggatactgtgctttttggagacaacaacccacaatcaccgaagccaaagttcggatcttattggatcaaagatggcaaggtggtaggggcattcctagaaggtggtagtgccgaagaaaaccaggcaattgctaaagttgctaagcttcagcctaaagctgagaatttggatgcgctggcaaaagaaggacttccctttgcctgtaagatatgaagagtagtaacagctgccatgccttacaaaaagggaagaactctgttgcaagaggactgcgtaagggaagggttggatctgtgtttttactttgggttgtgctgttatttctctttgcatttagtacatagattctggagtttgctttgtttatcttgcttttcttttgaatgatgaataataacaaacaatattccactgtatgttgtgcagtacgaaaaataaacccttaagctaagacccttgtactggaagatgtcgagagagttgatatctgattgaagatcaacagggtcattacttattagtaagttgggcgtgtttctaggtcctttctatgttgcaatctttaattgtgtcttgcttgttttgattttgtcatgagattaaatcagtaatggttcaattttgttgtgtttttctatctggattctttattaaagaattgtggatgagttgaggacttgtctatttatgtgctgcttgcttgtgaattaatgtttcataatatgatag

SEQ ID NO: 3376 - DNA, 1859 bp, Elaeis guineensis
gaaaaatatggtaactagagggtcgccgtgatctggtccaggtcattttttggaaggctatcgtggccagcgagtcatcatcggagaatgacggcccagcatgcgccgcgtggagctcgaaggtttacgacttccgtgtgcgcgcccccgaccatcctccagccaatggcgaacgcccttttcaccctctcccataaataatcccacctggcttcccacccaccgcctccctcgctcctccttccattccatccatctatacatctggatagagatcttcttgggcctctcatctaccaaatcgatcgatccatggcggcgaagcacttcaagtacttaattcttggcggtggtgtcgcagcgggttatgcggctagggagtttgcaaagcaaggagtcaagccaggagagctggcagtcatatcaaaggaggcggtggctccttatgagcgtccagcacttagcaaggcttacctttttcctcaaggtactgcaaggctcccaggctttcatgtatgtgttggaagcgggggagaaagactacttcctgaatggtatacagaaaaaggcatagagctgatactcagcacggaaattgtgaaagcagatgttgcttcaaagactctgacaagcgcttctggtgcagcattcacttatgatattttgatcattgctactggttccactgttataaggctctctgactttggtgttcaaggagcagatgccaataatatattttatctgagggagattgatgatgctgataagctggtggcggcaatacaagcaaagaagaatggaaaggctgtgatcgtgggaggaggatacattggtcttgaacttggtgctgcattgaggattaacaatttggatgtcacaatggtgtaccctgaaccatggtgcatgcctcgccttttcacatcaggtattgctgctttctatgagggttattatgcaattaagggaatcaaaattattaagggcacagtagctgttggatttgactctaatgcgaatggcgatgtaacagcagtgaagttgaaggatgggagagtgcttgatgctgatattgtggttgttggtgttggtggaaggcctctcgcagcactttttaagggccaagttgttgaggagaaaggtggaatcaagactgatggattctttagaacaagtgttcctggggtatatgctgtgggagatgtagcaaccttccccttgaaactgtactatgaaatgaggagagtggagcatgttgatcatgccagaaaatcagcagaacaagctgttaaggcaatcaaggcaagtgaagaaggaaaagacattgaggaatatgactaccttccatatttctattctcgtgccttcgatttgtcttggcaattctatggagacaatgttggagataccgttctctttggtgacaataatcctgcatcagctaagccgaagttcggttcttactggatcaaagatgggaaagtggttggagcctttctggaaggcggatctgcagaggaaaacaaggccatagccaaggtagcaaaggttcagccaccagcaggagatcttgaacaactgacaaaggagggtcttacatttgcatgtaagatctaatcccacagttgagcaggagattgggcagtcagtatgatcggcaattgcattttcttttcagatagattgtcatcttgattgtggttgagatagtctatacttaaaataacaatgatgccgtgtctctggtggaccttcagttaaaccgattcccaaataattttgtatgtatcaacctttctcaatctatttttatcgactttctaagtgatagcagtttctccatgtttgaatggagtgcg

SEQ ID NO: 3377 - DNA, 1885 bp, Brachypodium distachyon
ttcctcccaccttcttctcctcttccattcctccctccctccctcccttccacgttcttcctccttcccttccttctcgcgaatcaattcatcatcttccgggaggcccgtccatccaccggagccggagaccatggcgtccgagaagcacttcaagtacctcgtcctcggcggcggcgtcgcggcggggtacgcggcgcgggagttcgccaagcacggcctgcagccaggggagctcgccatcatctccaaggaatccgtggctccgtacgagcgcccagccctcagcaaaggctacctcgccccccagaacgcggcgaggctcccgggattccacacctgcgtcgggagcggcggggagaagctcttgccggaatggtacgcggacaaaggcattgagctgatcctcagcactgaaatcgtcaaggccgatcttgccaccaagacattgaccagtgcagatggagcaaccttcatatgcgagatcttgctcattgccaccggctcctcgaccataaagctcactgactttggcgtccaaggagcagaatcgaacaacatattgtacctaagggacatcgaggatgccgacaagttggtcgcagctatgcaggcaaagaaggacgggaaggccgtcgtcgtcgggggtggctacatagggcttgagctcggcgcggcgctcaagaccaacaactttgatgtcactatggtgtacccagaaccgtggtgcatgccccggctcttcaccgccggcattgctcatttctacgagggctactacgcgagcaaaggaatcaacattgtgaagggtaccgtggccagtggatttgatgctgatgccaatggagatgttagtaaagtgaaccttaaggatgggagagtactcgacgcggacatcgtcatcgttggcgttggcggcaggccattgacagggctcttcaaaggccaagtcgaggaggagaaaggtggactcaagacggacacattcttcgagacaagcgtggccggtgtgtacgccatcggcgacgtggccaccttccccatgaagctctacaacgagccgaggagagtggagcacgtggaccacgcccggaagtcggcggagcaggcggtgaaggcgatcaaggcgaaggagaccggcgagaccgcggcggagtacgactacctgccctacttctactcccggtcattcgaggtggcgtggcagttctatggcgacaacgttggtgagacggtgctgttcggcgacaacgacccggcgacggagaaggccaagttcggcacttactgggtcaaggacggcaaggtcatcggcgtgttcctggagggcggctcggccgaggagaaccaggccatcgccaaggtcgccagggcccagccgccggcggccgacctcgaggcgctctccaaggaggggctggacttcgcctccaagatctgaactgcgaattagctttgtgtgtttgatctggtgtactactttattaggctcgtgagtctttctatatgtatagttcttgctagatcatatgagtattttgattttctgaatctgccgttgcgtggaagtaataacaacaccattggtgttgcctgtgatataatgttcatagtaacatctgatcgtgcatgtcgaatcctatcctttatagttagccttagcccaatgtttgcaacacatgaatatcatcgtggaatgcacacccatgctgcatggaatttcaaatccagcatttcaaaccgtggaccgccaaatcgccagcggatgaaacatcactgtctttgcttttggctcaataagaatctcttttctctctctccgcagtccctccctctctccctcttgtttatgcttgtaatatacattaatatatttttgcaaata

SEQ ID NO: 3378 - DNA, 1537 bp, Gossypium hirsutum
gttaagagcaaaagaaagagcagagtaagctaagctttgatcatcaatggcggagaagagtttcaagtacgtgatccttggcggtggtgtagctgctggatatgcggcgagagagtttgccaagcagggagtgcatcctggtgagctagcaattatttccaaggaggcggtggctccatatgaacgacctgccctgagcaaagcatatctcttccctgagggagctgcaagacttcctggtttccatgtctgtgttggaagtggcggagagagattgcttcctgagtggtacaaggaaaaaggaattgaattgatccttagcacagaaatagtgaaagcagatcttcctgccaatactctagtaagcgccactggagaaacattcaagtatcaaatcttgatcattgcaactggttcaacggttatcaaattgacagattttggagtgcaaggagctgatgctaaaaacatcttctatttgagagaaattgatgatgctgataagttggtagaagcaatcaaagcaaagaagaatggaaaggctgttatcgttggtggaggttatattggtcttgagcttggtgcagccttgaaaattaacaatcttgatgtcagcatggtgtacccggaaccatggtgcatgccccggcttttcacctctggcatagctgctttttatgagggttattatgctaataaagggatcaaaattataaaggggacagttgcggttggattcacctctaactccaatggagaggtgaaggaagttcaacttaaggatggcagagttctggaagctgacattgttgtggttggtgttggtggaaggcctcttacagcactatttaaagggcaggttgaagaggagaagggcggaataaagactgatgcttttttcaaaacaagtgttcccacggtatatgctgtgggtgatgtagccactttccctctgaagttatacaatgagttgagaagggttgaacatgttgaccatgcccggaaatctgccgaacaggctgtaaaggccatcaaggggctcgagaaggggcaatcagtcgacgaatatgactacttaccgtacttctattcccgttcctttgacctagcatggcaattctatggtgacaatgttggggatacagtgctttttggagacaacaacccacaatcaccgaagccaaagttcggatcttattggatcaaagatggcaaggtggtaggggcattcctagaaggtggtagtgccgaagaaaaccaggcaattgctaaagttgctaagcttcagcctaaagctgagaatttggatgcgctgacaaaagaaggtcttgcctttgcctgtaagatatgaagagtagtaacagctgccatgccttacaaaaaaggaagaacactgttgcaagaggactgcgtaggggaagggttggatctgtgttttttcattgggttgttatttctctttgcatttagtacatagattctggagtttgctttgtttatcttgcttttcttttgaatgatgaataataacaaacaa

SEQ ID NO: 3379 - DNA, 2102 bp, Gossypium raimondii
ttgaatttaaacatttactagttttgtagaattaagttttttttaccatttatttaagattcataattttcaaaatttggaaaaaaatagtagggattcatagtgtagagatgcccatcgattggattgagatgaagttggattttaaaatatttctaagtttaagctcgtttttgggtaaaatcgcccaaaaatacttgttttactatttaaaagttgataaaatattaaaaatattttttaattctttaaattgaactagaatggggttagtcaggtctgcggtagtggtggaagaagcattgccagcagtgacgaacggcagcgttcatgccacgtggctgaatcacgtttacttctaaagatcagccaatgagaagggcagcctagccctttcctataaattaatctgaccgaacctaatttacaaaaacttgtttaattaccaaaaagttaagagcaaaagaaagagcagagtaagctaagctttgatcatcaatggcggagaagagtttcaagtacgtgatccttggcggtggtgtagctgctggatatgcggcgagagagtttgccaagcagggagtgcatcctggtgagctagcaattatttccaaggaggcggtggctccatatgaacgacctgccctgagcaaagcatatctcttccctgagggagctgcaagacttcctggtttccatgtctgtgttggaagtggcggagagagattgcttcctgagtggtacaaggaaaaaggaattgaattgatccttagcacagaaatagtgaaagcagatcttcctgccaatactctagtaagcgccactggagaaacattcaagtatcaaatcttgatcattgcaactggttcaacggttataaaattgacagattttggagtgcaaggagctgatgctaaaaacatcttctacttgagagaaattgatgatgctgataagttggtagaagcaatcaaagcaaagaagaatggaaaggctgttatcgttggtggaggttatattggtcttgagcttggtgcagccttgaaaattaacaatcttgatgtcagcatggtgtacccggaaccatggtgcatgccccggcttttcacctctggcatagctgctttttatgagggttattatgctaataaagggatcaaaattataaagggaacagttgcggttggattcacctctgactccaatggagaggtgaaggaagttcaacttaaggatggcagagttctggaagctgacattgttgtggttggtgttggtggaaggcctcttacagcactatttaaagggcaggttgaagaggagacgggcggaataaagactgatgcttttttcaaaacaagtgttcccacagtatatgctgtgggtgatgtggccactttccctctgaagttatacaatgagttgagaagggttgaacatgttgaccatgcccggaaatctgccgaacaggctgtaaaggccatcaaggggcttgagaaggggcaatcagtcgacgaatatgactacttaccgtacttctattcccgttcctttgacctagcatggcaattctatggcgacaatgttggggatacagtgctttttggagacaacaacccacaatcaccgaagccaaagttcggatcttattggatcaaagatggcaaggtggtaggggcattcctagaaggtggtagtgccgaagaaaaccaggcaattgctaaagttgctaagcttcagcctaaagctgagaatttggatgcgctggcaaaagaaggacttgcctttgcctgtaagatatgaagagtagtaacagctgccatgccttacaaaaagggaagaacactgttgcaagaggactgcgtaggggaagggttggatctgtgtttttactttgggttgtgctgttatttctctttgcatttagtacatagattctggagtttgctttgtttatcttgcttttcttttgaatgatgaataataacaaacaatattccactgtatgttgtgcagtacgaaaaataaaccttaaacctatgatcttgctggtactgaaatcaaccaattattccatccaatattagattagattattagaa

SEQ ID NO: 3380 - DNA, 1971 bp, Cannabis sativa
atgttcaaatttagacaagatggttgacgtggccattgcctaatcagaatgatgaacggtgtagaataagacacgtggacaattcctttttcgttgatctctccagtcggaccaattggcgaaagcacagaggcaatataaatagctgaccaatcacagactttcctcctcatcgcatattctcatcacagaccgaagatattgttattttgatctcgatttgtctctaatggcggaaaagagcttcaagtatgtaatcgtcggtggtggagtctcggctggatatgcagctagagagttcgccaaacaaggggttaagccaggcgagctagctattatctccaaagaagcggttgcaccttatgagcgtcctgctcttagcaaggcttatttgttccctgactctcctgcaagactaccgggtttccatgtgtgtgttggaagtggaggagaaagattgcttcctgagtggtacaaggagaaaggtatcgaattgatccttagcactgaaatagtcaaagcagatcttgctgggaaaactcttgtaagcgcagctggggaaacgttcaagtatcagattcttgttattgcaactggttctactgttattaaattgacagattttaaagttcaaggagctgatgccaaaaacattttctacttgagagaaatcgaagatgctgatacgcttgtagaagcaattaaagcaaaaaagaatggtaccgctgttattgttggaggtggatacattggtcttgagcttggtgctgctttgagaattaataatcttgacgtcactatggtttaccctgaaccttggtgcatgcctcggcttttcacttctgaaatagctgctttctacgagggctattatgcaaacaaaggagttaaaattatcaagggaactgttgcaactggtttcagttcaaatgctaatggagaggtgacggaagtgaaactcaaggatggtagagttctcgaagctgacattgttgttgttggtgttggaggaagaccccttacaacattattcaagggacaagttgaagaggagaaaggtggcattaagaccgatgcttttttcaagtcaagtgttcctgatgtgtatgctgtcggagatgtagctactttccctcttaaattgtacaatgagaatagaagagtcgagcatgttgaccattctcgcaaatcagctgaacaagccgtcaaggccatcaaggctagtgaggagggaaaatccgttgaggagtatgactaccttccatacttctactctcgttcttttgatctggcgtggcagttctatggcgacaatgttggtgaaactgtacttttcggagacaacaatcctgaaacaccaaaggccaagttcggtacatactggattaaggatggcaaggtcattggtgcattccttgaaggtggtaatcccgaggagaatagcgctatcgctaaggtggccaaactccaaccccctgttgagagcctagaccagcttaagaaggaaggtcttacctttgctagcaagatctgaggaattcttttctttgaaaggaacaagttaaaatggtgttggctttaaaatacttgctcttctatattgttttgacttatttggttattcacaatttacgattttgttgctcttttatgaagattacatgttgttgaaatgtggtaatttactaaattgtttattttagtttttacaagagtggtttgttactcgttcaaataatctctgatgagcaaggcatcaaattaagttgtgaggattaacttatttagctccaaatttgaatatggtaacaagaaaatgaaaccaattaaatggtacaaagattacaaacaaaggaagaatagaacatatattcttcgttggatttgcacaaatgcaattctactacaagctacactaaggtgtaatttggttggaggtaataaaatgaaatgaaaagaaacggaaaccgt

SEQ ID NO: 3381 - DNA, 1786 bp, Gossypium raimondii
aacatacggcactgtttatgccaagtggccaaaccatgggtcagccaatgagtaccctaccaagtcctttaaaaaaatcgattaattataaaaaaataaaaaataaaaactcagtgagcagtcaagctaagctttgagatttatcaatggcggagaagagtttcaagtacgtcatcctcggtggtggtgtcgctgccgggtatgcggcgagggagtttgccaagcagggagttcagcctggtgagctagccattatttccaaggaagcggttgctccatatgaacgtcctgctctgagtaaggcgtatctcttccctgagggagctgcaagacttcctggtttccatgtctgtgttggaagtggtggagagagattgcttcctgagtggtacaaggaaaaagggattcagttgatccttagcactgaaatagtgaaagcagatcttcctgccaagactctagtaagcgcagctggagaaacgttcaaatatcaaattttgatcattgcaactggttccacagttataaggttgacagattttggcgtggaaggagctgatgccaaaaacatcttttacctgagagaaattgatgatgctgataagttgctggaagcaatcaaagcaaagaagaatggaaaggctgttattgttggaggaggctatattggtcttgagcttgctgcagtgatgaaaatcaacaattttgatgtcaccatggtgtaccctgagccttggtgcatgccccggcttttcactccggacattgctgcgttctacgaggagtattatgctaataaaggggtcaaaattataaagggaacagttgcagttggattcacctccgactccaatggagaggtgaaggaagttaaacttaaggacggcagagctctagaagctgacatcgttgttgttggtgttggtggaaggcctcttacaacactatttaaaggacaggttgaagaggaaaagggtggaataaagactgatgcttttttcgaaacaagtgttcccaatgtatatgctgtgggtgatctagccacttttcctctgaagttatacaatgaattgagaagggtggaacacgttgaccatgcccggaaatcagctgaacaggcggtaaaggctatcaaggcaagtgaggaagggaaatcagttgacgaatatgactacctaccgtacttctattcacgttcctttgatctatcatggcaattctatggtgacaatgtaggagatacagtacttttcggagacagcaacccgaaatcaccaaaggcgaagttcggatcttactggatcaaagatgggaaggtggttggagctttcttagaaggcggcactgccgaagaaaaccaagctattgcaaaagtggctaagcttcagccttcagttcagagtttggaagctgtgaaacatgaaggtctttcttttgcctgtaagatctgatggattcacatacctgccatgcggttccaacacaactggcttttggtttcctttggattgagcttataactatactgtttgctttgttttcttttgaattgtgattgatatggatcatttatattctccatcatgaactttcaatcaggtcataaaattttaattttatcgcattacatttctattattaataaattagaaattagattatattacatcactactattattaataaattagattgattggttagttatcttttacattagaattatttaaaggaactagtgtaaataatttaattgtactaatagatgaaactatatgattaaat

SEQ ID NO: 3382 - DNA, 1597 bp, Populus trichocarpa
cttaaaaacctcaccagtcacacaaccatttctctcggttacacacagcaatacttttataagaagataagaaggaagcacagaaatagtcgcaacgtattcagaaagagaaggagaaaatcaatcacaatatcaatggcggagaagagcttcaagtatgtgatcatcggcggtggtgtatctgctggatacgctgctagagagttttgcaagcagggggttaagcccggtgagcttgcaatcatctccaaggaggcggtggctccttatgaacgtcctgcactgagcaaggcttatctttttcctgagggaactgcaagacttccaggattccatgtctgtgttggaagtggaggggagagattacttcctgagtggtacaaagagaaagggattgagttgatccttagcacagaaatagtgaaagcagatcttgctgccaagacacttgttagtgcagctggagaaatattcaagtatcatattttgattattgcaactggttccacagtcattaagttgacagattttggtgtccaaggagctgatgccaaaaacattctctacttgagagaaattgatgatgctgacaaacttgtagaagcaattaaaggaaagaagaatggaaaggctgtaattgttggaggaggatacattggtcttgaacttagtgcagctttaagaatcaacaatattgatgttacaatggtttatcccgaaccatggtgcatgcctcgcctttttactgctggtatagctgccttctatgagggttattatgctaacaaaggagtcaagatcgttaagggaacagttgctgttgggttcaatgctgattcaaatggagaggtaaaggaagtgaaactaaaggatggcagggtgctagaagctgacattgttgttgttggtgttggtggaaggcctcttacaacactatttaaagggcaggttgaagaggagaaaggtggaataaagactgatgcgtttttcaaaactagtatttctgatgtatatgctgtcggtgatgtcgccacatttcctttgaagttgtacaatgatatcagaagagttgaacatgttgaccatgcccgtaaatcagctgagcaggctgtgaaggccatcaagtcaaatgaagaggggaaaacaattgatgtatatgattaccttccattcttctattctcgttcctttgatctgtcctggcaattctacggtgacaatgttggtgatgccgtgctatttggagacaatgatccagcatcacccaagccaaagtttggatcatactggatcaaagatgggaaggttgtcggagtttttctggagggtggaactcccgatgagaataaagcaattgccaaggttgctagggtccagcctcctgttgagaatttggacgtgctgacaaaagaaggtctttctttcgcctgtaagatatgaaatttccttgcttacgagatcaaaagattatatcaaaggtgtttctatcaagaatgtaatatgaatagcttgcgagctctaataaggtggttcttgtagttgctatcttgcttgttggatgatgtttgttttaatacatgtttcatgtttgggatta

SEQ ID NO: 3383 - DNA, 1992 bp, Populus trichocarpa
aaaaaggcttaaaaacctcaccagtcacacaaccatttctctcggttacacacagcaatacttttataagaagataagaaggaagcacagaaatagtcgcaacgtattcagaaagtgaaggagaaaatcaatcacaatatcaatggcggagaagagcttcaagtatgtgatcatcggcggtggtgtatctgctggatacgctgctagagagttttgcaagcagggggttaagcccggtgagcttgcaatcatctccaaggaggcggtggctccttatgaacgtcctgcactgagcaaggcttatctttttcctgagggaactgcaagacttccaggattccatgtctgtgttggaagtggaggggagagattacttcctgagtggtacaaagagaaagggattgagttgatccttagcacagaaatagtgaaagcagatcttgctgccaagacacttgttagtgcagctggagaaatattcaagtatcatattttgattattgcaactggttccacagtcattaagttgacagattttggtgtccaaggagctgatgccaaaaacattctctacttgagagaaattgatgatgctgacaaacttgtagaagcaattaaaggaaagaagaatggaaaggctgtaattgttggaggaggatacattggtcttgaacttagtgcagctttaagaatcaacaatattgatgttacaatggtttatcccgaaccatggtgcatgcctcgcctttttactgctggtatagctgccttctatgagggttattatgctaacaaaggagtcaagatcgttaagggaacagttgctgttgggttcaatgctgattcaaatggagaggtaaaggaagtgaaactaaaggatggtagggtgctagaagctgacattgttgttgttggtgttggtggaaggcctcttacaacactatttaaagggcaggttgaagaggagaaaggtggaataaagactgatgcgtttttcaaaactagtatttctgatgtatatgctgtcggtgatgtcgccacatttcctttgaagttgtacaatgatatcagaagagttgaacatgttgaccatgcccgtaaatcagctgagcaggctgtgaaggccatcaagtcaaatgaagaggggaaaacaattgatgtatatgattacctaccattcttctattctcgttcctttgatctgtcctggcaattctacggtgacaatgttggtgatgccgtgctatttggagacaatgatccagcatcacccaagccaaagtttggatcatactggatcaaagatgggaaggttgtcggagtttttctggagggtggaactcccgatgagaataaagcaattgccaaggttgctagggtccagcctcctgttgagaatttggacgtgctgacaaaagaaggtctttctttcgcctgtaagatatgaaatttccttgcttacgagatcaaaagattatatcaaaggtgtttctatcaagaatgtaatatgaatagcttgcgagctctaataaggtggttcttgtagttgctatcttgcttgttggatgatgtttgttttaatacatgtttcttgtttgggattagtctctcatttctattgtttgaaggagcagcgccgccctgcatgagcaaaaacttccaatggaatttggtggcttgttttatgaatatttgcttgctgaaattatctgagaaatgcatacgaatgatgatatgactatgacagcacgtccttcttgattgatttctttaaagcatgtgcatgctctaggattttctttctcgttcaaacatgtttctaccagcatcttcatgcgataacatgctgcttagaacttttcgacacgtgtttgcattttgatgatgtgatttggtcaaatacttgtgttttgatgtttttccaagcatattattctaggattttcgtcgtgttgctttctaatgttctactgaataactgattttctagtg

SEQ ID NO: 3384 - DNA, 1823 bp, Gossypium hirsutum
ctcagtgagcaacagatagagaacatagccaaagtcaagctaagctttgagatttatcaatggcggagaagagtttcaagtacgtcatcctcggtggtggtgtcgctgccgggtatgcggcgagggagtttgccaaacagggagttcagcctggtgagctagccattatttccaaggaagcggttgctccatatgaacgtcctgctctgagtaaggcgtatctcttccctgagggagctgcaagacttcctggtttccatgtctgtgttggaagtggtggagagagattgcttcctgagtggtacaatgaaaaaggaattcagttgatccttagcactgaaatagtgaaagcagatcttcctgccaagactctagtaagcgcagctggagaaacgttcaaatatcaaattttgatcattgcaactggttccacagttataaggttgacagattttggcgtggaaggagctgatgccaaaaacatcttttacctgagagaaattgatgatgctgataagttgctggaagcaatcaaagcaaagaagaatggaaaggctgttattgttggaggaggctatattggtcttgagcttgctgcagtgatgaaaattaaccattttgatgtcaccatggtgtaccctgagccttggtgcatgccccggcttttcactccggacattgctgcgttctacgaggagtattatgctaataaaggggtcaaaattataaagggaacagttgcagttggattcacctccgactccaatggagaggtgaaggaagttaaacttaaggacggcagagctctagaagctgacatcgttgttgttggtgttggtggaaggcctcttacaacactatttaaaggacaggttgaagaggaaaagggtggaataaagactgatgcttttttcgaaacaagtgttcccaatgtatatgctgtgggtgatctagccacttttcctctgaagttatacaatgaattgagaagggtggaacacgttgaccatgcccggaaatcagctgaacaggcggtaaaggctatcaaggcaagtggggaagggaaatcagttgacgaatatgactacctaccgtacttctattcacgttcctttgatctatcatggcaattctatggtgacaatgtaggagatacagtacttttcggagacagcaacccgaaatcaccaaaggcgaagttcggatcttactggatcaaagatgggaaggtggttggagctttcttagaaggcggcactgccgaagaaaaccaagctattgcaaaagtggctaagcttcagccttcagttcagagtttggaagctgtgaaacatgaaggtctttcttttgcctgtaagatctgatggattcacatacctgccatgcggttccaacacaactggcttttggtttcctttggattgagcttataactatactgtttgctttgttttcttttgaattgtgattgatatggatcatttatattctccatcatgaactttcaatcaggtcataaaattttaattttatcgcattacatttctattattaataaattagaaatgtaatgcgataaaattaattttaatttacattgattagtaaagaatgtaaactttacagtatacagcagattgaaaacagttaacaattgccacaaacttctatataaacctaccaaattagaaaacaatctggaggctataagatagaaaccatttgataggcctttcatcgtatgggctccactgatgattactctgtgctaaacaacagcatctaatcttagaacaataaaaatgaccctgacaatcatgcat

SEQ ID NO: 3385 - DNA, 1641 bp, Fraxinus spp
aatattgcaatctgtgttatctttattctttacgcaggcgtacgattgttgaattgattcaatggcagagaagtcgttcaaatatgtgatcgttggtggtggcgtcgctgccggatatgccgccagggaatttgccaagcagggagttaagccaggtgaactggccatcatttccaaagaggcggtggctccttatgaacgtccagcacttagcaaggcatacttgtttcccgagggaactgcaagacttccaggtttccatgtgtgcgttggaagtggaggagagcggctccttcccgagtggtacacagaaaaagggatatctttgatccttagcacagaaatagtcaaggcagatctttcttcaaagacacttaccagtgcagcgggcgaaacatttaaataccagattctgatcatagcaactggttcttctgttatcaaattgtctgattttggagtacaaggggctgatgccaaaaacatcttttatttgagagaaattgatgatgccgataaacttgttgaagcaatcaaagcaaagaaaaacggaaaggctgtggttgttggtggaggatacattggtctcgagctcagtgcagctctgagagtcaataatattgatgtgactatggtttatcccgaaccttggtgcatgcctaggctttcacagctggcatagctgccttctacgaagattattatgcaaataagggagtcaaaatcatcaaagggacagtagctgttgggtttggcactaatgaaaatggagaagttacggatgtaaaacttaaggatgggagggtgctggaagcagacattgttgttgttggtgtaggtggaaagcctcttacaaccctatttaaaggtcaggttgaagaggataaaggtggaatcaagactgatgctttcttcaaaacaagcgtacctggtgtatatgctgttggtgatgttgccactttccctttgaaattgtatggtgagctgagaagagtagaacatgttgatcatgctcgcaaatctgcagaacaggctgtcaaggcaatcttttcaagtgaacaaggaaagtcggttgatgaatatgattaccttcccttcttctattcccgtgccttcgatctgtcatggcagttctatggcgacaatgtaggtgagactgtcctctttggggacagcagccctacatctacaacccacaagtttggatcatactggatcaaagacgggaaggttgtaggtgcatttttggaaagtggtactccagaagaaaacaaggcgattgcaaaagttgctagggttcagccccttgcacagaacttggatcaactagctacagaaggtctcgcttttgcctctaaaatttaagcatcttttttgacatggtacaaggtcagttcactggaggttgaacaattctggaattggtttccagtatttaccctgaacttgtggctgggaaaaattaattttggtggactgtagactgtgtgtgtgtttaaatttcatgttttatttagctaaactgggaggatgtctgcaagctatttgcgctaggacaagacctgttatatttcttgggaaataaggatacttttagatgatatcttacaagtttgtgtaagaatcaaatggtttgtattg

SEQ ID NO: 3386 - DNA, 1612 bp, Eschscholzia californica
aaatcgccttcttacattttattatccaattttctttcaaaaagacacgtacttgcctgagaaaaccagagctatctttctttctttctttctttctgagttcaccaatggcggataagcacttcaagtacgtgatcctcggtggtggtgtttctgctggatatgcagctaaagagtttgctaaacaaggtgttaagcctggcgagcttgctctaatttctaaagaagctgtggcaccttatgaacgtccagctcttagcaaggcatatcttttccctgaggctcctgcaagattaccagggtttcatgtctgtgttggaagtgggggcgagagactacttcctgaatggtacactcagaaaggcatagagctgatccttagcactgaaatagtgaaagctgatctagcttccaagactctaacaagtgcagctggagcaaccttcaagtatgaagtgttggtcatcgcaactggttccacggttataagattgactgattttggagttcaaggggctgacgccaagaatatcttatatttgagagaaattgacgatgccgataagcttatagaggtcattaaggcaaagaaaaatggaaaagcggtcattgttggaggaggatacattggtctcgagcttggagcagttatgcaaatcaacaacttggatgttactatggtctatccagagccatggtgcatgcctcgactctttacttccggaatagcagctttctatgagggatattatgctaacaaggggatcaaaattattaagggaacagttgctgttgggtttgattcagacgccaatggagaggtgaaggcagtaaagctcaaggatgggagagtcctggatgctgacattgtcattgttggtgttggtggaagaccattgacgacattattcaaaggccaggttgaagaggagaaaggtggaatcaagacagatacattcttcaaaacaagtgttccagacgtgtacgcagtgggtgatgtagcaaccttcccactgaaactatacaatgagatgagaagagttgagcatgtagaccatgcgaggaaatccgcagaacaagctgttaaggctatcaaggcggctgaagaagggaaaaccacggaagtatatgactaccttccttatttctactctcgttcatttgatttgtcgtggcagttttatggagacaatgtcggggaaactgtactttacggcgacagtgatccttcatcagcaaagcccaagtttggttcgtattggatcaaagacgggaaagtggtcggtgctttcctagagggtggaacaccagaagaaaacaaagccattgctaaggttgcaagggttcaaccttcagttgagaatgtggatcaactagctaaggaaggtttaacttttgcaagtaagatataagaaataaacataatcttcctaggaaaggatgagagagacgatgatgtgtgagatatcctggtattattatgattcaaataatgagaattattattttaagttgaaattgtcatttcttatatgtgaatctgcggaattattgagaacaactgtttcagtaaaatgtttgaataaaagcattgttatctctatcttctgtg

SEQ ID NO: 3387 - DNA, 1463 bp, Glycyrrhiza uralensis
aacaaaaccaaaaacaccatcatccagtgtgactcgtgaaacgcagaagaagaactgagaacttgcaaagcgtagcgatttctttacttcaatggcgaagaccttcaagtacgtcatcctcggaggaggagtttccgctggttatgcggcgagggagtttgccaaacagggagttaagccaggggagctggcaatcatatccaaggaagcggtagcaccttatgaacgtcctgctctaagcaaggcttacctttttccagagtcccctgctagacttcctgggttccatgtctgtgttggaagtggaggagaaagattgcttccagagtggtaccaagagaaagggatagagttaattcttggtacagaaattgtgaaagcggaccttgctgcaaaatctctgacaagtgcaggaggagaaacattcaattaccagattttggttattgcaactggctcatcggttataaggctgacagattttggtgtacaaggagctgatgccaaaaacattttttatttgagggaggttgatgatgctgacaaattgtacgaggcaatcaaagcaaaaaagagtggaaaagctgtggttgttgggggaggatacattggtctggaattgagcgcagtgttgaggctcaacggcattgatgttacaatggtctacccagaaccttggtgtatgccgcgactttttacagctggtatagctgcattctatgagggatattatgcaaataagggggtcaatatcattaaaggaactgttgctgttggattcactgctaattccaatggagaggtaaaagaagtcaaactaaaggatggaagagtcctggaagctgatattgtggccgttggtgttggaggaaggcctctaacatccttattcaaagggcaggttgaagaggagaagggtggaatcaagactgattccttcttcaaaacaaatgttcccggtgtatatgctgtcggtgatgttgctactttccctttgaaattgtacggtgagctaagaagagttgaacatgttgatcatgctcgcaaatcagctgagcaggctgtgaaggccatcaaggcagctgaggatggaaaaacagttgaggagtatgattatcttccatacttctattcccgttcatttgatctgtcttggcaattctatggtgacaatgttggcgagacggtgctattcggagacagcgatccagcgtcatcaaagcctaagtttgggacatactggattaaagacgggaaagttatcggggcctttctggagagcggtactcctgatgagaacaaggctattgccaaagttgcaagagtccagcctgcagtggaggatgcggatcaacttgcaaaggaaggcctttcctttgcaagtaaaatataatgatattgttggggaggacaaattgcttggtgattgcacagaatatatctgtactggcttcattttactc

SEQ ID NO: 3388 - DNA, 1694 bp, Tabernaemontana elegans
ctcgcaaattatgacaactatttaacttccacattgagggagctctaccactttcttctatctactgtcttctcgttctgtaactcctctgcgaattcaatcgatacgtgctcgcttgataatcgaatccataggagaatgtctgagaaatctttcaagtacgtgatccttggaggcggcgtcgctgctgggtatgctgctagggaatttgccaaacagggggttaagcctggtgaactggccatcatttctaaagaggcggttgctccatatgaacgtcctgcactaagcaaggcatatcttttccctgaggggacagcaagactccctggatttcatgtttgtgttggaagtggaggggagaggttgcttcctgaatggtatactgagaaagggatatcattgatccttagcacggacatagttaaagcagatcttccttcaaagacacttaccagtgcagctggagaaacatttaaatatcaaatactcattattgcaactggttctacagttataaggttgtcagactttggtgttcaaggggctgatgccaaaaatatcttttacttgagagaaattgatgatgctgataaacttgtagaagcaataaaggcaaagaaaaatggaaaggctgtggttgttggaggtggttacattggtcttgagcttagtgcagcattaaaaatcaataacatcgacgtcagtatggtgtacccagaaccatggtgcatgcctcggctgtttactgctgatatagctgccttctatgagggttattatgcaaacaaaggaatcaaaatcatcaagggtacagttgctgtggggtttggtacacatgaaaatggagaggtgaaggatgtaaaacttaaggatggcagggtgctggaagctgacattgttgttgttggtgttggggggagaccacttgtaactttgttcaaaggtcaggttgaggaagagaaaggtggaatcaagaccaatgcatttttcaaaacaaatctacctgatgtatatgctgtgggtgatgttgcgactttcccattgaaactgtataatgagttgagaagagttgaacatgttgatcatgctcgcaaatctgctgaacaggctgttaaggcaatttttgcaagtgaacaaggaaagccggttgatgagtatgactatctcccatacttctattcccgtgccttcgatctatcttggcagttctatggtgacaatgtgggtgactctgtaatctttggagatagtgatccaacttcttcatctcacaagtttggatcctactggattaaagacggtaaggttgttggtgcattcctggagagtggcaccccagatgaaaataaggccattgccaaagttgcaagggtgcagcccccagctagcagcttggccgaattgggaaaggagggcatcacttttgctgctaagatctgagaagctttgatgtcaagatcctctaaagatgattcatttcaagaaactcatgagctccatcatttatctcaatttgattggctagtatatgtcaatgtatcgttaattgtctttgttaattgtctttgatcaatagttaagttgcatgctgtgtttttcctcagggcgctgtcactttatggcaactgtatttctgtaaattatgagtgcatgaaatcaggggccaatactctttatgttttggatctttc

SEQ ID NO: 3389 - DNA, 1612 bp, Theobroma cacao
tcaatcctactttaaaaaaatcggtcaattaccaaaaagggtgaacgaaaagtgtcagcgcaaaaaagctaagctttgatcgtcgatggcggagaagtgtttcaagtacgtgatcctaggcggcggtgttgctgctggatacgcagcaagggagtttgccaagcagggggtgcagcctggtgagctggctattatttccaaggaagcggtggctccatatgaacgccctgctctgagtaagggatatctcttccctgagggagctgcaagacttcctggtttccatgtctgtgttggaagtggtggagagagattgcttcctgagtggtacaaggaaaaagggattgaattgatccttagcacagaaatagtgaaagcagatcttcctgccaacactttagtaagcgcagctggagaaaccttcaagtatcaaattttgatcattgcaactggttccacggttataagattgacagattttggagtgcaaggagctgacgctaaaaacatcttctacttaagagaaattgatgatgctgatgagttgatagaagctatcaaagcaaaaaagaatgggaaggctgttattgttggaggaggttatattggtcttgagcttggtgcagcaatgaaaattaataattttgatgtcaacatggtgtaccctgaaccatggtgcatgccccggctcttcacctctggcattgctgctttctatgagggttattatgctaataaagggatcaaaattataaaaggaacagttgcagttggattcacctctgactcaaatggagaggtgaaggaagttaaacttaaggatggcagagtgctggaagctgacattgttgttgtgggtgttggtggaaggcctcttacaacattatttaaagggcaggttgaagaggagaagggtggaataaagactgatgcttgtttcaaaacaagtgttcccaatgtatatgccgtgggtgatgtagccacttttcctatgaagttatacaacgacatgagaagggttgaacatgttgaccatgcccggaaatcagctgaacaggcagtaaaggccatcaaggcaagtgaggaggggaaatcagttgatgaatatgactacctaccatttttctattctcgttcctttgatctagcatggcagttctatggtgacaatgttggggatacggtactttttggagacaacgacccacaatcaccaaaggccaagttcggatcttactggatcaaagaggggaaggtcattggagctttcctagagggtggctctgctgaagaaaaccaggctattgcaaaagttgctaagctccagcctacagttggggatttggaagccctgacaaatgaaggtctttcctttgcctgtaagatttgaggactgtcagttgccatgccttccccccacgaaagagaacaaaaaacaaagaggttgttccaagaggactatatagatttagacttggatatgcttttcgtggggttgtgttcttagtgcgctttgggttgagtacctaaatttgtgggatttgctttgttctatatcgtagttatctcttcttgtgtttcttttgaatgatgaataataataataataata

SEQ ID NO: 3390 - DNA, 1678 bp, Gossypium hirsutum
gtcaagctaaggtttgagatttatcaatggcggagaagagtttcaagtacgtcatcctcggtggtggtgtcgctgccgggtatgccgcgagggagtttgccaagcagggagttcagcctggtgagctagccattatttccaaggaagcggttgctccatatgaacgtcctgctctgagtaaggcgtatctcttccctgagggagctgcaagacttcctggtttccatgtctgtgttggaagtggtggagagagattgcttcctgagtggtacaaggaaaaagggattcagttgatccttagcactgaaatagtgaaagcagatcttcctgccaagactgtagtaagcgcagctggagaaacattcaaatatcaaattttgatcattgcaactggttccacagttataaggttgacagattttggcgtggaaggagctgatgccaaaaacatcttttacctgagagaaattgatgatgctgataagttgctggaagcaatcaaagcaaagaagaatggcaaggctgttattgttggaggaggctatattggtcttgagcttgctgcagtgatgaaaatcaacaattttgatgtcaccatggtgtaccccgagccttggtgcatgccccggcttttcactccggacattgctgcgttctacgaggagtattatgctaataaaggggtcaaaattataaagggaacagttgcagttggattcacctccgattccattggagaggtgaaggaagttaaacttaaggacggcagagctctagaagctgacatcgttgttgtcggtgttggtggaaggcctctcacaacactatttaaaggacaggttgaagaggaaaagggtggaataaagactgatgcttttttcaaaacaagtgttcctaatgtatatgctgtgggtgatctagccacttttcctctgaagttatacaatgaactgagaagggtggaacacgttgaccatgcccggaaatcagctgaacaggcagttaaggctatcaaggcaagtgaggaagggaaatcagttgacgaatatgactacctaccgtacttctattcacgttccttcgatctatcatggcaattctatggtgacaatgtaggagatacagtacttttcggagacagcaacccgaaatcacaaaaggcgaagttcggatcttactggatcaaagatgggaaggtggttggagctttcttagaaggcggcactgccgaagaaaaccaagctattgcaaaggtcgctaagcttcagccttcagttcagagtttggaagctgtgaaacatgaaggtctttcttttgcctgtaagatctgatgattcacacacctgccatgctgttccaacacaactggcttttggtttcctttggattgagctcataactatactgtttgctttgttttcttttgaattgtgattgatatggatcatttatattctccatcatgaactttcaatcaggtcataaaattttaattttatcgcattacatttctattattaataaattagaaattagattatattacatcactactattattaataaattagattgattggttagttatcttttacattagaattatttaaaggaactagtgtaaataatttaattgtactaatagatgaaactatatgattaaattaaaaaaaaaaaa

SEQ ID NO: 3391 - DNA, 2242 bp, Vitis vinifera
atatctatccggaactagaatgatcgctgccatcaccaatgacgtcagacttcttggcccagaatcaatgaagagaacatccgctatagtctcttcctcgcctcatgttacaagattttgtacgcagacatttaacttaattgtcattgtgtgatgggacatatcaaatttggagcaaatacgttttaattttagattagtacatggtttccataagggtttgatcaaattcaaacccagtctagatcctaaaaggatggtttctcttttgatggtaaccggaactccgcaccagataaaatctcaaattagggatttgtttttcttttggtaatatagaaaaccactattctaatccgttcaccggagaagatgtcgtggcgtctgaagagtcagcggcgatgaacggtgggatattggccacgtgtacgactcgtgttcccagaacattaccataaatcgacggtcagccaatgacgatttaacgcatataaatattagatcccataagccggaccaacaaacccaacactggtgttgcagatacattcatcgatcggtcaatccatggcggagaagcattttaaatacgtgatcctcggcggtggcgtttctgctggatatgcagctagggagtttgccaagcaaggggttaagccaggggagctggcaattatttccaaagaggcggttgctccttatgaacgtcctgcgcttagcaaagcctacctatttcctgagggagctgcaagacttcctggatttcatgtttgtgttggaagcggaggagagagacttcttcctgagtggtataaagagaaaggtatagaattgatccttagtacagaaatagtgaaagcagatcttgcatccaaaactctgataagtgcagctggagaaacctttaagtatcacatcttgattattgcaactggttcaacggtcataaggttaactgactttcgtgtagaaggagctgatgcaaaaaatatcttatacttgagagaaatcgatgatgctgacaagcttatagatgtaataaaggccaaaaagaatggaaaggctgtgattgttggaggggggtacattggtctcgagcttagtgcagtgatgaaaatcaacaacttagatgtttgcatggtttatccagaaccatggtgcatgcctcggcttttcactgctggtatagctgctttttatgagggttattatgctaataaaggaatcaaaattatcaagggaacagtagcagttgggtttacctctgatgcaaatggagaggtaaaggaagtgaaacttaaggatggtagggtgctggaagctgacattgttgttgttggtgttggtggaagaccccttacaacattattcaaaggacaggtggaagaggagaaaggtggaattaagactgatgaattcttcaaaacaagtgttcctgatgtatatgctgtgggagatgttgctactttcccactgaaattgtacaatgaaattagaagagttgaacatgtcgaccatgcccggaaatcagctgagcaagctgtcaaggcaatcaaggcaagtgaggaagggaaatcagttgaggagtatgactaccttccatacttctactctcgtgcctttgatctgtcctggcagttctatggtgacaatgtgggtgaaacagtgctatttggagacaataatccagcatcaccaaaggccaagtttggaacctattggatcaaagatgggaaagtggtgggagcatttctggagggtgggactcctgaagagaacacggccattgccaaagttgcaaggctccaacctgcagttgagaatctggatcaactgactaatgaaggtctcacctttgcctgtaagatttgaggtcctccagaatatgggggacaaaatgaatgaatctggatggtttttttttttttttcgctggcttgttctgttggtctgcttggggttgtttagtatgaggattgttgatagcaattcccttcagggctgttatgtgatctaaattctaattgttggtatgatataagattcaccttgtcataagtttgtaactgagttagctatctctaatctagattaatttgcaggtctgtgctggaataaatacattcaccgtactgttttattttcttgagaataatgttattgggtaccctggaatctttgtgtttattaaggagaagcctttgttgagctcctttttgacaggtcgcctgtgagaaacggt

SEQ ID NO: 3392 - DNA, 1773 bp, Quercus alba
cagtcacacctaatcgcattgaatttttcctcttctatctgttcaaaacagatacacacacacacacacacataagtctctcagttcatagcaaaagcaaaaaaggcacaaaagctccatttcgatcatcatcaatggcggcgaagagcttcaagtacgtgatcgtcggtggcggagtctcagccggatatgcggctagggaatttgccaaacagggtgttaagccaggagagctggcaatcatttccaaagaggcggtggcaccttatgaacgtcctgcacttagcaaggcctacctattccctgagtctcctgccagactccctgggttccatgtctgtgttggaagtggaggagagagattgcttccagagtggtacaaagagaaaggaatagaattgatcctcagcacagaaatagttaaagcagatcttgctgccaaaactctgattagtgctgctggagaaactttcaattatcagattttgattattgcaactggttcatctgttatcaggttgacagattttggcgtacaaggagctgatgccaaaaacatctactacttgagagaagttgatgatgctgataagcttgtagaagctatcaaagcaaagaagaatgggaaggttgtgattgttggaggaggctatattggtcttgagcttagtgcggttatgaaaatcaacaatttggatgtcaaaatggtttaccctgaaccatggtgcatgcctcggcttttcactgctgatatagctgctttctatgagggtttttataaaaacaaaggaatccaaattatcaagggaacagttgctgttgggtttacagctgattcaaatggagaggtaaaggaagtgaagcttaaggatggcagggtgctagaagctgacattgttgttgttggtgttgggggaaggcctcttacaacattattcaaaggtcaggttgaagaggagaaaggtggcattaagactgactcattcttcaaaacaagcgtgcctaatgtatatgctgtaggcgatgtggccactttccctttgaaattgtacaaggagttgagaagagttgaacatgttgaccattcacgcaaatctgctgagcaggctgtgaaggccatcaaggcaagtgaggaggggaaaacaattgaggagtatgactaccttccattcttctattctcgctcatttgatctgtcatggcaattctatggtgacaatgttggtgacacagtgatatttggagacaataacccagaaacaccgaagcccaagttcggatcatactggatcaaagatgggaaggtattgggagctttcctggagggtgggactcctgaggaaaacaaggctattgccaaagttgcaagggtgcaacctcctgttgagaatttggatgtgctatcaaaggagggtctttcctttgcttgcaagatatgaaaactttcttccataggggggaagatggatagcttttgatcccacttcttgtctatgtagattacataaaactgttggcttttgttttcctaatcacttatgttttgatttggtaaattatgaactatgagctgcagatactcgttccttattgtagctttgaatttaataatttgttacgtttactgctggttatttaggtccaaattgttatatattaggtgcttaaatttccaatagtgtgcaactgcagaaacataaattgtaaaacttttcatccttaattcggttgtgaatggctaccccattgctttgagtataaccgcccccataa

SEQ ID NO: 3393 - DNA, 1626 bp, Olea europaea
aaaaaggctcttattgcggtctgtattatctttattctttacacaggcgtccgattggtgaattgattcaatggcagagaagtcgttcaagtatgtgatcgttggtggtggcgtcgctgccggatatgccgccagggaatttgccaagcagggagttaagccaggtgaactggccgtcatttccaaagaggcggtggctccttatgaacgtccagcacttagcaaggcatacttgtttcccgagggaactgctagacttccaggtttccatgtgtgcgttggaagtggaggagagcggctccttcctgagtggtacgcagagaaagggatttctttgatacttagcacggaaatagtcaaagcagatctttcttcaaagacacttgccagtgcagcgggcgaaacatttaaataccagattctgatcatagcaactggttctactgttatcaaattgtctgattttggagtacaaggggctgatgccaaaaacatcttttatttgagagaaattgatgatgctgataaacttgtagaagcaatcaaggcaaagaaaaacggaaaggctgttgtggttggtggaggatacattggtcttgagctcagtgcagccctgagagtcaataacattgatgcgactatggtttaccctgaaccttggtgcatgcctaggcttttcacagctggcatagctgccttctatgaaggttattatgcaaataagggagtcaaaatcatcaaagggactgtagctgttgggtttggcactaatgaaaatggagaagttacggatgtaaaacttaaggatgggagggtgctggaagcagacatcgtggttgttggtgtagggggaaagcctcttgcaaccctatttaaaggtcaggttgaagaggaaaaaggtggaatcaagactgatgctttcttcaaaacaagcgttcctgatgtatatgctgtaggcgatgttgccactttccctttgaaattgtatggtgagctgagaagagtagaacatgttgatcatgctcgcaaatctgcagaacaggctgtcaaggcaatctttgcaagtgaacaaggaaagtcagttgatgaatatgactaccttccgttcttctattcccgtgccttcgatctgtcatggcagttctatggcgacaatgtaggtgagactgtcctctttggggacagcagccctacatctacaacccacaaattcggatcatactggatcaaagacgggaaggttgtgggtgcatttttggaaagtggtactccagaagaaaacaaggcaattgcaaaagttgctagggttcagcccctcgcacagaacttggatcaactagctacagaaggtctcaattttgcctctaaaatttaagtatcttttttgaatagtaaaaggtcagtccactggaggtcgaacattctggaattggttttcagtatttaccctgaacttatgtccgggtaaaattattggattttttggtggactgtagactctgtgtgtgtgtgtgtgtgtgtgtgaatttcatgttttatttaccttaactgggaggatgtctgcaaactatcttgtgctaggacaagacctgttatgtttcttgggaaataaagttatacttttag

SEQ ID NO: 3394 - DNA, 1479 bp, Olea europaea
tattatctttattctttacacaggcgtccgattggtgaattgattcaatggcagagaagtcgttcaagtatgtgatcgttggtggtggcgtcgctgccggatatgccgccagggaatttgccaagcagggagttaagccaggtgaactggccgtcatttccaaagaggcggtggctccttatgaacgtccagcacttagcaaggcatacttgtttcccgagggaactgctagacttccaggtttccatgtgtgcgttggaagtggaggagagcggctccttcctgagtggtacgcagagaaagggatttctttgatacttagcacggaaatagtcaaagcagatctttcttcaaagacacttgccagtgcagcgggcgaaacatttaaataccagattctgatcatagcaactggttctactgttatcaaattgtctgattttggagtacaaggggctgatgccaaaaacatcttttatttgagagaaattgatgatgctgataaacttgtagaagcaatcaaggcaaagaaaaacggaaaggctgttgtggttggtggaggatacattggtcttgagctcagtgcagccctgagagtcaataacattgatgcgactatggtttaccctgaaccttggtgcatgcctaggcttttcacagctggcatagctgccttctatgaaggttattatgcaaataagggagtcaaaatcatcaaagggactgtagctgttgggtttggcactaatgaaaatggagaagttacggatgtaaaacttaaggatgggagggtgctggaagcagacatcgtggttgttggtgtaggaggaaagcctcttgcaaccctatttaaaggtcaggttgaagaggaaaaaggtggaatcaagactgatgctttcttcaaaacaagcgttcctgatgtatatgctgtaggcgatgttgccactttccctttgaaattgtatggtgagctgagaagagtagaacatgttgatcatgctcgcaaatctgcagaacaggctgtcaaggcaatctttgcaagtgaacaaggaaagtcagttgatgaatatgactaccttccgttcttctattcccgtgccttcgatctgtcatggcagttctatggcgacaatgtaggcgagactgtcctctttggggacagcagccctacatctacaacccacaaattcggatcatactggatcaaagacgggaaggttgtgggtgcatttttggaaagtggtactccagaagaaaacaaggcaattgcaaaagttgctagggttcagcccctcgcacagaacttggatcaactagctacagaaggtctcaattttgcctctaaaatttaagtatcttttttgaatagtaaaaggtcagtccactggaggtcgaacattctggaattggttttcagtatttaccctgaacttatgtccgggtaaaattaatggattttttggtggactgtagactctc

SEQ ID NO: 3395 - DNA, 1909 bp, Platanus occidentalis
tcccaatctcgcgacaccttgcgcgcacttagacaaagctcggtcccttttctcattttctcgcggtgctctaaaatcgatccatggcggagacgcatttcaagtacgtgatcgtcggtggtggtgttgcagctggatatgctgctagggagtttgctaaacagggcgtcaagccaggagagcttgcagttatttccaaagaggcggtggcaccttatgaacgtccagcgcttagcaaggcatacctttttcctgagggagctgcaagactcccagggtttcatgtctgtgttgggagtggtggtgagagactacttcctgggtggtacactgaaaaaggcatagagttgatccttagcactgaaatagtgaaagcagatctggcttccaagattctcataagtgcagctggggcgatctataattatgaaattttgatcattgcaactggttccacggtcataaggttgagtgactttggtgttcaaggagccgatgccaagaacatcttctacttgagagaaattgatgatgctgacaagcttatagaagcaattaaggcaaagaagaatggaaaggctgtgattgttggaggaggatacattggtcttgagcttggtgctgttatgaaaatcaacaattttgatgttactatggtgtaccctgaaccatggtgcatgcctcggcttttcactgctggtatagccgctttctatgagggttattatgctaataaaggaatcaaaattgttaagggaacagtagcagttgggtttgattctgatgcaaatggagaggtaaaggctgtgaaactgaaggacgggagagtactggatgctgatattgttgtcgttggtgttggtggaagacctcttaccacactattcaagggccaggttgaagaagagaagggtggaatcaagactgatgggttcttcaaaacaagtgtccccagtgtgtatgccattggtgatgtggctactttccctatgaagctgtacaacgagatgaggagagtggagcacgttgatcatgccaggaaatcagcagagcaggctgtgaaggctatcatggcagaagggaagttcattgatgaatatgactaccttccttatttctactcccgctcctttgatctgtcatggcagttctatggagataatgttggggatacagtgatgtttggagacagtgatccaacatcgccaaagcccaagtttggatcatattggatcaaagatggaaagatagtgggggtattcctggaggctgggacaccagatgagaacaaggccattgctaaagttgcaaggctccaacctccagttgagaatgtggatcaactgaccaaggaaggtgtcagttttgcatgtaagatttgagaatcctccagtctacaagtggtaaatggaatggtatatgctgttctatcatctacgcttgctatatttagtgtattgtggattgattgtattaatccatggctggtgtttggattgctgaatgtattgctggcctctttctgtagttcacgttgacgctttgttttcctaggtttgataaataaagctatcctagcatctgtgtggattccaattgtactgttttttaagacacggataggaaaattagtaccagcttcgctgtaagagaattggtttcagtgctggcttgctttgggaatggtctcgggattgaacttcacaagtgtaatatcccagtttgttcatgcactcccatctttgctatgcctatgatttacagtatttgagtgcctagcggcggccccaagttaaaatgtttcttttagaagggaatttcaattactgttgcccaaaaagaaaaaaatatgtaacgccatcttttttgattcatgagagcatgctgaatttgggatccgtgttttact

SEQ ID NO: 3396 - DNA, 1710 bp, Amsonia hubrichtii
gcaaaatttaatactgtatatctaatcgaaggactatttaacgtccacattgacggccagcactttctgctagctactctttactcattctagagctctgctgtgattttgatagaaacgcgctcgcttgataatccaatccataagaaaatggccgagaagtctttcaagtacgtgatcctaggaggcggtgtctctgctgggtatgctgctagggaatttgccaaacagggggtaaagcctggtgaactggcaatcatttctaaagaggcggttgctccgtatgaacgtcctgcactaagcaaggcatatcttttccctgaaggaacggcaagactcccaggatttcatgtgtgtgttggaagtggaggggaaaggttacttcctgaatggtatactgagaaagggatattgttgatcctaagcacggaaatagttaaagcagatcttccttcaaagacacttactagtgcagctggagaaacctttaaatatcagatactgattattgcaactggttccacagttataaagttgtcagactttggtgtacaaggggctgatgcccaaaatatcttttacttgagagaaattgatgacgcggataagcttgtagaagcaataaaagcaaagaaaaatgggaaggctgtggttgttggaggagggtacatcggtcttgagcttagtgcagcattaagagtcaataactatgatgtcagtatggtgtaccccgaaccatggtgcatgcctcggctgtttactgctggtatagctgctttctatgagggttattatgcaaacaaaggaatcaaaatcatcaagggtacagtagctgtggggtttggtacacatgaaaatggagaggtgaaggatgtaaaactcaaggatggtagggtgctggaagctgacattgttgttgttggcgttggagcaagaccactcacaactttgttcaaaggacaggttgaggaggaaaaaggtggaatcaagactgatgcgtttttcaaaacaaatctacctgatgtatatgctgtgggtgatgttgcaactttcccaatgaaactgtaccatgagattagaagagttgaacatgtcgatcattctcgcaaatctgctgaacaggctgtaaaggcaatttttgcaagtgagcaaggaaagtcaattgatgagtatgactacctcccattcttctattcccgttcctttgatctgtcatggcagttctatggtgacaatgtgggagacactgtactctttggagataacgatccaacttcttcatctcacaagtttggatcttactggatcaaagatggcaaggttgttggtgctttcctggagagcggtacccctgaagaaaataaggccatcgccaaagttgcaagggtgcagccgccagctaacagcttggacgaattggcaaaggagggtctcacttttgcctctaagatctgaaaagttctgatgtgaagtccattagacgattgatttctagatactcatgagctccgtcatttatctcaatttgattggctggtatatgacgtcgtattgttgattggctttgacaaacatttaaagttgcataccgtgtttttactcggggtgcctccacttcttagcgactggatttgtgtaaattatgagtgcatgaaatcagggacccggaccttcactgctttctttgactgaaattttcaaagtcgaatt

SEQ ID NO: 3397 - DNA, 1644 bp, Manihot esculenta
gctttatattatttcagttacaggacgcgcagtgaaagcaccagagagagaaagagagtagaggaccaactaatctaatggcggagaagagcttcaagtacgtgatcgttggtggtggcgtagccgctggatatgcagcaagggagtttggcaaccagggggttaagtcaggtgaattggcaatcatctccaaggaagcggtggctccttatgaacgtcctgcacttagcaaggcatatcttttccctgaaggaactgcaaggcttccaggattccatgtctgtgttggaagtggaggggagaggctggctcctgagtggtacaaagagaaaggaatagagttgatccttagcacagaaatagtcaaagcagatcttgctaccaagactctaacaagtgcagcaggagaaaccttcaagtatcagattttgattattgcaacaggttccactgttataagattgacagattttggcgtccaaggagctgattccaagaatatattctacttgagagaaattgatgatgctgataagcttgtagaagtaattaaggcaaagaaagatgggaaagctgtaatcgtgggaggaggatacatcggtcttgagcttagtgcagcactgagaattaataatattgatgtcacaatggtttatcctgaaccatggtgcatgcctcgtctttttactgccgaattagctgctttctatgagggttattatgctaataaaggaatcaacattatcaagggaacagttgctgctgggtttactgccgattcaaatggggaggtaaaggaggtgaaacttaaggatggtagagtattggaagctgacattgtcgttgttggtgttggtggaaggccacttacagcattatacaaagggcaggttgaagaggagaaaggtggaataaagaccgatgcatttttcagaacaagtgttcctgatgtgtatgccgttggtgatgttgctacttttcctttgaaattgtacaatgagctgagaagagttgaacacgttgaccatgcccgcaaatcagctgagcaggctgtgaaggccattaaatcaagcgaggaagggaaaacaattgatgagtatgactaccttccatacttctactctcgtgcctttgagctgtcctggcaattctatggtgacaatgttggtgagtcggtgttctttggggacagtgatccaaaagcaccaaagccaaagtttggatcatactggatcaaagacggaaaggttgttggagcatttctggaaggtggaagtcctgatgaaaacaaggctattgctaaagttgcgagagtccagccttcaattcagaatttggatcagctcacaaaggaaggtctttcctttgcctgtaacatttgattatttccttgcgcaacatctccttatgagtctacgttgtggcactgctgcgtgtttttccatttcaattctgtaatttacttttgaggatattcttgccgttgtcattctgcttttagtggctatgtacagaacgcaggattgcctttctgggatggttatttgttttattttttatttccaaggtttggaatggtaattattctttacaattgcgaatttttgcaaaatgttgtcaataatttttttttccccattgtcc

SEQ ID NO: 3398 - DNA, 1583 bp, Castanea mollissima
cagttcatagcaaaagcaaaaaaggcacaaaagctccatttcgatcatcatcatcaatggcggccaagagtttcaagtacgtgatcgtcggtggcggagtctcagccggatatgcggctagggaatttgccaaacagggtgttaagccaggagagctggcaatcatttccaaagaggcggtggcaccttatgaacgtcctgcacttagcaaggcctacctatttcctgagtctcctgccagactccctgggttccatgtctgtgttggaagtggaggagagagattgcttccagagtggtacaaagagaaaggaatagaattgatcctcagcacagaaatagttaaagcagatcttgctgccaaaactctgattagtgctgctggagaaactttcaattatcagattttgattattgcaactggttcatctgttatcaggttgacagattttggtgtacaaggagctgatgccaaaaacatctactacttgagagaaattgatgatgctgataagcttatagaagctatcaaagcaaagaagaatgggaaggttgtgattgttggaggaggctacatcggtcttgagcttagtgcggttatgaaaatcaacaatttggatgtcagcatggtttaccctgaaccgtggtgcatgcctcggcttttcactgctggtatagctgctttctatgagggtttttataaaaacaaaggaattgaaattatcaagggaacagttgctgttgggtttactgctgattcaaatggagaggtaaaggaagtgaagcttaaggatggcagggtgctaaaagctgacattgttgttgttggtgttgggggaaggcctcttacgacattattcaaaggtcaggttgaagaggagaaaggtggcattaagactgacgcattcttcaaaacaagcgttcctaatgtatatgctgtaggcgatgtggccactttccctttgaaattgtacaaggagttgagaagagttgaacatgttgaccattcacgcaaatctgctgagcaggctgtgaaggccatcaaggcaagtgaggaggggaaaacaactgaggagtatgactaccttccattcttctattctcgctcatttgatctgtcatggcaattctatggcgacaatgttggtgacacagtgatatttggagacaataacccagaatcaccgaagcccaagttcggatcatactggatcaaagatgggaaggtctttggagctttcctggagggtgggactcctgaggaaaacaaggctattgccaaagttgcaagggtgcaacctcctgttcagaatttggatgtgctatcaaaggagggtctttcctttgcttgcaagatatgaaaagtttcttccataggggggaagatggatagcttttgatgctacttcttgtctatgtagattacatgaaagcttttggcttttgttttccttctgttgtaatgttattcttaatctcttatggtttgattggtaaattatgaattatgagctacagatactcgtccatcttgttgctttgaatttaataatttgttacgtttactgctaccttaaaaaaaa

SEQ ID NO: 3399 - DNA, 1475 bp, Euonymus alatus
acttcgcacagaaagaggaacaatttcagaaagctgaaaaggcacggagagagtattcttcagtgttgatctacaattaaaatccatggcggcgaaaattttcaagtacgtgatcctcggtggtggagtggccgctgggtatgcagctagggagtttgctaaactgggggttaagctcggtgagctggcagtcatttctaaggagttggtagctccttatgagcgtcctgctcttagcaaggcttatcttttcccagtgggaactgcaagacttcctgggttccatgtctgcgttggaagtggaggagagagattgcttcctgagtggtacaaggagaaaggaattgagttgatcctgggcacagaaattgtaaaagctgatcttgctgccaagacacttgttagtgctgctggagagacgtttgagtatagcaccttgatcattgcaactggatctacggtgataagattatcagattttggtgtaaaaggcgctgatgccaaaaacatattttacttgagagaaattgatgatgctgataagcttgtggaagctattaaagcaaagaaaaatgggaaggctgtaattgttggagggggatacattggtcttgagcttagtgccgctttgaaaatcaacgatttagatgttactatggtttaccctgagccctggtgcatgcctcgactttttactgctgacatagctgcattttatgagggctattatgctaataagggagtcaagattattaagggaacagttgctgttgggtttactgctgattcagttggagaagtgaaggaggtgcaacttaaagatggcagggtgttggaagctgacatagttattgttggggttgggggcagaccacttacaaccttgttcaaaggttctgttgaagaggagaaaggcggaataaagactgatgcattcttcaaaacaagcgttcctgatgtgtatgctgtgggtgatgttgctacattccctatgaaattgtacaatgatataaggagagttgaacatgtcgatcatgctcgcaaatcagctgagcaagctgtgaaggccatcaaggcaaaggaggagggtaaacaaattgaggagtatgattatcttccattcttctattctcgtgcctttgatctctcatggcaattctacggtgacaatgtgggtgacaccgttctctttggagataacagtccaacgtctccaaagccaaagtttgggtcgtactggattaaagatggaaaggttgttggagcattcctggaaggtgggagtcctgatgaaaacaaagctatagccaaagttgccaggctgaaacctccagttgatagcctagttgagctgagaaaggaaggtctctcttttgcttgtaagatataaagaattcagtggattgctacgtcttttgctgtacttaacaataagattggcttgttattggagtttcatatgagctactttcgtt

SEQ ID NO: 3400 - DNA, 1462 bp, Utricularia gibba
gctgattgatccaatggcggaaaagtttttcaagtacgtgatcatcggcggcggcgtcgctgcggggtatgctgctcgggaattcgcaaagcagggagttaatcctgggactttggccatcatttctaaggaagcggtggccccttatgaacgtcctgcactcagtaaagcgtaccttttccctgagggacctgcaagactcccaggttttcatgtttgcgttggaagtggaggggagaggctccttcctgagtggtactctgaaaaagggatatctttgattttgagcactgaaatagttaaagcagaccttgctacaaagacacttattagtgcagcgggggagacattcaagtatcagatcttgttgatagcaactggttcatcagttattaggttgaccgactttggtgtacaaggtgctgatgctaaaaacatcttttacttgagagagattgaagatgctgatgcactcattgaagggattaaagcaaagaaaaacggtaaagctgtaatcgttggaggtggatatataggtttggagctcagtgcagttttgagaataaacaatgttgatgtcactatggtgtacccggaaccttggtgcatgcctaggttgtttactgcggacatagctgctttttatgaaacatactatgaaaacaagggagttaatattataaagggcacggtggctgttggatttggtacgaatgagaatggggaggtcacagatgtcaaactaaaggatggtagggtgctcgaagccgacattgttgttgttggtgtcggcggaaggccactaactactctattcaaaggccaggttgaagaggaaaagggtggaatcaagactgatgggttcttcaaaacaagcgttcctgatgtatacgctgtgggagacgttgccacattccccttgaaactgtacaacgagcttcgacgagttgagcacgttgatcatgcaaggaagtcagctgaacaggccgttaaggcaattttttctgccgacaccggagcgcagatcgacgagtacgactacctcccctacttctactctcgctccttcgatctgtcatggcagttctacggtgataatgtgggagacactgttctgttcggagacaacagtccaacctctcctactcacaagtttggtacctactggattaaagatgggaaagtcattggagccttcttggaaagtggtacccctgaagaaaacaaggcgattgctaaagttgcaaaactgcagcccccagttgctagcgcagatcaactagctgcagagggtctctcttttgcaagcaaaatctaagctccttttcatgtctgcttctccatgatcaaactcaaggttggcatcctatctacgtgaacagtctcatgtccctatttccagttcaataaaacttgttgtgagtaccaaggtcatgaatccatacactcccactgtcacgct

SEQ ID NO: 3401 - DNA, 1595 bp, Valeriana officinalis
aaaaataacaagtaataagtagaccataagcattacacactttcttcttcttctccaaaatcttcgaaatctcgttttcgagttacgaatcaatcaatggctgagaaagttttcaagtacatcatcgtcggcggcggtgtctccgctggttatgctgcgagggagtttgcaaagcaaggagttaaaccaggcgagctagcgattatttccaaggaggcggtagctccttatgaacgtcccgctcttagcaaggcatatctgtttcccgagggagctgcaagacttccaggctttcatgtttgtgttggtggtgggggtgaaagactccttcctgaatggtatcctcagaacggaatatcgctaatcctcagcactgaaatagtgaaagcagacctttcatcaaagtcactcactagtgcagctggtgaaacctttaaatatgaaattctgatcattgccactggttccacagtttttaggttgactgatttcggagtacaaggagcagatgccaaaaatatatattacttgagggaaattgatgatgcggataaacttgtagaagccattaaaggaaagaaaaatggaaaggctgttattgttggtggaggatatatcggtcttgagctcagcgccgttatgaaaatcaataactatgatgtcacaatggttttccctgaaccttggtgcatgcctaggcttttcactgctgaaattgctgctttttacgagagctactatgctaacaaaggagttaagattatcaaaggaactgtcgctgttggttttaccgctgatgcaaatggagaggtaaaagaagtgaaacttaaggacggtagtgtacttgaagctgatattgttgttgtcggagttgggggaaggcctcttacaactctgttcaaaggacaagttgaagaggagaaaggcggaatcaagactgatgggtttttcaagacaagtgtacccggtgtttatgctgttggtgatgtcgcaacttttccacttaaattgtataatgagatccgaagagttgaacatgttgatcacgcgcgtaaatctgctgaacaagctgttaaggcaatatttgctagtgaacaagagaagacgatcgaagaatacgactacttaccgtatttctactctcgctcctttactctatcgtggcaattctacggtgacaacgtcggtgatgcagtgatcttcggcgacagtaatcccacgtcagaaaatcccaaattcggatcatactgggtcaaagacggtaaagtagtgggcgtgtttttagagaacggaactcccgacgaaaacaaagccatcgctaaagtcgccagagctcaaccacctgctgcaagtttggaccaactcgctcaagacggtttatcatttgccagcaaaatttaaatttccgatacttaattcgaacaataatactaataataaaataatcatcgtatatttatctttttcacgaattttataaggattatataaaaactggttttcttgagctggtatttacactcttactgtacatacgaaatgatttcggttggtttggtggtttatcgatacttttttgctcaaaaaaaacgata

SEQ ID NO: 3402 - DNA, 1659 bp, Populus trichocarpa
aactgctctctttctcttcaaatttcttttcaagaaaaagaatactagaaatcctccccctctcttgcctgctagctagctacctgatctttctttttctagtctgttttttgtgtcttgtgtgtttatttatccatatagtttctttggaagaagtaagtttttagtcagtgttgagctattgatatggaagaagctgttgtggttaacaaaggagatgatcagattcatctgccagcgggttttcggttccatccaacagatgaagagatcataagtcattaccttacagagaaagtgatgaaaagtggtttctgtgcaattgctattggtgaagttgatctcaataagtgtgaaccatgggatctgccgaagaaagcaaagatgggagagaatgaatggtatttcttttgccaaagagataggaaatatccaactggtatgagaactaaccgtgcgactgaatctgggtactggaaggctacaggaaaagataaggaaattcacaaggaaaagaattgccttgttggaatgaagaagacccttgttttctacagagggagagctcctaaaggagagaaaaccaattgggttatgcatgaatataggcttgaaggcaaattctcctactacagcctccccaaagtagcaagggatgaatgggttgtttgtaggattttccataagagcacaggcatgaagaaaacttcaattcatgatctcctaagaatgaactcttttggagatgatttcttggattgctcctcactcccacctctcatggacccccctaattacactagcagcttcagcgatgccgataacaatgagttcaaggcaatgatgacttcaagatcctcagatggaaattacttctccaatactagcatgctcaacaacaatcaaggctttgttcaacctccaaataccaactaccaaacaccaaactcaagttttcaccttcaaactccagcttcaaaccctctttacacctttcaaaccaatcccaatatgcctgtttacttgcagcaaggaaaaagtaccaattcatttccaaactttcaaaactctacgtttggtaacaatggccaaacccttctgagagcattagctgcaggaaataattatggagaagcatctgatcaattggggaaacagtgcaaggttgaacagttctcatctaaccaatctatggtcagcctttcacaggacactggacttagcacagacgtgaacaccacaactgagatatcctccgtcgtatcgaagcaagaaataggaagccacaatgagttttacgaaagtcttgaggatccattagctggtcccattgcagattacatgtgggattactgaagattatagagaatatatatgttcgctttgtttatttgttctatagattcttaggatatatatatatgtaaccagaaaaaaacagaagaaaaacctcaggatacataaatttgcaacagttttctctccactagttacgtatcttgattagagcttgaaaagttttctttggattgatataaatactttgtatagattaattagttcatggtgtccatccttttacggatttcatttttatttgattggtagacaccaaaggaatgatgccatgaatatatataaaagcttcatgtacatctt

SEQ ID NO: 3403 - DNA, 1719 bp, Populus trichocarpa
aactgctctctttctcttcaaatttcttttcaagaaaaagaatactagaaatcctccccctctcttgcctgctagctagctacctgatctttctttttctagtctgttttttgtgtcttgtgtgtttatttatccatatagtttctttggaagaagtaagtttttagtcagtgttgagctattgatatggaagaagctgttgtggttaacaaaggagatgatcagattcatctgccagcgggttttcggttccatccaacagatgaagagatcataagtcattaccttacagagaaggtgatgaaaagtggtttctgtgcaattgctattggtgaagttgatctcaataagtgtgaaccatgggatctgccgaagaaagcaaagatgggagagaatgaatggtatttcttttgccaaagagataggaaatatccaactggtatgagaactaaccgtgcgactgaatctgggtactggaaggctacaggaaaagataaggaaattcacaaggaaaagaattgccttgttggaatgaagaagacccttgttttctacagagggagagctcctaaaggagagaaaaccaattgggttatgcatgaatataggcttgaaggcaaattctcctactacagcctccccaaagtagcaagggatgaatgggttgtttgtaggattttccataagagcacaggcatgaagaaaacttcaattcatgatctcctaagaatgaactcttttggagatgatttcttggattgctcctcactcccacctctcatggacccccctaattacactagcagcttcagcgatgccgataacaatgagttcaaggcaatgatgacttcaagatcctcagatggaaattgcttctccaatactagcatgctcaacaacaatcaaggctttgttcaacctccaaataccaactaccaaacaccaaactcaagttttcaccttcaaactccagcttcaaaccctctttacacctttcaaaccaatcccaatatgcctgtttacttgcagcaaggaaaaagtaccaattcatttccaaactttcaaaactctacgtttggtaacaatggccaaacccttctgagagcattagctgcaggaaataattatggagaagcatctgatcaattggggaaacagtgcaaggttgaacagttctcatctaaccaatctatggtcagcctttcacaggacactggacttagcacagacgtgaacaccacaactgagatatcctccgtcgtatcgaagcaagaaataggaagccacaatgagttttacgaaagtcttgaggatccattagctggtcccattgcagattacatgtgggattactgaagattatagagaatatatatgttcgctttgtttatttgttctatagattcttaggatatatatatatgtaaccagaaaaaaacagaagaaaaacctcaggatacataaatttgcaacagttttctctccactagttacgtatcttgattagagcttgaaaagttttctttggattgatataaatactttgtatagattaattagttcatggtgtccatccttttacggatttcatttttatttgattggtagacaccaaaggaatgatgccatgaatatatataaaagcttcatgtacatctttatattagtgcattaatattctttcgggttttctttattttttctgtttatactttgttc

SEQ ID NO: 3404 - DNA, 2189 bp, Theobroma cacao
agggttttaaagagccgggttgtccaattttttggacaacccgacgagggggttctggcacccctggagttggtggccagaacccccatcccgcgtaatgggtgggggatgggacggcgaagggatggctgggcgtacgcccagccatcccgattttttttattttttattttattttatttattttatttatatttatttattttattattatttttttattttatgtgtctacagttcccatgctgaaaattcttattacaaaaagcttgaaagctgacactagttgccaaggtgggggactctacttttgactttcctggttgcccatgtgatcaaatttaattcaattctgtcttatgtataccagatataaaatcacaatgttcttctacccgatggattcacacttcagaactcctggaacaaaagaaaaatataatcactgagcgacaaaagaagtgagaatagatcctcacccctattctattctatcagtcaacgttcaaatttccagttcccagaagtacaaccagcaaaggccttgaacctgtagaaatggccactcaatcacttttccttgcaaacccaccttccatcttattagcttcatcaagcatttacatcaaaggagaggaacaatggcttggatgccttccactaaagagaaaacaaatgcacataaggctttcaaatggctatagagtaagagcaagatcagctttaaatgctgattctacagcaatagaaattcctcgtcagtggtacaatctgatagcagatctatctgtaaagcctcctcctccattacatcccaaaacttgtgaaccagtcaaaccagaagatttgtctcctttatttcctgatgagttaattaagcaggaggctaccaatgaaaggttcatagatattcctgatgaagttcttgatatttacagactctggcgcccaacccctttaattagagccaagaggttggagaagcttctgaatacacccgctagaatttactacaagtatgaaggtgtcagccctgctggatcacacaaacccaacacagcagttccacaagttttctacaacgcacagcaagggatcaagaacgttgtgacagaaactggtgctggccagtggggtagttcactagccttcgcatgcagcttatttggtctcggatgtgaagtgtggcaagttcgtgcttcttatgatcagaaaccatatcggaaattgatgatgcaaacatggggtgcaaaagttcatccctctccatctgacattactgaggcaggtcgtaaaatcctgcaaatggatccatcaagcccaggaagtttagggatagctatttcagaagctgtagaggttgctgccacaaatgacgataccaagtactgtctggggagtgttctcaatcatgttttgctacaccaaacggtgataggggaagagtgcattagacaaatggaagccattggtgaaaccccagacttgatcatagggtgtactggtggtgggtccaattttgcaggacttagtttcccgtttataagagaaaagctcagtggaaaaatcaaccctgttattagagcagttgaacctacagcttgtccttcattaacaaaaggtgtctatgcatatgattttggtgacacagcagggatgactccattgatgaagatgcatacactagggcatgacttcattccagacccaattcatgccgggggcttacgttaccatggtatggcaccattgatttcacatgtctacgaattaggattcgttgaagcagtttcaattccccaaaacgagtgctttcaaggtgcaatacagtttgctcgatctgaagggctaattccagctcctgagccaactcatgcaattgctgccaccatcagggaagcgctccgctgtagggcgactggagaaccaaaggttattctcatggcaatgtgtgggcatggccattttgacttgacatcttatgagaagtatttgcagggagacatggttgacctgtcatttgaggaggagaaaataaaagaatcattagccaaaattcctcgagtaactggcatgagctagtggtacatttatactgaaatgtttaggttgaattccagactgatggaccattaataaattttgttgatgtagatttcatgatttgtgaattaagtgttcacgagttt

SEQ ID NO: 3405 - DNA, 3031 bp, Manihot esculenta
atgaaaattgaagaagtagtcgaggtggtttccgcctcacctggacggagatgccgtacagaatctttgacggagagaaacatgtatgtgacaaggcctctatccttgtacaggaaattcccaagtgccctttctgcagaaccaccagaaggtccatacacaggctatctagtgattacagatgaagaatctgaaacacaggatacttattgttttggtgcctgtaaaaagaggagagttaaaaggcttccatttcctcaggacaatattttaaatgtaattcattcatctgagtaccatgagactatattagcaagaaagaaagtttggtttctcccagttcttgatcagcctctgtcttctaactgctactatgtcatcaaagctaagggcagatataaagggcaggcgttcacatgttcaagggatgatgacatgggtttactatgttgcctcaagaaagttataaaagatgtaaaaccaaagccgttggatcccagaaacatataccagcaattcaagattcatcgtcattatggaaggagtttcttcgccaagtctcttgctccttatggttatcctccagaattgctgagaaataaaggatgggaagttagaatctcatcatcatcaactcacaaatttcaaccaagaattgacgatgctctaggccttgatgaatctctcaggacacaacttccaagcttcaattttccaatatccagcaagagttcatcctctgttattgttggaacatggtactgcccatttgtgttcataagggaagaagccagaataagagaacaaatgaagagatcaatgttatataagatgacccttgagcagtactgggaggaaattttctcgtgtgataatgtcaacaatgagactaacactgtgattgttgttgatacaaatgtgcaaagagaagtagataaggtgtttgatatggaagctgagaagggcgagagaactgggcgtggagcgttcatttggtacagagcagttgggaacagaaacaggaggatttgcagagggtttagagtgggtttaagctttgcaattgcagagaaaatgaaatgggtgttggaggcaggaggatgggctgatgggcctgagaggactgtgagagtagggggaagaattgaaattggaagcgaaggcgatggacttcagatacgcagccaagaccggaaggaaggatctctggaaacctctgaaatgattcctctgtccccttcctctgcgatctcatttcccatttcaagccgatcaaacaccagtatcagaggtgagaagcaatggcttggttgttttttaatgaaaacaaagccaacgtgtttaaggctttcaaatgggtttagagcaagagccaaagctgcttcaaatgctaattggaaagcaattgatattcctccacaatggtacaatctcatttcagatcttcctgtgaaacctcctcctcaactgcatccaaaaacttttgaacctgtcaaacctgaggatttagctgctttgtttcctgatgagttgattaagcaggaagcaaccaatgaaaaattcatagatatcccagaagaagttcttgacatttacagcctttggcgcccaactccattaattagggccaagaggttggagaaacttctcaatacaccagccaaaatttactataaatatgaaggtgtgagcccagctggatcacacaaacctaacactgcagtcccacaagttttttataatgcaagacaaggtgttaagaatgttgtgacagaaacgggtgctggccaatggggaagttcgctggcctttgcgtgcagcttatttggtcttgactgtgaggtgtggcaggtacgagcttcttatgatcagaaaccatatcgtagattgatgatggaaacttggggtgcaaaagtacatccatctccatcaagcattactcatgcaggtagagaaatccttcagaaggatccttcaagcccaggaagtttaggaatagctatttcagaagctgttgaggttgcagcaagaaatactgataccaagtattgcttgggcagtgtacttaatcatgttttgttacaccagaccattataggtgaggagtgcctaaagcaaatggaagctgtcggtgaaactcctgatgtgatcataggatgtactggtggcggctccaactttgcgggactcagtttcccattcattagagagaagctcagtgggaaaatcaatcctgtcataagagcagttgaacctacagcatgcccttcgctaacaaagggtgtttatgcatatgattatggtgatacagctgggatgactccattaatgaagatgcatacacttgggcatgacttcattcctgatcctattcatgctgggggcttgcgttaccatggtatggcaccattgatttcacatgtgtatgaattgggttttatggaagcaattgcaattcctcagaccgagtgctttcaagctgccttacaatttgctagatctgaagggctaatacctgcaccagaaccgactcatgcaattgctgccaccatcagggaggctctccattgtagagaaactggagaagcaaaggttattctcatggcaatgtgtggacatggccattttgacctaacatcttacgagaagtatttgcgaggaaatatggttgacttgtcatttgaagaggagaaaatacaggcatcattagccagagttcctcaggtcaaggcatgaagtgcagtaaacatgaaaactgctatctaaaatgaactttggagtgaaaaaaggattagaagttgacaaagttccataaacctgatgcctgtttagaattaagaataataattagaatatcatgagggtttagaaatgttttaggacttggtctttgaattctacaagcactaaaatttgtggttttgtttggacaagttcttggttatcatgaacgaagattccttgaaagcttgatagaattacaaaaaccacattgtgccagcaataatataacccggagcaaatcttctct

SEQ ID NO: 3406 - DNA, 2954 bp, Citrus clementina
acacacacgcacgcacgagggtccatgttaacttaagctttaagccatgtatgttacaaggcctctttccttgtacagaaattcgcccagcactctttcagcagagctaccaccacaagagggtccatactcgggtattttattgattacagatgaagaagcagaagcagaagatacattttgctggggaacatgtaaacttaggggagtaaaaagattgccgtttcctcaagacaagatactgacagttgttcattcaaatgattatcaagaaactagtgttactaaagtttggttcctcccagttctcgatcaaccgttgtcatccaatcggtactatgttattagagctaaaggcaaatacaaagggaaaacttgcaaaagttcaagggagacagaggtgggtatgtgttgcttcagcaatgtaataaaagacatgaaaccaaagccatttgatttcagaaacatataccagcagttcaaggttcaccgctaccaccgacactcgttcttcgccacgtcagcagccaccaccgacggccttcctccaaagtttctccgcaagaaaggctgggagcttcgcagctcctcctcatcatcaagatcatttctacgccgatggaataatgataaactcagcgaagccctgggcctcgatatctctcttcgaacacaactcccaagcttaaacttccccatcaccaacaagcgttcgagtgttagcattgtagggaaatggtactgcccatttgttttcgttagagaagaatcaagaatcagacaccaaatgagaaagtcggtgttgtataagatgaccctccagcagtggtgggagaaaatattctcatgtgtgaacaatggaggggatgatgctaatgaagtgaatgtgaatgtgaatgtacaaagggaagcgagttatgtttatggcaagcaaggtgagagggatgacaggggtaggcatttagggttcgtgggttatagggtttgtgataggaaccgtagacggcgaaggtggagtagaggtggtggtggtggtgttgtggggttgagtttggccattgacgagaagatgaggtggctgcaagaggaaggagggtgggttcgtgggagagaaaaggaattgagagtctcgagagttgaagaaattgctggtgaaaacgggtggcaaagatttgcttctcaggacaactgcagaaactttctgaaaatggctgcacaatcacttttatatgcaaatttaaacccactgctcatttccgggtcaacaggaaaccagatcaaagctcgggaacaatttcttgggtcttttccattgaaggcaaagactacacgcccgaggctttcaaatggctgtagagcaagagcagctgcgaatgctgttgcgttaccggttgaaattccttgtcagtggtacaatgtgattgcagacctatcagtgaaacctcctcctccgttgcatcccaaaacttttgaacctgtcaaacctgaagatttgtctcctctattccctgatgagttgattaagcaagaggcaagcactgacaggttcatagatatccctgatgaagttcttgatatatacaggctttggcgtccaacgcctctaataagagccaagaggttggagaagattctagatacgcccgccagaatttactacaaatatgaaggtgtcagcccagctggatctcacaaacctaacactgcagttccacaagtgtattataatgcacaagaaggcataaaaaatgttgtaactgaaaccggtgctggccagtgggggagttcactggccttcgcatgcagcttatttggtctcaactgtgaggtatggcaggtccgtgcttcttatgatcagaaaccatatcgaagattaatgatgcagacttggggtgcaaaagtacatccatctccatctgacatcactgaagtaggaaggaaaattctgcaaatggatccatcaagcccgggaagtttaggaatagccatttcagaagctgcagaggttgctgctgcaaatgctgatacgaagtactgcctgggcagcgttctcaatcatgtcttgctacaccagactgtcataggagaagagtgtataaagcagatggaggctgtaggagaaaccccagacatcatcatagggtgtaccggtggtggatccaattttggtgggctcagcttcccattcatccgagagaaactcaatggaaaaatcaaccctgtaataagagcagttgaacctactgcatgtccttctctaacaaaaggcgtgtatgcttatgattttggtgataccgcagggatgactccattgatgaagatgcatacacttgggcacgacttcatccccgatccaattcatgctggaggattacgttaccatggtatggcaccattattatcacatgtctatgaattaggcctcatggaagcaatttcaattcctcagactgagtgctttcaaggtgctatacaatttgctagaactgaagggataataccggcgccagaaccgactcatgcaattgcagccaccatcagggaagccctccgttgtaaggaaactggagaagcaaaggttattctgacggcaatgtgtggccatggccattttgaccttgcttcttatgagaattacttgcaaggaaagatggttgacttgtcgtttgaagagaagaaaatacaagagtcactggacaaaattcctcgagtgattgcatgaagtgaagaacaaatgactgatacacaatgtcggatgaaattcagaacagaaagatcataattttttctcgttgtacttccgttgttcattatccgagaaactttggggagtttgtataataaaatagattccaagttctgtaatcaaatgcattggtataataaaattggtggtgaatgttttgtaataccataaaatataataaaatttatatgatctcaaattttatttt

SEQ ID NO: 3407 - DNA, 1930 bp, Eucalyptus grandis
ccggtgtcatagaggcagagacgactttctttctctttttttttagcaaagaggcagagacgactttgattatagcacgattgttcactgtccttctgctttatggctctggacatttgacccgccgcagttggtccgtcacggtgaggaaaaaagagaatggcttcctgctctctcttgtctgcagattcagctgcagccatcttctgttcaagaacccaaagtaatggagagaagacagggcaagggagtttcgtgctgaggacgaaattaaaccatcaaagggcatatggctctcgtgctagcgtgcgggcatcgctgagcgctagcttgaagccaactgaaattcctcatcaatggtacaatttagtcgctgatctacccgttaaacctcctccgcccttgaatcccaggacatttcagccggttaaacccgaagatttgtcccctcttctccctgatgagttgatcaagcaggaagctagtctcgacagatttatcgatattcctgacgaagttcgtgacatttaccagctttggcgcccgacgcctttaataagagcgaagagattggagaagcttctcgacactcctgccaggatctactacaagtatgaaggtggtagccctgctgggtcacacaaaccaaacacatctgtgcctcaagtctggtataatgcacaggaaggcgtcaagaaggtcgtaactgaaaccggtgctggccagtgggggagtgccttggccttctcatgcagcttattcggcctcgactgtgaggtatggcaagtgcgtgcttcatatgaccaaaaaccatatcgtagattgatgatgcagacttggggcgcaaaagtacacccatctccctcagaaattactgaggccggtcgcaaaatcctgcaagaagatccatcaagcccggggagtttaggcatagctatttcagaagctgtagaagtggcagctaataatgcagacaccaagtactgcctcggaagtgtcctcaaccatgttctgctacaccagacggtcatcggcgaggagtgcataaaacaaatggaggcaataggcgaaaccccagatatcattgtagggtgtactgggggtgggtccaattttgcaggactcagtttcccattcattagagagaagctcaagggaaatatcaaacccatcataagagccgtcgaaccaacagcatgtccttcactaacaaaaggcgtgtatgcatatgattatggtgatacagcggggatgaccccattgatgaagatgcatactctggggcacgacttcattcccgatcctatccatgctggagggttgcgttaccacggtatggcaccactgatatctcatgtctatgagttgggtctcatggaagcaattgccattccccaaattgaatgctttcaaggtgccatacaatttgccaggtctgaagggataataccagcaccagaaccgactcatgccattgccgcaacaataagggaagccctcttgtgcagggagtctggagaatccaaggttatactcacggcaatgtgcgggcacggccacttcgacctggcagcttacgagaagtatctgcagggagatatggttgacttgtcattttcggaagagaaaatacatgcatccttagctaaagtccctcgagtgattagagactagggaggacattagttggtagtattatactgattctcaagtagctgtagtttctcagcagagtcgcagagtgatggttcagtggctcaaatggtcagtgcaataatcttttggcatctgactacttgacgtcaattcgagattgtatcggtccccctttgcaaacttacgacaagcatatcgcatgtttttttggctactgtaatagaattttatggatattaccttcacaacaatgaaattccattttcaccgggaa

SEQ ID NO: 3408 - DNA, 1544 bp, Citrus sinensis
ttgaaggcaaagactacacgcccgaggctttcaaatggctgtagagtaagagcagctgcgactgctgttgcgttaccggttgaaattccttgtcagtggtacaatgtgattgcagacctatcagtgaaacctcctcctccgttgcatcccaaaacttttgaacctgtcaaacctgaagatttgtctcctctattccctgatgagttgattaagcaagaggcaagcactgacaggttcatagatatccctgatgaagttcttgatatatacaggctttggcgtccaacgcctctaataagagccaagaggttggagaagattctagatacgcccgccagaatttactacaaatatgaaggtgtcagcccagctggatctcacaaacctaacactgcagttccacaagtgtattataatgcacaagaaggcataaaaaatgttgtaactgaaaccggtgctggccagtgggggagttcactggccttcgcatgcagcttatttggtctcaactgtgaggtatggcaggtccgtgcttcttatgatcagaaaccatatcgaagattaatgatgcagacttggggtgcaaaagtacatccatctccatctgacatcactgaagcaggaaggaaaattctgcaaatggatccatcaagcccgggaagtttaggaatagccatttcagaagctgcagaggttgctgctgcaaatgctgatacgaagtattgcctgggcagcgttctcaatcatgtcttgctacaccagactgtcataggagaagagtgtataaagcagatggaggctgtaggagaaaccccagacatcatcatagggtgtaccggtggtggatccaattttggcgggctcagcttcccattcatccgagagaaactcaatggaaaaatcaaccctgtaataagagcagttgaacctactgcatgtccttctctaacaaaaggcgtgtatgcttatgattttggtgataccgcagggatgactccattgatgaagatgcatacacttgggcacgacttcattcctgatccaattcatgctggaggattacgttaccatggtatggcaccattattatcacatgtctatgaattaggtctcatggaagcaatttcaattcctcagaccgagtgctttcaaggtgctatacaatttgctagaactgaagggataataccagcgccagaaccgactcatgcaattgcagccaccatcagggaagccctccgttgtaaggaaactggagaagcaaaggttattctgacggcaatgtgtggccatggccattttgaccttgcttcttatgagaagtacttgcaaggaaagatggttgacttgtcgtttgacgagaagaaaatacaagaggctctggacaaaattcctcaagtgattgcatgaagtgaagaaaaatgactgatgcacaatgtcggatgaaattcagaacagaaagatcatatttttttctcattgtacttccgttgttcattatctgagaaactttggggagtttgtataataaaatagattccaag

SEQ ID NO: 3409 - DNA, 2219 bp, Tabernaemontana elegans
cactgttgtactttcttgtcagactaatgcatatgggtttcgtattctttcctgcgggaatgtactcttcagcgcttgttgggctgtagcaacgagttgtgccgcagcttccttcttgaacggtcaaatttccaatcctttggctaactccaaagtcctggttccatcgattgtggtagtattaaatacgcatatcatttcagctgccacctgtctgcttcggccttcaatgccttcataaattggggatcctctgtgttgttttcggccttgaagttgaaccaagtcatctcagctttcttgcagaagaatggcgcagtctctgtttcttgccacaagtgtatgctccaaaattaccagcagaggtgaagagcagttgtttggaggtccaaaattaaagataaagacaagcaatctcaaaatttcatctggtcgcaaagtaggaattactgcagcctataatactaatacaaaggcgaccgaaattcctcatcaatggtataatatagttgcggatcttccagttaaacctcctcctcctctgcatccgaagactttcgaaccggtgaaaccagaggatttatctcctctgtttccggaggagttaattaaacaagaggctagctacgagcagtacattgatatcccagaagaggttttagatatttataaactttggcgtccaactcctctaatcagagcgaagaggttggagaaattacttgatacaccagcaagaatttattacaaatatgaaggtgttagcccagctggatcacataaagccaacacttctgtccctcaggtctggtacaatgcacaggaaggtgttaaaaatgtagttacagaaactggtgcaggccaatggggaagtgctctggcatttgcttgcagcttatttggtctcaattgtgaggtatggcaagttcgtgcctcttatgatcaaaaaccatatcgaagactgatgatgcagacttggggagcgaaagtccatccttcaccttctactattaccgatgctggtcagaaaattctccaattggatccatcaagcccaggaagtctaggaatagctatttcagaggctgtggaggttgctgctaaaaatgccaataccaagtattgtctaggaagtgttctcaaccatgtcctactacatcaaactgtcataggtgaggagtgtatcaagcagatggaggctataggagagacaccagatgtgatcatagggtgtacaggaggtggatccaactttgctggactcacttttccatttattagggagaaattcaatgggaaaatcaatcctcatattaaggctgttgaacctacagcatgtccttcattgacaaggggtgtctatgcttatgattatggtgatacagcaggcatgactcctctgatgaaaatgcatacgctagggcatgacttcatacctgaccctattcattctggaggtttgcgttaccatggaatggctccattaatctcacatgtctatgaattgggcttcatggaggccattgcaattccgcaaactgaatgttttcagggtgcaatccaatttgctaggtctgaggggttgataccagcacctgaacccactcatgccatagctgccacaataagggaagctcttagatgtagagaaacgggggagtccaaagtaattctcatggcaatgtgtggacatggccattttgatttgccatcttatgagaagtatttgcagggagcaatggttgatttggaattctcagaggataaaatgcaggcatcactgggtaaaattcctcagctggtcgcctaagcctatgggcagttatgcttagatatctcaagcacttcttatcatttcacgatgtcttcttgaaacctgtgtacccactagaacagcagcaataaggccacctacagctcaggacttgcatcagtttggagagcagaaggaagaatattagagcttcagttcgtggagggagttttcttattcatatgttctgtttaatatgactgaaaacaacaatcaagcaaacaaaaaatagatagtccgttactttgggttaggttaaccttacgtaacaatggttggttagggtacgtttcgttacgaaacctaatttagtttagtttaattaaaattaagttgtttagtttttaatttaacttaggttaggtggttcgggtcggtcgttcttctaacggacgacacacgggag

SEQ ID NO: 3410 - DNA, 1833 bp, Vitis vinifera
ctcaagagcagccgtcccaatagctttgtagttggaaaagtccctagtccgtaatctctctctttcttgaaggttgcggagagccggaagtattgaatccatactcatcttctagacatggttcagtccctactctctgcaagtttactttccatttcttctccaagcttcagcatcaaagttggggagcaagggaagcctatgctcctgagggcttcacctaggtgcagagtcagagcaagagctgcatcttccaaggctgggcctcaagcagttgaaattcctcatcagtggtacaatttaattgcagaccttccagttaaacctcctccagctctgcatccccagactcaggaaccaatcaaacctgaagatttgtctcccctgtttccagatgaattgatcaagcaagaggctagcactgacaggttcattgcaatcccagaggaagttattgatgtttatcggctttggcgtccaacacctctgatcagagccaagaggttggagaagcttcttgacacacctgccaggatttattacaagtatgaaggtgttagcccagctggatcccacaaacccaacactgcagtcccacaagtctggtataatgcacaagaaggcgtcaagagtgttactactgaaaccggtgctggccaatggggaagttcactggcctttgcttgcagcttatttggccttgactgtgaagtgtggcaagttcgcgcttcttatgatcagaaaccatatcgtaatctgatgatgcaaacttggggtgcaaaagtgcatccatctccatctagcatcactgaggcaggccgaaaaatccttcagatgaatccatcaagcccaggcagtttaggaatagctatttcagaggctgtggaggttgcagccgccaatgctgataccaagtactgtctgggaagtgttctcaatcatgttttgctacaccagaccgttataggcgaggagtgcataaaacagatggaagccatcggtgagaccccagatgtgatcattgggtgtactggtggtggttctaattttggtgggctcacttttccttttattagagagaagctcaaagggagaatcaaccctcttataagggcagttgaacctacagcatgcccttcattaacaaaaggtgtatatgcctatgattatggcgatacagcaggaatgactcctttgatgaagatgcatacacttgggcatgacttcgttcctgatcctattcatgcaggcggtttgcgttaccatggtatggcaccattgctttcacatgtctatgaactgggtttcatggaagcaatctcaattcctcagattgaatgctttcaaggtgctatacaatttgctaggacagaaggattaataccagcaccggagccaactcatgccattgctgctaccatcagggaagctctccattgcagagagactggagaatcaaaggtcattctcacggcaatgtgcggacacggccattttgaccttccagcctatgagaagtatttgcaaggaaatatggttgatttgtcatttgaggaggagaagataaaagcatccctagccaacatccctcaagtggtggcctgaggtgaagccatttactacattgctcaacaggttgatgagttttgaattgcagatatttaagcatttcagctgcacattacaaaaataacttgagctgtcaatgaattccttaaagccttgattttgactcaagcaaacatgctagtattaaggttttgtgtgaaaggaacaccttcaattagtaaatcatatcattaagccacgagtattttgaaaatagcatttatc

SEQ ID NO: 3411 - DNA, 2043 bp, Gossypium hirsutum
gtgcgatccaaagcatagaatatagtgattcagaatcctcatcaagtgagaaaattgtagtcatttctgattctataaatcatctcctaaaacagaaaatcaacagactaaaatacatacagacaatattttgtccccttctttcttctgttctgttctgttctgctccggtccgtctgatttgttagtgtattctatctgtccacgtttccagtctcaaactagaaaatggccacccactcagttttcaatccaaacccagtttccacctttacttcgtccaccatttccactaaaggagacaagcaatggcctggatatcttatgcttaatggagaacaaatgcatgtaaggctttccaacggttatagagcaagagcaagatcagttataaatgtcaattctacagcaatcgaaattcctcatcaatggtacaatctggttgcagatctagctataaagcctccgcctccattgcatcccaaaacatttgaaccggttaaaccagaagatttgtctcctttatttgccgatgaattaattaagcaagaggttaccgatgaaaggttcatagatattccagaagaagttattgacgtatacagactttggcgcccgacccctttaatcagagccaagaggttggagaagcttcttgatacacctgctcggatttattacaagtacgaaggtgtcagccctgccggatcgcataagccgaacactgcagttccgcaagtttactacaatgcacagcaaggggtcaagaatgtcgtgactgaaactggtgctggccaatggggtagttcattggcctttgcctgcagcttattcggtcttggctgtgaagtgtggcaagttcgtgcttcttatgatcagaaaccatatcggaaattgatgatgcaaacatggggtgcaaaggttcatccttctccatctgacattacccacgcaggtcgtaaaatacttcaaatggatccttctagccccggaagtttagggatagctatttcagaagctgtagagattgccgctgcaaatgatgataccaagtattgcctggggagtgttctaaatcatgttttgctacatcaaaccgtgataggagaggagtgtattcgacaaatggaggccatcggtgaaaccccggacttaatcatcgggtgtaccggcggtggctcgaatttcgcaggacttagtttcccatttatcagagaaaagctcaagggaaaaatcaaccctgttatacgagcagtcgaacctgcggcttgtccttcattaacaaaaggtgtctatgcatacgattttggtgatactgctgggatgactccattgatgaagatgcatacactggggcatgatttcattccggatccaattcatgccggtggcttacgttaccatggtatggcacctttgatttcgcacgtccatgaattaggcttcatggaagcaatttcgatcccgcaaactgagtgctttcagggcgcaatacgattcgcgcgatctgaagggataattccagctcccgagccaactcatgctattgcagctaccattcgggaagctgttcgctgcagagagagtggggaatcaaaggtgatattgatggcaatgtgtgggcatggccactttgatctggcttcttatgagaagtatttgcagggaagtttagttgatttatcatttgaagaggagaaaattaaagaatcattggccaaagttcctcaagtgcaggcataggttaaagattcatttattttgttgtgagatttaaaataatttctgaaaaataagctacctctactttcataaaatgtgaaaatttaaataaaagtaaaataaattatcttttggatatttgaattccttaaatatataattttaatgaataaagtttattttagaaaatttgcataattacccataaaataatggaatttgcagattctagtgatagctttgagaagtgattgtatgaaactataattctatgtcatctatatcattttccaataagagaataacaagtaagattgaaaa

SEQ ID NO: 3412 - DNA, 2089 bp, Gossypium raimondii
attgcagcgcctaaattgactgttcaaaacgggttatttatgcccgtccacatgaagccatgtgattgacttttaattcgaccagtcaatccaaagcatagaatatagtgattcagaatcctcatcaagtgagaaaattgtagtcatttctgattctataaatcatctcctaaaacagaaaatcaacagactaaaatacatacaaacaatattttgtccccttctttctgctgttctgttctgctccggtccgtctgatttggtagtgtattctatctgtccacgtttccagtctcaaactagaaaatggccacccactcagttttcaatccaaacccagtttccacctttacttcgtccaccatttccactaaaggagacaagcaatggcctggatatcttatgcttaatggaaaacaaatgcatgtaaggctttccaacggttatagagcaagagcaagatcagctataaatgtcaattctacagcaatcgaaattcctcatcaatggtacaatctggttgcagatctagctataaagcctccgcctccattgcatcccaaaacatttgaaccggttaaaccagaagatttgtctcctttatttgccgatgaattaattaagcaagaggttaccgatgaaaggttcatagatattccagaagaagttattgacgtatacagactttggcgcccgacccctttaatcagagccaagaggttggagaagcttcttgatacacctgctcggatttattacaagtatgaaggtgtcagccctgccggatcgcataagccgaacactgcagttccgcaagtttactacaacgcacagcaaggggtcaagaatgtcgtgactgaaactggtgctggccaatggggtagttcattggcctttgcctgcagcttattcggtcttggctgtgaagtgtggcaagttcgtgcttcttatgatcagaaaccatatcggaaattgatgatgcaaacatggggtgcaaaggttcatccttctccatctgacattacccacgcaggtcgtaaaatacttcaaatggatccttctagccccggaagtttagggatagctatttcagaagctgtagagattgccgctgcaaatgatgataccaagtattgcctggggagtgttctaaatcatgttttgctacatcaaaccgtgataggagaggagtgtattcgacaaatggaggccatcggtgaaaccccggacttaatcatcgggtgtaccggcggtggctcgaatttcgcaggacttagtttcccatttatcagagaaaagctcaagggaaaaatcaaccctgttatacgagcagtcgaacctgcggcttgtccttcattaacaaaaggtgtctatgcatacgattttggtgatactgctgggatgactccattgatgaagatgcatacactggggcatgatttcattccggatccaattcatgccggtggcttacgttaccatggtatggcacctttgatttcgcacgtccatgaattaggcttcatggaagcaatttcgatcccgcaaactgagtgctttcagggcgcaatacgattcgcgcgatctgaagggataattccagctcccgagccaactcatgctattgcagctaccattcgggaagctgttcgctgcagagagagtggggaatcaaaggtgatattgatggcaatgtgtgggcatggccactttgatctggcttcttatgagaagtatttgcagggaagtttagttgatttatcatttgaagaggagaaaattaaagaatcattggccaaagttcctcaagtgcaggcataggttaaagattcatattttgttgtgagatttaactttcataaaatgtgaaaatttaaataaaagtaaaataaattatctttcggatatttgaattccttaaatatataattttaatgaataaagtttattttagaaaatttgcataattacccataaaataatggaatttgcagattctagtgatagctttgagaagtgattgtatgaaactataattctacgtcatctatatcattttccaataagagaataacaagtaagattgaaa

SEQ ID NO: 3413 - DNA, 2598 bp, Prunus persica
atgtatgtaacaaggcctctttcgatgtaccggaaatctccaagcaccctttccataaagccacctgatgctccacattcaggttatgtggtgatcacagatgaagaggcagagtcaaaaaacacatcttgttggggcctttgcaagcgtgggaaagtgaaaaaactacccttcccacaggacaagattctgaccattgtttatacatccgagtaccaagaggcaaccgcgacgaaggtctggttcatcccagttcttgatcaacctctgtcttctaactgctactatgttatcagagcaaatggcaggcacaaagggaaagcatgcagatgttctagagagagggacatgaccaactgctgcattagaggtttcttgagagacaaaaaacctaaggttttaaattttagagacatataccaagaagttaagattcatcgccatcaaggtggtggtttttttgccgagtctgtagctcctgatggtgttcctccaaaattcctaaagaaaaaaggatggaaagtgcgtagctcaagtatgtaccggaatcaattaactgatgctttaggcctcgacgcctccctccggtctcgtcttccggacttcaattttcccatatttaaaaagtgttcggcttctagtgttgtggggagatggtactgtccatttgcatttgtgagagagaaagcaaccataagacaccagatgaagaagtccaagttttacagaataactcttgagcaatggtgggaagagatttactctcttgggaatgttaacaatgaaggaaatgttgtgaatgtgagtgtagatgtgcaaagggaagtggctttggtatctgccacagaagccgtgaaggacgataggaatggccgtactgggttcacctggttcaaagcttataacccacgtagcaagaaagtggtgagtgtaggtttgagttcagcaattgttcagaatatgagatgggttttggaggcaggaggatgggttaatggggatgaaatggatgtgagagtggagagggtagaagagattacaggtgagaataggtggacgaagtttggctgttatgttatggtggagagtttctccttgagaagaatggatggaagtttggcttggagatctgattttaggcacactgataagattcgatttgaggagaaatggcttggatttactgcacttgatagaaagccaacgcatctgaaactttcaaatggatgtagagcaagagcagctctcaatgctgatccaagatcaattgaaatccctcgtcaatggtacaacctgattgcagatcttcctgtaaaacctcctcctccattgcatcccaagacctttgaaccggtaaaacccaaggatttgtctcctctctttcctgatgagttgattaagcaggaggcaagcaacgaaagattcatagatattccagatgaagttcgtgatgtatacaggctttggcgcccgtcccctctcattagggccaagaggttggagaagcttcttgacacgcctgcaagaatttactacaaatatgaaggtgtcagccctgctggatcacacaagccgaacactgcagttccacaagtgtggtataatgcacagcaaggcatcaagaaggttgtgacagaaacaggagctggtcaatggggaagtgcattggcttttgcatgcagcttatttggtcttgagtgtgaggtgtggcaagtgcgagcttcttatgatcaaaaaccatatcgcagattgatgatgcaaacttggggtgcaaaggtacacccatctccatctaacttaaccgaagcaggtagaaaaatcctacaaatggatccatccagcccaggaagtttagggatagctatatctgaagccgttgagattgcagccatgaatgctgatactaaatactgtctcggaagtgttctcaatcatgttttgcatcaccagacagtaataggtgaggagtgcctaaaacaaatggaggcgataggtgaaaccccagactttatcataggatgtaccggcggaggatccaattttgcagggctaagtttcccattcatcagggagaagctgaaagggaaaatgaatcctgtaataagagcagttgaacctgcagcatgcccttcactaactaaaggggtatacacatatgattatggtgatacagcagggatgaccccactaatgaagatgcatacactcgggcacgacttcatccctgacccaattcatgctggaggattgcgctaccatgggatggcaccattgatttcacatgtgtacgaactgggttacatggaagcaattgcaattccccagattgagtgctttgaaggtgctatacaatttgctagatcagaaggattgataccagcgccggagcctactcatgccatagctgctaccattagggaagctctgaattgtagagagactggagaagccaaagtcattctcacagcaatgtgtggacatggccattttgatttgccagcttatgataactatctgcaaggaaagctggttgacttgtcatttgaggaggagaagatacaagcatcattggccagagttcccaaagtagggggttga

SEQ ID NO: 3414 - DNA, 3002 bp, Prunus mume
ttttagacacctccacttcttttcttaattcataagaaattttttttgatgaaagcttaaaaaacccccttctccactgctctcacccaacccacatccacaccacacagaccaaaaacacacacgccaacacacaaagatgtatgtaacaaggcctctttccatgtaccggaaatctccaagcaccctttccataaagccacctgatgctccacattcaggttatatggtgatcacagatgaagaggcagagtcaaaagacacatcttgttggggcctttgcaagcgtgggaaagttaaaaaactacctttcccacaggacaagattctgaccattgtttatacatccgagtaccaagaggcaaccacgacgaaggtctggttcatcccagttcttgatcaacctctgtcttctaactgctactatgttatcagagcaaatggcaggcacaaagggaaagcatacagatgttctagagagagggacatgaccaactgctgcattagaggtttcttgagagacaaaaaacctaaggttttaaattttagagacatataccaacaagttaaaattcatcgccatcaaggtggtggtttttttgcagagtctgtagctcctgatggtgttcccccaaaattcctaaagaaaaaaggatggaaagtgcgtagctcaagtatgtaccggaatcaattaactgatgctttaggccttgacgcctccctccggtctcgtcttccagaattcaattttcccatctttaaaaagcgttcggcttctagtgttgtggggagatggtactgtccatttgcatttgtgagagagaaagcaaccataagacaccagatgaagaagtccaagttttacagaataactcttgagcaatggtgggaagagatttactctcgtgggaatgttaacaatgaaggaaatgttgtgaatgtgagcgtagatgtgcaaagggaagtggctttggtatctgccacagaagccgtgaaggacgataggaatggccgtactgggttcacctggttcaaagcttataacccacgtagcaagaaagtggtgagtgtaggtttgagttcagcaattattcagaatatgagatgggttttagaggcaggaggatgggttaatggggatgaaatggatgtgagagtggagagggtagaagagattacaggtgagaacaggtggaggaagtttggctgttatgttatggtggagagtttctccttgagaagaatggatggaagtttggcttggagatctgattttaggcacactgataagattcgatctgaggagaaatggcttggatttactgcacttgatagaaagccaacgcatctgaaactttcaaatggatgtagagcaagagcagctctcaatgctgatccaagatcaattgaaatccctcgtcaatggtacaacctgattgcagatcttcctgtaaaacctcctcctccattgcatcccaagacctttgaaccggtaaaacctgaggatttgtctcctctctttcctgatgagttgattaagcaggaggcaagcaacgaaagattcatagatattccagatgaagttcgtgatgtatacaggctttggcgcccgtcccctctcattagggccaagaggttggagaagcttcttgacacacctgcaagaatttactacaaatatgaaggtgtcagccctgctggatcacacaagcccaacactgcagttccacaagtttggtataatgcacaacaaggcatcaagaaggttgtgacagaaacaggagctggtcaatggggaagtgcattggcttttgcatgcagcttatttggtcttgagtgtgaggtgtggcaagtgtgtgcttcttatgatcaaaaaccatatcgcagattgatgatgcaaacttggggtgcaaaggtacacccatctccatctaacttaaccgaagcaggtagaaaaatcctacaaatggatccatccagcccaggaagtttagggatagctatatctgaagccgttgagattgcagccatgaatgctgatactaaatactgtctcggaagtgttctcaatcatgttttgcatcaccagacagtaataggtgaggagtgcctaaaacaaatggaggcgataggtgaaaccccagactttatcataggatgtactggcggaggatccaattttgcagggttaagtttcccattcatcagggagaagctgaaagggaaaatgaaccctgtaataagagcagttgaacctgcagcatgcccttcactaactaaaggggtatacacatatgattatggtgatacagcagggatgaccccactaatgaagatgcatacgctcgggcacgacttcatccctgacccaattcatgctggaggattgcgctaccatggcatggcaccgttgatttcgcatgtgtacgacctgggttacatggaagcaattgcaattccccagattgagtgctttgaaggtgctatacagtttgctagatcagaaggattgataccagcgccggagcctactcatgccatagctgctaccattagggaagctctgaattgtagagagactggagaagccaaagtcattctcacagcaatgtgtggacatggccattttgatttgccagcttatgataactatctgcaaggaaaactggttgacttgtcatttgaggaggagaagatacaagcatcattgaccagagttcccaaagtagggggttgaggttgggccaacaagtaaaatgatgcattggatgtaatttgccatgcatggaatgttgttactcagttgatcatggactgatgacaagtcagaaattacaaattaggaaatttgaattgttcaggataaaaaataattagtgacactaaggaacaccaattttgtttattttattttagtaacaatgcaaggactatccaatggtcattagacaataaaatcatgcagtttaacataacaatgtagatatctctctagcactaaa

SEQ ID NO: 3415 - DNA, 1982 bp, Amsonia hubrichtii
ccgtcaatcttctgccacctaccttctcctttccttattaaatttgggatacccttatcttctcttctgtctctcggttcacccaagtcaccgaactttcctgcataataatggcgcagtctctgtttcttggcacaagtatatgcaccaacatctccaaaagaggtgaagagcagtggcttggaggttcaaaattgaagatagaaccaaggtatctaaaactttcatctgggtgcagaataggaggaagagcagcctataatgctaatgccaagattactgaaattccacatcaatggtataatatagttgctgatcttccagttaaaccacctccttctctgcatccaaaaacacatgaaccagtgaaaccagaggatttatctcctctatttcctgaagagttaattaaacaggaggctagcaacgaacggttcattgatatcccagaagaggttatagatgtttataaactttggcgcccaactcctctaatcagagctaagaggttggagaaactacttgatacaccagcaagaatctattacaaatatgaaggtgttagcccagctggatcacataaagccaacacttcggttcctcaggtctggtacaatgcacagcaaggtgttaaaaatgtagtcacagagaccggtgcaggccaatggggaagtgctctggcatttgcttgcagcttatttggtcttaattgcgaggtatggcaagttcgcgcttcttatgatcagaaaccatatcgtagactgatgatgcaaacttggggagccaaagtccatccttcaccttctattattacagaggctggtcagaaaattcttgaattggatcaatcaagtccaggaagtctaggaatagctatttcagaggctgtagaggttgctattaaaaatgccgataccaagtattgtctaggaagtgttctcaaccatgtactgttacatcaaactgtcataggtgaggagtgtatgaagcagatggaagctataggggagactccagatttgatcattggatgtacaggaggtggatccaactttgctggactcacttttccatttattagagagaaactcaatggaaaaatcaatcctcatattaaggctgttgaacctacagcatgtccttccttgacaaagggtgtctatgcttatgattttggtgatacagcaggcatgactcctttgatgaaaatgcatactctggggcatggcttcataccagaccccattcatgctggaggtttgcgttaccatggaatggctccattaatctcacatgtctatgaattgggcttcatggaggcaattgcaattccccaaactgaatgctttcagggtgctatacaatttgctaggtccgaggggttgataccagcacctgaacccactcatgccatagctgccacaatcagggaagctcttagatgtagagagactggggagtccaaagtaattctcatggcaatgtgtggacatggccattttgatttgccagcatatgaaaaatatttgctgggagctatggttgatttggatttctcggaggataaactacaaacatctctaggtaaaattcctcagctgtctgcctgagctgatagctgttatgctagttatctcaagcacttacttatcagttcatgaggtcctctaaacacctgcatatcactagaacagcaacaatggcacaggccacctacagcataagactgcatcattttggacggcaggaggaatagaaatttactccttatcgctgagtagtccaaattgagatcaggaaattgtttcacggcagggtttacagtcaaatcccagtttcatgttcattgagcatgttttcttattcatatgttaagaaatgcaattgctctattttaactacatgactgaaactgacaaacaagggaaacaaaaatttattgtgtttgcaaataaacaatgatgcttgcttgggaattatct

SEQ ID NO: 3416 - DNA, 1976 bp, Catharanthus roseus
caaacactcgctttttgtggatgccttcataatatagggtagacctcttcttcgctgctcctcaaagttgacccgaacctcggaccttccctgcacagcaatggcacagtgtctgtttcttgctcccactgtatgctccaaagtcgccggaagaggtgaagagcagtggctttgtggttcaaaattgaagaaaaaaccaagcaatttgatattttcatctcggtccagcataggaataagagcatcctataatgctaatgccactgcaattgaaattccaaatcagtggtacaatatagttgccgatcttccagttaaacctcctcctgctttgcatccaaagacttatgaaccagtgaaaccagaggatttatctccattgtttccggatgagttgattaaacaggaggctagcactgagcgatccattgatattccagaagaggttatagatgtttataaactttggcgtccaactcctctaattagagccaagaggttggagaaactacttgatacaccagcaagaatttattacaaatatgaaggcgtaagcccagctggatcacataaagccaatacttctgtcccccaggtctggtataattcacaggaaggtgttaaaaatgtcgttacagaaactggtgcaggccaatggggaagtgctctggcatttgcttgcagcttatttggtcttgattgcgaggtatggcaagttcgtgcttcttatgatcagaaaccataccgtagacttatgatgcagacttggggagccaaagtccatccttcaccatctaatattacagaggctggtcggaaaattctccaactggatccatcaagtccaggaagtctaggaatagcaatttcagaggctgtggagattgctgttaaaaatggcaataccaagtattgtctaggaagtgttcttaaccatgtcttattgcatcaaactgtcattggagaggagtgtatcaagcagatggaggctataggagagtcaccagatgtgatcattggatgtacgggtggtggatccaattttgcgggactggcttttccattcattagggagaaactcaatggaaaaatcaatcctcatattcaggctgttgaacctacagcatgtccttctttgacaaagggtgtctatgcgtatgattatggtgataccgctggcatgactcctttaatgaaaatgcacactttggggcatgattttataccagaccccattcatgctggaggtttgcgttaccatggaatggctccattaatctcacatgtctatgatttaggcttcatggaagccatagcaattcctcaaacggaatgttttcagggtgctatacaatttgctaggtccgaggggttgataccggcacctgagccaactcatgccatagctgcgacaatcagggaagctcttagatgtagagaaacgggggggtcaaagtaattctaatggcaatgtgtggacacggccattttgatttgccagcttatgcgaagtacttgcagggagctatggttgatttggcattctccgaggataaaatacaagcatcacttggtaaaattcctcagcttgtcccgtgatttgatagaagttttgccagatatcttgagcccttcttatcagttcacggggtcccttcaaccttaacaataatacagtgccacccacagcttcggagttgcatcactttggagggaaggatgaataaacgaacctggtacaaactcggaaaagtttacttcatgttcagcttttttgatatataaattcaattgaaattcctctgtttcactagtataataactgaatgtgacaatgaagtaaataaatatttgtttatgtttagaaatatcaattcattgggaataaatatggccagactgatcaaatgatcatcgatcagctctgagaaaagtggaatctgtcttctgagggttcaaaacatcttttattaaaa

SEQ ID NO: 3417 - DNA, 2594 bp, Fragaria vesca
atgtatgtgacaaaacctctttccatgtaccggaaatctccaaacaccctttctatacagccaccagatgcaccttattccggtcatttagtagttacagatgaagaagcagaagcacaagactcatgttgttggggtattttcaagcgtgaacagattaagcaactaccatttccacaagacaagatactcaccgttgtttatacatcggattaccaagaagcaaccaccaccaaagtttggttcatccctgttcttgatcagcctctttcttctaattgctactatgtcatcaaagcaaatggaagacacaaagggaaagcatgcagatgttctaaagagagggacataatgaactgctgcttcagagacttctcgagggacaagaaaccagtacctttgaatctaagaaacacataccaacaagttaagattcatcggcaccaaggaggcggtttcttcgcagagtctgttgctcctgatggtgttcctccaaagtttctaaggaaaaaaggatgggtaatccgcagctcaagtttgtaccgatggcagttaagtgatgccttaggccttgacacttccctccgattgcgcttccctgacttcaacttccccatctttaagaaacgttcagcttctaacgttgtggggaaatggtacagtccatttgtgtttgtgagagagagatccagcgtaagacgccagatgaagaagtcgaaattctacagaatatctatggagcagtggtgggaagagatttactcctgtgggaatactagcaatgaaggcaatgttgtgaatgtggatgtaagtgtacaaagggaagtggcttttgtatctgccgcggaagctgtcaaggacgacagaaatggtcgtacagggttcacttggttcaaggcttataatccagacagccgaaaactggtcaccatcggtttgagctccgcgattgtccagaatatgaaatgggttttagaggcaggagggtgggttactggggatgagaaggacacaagggtgcagaaagtagaagagatcagagacgggtggaggaagttcggctgttatgttctggtggagagtttcaaattgagaagaatggacggaagcctggtattgagacatgacttcaggcacactaacaccataagaattgagaagaaatggcttggatttatcacacttgatagaaagccgaggaatttgaagctttcaaaaggctgtagagcaagagcagctctcaatgctgatacagtaccagtcgaaatccctcgtcaatggtacaacctgattgcagatctgcctataaaacctcctcccccattgcatcccaagacttttgaacctgttaaacctgaagatctgtcccctctatttcctgatgagttgattaaacaggaggcaagtggtgagagatacatagatatcccagaagaagttcgcgagatatacaagctttggcgcccaacccctctcattagggccaagaggttggagaagcttcttgacacgccggccagaatttattacaaatacgaaggcggtagccctgctggatcacacaaacccaacagtgcagttccacaagtgtattataatgcaaagcaaggcatcaagaaggttgtgacagaaacaggagctggacaatggggatgttctttggcttttgcatccagcttatttggtcttgactgtgaggtatggcaagtgcgagcttcatatgatcagaaaccgtatcgcaaattgatgatgcaaacttggggggcaaaggtacacccatctccatcaaacataactgagtccggtagaaaaacccttctgatggatccatcaaccccgggaagcttaggaatagctatttctgaagctgtggaggttgcagctatgaatgccgacactaaatattgtctagggagtgttctcaatcatgttttgctccaccagactgtaattggtgaagagtgtctgaaacaaatggaagcaataggtgagaccccggacttgatcatagggtgtactggtggaggatctaactttgcaggcctcagtttcccattcattagagaaaagctcaatggaaaaatgagccctgtaataagagcagttgaaccttctgcttgtccttcattaactcaaggtgtatacagatatgattatggtgacacagcagggatgactccactaatgaagatgcatacacttgggcatgacttcattcctgacccaattcatgccggaggattgcgctatcatggcatggctccactgatttcacatgtctatgaactcggtttcatggaagcattagcaattccccagactgagtgcttcagaggtgctatacaatttgctaggtccgaaggattgattccagcaccagagccaacccatgccatagctgccaccattagggaggctctgaagtgtaaagaatctggagaagcaaaagttattctcactgcaatgtgtggacatggccatttcgatttgccagcttacgacaattacctacaaggaaatctggttgacctgtcattcgatgatgagaagctacaagcagcattgagcagtgttcctaacatgcgtagctgacg

SEQ ID NO: 3418 - DNA, 1664 bp, Citrullus lanatus
ggttgccttctcttctcatttgcccttcttcattgtttaatcccaatttcatccatagacaaaacttcaagcttccttctctttttacacagaaaagggttgaaaatccatctggaaaatggccgctaccttccttgctgttggatcattagcttcttcaagcatcaataatgttgaggagcaattgcctggatgtctttcacttaagagaattccaagacatttgaggttttcaaatggttatagaacaaaagcagcattaaatcctaatttgaaggcagttgaggtcccacgccaatggtacaatctggttgcagatcttcctgtaaaacctcctcctccattgcatcccaagacttttgaaccaataaaacccgaagatttgtcgcatctctttcctgatgaattgattaagcaagaggccagtactgatcgatacataaatattcctgacgaagttttggatatctacgggctttggcgcccaactcctctgattagagctaagaggttagagaaacttcttgacacaccagctagaatttactacaagtatgaaggagttagccctgctgggtcacataaacccaactctgctgttccacaagtttggtataatgtacaagaaggtgtcaagaatgttgttacagaaactggggctgggcaatggggatccagtttggcctttgcgtgcagcatatttggtattggctgtgaggtgtggcaagtgcgggcatcttatgatcaaaaaccgtatcgacgaatgatgatgcaaacttggggggcaaaagtacacccatctccgtctgatctaacggatgcaggtagaaaacttcttcaagttgacccgtcaagcccgggaagtttgggaattgccatttcagaagctgtggaggttgcagctcgcgatgctgatacaaaatactgtttgggaagtgtcctcaaccatgttttgcttcaccaaaccgtgatcggtgaagagtgtctaaaacaaatggaagccataggtgagaggccggatgttatcatcggttgcacgggcggaggatcaaatttcgcaggtcttagcttcccattcctccgtgagaaacttgctggaaacataaaccctgttatcagagcagttgaacccgcagcatgtccttcattaaccaaaggcgtgtacgcttatgattatggcgatacagccgggatgacaccattgatgaaaatgcacacacttggtcacaacttcattcctgaccccatccacgctggtggattgcggtatcacggtatggctccattgatctcacatgtctataatcttggtctcttggaagctatatcacttccccagacagaatgctttcaaggtgctatacaatttgctcgatcagaaggactaataccagcacccgagccaactcacgccatagctgcaactatccgagaggctcttcgctgtcgagaaactggagaatcaaaagttattctcacagccatgtgtgggcacggtcactttgacttgccagcttatgagaagtatctacaaggagggatcacagatctttcttttgcaaaggagaagatacaagaatcactaaccaccattcctcaggtgggctgaaattttatatataaacaaggtttagatttttaaggtttacgagtgaacgaatcat

SEQ ID NO: 3419 - DNA, 2186 bp, Populus trichocarpa
caagaatagccaggtagattagccaaagcacaaacatggcttcatcttctctagcttttccaacccttcaaccccaattccagtcactaaaaaacaaatctacttccaagccctcaactcgtagactgtccttccgtaccatcagagcatcagtatcagaaaaaccatcagtttcggctccaggtgttactgtttcaccacctgaaaacaccaaactcccgatccgtaaaatccctggtgattatggccttcctcttgtcggtccctttaaagatcgtatggattatttttataaccagggcagagacaatttcttcaaatccaaagttctgaaatacggatcaacggtgtttagagccaacatgggaccaggtccttttattgctccaaatccacaggttgtggttttacttgacggcaagagctttccggttctatttgacgtgacaaaagttgaaaagaaagacctttttacaggtacttacatgccttcaacagaactcactggtggctatcgaattctgtcctatctcgatccatccgagccaatgcacgccaaattgaagaaattcatgttctatctcctcaagtcacgccgtgatcacgtaatccctgaattcaaagccagttacacagaactctttacgagtcttgaaaaagatttggctctcaaagggaaagctaatttcgtcgctgctaatgatcaagcagcttttaacttcttggctcgggcttggtttggtactgaaccggcacagaccagtcttggccttgacggacctggtctagtttcaaaatgggtgctctttaaccttggtccggtcctttctctcggtcttccaaaatatctcgaagatcttacaatccactccttccgtctaccaccatcaatgattaaaaaaaactaccagcgcctttacgatttcttctatgcttcgtcaagcttcctgctcgatgaagcagagaatttaggaatttcacgagaggaggcatgccataatcttctcttctccacatgctttaactcgttcggtggaatgaagattttatttccaaacatgatgaaatggctaggccgtgccggggccaaactccacgctcagttagccgaagagatcagatcagttgttcaatccgacggtggaaatgttacaatgaggggtatggaacagatgccgttgatgaaatcagcagtctatgaagcactccggattgaaccaccagtccctctacagtacggtaaagcaaagcgtgatctgataattgaaagccacgatgctgctttcgaagtcaaagaaggggagctgttattcgggtttcaaccatttgctactaaagacccgaaaatatttactcgggctgaagagtttgttgctgacaggtttattggggagggagaggagttgttgaagcatgtgctgtggtctaatgggcctgagacagagaagccaacgttgggaaataaacagtgtgcagggaaggattttgttgtactcgtggctaggctgcttgtcgtggaattgtttttaaggtatgattcttttgagatagaggttggcaagtcatccctgggagctgctgtgacggtcacttcattaaagagggcaaggttttagataattagagattttggtttcttgttgtgggaagagtataacgtgggtagtggggatgccaatgcctgctttcaagggcagtagctttctgtaatgcataatggcattgatatcatcatgttgtagtccttttcttagctaagtcgatagaaaaaacaatgatgatacagtactgcattctgtgaataatgaaataagaagcatgttgctagagtcgcaccactccttttgagataattggaggctttgctcttttgcaatggtgactttttgaaaaaggagttcttgaagtgtataatgtgggtggaggagggagcggtcctgctttcttgtgcccgtagctttttgtgcgttccataatgacatcgatatcatttcccggtttaattaatattatgcaataagtctaaaagaaaacatgtccgttgtcgttgtatgccctcacctgttcagcattgagatgtgtggtttctgtttttttttttatatatataattttcacgtgacaatgtaaaaatataaaacaaatctaaataaatattattttaatatattttctattaaaaatca

SEQ ID NO: 3420 - DNA, 2219 bp, Populus trichocarpa
actccctgtctcccaccatatcctttccagcttgcacaacaatagccaggtagattagccaaagcacaaacatggcttcatcttctctagcttttccaacccttcaaccccaattccagtcactaaaaaataaatctacttccaagccctcaactcgtagactgtccttccgtaccatcagagcatcagtatcagaaaaaccatcagtttcggctccaggtgttactgtttcaccacctgaaaacaccaaactcccgatccgtaaaatccctggtgattatggccttcctcttgtcggtccctttaaggatcgtatggattatttttataaccagggcagagacaatttcttcaaatccaaagttctgaaatacggatcaacggtgtttagagccaacatgggaccaggtccttttattgctccaaatccacaggttgtggttttacttgacggcaagagctttccggttctatttgacgtgacaaaagttgaaaagaaagacctttttacaggtacttacatgccttcaacagaactcactggtggctatcgaattctgtcctatctcgatccatccgagccaatgcacgccaaattgaagaaattcatgttctatctcctcaagtcacgccgtgatcacgtaatccctgaattcaaagccagttacacagaactctttacaagtcttgaaaaagatttggctctcaaagggaaagctaatttcgttgctgctaatgatcaagcagcttttaacttcttggctcgggcttggtttggtactgaaccggcacagaccagtcttggccttgacggacctgatctagtttcaaaatgggtgctctttaaccttggtccggtcctttctctcggtcttccaaaatatctcgaagatcttacaatccattccttccgtctaccaccatcactgattaaaaaaaactaccagcgcctttacgatttcttctatgcttcgtcaagcttcctgctcgatgaagcagagaatttaggaatttcacgagaggaggcatgccataatcttctcttcgccacatgctttaactcatttggtggaatgaagattttatttccaaacatgatgaaatggctaggccgtgccggggccaaactccacgctcagttagccgaagagatcagatcagttgttcaatccaacggtggaaatgttacaatgaggggtatggaacagatgccgttgatgaaatcagcagtctatgaagcactccggattgaaccaccagtccctttacagtacggtaaagcaaagcgtgatctgataattgaaagccacgatgctgctttcgaagtcaaagaaggggagctgttattcgggtttcaaccatttgctactaaagacccgaaaatatttactcgggctgaagagtttgttgctgacaggtttattggggagggagaggagttgttgaagcatgtgctgtggtctaatgggcctgagacagagaagccaacgttgggaaataaacagtgtgcagggaaggattttgttgtactcgtggctaggctgcttattgtggaattgtttttaaggtatgattcttttgagatagaggttggcaagtcatccctgggagctgctgtgacggtcacttcattaaagagggcaaggttttagataattagagattttggtttcttgttgtgggaagagtataacgtgggtagtggggatgccaatgcctgctttcaagggcagtagctttcggtaatgcataatggcattgatatcatcatgttgtagtccttttcttagctaagtcgatagtaaaaacaatgatgatgcagtgctccattctgtgaataatgaaataagaagcatgttgctagagtcgcaccactctttttgagataattggaggctttgctcttttgcaatggtgacttttgaaaaaggagttcttcaagtgtataatgtgggtggaggagggagcggtcctgctttcttgtgccagtagctttttgtgcgttccataatcacatcgatatcatttcccggtttaattaatattatgcaataagtctaaaagaaaacatgtccgttgtcgttgtatgcactcccctgttaagcattgagatgtgtggtttctgtttttttttatatatataattttcacgtgacaatgtaaaaatgtaaaacaaatctaaataaatattattttaatatattttctattaaaaatca

SEQ ID NO: 3421 - DNA, 1768 bp, Oryza sativa
gtttgatccaaagcgtgataggcgatagccgcctccacacaaacaatcacgaggagcagagcaggcagccgattcgacacctaacccccaattccaatcccgtatttaatccctccaattcccaaatcatccaagcccgattccacccaaaccctcctctcctcgcccgccatgaactcgctccaatccttcctcgccctcaacccgcccgccaccgccgccgcccttggcggcctcggcctcggcggcgcgcgcctccgtccgtcgcgcgtcaccgcgtgcctcgccacgcccacgcccacgccgccgcccccgacctccgcgcccctcgcccccgccgcggccgcgcgccgcgagctgtccgccgcgagccgcgccgtggtggaggacgaggcgaggtacatcgtcgggacgtacaaccgctcccgcgtcgtcctcgtcgccggccgcggctgcaagctgtacgacgccgacgggcgcgagtacctcgacatggccgccggcatcgccgtcaacgcgctcggccacgccgaccccgactgggtcgccgccgtctccgcccaggccgccaccctcgtccacgccagcaacgtccagtacaccgtcccccaggccagtctcgaacgcgtcacgcccaccgctcaccacgtgttcgacgcattgcccaaccctctcgtcacgccaagctcccgtgatcatttctttttccgcgtgcatgtggcgctcgccaagcgcctcgtggaggcctccttcgcggaccgcgtcttcttcgccaacaccggcacggaggccaacgaggccgccatcaagttcgccaggaagtaccagagggtggcgcgccccgacggggacgcgcccaccgagttcatgtcgttcaccaactgcttccatggcaggacaatggggtcgctcgcgctcaccagcaaggtgcagtaccgggagccgttcgcgccggtgatgcccggcgcgacgttcgccgagtacgggaacctagaggaggccaagaaggtgattcagtccggcaaaattgctgccgtgttcgtcgagcccatgcagggcgagggtgggatccatagtgccaccaaggagttcttgcaggggctgcgggatgcttgcgatgaggctggagctctcttggtttttgatgaggtgcaatgtggtctgggacgcactggttacctctgggcgtatgaagcctatggagtagtacctgacattatgaccttggcaaagccattggcgggtggtctccccatcggtgtagtcttggtcaccgagaaggttgcttcagcgataaactacggcgaccatggtaccacattcgggggaggccctcttgtttgccaggctgcattgaccacattggacaagatccagaaacctggcttcctagcagaggtggccaagaaaggagagaacttcaagcagcttctcagtaccaagctgagtggaaacgcccatgtgaaagagatccgggggatcggtctcatcgtcggcatcgagctcgatgttccagcgggtcctttggtcgatgcatgcttggaccgcggtgtcatagtgctgacagccgggaaaggcaatgttgtgaggcaatgttgctgattttttacagagtgaaatatatctcatcttcctgcttgctccttcatcattttgtgctggtacaagagtacttgtagcgtgttcggatcctcttagtgtccagcgatcacacatatatttttctggtgccacatacatattcaattgtgtcatcacttttaaaaca

SEQ ID NO: 3422 - DNA, 1593 bp, Hordeum vulgare
ccgaccccaatccgtatttaactccgaaacctctccgccctctcgcccaccccgaatccgtccgccatgaactcgctccaatccttcctcgccgtcgcgcccgtcaagccggccgctgccggcgcgaggctcccgtcgtcccggcgggcgcgcgtctccgcctgcctcgcggccccggcgcccgcgccgccggccgccccctcggcgcggcgggagctgtccgcggcgagccgggccgtcatggcggacgaggccaagtacatcgtgggcacctacaagcgcgcccaggtcgtcttcgtgtccgggcgcggctgcaagctctacgacatcgacggccgcgagtacctcgacatggccgccggcatcgccgtcaacgccctcggccacggcgaccccgacgtcgacgccgccgccgcggaccagcgcggccgcctggtccacgccagcaacgtcgggtacaccgtgccccaggtggagctcgccaagcggctcgtggaggcctccttcgctgaccgcgccttcttcgccaactctggcaccgaggccaacgaggcggccatcaagttcgccaggaagtaccagagggtcgcgcaccccgacggggacgcgcctacggagttcatgtccttcaccaactgcttccatggccggaccatcggctcccttgcgcttaccagcaaggtgcagtacagggagccctttgaaccggtcatgcccggctcaacatttgccgagtatggcaatttggaggaggccaagaaggtgatacagtcggggaagattgctgctgtgtttgtcgagcccgtgcagggtgagggtgggattcacagtgccaccaaggagttcttgcaggggctgcgtgatgcttgtgatgaggctgggactctgttggtctttgacgaggtgcaatgtggtctggggcgcacaggttacctctgggcccacgaggtttatggtgtagtacctgacataatgaccttggcaaagccactggccaatggccttcccattggcgtggccttggtcacggaaaaggttgctgcagccataaactacggtgaccatggtaccacgttcggcggaggcccttttgtgtgccatgctgcattagccacattggacaagatccagaaacctggctttctagcagaggtgaccaagaaaggagaatacttcaagcagctgctcaaaactaagctgggtggaaaccctcatgtcaaagagatccggggggccggtctcattgttggcatcgagctcgatgtaccggctgggcctttggtcgatgcgtgcctggatgctggtgtctttttgctgacggccgggaaaggcaatgtggtgaggcttgtgcctgcgctcatcgtgtcggagaaggagctggagcaagctgcagaggtgataagggaatgtctacctgctcttgaagcctctacctcttagtgtaagcaagatctcttaccaatatgatgagatctacatgttgaagtttctgtcgaaatttggaagggaataaaatgtcatgttggactactgtgatgttgaagcccttttcgaagtttggatggaagcaatgtctgttgttgtcggtataag

SEQ ID NO: 3423 - DNA, 1542 bp, Pseudoroegneria spicata
gaactcgctccaatccttcctcgccgtcgcgcccgtcaagccggccgcggcctcggccggcgcgaggctcccgtcgtcccggcgggcgcgcgtctccgcctgcctcgcgacccccgcccccgcggcggcggcctcggcgcggcgggagctgtccgcggcgagccgggccgtcatggcggacgaggccaagtacatcgtgggcacctacaagcgcgcccaggtcgtcttcgtggcggggcgcggctgcaagctctacgacatcgacgggcgcgagtacctcgacatggccgccggcatcgccgtcaacgccctcggccacggcgaccccgacgtggatgccgccgccgcggaccagcgcggacgcctggtccacgccagcaacgtcggctacaccgtgccccaggtggagctcgccaagcggctcgtggaggcctccttcgctgaccgcgccttctttgccaactccggtactgaggcaaacgaggcggccattaagttcgcaaggaagtaccagagggtcgcgcaccccaacggtgacgcgcctacggagttcatgtcgttcactaactgcttccatggccggaccattggctcgctcgcgctgaccagcaaggtgcagtacagggagccctttgaaccggtcatgcctggctcaacatttgccgagtatggcaatttggaggaggccaagaaggtgatacagtcggggaagattgctgctgtgtttgtcgagcccgtgcagggtgagggtgggattcacagtgccaccaaggagttcttgcagggactgcgggatgcttgtgatgaggcagggactctcttggtctttgatgaggtgcaatgtggtctggggcgcacaggttacctctgggcccatgaggtttatggtgtagtacctgacataatgaccttggcaaagccactggccaacggccttcccattggcgtggccttggtcacggaaaaggttgctgcagccataaactacggtgaccatggtaccacatttggcggaggcccttttgtgtgccatgctgcattagccacattggacaagatccagaaacctggctttctagcagaggtgagcaagaaaggagaatacttcaagcagctgctcaaaactaagctgggtggaaaccctcatgtcaaagagatccggggggccggtctcattgttggcatcgagctcgacgtaccggctggtcctttagtcgatgcgtgcttggatgctggtgtctttttgctgacggccgggaaaggcaatgtggtgaggcttgtgcctgcgctcatcgtgtcggagaaggagttggagcaagctgcagaggtgataagggactgtctacctgcccttgaagcccatacctcctagtgtaagcaagatctcttaccaatatgatgagatctacatgttgaagtttctttcaaaatttggaagggaataaaatgtcatgttgaactattgtgatgttgaagttctttttcaagtttggatggaaacaatgtctctgttgttgtcggtataaagtcttttatttgcta

SEQ ID NO: 3424 - DNA, 3052 bp, Triticum aestivum
aatccttcctcgccgtcgcgcccgtcaagccggccgcggccgccgcgaggctcccgtcgtcccggcgggcgcgcgtctccgcctgcctcgcgaccccggcgcccgcgccgaccacccccgcggcggcggcgtcggcgcggcgggagctgtccgcggcgagccgggccgtcatggcggacgaggccaagtacatcgtcggcacctacaagcgcgcccaggtcgtcttcgtggcggggcgcggctgcaagctctacgacatcgacgggcgcgagtacctcgacatggccgccggcatcgccgtcaacgccctcggccacggcgaccccgacgtggacgccgccgccgcggaccagcgtggacgcctggtccacgccagcaacgtcggctacaccgtgccccaggtggagctcgccaagcggctcgtggaggcctcctttgctgaccgcgccttctttgccaactccggcactgaggccaatgaggcggccatcaaattcgccaggaagtaccagagggtcgcgcaccccaacggtgacgcgcctacggagttcatgtccttcaccaactgcttccatggccggaccattggctcgctcgcgctgaccagcaaggtgcagtacagggagccctttgaacccgtcatgcccggctcaacatttgtcgagtatggcaatttggaggaggccaagaaggtgatacagtcggggaagattgctgctgtgtttgtcgagcccgtgcagggtgagggtgggattcacagtgccaccaaggagttcttgcagggactgcgggatgcttgtgatgaggcaggggctctcttggtctttgacgaggtgcaatgtggtctggggcgcacaggttacctctgggctcatgaggtttatggtgtagtacctgacataatgaccttggcgaagccactggccaatggccttcccattggtgtggccttggtcacggaaaaggttgctgcagccataaactacggtgaccatggaaccacattcggcggaggcccttttgtgtgccatgctgcattagccacattggacaagatccagaaacctggctttctagcagaggtgaccaagaaaggagaatacttcaagcagctgctcaaaactaagctgagtggaaaccctcatgtcaaagagatccggggggccggtctcatcgttggcattgagctcgacgtaccggctgggcctttggtcgatgcatgcttggatgctggtgtctttctgctgacggccgggaaaggcaatgtggtgaggcttgtgcctgcgctcatcgtgtcggagaaggagctggagcaagctgcagaggtgataagggaatgtctacctgctcttgaagcctctacctcttagtgtaaacaagatctcttaagatctacatgttgaagtttctttcgaaatttggaagggaataaaatgtcatgttggactattgtgatgttgaagttcttttcaaagtttggaaggaaacaatgcctgtgttgttgtcggtataagtcttttattggctaagttatatctgcctaaattacaaggacggcattgccattgcacatctctcgactgaaaacaggaacatcagttatggagaagcctagcaagaactccgactatgggcgcgacagtgtaggtcgatggctcgccttgctggtaatttccccgagaatcgtcgtaatggtcgttgttgtcaggccctccgacgatggcgccgtcaatcacattcaagttgggcgcagacctgtggaagtactcggctcccttgccgcaggagatcttccccgggtatttcctaatggatggcagcgacgcgccgcggtggtgcggctgcaacgggtacctctttccaaccccaaccatgtagctcatcttcattgggttcttgccaaggatgtagtccacctgtgaccgtgcgaacgagacgagctgcgccggcggcagcctcacgccgccgcactgcagggaagcgctcgccgccgccaggtggtcggcgtgcgtgacgaggacgaacatcgccgtcgtgacgtcctgcaggttagaccagggctgcaggtagagcatgccgcctggggtgagccgcccgctgcggccgtcaccgtgctgaaggacgttgcagaggaagctctccacgttgctcctcatctcggcgtggcggccgttgttgggtagcttccctttgaggatgagcttggcgaccagtgcctgggctccgacgaacttgtcgtcccagcccaaggattgccgcaccccgccgacgttgttggcgccggcgatgtaggccttgtactcctggtggccggtggcgatgtagagccagacagctgcccacagcagctcgtcctcgtcgccgctgcttctgtagaaacttctagccgatggaatgctgttctggtagaggccacgatggttcttggcgaactgaaacaactgtttcgcgtgcttcagaagcgtcaacgcgtatcgggggtcaccgtgcggccccgtgtgcggccccgtgaacgcgacggaggccgcagccagcgccgccgccgtctcggcggcgacatcggagcccgggtgggtggcgttcaccaagtacgacctccggggcgtgtccatgtcctccggccgctcccagcacgcgtggtcggagtggccgtcgccgacattcacgtagagcacatcggggcgggcgtgcgccttggccaggtagtcggcgccccaccgcaccgcctggagcgcgtggcccagctcccccgccgcggccagccggccccggtgctccaccacgctccacgacagcatggtcaccgtgaacgccatggggaacccgaacttgacgttgtcgccggagtcgtagtagccgccggtgagatccaccccgtggtcggcgccgtccttgagggccgagttgccgcgccactggacgcgctgggtcggcggcagcctgccggagcgctgcgcctcgaagtagagcagcgacttggtgagcgcggtggcgtagtcccgctgggcggcttggcacgccgtggttgccaaaaaccataccacggcggcaa

SEQ ID NO: 3425 - DNA, 1525 bp, Triticum aestivum
aatccttcctcgccgtcgcgcccgtcaagccggccgcggccgccgcgaggctcccgtcgtcccggcgggcgcgcgtctccgcctgcctcgcgaccccggcgcccgcgccgaccgcccccgcggcggcgacctcggcgcggcgggagctgtccgcggcgagccgggccgtcatggcggacgaggccaagtacatcgtgggcacctacaagcgcgcccaggtcgtcttcgtggccgggcgcggctgcaagctctacgacatcgacgggcgcgagtacctcgacatggccgccggcatcgccgtcaacgcccttggccacggcgaccccgacgtggatgccgccgccgcggaccagcgcggacgcctggtccacgccagcaacgtcggctacaccgtgccgcaggtggagctcgccaagcggctcgtggaggcctccttcgctgaccgtgccttcttcgccaactccggcactgaggccaacgaggcggccatcaagttctccaggaagtaccagagggtcgcgcaccccaacggtgacgcgcctacggagttcatgtccttcaccaactgcttccatggccggaccattggctcgctcgcgctgaccagcaaggtgcagtacagggagccctttgaaccggtcatgcccggctcaacatttgcagagtatggcaatttggaggaggccaagaaggtgatacagtcggggaagattgctgctgtgtttgtcgagcccgtgcagggtgagggtgggattcacagtgctaccaaggagttcttgcagggactgcgggatgcttgtgatgaggcaggggctctcttggtctttgacgaggtgcaatgtggtctggggcgcacaggttacctctgggctcatgaggtttatggtgtagtacctgacataatgaccttggcgaagccactggccaatggccttcccattggcgtcgccttggtcacggaaaaggttgctgcagccataaattacggtgaccatggaaccacattcggcggaggcccttttgtgtgccatgctgcattagccacattggacaagatccagaaacctggctttctagcagaggtgaccaggaaaggagaatacttcaagcagctgctcaaagctaagctgagtggaaaccctcatgtcaaagagatccgtggggccggtctcatcgttggcatcgagcttgacgtaccggctgggcctttggtcgatgcatgcttgaatgctggtgtctttttgctgacggccgggaaaggcaatgtggtgaggcttgtgcctgcgctcatcgtgtcggagaaggagctggagcaagctgcagaggcgataagggaatgtctacctgctcttgatgcctctacctcttagtgtaaacaagatctcttaccaatatgatgagatctactacatgttgaagtttctttcaaaatttggaagggaataaaatgtcatgttgaactattgtgatgttgaagtccttttcgaagtttggatggaaacaatttctgtgttgttgtcggtat

SEQ ID NO: 3426 - DNA, 1749 bp, Secale cereale
gcccgtcaagccggcggccgccgccaggctcccgtcgtcccggcgggcgcgcgtctccgcctgcctcgcgaccccggcgcccgcgccgaccgcccccgcggcggcgcggcgggagctgtccgcggcgagccgggccgtcatggcggacgaggccaagtacatcgtgggcacctacaagcgcgcccaggtcgtcttcgttgcggggcgcggctgcaagctctacgacatcgacgggcgcgagtacctcgacatggccgccggcatcgccgtcaacgccctcggccacggcgaccccgacgtggacgccgccgccgcggaccagcgcggacgcctggtccacgccagcaacgtcggctacaccgtgccccaggtggagctcgccaagcggctcgtggaggcctccttcgctgaccgcgccttcttcgccaactccggcactgaggccaacgaggcggccatcaagttcgccaggaagtaccagagggtcgcgcaccccaacggtgacgcgcccacggagttcatgtcgttctccaactgcttccatggccggaccattggctcgctcgcgctgaccagcaaggtgcagtacagggagccctttgaaccggtcatgcccggctcaacatttgtcgagtatggcaatttggaggaggccaagaaggtgatacagtcggggaagattgctgctgtgtttgtcgagcccgtgcagggcgagggtgggattcacagtgccaccaaggagttcttgcagggactgcgggatgcttgtgatgaggcaggggctctcttggtctttgatgaggtgcaatgtggtctggggcgcacaggttacctctgggcccatgaggtttatggtgtagtacctgacataatgaccttggcgaagccactggccaacggccttcccattggcgtggccttggtcaccgaaaaggttgctgcagccataaactacggtgaccatggaaccacattcggcggaggcccttttgtgtgccatgctgcattagccacattggacaagatccagaaacctggctttctagcagaggtgaccaggaaaggagaatacttcaagcagctgctcaaaactaagctgagtggaaaccctcatgtcagagagatccggggggctggtctcattgttggcatcgagctcgacgtaccggctggtcctttagtcgatgcgtgcttggatgctggtgtctttttgctgacggccgggaaaggcaatgttgtcaggcttgtgcctgcgctcatcgtgtcggagaaggagctggagcaagctgcagaggtgataagggaatgcctacctgctcttgaagcctctacctcttagtgtaaacaagatctcttaagatctacatgttgaagtttctttcaaaatttggaagggaataaaatgtcatgttggactattgtgatgttcaagttcttttcaaagtttggaaggaaacaatgtctgtgttgttgtcggtgtaagtcttttattggctaagttatatatctgcctaaattacaaggacggcattgacattgcacatctcttgactgaaaacaggaacatcagttatgcagaagcctcgcaagcactccgacgatgggcgcgacagtgtaggttgatggctctccttgctggtaatttccacgggaatcgtcgtagtgatcgttgttatcaggccctccgacgatggcgccgtcgatcacattcaagttgggcgctgacctgtggaagtaatcagatccctt

SEQ ID NO: 3427 - DNA, 1545 bp, Secale cereale
cgcccgtcaagccggcggccgccgccaggctcccgtcgtcccggcgggcgcgcgtatccgcctgcctcgcgaccccagcgcccgcgccgaccgcccccgcggcggcctcggcccggcgggagctgtccgcggcgagccgggccgtcatggcggacgaggccaagtacatcgtgggcacctacaagcgcgcccaggtcgtcttcgttgcggggcgcggctgcaagctctacgacatcgacgggcgcgagtacctcgacatggccgccggcatcgccgtcaacgccctcggccacggcgaccccgacgtggacgccgccgccgcggaccagcgcggacgcctggtccacgccagcaacgtcggctacaccgtgccccaggtggagctcgccaagcggctcgtggaggcctccttcgctgaccgtgccttcttcgccaactccggcaccgaggccaacgaggcggccatcaagttcgccaggaagtaccagagggtcgctcaccccaacggtgacgcgccgacggagttcatgtcgttctctaactgcttccatggccggaccattggctcgctcgcgctgaccagcaaggtgcagtacagggagccgtttgaaccggtcatgcccggctcaacatttgtggagtatggcaatttggaggaggccaagaaggtgatacagtcggggaagattgctgctgtgtttgtcgagcccgtgcagggtgagggtgggattcacagtgccaccaaggagttcttgcagggactgcgggatgcttgcgatgaggcaggggctctcttggtctttgatgaggtgcaatgtggtctggggcgcacaggttacctctgggcccatgaggtttatggtgtagtacctgacataatgaccttggcgaagccactggccaacggccttcccattggcgtggccttggtcaccgaaaaggttgctgcagccataaactacggtgaccatggaaccacattcggcggaggcccttttgtgtgccatgctgcattagccacattggacaagatccagaaacctggctttctagcagaggtgaccaggaaaggagaatacttcaagcagctgctcaaaactaagctgagtggaaaccctcatgtcagagagatccggggggctggtctcattgttggcattgagctcgacgtaccggctggtcctttagtcgatgcgtgcttggatgctggtgtcttcttgctgacggcagggaaaggcaatgtcgtgaggcttgtgcctgcgctcatcgtgtcggagaaggagctggagcaagctgcggaggtgataagggaatgcctacatgctcttgaagcctctacctcttagtgtaaacaagatctcttaagatctacatgttgaagtttctttcaaaatttggaagggaataaaatgtcatgttcgactattgtgatgttcaagttcttttcaaagtttggaaggaaacaatgtctgtgttgttgtcggtataagtcttttattggctaagttatatatctgcctaaattacaaggacggcattgacatt

SEQ ID NO: 3428 - DNA, 1219 bp, Saccharum officinarum
ctttccccttccaatggagtcctgtagcttccgcgccgcaacagcgccttctcccttcccctccgcgccctcatcctcatcttcatccccgcgcgccccatgccccatactccgatttcccagaccaagaaaagggaggcagattggggtgcggaggagggcgtccggatttgatgccttcccgcccctccccggcaaggtcttcgtcgatgaggcaatcggagcggaatatggggagggcttcgaaacatttcggatggatggaccactcaaggttgatgtggattatttgaatgaaaaattgcaagaatgcttccttcaaaggataaggcatgctatgaagccagatgaggcgtttggtctaattttttcatgggacaatgttattgctgatacagactcgctaaagttgaatgcttggagacagcttgctttggaggaaggcaaggatatcccaagtgctgctcatgtccggaagagcattcttcatggtgctgctgaccatgttcttagaaaggttttgtactgggcaaaagaggaagataaaatggaaaaactgaaggcacgccttatagagttgtactatgagaacctgttcaaactcgatacacctgtaaaaggattgagagaatggctggatgctgttcagacggcaggtataccttgtgctgtcgcgtcatcccttgacaggagatgcatgatcgaagctttggatcggatggcactaagcaaatatttcaaggcgattgtgactgacgaagatgatatggagtcgatagcaaataggtttctgtcagctgctatgaagttggatcgtaaaccctcaaagtgtgtggtgttcgaggatgacccaaggggcgtcacagccgctcacaactgtactatgatggcagttgcattgattggtgctcatccggcgtatgagttggtacaggccgaccttgccattgcaaagtacagcgagctctcagtgatcaacctcagaagattgtttgcgaacaagggaatcagcttcatggatttgcagaagcagataatcgagaagtcaccttccaagaggaggctgacagtagacaccattttctgatggatatactttctatttggcgtctgcctgttgttcttgagtagccaaccaccttcgacatttgtgttggcgttgtatataagatagtgctgatgttaggtgatgtgctgtgcccctccttgtgaatgcaac

SEQ ID NO: 3429 - DNA, 1432 bp, Setaria italica
acatttacagccagaaaaataataggaaataaataggaaatcgggaaaactctaaaaataaaacccctccactactatcactctcttcctctcttctttccccttccaatggagtcctgtagcttccgccccgccaccgcgccttcccccttcccctcggcgccctcctcctcgtcttcatccccgcgcgccccgtgccccaatctccggtttcctagaccaagaaacgggagacaggttggggtgcggcggagggcgtccggatttgatgccttcccgcccctccctggcaaggtcttcgttgatgaggcaattggagctgaatatggggaaggcttcgaaacatttcggatggatggaccactcaagatcgatgtggattacctgaatgaaaaattgcaagaatgcttccttcaaaggataaggcatgccatgaagccggatgaagcgtttggtctaattttttcgtgggataatgtcattgctgatacagactcgctaaagttggatgcttggagacagcttgctttggaggaagggaaggatatctccaagtgctgctcatgtccgaaagagtatccttcatggtgctgctgaccatgttcttagaaaggttttgtattgggcaagagaggaagataaaatggaaaaactgaaagcacgccttatagagctatactacgaaaacctgttcaaactggatacgcccgtagaagggttgagagaatggttggatgctgttcagacagccgggataccctgtgctgtcgcatcatcccttgacaggagatgcatgatcgaagctctggatcgtatggcgctaagcaaatatttcaaggcgattgtgactgatgaagatgacatggagtcgatagcaaataggtttctgtcagcttctatgaagttggatcgtaaaccctcaaagtgtgtggtgtttgaggacgacccaagaggcgtcacggctgctcacaactgtaccatgatggcagtcgcactgatcggtgctcatccagcgtatgagctggtacaggccgaccttgcgatcgcaaagtacagcgagctctcagtgatcaacctcaggaggctgtttgctaacaaggggataagcttcatggacctacagaaacagataatcgagaaggcgcctcccaagaggaggctgacagtagacaccatcttctgattgattcttcccttttggctcctgtctgccagtattgaacagccagagccagccgcagcccggtcgttccgtgctgttgtatataaagatagtgctgatgtaggttatctgccctgtataccccttggcctgactaaatgtggtagttgtatcgtgatgacatccatgaagagaactgctgcaacaatgctgatgttgttgcaagctggcattgcccgatttattcatcatctatatctagttacggta

SEQ ID NO: 3430 - DNA, 1479 bp, Panicum virgatum
aaaaataaaacccctccacacactcttcctctcttctttccccttccaatggagtcgtgcagcttccgccccgccacagcgccttcccctttcccctcggcgccttcctcatcgtcttcatccccgcgcgccccgtgcccccatctccggtttcctagaccaagaaacgggagacagattcgggtgcggaggagggcgtccggatttgatgccttcccgcccctccccggcaaggtctttgttgacgaggcaattggagctgaatatggggagggctttgaaacatttcggatggatggaccaattaaggtcgatgtggattatctgaatgaaaaattgcaagaatgcttccttcaaaggataaggcatgccatgaagccagatgaggcgtttggtctaattttttcgtgggataatgttattgctgatacagactcgctaaagttggatgcttggagacagcttgctttggaggaagggaaggatatcccaagtgcagctcatgtccgaaagagtattcttcatggtgctgctgaccatgttctgagaaaggtattgtattgggcgaaagaagaatataaaatggaaaagctgaaggcgcgcctcatagagttatactacgaaaacctgttcaaactcgatacacccgtagaagggttgagagaatggttggatgccgttcagacagcagggataccttgtgctgtcgcatcgtcccttgacaggagatgcatgatcgaagctttggaccggatggcgctaagcaaatacttcaaggcaattgtgactgacgaagatgatatggagtcgatagcaaataggtttctgtcagctgctatgaagttggatcgtaaaccctcaaagtgtgtggtgtttgaggatgacccgagaggtgtcaccgctgcgcataactgtaccatgatggcagtcgcactgattggtgctcatccagcgtatgagctggtacaggccgaccttgcgatcgcaaagtacagcgagctctcggttatcaacctcagaaggctgtttgcgaacaaggggataagcttcatggacctacagaaacagataattgagaaggcacctcccaggagaaggctgacagtagacaccatcttctgattgattcttcctcgtttgtctcctgcccgtgcttgaatagccagagccagccacagtcggtttatttgtgctgttgtatataaagatagcgctgatgtaggttatctgccctgtaccccttgtcggcctgaatgtggtagttgtatcgaggtaacaagcatgaagagaactgctgcaacaatgctgacgttgttgcaagctgacactgtccaatttattcgttatccatatcttttgagagcatgaaaaatgggcgtggcgaaaggatatgcacgacttttttacgcattctgttgataactatgatgctgctggttgatacaaatcaaaatgaaggtccttagagacgtcatgatc

SEQ ID NO: 3431 - DNA, 1349 bp, Panicum virgatum
tatccctctcttcctctcttctttccccttccaatggagtcgtgcagcttccgccccgccacagcgccttcccctttcccctcggcgccttcctcatcgtcttcatccccgcgcgccccgtgcccccatctccggtttcctagaccaagaaacgggagacagattcgggtgcggaggagggcgtccggatttgatgccttcccgcccctccccggcaaggtctttgttgacgaggcaattggagctgaatatggggagggctttgaaacatttcggatggatggaccaattaaggtcgatgtggattatctgaatgaaaaattgcaagaatgcttccttcaaaggataaggcatgccatgaagccagatgaggcgtttggtctaattttttcgtgggataatgttattgctgatacagactcgctaaagttggatgcttggagacagcttgctttggaggaagggaaggatatcccaagtgcagctcatgtccgaaagagtattcttcatggtgctgctgaccatgttctgagaaaggtattgtattgggcgaaagaagaatataaaatggaaaagctgaaggcgcgcctcatagagttatactacgaaaacctgttcaaactcgatacacccgtagaagggttgagagaatggttggatgccgttcagacagcagggataccttgtgctgtcgcatcgtcccttgacaggagatgcatgatcgaagctttggaccggatggcgctaagcaaatacttcaaggcaattgtgactgacgaagatgatatggagtcgatagcaaataggtttctgtcagctgctatgaagttggatcgtaaaccctcaaagtgtgtggtgtttgaggatgacccgagaggtgtcaccgctgcgcataactgtaccatgatggcagtcgcactgattggtgctcatccagcgtatgagctggtacaggccgaccttgcgatcgcaaagtacagcgagctctcggttatcaacctcagaaggctgtttgcgaacaaggggataagcttcatggacctacagaaacagataattgagaaggcacctcccaggagaaggctgacagtagacaccatcttctgattgattcttcctcgtttgtctcctgcccgtgcttgaatagccagagccagccacagtcggtttatttgtgctgttgtatataaagatagcgctgatgtaggttatctgccctgtaccccttgtcggcctgaatgtggtagttgtatcgaggtaacaagcatgaagagaactgctgcaacaatgctgacgttgttgcaagctgacactgtccaatttatttgttatccatatcttttgagagc

SEQ ID NO: 3432 - DNA, 1585 bp, Panicum virgatum
cattttagggccagaaaaaaataatataaatacataggaaatcgggaaaactcttctaaaaataaaacccctccactactatccctctcttcctctcttctttccccttccaatggagtcctgcagcttccgccccgccacggcgccttcccctttcccctccgcgccttcctcatcgtcttcatccccgcgcgcctcgtgcccccatctccggtttcctagaccaagaaacgggagacagattcgggtgcggaggagggcgtccggatttgatgccttcccgcccctccccggcaaggtctttgttgatgaggcaattggagctgaatatggggagggctttgaaacatttcggatggatggaccactcaaggttgatgtggattatctgaatgaaaaattgcaagaatgctttcttcaaaggataaggcatgccatgaagccagatgaggcgtttggtctaattttttcgtgggataatgttattgctgatacagactcgctaaagttggatgcttggagacagcttgctttggaggaagggaaggatatcccaagtgcagctcatgtccgaaagagtattcttcatggtgctgctgaccatgttcttagaaaggttttgtattgggcgaaaggagaagataaaatggagaaacttaaggcacgccttatagagttatactacgaaaacctgttcaaactggatacacccatagaagggttgagagaatggttggatgccgttcagacagcagggataccttgtgctgtcgtatcatcccttgacaggagatgcatgatcaaagctttggatcggatggcgctaagcaaatacttcaaggcaattgtgactgacgaagatgatatggagtcgatagcaaataggtttctgtcagctgctatgaagttggatcgtaaaccctcgaagtgtgtggtgtttgaggatgatccgagaggtgtcaccgctgctcacaactgtaccatgatggcagtcgcactgattggtgctcatccagcgtatgagctggtacaggccgaccttgcgatcgcaaagtacagcgagctctcggtgatcaacctcagaaggctgtttgcaaacaaggggataagcttcatggacctgcagaaacagataatcgagaaggctcctcccaagaggaggctgacagtagacaccatcttctgattgattgttactcctttggctgctgcccgtgattgttccgtgccatggccagcccagtcgttttggtccgtgccgttgtatataaagatagcgctgatctaggttatccgccctgtaccccttgttagcctgaatgtagtaattgtatcgaggtaacatgcatgaagagaactgctgcaacaatgctgatgttgttgcaagctgacatttgtccactgtattcgttatccatatcttctacagcatggaaaatggacatggcgaaaggatacgcattttattgataaccactgatactgcttgctgatacaaattaaagggggagggctgtagagacgtcatgagtcatgaccctgctagttcgtcctaacacctaaggcaacacttattacagtacta

SEQ ID NO: 3433 - DNA, 1395 bp, Sorghum bicolor
ctaaaaataaaacccctccactagtatccctctcttcctgtctcttctttccccttccaatggagtcctgtagcttccgcgccgcaacagcgccttctccctttccgtccgcgccatcctcctcctcctcatcatccccgcgcgcccgatccctcatactccgatttcccagaccaagaaaagggaggaagattggggtgcgcaggagagcgtccgggtttgatgccttcccgcccctccccggcaaggtcttcgtcgatgaggcaatcggagcggaatacggggagggcttcgaaacatttcggatggatggaccactcaaggttgatgtggattatctgaatgaaaaattgcaagaatgcttccttcaaaggataaggcatgctatgaagccggatgaggcgtttggtctaattttttcgtgggacaatgttattgctgacacagactcgctaaagttgaatgcttggagtcagcttgctctggaggaaggtaaggatatcccaagtgctgctcatgtccggaagagcattcttcatggtgctgctgaccatgttcttagaaaggttttgtactgggcaaaagaggaagataaaatggaaaaaatgaaggcacgccttatagagttatactatgaaaacctgttcaaactggatacacctgtagaaggattgagagaatggctggatgctgttcagactgcagggataccttgtgctgttgcatcatcccttgacaggagatgcatgatcgaagctttggatcggatggcactaagcaaatatttcaaggcgattgtgactgacgaagatgatatggactcaatagcaaataggtttctgtcagctgctatgaagttggatcgtaaaccctcaaagtgtgttgtgtttgaggacgacccaaggggcgtcacagccgcccacaactgtactatgatggcagttgcattgattggtgctcatccagcgtatgagttggtacaggccgatcttgccattgcaaagtacagcgagctctcagtgatcaacctcagaaggctgtttgcgaacaagggaatcagcttcatggacttgcagaagcagataatcgagaagtcacctcccaagaggaggctgacagtagacaccattttctgatggatatactttatttggtgtctgtctgttgttcttgagtagccgaccatctttgacagcgttgtatataagatagtgctgatcttagttgatctgccgtgtccctccttgtgaatgcaatgcagtagttccatcaaggtaccatgaagactgctgcatcaatgttgctgttgatgtaagctgatattattcaaatttattcatatttcatagtcgatactagtgactgggcatgcccctgcgcctgggttgcaccaca

SEQ ID NO: 3434 - DNA, 1402 bp, Triticum aestivum
cccctcgcctctttccccttcccatttccatggagtcgtgcagcttccgcaccgccacctctccttcgccgttcccctcggctccgtcctcctcctcgtccgctcgcgtgccgtgccccagtctccggttcgccagagcaagaaatgggaggcagatgcggatgcggaggatggcgtcgggttttgatgccttcccacccctcccaggcaaagtcttcgtcgaggagacaattggagctgaatatggggaaggatttgagactttcaggatggacggaccactcaatatcgatgtggattatctaaacgaaaaattgcaagaatgcttccttcaaaggataaggcatgctatgaagccggatgaagcatttggtctaattttctcatgggacaatgttattgctgacacagactcactaaagttggatgcttggagacagcttgctttggaggaagggaaggacatccctactgctgctcatatccaaaagagtattcttcatggtgctgctgaccatgtccttagaaaggttttgtattgggcaaaagaggatgatcaaatggaaagattgaaggcacgccttatcgagctttactatgaaagcctcttcagacttgataccccagtagaaggattgagagaatggttggatgcagttcggacagcaggtataccctgtgctgtggcatcgtccctggataggagatgcatggttgaagctttggataggatgtcgttaagcaaatacttcaaggcgattgtgaccgatgaggatgacatggagtcaatagcacataggtttctctcagctgctgttaagttggatcggaagccctcgaaatgcatagtgtttgaggatgacccaagaggcgttacagctgctcacaactgcactatgatggcagtttccctgattggtgctcatccggcgtacgagctggaacaagcggaccttgctgtcgcgagatacagcgagctctcggtgatcaacctcagaaggatgtttgcacacaaggggctaagcttcatggacatgcagaagcagataattgagaggtcaccgcccaagagaaagctgacagtagacaccatcttctgattaactattttgctccggttccccatcttctgttcttgaaccgctagcctgcctgtggcttgcgcactgtatatagtgttgcattgcatgtgagttagataagatagtggcgtagtgctaatcttagctgatcccgtcgtgttgcactcgttcagagatctctgaatgtagtagctgtattcaaaattacagggagaaaattgccgccgttgctgctgcaagctaatggcggtatcgaatttattcattatttttaagttacatggagatgactattgcacattgctaagtctttttctgga

SEQ ID NO: 3435 - DNA, 1368 bp, Pseudoroegneria spicata
gagtcctgcagcttccgcaccgccacctctccttcgccgttcccctcggctccgtcgtcctcctcgtcccctcgcgcgccgtgccccagtctccggttccccagagcaagaaatgggaggcagatgcggacgcggaggatggcgtcggggtttgatgccttcccgcccctcccaggcaaggtcttcgtcgaggagacaattggagctgaatatggggaaggctttgagactttcaggatggacggaccactcaatatcgatgtggattatctgaatgaaaaattgcaagaatgcttccttcaaaggataaggcatgctatgaagccggatgaagcatttggtctaattttctcatgggacaatgttattgctgacacagactcactaaagttggatgcttggagacagcttgctttggaggaagggaaagacatccctactgctgctcatatccaaaagagtattcttcatggtgctgctgaccatgtccttagaaaggttttgtattgggcaaaagaggatgatcaaatggaaaggttgaaggcacgacttatagagctttactatgaaagcctcttcaaacttgacaccccagtagaaggattgagagaatggttggatgcagttcggacagcaggtataccctgcgctgtggcttcgtccctggataggagatgcatggttgaagctttggacaggatggcattaagcaaatacttcaaggcaattgtgaccgatgaggatgatatggagtcaatagcacataggtttctctcagctgctgttaagttggatcggaagccctcgaaatgcatagtgtttgaggatgacccaagaggcgttacagctgctcacaactgcactatgatggcagtttccctgattggtgctcatccagcgtacgagctggaacaagcggaccttgccgtcgcgagatacagcgagctctcggtgatcaacctcagaaggatgtttgcacacaaggggctaagcttcatggacatgcagaagcagataatcgagaggtcgccgcccacgagaaagctgacagtagacaccatcttctgactaactattttgctccggttccccatcttctgttcttgaaccgctagccagcagcctgtggcttgcgcactgtatatagtgttgcattgcatgtgagttagataagatagtggcgtagtgctgatcttagctgatcccgtcgtgttacactcgttcagagatctctgaatgtagtagctgtattcgaaattatagggagaaaattgccgccgttacaaccagcactgttgctgctgcaagctaatggcggtatcgaatttattcatcattttgaagttacatggagatgactattgcaca

SEQ ID NO: 3436 - DNA, 1659 bp, Triticum aestivum
aaacccttccactccatcccgtctctccccctcgcctctttccccttcccatttccatggagtcgtgcagcttccgcaccgccacctctccttcgccgttcccctcggctccgtcgtcctcctcgtcccctcgcgcgccgtgccccagtctccggttcgccagagcaagaaatgggaggcagatgcggatgcggaggatggcgtcggggtttgatgccttcccgcccctcccaggcaaggtcttcgtcgaggagacaattggagctgaatatggggaaggctttgagactttcaggatggacggaccactcaatatcgatgtggattatctgaacgaaaaattgcaagaatgcttccttcaaaggataaggcatgctatgaagccggatgaagcatttggtctaattttctcatgggacaatgttattgctgacacagactcactaaagttggatgcttggagacagcttgctttggaggaagggaaggacatccctactgctgctcatatccaaaagagtattattcatggtgctgctgaccatgtccttagaaaggttttgtattgggcaaaagaggatgatcaaatggaaaggttgaaggcacgacttatagagctttactatgaaagcctcttcaaacttgataccccagtagaaggattgagagaatggttggatgcagttcggacagcaggtataccctgtgctgtggcatcgtccctggataggagatgcatggttgaagctttggataggatgtcgttaagcaaatacttcaaggcaattgtgaccgatgaggatgatatggagtcaatagcacataggtttctctcagctgctgttaagttggatcggaagccctcgaagtgcatagtgtttgaggatgacccaagaggcgttacagctgctcacaactgcactatgatggcagtttccctgattggtgctcatccggcgtacgagctggaacaagcggaccttgctgtcgcgagatacagcgagctctcggtgatcaacctcagaaggatgtttgcacacaaggggctaagcttcatggacatgcagaagcagataatcgagcggtcaccacccaagaggaagctgacagtagacaccatcttctgactaactattttgctccggttccccatcttctgttcttgaaccgctagccagcagcctgtggcttgcgcactgtatatagtgttgcattgcatgtgagttagataagatagtggcgtagtgctgatcttagctgatcccgtcgtgttacactcgttcagagatctctgaatgtagtagctgtatttgaaattacagggagaaaattgccgccgttacaaccagcgccgttgctgctgcaagctaatggcagtatcgaatttattcatcattttgaagttacatggagatgactattgcacattgctaagtctttttctggatgagctgcattctcttgagaacacttttgctgatggcacgttcttcttttacatacttaggccccgttcggtgtccatccgctccactgctcctgctcctgctccgctccggccttaatacctgcgggacagcacaatcagcatggattggatccagaagaactgaacatcaacaatcacaattgctccactgaacaagacatggtgacctg

SEQ ID NO: 3437 - DNA, 1384 bp, Secale cereale
tgggaccctcgcctctttccccttcccatttccatggagtcctgcagcttccgcaccgccacatctccttcgccgttcccctcggctccgtcgtcctcctcctcccctcgcgcgccgtgccccagtctccggttcgccagagcaagaaatgggaggcagatgcggatgcggaggatggcgtcggggtttgatgccttcccgccctcccaggcaaggtcttcgtcgaggagacaattggagctgaatatggggaaggctttgagactttcaggatggacggaccactcaatatcgatgtggattatttgaacgaaaaattgcaagaatgcttccttcaaaggataaggcatgctatgaagccggatgaagcatttggtctaattttctcatgggacaatgttattgctgacacagactcactaaagttggatgcttggagacagcttgctttggaggaagggaaggacatccctactgctgctcatatccaaaaaagtattattcatggtgctgctgaccatgtccttagaaaggttttgtattgggcaaaagaggacgatcaaatggaaaggttgaaggcacgacttatagagctttactatgaaagcctcttcaaacttgacaccccagtagaaggattgagagaatggttggatgcagttcggacagcaggtataccctgcgctgtggcttcctccctggataggagatgcatggttgaagctttggacaggatggcattaagcaaatacttcaaggcgattgtgaccgatgaggatgatatggagtcaatagcacataggtttctctcagctgctgttaagttggatcggaagccctcgaaatgcatagtgtttgaggatgacccaagaggtgttacagctgctcacaactgcactatgatggcagtttcgctgattggtgctcatcctgcgtatgagctagaacaagcggaccttgctgtcgcgagatacagcgagctctcggtgatcaacctcagaaggatgtttgcacacaaggggctaagcttcatggacatgcagaagcagataatcgagaggtcgccacccaagaggaagctgacagtagacaccatcttctgactaactattttgctccggttccccatcttctgttcttgaaccgctagccagcaggcagcagcctgcggcttacgcagtgtatatagtgttgcattgcatgtgagttagataagatagtggcgtagtgctgatcttagctgatcctgtcgtgttacactcgttcagagatctctgaatgtagtagctgtattggaaattacagggagaaaaattgccgcctttgcaatgagtgccgttgctgctgcaagctaatgctggtatcgaatttattcatcattttg

SEQ ID NO: 3438 - DNA, 1364 bp, Triticum aestivum
agtcgtgcagcttccgcaccgccacctctccttcgccgttcccctcggctccgtcgtcctcctcgtcccctcgcgcgccgtgccccagtctccggttcgccagagcaagaaatgggaggcagatgcggatgcggaggatggcgtcggggtttgatgccttcccacccctcccaggcaaagtcttcgtcgaggagacaattggagctgaatatggggaaggatttgagactttcaggatggacggaccactcaatatcgatgtggattatctaaacgaaaaattgcaagaatgcttccttcaaaggataaggcatgctatgaagccggatgaagcatttggtctaattttctcatgggacaatgttattgctgacacagactcactaaagttggatgcttggagacagcttgctttggaggaagggaaggacatccctactgctgctcatatccaaaagagtattcttcatggtgctgctgaccatgtccttagaaaggttttgtattgggcaaaagaggatgatcaaatggaaagattgaaggcacgccttatcgagctttactatgaaagcctcttcaaacttgataccccagtagaaggattgagagaatggttggatgcagttcggacagcaggtataccctgtgctgtggcatcgtccctggataggagatgcatggttgaagctttggataggatgtcgttaagcaaatacttcaaggcgattgtgaccgatgaggatgatatggagtcaatagcacataggtttctctcagctgctgttaagttggatcggaagccctcgaaatgcatagtgtttgaggatgacccaagaggcgttacagctgctcacaactgcactatgatggcagtttccctgattggtgctcatccggcgtacgagctggaacaagcggaccttgctgtcgcgagatacagcgagctctcggtgatcaacctcagaaggatgtttgcacacaaggggctaagcttcatggacatgcagaagcagataatcgagaggtcaccacccaagaggaagctgacagtagacaccatcttctgactaactattttgctccggttccccatcttctgttcttgaaccgctagccagcagcctgtggcttgcgcactgtatatagtgttgcattgcatgtgagttagataagatagtggcgtagtgctgatcttagctgatcccgtcgtgttacactcgttcagagatctctgaatgtagtagctgtatttgaaattacagggagaaaattgccgccgttacaaccagcgccgttgctgctgcaagctaatggcggtatcgaatttattcatcattttgaagttacatggagatgactattgc

SEQ ID NO: 3439 - DNA, 1429 bp, Hordeum vulgare
gtaaacccttccactccatcctttctttccccttcccatttcaatggagtcctgcagcttccgcaccgccacctctccttcgccgttcccctcggctccgtcctcctcctcctcctcgtcacctcgcgcgccgtgccccaatctccgcttcgccagagcaagaaatgggaggcagatgcggattcggaggatggcgtcggggtttgacgccttcccgcccctcccaggcaaggtcttcgtcgaggagacaattggagctgaatatggggaaggctttgagactttcaggatggacggaccactcaatatcgatgtggattatctgaacgaaaaattgcaagaatgcttccttcaaaggataaggcatgctatgaagccagatgaagcatttggtctcattttctcatgggacaatgttattgctgacacagactcactaaagttggatgcttggagacagcttgctttggaggaagggaaggacatccctactgctgcccatatccaaaggagtattcttcatggtgctgctgaccatgtcctcagaaaggttttgtattgggcaaaggaggatgatcaaatggaaagattgaaggcacgccttatcgagctttactatgaaagcctcttcaaacttgataccccagtagaaggattgagagaatggttggatgcagttcggactgcaggtattccctgcgctgtggcatcctccctggataggagatgcatggttgaagctttggataggatggcgttaagcaaatacttcaaggcgattgtgaccgatgaggatgatatggagtcaatagcacataggtttctctcagctgctgttaagttggatcggaagccttcgaaatgtatagtgtttgaggatgacccaagaggcgttacagctgctcacaactgcactatgatggcagtttctttgattggtgctcatccggcgtacgagctggaacaagcggaccttgctgtcgctagatacagtgagctctcggtgatcaacctcagaaggatgtttgcacacaaggggctaagcttcatggacatgcagaagcagataatcgagaggtcgccacccaagaggaagctgacagtagataccatcttctgactaactattttgctctgattccccgtcttctgttcttgaactgctagccagtagcctgtggcttgcgcactgtatatagtgttgcattgcatgcgagttagataagatagtggcatagtgctgatcttagccgatcccgtcgtgtcacgctcgttcagagatctctgaatgtggtagctgtatttgaaattacagggagaaaaatactgccgttacaaccaatgctggtgctgctgcaatctaatggcggtattgaatttattcatcattttgaagttacatgaaggtgacttctggggacgggctgca

SEQ ID NO: 3440 - DNA, 1394 bp, Triticum aestivum
ttccccttcccatttccatggagtcgtgcagcttccgcaccgccacctctccttcgccgttcccctcggctccgtcgtcctcctcgtcccctcgcgcgccgtaccccaatctccggttcgccagagcaagaaatgggaggcagatgcggatgcggaggatggcgtcggggtttgatgccttcccgcccctcccaggcaaggtcttcgtcgaggagacaattggagctgaatatggggaaggcttcgagactttcaggatggacggaccactcaatattgatgtggattatcttaacgaaaaattgcaagaatgcttccttcaaaggataaggcatgctatgaagccggatgaagcatttggtttaattttctcatgggacaatgttattgctgacacagactcactaaagttggatgcttggagacagcttgctttggaggaagggaaggacatccctactgctgctcatatccaaaagagtattattcatggtgctgctgaccatgtccttagaaaggttttgtattgggcaaaagaggacgatcaaatggaaaggttgaaggcacgacttatagagctttactatgaaagcctcttcaaacttgacaccccagtagaaggattgagagaatggttggatgcagttcggacagcaggtataccctgcgctgtggcttcctccctggataggagatgcatggttgaagctttggacaggatggcattaagcaaatacttcaaggcgattgtgaccgatgaggatgatatggagtcaatagcacataggtttctctcagctgctgttaagttggatcggaagccctcgaaatgcatagtgtttgaggatgacccaagaggtgttacagctgctcacaactgcactatgatggcagtttcgctgattggtgctcatcctgcgtatgagctagaacaagcggaccttgctgtcgcgagatacagcgagctctcggtgatcaacctcagaaggatgtttgcacacaaggggctaagcttcatggacatgcagaagcagataatcgagaggtcgccacccaagaggaagctgacagtagacaccatcttctgactaactattttgctccggttccccatcttctgttcttgaaccgctagccagcaggcagcagcctgcggcttacgcagtgtatatagtgttgcattgcatgtgagttagataagatagtggcgtagtgctgatcttagctgatcctgtcgtgttacactcgttcagagatctctgaatgtagtagctgtattggaaattacagggagaaaaattgccgcctttacaatgagtgccgttgctgctgcaagctaatgctggtatcgaatttattcatcattttgaagttacatggagatgactattgca

SEQ ID NO: 3441 - DNA, 1796 bp, Hordeum vulgare
tcctttctttccccttcccatttcaatggagtcctgcagcttccgcaccgccacctctccttcgccgttcccctcggctccgtcctcctcctcctcctcgtcacctcgcgcgccgtgccccaatctccgcttcgccagagcaagaaatgggaggcagatgcggattcggaggatggcgtcggggtttgacgccttcccgcccctcccaggcaaggtcttcgtcgaggagacaattggagctgaatatggggaaggctttgagactttcaggatggacggaccactcaatatcgatgtggattatctgaacgaaaaattgcaagaatgcttccttcaaaggataaggcatgctatgaagccagatgaagcatttggtctcattttctcatgggacaatgttattgctgacacagactcactaaagttggatgcttggagacagcttgctttggaggaagggaaggacatccctactgctgcccatatccaaaggagtattcttcatggtgctgctgaccatgtcctcagaaaggttttgtattgggcaaaggaggatgatcaaatggaaagattgaaggcacgccttatcgagctttactatgaaagcctcttcaaacttgataccccagtagaaggattgagagaatggttggatgcagttcggactgcaggtattccctgcgctgtggcatcctccctggataggagatgcatggttgaagctttggataggatggcgttaagcaaatacttcaaggcgattgtgaccgatgaggatgatatggagtcaatagcacataggtttctctcagctgctgttaagttggatcggaagccttcgaaatgtatagtgtttgaggatgacccaagaggcgttacagctgctcacaactgcactatgatggcagtttctttgattggtgctcatccggcgtacgagctggaacaagcggaccttgctgtcgctagatacagtgagctctcggtgatcaacctcagaaggatgtttgcacacaaggggctaagcttcatggacatgcagaagcagataatcgagaggtcgccacccaagaggaagctgacagtagataccatcttctgactaactattttgctctgattccccgtcttctgttcttgaactgctagccagtagcctgtggcttgcgcactgtatatagtgttgcattgcatgcgagttagataagatagtggcatagtgctgatcttagccgatcccgtcgtgtcacgctcgttcagagatctctgaatgtggtagctgtatttgaaattacagggagaaaaatactgccgttacaaccaatgctggtgctgctgcaatctaatggcggtattgaatttattcatcattttgaagttacatgaaggtgacttctggagcggccgctgccggcagacgctgaaaacgggaaaagtgaagagaagtggagaaagaggcatagcagcgaaaaggtcctccaaagaaagggatatttacgatgatgcccttgagatattccaacctggacctcttcatcgccgtcatcggccgaagctccgccggaggaaatggtgggtgctccatgattgcggttccaacatgacgggcggccattgaccacactagcaagtagctagtgcatattagtgggctatacatacacacgcttgagatcattgtcattgtgttcatgcatgcactacattagtgggtgggtgagctatggcattcggcaacttgttgattcttcgcggccattgtctcatcatatggcaggtccaagtccaaaagatac

SEQ ID NO: 3442 - DNA, 1419 bp, Avena sativa
tttccatggagtcgtgcagcttccgcaccgccacctctccttcgcccttctcctcggccccgtcgtcctcctccccccctcgcctgccgtgccccaatctccgattccccagagcaagaaatgggaggctgatggggacgcggaggagggcgtcggggttcgatgtcttccctcccctcccaggcaaggtcttcgtcgaggagacaattggagctgaatatggggaaggctttgagacatttaggatggatggaccactcaatattgatgttgattatttgaatgaaaaattgcaagaatgcttccttcaaaggataaggcatgctatgaagccagatgaagcatttgggctaattttctcatgggacaatgttattgctgacacagactcactaaagttggatgcttggagacagcttgctttggaggaagggaaggacatccctacttctgctcgcatccaaaggagtattcttcatggtgctgctgaccatgtccttagaaaggttttgtattgggcaaaagaggatgatcaaatggaaagattgaaggcacgtcttatagagctgtactatgaaagcctcttcaaacttgatacaccagtagaagggttgagagaatggttggatgcagttcggacagcaggtataccatgcgctgtggcatcgtccctggataggagatgcatggttgaagctttggataggatggcgctaagcaaatacttcaaggcgatagtgaccgatgaggatgatatggagtcaatagctcatagatttctctcagctgctgtgaagttggatcggaagccctcaaaatgcatagtgtttgaggatgaccccagaggcgttacagctgctcacaactgcactatgatggcagtttccttgattggtgctcaccctgcgtatgagctggaacaagccgaccttgccgtcgcgaaatacggcgagctctcggtgatcaatctgagaaggctgtttgcgcacaaggggataagcttcatggacatgcagaagcagctaatcgagagatcgcctcccaagaggaagctgaccgtggacaccatcttctgattaactcttctgctctgtttccctctcgttggttcttgattcgccaggcctgccgtccaccgctttgctcagtgtatatagtgttttgttccatgccagttagataagatagcattgatcctagctgatcctgttgcgttacgctcgttcagagatctctgaatgtagtagtagtagtttgtatcgaagtaccatgaagaaatgtactgctgttacaacggatgttgttggtgttgtaatgcttgtggcgttatcggatttattcaggacttgaagttacgtgatggctatttcacattgttctcttgtcttgagtgccttaatgggaagaactggatgaact

SEQ ID NO: 3443 - DNA, 1505 bp, Brachypodium distachyon
aaattaaaaaagggataatgaaataaaaatctaaaaataatacccttccatttcatcccgtcttctcttcctccccctcttcctctttcccctacccgtggccatggagtcgtgcagcttccgcaccgccacctctccttcgccgttcccctcggctccttcctcctcgtactcctcctacgctcgctccccttgccccaatatccgattcgccagaacgagaaatggcaggcagatggggatgcggaggagggcctctgggtttgatgccttcccgcccctcccaggcaaggttttcgttgaggagacaattggagctgaatatggggaaggctttgagacatttaggatggatggaccactcaatatcgatgtggattatctgaacgaaaaattgcaagaatgcttccttcaaaggataaggcatgctatgaagccagatgaagcgtttgggttaatcttctcatgggacaatgttattgctgacacagactcactaaaattggatgcttggagacagcttgctctggaggaagggaaggatatccctactgctgctcatataaaaaagagtattcttcatggttctgctgatcatgtgcttagaaaggttttgtattgggcaaaagaggatggtcaaatggaaaaactaaaggcacgccttatagagctgtactatgaaagtctcttcaaacttgatacaccagtagagggattgagagaatggttggatgcagttcagacagcaggcataccctgtgctgtggcatcatccctggataggagatgcatggttgaagctttggataggatggccctaagcaaatacttcaaggctattgtgacagatgaggatgatatggagtcaatagcacataggtttctgtcagctgctgtgaagttggatcggaagccctcaaagtgtatagtgtttgaggatgacccaagaggtgttacagctgctcacaactgcactatgatggctgtttccctgattggcgctcatcccgcgtatgagctggaacaagccgaccttgctgtcgcgagatataacgagctctcagtgatcaacctgagaaggctgtttgcacacaaggggatcagcttcatggacatgcagaagcagataatagagaggtcaccacccaagaggaagctgacagtagacaccatcttctgactgactctttattctggttctcctttgttcattctcgaatcgccagccagatgcccaccatctttgggcagtgtatatagtgttgcattgcctgtcagttagataagatagtgctgatgttagctgatcctatatcgttacattcgttcagagatctctgaatgtagcagttgtattgaattttactggaataaaagtgcttctgctccaatcaatgctgttgctactgtaaggtaatggcatcatcaaatttcttgatgatactaatggcatcatcaaatttcttcacgattcgaagttacatgaagatgactgttacatgcta

SEQ ID NO: 3444 - DNA, 1133 bp, Festuca arundinacea
  misc_feature (109)..(109): n is a, c, g, or t
  misc_feature (253)..(253): n is a, c, g, or t
  misc_feature (805)..(805): n is a, c, g, or t
  misc_feature (836)..(836): n is a, c, g, or t
atcccgtctccctttcctccctctctcctcttcccctcttcccatttccatggagtcgtgcagcttccgcaccgccacctctccttcgccgttctcctcggccccgtcntcctcctcctcccctcgtgcgccatgccccaatctccgattcgcgagagaaagaaatgggaggcagatgcggatgcggaggagggcgtcgggatttgatgccttcccgcccctcccaggcaaggtcttcgtcgaggagacaatnggagctgaatatggggaaggcttcgagacatttaggatggacggaccactcaatattgatgtggattatttgaacgaaaaactgcaagaatgcttccttcaaaggataaggcatgctatgaagccagatgaagcttttgggctaattttctcatgggacaatgttattgctgacacagactcactaaagttggatgcttggagacagcttgctttggaggaagggaaggacatccctaccgctgctcacatccaaaggagtattcttcatggtgctgctgaccatgtccttagaaaggttttgtattgggcaaaagaggatgatcaaatggatagattaaaggcacgtcttatagagctgtactatgaaagtctcttcaaacttgatacaccagtagaaggattgagagaatggttggatgcagttcggacagcaggtataccatgcgctgtggcatcgtccctggataggagatgcatggttgaagctttggataggatgtcactaagcaaatacttcaaggcgatagtgaccgatgaggatgatatggantcaatagcacatagatttctttcagctgctntgaagttagatcggaagccctcgaaatgcatagtgtttgaggattgccccagaggcgttacagctgctcataactgcactatgatggcagtttcattgattggtgctcatcctgcgtatgagctggagcaagcggaccttgccgtcgcgaaatacaatgacctctcggtgatcaatctgagaaggctgtttgcacacaaggggataagcttcatggacatgcagaagcagataattgagaggtcgccccccaagaggaagctaaccgtggacaccatcttctgattaactcttctgc

SEQ ID NO: 3445 - DNA, 1509 bp, Zea mays
acattttacggccacaaaaaatgtataaaataggaaatgggaaaaccccatcacagctccacgcctccactgctatccctctcttcctctctgctttccccttccaatggaatcctgtagcttccgtgccgcaaccgcgccttctccctttccctccgctccttcttcatcttcatccccgcgcgccccatgccccatactccgatttcccaggccaagaaaagggaggcagattggggtgcggaggagggcgtccggatttgatgccttcgcgtctttcgccggcaaggtcttcgtggatgaggcgattggagcggaatatggggagggcttcgaaacatttcgaatggatggaccactcaaggttgatgtggattatctgaatgaaaaattgcaagagtgcttccttcaaaggataaggcatgctatgaagccggatgaggcgtttggtctaattttttcgtgggacaatgttattgctgatacagactcgctaaagttgaatgcttggagacaacttgctttggaggaaggtaaggatatcccaagtggtgctcatgtccggaagagcattattcatggtgctgctgaccatgttcttagaaaggttttgtactgggcaaaagaggaagataaaatggaaaaattgaaggcacgccttatagagttgtactacgagaacctgttcaaactcgatacacctgtagaaggattgagagaatggctggatgctgttcagacagcagggataccttgtgctgtcgcatcaccccttgacaggagatgcatgatcgaagctttggatcggatggcgctaagcaaatatttcaaggcgatcgtgactgacgaagatgatatggagtcgatagcaaatcgatttctgtcagctgctatgaaggcatgctcctgccccacttctaatcgttgtacatcatgttaatatatataggtcacacatttgcggtttttcttttcttcctggcagttggatcgtaaaccctcgaagtgtgtggtgttcgaggatgacccaaggggcgtcacagccgcccacaactgtacaatgatggcagtcgcattgattggtgctcatccagcgtatgagttggtacaggcagaccttgccattgcaaagtacagcgagctctcagtgatcaacctcagaaggctgtttgcgaacaagggaatcagcttcatggacttgcagaagcagataatcgagaagtcacctcccaagaggaggctgacagtagacaccattttctgatagatacacttttatttggtgtctgcctgttgttcttgagtagccaacaaccttcggcattatggcggtggcgttgtatataagatagtgctgatgttaggtgatccgctgtgtacctccttgtgaatgcaatgcggtagttccatcaaggtaccatgaggaagactgctgcaacaatgttgttgctgatgtaagctgatattattcaaatttattcatatttcatggtcgatatctagctcgtc

SEQ ID NO: 3446 - DNA, 1458 bp, Panicum virgatum
tcaggtgccagaagtgatcgactgcaggtatgggcaacttgtgctgctgtgttcaagttgatcagtcaaccgtggccatcagggagcagtttggcaagtttgacagcgtgcttgagccaggatgccactgcttgccttggttcatcggcaagcgtgtagctggtcatctcacactcaggctgcagcaactggatgtgcgctgtgagaccaagactaaggacaatgtctttgtgaacgtcgtggcatctattcagtaccgtgctctggctggcaaagcaagtgatgcgttctacaaactgagcaacacaaggtcccagatccaagcatacgtctttgatgttatccgagcaagcgttcccaagctcattttagatgacgctttcgagcagaaggatgagatcgcaaaggcagtggaggaggaactcgagaaggccatgtcagcttacggctttgagatcgtgcaaactctgattgtggacattgagccagatgagcacgtgaagcgcgcaatgaatgagatcaacgcagcggcgaggctgagggtggctgcgaacgagaaggccgaggcggagaagatcgtgcagatcaagcgcgcggagggtgaggcggaggccaagtacctgtccgggctgggcatcgcccgtcagcggcaagcaatcgtggatgggctgagggacagtgtgctgggcttctccgtgaacgtgcctggcaccaccgccaaggacgtgatggacatggtgctcatcacccagtacttcgacaccatgaaggagatcggcgcgtcatccaaggcctcatcggtgttcatcccgcatggccccggcgcagtgcgcgacatcgccacgcagatccgcgacggcctcctgcagggctcctccgtctcccaccactagtctgctggttctggagcagcgtggatgcggattcattcagtcgcagggaaggagattgcttagctatatgcttgccactcagtcagaccagtatgatgcctgtctatattgctcgtgtgtttctgcggagtatggagtgatttcagtgtggaaccataaattataacactcttcagtattacctgctactcctagggtgcttggggatcggagaaccttatctaaccttttataagtggtaatatgaacataaggcagcatgagtttgcagtatatctactcttcctgtcatgcatgtcgcctgaattctgtttcagcgaactgtttgtttgcaatcaagctcccttccaatcaataacaggaaaatgttgctgcacgctgcctgtaaacatgttggtgcagactgcagatgcatgaatgagaaatttgcccaatgttgccagaacgaaggagctgccatgaatgagtggcgcaccacatgcgtcgtaatggaggcagcatcatagcacaacatagcattgttttgacctatcctgaaaatgaatgatggtgctcatgattgaga

SEQ ID NO: 3447 - DNA, 1514 bp, Setaria italica
atggcggtcgagagcgtcggcccggggtgctccgccatctgcccagggaagcttcgctgcgctaggccagggagctgcgccgccggccagggagctccgccgtcggcttggggagctccgccgctgatcttgagagttgctccggtgtggtggacactggactggacggactatatatcaaaccagttcaaggcgaggcagtctgctcacaagcctctgctcctccgtcgtcttcctcgcctcttctccgaccgttcgaagcccaggcattcagttaccagcagaagtgatccgtggactgcagctatgggcaacttgtgctgctgtgttcaagttgatcagtcgaccgtggccatcagggagcagtttggcaagtttgacagcgtgcttgagccagggtgccactgcatgccctggttcatcgggaagcgtgtagctggtcatctcacgctcaggctgcagcaactggatgtgcgctgtgagaccaagactaaggacaatgtctttgtgaacgtcgtggcatctattcagtaccgcgctctggctggcaaagcaagcgatgcgttctacaaactgagcaacacaaggtcccagatccaagcttacgtctttgacgttatcagagcaagtgtccccaagctcatcctagacgacgctttcgagcagaaggatgagatcgcaaaggctgtggaggaggagctcgagaaagccatgtcagcttacggctttgagatcgtgcagactctgatcgtggacatcgagccagacgagcacgtgaagcgcgcaatgaacgagatcaacgcagcggcgaggctgagggtggccgcgaacgagaaggctgaggctgagaagatcgtgcagatcaagcgcgcggagggggaggcggaggccaagtacctgtccgggctgggcatcgcccggcagcggcaggcgatcgtggacgggctgcgtgacagcgtgctgggcttctccgtcaacgtgccgggcaccaccgccaaggacgtgatggacatggtgctcatcacccagtacttcgacaccatgaaggagatcggcgcgtcgtccaaggcctcatcggtgttcatcccgcacggccccggcgcggtgcgcgacatcgccacgcagatccgcgacggcctcctgcagggctccgccgtctcccaccactagttcgctggtgctggagcagcgtggtgggcgtggatccattcagtcacaaggaaggagcttgctagctataccatttatgcttgccactgtcagtcagggtcagtgtggtgcctgtctatattgctcatgtgtgttatctggagtgatctcagcgtggaaccgtatataatggctctcgagtgttacctgctactgctagaatgcttggggatcgacaaacttatctaaccttttagagaagtggcaagataaatataatgcagcatgagtttgcagtatgtctactctgtttgtcatgcgtgaagctctgaattcagtttcagtgagctgcttgcttgcaatca

SEQ ID NO: 3448 - DNA, 1228 bp, Eragrostis curvula
  misc_feature (1063)..(1063): n is a, c, g, or t
ccccccataactcccccctgccagttggggcaagctgggtgtgttccctctcgctctgccgtttcggcgctggtaccacgggcagtgacttgtagacggcaaggatgggcaacttgtgctgctgtgttcaggtcgatcagtccaccgtggccatcagagagcagtttggcaagtttgacagtgtactggagcccggctgtcactgcttgccatggtttgtcggtaagcgcgttgctggtcatctcacactcaggctgcagcaacttgatgtgaaatgtgagaccaaaacaaaggacaatgtttttgtgaatgtcgttgcatccattcagtaccgtgctctggctggcaaagcaagtgatgcattctacaagctgaccaacacaaggtcccagatccaagcttacgtctttgatgtgatcagagccagtgtcccgaaactcaacctcgacgacacgttcgagcagaagaatgagatagcaaaggccgttgaggaggagcttgagaaggccatgtctgcctatggctttgagatcgtgcaaacgctgatcgtggacatcgagccagacgagcacgtcaagcgcgccatgaacgagatcaacgcagctgcgaggctgaggatggctgcgaacgaaaaggcggaggcggagaagatcgtgcagatcaagcgcgcggagggagaggcggaggccaagtacctgtccggcctcggcatcgcccggcagcgccaggccatcgtcgacggcctgcgtgacagcgtgctgggcttctccgtcaacgtgcctgggacaactgccaaggacgtcatggacatggtgttgatcacccagtacttcgacacgatgaaggaaatcggcgcgtcgtccaaggcctcgtcggtgttcatcccccacggccccggcgcggtgcgcgacatcgccacgcagatccgcgacggcctcctccagggcgctgccacccagcgccactagcccagcaatctcggacggactcactgcctgccagttcatgctactactagctatgcttgctaccgtactctaaatttgatgatggtgtgaatgcntaaagtttggtgagaccgacctccttcagaccactaaaatgaattaactggtggtccaaacctctaaataaatttgggcttgaaggggcagcatgaattgtcctctagatttaatccattccggcaaccaaagtttctccgtaatttccctgcaagggaaaaaaa

SEQ ID NO: 3449 - DNA, 1243 bp, Panicum virgatum
gcactctgcctgcacacaagcgtctgctgctccgtcgtcttcctcgcctcttctccaaccgttcgaccccgcaaggtgccagaagtgatcgactgcaggtatgggcaacttgtgctgctgtgttcaagttgatcagtcaaccgtggccatcagggagcagtttggcaagtttgacagcgtgcttgagccaggatgccactgcttgccttggttcatcggcaagcgtgtagctggtcatctcacactcaggctgcagcaactggatgtgcgctgtgagaccaagactaaggacaatgtctttgtgaacgtcgtggcatctattcagtaccgtgctctggctggcaaagcaagtgatgcgttctacaaactgagcaacacaaggtcccagatccaagcatacgtctttgatgttatccgagcaagcgttcccaagctcattttagatgacgctttcgagcagaaggatgagatcgcaaaggcagtggaggaggaactcgagaaggccatgtcagcttacggctttgagatcgtgcaaactctgattgtggacattgagccagatgagcacgtgaagcgcgcaatgaatgagatcaacgcagcggcgaggctgagggtggctgcgaacgagaaggccgaggcggagaagatcgtgcagatcaagcgcgcggagggtgaggcggaggccaagtacctgtccgggctgggcatcgcccgtcagcggcaagcaatcgtggatgggctgagggacagtgtgctgggcttctccgtgaacgtgcctggcaccaccgccaaggacgtgatggacatggtgctcatcacccagtacttcgacaccatgaaggagatcggcgcgtcatccaaggcctcatcggtgttcatcccgcatggccccggcgcagtgcgcgacatcgccacgcagatccgcgacggcctcctgcagggctcctccgtctcccaccactagtctgctggttctggagcagcgtggatgcggattcattcagtcgcagggaaggagattgcttagctatatgcttgccactcagtcagaccagtatgatgcctgtctatattgctcgtgtgtttctgcggagtatggagtgatttcagtgtggaaccataaattataacactcttcagtattacctgctactcctagggtgcttggggatcggagaaccttatctaaccttttataagtggtaatatgaacataaggcagcatgagtttgcagtatatcta

SEQ ID NO: 3450 - DNA, 1753 bp, Sorghum bicolor
cgagttgtggagctaaaacaagaaacagagaacgtgaggtccgtctgatattttatttctttcgattatgcatttcaaaaaataagactaaagtaagctaaaaaaaaatctaagagctagctataatttattcaagctattagtacctcctaaagaatgccaatgtccattgtcactgagagaggatcatgtactaaactaccctctgagaactggacgtctggacagacagcagcggagcactatacatcggcatagcagagcactccccctttctcactcgcagctctgctccttggtcgtcttcgtcctcttctcttgtgcctgccaactgccatccacgaccccgcaagggcaaggtgccagcagaagtgatccgtggactgcagctatgggcaacctgtgctgctgtgttcaagttgaccagtcgactgtggccatcagggagcagtttggcaagtttgacggcgtgcttgagccaggatgccactgcatgccttggttcgttgggaagcgtgtagctggtcatctcacactcaggctgcagcaactggatgtgcgctgtgagaccaaaacaaaggacaatgtctttgtcaatgtggtggcatctattcagtaccgcgctctggctggcaaagcaagtgatgcattctacaaactgagcaacacaaggtcccagatccaagcttacgtctttgacgttatcagagcaagcgttcccaagctccatttggacgatgctttcgagcagaaggacgagatcgcaaaggctgtggaggaagagcttgagaaggccatgtcggcttatggctttgagatcgtgcagactctcattgtggacatcgagccagatgaacatgtgaagcgcgcaatgaacgagatcaacgcagctgcgaggctgagggcggctgcaaacgagaaagcagaggcagagaagattgtgcagatcaagcgtgcggagggggaggcggaagccaagtacctgtctgggctgggtattgcacggcagcggcaggcgatcgttgatgggctgagggacagcgtgcttgggttctccgtgaacgtgccgggcaccaccgccaaggacgtcatggacatggtgctcatcacccagtacttcgacaccatgaaggagattggcgcatcatccaaggcttcatcagtgttcatcccacatggcccaggtgcagtgcgcgacatcgccacgcagatccgcgacggcctcctgcagggctcctctgtcacccagcactagtttgctgttgctgaggggagcagcatgatcattcctggagtttggtacctatttatatgaccccgtcagtcagaccagtgtggtgcttgtctatattgttcgtctatatctctggagctggggtgatcaaggtgtggaacatatataatgtgctcttaagaaccatctgcttctgctaagatggttatcttgatgcaatggggactggagaacctttatctaaccttttagggaaccggtaattatatcataaatataatgcagcatgagtttgcagtatgttcatgtgtcatgtatgctgcctgaattcagatgttgctgccctgaatatgttgatgcagagtgcaaattcatgaatggaatgtgctcaatgttggcaggaggacctgccactgttgccacgagtgaatggcacacatgcacagtaatgggggcatcatagcacagcatagagttgctttcaaacaccataataataaataatgaatgatgatgctg

SEQ ID NO: 3451 - DNA, 1322 bp, Cenchrus ciliaris
  misc_feature (804)..(804): n is a, c, g, or t
  misc_feature (1098)..(1098): n is a, c, g, or t
caccagttcaaggcgagcaatctgctgctcgcaagcctctgctcctccgtccgtcgtcttcctcgcctcttctccgaccgttccgagccccaaggtgccagcagaagtgatccgtggactgtagctatgggcaacttgtgctgctgtgttcaagttgatcagtcgactgtggccatcagggagcagtttggcaagtttgacagcgtgcttgagccagggtgccactgcatgccctggttcatggggaagcgcgtagctggtcatctgacgctcaggctgcagcaacttgatgtgcgctgtgaaaccaagactaaggacaatgtctttgtgaacgtcgtggcatctgttcagtaccgtgctctggctggcaaagcaaacgatgcgttctacaaactgagcaacacaaggtcccagatccaagcgtatgtctttgacgttatcagagcaagtgtccccaagctcatcctggacgacgccttcgagcagaaggatgagatcgcaaaggctgtggaggaggagctcgagaaggccatgtcagcttacggctttgagatcgtgcagactctgatcgtggacatcgagccagacgagcacgtgaagcgcgcaatgaatgagatcaacgcagcggcgaggatgagggtggccgccaacgagaaggccgaggctgagaagatcgtgcagatcaagcgcgcggagggggaggcggaggccaagtacctgtctgggctgggtatcgcccggcagcggcaggcgatcgtggacgggctgagggacagcgtgctgggcttctccgtgaacgtgccnggcaccaccgctaaggacgtgatggacatggtgctcatcacccagtacttcgacaccatgaaggagatcggcgcgtcatccaaggcctcgtcggtgttcatcccgcacggccccggcgcggtgcgcgacatcgccacgcagatccgcgatggcctcctgcagggctcgtccgtctcccaccagtagtcgcttcgtcttggtgtggtggatccattcagtcacaaggaagaagcttgctagctatactatttatgcttgccactgtcagtcagagtgtcagaccagtgtgatgcntgtctatattgctcgtgtgtttttctggagtgtgtgatctcagtgtggaaccatatgtaaaatggatcttgagtatggagtgcctgctactgctagaatgattggggtgggagaaacttacctaaccttttagagaaatggcaagataaacataatgcagcatgagtttgcagtatgtctaactctgtctgtcatgcgtgaagctttgaattcagtttcagtga

SEQ ID NO: 3452 - DNA, 944 bp, Saccharum officinarum
tgccagcagaagtgatccgtggactgaagctatgggcaacctgtgctgctgtgttcaagttgaccagtcgactgtggccatcagggagcagtttggcaagtttgacagcgtgcttgagccaggatgccactgcatgccttggttcgccgggaagcgtgtagctggtcatctcacactcaggctgcagcaactggatgtgcgctgtgagaccaaaacaaaggacaatgtctttgtcaatgtggtggcatctattcagtaccgcgctttggctgacaaagcaagtgacgcgttctacaaactgagcaacacaaggtcccagatccaagcttacgtctttgacgttatcagagcaagtgttcccaagctccatttggacgatgctttcgagcagaaggatgagatcgcaagggctgtggaggaagagcttgagaaggccatgtcggcttatggctttgagatcgtgcagactctcattgtggacatcgagccagacgagcatgtgaagcgcgcaatgaacgagatcaacgcagctgcgaggctgagggcggctgcaaacgagaaggcagaggcggagaagatcgtgcagatcaagcgtgcggagggggaggcggaagccaagtacctttccgggctgggcattgcacggcagcggcaggcgatcgtggacgggctgagggacagcgtgctagggttctccgtgaacgtgccgggcaccaccgccaaggacgtcatggacatggtgctcatcacccagtacttcgacaccatgaaggagatcggcgcatcgtccaaggcttcgtcggtgttcatcccgcatggtcccggtgcggtgcgcgacatcgccacgcagatccgcgatggcctcctgcagggctcctctgtcacccagcactagtttgctgttgctgactggagcagcatgatcatttcaggagcttggtacc

SEQ ID NO: 3453 - DNA, 1390 bp, Zea mays
gacgcagggcaatcacggatttcatggtacaagataagaagaatgccagggcactgcccctgcccctgtggtttggacagctagctacatggactcctgctttcacgttctcatacaggcactcctgcactgtgctccttcgtctcctcctcccctgcctgccaccaactgccaaggtgccaagtgcagataccttccctgcctcacaaacaacgccaccctgtactagataccatcagggtcttcaaccagggcaggtttatgttcaggtggcactgccagcagaagtgatccgttgacttcagctatgggcaacctgtgctgctgtgttcaagtcgaccagtcgactgtggccatcagggagcagtttggcaagtttgacagcgtgcttgagccaggatgccactgcatgccttggttcgccggcaagcgtgtagctgggcaactcacactcaggctgcagcaactggatgtgcgctgtgagacaaaaacaaaggacaatgttttcgtgaatgtggtggcatctattcagtaccgcgctctggctgacaaagcaagtgacgctttctacaaactgagcaacacaaggtcccagatccaagcctacgtctttgacgtgatcagagcaagcgttcccaagctccatttggacgatgctttcgagcagaaggacgagatcgcaagggcggtggaggaagagcttgagaaggccatgtcggcttatggctttgagatcgtgcagactctcatcgtggacatcgagccagacgagcatgtgaagcgcgcaatgaacgagatcaacgcagctgcgaggctcagggcggctgcaaacgagaaggcggaggcggagaagatcgtgcagatcaagcgcgcggagggggaggcagaagccaagtacctgtccgggctgggcattgcgcgccagcggcaggccatcgtggacgggctcagggacagcgtgctggggttctccgtcaacgtgccgggcaccaccgccaaggacgtcatggacatggtgctcatcacccagtacttcgacaccatgaaggagatcggcgcgtcgtccaaggcgtcctcggtgttcatcccgcatggccccggagcggtgcgcgacattgccacgcagatccgcgacggcctcctgcagggatcctctgtcgccaaacactaagctgcctgccgttgccgttgctgctgaagaacaccaccaccactattatatatataatataatgatgatcttggtaccagagtgatgcttgtctatattgttcatcactcatcgtcaccatctgctaggatggctatctttatgcttggggattggagaaaaccttatctaaccttttagggaaccggtaatatatataatgcagcatgagtttgcagt

SEQ ID NO: 3454 - DNA, 1455 bp, Brachypodium distachyon
gttcttatcccgtccgaaggctgcaactgcaaggcagatttggttggggttgcagtgcagaggagtccgcaacttttgtaacactaatcacgatgattttcacagtaatgtcgaggatgtgttgttccacacggagtaggagtagtatttaggctgtcttggggttgcgagaaagagaagaggtagtcgcactagtctcctttctccaagcaccgcccgaggtactaccagaagggatctgaaggtttccattatgggcaatttgtgctgctgtgttcaagttgatcagtctaccgtggccatcagagagcagtttgggaggttcgatagtgtgcttgagccaggatgccactgcctgccgtggatgattgggaagcgtatagttggccatctcactctcaggttgcagcaactggatgtgcgctgtgaaactaagacaaaggacaatgtgtttgtaactgttgttgcgtctattcagtaccgaccgctggctggcaaagaaagtgatgcattctacaaactaacaaacacaagatcccagatccaagcttatgtttttgatgtgatcagggcaagtgttccaaagctcaacctggatgatgcttttgagcagaagaacgatatagcaaaagctgtggaggatgaacttgaaaaggcaatgtcagcatatggatttgagatcgtgcagactctcatcgttgacattgagccagatgagcatgtcaaacgtgcaatgaatgagatcaatgcagctgcaaggatgagggtggctgcaaatgagaaggctgaagctgagaagattgtccagatcaagcgtgccgagggcgaagcagaagccaagtacctgtccggactgggtatcgcccgccagcgccaggccatcgtggatggcctgagggacagtgtcctgggcttctcagtcaatgtgcctggcaccaccgccaaggacgtgatggacatggtgctcatcacccagtacttcgacaccatgaaggagatcggcgcgtcctcaaagtcctccgcggtgttcatcccccacggccctggcgcggtgcgagacatcgccacgcagatccgtgacgggcttcttcagggccagtctgccgctcatcagtagttcgcttcggccagaataataagaactcttacagctgatgttagctatgccttactatattatgacttgtctggaaccatgtgtggatttggattgtggcatgtcctaccttaggttgatgcgtggaaacagaactttaaacccttttgggtatgtctatattataaaacggtggtgatgaacttgatctgacgcttttgccgcatttccctcgccttatgacgaccaatggtttaggaactaaatttgattggttgatacttgtagaaatttaagacacttattatgaatcggaggaagtatctctccgacctatctgcgtgattgaatcgagctgg

SEQ ID NO: 3455 - DNA, 1048 bp, Cucumis sativus
gacccacttctataaacttgatccttgttctcaaacagcccttgaattccaatcgcagtggggtttgtgaaggttaacacaaactgaaaggttcaagatatgggtaatcttttttgttgtgtgaaagtggaccagtccactgtagctatcagggagacgtttggcaaatttgatgaagttgttgagccaggatgccattgcttgccttggtttcttggagcccagatcgccggcactctgtctctccggttgcaacaattggatgtgcgatgcgagaccaagacaaaggataatgtgttcgttaatgtggttgcctctattcaatatcgagcactggcggataaagcaaatgatgcattctacaagctcagcaatacaaggtcccagatccaggcttatgtttttgatgtgatcagggcaagtgttccaaaactcaacttggatgatgcttttgagcagaaaaatgatattgctaaagcagtagaagatgaacttgagaaggctatgtcggcttatggctttgagattgtccaaaccctcattgttgatatagaaccagacgagcatgttaagagagcaatgaatgaaattaatgctgctgctagattaagggtggcagcaaatgagaaggcagaagcagagaaaattttacagattaagcgagccgagggtgaagctgaagccaagtatttgtcaggtttgggtattgctcggcagcgtcaagcaattgtggatggtttaagagacagtgttttgggtttctctgttaatgttcctgggacgacagcaaaggatgttatggatatggtgcttgtgacccagtattttgacaccatgaaggaaattggagctgcctcgaaatcaacttctgtgtttatacctcatggacctggagctgttcgagatgtcgcatcacagattcgtgatggacttcttcagggtgccgctacttctcactagtccaactctgtgttaaaatgatgtttgtaaggtggtattcagtgtgttgtaattttctcttcttaaatgatatatattgtgtatttga

SEQ ID NO: 3456 - DNA, 1259 bp, Panicum virgatum
cagaacagttcaaggcaaggccctctgcctgctcacaagcctctgctcctccgtcgtcttcctcgcctcttctccaaccgttcgaccccgcaaggtgccagaagtgatcgactgaagctatgggaaacttatgctgctgtgttcaagttgatcagtcgactgtggccatcagggagcagtttggcaagtttgacagcgtgcttgagccaggatgccactgcatgccttggttcatcggcaagcgtgtagctggtcatcttacactcaggctgcagcaactggacgtgcgctgtgagaccaagactaaggacaatgtctttgtgaacgtcgtggcatctattcagtaccgtgctctggctggcaaagcaagcgatgcgttctacaaactgagcaacacaaggtcccagatccaagcatacgtctttgatgttatccgagcaagcgttcccaagctcattttagatgacgcttttgagcagaaagatgagatcgcaaaggctgtggaggaggagctcgagaaggccatgtcagcttacggttttgagatcgtgcagactctgattgtggacattgagccagatgagcacgtgaagcgctcaatgaatgagatcaacgcagcggcgaggctgagggttgctgcgaacgagaagggtgaggcggagaagatcgtgcagatcaagcgtgcggagggtgaggcggaggccaagttcctgtctgggctgggcattgcccggcagcggcaggcgatcgtggatgggctgagggacagcgtgctgggcttctccgtgaacgtgccgggcaccaccgccaaggacgtgatggacatggtgctcatcacccagtacttcgacaccatgaaggagatcggcgcgtcgtccaaggcctcgtcggtgttcatcccgcatggccccggcgcggtgcgcgacatcgccactcagatccgcgaaggcctcctgcagggctcttccgtctcccaccactagtctgctggttctggagcagcgtggatgcggattcattcagtcacagggaaggagattgcttagctatatatgcttgccactgtcggtcagaccagtatgatgcctgtctatattgctcgtgtgtttctgcggagtatggagtgatctcagtgtggaaccataaattataacgctctacctgctactcctaggatgcttggggatcggagaaccttatctaaccttttagagaaggggtaatatgaacataatgcagcatgagtttgcagtatatct

SEQ ID NO: 3457 - DNA, 1378 bp, Panicum virgatum
tatgagaatcatgtgatgtccaaacgggacactggactactgcacggacctatatataatatatgcaggggagggacaggccagccgccatcagaacagttcaaggcaaggccctctgcctgctcacaagcctctgctcctccgtcgtcttcctcgcctcttctccaaccgttcgaccccgcaaggtgccagaagtgatcgactgaagctatgggaaacttatgctgctgtgttcaagttgatcagtcgactgtggccatcagggagcagtttggcaagtttgacagcgtgcttgagccaggatgccactgcatgccttggttcatcggcaagcgtgtagctggtcatcttacactcaggctgcagcaactggacgtgcgctgtgagaccaagactaaggacaatgtctttgtgaacgtcgtggcatctattcagtaccgtgctctggctggcaaagcaagcgatgcgttctacaaactgagcaacacaaggtcccagatccaagcatacgtctttgatgttatccgagcaagcgttcccaagctcattttagatgacgcttttgagcagaaagatgagatcgcaaaggctgtggaggaggagctcgagaaggccatgtcagcttacggttttgagatcgtgcagactctgattgtggacattgagccagatgagcacgtgaagcgctcaatgaatgagatcaacgcagcggcgaggctgagggttgctgcgaacgagaagggtgaggcggagaagatcgtgcagatcaagcgtgcggagggtgaggcggaggccaagttcctgtctgggctgggcattgcccggcagcggcaggcgatcgtggatgggctgagggacagcgtgctgggcttctccgtgaacgtgccgggcaccaccgccaaggacgtgatggacatggtgctcatcacccagtacttcgacaccatgaaggagatcggcgcgtcgtccaaggcctcgtcggtgttcatcccgcatggccccggcgcggtgcgcgacatcgccactcagatccgcgaaggcctcctgcagggctcttccgtctcccaccactagtctgctggttctggagcagcgtggatgcggattcattcagtcacagggaaggagattgcttagctatatatgcttgccactgtcggtcagaccagtatgatgcctgtctatattgctcgtgtgtttctgcggagtatggagtgatctcagtgtggaaccataaattataacgctctacctgctactcctaggatgcttggggatcggagaaccttatctaaccttttagagaaggggtaatatgaacataatgcagcatgagtttgcagtatatctactcttcctgtcatgcgtgtctcctgaa

SEQ ID NO: 3458 - DNA, 2065 bp, Pennisetum glaucum
gacccagttcaaggcgaggcagtctgctgctcgcgagcctctggtcctccgtccgtcgtcttcctcgcctcttctcccgaccgttccgagccccaaggtgccagcagaagtgatctgtggactgcagctatgggcaacttgtgctgctgtgttcaagttgatcagtcgaccgtggccatcagggagcagtttggcaagtttgacagcgtgcttgagccagggtgccactgcatgccctggttcatggggaagcgtgtagctggtcatctcacgctcaggctgcagcaacttgatgtgcgctgtgagaccaagactaaggacaatgtctttgtgaacgtcgtggcatctattcagtaccgtgctctggctggcaaagcaaacgatgcattctacaaactgagcaacacaaggtcccagatccaagcttacgtctttgacgttatcagagcaagtgtccccaagctcatcctagacgatgctttcgagcagaaggatgagatcgcaaaggctgtggaggaggagctcgagaaggccatgtcagcttacggctttgagatcgtgcagactctgatcgtggacatcgagccagaaacgcgcaatgaacgagatcaacgcagcggcgaggatgagggtggctgccaacgagaaggctgaggctgagaagatcgtgcagatcaagcgtgcggagggggaggcggaggccaagtacctgtccgggctgggtatcgcccggcagcggcaggcgatcgtggacgggctgagggacagcgtgctgggcttctcagtgaacgtgccgggcaccacagccaaggacgtgatggacatggtgctcattacccagtacttcgacaccatgaaggagatcggcgcgtcgtcaaaggcctcgtccgtgttcatcccgcacggccccggcgcggtgcgtgacatcgccacgcagatccgcgacggcctcctgcagggctcctccgtcccccaccactagtcgcttgccgtggggcagcgtggtgtgggtgtggtggatccattcagtcacaaggaagaagcttgctagctatactatttatgcttgccactgtcagtcagagtgtcagaccagctttgatgcctgtctatattgctcgtgtgtttctctggagtgtgatctcagtgtggaaccatatgtaatgtatcttcagtattacctgctactgctagaatgcttggggatgggagaaacttatctaaccttaagtggcaatctaatatgtataaccccagaaatattatttcgatctcggaaaggaaccatgtagtgaataatttcttgctatgaacactacaaaaaactatcaccaatctgaaaagaaagaagaaataaccactaagtgcactatcaccaatccacctaaaactagcacaaaactttcagcatccaagctacatttgtcatatgtacacacatcatccatcagcacccaccctgagctactctaccatcagtcctgagcagcctactgtacatacggtggttgccttgaaagtttgaagacctcggcgattacctccaagctaagcgtcctcgtctccggaatcctatagtagacgataaaaagaggaatgcaacacacaagtgcatagatcccacacgctccgccgagcctgatggtactcagcatcacagggaagcagtatgatgaaagcagccctccgaaccagaaggaaagagaacagaagctcacacaggttgcacgggccttggttgggaacatctcggagcagagaatgttggggacaggtcccaaaccaatgacgtaggagcagaagcatatggttaacgcgaggtggaagaggatggcacgctgcaatgatcccatatccaccagggtcaacagagacataacgctcaatgataatattaggattggagcagtggccagtataagagcccttctcccgcagacatccatcagcagcattgcagcagttatacaggggagcaacagcaaagcattaagggcacttatgagaactgatgttgaatgaggagaaattccaatatctgaaacaaactaaccactccaacctg

SEQ ID NO: 3459 - DNA, 1408 bp, Cucumis melo
aatgtaaaaaaggtctctttctcagaaattcttgtttctctcttgtcattaacctaatagaaactcattcacaaagataaagatatttcattgaagatattaaaggtcaagagtgcccgtctctttcataattcctggggtttgttccaaattccaacggcgacccacttctataaactcgatccttgttctcaaaccgcccttgaattccaatcgcagtggtttgtgaaggttaacacaaactaaaaggttcaagatatgggtaatcttttttgttgtgtgcaagtggaccagtccactatagctatcagggagaggtttggcaaatttgaggaagttcttgagccaggatgccattgcttgccttggtttcttggagcccagatcgctggcaatctgtctctccggttgcaacaattggatgtgcgatgcgagaccaagacaaaggataatgtgttcgttaatgtggttgcctctattcaatatcgagcactggcagataaagcaaacgatgcattctacaagctcagcaatacaaggtcccagatccaggcttatgtttttgatgtgatcagggcaagtgttccaaagctcaacttggatgatgcttttgagcagaaaaatgatattgctaaagcagtagaagatgaactggaaaaggctatgtcggcttatggctttgagattgtccaaaccctcattgttgatatagaaccagacgagcatgttaagagagcaatgaatgaaattaatgctgctgctagattaagggtggcagccaatgagaaggcagaagcagagaaaattttacagattaagcgagctgagggtgaagctgaagccaagtatttgtcaggtttgggtattgctcggcagcgtcaagcaattgtggatggtttaagagacagcgttttgggattttctgttaatgttcctgggacgacggcaaaggatgttatggatatggtgcttgtgacccagtattttgacaccatgaaggaaattggagctgcctctaaatcaacttctgtgtttatacctcatggacctggagccgttcgagatgtcgcatcgcaaatccgcgatggacttcttcagggtgccgcttcttctcactagtccaacactatgttaaaatgatgtttgtaaggtggtgttcagtgtgttgtaattttctcttcttaaatgatatatattgtctatttgagctaatggaaattgttcttaatacttaatactaatgaatgcttccatgacatctccattggtccattggcaacctgaggctcaaagataatggaaatcccgttcttcttatcttgcaacccagaaaaagaaacaagaagaatctggttaaatgactggtttcactctaaaaaaaacctagagacacgcaacaggggatagg

SEQ ID NO: 3460 - DNA, 1388 bp, Citrullus lanatus
tcctcaccttgtataccctgtcaaattcataattttccatgtagaaaaactcataagtgggaactagaaaaaaaaaaaaatgtaaaaggtctctttctaagaaattcttgtttctctttttatcattaatttaatggaaactcactcacaaagttaaaagatatttcatagaagatattacaggtcaagagggcccgtctctttcataatttctgggggctgatccgaattccaaccgaaacccagttctataaactcgatttttattctcaaacccccatcaattccgatcgcagtgggatttgtgaaggttaagacaaattgaaaggttgaagatatgggtaatcttttttgttgtgtgcaagtggaccaatccactgtagctatcagggagaggtttggtaggtttgaggaagttcttgagccaggatgccattgtttgccttggtttcttggagcccagattgctggcaatctgtctctccggttgcaacaattggatgtgcgatgtgagaccaagacaaaggataatgtgttcgtcaatgtggttgcctctattcaatatcgagcactggcagataaagcaaacgatgcattctacaagcttagcaatacaaggtcccagatccaggcttatgtttttgatgtgatcagagcaagtgttccaaagctcaacttggatgatgcttttgagcagaaaaatgatattgccaaagcagtagaagatgaacttgagaaggctatgtcagcttatggctttgagattgttcaaaccctcatcgttgatatagaaccagacgagcatgttaagagagcaatgaatgaaattaatgctgctgctagattaagggtggcagcaaatgagaaggcagaagcagaaaagattttgcagattaagcgagctgagggtgaagctgaagccaagtatttgtctggtttgggtattgctcggcagcgtcaagctattgtggatggtttaagagacagcgttttgggattctctgttaatgttcctgggacgacggcaaaggatgttatggatatggtgcttgtgacccagtattttgacaccatgaaagaaattggagctgcctctaaatcaacttctgtgtttataccccatggacctggagccgttcgagatgtcgcatcgcaaattcgcgatggacttcttcagggtgcctcctcttctcactagtccaactctatgttgcagtgatgtttgtctataaggtggtattcagtgtgttgtgattttctcttctcaagtgacaaatattgtccatgatttacatttgagctatggaaagtgttcttaatgcttaatttccgccctttaaattctaagtggtttctccaattcatagagaaatatatttctctaccag

SEQ ID NO: 3461 - DNA, 1378 bp, Triticum aestivum
cgctccgcccgccggctggcagcgaaccgaatccggtactggcagtactctccggcgctaatcgcaatgattttcgcagtaggggtcttggcttcttccgctgatcctcatctacaatgccgactatttagggccgcgccgcggtaggaaggaagggtgggcacacagacagactcactgccacttcaccgcaccgctcccccctttccccactcttctccaacccccggacggaggtgctagcggaagtgatcggaagcctgcagtatgggcaatctgtgctgctgtgttcaagttgaccagtccaccgtggccatcagggagcagtttgggaagtttgacagtgtgcttgagccaggatgccactgcctgccttggatctttgggaaacgtgtagttggccatctcacactcaggttgcagcagctggatgtgcgctgtgaaactaagacaaaggacaatgtgtttgtcactgttgttgcatcgattcagtaccgacctctggctggcaaagaaagtgacgcatactacaaactgaccaacacaagatcccagattcaagcctatgtctttgatgtgatcagggcaagtgttccaaagctcaacctggatgatgctttcgtgcagaagaacgatatagcaaaggctgtggaggatgaacttgaaaaggctatgtcggcatatggctttgagatcgtgcagaccctcattgtcgacatcgagccagatgcgcatgtcaagcaggcgatgaatgagatcaatgcagctgcaaggatgagggtggctgcaaacgagaaggcggaggctgagaagattgtccagatcaagcgtgccgagggtgaagcagaggccaagtacctgtctggcctcggtatcgcccgccagcgccaggccattgtggatggcctgagggacagcgtcctgggcttctcagtcaatgtgcctggcaccactgcaaaggatgtgatggacatggtgctgatcacccagtacttcgatactatgaaagagattggcgcgtcctccaagtcctcggcggtgttcatcccccatggccctggtgcggtgcgcgacatcgccacgcagatccgtgacggtcttcttcaaggccagtctgcctctgacaactagcagtttgcttcgccggcatgaactttgaagctgctggtggtttgtggtttgctagctattgcctacagtactgtctaatatgatgcatgccgtattatttatgaacctatatggaaccatatgtggatcgtggcatgccatgccttaggttgatgtgcagtaacaaaacctttaaccttgtgtgaatgcaggatgatataagtgtgttatgaaatgttggtgatgaacttgatctaatgcttttgcc

SEQ ID NO: 3462 - DNA, 1355 bp, Triticum aestivum
cagactcactgccacttcaccgcaccgctcccccctttccccactcttctccaacccccggacgcaggtactaccagaagtgatcggaagcctgcagtatgggcaatctgtgctgctgtgttcaagttgaccagtctaccgtggccatcagagagcagtttgggaagtttgacagtgtgcttgagccaggatgccactgcctgccttggatctttgggaaacgtgtagttggccatctcacactcaggttgcagcagctggatgtgcgctgtgaaaccaagacaaaggacaatgtgtttgtcactgttgttgcatcgattcagtaccgacctctggctggcaaagaaagtgacgcatactacaaactgaccaacacaagatcccagattcaagcctatgtctttgatgtgatcagggcaagtgttccaaagctcaacctggatgatgctttcgtgcagaagaacgatatagcaaaggctgtggaggatgaacttgagaaggctatgtccgcatatggctttgagatcgtgcagaccctcattgtcgacatcgagccggatgcgcatgtcaagcaggcgatgaatgagatcaatgcagctgcaaggatgagggtggctgcaaacgagaaggcggaggctgagaagattgtccagatcaagcgtgccgagggtgaagcagaggccaagtacctgtctggcctcggtatcgcccgccagcgccaggccattgtggatggcctgagggacagcgtcctgggcttctcagtcaacgtgcctggcaccactgcaaaggatgtgatggacatggtgctgatcacccagtactttgatactatgaaagagattggcgcgtcctccaagtcctctgcggtgttcatcccccatggccctggtgcggtgcgcgacatcgccacgcagatccgcgatggtcttcttcaaggccagtctgcctctgacaactagtagttggctttgccggcatgaactttgaagctggtggtggtttgtggtttgctagctattgcctagagtactgtctaatatgatgcatgccgtattattatgaacttatatggaaccatatgtggatcgtggcgtgccatgccttaggttgatgtgcggtaacaaaacctttaaccttgtgggaatgcaggatgatacaagtgtgttatgaaatgttggtaatgaagttgatctaatgcttttgcctcgtttattttgccttatagtattgtggttacatagttttcatgggggatttcttctgagatgtctttactgttttgcaagagatgttttttctttgagattacacttatgtgtaccatatgtttatagaagaggagatctatgatt

SEQ ID NO: 3463 - DNA, 1197 bp, Triticum aestivum
tataaccattatacatccctgaaagtgtttaatactcaaacatgcaagtggggcattagtcaatgcttaggctcatgtaggaactccctgattggttctggtttacgtctgtacaacgggataattgaggatgatggtggctgtagcacgcccttgcttatatataccacctctttcctgcctcattaatcaccccaccttgtcatttgaacctatcctggtactaccagaagtgatcggaagcctgcagtatgggcaatctgtgctgctgtgttcaagttgaccagtctaccgtggccatcagagagcagtttgggaagtttgacagtgtgcttgagccaggatgccactgcctgccttggatctttgggaaacgtgtagttggccatctcacactcaggttgcagcagctggatgtgcgctgtgaaaccaagacaaaggacaatgtgtttgtcactgttgttgcatcgattcagtaccgacctctggctggcaaagaaagtgacgcatactacaaactgaccaacacaagatcccagattcaagcctatgtctttgatgtgatcagggcaagtgttccaaagctcaacctggatgatgctttcgtgcagaagaacgatatagcaaaggctgtggaggatgaacttgagaaggctatgtccgcatatggctttgagatcgtgcagaccctcattgtcgacatcgagccggatgcgcatgtcaagcaggcgatgaatgagatcaatgcagctgcaaggatgagggtggctgcaaacgagaaggcggaggctgagaagattgtccagatcaagcgtgccgagggtgaagcagaggccaagtacctgtctggcctcggtatcgcccgccagcgccaggccattgtggatggcctgagggacagcgtcctgggcttctcagtcaacgtgcctggcaccactgcaaaggatgtgatggacatggtgctgatcacccagtactttgatactatgaaagagatcggcgcatcctccaagtcctcggcggtgttcatcccccatggccctggtgcggtgcgcgacatcgccacgcagatccgcgatggtcttcttcaaggccagtctgcctctgacaactagcagttggctttgccggcatgaactttgaagctggtggtggtttgtggtttgctagctattgcttagagtactgtctaatatg

SEQ ID NO: 3464 - DNA, 1342 bp, Triticum aestivum
agcgtggtcgcggccgaggttgaccctccacgtacttatctgcagccggtttgccccagctttcgctccgcccgccggctggcagcaaaccgcatccgggccgcggcagcggggtggggggaacgaacacaacagacgccgtcctcctgccacttcacctctcccccctttccccactcttctccaacccccggacggaggtgctagcggaagtgatcggaagcctgcagtatgggcaatctgtgctgctgtgttcaagttgaccagtctaccgtggccatcagggagcagtttgggaagtttgacagtgtgcttgagccaggatgccactgcctgccttggatctttgggaaacgtgtagttggccatctcacactcaggttgcagcagctggatgtgcgctgtgaaactaagacaaaggacaatgtgtttgtcactgttgttgcatcgattcagtaccgacctctggctggcaaagaaagtgacgcatactacaaactgaccaacacaagatcccagattcaagcctatgtctttgatgtgatcagggcaagtgttccaaagctcaacctggatgatgctttcgtgcagaagaacgatatagcaaaggctgtggaggatgaacttgaaaaggctatgtcggcatatggctttgagatcgtgcagaccctcattgtcgacatcgagccagatgcgcatgtcaagcaggcgatgaatgagatcaatgcagctgcaaggatgagggtggctgcaaacgagaaggcggaggctgagaagattgtccagatcaagcgtgccgagggtgaagcagaggccaagtacctgtctggcctcggtatcgcccgccagcgccaggccattgtggatggcctgagggacagcgtcctgggcttctcagtcaatgtgcctggcaccactgcaaaggatgtgatggacatggtgctgatcacccagtactttgatactatgaaagagattggcgcgtcctccaagtcctcggcggtgttcatcccccatggccctggtgcggtgcgcgacatcgccacgcagatccgtgacggtcttcttcaaggccagtctgcctctgacaactagcagttggcttcgccggcatgaactttgaagctggtggtggtttgtggtttgctagctattgcctagagtactgtctaatatgatgcatgccgtattattatgaacttatatggaaccatatgtggatcgtggcatgccatgccttaggttgatgtgcagtaacaaaacctttaaccttgtgggaatgcaggatgatataagtgtgttatgaaatgttggtgatgaacttgatctaatgcttttgcct

SEQ ID NO: 3465 - DNA, 1883 bp, Cucurbita pepo
ttcatatcttgttcgtaaggtcaagaccgctcgccctttcatacaattctgcgtgctgattcagacgcaaaatactttaataaaagcatcccgtgattccaatttcattacagatttttcgttgtgaatccaaatttctgattcgatatgggtaatctttttgttgtgttcaagtggatcaatccactgtggctatcagggagagatttgggaaatatgaggaagttcttgagccaggatgccattgtttgccttggtttcttggagctcaggtcgccggcagtctgtctctcaggttgcaacaattggatgtccgatgtgagaccaagacaaaggataatgtgtttgtcaacgtggttgcgtcgattcaatatcgagcactggccgataaagcaagtgatgcattctacaaactaagcaatacaagatctcagatccaggcttatgtttttgatgtaattagagcaagtgttccaaagctcaacttggatgatgcttttgagcagaaaaatgatattgccaaagcagttgaagatgaacttgaaaaggctatgtcggcttatggctttgagattgtccaaacgctcattgtcgatatagaaccagacgagcatgtgaagagagcaatgaatgaaattaatgctgctgctagattaagggtggcagcaaatgagaaggcagaagcagagaaaattttgcagattaagcgagctgagggtgaagctgaagccaagtatttgtctggtttgggtattgctcgacagcgtcaagcaattgtggatggtttaagagacagtgtgttgggattctctgttaatgttccagggacgacggcaaaggatgttatggatatggtgcttgtgacccaatattttgacaccatgaaagaaattggagcttcttccaagtccacttctgtgtttatacctcatggacctggagctgttcgagacgtcgcatcacagattcgcgatggacttcttcagggtgcttcttcttctcactagtccaaaactctatttcacaaagttgatggtatttagtgtgtgttgtggttttctgttttcaagtgacatctatgtttggtaattcacatttgagctttggaaattgttcttaatactttaatactagtggtttctccaataaatgtacaaatatatttctctacaagtaattgattctaaaacattcgaccatgcttaaatgaagcagccacctatctatatacgttatgaatgtggcacatgatctaaacaggcaaagcaaaccgaagaacgaactgaccatttgctgactcaaaccacaaccgggaggaacctgatcgaaagcttaggccctacttcccggacgacagcttcaccgatcaaacgtgggtgctccaagccaattccagtttaagcgatctggtaacctgagatatcttgagctccaattcatcccactccaaagacggattgcttccttttactatccctgttcccgcatagaccaaggcaccaagacctgtctccactaatgctgatctgatgcccacagcaaactcactctcttctcctccaaaccaaccaacaggcccggcgtacatccctctatcaaataactcagtttctgcaatcaaatctcgagcctcctctgttggaaatccacaaaccgcgggagttggatgaagcgttgataaaatttcaaactcatcatcattggttctcaatctgcctgctagttgggcatacagatgttgaattctgggaagttttctaactgatttatgtggttcaacgactacagcatcacatacagcctaacaaacaggattaagctggctaagatctgcaatattctgagatgttgtcctcttcgtaattgcctatagatttcagcag

SEQ ID NO: 3466 - DNA, 1165 bp, Secale cereale
agactcactgccacttcaccgtcaccgctcccccctttccccactcttctccaacccccggacggaggtatgggcaatctgtgctgctgtgttcaggtcgatcagtctaccgtggccatcagagagcagtttgggaagtttgacagtgtgcttcagccaggatgccactgcctgccttgggtcttagggaaacgtgtagttggccatctcacactcaggttgcagcagctggatgtgcgctgcgaaactaagacaaaggacaatgtgtttgtcactgttgttgcatcaattcagtaccgtcctctggctggcaaagaagtgacgcatactacaaactgaccaacacaagatcccagattcaagcctatgtttttgatgtgatcagggcaagtgttccaaagctcaacctggatgatgctttcgtgcagaagaacgatatagcaaaggctgtggaagatgaacttgaaaaggctatgtcggcatatggctttgagatcgtgcagaccctcattgtcgacatcgagccagatgcgcacgtcaagcaggcaatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattggcgcgtcctccaagtcctcggccgtcttcatcccccatggccctggtgcggttcgtgacatcgccacgcagatccgcgacggtcttcttcagggccagtctgcctctgacaactagtagtttgcttcgccggcatgaactttgaagctggtggtggtttgtggtttgctagctattgcctacagtactgtctaatatgatgcatgccgtattattatgacttatatggaaccttatgtgtatcgtggcttaggtcgatgtgcggtaacaaaacctttaacctattgggaatgcaggatgatataagtgtgctatgaaatgctggtgatgtacttgatctaatgttcttt

SEQ ID NO: 3467 - DNA, 1142 bp, Secale cereale
gggtgggcactgggcacacacacagactcactgccacttcaccgtcaccgctcccccctttccccactcttctccaaccccggacggaggtatgggcaatctgtgctgctgtgttcaggtcgatcagtctaccgtggccatcagagagcagtttgggaagtttgacagtgtgcttcagccaggatgccactgcttgccttgggtcttagggaaacgtgtagttggccatctcacactcaggttgcagcagctggatgtgcgctgcgaaactaagacaaaggacaatgtgtttgtcactgttgttgcatcaattcagtaccgtcctctggctggcaaagaaagtgacgcatactacaaactgaccaacacaagatcccagattcaagcctatgtttttgatgtgatcagggcaagtgttccaaagctcaacctggatgatgctttcgtgcagaagaacgatatagcaaaggctgtggaagatgaacttgaaaaggctatgtcggcatatggctttgagattgtgcagacccctcattgtcgacatcgagccagacgcccatgtcaagcaggcgatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattggcgcgtcctccaagtcctcggccgtcttcatcccccatggccctggtgcggttcgtgacatcgccacgcagatccgcgacggtcttcttcagggccagtctgcctctgacaactagtagtttgcttcgccggcatgaactttgaagctggtggtggtttgtggtttgctagctattgcctacagtactgtcttatatgatgcatgccgtataattatgacttatatggaaccatatgtggattgtggcttaggtcgatgtgcggtaacaaaacctttaacctattgggaatgcaggatgata

SEQ ID NO: 3468 - DNA, 1192 bp, Leymus cinereus x Leymus triticoides
  misc_feature (25)..(26): n is a, c, g, or t
atccgggcatttcgttgtggttccnntgctcccccactcttctccaagccccggaggtgctaccggaagtgatcggaagcctgcagtatgggcaatctgtgctgctgtgttcaagttgatcagtctactgtggccatcagagagcagtttgggaagtttgacagtgtgcttgagccaggatgccactgcctgccttggatctttgggaaacgtgtagttggccatctcacactcaggatgcagcagctggatgtgcgctgtgaaactaagacaaaggacaatgtgtttgtcactgttgttgcatcaattcagtaccgacctctggctggcaaagaaagtgacgcatactacaaactgaccaacacaagatcccagattcaagcctatgtttttgatgtgatcagggcaagtgttccaaagctcaacctggatgatgctttcgtgcagaagaatgatatagcaaaggctgtggaggatgaacttgaaaaggccatgtcggcatatggctttgagatcgtacagaccctcattgtcgacatcgagccagatgcgcatgtcaagcaagcaatgaatgagatcaatgcagctgcaaggatgagggtggctgcaaacgagaaggcagaggctgagaagattgtccagatcaagcgtgccgagggcgaagcagaagccaagtacctgtccggccttggtatcgcccgccagcgccaggccattgtggatggcctgagggacagcgtcctgggcttctcagtcaatgtgcctggtaccactgcaaaggacgtgatggacatggtgctgatcacccagtacttcgacaccatgaaggagatcggcgcgtcctccaagtcctcagcggtgttcatcccccatggccctggcgcggtgcgtgacatcgccacgcagattcgcgacggtcttcttcagggccagtccgcctctgacaactagcagtttgctttgccggcatgaactttgaagctggtggtggtttgtggtttgctagctattgcctacagtactgtctaatattatgatgcatgccgtattattatgaacttattatatggaaccatacgtggatcgtggcatgccgtgccttaggtcgatgtgcggtaacaaaacctttaaccttttgggaacgcaggatgatataagtgtgttatgaaatgttggtgatgaacttgatcta

SEQ ID NO: 3469 - DNA, 1294 bp, Secale cereale
atttggggtaatgcccgactatttagggccgcgccgcggtaggaagggagggtgggcactgggcacacacacagactcactgccacttcaccgtcaccgctccccctccccactcttctccaaccccggacggaggtatgggcaatctgtgctgctgtgttcaggtcgatcagtctaccgtggccatcagagagcagtttgggaagtttgacagtgtgcttcagccaggatgccactgcctgccttggatcttagggaaacgtgtagttggccatctcacactcaggttgcagcagctggatgtgcgctgcgaaactaagacaaaggacaatgtgtttgtcactgttgttgcatcaattcagtaccgtcctctggctggcaaagaaagtgacgcatactacaaactgaccaacacaagatcccagattcaagcctatgtttttgatgtgatcagggcaagtgttccaaagctcaacctggatgatgctttcgtgcagaagaacgatatagcaaaggctgtggaggatgaacttgaaaaggctatgtcggcatatggctttgagattgtgcagaccctcattgtcgacatcgagccagacgcccatgtcaagcaggcgatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattggcgcgtcctccaagtcctcggccgtcttcatcccccatggccctggtgcggttcgtgacatcgccacgcagatccgcgacggtcttcttcagggccagtctgcctctgacaactagtttgcttcgccggcatgaactttgaagctggtggtggtttgtggttgtgctagctattgcctacagtactgtctaatatgatgcatgccgtattattatgacttgtatggaaccatatgtggatcgtggcttaggtcgatgtgcggtatcaaaacctttaacctattgggaatgcaggatgatataagtgtgttatgaaatgctggtgatgaacttgatctaatgcttttgcctcgtttattttgccttatagtgctgccagctgcatgtaaaatgctggtttaaggttacat

SEQ ID NO: 3470 - DNA, 1160 bp, Secale cereale
actgccacttcaccgtcaccgctccccctttccccactcttctccaaccccggacggaggtatgggcaatctgtgctgctgtgttcaggtcgatcagtctaccgtggccatcagagagcagtttgggaagtttgacagtgtgcttcagccaggatgccactgcctgccttggatcttagggaaacgtgtagttggccatctcacactcaggttgcagcagctggatgtgcgctgcgaaactaagacaaaggacaatgtgtttgtcactgttgttgcatcaattcagtaccgtcctctggctggcaaagaaagtgacgcatactacaaactgaccaacacaagatcccagattcaagcctatgtttttgatgtgatcagggcaagtgttccaaagctcaacctggatgatgctttcgtgcagaagaacgatatagcaaaggctgtggaggatgaacttgaaaaggctatgtcggcatatggctttgagattgtgcagaccctcattgtcgacatcgagccagacgcccatgtcaagcaggcgatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattggcgcgtcctccaagtcctcggccgtcttcatcccccatggccctggtgcggttcgtgacatcgccacgcagatccgcgacggtcttcttcagggccagtctgcctctgacaactagtagtttgcttcgccggcatgaactttgaagctggtggtggtttgtggtttgctagctattgcctacagtactgtctaatatgatgcatgccgtattattatgacttatatggaaccttatgtgtatcgtggcttaggtcgatgtgcggtaacaaaacctttaacctattgggaatgcaggatgatataagtgtgctatgaaatgctggtgatgaacttgaataaaactaaaaaaa

SEQ ID NO: 3471 - DNA, 2118 bp, Hordeum vulgare
tttgctttctagtattaaacatgttctcaagaattgcttttaaattcgatattgtcatatatggagtggttaatatttgttagttctttcggctttcttgttttctggagctctaccgaaagcctttaaagtcgttgtattatgtatatgtatgctagtcatgtctgaagccttataatgcttataaacgaattaaatcatgttgctactactattttgtgtgtggtgggagtgggaccatagattagtcttccgattgtacatcaatcctttggaatcaacaatggtttcaggaagagcagttgcattctttagtatcttactattgtctaacctgagtgttctgtacgcagttgtctcctttacagttagcctatggcattatgcatttctgaaagtgattcatatgtttgtaagttagctcaaacgcccaagtgggtgatcagtgaattgcttaggatgcgtatactcatgctgattggtctcatttgtctccgtccaagtggatacagataacaacgggtataattgaacaggctgtagacctgtagtgtgcccttgcttatagggcgcattgcagatacctgccttcattgtaaagatccagcttatttgtcatttggccttatccttgtaccagctgagcttttctcttttgccctgccaattcaagtttcggttcaggcatgttctgttgcattcttctattgattgctgagtattgttattagtattgttctcaagaattgttacttcttttgcagtcctatttttgtggtgttctacagaaagctcttatagttatatgttcatctctgcatctttgtaattttacaaaaaaataaatgtttttctctaggaagcctgcagtatggggaatctgtgctgctgtgttcaagtcgaccagtctaccgtggccatcagggagcagtttgggaagttcgacagtgtgcttcagccaggatgccactgcctgccttggatctttgggaagcgtgtagttggccatctcacactcaggttgcagcagctggatgtgcgctgtgagactaagacaaaggacaatgtgtttgtcactgttgttgcatcaattcagtaccgacctctggctggcaaagaaagcgacgcgtactacaaactgaccaacacaagatcccagattcaagcctatgtttttgatgtgatcagggcaagtgttccgaagctcaacctggatgacgctttcgtgcagaagaacgatatagcaaaggctgtggaggatgaacttgaaaaggctatgtcagcatatggctttgagatcgtgcagaccctcattgtcgacatcgagccagatgcgcatgtcaagcaagcgatgaatgagatcaatgcagctgcaaggatgagggtggctgcaaacgagaaggcagaggctgagaagattgtccagatcaagcgtgctgagggcgaagcagaagccaagtacctgtccggcctaggtatcgcccgccagcgccaggccattgtggatggcctgagggacagcgtcctgggcttcgcagtcaatgtgcctggcaccactgcaaaggacgtgatggacatggtgctgatcacccaatacttcgatactatgaaagagatcggcgcgtcctccaagtcctcggcggtgttcatcccccatggccctggcgcagtgcgcgacatcgccacacagatccgcgacggtcttcttcagggccagtctgcctctgacaactagcagtttgcttcagggccagtctgcctctgacaactagcagtttgctttgccggcatgaactttaaaagctggcggtggtttgtggtttgctagctattgcctacagtactgtctaatatgatgcatgccgtattattaagaacttatatggaaccatatgtggatcgtggcatgccatgccttaggttgatgtgcggtaacaaaacccattaaccctgtgggaatgcagtgtgatataagcgtgttataaaatgttggtgatgaacttgatctaatgcttttgcctcgtttattttgcattatagtgctgtcagttacatgtaaaatgatggcttgaggttacatgtttttcattggggatttcttctgaaatgcctttcctg

SEQ ID NO: 3472 - DNA, 1300 bp, Hordeum vulgare
agggtcctcactgccactgccacttcaccgctcccacctttccccactcgtctcttcttctccaagcccccggacggaggaagcctgcagtatggggaatctgtgctgctgtgttcaagtcgaccagtctaccgtggccatcagggagcagtttgggaagttcgacagtgtgcttcagccaggatgccactgcctgccttggatctttgggaagcgtgtagttggccatctcacactcaggttgcagcagctggatgtgcgctgtgagactaagacaaaggacaatgtgtttgtcactgttgttgcatcaattcagtaccgacctctggctggcaaagaaagcgacgcgtactacaaactgaccaacacaagatcccagattcaagcctatgtttttgatgtgatcagggcaagtgttccgaagctcaacctggatgacgctttcgtgcagaagaacgatatagcaaaggctgtggaggatgaacttgaaaaggctatgtcagcatatggctttgagatcgtgcagaccctcattgtcgacatcgagccagatgcgcatgtcaagcaagcgatgaatgagatcaatgcagctgcaaggatgagggtggctgcaaacgagaaggcagaggctgagaagattgtccagatcaagcgtgctgagggcgaagcagaagccaagtacctgtccggcctaggtatcgcccgccagcgccaggccattgtggatggcctgagggacagcgtcctgggcttcgcagtcaatgtgcctggcaccactgcaaaggacgtgatggacatggtgctgatcacccaatacttcgatactatgaaagagatcggcgcgtcctccaagtcctcggcggtgttcatcccccatggccctggcgcagtgcgcgacatcgccacacagatccgcgacggtcttcttcagggccagtctgcctctgacaactagcagtttgcttcagggccagtctgcctctgacaactagcagtttgcttcagggccagtctgcctctgacaactagcagtttgcttcagggccagtctgcctctgacaactagcagtttgctttgccggcatgaactttaaaagctggcggtggtttgtggtttgctagctattgcctacagtactgtctaatatgatgcatgccgtattattaagaacttatatggaaccatatgtggatcgtggcatgccatgccttaggttgatgtgcggtaacaaaacccattaaccctgtgggaatgcagtgtgatataagcgtgttataaaatgttggtgatgaacttgat

SEQ ID NO: 3473 - DNA, 1307 bp, Hordeum vulgare
acgagggtcctcactgccactgccacttcaccgctcccacctttccccactcgtctcttcttctccaagcccccggacggaggaagcctgcagtatggggaatctgtgctgctgtgttcaagtcgaccagtctaccgtggccatcagggagcagtttgggaagttcgacagtgtgcttcagccaggatgccactgcctgccttggatctttgggaagcgtgtagttggccatctcacactcaggttgcagcagctggatgtgcgctgtgagactaagacaaaggacaatgtgtttgtcactgttgttgcatcaattcagtaccgacctctggctggcaaagaaagcgacgcgtactacaaactgaccaacacaagatcccagattcaagcctatgtttttgatgtgatcagggcaagtgttccgaagctcaacctggatgacgctttcgtgcagaagaacgatatagcaaaggctgtggaggatgaacttgaaaaggctatgtcagcatatggctttgagatcgtgcagaccctcattgtcgacatcgagccagatgcgcatgtcaagcaagcgatgaatgagatcaatgcagctgcaaggatgagggtggctgcaaacgagaaggcagaggctgagaagattgtccagatcaagcgtgctgagggcgaagcagaagccaagtacctgtccggcctaggtatcgcccgccagcgccaggccattgtggatggcctgagggacagcgtcctgggcttcgcagtcaatgtgcctggcaccactgcaaaggacgtgatggacatggtgctgatcacccaatacttcgatactatgaaagagatcggcgcgtcctccaagtcctcggcggtgttcatcccccatggccctggcgcagtgcgcgacatcgccacacagatccgcgacggtcttcttcagggccagtctgcctctgacaactagcagtttgcttcagggccagtctgcctctgacaactagcagtttgcttcagggccagtctgcctctgacaactagcagtttgcttcagggccagtctgcctctgacaactagcagtttgctttgccggcatgaactttaaaagctggcggtggtttgtggtttgctagctattgcctacagtactgtctaatatgatgcatgccgtattattaagaacttatatggaaccatatgtggatcgtggcatgccatgccttaggttgatgtgcggtaacaaaacccattaaccctgtgggaatgcagtgtgatataagcgtgttataaaatgttggtgatgaacttgatctaa

SEQ ID NO: 3474 - DNA, 882 bp, Avena sativa
aggtactaccagaagcgatctgaagcctgcagtcatgggcaacttgttgtgctgtgttcaagttgatcagtcgaccgtggccatcagagagcagtttgggaagttcgatagtgtgcttgagccaggatgccactgcctgccttggatggttgggaagcgtatagttggtcatctcacactcaggttgcagcaactggatgttcgctgtgagactaagacaaaggacaatgtgtttgtcacagttgttgcttctattcagtacagacctctggctggcaaagaaagtgatgcattctacaaactgaccaacacaaggtcccagatccaagcctatgtatttgacgtgatcagggcaagtgttccaaagcttctcttggatgatgcttttgagcagaagaatgacatagcaaaggctgtggaggatgaacttgaaaaggccatgtcagcatatggttttgagatcgtgcagacactcatcgttgacattgagccagacgagaatgtcaagcgagcaatgaatgatatcaatgcagctgcaaggatgagggtggccgcgaacgagaaggcggaggcggagaagatcgtgcagatcaagcgcgccgagggcgaagcggaagccaagtacctgtcaggccttggcatcgcccggcagcgtcaggcgatcgtggacggactgagggacagcgtgatggggttcgcggagaacgtgcccggcacgagcgccaaggacgtgatggacatggtgctcatcacccagtacttcgacacgatgaaggagatcggcgcgtcctccaagtcctcggcggtgttcatcccccacggcccgggcgcggtgcgcgacattgctacgcagatccgtgacggccttcttcagggccagtc

SEQ ID NO: 3475 - DNA, 1221 bp, Elaeis guineensis
agaagaaacaagcgaaggatagctgtgccggcattattcctgtgatccacttttctatatatatctcgttttatgctgagggtcacatgtttgccactcacaccaccacctttctgaacgctttctttgaggttcttttgcgatctccgcccggcttgtgctactgtgtagcttggagattaaagggaagatcatgggccaattgctttgctgtgtccaagtggatcaatccactgttgcaatcagggaaacatttgggaagtttgatgatgtgctcgagccaggctgccattgcttaccttggatctttggtcgccgaatagctggccatctttcactccgtctgcaacaattggatgtgcggtgtgagacaaagacaaaggataatgtttttgtcaatgttgttgcatctatacagtaccgtgctctgtctgacaaggcaaatgatgcattttataaactgagcaacacaaggtctcaaatccaagcttatgtgtttgatgtgatcagagcgagtgtcccaaagctcaaccttgatgatgcttttgagcagaagaatgatattgcaaaagctgtggaagaagaactggaaaaggctatgtcagcttatggatatgagatcgtacagacacttattgttgatattgagccagatgaacatgtgaagcgagcaatgaatgaaatcaatgcagctgcaagattaagggtggctgcaaatgagaaggcagaagctgagaagatcatccaaatcaagcgagctgagggtgaggctgaatctaagtatctgtcaggtctaggtattgctcgccaacgccaagcaattgtagatggactgagggacagcgttcttggcttctcagtcaatgtgccagggaccactgcaaaagatgttatggacatggtcttggtcacacagtactttgacaccatgaaagagattggtgcagcctccaaatcttcggctgttttcattcctcatggacctggtgctgttcgtgatgtcgccacacagattcgggatggattgcttcaagcatctgcccacaactgaaactccaaggtttgagtgcattatgtagataagttgtagaggactttggtactagtttcgtttcaaaatgtgtataattgatttggaacttttcggtgtgttatgtgtgtaatagtccagaaatgtgagacttttgagtatgttatatttagcactccagaattccatca

SEQ ID NO: 3476 - DNA, 1186 bp, Carica papaya
gacatctcatcttgtcttgggttcttctcctcaaaaacaaaaaatctccttgtctcttggtttcttcccctcagccatttgtgtttgtttactaacttgtgtagagaagatgggtaatctgttctgttgtgtacaagttgatcagtctacagtagctatcagggagagatttggaaaatttgatgatgttcttgaacctggatgtcattgcctaccttggtttcttgggagtcagctagcgggccacctttcactgaggttgcaacagttggatgtacgctgtgagaccaagactaaggacaatgtatttgtcaatgttgttgcatctattcaataccgtgcgctggctgataaggcaaatgatgctttctacaaactgagcaacacgaggactcaaattcaggcttatgtttttgatgttatcagagcaagtgttccaaagctaaatctggatgatgtgtttgagcaaaaaaatgagattgctaaggctgtggaagatgaacttgaaaaggctatgtctgcttatgggtatgagattgttcaaacactcattgttgatattgaaccagatgagcatgtgaagcgggcgatgaatgaaattaatgctgctgcaagactgagggtggcagctaatgagaaggcagaggcagagaaaattttacaaataaagcgagctgaaggtgaggccgagtctaagtacctttcagggctgggtattgctcgccagcgacaagcaattgttgatggcctgagagacagtgtgcttggtttctctgtcaatgttccggggactactgcaaaggacgtgatggacatggtcctcgtcactcaatacttcgacaccatgaaagaaattggtgctgcttccaaatcctcagctgtgttcatacctcatggacctggtgctgttcgcgacgtagctactcagattcgagatggacttctacaagcttcctcgcatcaatgagtttgttacttcttttatggtcttgttatgaagtgtgggactagatgcttatccgtctgatttgtgtatttatgtattggataattgttttctgtaattgagccctattgctttatatgtatattaattatgaaacgagagtcctgatgctgttaatacgtgtttaaaaactcttggaatgaatgaagaactccagttttcattatcttattttgggaa

SEQ ID NO: 3477 - DNA, 1145 bp, Triticum aestivum
cccactcttctccaagccccggaggtgctaccggaagtgatcggaagcctgcagtatgggcaatctgtgctgctgtgttcaagttgaccagtctaccgtggccatcagagagcagtttgggaagtttgacagtgtgcttgagccaggatgccactgcctgccttggatctttgggaagcgtgtagttggccatctcacactcaggttgcagcagctggatgtgcgctgtgaaactaagacaaaggacaatgtgtttgtcactgttgttgcatcaattcagtaccgacctctggctggcaaagaaagtgacgcatactacaaactgaccaacacaagatcccagattcaggcctatgtttttgatgtgatcagggcaagtgttccaaagctcaacctggatgatgctttcgtgcagaagaatgatatagcacaggctgtggaggatgaacttgaaaaggctatgtcggcatatggctttgagatcgtgcagaccctcattgtcgacatcgagccagatgcgcatgtcaagcaggcgatgaatgagatcaatgcagctgcaaggatgagggtggctgcaaacgagaaggcggaggctgagaagattgtccagatcaagcgtgccgagggtgaagcagaggccaagtacctgtctggcctcggtatcgcccgccagcgccaggccattgtggatggcctgagggacagcgtcctgggcttctcagtcaatgtgcctggcaccactgcaaaggacgtgatggacatggtgctgatcacccagtactttgatactatgaaagaggtcggcgcgtcctccaagtcctcggcggtgttcatcccccatggccctggcgcggtgcgcgacatcgccacgcagatccgcgacggtcttcttcagggccagtctgcctctgacaactaagcagtttgcttcgccggcatgaactttgaagctggtggtggtttgtggtttgctagctattgcctacagtactgtctaatatgatgcatgccgtatgattatgacttatctggaaccatatgtggatcgtggcttaggtcgatgtgcggtaacaaaacctttaacctattgggaatgcaggatgatataagtgtgttatgaaatgctggtgatgaacttgatctaa

SEQ ID NO: 3478 - DNA, 1091 bp, Secale cereale
tccccctttccccactcttctccaaccccggacggaggtatgggcaatctgtgctgctgtgttcaggtcgatcagtctaccgtggccatcagagagcagtttgggaagtttgacagtgtgcttcagccaggatgccacctgcctgccttgggtcttagggaaacgtgtagttggccatctcacactcaggttgcagcagctggatgtgcgctgcgaaactaagacaaaggacaatgtgtttgtcactgttgttgcatcaattcagtaccgtcctctggctggcaaagaaagtgacgcatactacaaactgaccaacacaagatcccagattcaagcctatgtttttgatgtgatcagggcaagtgttccaaagctcaacctggatgatgctttcgtgcagaagaacgatatagcaaaggctgtggaagatgaacttgaaaaggctatgtcggcatatggctttgagatcgtgcagaccctcattgtcgacatcgagccagatgcgcacgtcaagcaggcaatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattggcgcgtcctccaagtcctcggccgtcttcatccccatggccctggtgcggttcgtgacatcgccacgcagatccgcgacggtcttcttcagggccagtctgcctctgacaactagtttgcttcgccggcatgaactttgaagctggtggtggtttgtggttgtgctagctattgcctacagtactgtctaatatgatgcatgccgtattattatgacttgtatggaaccatatgtggatcgtggcttaggtcgatgtgcggtatacaaaacctttactattgggaatgcaggatgatataagt

SEQ ID NO: 3479 - DNA, 1105 bp, Catharanthus roseus
tagatatgtattagtctccccgcaagtccctttcctcctttccaatttgcagtatataatacctgtgggctgttctgagttttcaaacgaatctgtttcctctgcttcttcgcccttttgattgcttaacaagatgggtaatctattttgttgtgtacaagttgatcaatccactgtggctatcaaggagcgttttggaaggtttcaggaggttcttgaaccaggatgccactgtatgccttggttccttggcagccagctagctggtcatctctcacttcggctccaacagttggatgtccgctgtgagacaaagacaaaggataatgtgtttgtcaatgtagtggcatcaattcagtaccgggcacttggagacaaggcaaatgatgcattctacaagcttagcaataccaggagtcaaatccaggcatatgtttttgatgtgataagggcaagtgtaccaaagcttaatcttgatgatgcttttgagcaaaagaatgagattgctaaggctgttgaagatgaacttgagaaggctatgtctgcttatggatatgaaattgttcagacacttattgttgacatagaaccagatgaacatgtcaagcgcgcaatgaatgaaataaatgctgctgctaggctgagggtggctgctaacgagaaggcagaggctgagaaaattctacaaataaagcgtgctgaaggggaggcagaggctaagtatctgtctggtctgggaattgctcgtcagcgccaagccattgtggatggtcttagagatagcgttctgggcttctccgtgaatgtccctggaacaacagcaaaagatgtgatggatatggttcttgttactcagtatttcgataccatgaaagaaattggtgcgacctccaagtcttctgctgtcttcatcccccacggccctggtgctgtccgtgatgtggcaactcagattcgtgatggtcttcttcaggcatctacacatcagtgattggtctcattataccctctacttttttcagttcgatgaatgcgactgttctttacaactatggttatactggtttttgtatattcaaatttggtgcttttgctctgctgaatc

SEQ ID NO: 3480 - DNA, 1094 bp, Tripterygium wilfordii
aaaccaatcaaatcagagaaaaacagtgtatagtagatgggaaatctgttatgttgcattcaagttggccagtcaactgttgctatcaaggagcaatttggtaagtttgatggagttcttgagcctggatgccattgcctcccttggtttcttggaagccagcttgcaggccatctgtcactgaggctgcagcagttggatgtaaaatgtgagaccaagacaaaggataacgtatttgtcaatgtggttgcatcgattcaataccgtgccctggcagataaggcaaatgatgcattctacaaactgagtaacacaaagtcccaaattcaggcctatgtgtttgatgtaatcagagcgagtgttccaaaacttaatctggatgatgcatttgaacaaaaaaacgaatattgcaaaagctgtggaagatgaactcgagaaggctatgtctgcatatggctatgagattgttcaaacgctcattgttgatatagaaccagatgagcatgtgaaacgggcaatgaatgaaatcaatgctgctgctagactgagggtggcagccaatgataaggcagaagctgagaaaattgtgcaaatcaaacgggctgagggtgaggctgaggccaagtatctctcagggcttggcattgctcgtcagcgacaagcaattgtggatggtttaagagatagtgtgctagggttctcagtcaacgtgccagggacaactgcaaaggatgttatggacatggtgctagtcacacagtattttgacacaatgaaggaaatcggtgctgcctccaagtcctcagctgtcttcatcccccatggacctggtgctgttcgtgatgttgctagtcagattcgtgatggactgcttcagggctctgcaccacaatgactgttacccttttcctagctctacaatgttgtgttgatacaggttatttgtgcgtattatgtttgtctgtcaaggtttcttatcggcaagtcttgttaaatgttgttgtccatgtcaataattactgtacaaattaccgtggatgctaaatgaaaaggtacaggagcatcagactacacgggaactttgatatctatat

SEQ ID NO: 3481 - DNA, 1116 bp, Triticum aestivum
tgccacttcacctctcccacctttccccactcttctccaacccccggacgcaggtactaccagaagtgatcggaagtctgcagtatgggcaatctgtgctgctgtgttcaagtcgaccaatctactgtggccatcagagagcagtttgggaagtttgacagtgtgcttgagccaggatgccactgcctgccttggatctttgggaagcgtgtagttggccatctcacactcaggttgcagcagctggatgtgcgctgcgaaactaagacaaaggacaatgtgtttgtcactgttgttgcatcaattcagtaccgacctctggctggcaaagaaagcgacgcatactacaaactgaccaacaccagatcccagattcaggcctatgtttttgatgtgatcagggcaagtgttccaaagctcaacctggatgatgctttcgtgcagaagaatgatatagcacaggctgtggaggatgaacttgaaaaggctatgtcggcatatggctttgagatcgtgcagaccctcattgtcgacatcgagccagatgcgcatgtcaagcaggcgatgaatgagatcaatgcagctgcaaggatgagggtggctgcaaacgagaaggcggaggctgagaagattgtccagatcaagcgtgccgagggtgaagcagaggccaagtacctgtctggcctcggtatcgcccgccagcgccaggccattgtggatggcctgagggacagcgtcctgggcttctcagtcaatgtgcctggcaccactgcaaaggatgtgatggacatggtgctgatcacccagtactttgatactatgaaagaggtcggcgcgtcctccaagtcctcggcggtgttcatcccccatggccctggcgcggtgcgcgacatcgccacgcagatccgcgacgatcttcttcagggccagtctgcctctgacaactaagcagtttgcttcgcctacagtactctctaatatgatgcgtgttgtatgattatgacttatatggaaccatatgtggatcgtggcttaggtcgatgtgcggtaacaaaacctttaacctattggggatgcaggatgatataagtgtgttgtgaaatgctggtgatgaac

SEQ ID NO: 3482 - DNA, 1238 bp, Triticum aestivum
actcactgccaagcccacctttccccactcttctccaagccccggaggtgctacgggaagtgatcggaagcctgcagtatgggcaatctgtgctgctgcgttcaagttgatcagtctaccgtggccatcagagagcagtttgggaagtttgacagtgtgcttgagccaggatgccacttcctgccttggatctttgggaagcgtgtagttggccatctcacactcaggttgcagcagctggatgtgcgctgtgaaactaagacaaaggacaatgtgtttgttactgttgttgcatcaattcagtaccgacctctggctggcaaagaaagtgacgcatactacaaactgaccaacacaagatcccagattcaggcctatgtttttgatgtgatcagggcaagtgttccaaagctcaacctggatgatgctttcgtgcagaagaatgatatagcacaggctgtggaggatgaacttgaaaaggctatgtcggcatatggctttgagatcgtgcagaccctcattgtcgacatcgagccagatgcgcatgtcaagcaggcgatgaatgagatcaatgcagctgcaaggatgagggtggctgcaaacgagaaggcggaggctgagaagattgtccagatcaagcgtgccgagggtgaagcagaggccaagtacctgtctggcctgggtatcgcccgccagcgccaggccattgtggatggcctgagggacagcgtcctgggcttctcagtcaatgtgcctggcaccactgcaaaggacgtgatggacatggtgctgatcacccagtactttgatactatgaaagaggtcggcgcgtcctccaagtcctcggcggtgttcatcccccatggccctggtgcggtgcgtgacatcgccacgcagatccgcgacggtcttcttcagggccagtctgcctctgacaactaagcagtttgcttcgccggcatgaactttgaagctggtggtggtttgtggtttgctagctattgcctacagtactgtctaatatgatgcatgccgtatgattatgacttatatggaaccatatgtggatcttggcttaggtcgatgtgcggtaacaaaacctttaacctattgggaatgcaggatgatataagtgtgttatgaaatgctggtgatgaacttgatctaagcttcttttattttgccttttagtgctgtcaattgcatgtaaaatgctggtttaaggttacatatttctc

SEQ ID NO: 3483 - DNA, 1154 bp, Tabernaemontana elegans
acacaatgcaactcccattatacgttgattggtatccccgccagttttgatctgggtatataagatcttgggctgtgttgttttttcatcggattccgttttcagtccttgctgtgccattttgcttgctaaagaagatgggtaatctattttgctgtgttcaagttgaacaatctactgttgctatcaaggagcgttttggtaagtttgaggatgtgcttgaaccaggatgccactgcatgccttggttccttggaagccagttggctggtcatctctctcttcgtctccaacaattggatgtccgctgtgagacaaagacaaaggataatgtgtttgtcaatgttgtagcatcaattcagtaccgtgcacttggagacaaggcaaatgatgctttctataagctcagcaatactaggagtcaaatccaggcatatgtctttgatgtgataagagcaagtgtaccaaagcttaaccttgatgatgcttttgagcaaaagaatgacattgccaaagctgttgaagatgaacttgagaaggctatgtctgcttatgggtatgagattgttcagacacttattgttgacatagaaccagatgagcatgtcaagcgagctatgaatgaaatcaatgctgctgctaggctgaggctggctgctaatgagaaggctgaggctgagaaaattctacaaattaagcgtgctgaaggggaggcagaggctaagtatctctcaggtctgggaattgcgcgccagcgccaagccattgttgatggtttgagagatagtgtgctgggcttctcagtgaatgtccctggaacaacagcaaaggatgtgatggatatggtgcttgttacacagtatttcgacaccatgaaagaaattggtgccgcctccaaatcttctgcagtgttcatcccccatggacctggtgcagttcgtgatgtggcaacacagattcgtgatggactccttcaggcttctgcacacgagtgattatgctttaccatgttatgttaatttggtaattagatttgtttcaggtttgatgaatggcaactgttctttaccaataccgtttataatgtggcaatgctgtatataatgtggcaatgtgtactcaagttctgcaacttattttgggttattcaatca

SEQ ID NO: 3484 - DNA, 1348 bp, Cannabis sativa
gttttcttgattatatattaatgattttgctccgaagaaataagtacttttcatatcttaatgagaggttttgagtctcggttttggaatttggtataaagtattgttttgtttaggtcgtgctcattccatttctccccactttgtgtgcttcttatccttttgttacgtttaactattggcttcctagagagaagagaagatgggtaatttgttctgttgtgtacaagttgaccagtctacagtagctataaaggagagatttggcaagtttgatgatgtacttgagccaggatgccattgcctcccatggtttcttggaagtcagctagctggacatctcactcttcgtttgcagcaattggacgtgcgatgtgagaccaaaactaaggacaatgtctttgtcaatgttgttgcatcaatccaataccgagcccttgcagacaaagctagtgatgcattctacaaacttagcaacacacgttcccagatacaggcttacgtttttgatgtgattagagctagtgttccgaagctcaacttggatgatacttttgagcagaaaaatgaaattgctaaagctgtggaggaagaactcgagaaggctatgtctgcttatggctatgaaattgtgcaaacacttattgtggacatagagccagatgagcatgtgaagcgagcaatgaacgaaataaatgctgctgcaagaatgagggtggctgctaatgagaaggcagaggcagagaaaattttgcaaattaagagggctgagggtgaggctgagtctaagtatctttctgggctgggtattgctcgccagcgtcaagcaattgttgatggattgagagacagtgtgctgggcttttctgttaatgttcccgggaccactgcaaaggacgtcatggacatggtccttgtcactcagtattttgacaccatgaaggaaattggtgctgcttcgaaatcatctgctgtgttcattcctcatgggccaggcgctgtccgtgacatagccacccaaattcgtgatggacttctccagggttctcatgctcagcagcagtagtttggtacatctaaagcttctttccatgcatgtccaattgttgatgtcttatatacaagggtgttcctttcttaatccccaacccctctttagttttctatgatgtgtccagtgtttttgtttcatgctactgaaatttgttcatattcccattatggattttataggtataaatattaaaggtgtgttcatattttgttcatagtgcattcgatttgcaccaagttctgattttatattttagattcaatccaatccgcacaagagttctaatttaattta

SEQ ID NO: 3485 - DNA, 1489 bp, Cannabis sativa
ttcgtctttctcaaggttgtgtgtattaggagaaaaaaactatgtaacctgttacaatctgttttgtttagttatctatgctcttgtttttgaaaaacgttattgggttgcttatgattagattctgttttggttattagtttccttgaaacttttgttttgattctatctctttctgtgttctgcttacttgagagtttcaatctttgtctttgtatcccttagacactttgatgaggatctcgtagattgcttctgttgatttttctctttctctaataaaagttaattacatagaattgattgtctgtaatctctattccagttctagagagaagagaagatgggtaatttgttctgttgtgtacaagttgaccaatctacagtagctataaaggagagatttggcaagtttgatgatgtacttgagccaggatgccattgtctcccatggtttcttggaagtcagttagctggacatctcactcttcgtttgcagcaattggacgtgcgatgtgagaccaaaactaaggacaatgtctttgtcaatgttgttgcatcaatccaataccgagcccttgcagacaaagctagcgatgcattctacaaacttagcaacacacgttcccagatccaggcttatgtttttgatgtaattagagctagtgttccgaagctcaacttggatgatacttttgagcagaaaaatgaaattgctaaagctgtggaggaagaactcgagaaggctatgtctgcttatggctatgaaattgtgcaaacacttattgtggacatagagccagatgagcatgtgaagcgagcaatgaacgaaataaatgctgctgcaagaatgagggtggctgctaatgagaaggcagaggcagagaaaattttgcaaattaagcgggctgagggtgaggctgagtctaagtatctttctgggctgggtattgctcgccagcgtcaagcaattgttgatggattgagagacagtgtgctgggcttttctgttaatgttcccgggaccactgcaaaggacgtcatggacatggtccttgtcactcagtattttgacaccatgaaggaaattggtgctgcttcgaaatcatctgctgtgttcattcctcatgggccaggcgctgtccgtgacatagccacccaaattcgtgatggacttctccagggttctcatgctcagcagcagtagtttggtacatctaaagcttctttccatgcatgtccaattgttgatgtcttatatacaagggtgttcctttcttaatccccaacccctctttagttttctatgatgtgtccagtgtttttgtttcatgctactgaaatttgttcatattcccattatggattttataggtataaatattaaaggtgtgttcatattttgttcatagtgcattcgatttgcaccaagttctgattttatattttagattcaatccaatccgcacaagagttctaatttaattta

SEQ ID NO: 3486 - DNA, 1333 bp, Humulus lupulus
tgctcattccatctctgcccactttgtgtgcttcttccccttttgttacgtttcactgttggctttctagggagaagagaagatgggtaatttgttctgttgtgtacaagttgaccagtccacagtagctataaaggagagatttggcaagtttgatgatgtacttgagccaggatgtcattgcctgccatggtttcttggaagccagctagctgggcatctcactcttcgtttgcagcaattggatgtgcgatgtgagactaaaactaaggacaacgtctttgtcaatgttgttgcatcaatccaatatcgtgcacttgcagacaaggctagcgatgcattctacaaacttagcaacacacgttcccaaatccaggcttacgtttttgatgtgattagagctagtgttccaaagctcaacttggatgatacttttgagcagaaaaatgaaattgccaaagctgtggaggaagaacttgagaaggctatgtctgcttatggttatgagattgtacaaacacttattgtggacatagagccagatgagcatgtgaagcgagcaatgaatgaaataaatgctgctgcaagaatgagggtggctgctaatgagaaggcagaggctgagaaaattttgcaaattaagcgggccgagggtgaggctgagtctaagtatctttctgggctgggtattgctcgccagcgtcaagcaattgttgatggattgagggacagtgtgctgggcttctctgttaatgttcccgggaccactgcaaaggacgtcatggacatggtccttgtcactcagtattttgacaccatgaaggaaattggtgctgcctcgaaatcatctgctgtgtttattcctcatggcccaggtgctgtccgtgatattgctacccaaattcgtgatggacttctacagggttctcacgctcagcaacagtagtttggtacatctaaagcttctttccatgcatgttgaattgttgatgtcttatatgcaagggtgcatcttcccactcctccacccctcattagttttctatgacgtgtctagtgtttgtatttcatgttactgaaatttgttcatatttccatgatggattttaatatagcaataaatattaaagttgtgatcatataccaaagaagaaagaaggaaaatggttagttgtcatgtggatatatgaactttgaaaaatccacttccaaaatgttcatataataaaatctttcttttgttggtcatttggtggttaagagaatgatattgaagatactagtgtatatcttgttcaattctttagcattggtagcgaatgaattgtaactc

SEQ ID NO: 3487 - DNA, 945 bp, Olea europaea
gaccaactgaaatgggaaatctattgtgttgtgtacaagtagatcaatctaaggttgctatcaaggagcggtttggcaaatttgatgaagtccttgagccagggtgccattgcatgccttggtttcttggaagccaagtagccggttatctctccctccgtctacagcagttggatgtacgctgtgaaactaagacaaaggacaatgtattcgtcaatgtagtggcatcaatacagtaccgcgcccttgcagacaaggcaagtgatgctttctacaaactgagcaacacaagaagtcaaattcaggcctacgtatttgatgtaattagagcaagtgttccaaaactcaaccttgatgatgcttttgagcagaaaaatgatatagcaaaggctgttgaagatgaacttgagaaggcaatgtctgcttatgggtatgaaattgttcagacgctgattgttgacatagaaccagacgagcatgttaagagagcaatgaatgaaataaacgctgctgcaaggctaagattagctgctaatgagaaggcagaggctgaaaagatcttgcaaattaagagagccgaaggagaagctgaggctaaatatctatctggattgggtattgctcgccagcgtcaagcaattgtggatggtttaagagatagtgtactaggtttctcagttaatgttcccggaaccactgcaaaggatgttatggatatggtccttgtcactcaatactttgacacgatgaaagaaattggagctacctccaaatcatctgctgtgttcatccctcatggaccaggtgcagttcgtgatgtggcaacacaaattcgtgatggacttcttcaggcttctcaagcatgacctcaatttctacagctgtcatctaaaaatttatcacttatttcctgctgcctgtgtgattttgaattttcctttcctt

SEQ ID NO: 3488 - DNA, 1096 bp, Gossypium hirsutum
tgttctcttgacatccttgtccggtcgtatgtattgtgcttcttttttatgtgtttcttttgtagtttgttgttagtccatagggaaaaacaagggaggggatgggcaacctattttgttgtgtccaagtagaccaatcaaccgtagcgataaaggaaagatttggcaagtttgatgaagttctagagcctggatgccattgtttaccttggtgtattgggagccagcttgccggccatctcactctgcgtttacagcagcttgatgtgcgttgtgagaccaagactaaggacaatgtatttgtcaacgttgtggcatccatacagtatcgcgccctggctgagaaggctaatgatgctttctacaaacttagcaaccccaggactcaaattcaagcctatgtttttgatgttattagggcaagtgttccaaagctggatttggatgatgcttttgagcaaaagaatgatattgctaaagctgttgaagatgagcttgaaaaggctatgtctgcttatggatatgagattgtccagaccctcattgttgatatagaaccagatgaacacgtgaaaagggccatgaacgagattaatgctgctgcaaggatgagagttgcagcaaacgagaaagcagaggcggagaagattatacagataaagagagcagagggagaggcggaatcaaagtatctgtcaggagtggggattgcaaggcaacgacaggcgattgtggacggtctaagggacagtgtgcttgggttctcagtcaatgttccagggacaacggctaaggatgttttggatatggtccttattacccagtattttgataccatgaaagaaattggtgctgcctctaaatcttcatccgtctttatccctcatggacctggtgctgttcgagacattgccacccagattcgagatggcctgcttcaggcatctcaccatcatgaataaagggtcagacccaaactcaattgtaataaaaagtcttaaaaccaggatacggtttagtgtgtttgagtgaaatctatatttagtctctctgcttagaaatatgaaatgtaatttgctatgtaaagttaatgaaa

SEQ ID NO: 3489 - DNA, 1252 bp, Gossypium raimondii
aattattaataaatagatttgcttgatattttctagccctatatctagtcagatgtttgaatggcattatttatatcatccttgttttctttcctctcttcaaactaaactctaaatgtgtgttctcttgacatccttgtccggtcgtatgtattgtgcttcttttttatgtgtttcttttgttgtttgttgttagtccatagagaaaaacaagggaggggatgggcaacctattttgttgtgtccaagtagaccaatcaaccgtagcgataaaggaaagatttggcaagtttgatgaagttctagagccaggatgccattgtttaccttggtgtattgggagccagcttgccggccatctcactctgcgtttacagcagcttgatgtgcgttgtgagaccaagactaaggacaatgtatttgtcaacgttgtggcatccatacagtatcgtgccctggctgagaaggctaatgatgctttctacaaacttagcaaccccaggactcaaattcaagcctatgtttttgatgttattagggcaagtgttccaaagctggatttggatgatgcttttgagcaaaagaatgatattgctaaagctgttgaagatgagcttgaaaaggctatgtctgcttatggatatgagattgtccagaccctcattgttgatatagaaccagatgaacacgtgaaaagggccatgaacgagattaatgctgctgcaaggatgagagttgcagcaaacgagaaagcagaggcggagaagattatacagataaagagagcagagggagaggcggaatcaaagtatctgtcaggagtggggattgcaaggcaacgacaggcgattgtggacggtctaagggacagtgtgcttgggttctcagtcaatgttccagggacaacggctaaggatgttttggatatggtccttattacccagtattttgataccatgaaagaaattggtgctgcctctaaatcttcatccgtctttatccctcatggacctggtgctgttcgagacattgccacccagattcgagatggcctgcttcaggcatctcaccatcatgaataaagggtcagacccaaactcaattgtaataaaaagtcttaaaaccaggatacggtttagtgtgtttgagtgaaatctatatttagtctctctgcttagaaatatgaaatgtaatttgctatgtaaagttaatgaaagtgaacttttccatttatggtttatgatttagagaa

SEQ ID NO: 3490 - DNA, 969 bp, Secale cereale
tttgggggtttgggtcactgggcacacacacagactcactgccacttcaccgtcaccgctcccccctttccccactcttctccaacccccggacggaggtatgggcaatctgtgctgctgtgttcaggtcgatcagtctaccgtggccatcagagagcagtttgggaagtttgacagtgtgcttcagccaggatgccactgcttgccttgggtcttagggaacgtgtagttggccatctcacactcaggttgcagcagctggatgtgcgctgcgaaactagacaaaggacaatgtgtttgtcactgttgttgcatcaattcagtaccgtcctctggctggacaaagaaagtgacgcatactacaaactgaccaacacaagatcccagattcaagcctatgtttttgatgtgatcagggcaagtgttccaaagctcaacctggatgatgctttcgtgcagaagaacgatatagcaaaggctgtggaagatgaacttgaaaaggctatgtcggcatatggctttgagatcgtgcagaccctcattgtcgacatcgagccagatgcgcacgtcaagcaggcaatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattggcgcgtcctccaagtcctcggccgtcttcactcccccatggccctggtgcggttcgtgacatcgccacgcagatccgcgacggtcttcttcgagggccagtctgcctctgacaactagtagt

SEQ ID NO: 3491 - DNA, 1023 bp, Antirrhinum majus
  misc_feature (848)..(848): n is a, c, g, or t
  misc_feature (863)..(863): n is a, c, g, or t
aacccaaaaaaagagatctaattcggcacgaaaaaaacggtaaaatgggaaatttgttttgctgtattcaagtggaccaatcgaccgttgcgatcaaggagcgatttggaaaatttgaggaagtcctggagccaggatgccattgcttgccttgggttttcggaagtcagttggctggccatctcacgctccgtttgcagcaattagatgttaagtgcgaaaccaagacaaaggacaatgtttttgtgaatgtagtggcatcaatacagtaccgtgccctggctgacaaggcaagtgatgcattttacaaactcagcaacacaaggagtcagattcaggcctatgtcttcgacgtaatcagagcaagtgttccaaaactcaatctggatgatgcttttgagcagaagaatgatattgctaaggctgttgaagatgagcttgaaaaggccatgtctgcttatggatatgaaattgttcagacactaattgttgacattgaaccagatgagcacgtcaagagagcaatgaacgaaatcaatgcagccgcaaggatgaggcttgctgctaatgagaaagcagaggctgaaaagattttacaaatcaagagagctgaaggtgaagcagaggctaaatatctctcgggtttaggtatcgcacgtcagcgtcaagcaattgtagatggattaagagacagtgttctgggattctccgttaatgtgcctgggaccactgcaaaggatgtcatggatatggttcttgtcacccaatattttgacacaatgaaggaaattggtgcatcttctaagtcttctgctgtgttcattcctcatggacccggcgcagttcgngatgtggctgctcanattcgtgatggtcttcttcagggatcccatggcccagcataatatgccgtaacttctccagctgttctggaagtgagagtgtgaaataaactttgtcagggttgcttcttgtctgtctgatgttaagtatgttactgttatattggggattttcgtcgag

SEQ ID NO: 3492 - DNA, 1342 bp, Avena sativa
aaagatccaccctgttcgtcatttggtcctatccttgttcagtaccacctgagcattatctcttgttcagccagtacacgtttcaattcaggtattaccagaagcgacctgaagcctgccgccatgggcaatttgttgtgctgtgttcaagttgatcagtcaaccgtggccatcagagagcagtttgggaagtttgatagtgtccttgagccaggatgccactgcctgccttggatggttgggaaacgtatagctggccatctcacactcaggctgcagcagctggatgtgcgctgtgagaccaagacaaaggacaatgtgtttgtcactgttgttgcatcaattcagtaccgacctctggctggcaaagaaagtgatgcattctacaaactgaccaacacaaggtcccagatccaagcttatgtttttgatgtgatcagggcaagtgttccaaagctcctcctggacaatgcttttgagcagaagaacgacattgcgaagtctgtggaggatgagctcgagaaggccatgtcagcatatggcttcgagatcgtgcagacactcatcgtcgacattgagccggacgagcatgtcaagcgagcgatgaacgagatcaacgcagctgcaaggatgagggtggccgcgaacgagaaggcggaggctgagaagatcgtgcagatcaagcgcgcggagggcgaggcggaggccaagtacctgtcgggcctgggcatcgcccggcagcgtcaggccatcgtggacgggctgagggacagcgtgatcgggttcgcggagaacgtgcccggcacgagcgccaaggacgtgatggacatggtgctcatcacgcagtacttcgacacgatgaaggagatcggcgcgtcctccaagtcctcggcggtgttcatcccccacggccccggcgcggtgagcgacgtcgccgcgcagatccgcgacgggctcctccagggccactccgccgccgctgccggccggcactagttgggcgtcttcgcgggcgtgaacatacatgcgacagacggctgatgagatggtggtgtgtggtttgctaagctatatatggctaccttattgtaagtagtggacttctctgggaccgtgtgtgtgggttgtggcagcatgtcgtgccttattagatgatgtgtggaggcaagactggtagtattaacctcctggggattcagcgtgatatatgcaatagtattgtggaaattgtggattgtggtgatgaacttggtctgataggtttgccacatttccggtgtgtcagttagatgtgaagggcccaattatactgaactgaagcagaccccttcattattccttt

SEQ ID NO: 3493 - DNA, 990 bp, Amsonia hubrichtii
gagaagatgggtaatctattttgctgtgtacaagttgaccaatccactgttgctatcaaggagcgttttggcaagtttgaggaagtgcttgaaccaggatgccactgcatgccttggttccttggaagccagatggctggtcatctctcccttcggctccaacaattggatgttcgctgtgagacaaagacaaaggataatgtgtttgtcaatgtagtggcatcaattcagtaccgtgcacttggaggcaaggcaagtgatgctttctacaagctcagcaataccaggagtcaaatccaggcatatgtctttgatgtgataagagcaagtgtaccaaagcttaatcttgatgatacttttgagcaaaagaatgatattgctaaagctgttgaagatgaacttgagaaggcgatgtctgcttatggatatgaaattgttcagacacttattgttgatatagaaccagatgagcatgttaagcgagcaatgaatgaaattaatgctgctgctagaatgaggttggctgctaatgagaaggctgaggctgagaaaattctacagattaagcgtgctgaaggtgaagcagaggccaagtatctctcaggtctgggaattgcccgccagcgccaagccattgttgacggtttgagagatagtgtattaggcttctcagtcaatgtccctggaacaacagcaaaggatgtgatggatatggtgcttgttacacaatatttcgacaccatgaaagaaattggtgctgcctccaaatcttctgctgtcttcattccccatgggcctggtgctgttcgggatgtggcatcccagattcgtgatggactccttcaggcttctgcacatgaatgatcatcctttactacattaccttgaatttgatagtaattaaatatgtttcaagtttgatgaatgatgattgttcttaccaaataacgttcatagtgtttatgtatagttgaatttttatttttgcac

SEQ ID NO: 3494 - DNA, 1241 bp, Liriodendron tulipifera
  misc_feature (908)..(908): n is a, c, g, or t
  misc_feature (912)..(913): n is a, c, g, or t
  misc_feature (926)..(926): n is a, c, g, or t
  misc_feature (929)..(929): n is a, c, g, or t
  misc_feature (939)..(939): n is a, c, g, or t
  misc_feature (980)..(980): n is a, c, g, or t
  misc_feature (1182)..(1182): n is a, c, g, or t
atttgctttcgaaaagaggaagaacgtctttgaagttcgaaagaggcttggtgcttgtgtttgttgaagaggagcttttgtgtaaaaactgaacatgggtcagttgctttgctgtatacaagtcgatcaatccactgtagctatcaaggaaagatttggtaagtttgacgaagttcttgagccaggatgtcattgcctgccgtggtttcttggcagtcaagtagctggtcatctatcactgcggctgcagcaactggatgtgcgatgcgagacaaagacaaaggataatgtttttgtcaatgtcgttgcatctatccaataccgtgcccttgctgataaggcgaatgatgcattttataaactcagcaatacaaggagtcaaatccaggcatacgtgtttgatgtaattagagctagcgtcccaaagctcaacctggacgatactttcgagcagaagaacgatattgcgaaagcagttgaagatgagcttgagaaggccatgtctgcttatggttttgagattgttcagaccctcattgttgatatagagccagatgagcacgtgaagcgagccatgaatgaaatcaatgcagctgcaaggcttagagtggcagcaaatgagaaggcagaagccgagaaaatcctgcaaatcaagcgggccgagggtgaggcagaatccaagtatctgtcaggcttgggcattgcccgtcagcgccaagcaatcgtggacggattgagagatagcgtcctcggcttctctgtcaatgtgccagggacaaccgcaaaggacgtcatggatatggttctggttactcagtactttgacacgatgaaggagattggtgcggcctccaagtcttctgccatcttcattccccatggacctggagctgtccgtgatgttgccncccnnatccgcgacgggntgntacagggttntgccgctaaccactaataaattttagtgtttgggcatgaantaagttgtggggtatgtgtttgcagactcttaccaagtcttttgtgggtttttcttcagatggtgattgtttgtttggtctgcctttgaaaggtttggtatatagtgtcattcgcctggatatatgggctatacttctctcttttgcttttgcgaggtttggtatgcagtgtcgttcacctggatatatggttatacttctntatttcacttttgtaaggtttggtatagtgttgttcgcctggatatatggttatgcttc

SEQ ID NO: 3495 - DNA, 1194 bp, Secale cereale
aaaaccctcatttttctccccctccttcttcctcattaatcgtgtcgcgcgagatccggacatttcttcgttgtggctcctctgctcccggatcctgctctgcttttcggtatgggcaatctgtgctgctgtgttcaggtcgatcagtctaccgtggccatcagagagcagtttgggaagtttgacagtgtgcttcagccaggatgccactgcttgccttgggtcttagggaaacgtgtagttggccatctcacactcaggttgcagcagctggatgtgcgctgcgaaactaagacaaaggacaatgtgtttgtcactgttgttgcatcaattcagtaccgtcctctggctggacaaagaagtgacgcatactacaaactgaccaacacaagatcccagattcaagcctattgttttgatgtgatcagggcaagtgttaccaagctcaacctggatgatgtctttcgtgcagaagaacgatatagcaaaggctgtggaagatgaacttgaaaaggctatgtcggcatatggctttgagatcgtgcagaccctcattgtcgacatcgagccaggatgcgcacgtcaagcaggcaatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattggcgcgtcctccaagtcctcggccgtcttcatccccatggccctggtgcggttcgtgacatcgccacgcagatccgcgacggtcttcttcagggccagtctgcctctgacaactagtttgcttcgccggcatgaactttgaagctggtggtggtttgtggttgtgctagctattgcctacagtactgtctaatatgatgcatgccgtattattatgacttgtatggaaccatatgtggatcgtggcttaggtcgatgtgcggtatcaaaacctttaacctattgggaatgcaggatgatataagtgtgttatgaaatgctggtgatgaacttga

SEQ ID NO: 3496 - DNA, 1685 bp, Vitis vinifera
cggataatatcttaaaaaattaataataataaaaaaagaaactttggatggggagaagttgcttgggaatggtggcccaggtcgtcgtttactttatgaagcagcagcttcgcagtcttttctaggtattatcccaactcggtagcccttatgctcttgtctccaactgctagatcttgattctaggaaagcaaaaaagcaggtaaatttcgtattttccctttcatttcgcatgtgggtttcgtctattcttcttgaattcatctttaatctcctttaattttctccgaaaatggccaagtcacccaccttttgtcttctctccatctcctccccgtttcacacagctgtacataggctttattgctttttttttttttttattcatctgatatttattacattccccattccgctttcgtctccttcccttttgtttgtatatcgaattagcgcagaaaacatgggtaatctgcttggttgcatacaagtcgatcaatccacagtagctatcaaggagagatttggcaagtttgaggaagtgcttgagccaggatgccattgcttgccttggtgctttgggagtcagcttgctggccatctttcacttaggttgcaacagttggatgtgcgttgtgagaccaagacaaaggacaatgtgtttgtcaatgttgttgcttctatacaatatcgtgccctggcagataaggcaaatgatgctttttacaaactcagcaatacaaggtcccagatccaggcttatgtttttgatgttattagagcaagtgttccaaagctcaatctggacgatgcatttgagcaaaaaaatgaaattgctaaatctgtggaagatgaacttgaaaaggctatgtctgcctatgggtatgagattgtacaaacactcattgttgatatagaaccagatgagcatgtgaagcgagcaatgaatgaaatcaatgctgctgcaagaatgagggtggcagccaatgagaaggcggaggctgagaaaattttgcaaatcaagcgtgcagagggtgaggctgagtccaagtatctatcagggcttggtattgctcgtcagcgtcaagcaattgttgatggcttgagagacagtgtgctaggcttctcagtcaatgttccaggcaccactgcgaaggatgtgatggacatggtcctcgtcacacagtacttcgacaccatgaaggaaattggtgctgcttctaaatcctcagctgtgttcatcccccatggacccggagctgttcgtgatgtggctactcagattcgtgatggacttcttcagagtaccctctcacatcagtaattgtcttatgtttacaaggttttttctatttttaggcttgtcactgaaacaactttgatgtgaagtttatgttcatgttgatctctcagggtgtttagtgtggtttggttttatttcatggtcagtgcaatctgtccattgctattattgtacatatgaactcaaagatttgtcacatgagccgtatacttgaatttgattttaaactttgagagatttcttaatgctaatgctagtttctcctgcaagaatatattggatattggtttctgtttcaccttcaagcattgttctaaaaatgcatccccatggtgatccagtagacatactttattttcttgtggcagtctcatcttcctcc

SEQ ID NO: 3497 - DNA, 1147 bp, Brassica juncea
attcacagctaaccaaaagcgttttcatctaatcatcaaacccagcaaaatcaaaagaagacaactttcgataactgcgaagaaagatggggaatttgttttgctgtgtacaagtggaccagtcaacggtggcgatcaaagaaacgtttgggaagttcgaagaggttcttgagcctggttgccattttctcccttggtgtcttggtcagcaagtcgctggttacctctctctcaggcttcagcagttggatgttcgctgcgagaccaagactaaggacaatgtgtttgttaacgttgttgcatcgattcaataccgtgcattggctaataatgctaatgatgccttctacaagcttagtaacacacggagccagatccaagcttacgtctttgatgttatcagagcgagtgtccccaagctgattctggatgatgtctttgagcagaagaatgaaattgccaaagctgttgaagaggagctcgagaaggcaatgtctgcttacggttttgagattgtccaaactctcattgttgacatcgagcctgacgaacatgtcaaacgagccatgaacgaaatcaacgctgctgcaaggatgaggttggctgcaaacgagaaggcagaggctgagaaaatcctgcagatcaagcgagctgaaggtgaagccgaggccaagtacctatctgggctaggtatcgcccgtcagaggcaggccattgttgacgggttacgcgacagcgtccttggtttctctgtgaatgttcccgggacaactgctaaagacgtgatggacatggtgcttgtcacgcagtacttcgacaccatgaaggagattggtgccagttccaaatcctctgctgtgttcattccccacggaccaggagcggttcgtgatgtggctactcagatcagagatggcctccttcaaggctcgttcgcagaccagtcttgaattagatggactgatcattatatgttatctactaagcttgctgtgtgttgagatcatatgatcttgtgctgagaaactctcatgcttttaggttcttttatttttcgttaatatatatttcaagtacgacgtactatttgggtgtacaaccaaaaatcgcaattagtaatcaattaatctacatggattatatgttg

SEQ ID NO: 3498 - DNA, 1273 bp, Lactuca sativa
caaaaactaagcaaaacgaagaaaattaggatgaaggtgaagtgtgaacgcatcgataaatacaaatactttttcgatcctttccttattaaagatacatccgcgaaatatcttctccaccgcgctgttcgatcttggccttgcaaccacctcagtataagatcatgggaaacctattctgtttagttcaagtagatcagtccacagtagccatcaaggaaactttcggaaaatttgatgatgttcttgagccaggtttacattgtgtcccttggattttcggaagtcaggttgctggacaactcacactaagacttcaacagttagatgtcaagtgtgagaccaaaacaaaggacaatgtttttgtcaatgttgtagcttcaatacagtatcgtgccctagctgataaagcaagtgacgccttttacaaactcagcaacacaaggtcccaaatccaagcttatgtttttgatgtcataagagctagcgtcccaaagctcaacctagatgatgcttttgaacaaaagaatgaaatcgccaaagctgttgaagacgaacttgaaaaggcaatgtctgcatatgggtttgagatagttcaaactttaattgtggacatagagccggatgagcatgttaagagagcaatgaacgagatcaatgcagctgcaaggtttaggatggcagctactgagaaggctgaagccgagaagatacttcagataaagagggctgaaggagaggctgagtcgaagtatttgtctggattgggtattgcacgacaaagacaagcaattgttgatggtttaagggacagtgtgttggggttttcagttaatgttcctgggacaacagctaaggatgttatggatatggttttggttactcagtattttgatacaatgaaggaaattggggcttcatctaaatcatctgctgtgtttatcccacatggacctggtgctgttcgtgatgtggctgctcagattcgcgatggtcttcttcagggtaacgccactcactgattgttgactgttttcatacagttttttatggtggttgactttgggtcatacagttttttaatgaatgtgtttatattgtttaactttgtgagtttgtgtatgctttatattgttgatatggtatagtaggttttgaatttggtttccggtttctttctaaaagaatttgagtttctgtgtttggaattttttatatatgatttgaagcttttaaagaataatgtgaaagaaataaaggaaaagctctaaag

SEQ ID NO: 3499 - DNA, 1139 bp, Brassica rapa
gatcacaggctgtttgttcttcacagagctacccccaataacgttgtctcatcgaaatcaaaaagaagacaactttcgagaggaaatagtgaagaaagatggggaatttattttgctgtgtacaagtggaccaatcaacggtggcgataaaagaaacgtttgggaagttcgaagaggttcttgagcctggttgccattttctcccttggtgtcttggtcagcaagtcgctggttacctctctctcaggcttcagcagttggatgttcgctgcgagaccaagacaaaggacaatgtgtttgttaacgttgttgcatcgattcaataccgtgcattggctaataatgctaacgatgccttctacaagctcagtaacacaaggagccagatccaagcttacgtctttgatgttatcagagcaagtgtccccaagctgattctggatgatgtctttgagcagaagaatgaaattgccaaagctgttgaagaggagctcgagaaggcaatgtctgcttacggttttgagattgtccaaactctcattgttgacatcgagcctgacgaacatgtcaaacgagccatgaacgaaatcaacgctgctgcaaggatgaggttggctgcaaacgaaaaggctgaggctgagaaaatcctgcagatcaagcgagctgaaggtgaagccgaggccaagtacctttctggtcttggtatcgcccgtcagaggcaagccatcgttgacgggctacgcgacagtgtcttgggcttctctgtgaatgttcccgggacaactgctaaagatgtgatggacatggtgctcgttacgcagtactttgacaccatgaaggagattggtgccagttccaaatcctctgctgtgttcattccccacggaccaggagcggttcgtgatgtggctactcagatcagagatggcctccttcaaggctcgttcgcagaccagtcttgaattagatggactgatcattatatgttatctactaagcttgctgtgtgttgagatcatatgatcttgtgctgagaaactctcatgcttttaggttcttttatttttcgttaatatatgacgtatttgggtgtacaaaaaagaagctaaaaggacaccatttaaactatttactatata

SEQ ID NO: 3500 - DNA, 1196 bp, Brassica rapa
aacataaagatcttctctgccctctgaatataaatcatatcagctcgctgaaattatctgttacctgcaaaatcaaaagacacgataactttcggattagagatttgtaaagaaaaaagatgggtaatttattctgctgtatccaagtcgaccaatcaacagtagccatcaaagaaacgtttgggaagttcgaagatgttcttgagcctggttgtcactttcttccatggtgccttggtcagcaagttgctggtcacctctctctaaggcttcagcagttagatgttcgttgcgagactaagacaaaggacaatgtgtttgttaatgttgttgcgtcgattcagtatcgtgccttggctaataaggctaatgatgcgttttacaagcttagtaacactaggagtcagatccaagcttatgtctttgatgtgatcagagcaagtgtccccaagctgcttcttgatgatgtctttgagcagaagaatgagattgccaaagctgttgaagaggagctcgagaaggcaatgtctgcttacggttttgagattgtgcaaactctcatcgttgatattgagcctgatgaacatgtcaaacgagccatgaacgaaatcaacgctgctgcaaggatgagattggctgcaaacgaaaaggcagaagctgagaaaatcctgcagattaagagagctgaaggtgaagctgaggccaagtatctatctggtctaggtatagctcgtcagaggcaagctattgttgacggtttacgcgacagtgtcttgggattctctgtgaatgtgcctgggacaactgctaaagatgtgatggacatggtgcttgttacgcagtactttgacacgatgaaggagattggtgccagttccaaatcttccgctgtgttcatacctcacggaccaggagcggttcgtgatgtggctactcagatcagagatgggctccttcaagggtcctttgctgagcagccttgaatgtggatgtattgagtttatgttcttcttgcttttgctaagcttatggtgtgttaagacttaagattggagtgctaacttagctttatgtttttttttttattaatttttatttcaactatttgtgtggattgaaaacatatattatcatcatattagtaacaaagttttttttttcttcttattctgtcaatttaatttctattttctaga

SEQ ID NO: 3501 - DNA, 1969 bp, Brassica rapa
tgggtataaatcaagttcggttttttttttttttgtcaataaaaaggttgtgttttgtttgtttgtttggattagagaggaaatagtgaagaaagatggggaatttattttgctgtgtacaagtggaccaatcaacggtggcgataaaagaaacgtttgggaagttcgaagaggttcttgagcctggttgccattttctcccttggtgtcttggtcagcaagtcgctggttacctctctctcaggcttcagcagttggatgttcgctgcgagaccaagactaaggacaatgtgtttgttaacgttgttgcatcgattcaataccgtgcattggctaataatgctaacgatgccttctacaagctcagtaacacaaggagccagatccaagcttacgtctttgatgttatcagagcaagtgtccccaagctgattctggatgatgtctttgagcagaagaatgaaattgccaaagctgttgaagaggagctcgagaaggcaatgtctgcttacggttttgagattgtccaaactctcattgttgacatcgagcctgacgaacatgtcaaacgagccatgaacgaaatcaacgctgctgcaaggatgaggttggctgccaacgaaaaggctgaggctgagaaaatcctgcagatcaagcgcgctgaaggtgaagccgaggccaagtacctttctggtcttggtatcgctttgtctcatcgaaatcaaaaagaagacaactttcgagaggaaatagtgaagaaagatggggaatttattttgctgtgtacaagtggaccaatcaacggtggcgataaaagaaacgtttgggaagttcgaagaggttcttgagcctggttgccattttctcccttggtgtcttggtcagcaagtcgctggttacctctctctcaggcttcagcagttggatgttcgctgcgagaccaagactaaggacaatgtgtttgttaacgttgttgcatcgattcaataccgtgcattggctaataatgctaacgatgccttctacaagctcagtaacacaaggagccagatccaagcttacgtctttgatgttatcagagcaagtgtccccaagctgattctggatgatgtctttgagcagaagaatgaaattgccaaagctgttgaagaggagctcgagaaggcaatgtctgcttacggttttgagattgtccaaactctcattgttgacatcgagcctgacgaacatgtcaaacgagccatgaacgaaatcaacgctgctgcaaggatgaggttggctgcaaacgaaaaggctgaggctgagaaaatcctgcagatcaagcgcgctgaaggtgaagccgaggccaagtacctttctggtcttggtatcgctcgtcagaggcaagccatcgttgacgggctacgcgacagtgtcttgggcttctctgtgaatgttcccgggacaactgctaaagatgtcatggacatggtgctcgttacgcagtactttgacaccatgaaggagattggtgctagttccaaatcctctgctgtgttcattccccacggaccaggagcggttcgtgatgtggctactcagatcagagatggcctccttcaaggctcgttcgcagaccagtcttgaattagatggactgatcattatatgttatctactaagcttgctgtgtgttgagatcatatgatcttgtgctgagaaactctcatgcttttaggttcttttatttttcgttaatatatatttcaagtacgacgtactatttgggtgtacaaccaaaaatcgcaattagtaatcaattaatctacatggattatatgttgatcatattcaaatttgcgattacattagatgctacataaaattaattcaacttgtatggagttggggaatgaaaatagatactagtaaaaaacatatagttttctgtcaattaatattttattaattcaatttttctagacaaatc

SEQ ID NO: 3502 - DNA, 1099 bp, Brassica napus
gacctgcaaaatcaaaagacacgataactttcggattagagatttgtaaagaaaaaagatgggtaatttattctgctgtatccaagtcgaccaatcaacagtagccatcaaagaaacgtttgggaagttcgaagatgttcttgagcctggttgtcactttcttccatggtgccttggtcagcaagttgctggtcacctctctctaaggcttcagcagttagatgttcgttgcgagactaagacaaaggacaatgtgtttgttaatgttgttgcgtcgattcagtatcgtgccttggctaataaggctaatgatgcgttttacaagcttagtaacactaggagtcagatccaagcttatgtctttgatgtgatcagagcaagtgtccccaagctgcttcttgatgatgtctttgagcagaagaatgagattgccaaagctgttgaagaggagctcgagaaggcaatgtctgcttacggttttgagattgtgcaaactctcatcgttgatattgagcctgatgaacatgtcaaacgagccatgaacgaaatcaacgctgctgcaaggatgagattggctgcaaacgaaaaggcagaagctgagaaaatcctgcagattaagagagctgaaggtgaagctgaggccaagtatctatctggtctaggtatagctcgtcagaggcaagctattgttgacggtttacgcgacagtgtcttgggattctctgtgaatgtgcctgggacaactgctaaagatgtgatggacatggtgcttgttacgcagtactttgacacgatgaaggagattggtgccagttccaaatcttccgctgtgttcatacctcacggaccaggagcggttcgtgatgtggctactcagatcagagatgggctccttcaagggtcctttgctgagcagccttgaatgtggatgtattgagtttatgttcttcttgcttttgctaagcttatggtgtgttaagacttaagattggagtgctaacttagctttatgttttttttattaatttttatttcaactatttgtgtggattgaaaacatatattatcatcatattagtaacaaagtttttttttcttc

SEQ ID NO: 3503 - DNA, 1142 bp, Brassica napus
acaggctgtttcgttattcacagagcttcttccccaataacgttgtgtttcatcgaaatcaaaaagaagacaactttcgagaggaaatagtgaagaaagatggggaatttattttgctgtgtacaagtggaccaatcaacggtggcgataaaagaaacgtttgggaagttcgaagaggttcttgagcctggttgccattttctcccttggtgtcttggtcagcaagtcgctggttacctctctctcaggcttcagcagttggatgttcgctgcgagaccaagactaaggacaatgtgtttgttaacgttgttgcatcgattcaataccgtgcattggctaataatgctaacgatgccttctacaagctcagtaacacaaggagccagatccaagcttacgtctttgatgttatcagagcaagtgtccccaagctgattctggatgatgtctttgagcagaagaatgaaattgccaaagctgttgaagaggagctcgagaaggcaatgtctgcttacggttttgagattgtccaaactctcattgttgacatcgagcctgacgaacatgtcaaacgagccatgaacgaaatcaacgctgctgcaaggatgaggttggctgccaacgaaaaggctgaggctgagaaaatcctgcagatcaagcgcgctgaaggtgaagccgaggccaagtacctttctggtcttggtatcgctcgtcagaggcaagccatcgttgacgggctacgcgacagtgtcttgggcttctctgtgaatgttcccgggacaactgctaaagatgtcatggacatggtgctcgttacgcagtactttgacaccatgaaggagattggtgccagttccaaatcctctgctgtgttcattccccacggaccaggagcggttcgtgatgtggctactcagatcagagatggcctccttcaaggctcgttcgcagaccagtcttgaattagatggactgatcattatatgttatctactaagcttgctgtgtgttgagatcatatgatcttgtgctgagaaactctcatgcttttaggttcttttatttttcgttaatatatatttcaagtacgacgtactatttgggtgtacaaccaaaaatcgcaattagtaatcaattaatc

SEQ ID NO: 3504 - DNA, 1306 bp, Euonymus alatus
gtattagacatcaagacattgacctttgacgtagtcttcgtttggctgtctttcttatttctgcgaaccccctttttttttctttctaattctctgatgtttatcctacagcttcgagcatgatttgtgtaaaacagtaaactagatgggaaatctgttttgttgtattcaagttgaccagtcaaatgttgctatcaaggagcgatttggtaagtttgaagaagttcttgagcctggatgccattgcctcccttggtttcttggcagccagcttgcaggccatctgtcactaaggttgcagcagttggatgtgaaatgtgagaccaagacaaaggataacgtatttgtcaatgtggttgcatcaattcaatatcgtgccctggcacacaaggcaaatgatgcattctacaaactgagtaacacgaggtcacaaattcaggcctatgtgtttgatgtaatcagagcaagtgttccaaaacttaatctggatgctgcatttgaacaaaaaaatgaaattgctaaagctgtggaagatgaactcgagaaggctatgtctgcatatgggtttgagattgttcaaacgctcattgttgatatagaaccagatgagcaagtgaaacgggcaatgaatgaaatcaatgctgctgcaagaatgaggttggcaaccaatgaaagggcggaagctgagaaaattttgcaaatcaaacgggctgagggtgaggctgaggctaagtatctctcagggcttggcattgctcgtcagcgacaagcaattgtggatggtttaagagatagtgtgctaggcttctcagtcaacgtgccagggaccactgcaaaggatgtcatggacatggtgcttgtcacacagtattttgacacaatgaaggaaattggtgcttcctctaagtcctcagctgtcttcattccccatggacctggtgctgttcgcgacgttgctagtcagattcgtgatggactccttcagggctctatgtcccattgattgttacccttttgctagttttacaaggtttgtgttgatgcagtttatttgtgcatactatgtttgtctctggaggtttttcactggaaagtcctgttaaacgttgatgtccattaaaataattcctgtacaaattatcctggatgctaagtggaaagtacagaagtggcaccgaactgtgatatttatctattgcgagctttcaaaattatgttgcatagatgtgttggatgactgagaactgtatttgtgtctctgtaattcggattagttttgttattggataaactacattgctgctgt

SEQ ID NO: 3505 - DNA, 1185 bp, Euonymus alatus
ttggttgtggcgagtaaactctgtagtctatataaatctgttgttgggtttttcttactcattgtctctgctcatacgatctgctgtttctttattacccttgtaaaacagtaaactagatgggaaatctgttttgttgtattcaagttgaccagtcaaatgttgctatcaaggaacgatttggtaagtttgaagaagttcttgagcctggatgccattgcctcccttggtttcttggcagccagcttgcaggccatctgtcactaaggttgcagcagttggatgtgaaatgtgagaccaagacaaaggataacgtatttgtcaatgtggttgcatcaattcaatatcgtgccctggcgcacaaggcaaatgatgcattctacaaactgagtaacacgaggtcacaaattcaggcctatgtgtttgatgtaatcagagcaagtgttccaaaacttaatctggatgctgcatttgaacaaaaaaatgaaattgctaaagctgtggaagaagaactcgagaaggctatgtctgcatatgggtttgagattgttcaaacgctcattgttgatatagaaccagatgagcaagtgaaacgggcaatgaatgaaatcaatgctgctgcaagaatgaggttggcaaccaatgaaaaggcggaagctgagaaaattttgcaaatcaaacgggctgagggtgaggccgaggctaagtatctctcagggcttggcattgctcgtcagcgacaagcaattgtggatggtttaagagacagtgtgctaggcttctcagtcaacgtgccagggaccactgcaaaggatgtcatggacatggtgctggtcacacagtattttgacacaatgaaggaaattggtgcttcctctaagtcctcagctgtcttcattccccatggacctggtgctgttcgcgacgttgctagtcagattcgtgatggactccttcagggctctatgtcccattgattgttacccttttgctagttttacaaggttgtcttgatgcagtttatttgtgcatactatgtttgtctgtggaggtttttcatcggaaagtcctgttaaacgttgatgtccattaaaataattcctgtataaattatcctggatgctaagtgaaaagtacagaagtggcaccaaactgtgatatttatctattgcgagctttcaaaat

SEQ ID NO: 3506 - DNA, 1203 bp, Lactuca sativa
tttcgatcctttccttataaaagatacatccgcgaaatatcttctctacacgctgttcgatcttggccttgcaaccacctcagtataagatcatgggaaacctattctgtttagttcaagtagatcagtccacagtagccatcaaggaaactttcggaaaatttgatgatgttcttgagccaggtttacattgtgtcccttggattttcggaagtcaggttgctggacaactcacactaagacttcaacagttagatgtcaagtgtgagaccaaaacaaaggacaatgtttttgtcaatgttgtagcttcaatacagtatcgtgccctagctgataaagcaagtgacgccttttacaaactcagcaacacaaggtcccaaatccaagcttatgtttttgatgtcataagagctagcgtcccaaagctcaacctagatgatgcttttgaacaaaagaatgaaatcgccaaagctgttgaagacgaacttgaaaaggcaatgtctgcatatgggtttgagatagttcaaactttaattgtggacatagagccggatgagcatgttaagagagcaatgaacgagatcaatgcagctgcaaggtttaggatggcagctactgagaaggctgaagctgagaagatacttcagataaagagggctgaaggagaggctgagtcgaagtatttgtctggattgggtattgcacgacaaagacaagcaattgttgatggtttaagggacagtgtgttggggttttcagttaatgttcctgggacaacagctaaggatgttatggatatggttttggttactcagtattttgatacaatgaaggaaattggggcttcatctaaatcatctgctgtgtttatcccacatggacctggtgctgttcgtgatgtggctgctcagattcgcgatggtcttcttcagggtaacgccactcactgattgttgactgttttcatacagttttttatggtggttgactttgggtcatacagttttttaatgaatgtgtttatattgtttaactttgtgagtttgtgtatgctttatattgttgatatggtatagtaggttttggatttggtttctggttttttttctataagaattttgagtttttgtgtttggaattttttatgtatgatttgaagcttttatagaataaagtaaagaaataaagaaaagggtcaaaaaa

SEQ ID NO: 3507 - DNA, 1074 bp, Olea europaea
acatgggaaacttactgtgttgtgtacaagtggaccaatctacagttgccattaaggagcgttttggcaaatttgatgaagtacttgaaccggggtgccattgcttgccttggtttcttggaagccagcttgctggcagtctctctcttcgtctacagcaattggacgtacgctgtgaaaccaagacaaaagacaatgtatttgtcaatgtagtggcatcaattcaataccgcgccctttcggacaaggcaagtgatgctttctacaaacttagcaacacaagaacccaaattcaggcctatgtctttgatgtgataagagcaagtgttccaaaactctatcttgatgatgcttttgagcaaaaaaatgaaattgcaaaggctgttgaagatgaacttgaaaaggctatgtctgcttatggttttgaaattgttcagactctaattgtcgacatagaaccagacgaacatgttaagagggcgatgaatgaaatcaatgctgctgctaggctaaggttagcagctaatgagaaggctgaggctgaaaagattttgcaaattaagagagctgaaggtgaagcggaggctaaatatctggcaggattgggtattgctcgccagcgtcaggcaattgtggacggtttaagagatagtgtattaggtttctcggttaacgttcctggaacaactgcaaaggatgttatggatatggttctcgtaactcagtacttcgatacaatgaaagaaataggtgctacctccaagtcttctgctgtgttcatacctcacggacctggtgcggttcgtgatgtggcaactcagattcgcgatggacttcttcaggcttcccagcataatctatcttaacttctccctcggtttttgaaattctgaccgaaacaagattttatctatattgcttaatatttcgtggtgttggtaaatctgtttttcgtttgattttggatattccatttcccattgcttgtatattttagccttttctgtgtttaaagaatggatattgaactaccagaggtattggttggtataattctcattttacgagaattaa

SEQ ID NO: 3508 - DNA, 1721 bp, Phalaenopsis aphrodite
gggtttcttaggagctctgatttcaagggcggagctaatataaaagctcaagtcaaagctcaagtttaagccatggggcagctgttatgttgcgtacaaatagaccaatccactgttgctattagagagcaattcggaaagtttgacgatgttctcgagcctggctgccattgcgtcccgtggttcatgggtagtcacatagccggctatctctccttacgattacaacaactagacgtgaaatgtgaaacaaagacgaaggataatgtttttgtcaatgttgttgcatccatacaataccgtgcgcttgccggtaaagcgaatgatgcattctacaagcttagcaacacaaggactcaaatccaggcttatgtgtttgatgtaatcagagctagtgttccaaaactcaacctggacgacgttttcgagcagaagaacgaaatcgcgagagccgtggaagacgaacttgagaaggccatgtctgcttatggctatgaaatagtgcagactctaattgtcgatattgaaccagatgagcatgtcaagagagccatgaatgaaatcaatgctgccgcgagactcaggtcggctgcgaacgagaaagccgaggccgagaaaatcatccagatcaagcgagctgagggcgaggccgaggcaaagtatctgtcaggtctcggaatagctcggcagcgtcaggcgatcgtcgacggattgagagacagcgtgttgggattttccgtcaacgtgcccggaacaacggcaaaggatgtgatggacatggtcctcgtcacgcaatatttcgacaccatgaaggagattggagcctcctccaagagctcggcggtgttcatccctcatggacctggagctgttcgagacgtcgccgatcagatccgagatgggctgctccaagcgaatcgggtctagtaagtctgcttggtttctgaaaggcatgaaaaaactaccaccatgaattttaagatgctttttttgtttcggttctgtgattattatagtgggagttctgtgtgaaattgtggagcaggatctgcttttaactgtgaatttgaatgatttgtgtattttctttatcgaaggttggctgttacagttgatcttatgttactcaattaacattgtgattagtatcaatgtatttacatatctgacaccccaaagtttgatttttacacttttaacaacttggcctcttaaacctacgcatgaaaagggtcgctactaactaactaactacacgactactacacttacttactactactatatatatatagtatagtagtagtagtagtatagtaataagtagtatagtagtatagtatagtatagtatatatatatatacgtatattagtactacgttacgtacgtaactacctaagttacctagtaaccgtacgaacgtcgttaaggacgtaagttagacggttactacgttaccttagaactggtaacgtcgtacttaaccggtattaaccggtaacgttaaacctacgttaaattaacctttacgtaaggtaattacgtaatttaacgtacggttaagacgggtaaaaccggttaaacgtaacgtaacgtaccgtaactaaccggtaataccggtagtacgtacgtaggtaccgttagacggtacggtacgtcggaacggtagaccggtagaacgggtaagggagtgatcgagcgagcggggggggggggggg

SEQ ID NO: 3509 - DNA, 1267 bp, Rosa hybrid cultivar
tctctctctctgatccaaaaacccacagctttcttctctcactttggccatagctcttcatcttcttcgtcaattccaaaggaggtaccatagttaagagaacatgggtaatctattctgtttagtacaagttgatcaatccacagtagctatgagggaacaatttggcaagtttgtggaagttatggagccaggatgccattgcatgccttggtttcttgggcatcaggttgctggtcatctttctctgcgtttgcagcaattggatgtgcggtgtgagaccaagacaaaggacaatgtctttgtcaatgtcgttgcatctattcaatatcgtgctctggcagacaaagcaaatgatgctttctacaaactcagcaacactaggtctcaaatccaggcctatgtttttgatgtgattagagccagtgttccaaagctcctcctggatgatgcttttgagcaaaagaatgaaattgcaaaagctgtagaagatgagcttgagaaggccatgtctgcttatggttatgagattgtacaaactctcattgttgacatagaaccagatgagcatgtgaaacgtgcaatgaatgaaatcaatgctgctgcaagaatgagggtggcagctaatgaaaaggcagaggcagagaagattttgcaaattaaacgggctgagggtgaggctgagtccaagtatctgtctgggctgggtatagctcgtcaacgtcaagcaattgtagatggtttgagagacagtgtgctgggctttgctgttaatgttccagggaccaccgcaaaggatgtcatggacatggtccttgtcactcagtattttgacacaatgaaggaaattggtgccagctctaaatcctctgctgtttttattccccatggacctggtgctgtccgcgatgtagcctctcagatccgtgatggacttcttcagggttctcaccagtagttgggcacttctacaagcttcttgttatattggtctttgggatcattgcgatgttcagtgtgttaaagtttttgtttcctggtgaccttaattctccattgctgtaaatgcgagcttttaagattttgtggttagtcgtatatcaatcttatacaatgacttggttcttcgtgttcaaacttggatctcgtatagtttttggacgactggaaaatgctttatatgtccagtttatcaaattttcatcaaacagaatcctactatgcttttatcatacattactgtaaatactaaatttgatttgattgt

SEQ ID NO: 3510 - DNA, 1372 bp, Fragaria vesca
gagataaactctattctcgttagaaaggtagatgctctcatgtacagtttgcaagaaattcatcatcttgcttcacaaacaaggtattcagatagaaaaccccctctcattctttctctgtgacccaaaaacccagagcttctcctcactttcgtctcttcatcttcttcgtcaatctccaaggaggtacaatagtaaagagaacatgggtaatctactatgttgtgtacaagttgatcaatccacagtcgctatgagggaacaatttggtaagtttgtggacgtaatggagccaggatgccattgcatgccttggtttcttgggcatcaggttgctggtcatctctctctgcgtttgcagcagttggatgtgcggtgtgagaccaagacaaaggacaatgtctttgtcaatgttgttgcatcaattcaatatcgtgctctggcagacaaagcaaatgatgctttctacaaactcagcaacactaggtctcaaatccaggcctatgtgtttgatgtgattagagccagcgttcctaagctccttctggatgatgcttttgagcaaaagaatgaaattgcaaaagctgtggaagatgagttggagaaggccatgtctgcttatggttatgagattgtacaaactctcattgttgacatagaaccagatgagcatgtgaaacgtgcaatgaatgaaatcaatgctgctgcaagaatgagggtggcagctaatgagaaggcagaggcagagaagattttgcaaattaaacgagctgagggtgaggctgagtctaagtatctgtccgggcttggtatagctcgtcaacgtcaagcaattgtagatggtttgagagacagtgtgctgggctttgctgttaatgttccagggaccaccgcgaaggatgtcatggacatggttcttgtgactcagtattttgacacaatgaaggaaattggtgccagctctaaatcctctgctgtgttcattccccatggacctggtgccgtccgcgatgtagcttctcagatccgtgatggacttcttcagggttctcaacagtagttgggcacttctacaaacttcttgttacatagttctttgggatcattgagatgttaagcatgttccagtttttgttttctcatcaaccttatttcttcgttcgtgctgctgtaaatgcgatcttttaagatttgtggttagtcctaaatcgatcttatacaatgacctagttcttcatgttcaaacttgaatcttgtatagtttttggtcgactaggaaatgctttatatggccagcttatcaaatttcatcaaacagtcatatttttttatgggtaaaatattatatagtccttgtggtttgaagtcgaca

SEQ ID NO: 3511 - DNA, 1039 bp, Eutrema parvulum
tttttcgaatggattaggtttgtgaagaaagatgggaaatctactttgctgtgtacaagtcgaccaatcaacggtagcgataaaggaaacgtttgggagattcgaagatgttcttgagcctggttgccattttctcccatggtgtcttggtaagcaagttgctggttacctctctctaaggcttcagcaattggatgttcgttgcgagactaagacaaaggacaatgtgtttgttaatgttgttgcatcaattcaataccgtgccttagctaataaggccaatgatgcgttctacaaactcagtaacacaaggagccaaatccaagcttatgtgtttgatgttatcagagcaagtgtccccaagctgcttctggatgatgtctttgagcagaagaatgaaattgcgaaagctgttgaagaggagctcgagaaggcaatgtctgcttacggttttgagattgtccaaactctcattgttgacatcgagcctgacgagcatgtcaaacgggccatgaacgaaatcaacgccgctgcaaggatgagattggctgcaaacgaaaaggcagaggctgagaaaatcttgcagattaagcgagctgaaggtgaagctgaggccaagtacctatctggtctaggtatcgcccgtcagaggcaagcaattgttgacggattacgcgacagtgtcttgggtttctctgtgaatgtccccgggacgactgctaaagatgtgatggacatggtgcttgttacgcaatacttcgatacaatgaaggagattggtgctagctccaaatcttctgctgtgttcataccgcacggaccaggagctgttcgcgatgtggctactcagatcagagacggactccttcaaggctcgtttgcagaccagtcttgaagtggatgcacagattatgttctccttccttttactaagcttatggtgtgttcaggtcccattatttgttttttatctcttttggattacattgagtgctgacaagctcgcatgttttgttctctttttattttactatttctt

SEQ ID NO: 3512 - DNA, 1285 bp, Tragopogon dubius
gaaactaagcaaacgaagaaatttaggataccggtgaacgcatcaataaatacaaaaggcgacttcaacaattaatctgcgcaaacatcgctttcagttttatctagtgggtgtcgggtgattccatctttctcctataagatacatccaggaaatatcttctccaacagttcgatcttggtcttgcaatcatcctcagtataatatcatgggaaacctattctgtttagttcaagtagatcaatccactgttgccatcaaggaaacattcgggaaatttgctgatgttcttgagccaggtttacattgtgtaccttgggtttttggaagtcaggttgctggctatctcactctaaggcttcaacagctagatgtgaagtgtgagaccaaaacaaaggataatgtctttgtgaatgttgtagcttcaatacaataccgtgccctagctgataaagcaagtgacgcattctataaactcagcaacacaaggtcccaaatccaagcttatgtctttgatgtgataagagctagtgttccaaagctaaatcttgatgatgcctttgaacaaaagaatgaaatagccaaagctgttgaagaagaacttgaaaaggcaatgtctgcatatgggtttgagattgttcaaacattgattgtggatatagaaccagacgagcatgtgaagagagcaatgaatgagatcaatgctgctgcaaggttgaggatggcagctactgagaaagctgaggctgagaagattctgcaaattaagagggctgaaggtgaggctgaatcaaagtatctatctggattgggtattgcacgccagagacaggcgattgtggatggattgagagacagtgtgttagggttttcagtgaatgtgcctggaaccacagctaaagatgtgatggatatggttcttgtgactcagtattttgacaccatgaaggaaatcggggcttcatctaaatcgtctgctgtgttcatccctcatggacctggggctgttcgtgatgtggcggctcagatacgcgatgggcttcttcaggggaatgccaccacttgattgttgactttgtttggagtgaaacgcaccgtaagagtacagttttattgtttatattgttcaactttttgtgagtttgtgcatactatgtcgatatgctatgttagggttattaaatgtcgagtttatcccaacgaaatcttgacatgtttgaaggtggttttggatttgaatctatgttttgtgaattgtctgatgaatgatttcaagtgtttgatg

SEQ ID NO: 3513 - DNA, 1392 bp, Olea europaea
cgtaacgttgcgtccgttcctacgtaaaggtttaacggttacgtagtaagtacctacggttaggttttgttttcgttccggcccgtaccgtactcgtcggttggttaaaggaaacacgtagggttagttactaaccgaccgagaagtacggacgggaggtagtactactctatatttacggttttgggttgggtaggaaaaaaaaatgttttctggttttcagtaaattataattgggtttaaattttttgtccacaatctgtgcaagaaatgggaaatatatgttgttgtgcgcaagtagaccagtcgacggttgctattagggagcagtttggtaaatttgacgaagtactagagcctggatgtcgttgtgtcccttggttccttggaaaacgtttggctggccatctctcccttcggctgcagcagttggatgtgcgctgtgagacaaagacaaaggacaatgtatttgtcaatgtagtggcatcagtacagtaccgtgccctggcagacaaggccagtgatgctttttacagactcagcaacaccaggaatcaaattcaggcctatgtcttcgacgtgataagggcaagcgtcccaaaaatgaatcttgatgatgctttcgagcagaaaaatgaaattgctatggccgttgaagatgaacttgagaaggctatgtctgcttatggttacaaaattgtccagactctaattgttgacatagaaccagacgagcatgttaagagagcaatgaatgaaattaacgccgctgctaggctgagggtggctgctaacgagaaggcagaggctgaaaagattttgcaaattaagcgagctgaaggtgaagcagaggctaaatatctctcgggattgggtattgctcgccaacgtcaagcaattgtcgatggtttgagagatagtgtgcttggtttctcagttaatgtgcctggaaccactgcaaaggacgtaatggatatggtacttgtcactcagtatttcgatacgatgaaagaaattggggctacttccaagtcttctgctgtgttcattccacatggacctggtgcagtccgtgatgtggctacccagattcgtgatggacttcttcaggcttctactcaggatcatctgtcttaaattccaggttgcttttcagatattctaatctaagcaagctttatttgtattgtcgtttgattcctatgtactaaatctattttctgtttggttttgtggatactgggtattgtactttccaataactcgatgtattatacatactactgtttcgcatagtatgatctataatacatgtgctactactgtaaagtcttgaacagtgagattgttatgtttcatctaaatcaacgtacatggcaattggtcattgaa

SEQ ID NO: 3514 - DNA, 2789 bp, Theobroma cacao
caagtcaccagccaagcagctaacacaagtacttctcttttcgaatgcatgttccatgtacaactttgtgctttctgtttggttcctgagaaaccatgggaaactttaggattttgtttacattatatttataaagattttttttctcatttctcattttttatttttttagatagctggtattttagactgaatttggagtgtgcttcttgtatattccatgatccggagctttttgccatcttcacttgttcttttcaatgacaatgtctttgtcaatgtggttgcatctgttcaatatcgtgccctggcagacaaagcggctgacgctttctataagctctcaaacaccaaaggacaaatccaatcctatgtttttgatgttatcagggcaagtgtgccaaaactgaacttggatgccgtctttgaacagaagaattctattgtaaaagctgtggaagaggagcttgagaaggccacgtctgcctacggttatgaaatagtacagacactaattgtggatatagagcctgatgttaaagtgaagaaagcaatgactgagataaatgcagaaagggagaacctgagttcacgacttacaacaattttgcaaggttatgccccaataaccaggggtataccattacaaaattctttcattgtcgagttccctgtacgctttcagaaaggaaaccaccctaaacacccccaacgaaaacagccaaccccactgacatctgcacccatttccttaaccttcatggagctgattttggctcctgcacccatttcacgccgttcagtgagttgctctccactaacagcttgcgagaatcgcacacaaaagctagcttccaggctagctagaaattcagctagacttgagtcccccacccctatggacttcgaaaacatcgttctaatttctcccttggaattccttagtaacgcaccaattcaagcttcattcgtgcttccacttgcagccccatcgacgttaaatttcatagttctatcaatcaaacgagccgaaggagatgcagagtcaaagtacttgtcaggacttggcatagctcgtcaccgccaggcaattgtggatggactgagggatagcgtgcttgccttttctgagaatgttccaggaacaacagccaaagatgtcatggatatgatgctggggactcaatacttcgacaccatgaaggaggttggtgcatcttcaaagtcttcttctgtttccaatccacatggacctggtgcagtccaggacatatcatcacggattcgagaggggcttctcttcaggcccatgctactcggcactagagggaacataggcttttgattcattgacttgtgccggcgcccttgttgccttttttgtgtgtgtgtgtgattaattgacaataatttcaaattctgaagtctggaatgtgtttctgctgaatcaagtcatggcccagtgcccaagtctaattgtttcattttaggccgaatttaatctaatgtttatcttgccatttttgccaaaagaagctgaaggatgctcgatctttgtcagaagcttttggcagcattttgctttaggatgcttatcttctaaagagcttttatctctctcagttcttgcattaatgctgggttactctttggtgttaatacttcactataatctcttccttgaaaagatcatatagaatagctacaagatataaaacggatgggcaacctattttgctgtgtacaagttgaccaatcaacagttgctatcaaggaaaggtttgggaagtttgatgaagttcttcaaccaggatgccattgtttaccttggtgtctcggaagccagcttgccggccatctcacactccggttgcagcagctagatgtgcgttgtgagaccaagacaaaggacaatgtttttgttaacgttgttgcatcagtacaatatcgttccctggcagagaaggcgaatgatgctttctacaaacttagcaaccccaggacacaaattcaagcctatgtttttgatgttatcagggcaagcgttccaaagcttgatttggatgatgcttttgagcaaaagaatgatattgctaaagcagttgaagatgaacttgaaaaggctatgtccgcttacgggtacgagattgtccagaccctcattgttgatatagaaccggatgaacatgtgaaaagggccatgaatgaaattaatgctgctgcaaggatgagagttgcagcaaacgagaaagcagaggccgagaagattatacagattaagagggcagagggagaggcagaatccaagtatctatcaggagttggcattgccaggcagcgccaggcaattgttgatggcctaagggacagtgtgcttggtttctcggtcaatgtgcctgggactactgctaaggatgttttagacatggtcctcattacccagtattttgataccatgaaggaaattggtgctgcctctaaatcttcatcagtgtttatcccacacggacctggcgcagttcgagacattgcaacccagatccgagatgggttgcttcaggcatctcaccatcatgaataaaaagccttatatgcgtgagttttataagcaacaagctaccgttatgttaaaattacgccaatacctataggtcatctaactgatagccaagctttactggctatccttgggcgttttgagtgaaatctgtacccagttcctctgtttagaaatataaatgtaattgctgtttgtaaggtaatttgtaaaatcaactacggggatagat

SEQ ID NO: 3515 - DNA, 1267 bp, Secale cereale
ggaccttggccctaggtccttcgcaaggacactggtagttcaacgtacacgaggacgaggggggttcgccacacacacgactcactgccacttcaccgtcaccgctcccccttcccactctctcaaccccggacggaggtatgggcaatctgtgctgctgtgttcaggtcgatcagtctaccgtggccatcagagagcagtttggaagtttgacagtgtgcttcagccagatcgactccctgtcgtgccttggatcttagggaaacgtgtagttggccatctcacactcaggttgcagcagctggatgtgcgctgcgaaactaagacaaaggacaatgtgtttgtcactgttgttgcatcaattcagtaccgtcctctggctggcaaagaaagtgacgcatactacaaactgaccaacacaagatcccagattcaagcctatgtttttgatgtgatcagggcaagtgttccaaagctcaacctggatgatgctttcgtgcagaagaacgatatagcaaaggctgtggaggatgaacttgaaaaggctatgtcggcatatggctttgagattgtgcagaccctcattgtcgacatcgagccagacgcccatgtcaagcaggcgatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattggcgcgtcctccaagtcctcggccgtcttcatcccccatggccctggtgcggttcgtgacatcgccacgcagatccgcgacggtcttcttcagggccagtctgcctctgacaactagtagtttgcttcgccggcatgaactttgaagctggtggtggtttgtggtttgctagctattgcctacagtactgtctaatatgatgcatgccgtattattatgacttatatggaaccttatgtgtatcgtggcttaggtcgatgtgcggtaacaaacctttaacctattgggaatgcaggatgatataagtgtgctatgaaatgctggtgatgaacttgatctaatgcttttgcctcgtttattttgccttatagtgctgcc

SEQ ID NO: 3516 - DNA, 1237 bp, Brassica juncea
gattcacagctaaccaaaagcgttttcatctaatcatcaaacccagcaaaatcaaaagaagacaactttcgataactgcgaagaaagatggggaatttgttttgctgtgtacaagtggaccagtcaacggtggcgatcaaagaaacgtttgggaagttcgaagacgttcttgagcctggttgccatttcctcccatggtgtcttggtcagcaagttgctggttacctctctctgaggcttcagcaactggatgttcgctgcgagaccaagacaaaggacaatgtgtttgttaatgttgttgcatccattcaataccgtgccttggctaataatgccaatgatgctttctacaaactcagtaacactaggagccagatccaagcttacgtctttgatgttatcagagcgagtgtccccaagctgattctggatgatgtctttgagcagaagaatgaaattgccaaagctgttgaagaggagctcgagaaggcaatgtctgcttacggttttgagattgtccagactctcatcgttgacatcgagcctgatgaacatgtcaaacgagccatgaacgaaatcaacgctgctgcaaggatgaggttggctgcaaacgagaaggcagaggctgagaaaatcctgcagatcaagcgagctgaaggtgaagccgaggccaagtacctatctgggctaggtatcgcccgtcagaggcaggccattgttgacgggttacgcgacagcgtccttggttcctctgtgaatgttcccgggacaactgctaaagacgtgatggacatggtgcttgtcacgcagtacttcgacaccatgaaggagattggtgccagttccaaatcctctgctgtcttcatacctcatggaccaggagcggttcgtgatgtggctactcagatcagagatgggctccttcaaggctcctttgcaggccagtcttgagttagatatggactgatcattatatgatgttctctactaagtttgtggtgtgttgagatcctatgatcttgtgctgagaaactctcatgctttaggtttttttatatttcacgtatttggatgtacaaccaaaagtcgttattagtatcgtttactaatctacatggattatatgttgatcatactcaaacttgcgaatactcatcagttcaaggggttacattagaggctaaataaaacaaattcaacttaaaaaagagtagtgttgtttggttcaccacctgac

SEQ ID NO: 3517 - DNA, 1099 bp, Brassica napus
gagagctaccagaagcgttacatcgaaatcatagccagcaaataaaaaagaagacaactttcgagaattagtgaagaaagatggggaacttatgttgctgtgtacaagtggaccaatcaacggtggcgatcaaagaaacgtttgggaagttcgaagatgttcttgagcctggttgccattttctcccttggtgtcttggtcagcaagtcgctggttacctctctctcaggcttcagcagttggatgttcgctgcgagaccaagacaaaggacaatgtgtttgttaacgttgttgcatcgattcaataccgtgcattggctaataatgctaatgatgccttctacaagctcagtaacacaaggagccagatccaagcttacgtctttgatgttatcagagcaagtgtccccaagctgattctggatgacgtctttgagcagaagaatgaaattgccaaagctgttgaagaggagctcgagaaggcgatgtctgcttacggttttgagattgtccaaactctcattgttgacatcgagcctgacgagcatgtcaaacgagccatgaacgaaatcaacgctgctgcaaggatgaggttggctgcaaacgaaaaggctgaggctgagaaaatcctgcagatcaagcgagctgaaggtgaagccgaggccaagtacctttctggtcttggtatcgcccgtcagaggcaagccatcgttgacgggttacgcgacagtgtcttgggcttctctgtgaatgttcccgggacaactgctaaagatgtgatggacatggtacttgttacgcagtacttcgacaccatgaaggagattggtgccagttccaaatcctctgctgtgttcattccccacggaccaggagcagtacgcgatgtggctactcagatcagagatgggctccttcaaggctccttcgcagaccagtcttgaattagatggactgatcattatatgttatctactaagcttgctgtgtgttaagatcatatgatcttgtgctgagaaactctcatgcttttaggttcttatatttttcgttaatatatttcgcgtatgacgtatttgggtgtacgaccaaaaatcgc

SEQ ID NO: 3518 - DNA, 1128 bp, Castanea mollissima
ctgggtgctatggtaccataaaaacacagctcttactcttcatcaacttgaaaagaaaaatccagatataataacacagtatactgaagatgggtaatctgctttgttgtgtacaagtcgaccaatccaccgtggctatcaaggagaaatttggcaagtttgaggaagttcttgagccaggatgccatttcttgccttggtgccttggaagtcagctttctggtcatctcactcttcggttacagcaattggatgtgcgatgtgagacaaagacaaaggacaatgtatttgtcaatgtcgttgcctctattcaataccgtgccctggcagacaaggcaagtgatgccttttacaaactcagcaacacaagaagccaaatccaggcctatgtgtttgatgtaatcagagcaagtgtcccaaagctcaccttggatgatgcttttgaacagaaaaatgacattgccaaagctgtagaagatgaacttgaaaaggctatgtctgcttatgggtatgaaattgtacaaacactcattgttgatatagaacctgacgagcatgtcaagcgagcaatgaatgaaatcaatgcagctgcaagaatgagggtggcagccaatgagaaggcagaggctgagaaaatcttgcaaattaagcgagctgagggtgaggctgagtcgaagtatttgtctgggctgggtattgcgcgccaacgtcaagcaattgttgatggattgagagatagtgtgttgggcttctctgttaatgtgccagggaccacgccgaaggatgtcatggacatggttcttgttacccagtattttgacacaatgaaggaaattggtgctgcctcaaaatcctctgctgtgttcatccctcatggacctggtgctgttcgtgatgtagcatctcaaattcgtgatggacttcttcagggttctgttcaacattagggttacttttccattttttccccttttgtgtgttgaaactaggtctatgcacgttgatgtttctttgcaagtttttcagcgtgttacgtaatctatcttgatgcaactgtcatgtctgtttgtgaattatgataattattgtaaataggagacttaaagatgtctcaagtatgtacagatc

SEQ ID NO: 3519 - DNA, 1070 bp, Cynara scolymus
  misc_feature (981)..(981): n is a, c, g, or t
  misc_feature (984)..(984): n is a, c, g, or t
  misc_feature (988)..(988): n is a, c, g, or t
  misc_feature (990)..(990): n is a, c, g, or t
  misc_feature (1001)..(1001): n is a, c, g, or t
  misc_feature (1015)..(1015): n is a, c, g, or t
  misc_feature (1018)..(1019): n is a, c, g, or t
  misc_feature (1027)..(1028): n is a, c, g, or t
  misc_feature (1030)..(1031): n is a, c, g, or t
  misc_feature (1039)..(1039): n is a, c, g, or t
  misc_feature (1047)..(1047): n is a, c, g, or t
  misc_feature (1049)..(1049): n is a, c, g, or t
  misc_feature (1055)..(1055): n is a, c, g, or t
  misc_feature (1058)..(1058): n is a, c, g, or t
  misc_feature (1061)..(1061): n is a, c, g, or t
  misc_feature (1064)..(1065): n is a, c, g, or t
gggctaacgtcgttttcattttagcaagtggcttcgagtgattcaatcctcttcctttatataaagatctgcgaagaatctgctcacatactccgctttcttccctcttgatcttgcaaccatctttttccgtataagatcatgggaaaccttgtgtgtttggttcaagtagatcaatccactgttgctatcaaggaaacttttgggaagttcgatgatgttcttgagcctggttgtcattgtgtaccttggattttcggaagtcggcttgctgggcatctcacactaagggttcagcagttggatgtcaagtgtgagaccaaaaccaaggacaatgtttttgtgaatgttgtagcttcgatacaatatcgtgctttggctgataaggcaagtgatgcattctataagctcagcaacacaaggtcccaaatccaggcttatgttttcgatgttataagagctagcgttccaaagcttaatctagacgatgcttttgagcaaaagaatgatattgccaaagctgtggaagaagaacttgaaaaggcaatgtcagcatatggttttgagatcgttcaaacattgattgtcgatatagaaccagatgagcacgtgaagagggcaatgaacgagatcaatgccgctgcaaggctgaggatggcggccactgagaaagcggaggctgagaaaattcttcagatcaagagagccgagggtgaggctgaatccaagtacctgtcgggtttgggtatcgcacgccaacgacaagccatcgtggacggtttgagagacagcgtgttggggttctcggtcaacgtgcctggaaccacggctaaagacgtgatggacatggttctagtcactcaatattttgataccatgaaggaaattggtgctgcttctaaatcctctgccgtcttcatccctcatggacccggtgcagttcgtgatgtggctatgcagatacgagatggacttcttcanggnaacncngccagctgatngttaacttcgattngcnnatacattnnanntttggagngaaatgangnaaagantanagnttnntgttt

SEQ ID NO: 3520 - DNA, 1111 bp, Phalaenopsis aphrodite
ataaaagctcaagtcaaagctcaagtttaagccatggggcagctgttatgttgcgtacaaatagaccaatccactgttgctattagagagcaattcggaaagtttgacgatgttctcgagcctggctgccattgcgtcccgtggttcatgggtagtcacatagccggctatctctccttacgattacaacaactagacgtgaaatgtgaaacaaagacgaaggataatgtttttgtcaatgttgttgcatccatacaataccgcgcgcttgccggtaaagcgaatgatgcattctacaagcttagcaacacaaggactcaaatccaggcttatgtgtttgatgtaatcagagctagcgttccaaaactcaacctggacgacgttttcgagcagaagaacgaaatcgcgagagccgtggaagacgaacttgagaaggccatgtctgcttatggctatgaaatagtgcagactctaattgtcgatattgaaccagatgagcatgtcaagagagccatgaatgaaatcaatgctgccgcgagactcaggtcagctgcgaacgagaaagccgaggcggagaaaatcatccagatcaagcgagctgagggggaggctgaggcaaagtatctgtcaggtctcggaatagctcggcagcgtcaggcaatcgtcgacggattgagagacagcgtgttgggattttccgtcaatgtgcccggaacaacggcaaaggatgtgatggacatggtccttgtcacgcaatatttcgacaccatgaaggagattggagccgcctcgaagagctcggcggtgttcatccctcatggacctggagctgttcgagacgttgccgatcagatccgagatgggctgctccaagcgaatcgggtctagtaagtctgcttggtttctgaaaggcatgaaaaaactaccaccatgaattttaagatgctttttttgtttcagttctgtgattattatagtgggagttttgtgtgacattgtggagcttttaactgtgaatttgaatgatttgtgtattttctttgtcgaagtttggctgttacagttgatcttatgttactcaattaacattgtgattagtatcaatgtatga

SEQ ID NO: 3521 - DNA, 1207 bp, Prunus persica
tgtagccttcttcaagagttttacaagttatcgtcttttgagtctatataaatctcaactcgtttgggtcgtctcattcctatcttcttccctttctctcttgtccgctcttctgttatactaactgtacaaatagtgaagagaacatgggtaatcttttctgttgtgtacaagttgatcaatccaaagtagctgtaaaggaaaaatttggtaggtttgtggaggttcttgagccaggatgccattgcctaccttggtttcttgggcatcagattgctggtcatctctctcttcgtttgcagcaactggacgtgcgctgtgagaccaagacaaaggacaacgtatttgtcaacgtcgttgcatctattcaatatcgtgctctggcagacaaagcagatgatgccttctacaaactcagcaacacaaggtctcaaatccaggcctatgtttttgatgtcattagagctagtgttccaaagctcaacctggatgctgcttttgagcaaaagaatgaaattgcaaaagctgtggaagatgagctcgagaaagctatgtctgcttatggttatgagattgtacaaacgctcattgttgacatagaaccagatgagcatgtgaaacgggcaatgaacgaaatcaatgctgctgcaagaatgcgggtggcagctaatgagaaggcagaggcagagaagattttgcaaattaagcgggctgagggtgaggccgagtccaagtatctctctgggctgggtatagctcgccagcgtcaagcgattgtagatggtttgagagacagtgtgctgggcttctctgtcaatgttccagggactactgcaaaggatgtcatggacatggtccttgtgactcagtattttgacaccatgaaggaaattggcgcttcctctaaatcctctgccgtgtttattccccatggacctggttctgtccgtgatgtagcttctcagattcgtgatggacttcttcagggttctcaccagtagttcggaacttctacaagtttttcatttcttatcggcaagtcgttcttttgcttcaccccgaggtgttctgtttgctatagttttatttcatggttactttaattgttcaatactgctactgtatacttgtggtgagcatgtaatgatcttataaaatgagagaattcttcgtacttaaacttgattcttgtacagtttcaccttct

SEQ ID NO: 3522 - DNA, 1154 bp, Raphanus sativus
gattcacagagcttaacaaaaaaaaacgtctcatctaaaatcaaacccagaagaaaatcaaaagacgagtgaagaaagatggggaacttgttgtgctgtgtacaagtggaccagtcaacggtggcgatcaaagaaacgtttgggaagttcgaagatgttctagagcctggttgccattttctcccatggtgtcttggtcagcaagttgctggttacctctctctcaggcttcagcagttggatgttcgctgcgagactaagaccaaggacaatgtgtttgttaatgttgttgcatcgattcagtaccgtgccttggctaataatgccaatgatgccttctacaagcttagtaacactaggagccagatccaagcttacgtctttgatgttatcagagcaagtgtccccaagctgattctggatgatgtctttgagcagaagaatgaaattgccaaagctgttgaagaggagctcgagaaggcaatgtctgcttacggttttgagattgtccaaactctcatcgttgacatcgagcctgacgaacatgtcaaacgagccatgaacgaaatcaacgctgctgcaaggatgaggttggctgcgaacgaaaaggcagaggctgagaaaatcctccagatcaagcgagctgaaggtgaagccgaggccaagtacctgtctggtcttggtatcgcccgtcagaggcaagccattgtcgacgggctacgcgacagcgtccttggtttctctgtgaatgttcccgggacaactgctaaagatgtgatggacatggtgcttgttacgcagtacttcgacacgatgaaggagattggcgccagttccaaatcctctgctgtcttcattccccatggaccaggagctgtacgcgatgtggctactcagatcagagatgggctccttcaaggctcctttgcagaccagtcctgaaatatagataatggactgatatcattatatgttctctactaagcttgctgtgtgttaagacttatgatctcgtgttgagaaactctcatgctttaggtttctatatttttcgttattgtattccacgtatttggagtgtgcaaccaaaaaatcgtaattaatcaaataatgtatatgttgatcatgttcaaatttgcgaacactcgtgacta

SEQ ID NO: 3523 - DNA, 1144 bp, Raphanus sativus
  misc_feature (726)..(726): n is a, c, g, or t
ggattcacagagctacacaaaaacgtttcatcgaaatcgaacccaccaaatctgcaaataaaaaagacgacaactttcgagaatccgtgaagaaagatggggaatttactgtgctgtgtacaagtggaccaatcaacggtggcgatcaaagaaacgtttgggaagttcgaagatgttctagagcctggttgccattttctcccttggtgtcttggtcagcaagttgctggttacctctctctcaggcttcagcagttggatgttcgctgcgagactaagacaaaggacaatgtgtttgttaatgttgttgcatcgattcagtaccgtgccttggctaataatgccaatgatgccttctacaaactcagtaacacaaggagccagatccaagcttacgtctttgatgttatcagagcaagtgtccccaagctgattctggatgatgtctttgagcagaagaatgaaattgccaaagctgttgaagaggagctcgagaaggcaatgtctgcttacggttttgagattgtccaaactctcatcgttgacatcgagcctgacgaacatgtcaaacgagccatgaacgaaatcaacgctgctgcgaggatgaggttggctgcgaacgaaaaggcagaggctgagaaaatcctccagatcaagcgagctgaaggtgaagccgaggccaagtacctgtctggtctaggtatcgcccgtcagaggcaagccatngtcgacgggctacgcgacagcgtccttggtttctctgtgaatgttcccgggactactgctaaagatgtgatggacatggtgctcgttacgcagtactttgacacgatgaaggagattggtgccagttccaaatcctctgctgtcttcattccacacggaccaggagctgttcgcgatgtggctactcagatcagagatgggctccttcaaggctcctttgcagaccagtcctgaaatatagataatggactgatcattatatgttctctactaagctttgctgtgtgttaagatcctatcatcctgtgttgagaaactctcatgctttaggtttctatatttttcgttattatatttcacgtatttggagtgtacaaccaaaaaatcgtaattaatcaaataatcatcatgttgacca

SEQ ID NO: 3524 - DNA, 1222 bp, Carthamus tinctorius
  misc_feature (831)..(831): n is a, c, g, or t
ataagatcatgggaaaccttctctgtttggttcaagtagatcaatccactgttgcaatcaaggaaacttttgggaagtttgatgatgttcttgagccaggttgtcactgcgttccatggattttcggaagtcggcttgttgggcatctcacactcaggcttcagcagttggatgtcaagtgtgagaccaaaaccaaggacaatgtttttgtcaatgttgtagcctcgatacaatatcgtgctctagctgataaggcaagtgatgcattctataaactcagcaacacaaggtcccaaatccaagcttacgtttttgacgttataagagctagcgttccgaagcttaatctagacgacgcttttgagcaaaagaatgatatcgccaaagctgttgaagaagaactcgaaaaggcgatgtcagcatatggtttcgagatcgttcaaacattgattgtcgatattgagccagatgagcatgtgaagagagcaatgaacgagatcaatgcggctgcgaggctgaggatggcggctactgagaaagcggaggcagagaaaattctccagatcaagagagccgagggtgaggctgagtcaaagtacctgtcgggtttgggtatagcacgccaacgacaagccatcgtggacggtttgagagacagcgtgttggggttctcggtcaacgtgcccggaaccacggctaaagacgtgatggacatggtgctagtcactcagtattttgataccatgaaggaaatcggtgcggcttctaaatcgtcggccgtcttcatcccgcatgggcccggtgcggttcgtgacgtggcaacccagatangcgatgggcttcttcaagaaatgctgccagctgatcattaaggttgatttaatgtttctatatgtgtgtgttaactttgtttgagtttgtgttttcctatgtctatatactagattaggtttatgatatcgtgtttacgttggacgttttccatcgaaatgttgacgtgtttgaacgtgatttttgacaagacactcgactgtttagagtcgtgtcatgtttgtgaccgagtcatatgacaataagcggttccgagttgactcagatgactcggccttgaaaatgtcgagctgagcaaggaggaccgattcacccgaatctttgtaaacggagacatgcttataaaatgtttgtattaaatataaaaccctgaaaaaggaaaaatgccgat

SEQ ID NO: 3525 - DNA, 1017 bp, Helianthus annuus
gtgtgaaatcatggggaacttgttctgtttggttcaagtagatcaatctactgttgctataaaggagacttttgggaagtttgatgatgttcttgagccgggctgtcattgcgtgccttggatatttggaagtcggcttgctggacatcttactctcagggttcagcagttggatgtcaagtgtgagaccaaaacaaaggacaatgtttttgtcaatgttgtagcttcgattcagtatcgtgctctgactgataaggcgagtgatgcgttctacaaactcagcaacacaagggcccaaatccaggcctatgtttttgatgttataagagctagtgttccaaagcttaatcttgatgatgtgtttgagcaaaaaaatgagattgccaaggctgtggaagaagaacttgaaaaggcaatgtctgcgtatggttttgagattgttcagactttgattgttgatatcgagcccgatgagcatgtgaagagagcaatgaacgagatcaatgcagctgcaaggctaagggtggcggctactgagaaagccgaggctgaaaaaattctacaaatcaagagagctgagggtgaggctgagtcgaaatacctgtctggtttgggtattgcgcgccaacgacaagcgattgtggatgggttaagagacagtgtgttgggtttctcggtcaatgtgcctgggacgacggctaaagacgtgatggacatggttctagtgactcagtattttgacaccatgaaggaaattggggctgcatccaaatcgtctgctgtgtttattcctcatggacctggtgctgttcgtgatgtggctactcagatacgtgatggtcttcttcaaggcagtgctgctgctagttgattttcggagtttgatggcaatgcaatcgtaagagtacagtttcatgttttcttaagtaatcgtggtttatgttttcaactatgtgtatatggatggggttatgaaatgatgtctatacggatatttcccgcttgaatatggttttc

SEQ ID NO: 3526 - DNA, 1179 bp, Coffea canephora
tacgcgggggctatttcgtccttttttttttcttgtttgattctctggagaaaatgggtaacctgttttgctgtgtgcaagtggaccaatccactgttgctatgaaggaacgttttggtaagtttcaggatgtgcttgagccaggatgccattgtatgccttggtttctagggagtcaagtggccggacatctctctctgaggctccagcaactggatgtgcgctgtgagacaaagactaaggacaatgtttttgtcaatgtcgtcgcatcaattcagtaccgtgccattgtggaaaaggcaaatgatgctttctataggctcagcaacactaggacccagattcaggcctatgtatttgatgtgataagagcaagtgttcccaaactcaatcttgatgatgcttttgagcaaaagaatgaaattgccaaagctgttgaagaagaacttgagaaggctatgtctgcttatggatatgaaattgttcagacactgattgttgacattgagccagatgagcatgtgaagagagcaatgaacgaaatcaatgcagctgctaggttgagggtggctgctaatgagaaggctgaggcagagaaaatcctacaaattaagcgagctgaaggtgaggctgaggccaaatacctctcgggtatgggtattgcccgccagcgtcaggctattgttgatggtttgagagacagcgtgctcggcttctcagtgaatgttcctggaacaacagccaaagatgtcatggacatggttcttgttactcaatacttcgataccatgaaagaaattggcgctgcctccaagtcgtctgctgtgtttattccccatggacctggtgctgttcgtgatgtggcaacccagattcgtgatggactacttcaggcttctgcagagcacctgtagtgatcctcacaagttcatcttgaagcaaaaactagttacaccacctgtttaatatcaagttttagattttgttcaggtttgacctctggagactcttaattttcagagcatctcagtggcttgtgaagcttgatgactttgattttagcaattttatgggatgattgtcctcatggctgtgtttcctcgcgttttgtggctctgtttatgcatgtgttggttgtcaaatcttagggtgaataaaaacagttctacttgagatgtc

SEQ ID NO: 3527 - DNA, 1532 bp, Solanum phureja
atataattttgtttatgctattatggtttgtgtaaattatttatatattttcactttcctaagcacatcaacccatatttaacaccccacctcgtgtctctctccgctgatctctgcaaaataacaatcaaaggtatgtctcatcctaataatcttggaaattcgatcttccattcttgaaaaaattaccttattcaataatacccaattaagtttggtgccatatgttagcataacttttgtaatttgtgggtaccttaaaaagtagaaaggaaaaacttgccccttttgattcttgatactatatgaacctatacactgctgcttgtatgtggcataggataattggttattcttttattgttaaaaaggaaatattactcttttatttctttgtgttttaaaatcttgaatttttacctgttgtgttggaattgttgggggaacagagacaatggggaatctgttctgctgtgtacaagttgaccaatccacagtagctattaaggagagatttggcaagtttgatgatgtgcttgagcctggatgtcatttcttgccatggtgtatagggagccaggtagctggttacctaactttaaggctgcaacagcttgatgtacgatgtgaaaccaagtcaaaggataatgtatttgtaactgttgttgcttctatacaatatcgtgctctggctgataaagctactgatgctttttacaagcttagtaatactcgatcccagatccaagcctatgtgtttgatgtaatcagggcgagtgttccaaagctaaatctggatgatgtctttgagcagaagaatcaaattgcaaaagcagtggaggatgaacttgaaaaggcaatgtctgcttacgggtatgagattgttcagacactcatagttgatatagagccagatgaacacgttaagcgagctatgaatgaaatcaatgcagctgcaaggttgagagtagccgccaatgagaaagcagaagctgaaaaaattgtccagattaaacgagctgaaggtgatgctgaagctaagtacctggcaggactagggattgctagacaacgccaggccattgttgatggtttaagggacagtgttcttggattttcagttaatgtacctggaactactgccaaggacgtcttggacatggtcctcataactcagtattttgacaccatgaaggaaattggtgccagctccaaatcctcagcagtctttatcccacatggacctggtgctgtgagtgacattgcagggcagattcgacaaggattactccagggttcagctgtggagcaacaaaatcttttataaatgtgtttcacagtgtctcgtgtggttctgttttgtaagtaatatttcttgattcgattatgatggtcattattgttctctacatacatgtgtgttgctaatgtaattacatgcaactatttaagtcgaatgtttgttgtcttatagtcggttcaatgtattgtttcattgacatattaccacatgccagaaaagttttttttca

SEQ ID NO: 3528 - DNA, 1377 bp, Juglans hindsii x Juglans regia
  misc_feature (514)..(514): n is a, c, g, or t
  misc_feature (942)..(942): n is a, c, g, or t
  misc_feature (1213)..(1213): n is a, c, g, or t
  misc_feature (1222)..(1222): n is a, c, g, or t
ggggacagagaagaaagcaacgggatatgggaaatttctatggattgaaattgattacaatgtccctggggggtcgctatagcgattagcggggccgtcctgcttggttcttgacctagctcttgtcttcatccaaaagcaaagggcgaagtttctcaccatcccgggtgctgcttaaaataataacgcaatttctgtttcttatcttcgtcttctgggatcagttaagaaaagaaatccagagataatcaaagagtgaagagaagatgggtaatctgttatgttgtgtacaagttgaccaatcgacggtggctatcaaggaaagatttggcaaatttgatgaagtacttcagccaggatgccattgcttgccttggtgccttggaagccagctttctgggcatctcactcttcggttgcagcaattggatgtgaagtgcgagaccaagacaaaggacaatgtttttgtcaatgtggttgcatccattcaataccgtgccctggctgacaaggnaagtgatgccttctacaaactcagcaacacaagaacccaaatccaagcttatgtttttgatgtaatcagagctagtgtcccaaagcttaacttggatgatgcttttgagcagaaaaatgatattgccaaagctgtggaagatgaacttgagaaggctatgtctgcttatgggtatgaaattgtacaaacacttataattgatattgaaccagatgagcatgtgaagcgagcaatgaatgaaattaatgcagctgcaaggatgagggtggcagctaatgagaaggcagaggctgagaaaatcttgcaaattaaacgagctgagggtgaggccgagtctaagtatttgtctggtctgggtattgctcgccagcgtcaagctattgtggatggcttgagagacagtgtgctaggcttctctgttaatgtgnctgggaccacagcaaaggatgtcatggacatggtacttgttacccagtattttgacaccatgaaagaaattggtgctgcctcaaaatcgtctgccgtgttcatcccacatggacctggtgcagttcgtgatgtagctactcaaatccgtgatggccttcttcagggttctagtcaccagtagtgttgttgattttccatgtgtatgccactaataagttcgcgcatgggcgctgatatttatatgcaagttgttcagtgtactataatccnacatgagtnactgtcatattagtttgtgaacaatgattatcactgttaataggaagtttgaagatgtcccaagtatgttaagttgatcatttcgaaactatgtaagttgtcccaagtactgtcatattatttctggtcgtgaaacttgagagttgttcattccg

SEQ ID NO: 3529 - DNA, 1223 bp, Aquilegia formosa
tggaaaaagtatatataaaggcaaaatgcttcaaagagtagtgataaagctcgcttaaagacagagaaaaaaaccaattgtttttaattttaaaagaaagaaagaagaagaaagagggttttgagacaagaagcatgggtaatcttttctgctgtgttcaagtggaccaatccactgtagctatcgctgagaggttcggaaaatttaatgaagtaatggaaccaggatgccattgccttccatggccagttggttataaggttgctggccatctgtcacttcggttacagcagctagatgtgaagtgtgagactaagacaaaggacaatgtctttgttaatgttgttgcatctatacaatatcgggccctagctgataaagcaagtgatgcattctataagctgaccaacacgagatcccaaatccaagcatacgtctttgatgtaatcagagcaagtgttccaaagctcaatctggatgacacttttgagcagaaaaatgaaattgcaaaagctgttgaagaggaacttgagaaggctatgtctgcctacgggtatgagattgtgcaaacactcattgtggatatagagccggatgaacatgtgaagcgagcaatgaatgaaattaatgctgctgcaaggatgagggtggcagctaaagaaaaggcagaagctgaaaaaattctacagattaagcgagctgagggtgaggcagaggccaagtatctgtctggacttggtattgcccgccaacgccaagctattgttgatggtctaagagacagtgtgcttgggttctcagtgaatgtgccagggaccacagcaaaggatgtgatggatatggttcttgttacacaatactttgatacaatgaaggaaattggtgcttcttccaaatcctcagctgtgttcatccctcatggacctggtgctgttcgtgatgttgctgcccagatcagagatggactacttcagggatcctcgacccagtgaactgccatctgaactagtacagtctgcaaaattgtagcaagtttcatatatgttttgctttagtgcgatctttcgtagttttcagttcacattgccatagagctagtagatgttcattttgtttgctcttggcaagtttgtttgtgttgatataaacacggtttggattatatttttcagtaaagccaatttggattatattgatttgaacatatggtgaatacttataaa

SEQ ID NO: 3530 - DNA, 1295 bp, Prunus mume
tgtagccttcttcgagagttttacaagttatcgtcttttgagtctatataaatctcaacttgtttgggtcgtctcattcctatcttcttccctttctctcttgtccgctcttctgttatactaactgtacaaatagtgaagagaacatgggtaatcttttctgttgtgtacaagttgatcaatccaaagtagctataaaggaaaaatttggtaggtttgtggaagttcttgagccaggatgccattgcctcccttggtttcttgggcatcagattgctggtcatctctctcttcgtttgcagcaattggatgtgcgctgtgagaccaagacaaaggacaacgtatttgtcaacgtcgttgcatctattcaatatcgtgctctggcagacaaagcagatgatgccttctacaaactcaccaacacaaggtctcaaatccaggcctatgtttttgatgtgattagagctagtgttccaaagctcaacctggatgctgcctttgagcaaaagaatgaaattgcaaaagctgtggaagaagagctcgagaaagctatgtctgcttatggttatgagattgtacaaacgctcattgttgacatagaaccagatgagcatgtgaaacgggcaatgaacgaaatcaatgctgctgcaagaatgcgcgtggcagctaatgagaaggcagaggcagagaagattttgcaaattaagcgggctgagggtgaggccgagtccaagtatctctctgggctgggtatagctcgccagcgtcaagcaattgtagatggtttgagagacagtgtgctgggcttctctgtcaatgttccagggactactgcaaaggatgtcatggacatggtccttgtgactcagtattttgacaccatgaaggaaattggcgcttcctctaaatcctctgccgtgtttattccccatggacctggttctgtccgtgatgtagcttctcagattcgtgatggacttcttcagggttctcaccagtagttcggaacttctacaagtttttcatttcttatctgcaagtcttttttttgcttcatcccaaggtgttctgtttgctatagttttgtttcatggtttcatttaattgttcaatactgccactgtatacttgtggtgagcatataatgatcgtatacaatgagtgaattcttcttgcttgaacttgattcttgtacagtttcaccttttaagtgtgtagacgactgaaaagtgtatgaatttcttcacaaaaaagaatcctatttgttcattatctttctccaaataagcttcact

SEQ ID NO: 3531 - DNA, 1222 bp, Aquilegia formosa
tggaaaagtatatataaaggcaaaatgcttcaaagagtagtgataaagctcgcttaaagacagagaaaaaaaccaattgtttttaattttaaaagaaagaaagaagaagaaagagggttttgagacaagaagcatgggtaatcttttctgctgtgttcaagtggaccaatccactgtagctatcgctgagaggttcggaaaatttaatgaagtaatggaaccaggatgccattgccttccatggccagttggttataaggttgctggccatctgtcacttcggttacagcagctagatgtgaagtgtgagactaagacaaaggacaatgtctttgttaatgttgttgcatctatacaatatcgggccctagctgataaagcaagtgatgcattctataagctgaccaacacgagatcccaaatccaagcatacgtctttgatgtaatcagagcaagtgttccaaagctcaatctggatgacacttttgagcagaaaaatgaaattgcaaaagctgttgaagaggaacttgagaaggctatgtctgcctacgggtatgagattgtgcaaacactcattgtggatatagagccggatgaacatgtgaagcgagcaatgaatgaaattaatgctgctgcaaggatgagggtggcagctaaagaaaaggcagaagctgaaaaaattctacagattaagcgagctgagggtgaggcagaggccaagtatctgtctggacttggtattgcccgccaacgccaagctattgttgatggtctaagagacagtgtgcttgggttctcagtgaatgtgccagggaccacagcaaaggatgtgatggatatggttcttgttacacagtactttgatacaatgaaggaaattggtgcttcttccaaatcctcagctgtgttcatccctcatggacctggtgctgttcgtgatgttgctgcccagatcagagatggactacttcagggatcctcgacccagtgaactgccatctgaactagtacagtctgcaaaattgtagcaagtttcatatatgttttgctttagtgcgatctttcgtagttttcagttcacattgccatagagctagtagatgttcattttgtttgctcttggcaagtttgtttgtgttgatataaacacggtttggattatatttttcagtaaagccaatttggattatattgatttgaacatatggtgaatacttataaa

SEQ ID NO: 3532 - DNA, 1103 bp, Brassica oleracea
  misc_feature (60)..(60): n is a, c, g, or t
ggttgtttgttattcacagagctaccagaagcgttacatcgaaatcatagccagcaaatnaaaaagaagacaactttcgagaattagtgaagaaagatggggaacttatgttgctgtgtacaagtggaccaatcaacggtggcgatcaaagaaacgtttgggaagttcgaagatgttcttgagcctggttgccattttctcccttggtgtcttggtcagcaagtcgctggttacctctctctcaggcttcagcagttggatgttcgctgcgagaccaagacaaaggacaatgtgtttgttaacgttgttgcatcgattcaataccgtgcattggctaataatgctaatgatgccttctacaagctcagtaacacaaggagccagatccaagcttacgtctttgatgttatcagagcaagtgtccccaagctgattctggatgacgtctttgagcagaagaatgaaattgccaaagctgttgaagaggagctcgagaaggcgatgtctgcttacggttttgagattgtccaaactctcattgttgacatcgagcctgacgagcatgtcaaacgagccatgaacgaaatcaacgctgctgcaaggatgaggttggctgcaaacgaaaaggctgaggctgagaaaatcctgcagatcaagcgagctgaaggtgaagccgaggccaagtacctttctggtcttggtatcgcccgtcagaggcaagccatcgttgacgggttacgcgacagtgtcttgggcttctctgtgaatgttcccgggacaactgctaaagatgtgatggacatggtgcttgttacgcagaacttcgacaccatgaaggagattggtgccagttccaaatcctctgctgtgttcattccccacggaccaggagcagtacgcgatgtggctactcagatcagagatgggctccttcaaggctccttcgcagaccagtcttgaattagatggactgatcattatatgttctctactaagcttgctgtgtgttaagatcatatgatcttgtgctgagaaactctcatgcttttaggttcttatatttttcgttaatatatttcgcgtatgacgtatttgggtgtacg

SEQ ID NO: 3533 - DNA, 1734 bp, Theobroma cacao
attttcagttgtctctccatctaccgtgtaaggactccaacttcttcttggaaaaataataataatactaaaaagaattccaattaaatcaggtaaagtttagatgataaaatattttgctttcatgtacaaggaaacaatacagctggatgaaatttcctgttgacttacctttttcgggtcaatgctaatcttctttattgccatacaatttcaataatttgcgaaaaaggaatgtgtgttggagactcgtggcaagtattgtgaaattttccaagccagcttgccgcagtctatatatttaggtcaactatatttgagtgtttatctcttatctcttcagagtttcttctgatttgccatcctttgctcattaagttatcaaagagaaaatgggtaatttattctgttgtatacaagttgaccagtctacagtagccatcaaggagagatttggcaggttcgatgatgttcttgaacctggatgccattgcctaccttggtttcttggaagtcagcttgctggccacctgtcgctgaggttgcagcagttggatgttcgttgtgagaccaaaactaaggacaatgtatttgtcaatgttgtcgcatctattcaataccgtgcactagcagataaggcaagcgatgccttttacaaactcagcaacacaaggacacaaattcaagcttatgtttttgatgttattagagcaagtgttcccaagctgaatctggatgatgtttttgaacaaaagactgaaattgctaaagctgttgaagaagaacttgagaaggctatgtctgcctatgggtatgagattgttcaaacacttattgtggacatagaacctgatgagcatgtgaagcgtgcaatgaatgaaattaatgctgctgcaaggctgagggtagcagctaatgagaaggcagaggctgagaaaattttgcaaatcaaacgagcagaaggtgaggctgagtctaaatatttgtcaggactgggtattgctcgccagcggcaagcaattgttgatggtttgagagatagtgtgctgggattctctgtcaatgttcctgggactactgcaaaggatgtcatggacatggtcctggtcacccagtactttgacaccatgaaagaaattggtgcggcttctaaatcttcggctgtgttcatccctcatggtcctggagctgttcgtgatgtcgctactcagattcgtgatggacttctccaggctgcacatcagtaactgtatgacttttcaaaggcttatactgggttttgctttagacaagcattaagggttttaatatttgcctgtttagttcttggtgccttagctctggtttaattgtggtttgtcatttgtccggtgtgagcacttgtgtacatatggcgtaaaaggtttgtgaagtacatgggctgcataattttctatttttatagatattgagaggctttatgttggatttctcttggtttattgtcaccatgggcaaaggtaaaaaatcttttatcaaaatctgtgcgccatctgcctccctatataagttttcctgcaaataagttcattattccgagagggaatcgaaaggaagatgttcaatgttttagcattcacaaatttctctttctcatatgctaaccttcatttagctgcaattgattccaagcattctttaattttctgcatcatggctaagtgccaactgtttcaatatagaattaactttaca

SEQ ID NO: 3534 - DNA, 1326 bp, Manihot esculenta
atgggattcaactcgctgcagagtgagttggctgagtggctagactcgtttattgcccccaccaaaacacgaccatgcgtaaacgcccacagagaagctaatatctgtgtgcacagcctggaccatacccactgcacatccttagtcaccgcggttttcttcctctcaagaaatctcattatttcaaagcgttactctcaaaacaaagagaggatgggtaatctgttttgctgcgtgcaagttgaccagtctacagtagctatcaaggagagatttgggaaatttgatgaagttcttgagcctggatgccattgcctaccttggatttttggaagccagcttgcaggccatttgtcactgaggttgcagcagttggatgttcgttgtgagaccaagacaaaggacaatgtttttgttaatgttgttgcatctattcaataccgagctctggcagataaagcaagtgatgctttctacaaactgagcaacacaagaatccaaatccaggcctatgtttttgatgttattagggcaagtgttccaaaacttgatcttgatgatgcttttgagcagaagaatgaaattgccaaagccgtggaagatgaacttgaaaaggctatgtctgcttatggatatgaaattgtgcaaacactcattgttgatatagaaccagatgaacatgtgaagcgggcaatgaatgaaataaatgcagctgcaaggctgagggtggcagcaaaagagaaggcagaggctgagaagattctccaaattaagcgagctgagggtgaggctgaagcaaagtatcttgctggactgggtattgctcgtcagagacaagcaatcgtagatggattaagggatagtgtgctgggtttctctgaaaatgtaccgggcaccactgcaaaagatattatggacatggtccttgtcactcaatattttgacacaatgaaggaaattggtgctgcctctaaatcgtctgccgtgtttattccccatggacctggtgctattcgtgatgttgcttctcagattcgtgatggacttctccaggcttctgcccataccagtggctgagctccatcctacatgtccagcttcatggcctcatggctttgtgttagacaggatctttataagcatcagtggtggttttctctctctgcccctctctccatatgtatgtaaaatttatctacagtttccttgtgcaaaaagcttgtaagtaaacacagcatcaaacgcgtaatacgctgtaaattgaacttcgtatttatatgtttgtattgttttccaaacctagttgatactgttcatgtttttgag

SEQ ID NO: 3535 - DNA, 1056 bp, Cichorium intybus
atatcgttttcgattatatcaagtaccaagtgggcgtgggtgtttcgatctcttccttataaagatacatccgcgaaatatctcctctaccaggctgtctgatattggtcttgcaaccacctcagtataaagtcatgggaaacctcttctgtttagttcaagtagaccaatccacagttgccatcaaggaaactttcgggaaattcgctgatgttcttgagccaggtttacattgtgtcccttggattttcggaagtcaagttgctggacaactcacactcagacttcaacagttggatgtcaagtgtgagaccaaaacaaaggacaatgtctttgtcaatgttgtagcttcaatacagtatcgcgctctagccgataaagcaagtgacgcgttctataaactcagcaacacaaggtcccaaatccaagcttatgtatttgatgttatacgcgctagtgtcccaaaactcaacctcgacgacgcattcgaacaaaaaaacgaaatagcaaaagccgttgaagaggaattagaaaaagcaatgtctgcgtacggttttgaaattgttcagacattaatcgtcgatatagaacccgacgagcatgtcaagagagccatgaatgaaatcaatgccgctgcgaggttgaggatggcggctactgaaaaggctgaagctgaaaagattcttcaaattaagagggctgaaggagaggctgaatcaaagtatttgtctggattgggtatcgcgcgtcagagacaagcgattgtggatggtttgagagacagtgtgttggggttttcggtcaatgtgcccgggaccacggctaaggatgttatggacatggttttagtgactcagtattttgatacgatgaaagagattggggcttcttctaaatcgtctgctgtgtttattcctcatggtcctggtgcggttcgtgatgtggctactccaatacgcgatgggcttcttcagggtaatgctgcccagtgattgttgactttgtttcacgcgtacctttgactttaatgtttttgattgcgtgtaaacaaagttc

SEQ ID NO: 3536 - DNA, 1325 bp, Euonymus alatus
tatacagcttatatactgatattttcatgtatctgctaagcaatagagtggaattggactataaattgattcgaagtttctgattggttgtggctagtaaagtttgtagtctatataaatctgtcattgagttttgttattccttgtctctgcgcatacgatctactgtttctttgttacccttgtaaagtagatgggaaatctgttttgttgcattcaagttgaccagtcaactgttgctatcaaggagcaatttggtaagtttgatgaagttcttgagcctggatgccattgcctcccttggtttcttggaagccagcttgcaggccatctgtcactaaggctgcagcagttggatgtgcgatgtgagaccaagacaaaggataacgtatttgtcaatgtggtcgcgtcgattcaataccgtgccctggctgaaaaggcaaatgatgcattctacaaactgagtaacacaaggtcccaaattcaggcctatgtgtttgatgtaatcagagcaggtgttccaaaacttgatctggatgatgtatttgaacaaaaaaatgaaattgctaaagccgtagaagatgaactcgagaaggctatgtctgcatatgggtatgagattgttcaaactctcattgttgatatagaaccagatgagcttgtgaaacgttcaatgaatgaaatcaatgctgctgcaagaatgagagcggcagccactgataaggcagaagctgagaaaattttgcaaatcaaacgggctgagggtgaggctgaggctaaatatctctcggggcttggcattgctcgtcagcgacaagcaattgtggatggtttaagagatagtgtgctagggttctccgtcaacgtgccagggaccactgcaaaggatgttatggacatggtgctagtcacacagtattttgacacaatgaaggaaattggtgctgcctctaagtcctcagctgttttcatcccccatggacctggtgctgttcgcgacgttgctagtcagattcgtgatggactccttcagggctctgcagaacaatgattgttacccttttcctagctttacaaggttgtgttgatacatgttatttgtgcgtactatgtttgtctgtaaaggtttcttatctgcaagtcttgtcaaattttggcatccatttcaataattactgtacaaattaccctggatgctaccaagtgagcatcacactacccctgaactttgatatttatctattgtgagctttcaaaattatgtgacaaatatctgttggatgacttagaactgtacagctgattttgtttctctggtctttaaa

SEQ ID NO: 3537 - DNA, 1075 bp, Citrus sinensis
ggacttcccttaatttgctgttaacttaactaaaaaacgcatagaaagtttggagaagtttcctaggccaagcttttgtttctatttaagtcccttgatttagttgtttgtttctatcactatatatcttcctacagcagcatttgcattccccattttgtttctgcattgatttagtgtaaagaagatggggaatctgttctgttgcgtacaagttgaccaatcaacagtggctattaaggagagatttggcaagtttgaggatgtccttgaacctggatgccatttcctcccatggatccttggacatcagctagctggtcaccttacactcaggctgcagcagttagatgttcgttgtgaaaccaagactaaggacaatgtatttgtcaatgttgttgcatctgttcaataccgtgccctggcacataaggcaaatgatgctttctataaactcagcaacacaaggactcaaattcaggcctatgtctttgatgtgattagggcaagtattccaaagttaaatctagatgacgcatttgagcaaaaaaatgaaattgccaaagctgtggaggaggagcttgaaaaggctatgtctgcttatggctatgagattgttcaaacacttattgtcgatatagaacctgatgagcatgtcaagcgggcaatgaatgaaattaacgctgctgcaagactgagggtggcagctaacgagaaggcagaggcagagaaaattttacagatcaaacgagctgaaggcgaggctgagtctaaatatctgtcagggcttggtattgctcggcagcgacaggcaattgtggatggcttgagagacagtgtgctgggtttttctatcaacgttccaggaaccacggcaaaggatgtgatggacatggtcctggtcacccaatacttcgacaccatgaaggaaattggagctgcttctaaatcatctgctgtctttattccccatggacctggtgccgttagagatgtagcgacacagatccgtgatggacttcttcaggcttctcaacaccagtgaatcgttaattgataaggcttatctagtttt

SEQ ID NO: 3538 - DNA, 985 bp, Helianthus annuus
ccacctctcattcgtgtgaatcatggggaacttgctctgtttggttcaagtagatcaatctactgttgctataaaggagacttttgggaagtttgatgatgttctcgagccgggttgtcattgcgtgccttggatattcggaagtcggcttgctggacatcttactctcagggttcagcagttggatgtcaagtgtgagaccaaaacaaaggacaatgtttttgtcaatgttgtagcttcgattcagtatcgtgctctgactgataaggcgagtgatgcgttctacaaactcagcaacacaagggcccaaatccaggcctatgtttttgatgttatacgggctagtgttccaaagcttaatcttgatgatgtatttgagcaaaaaaatgagatagccaaggctgtggaagaagaacttgaaaaggcaatgtctgcgtatggttttgagattgttcagactttgattgttgatatcgaacccgatgagcatgtgaagagagcaatgaatgagatcaatgcagctgcaaggctaagggtggcggctactgagaaagccgaggctgaaaaaattctacaaatcaagagagccgagggtgaggctgagtcgaaatacctgtctggtttgggtattgcgcgccaacgacaagcgattgtagatgggttaagagacagtgtgttgggtttctcggtcaatgtgcccgggaccacagctaaagacgtgatggacatggttctagtgacccagtattttgacaccatgaaggaaattggggccgcatccaaatcgtctgctgtgtttattccacatggacctggtgctgttcgtgatgtggctactcagatacgtgatggtcttcttcaaggcagtgctgctgctagttgattttcggagtttgatggcaatgcaatcgtaagagtacagtttcatgttttcttaagtaatcgtggtttatgttttcgactatgtgaagcttttgagtttgtg

SEQ ID NO: 3539 - DNA, 1181 bp, Papaver somniferum
taacaacagagaatgggtaacttattgtgctgtgtacaagtggaccaatcaaaagttgctattagggaaagatttggcaagtttgatgacgttcttcaaccaggatgccattgcctaccatggtttcttggtagccagatagctggtcatctcacccttagggttcagcagctggatgtgaaatgtgagaccaagacaaaggataatgtatttgtgaatgttgttgcgtctatccaatatcgagctttagcagagaaggcgaatgatgcattctacaaactgagcaatacaaggggccaaatccaagcctatgtttttgatgtaatcagagctagtgttccaaagctccttttggatgacgttttcgagcaaaagaatgatattgctaaagctgttgaagaagaacttgaaaaggctatgtctgcttatggatatgagattgttcaaaccctcattgttgatatagaaccagatgagcacgtgaagcgggcaatgaatgaaatcaatgctgctgcaaggcttcggttggcagcaaccgaaaaggcagaggctgagaaaattttacagataaagagagcagagggtgaggctgaatctaaatacctctctggactgggtattgctcgtcagcgtcaagcaatcgttgatgggctcagagacagtgtaataggtttctcagttaacgttcctgggactactgcgaaagacgttatggacatggttttggtaacacaatacttcgacacgatgaaggaaattggtgcagcctctaaatcctctgcagtgtttatccctcatggtcctggtgctgttcgtgacgtggccactcaaattcgtgatggtctacttcagggctcttctgctcacatgccatgaatgatgacttagtttcccagctctacttgcctttgacctcaaactacaacaagcgatccctcttttttatagtagtacttaaaatgcggtgtgtctatattcacgtttcctttcggcaacacttggcattttgttacctttagatgcgcagtatgtatatcctatgtttgcatttgggattaatcgtgtgactggaactactgattaagtaatgtggattggtttattagagtttataaatctgcttacttgtaaaatagtgctcaagtatctaaataataagtatgtgctagaacttcatatct

SEQ ID NO: 3540 - DNA, 1493 bp, Vaccinium corymbosum
tacttacggtaccgggaacggacagtggtctacacgacagagtggctatacgggtccggggggttaccggtaaaagttagtacgttggttacgtaatactaattatacctaaacttaggatattctaaacaaaaaagggggacattttgatcattagttaactagcggaggtagcattgcaatcgtttttcctatacggggttggtcgcatgagttctacatcgatccgattagcttcacttttgatttccattccccattgctatcctgttttcccctgtatttagattgactaaattagatcatgggcaatctatttggctgcttgatagttgatcaatccacggttgctatcaaggaaaagtttggcaagtttgatgaagtgctagagccaggatgccattgcgtaccttggtgcctcggaagccagctggctggtcatctcacccttcgggtgcagcagttggatgttcgttgcgaaaccaagacaaaggacaatgtatttgtcaatgttgtagcgtctatccagtaccgcgcccttgctgacaaagcaaatgaagctttctataaactcagcaacacaaggagccaaatccaagcctacgttttcgatgtgattagggcatttgttccaaagctcaatttggatgacacttttgagcaaaagaatgacatagccaaagcggttgaagatgaacttgagaaggcaatgtctgcttacggatacgagattgtccagacactaattgttgatatagaaccagatgagcatgtgaagcgggcaatgaatgaaatcaatgctgctgcaaggatgagggtggcggctaacgagaaggcagaggctgagaaaattctacaaatcaagcgagctgaaggtgaggccgagtcaaagtacctgtccggtttaggtgtcgctcgccaacgccaagcaatagtggatggtttgagagacagtgtgctaggcttctcagttaacgttcctggaaccactgcaaaggatgtcatggacatggtcctagtcacccagtactttgacactatgaaggaaatcggtgctgcctccaaatcctcagctgttttcataccccacgggcccggtgccgttcgtgacgtggccactcaaatccgcgacggacttcttcaagcttcttctcagcattagttaaactaatgttccactgcctccaaatcttcagctgttttttacagtgtttataagatttagaagttgcaagataaataaaacttcggaatttcaaaattagttgaggtgtgttcgagctgattcagaactcggaataaaaagttagtgggtaatttctccattgtaattattgtcttggagaagagttgaaggtgatatcttttcacttaattggccttcctccatcacttaccaatgccaataggatagggaactttttattgccgtactcttgtttcattttgtcctttttctttactttgtgtgccatgtgattggattgcctttc

SEQ ID NO: 3541 - DNA, 1114 bp, Artemisia annua
atacaacaacacacttttatacagtttcttcttcatctgttaaagatcatggggaatttgttctgtttgtatcaagtggatcaatcaactgttgctattaaggagacttttgggaagtttgatgatgttcttgaaccggggtgtcattgtgtgccgtggatttttggtaagcagattgcggggaatcttacgttgaggcttcagcagttggatgttaagtgcgagacgaaaactaaggacaatgtctttgtcaatgtcgtagcttccgttcagtatcgtgctctggctgataaagcaagtgatgcattctacagactcagcaacacaagatcccaaatccaggcttatgttttcgatgttataagggctactgttccaaagcttttacttgatgatgcttttgagcaaaagaatgaaattgccaaggctgttgaagatgagcttgaaaaggcaatgtctgcatatggttttgagattgttcaaacgctgatcgttgatatagaacctgatgagcacgtgaagagagcaatgaatgaaatcaatgcagctgcgaggctgaggatggcagctacagagaaagccgaggcagagaaaattctccaaatcaagagagccgagggtgaggccgaatccaagtacttggcgggtgtgggtattgcacgccagagacaagccattgttgatggtttaagagacagtgtgttggggttctcagtcaatgtgcctggaactacagctaaagacgtgatggacatggtcctagtgacacagtactttgacacgatgaaggaaatcggtgctgcatcaaaatcatcagctgtgtttatccctcatggacctggtgctgttcgtgatgtggctactcagatacgtgatggacttcttcagggcaacgctgccaccagctgatagtcggcgttgttttttcagatcattctggtttgggttgaaatgcactgttagagtacagttttatgttgtctatgaatgggtttatattttaaactttgtgagtttgtgtatgctatgtctatatgctatgttagggtttatgaattctatgtttgaaagtatattctcacctaaatcttgaatatgaatgtgggttttcaag

SEQ ID NO: 3542 - DNA, 1339 bp, Gossypium hirsutum
cacttgagggtgaagattctattttatcttgttctatttgggaataaacaatccacactgtatgagcccgcaatttcagttgattctatgtgctgcttcttctccttcttcctcttcaacaactccaattttcctttcgaaaaggaataatcaataacacaaagacaaatccaatcaatcagagcaaaatccaaatgggtaatcttttctgttgtgtacaagttgaccagtctacagtagccattaaggagagatttggcaggtttgaggatgttcttgaacctggatgccattgcctaccttggtttcttggaagtcaacttgctggccacctgtcgctaagattgcagcagttggatgttcgttgtgaaaccaagactaaggacaatgtatttgttaatgttgttgcatctattcaataccgggcactggcagacaaggcaagtgatgccttttacaagctgacaaacacaaggacacaaattcaagcctatgtgtttgatgttattagagcaagtgttccgaagctaaatctggatgatgtttttgaacaaaagactgaaattgctaaagctgttgaagaagaacttgagaaggctatgtctgcctatgggtatgagattgttcaaacacttattgtggacatagaacctgacgagcatgtgaagcgtgcgatgaatgaaattaatgccgctgcaaggctgagagtggcagctaatgagaaggcagaggctgagaaaattttgcaaatcaaacgagctgaaggtgaggctgagtccaaatatttgtcggggctgggtatcgctcgccaacgacaagcaattgttgatggtttgcgagatagcgtgcttggattctccgttaatgtcccggggactactgcaaaggatgttatggatatggtcctggttacccagtactttgacaccatgaaagaaattggtgctgcttctaagtcctcagctgtgtttatccctcatggtcctggagctgttcgtgatgtcgctactcagattcgtgatggactcctccaggccacacaccagtaactatacgatttttttttaagacaagacaagacaagacaagcattagtagttttttaaggataatacctggttttaacgttacctgtttagttcttgatgtcatttttacattatgagcactggatgtacatatggtgtgggcataaacggtttgtgaaatgcgtaagatattttatactcttatagaggttgagtggtctttattatggatttttcttggttttattgtcgccatggatgaaggttgaacaattcttctatcaaaaattggtcacaaatgagttcatttc

SEQ ID NO: 3543 - DNA, 1188 bp, Flaveria ramosissima
tcgacgactttactcgtatttggcttccacgtctcctccctggatcatggggaacctattttgtttgtatcaagtggatcaatcgactgttgctattaaggagtcttttgggaaatttgatgatgttttggagcctggatgtcactgtgttccatggatatttggtaaacagcttgctggttatctttctcttagagttcagcagttggatgtcaagtgtgagactaaaacaaaggataacgtctttgtgaatgttgtggcttcaatacaataccgcgctttggctgataaagcaaacgacgctttctataaactcagcaacacaaggtcccaaatccaggcctatgtgtttgatgttattagagcttttgtgccaaagctgaatctggatgatgcttttgagcaaaagaatgaaattgcaaaggcagttgaacaagaacttgaaaaggctatgtctgcatatgggtacgagatagttcagacattgattgttgatatagaaccagatgagcatgtaaagagagcaatgaatgagatcaatgctgctgcaaggttgaggatggcggctgctgagaaagcagaagctgagaaaattctgcaaatcaagagagccgagggggaagccgagtccaaatacctgtcgggtttgggtatagcccgccaacgacaagccattgtggacggtttgagagacagtgtgttgggattctcagtcaatgttcctggaaccactgcaaaagatgtaatggacatggttctagtgactcagtattttgacaccatgaaggaaatcggtgcgtcttccaagtcttcagctgtgtttctccctcatggacctggtgctgttcgtgatgtggcctcccagatacgtgatggactccttcaaggttctgctgccacttgatttgcagctcaatttgctcctcatgattggaatgaacttctttaagtttatctgtttgtgttttacttgaagttttgtagagctaaacttcttttggtttgaacctttcttttaagtgtaaattcatttaaaacttgaatatgtgctcgccaaggattgtgtgatttcagccttgtgcatgtacacacatgcatcaaattcttgacattcatctgaagcaaccagaagttgccacgtatacgaatgtgtaaggtgtaaatgcatcaatgaaacttcataaggtt

SEQ ID NO: 3544 - DNA, 1281 bp, Flaveria ramosissima
tcatgtgatttcaattttggattctttagggatatcatgatcttctttctactcagattaacatgctgtaaactcattctgttgatttgagcgatatgaaattcgaaagctgttaattagtttttgtacgaaaacggttttgtttctgaataatatcatgggcaatttattgtgcttggttcaagtagatcaatccactgttgcaattaaggagacttttgggaagtttgatgatgttcttgagcctgggtgccattgtgtgccgtggatattcggaagccggcttgcggggcatctcacactcagggttcagcagttggatgtcaagtgtgagaccaaaacaaaggacaatgtttttgtcaatgttgtagcttcagtacagtatcgtgccctgtctgaaaaagcaagtgatgcgttctacaaactcagtaacacaagggcccaaatccaggcctatgtttttgatgttataagagctagtgttccaaagcttaaccttgatgatgcatttgagcaaaagaatgaaattgctaaggctgtggaagaagaacttgaaaaggcaatgtctgcatacggttttgagattgttcaaacactgattgttgatatagaaccagatgagcatgtgaagagagcaatgaatgagatcaatgcagctgcaaggctgaggatggcagctgctgagaaagcagaggctgaaaaaattctacaaatcaagagagctgagggtgaggcagagtccaagtacctctctggtttgggtattgcacgccaaaggcaagccattgtggatggattacgagacagtgtgttgggtttctcggtcaatgtgcctggaaccacggctaaagacgtgatggacatggttctagtgactcagtattttgacaccatgaaggaaattggcgctgcatccaaatcatctgctgtgttcatccctcatggacctggtgctgttcgtgatgtggctactcaaatacgtgatggtcttcttcaaggcagtgcggctagttgatcgtctggactttgatggcctgatccgttctatgcaaccgtaacgagtacagtttcttgtttcttcagtacgtatggtttatattttcaacttcgtgatgtttgtgagtttgtgtgttaagcgtgcgtttaggtttataaacttgatgtctatatacttcctgtttgaatttggatttctaagttctattaatacccctttgaaacaagtgttatataatatgatatattaatcacaaacaaggtttcaaataaacatattagtta

SEQ ID NO: 3545 - DNA, 1054 bp, Flaveria ramosissima
cccctgcaacaatccttcattcgaataatatcatgggcaatttattgtgcttggttcaagtagatcaatccactgttgcaattaaggagacttttgggaagtttgatgatgttcttgagcctgggtgccattgtgtgccgtggatattcggaagccggcttgcggggcatctcacactcagggttcagcagttggatgtcaagtgtgagaccaaaacaaaggacaatgtctttgtcaatgttgtagcttcggtacagtatcgtgctctttctgaaaaggcgagtgatgcattctacaaactcagcaacacgagggcccaaatccaggcctatgtttttgatgttataagagctagtgttccaaagcttaaccttgatgatgcctttgagcagaagaatgaaattgccaaggctgtggaagaagaacttgaaaaggcaatgtctgcatacggttttgagattgttcaaactctgattgttgatatagaaccagatgagcatgtgaagagagcaatgaatgagatcaatgcagctgcaaggctgaggatggcagctgctgagaaagccgaggctgagaaaattctacaaatcaagagggctgagggtgaggcagagtccaagtacctctctggtttgggtattgcacgccaaaggcaagccattgtggatggattacgagacagtgtgttgggtttctcggtcaatgtgcctggaaccacggctaaagacgtgatggacatggttctagtgactcagtattttgacaccatgaaggaaattggcgccgcatccaaatcatctgctgtgttcatccctcatggacctggtgctgttcgtgatgtggctactcagatacgcgatggtcttcttcaaggcagtgcggctagttgatcgtctggactttgatggcctgatccgttctatgcaaccgtaacgagtacagtttcttgtttcttcagtacgtatggtttatattttcaactacgtgatgtttgtgagtttgtgtgttaagcgtgcgtttaggtttataacttgatgtctatatacttcctgtt

SEQ ID NO: 3546 - DNA, 1402 bp, Gossypium raimondii
attttaatgtttaatggaaaaggtcacttgagggtgaagattctattttatcttgttctaattgggaataaacaatccacactttatgagcccgcaatttcagttgattctatgtgctgcttcttctccttcttcctcttcaacaactccaattttccttttgaaaaggaataatcaataacacaaagacaaatccaatcaatcagagcaaaatccaaatgggtaatcttttctgttgtgtacaagttgaccagtctacagtagccattaaggagagatttggcaggtttgaggatgttcttgaacctggatgccattgcctaccttggtttcttggaagtcaacttgctggccacctgtcgctaagattgcagcagttggatgttcgttgtgaaaccaagactaaggacaatgtatttgttaatgttgttgcatctattcaataccgggcactggcagacaaggcaagtgatgccttttacaagctgacaaacacaaggacacaaattcaagcctatgtgtttgatgttattagagcaagtgttccgaagctaaatctggatgatgtttttgaacaaaagactgaaattgctaaagctgttgaagaagaacttgagaaggctatgtctgcctatgggtatgagattgttcaaacacttattgtggacatagaacctgacgagcatgtgaagcgtgcgatgaatgaaattaatgccgctgcaaggctgagagtggcagctaatgagaaggcagaggctgagaaaattttgcaaatcaaacgagctgaaggtgaggctgagtccaaatatttgtcagggctgggtatcgctcgccaacgacaagcaattgttgatggtttgcgagatagcgtgcttggattctccgttaatgtcccggggactactgcaaaggatgttatggatatggtcctggttacccagtactttgacaccatgaaagaaattggtgctgcttctaagtcctcagctgtgtttatccctcatggtcctggagctgttcgtgatgtcgctactcagattcgtgatggactcctccaggccacacaccagtaactatatgattttttcttaagacaagacaagacaagcattagtagttttttaaggataatacctggttttaacgttacctgtttagttctggatgtcatttttacattatgagcactggatgtacatatggtgtgggcataaacggtttgtgaaatgcgtaagatattttatactcttatagatgttgagtgatctttattatggatttttcttggttctattgtcgccatggatgaaggttgaacaattcttttatcaaaaattggtcacaaatgagttcatttcaagaagggttcaaattcaagaataatatgcaatcgattccaatt

SEQ ID NO: 3547 - DNA, 1099 bp, Raphanus sativus
gcttaacaaaaaaacgtctcatctaagatcaaacccagaagaaaatcaaaagacgagtgaagaaagatggggaacttgttgtgctgtgtacaagtggaccagtcaacggtggcgataaaagaaacgtttgggaagttcgaagatgttctagagcctggttgccattttctcccatggtgtcttggtcagcaagtcgctggttacctctctctcaggcttcggcagttggatgttcgctgcgagactaggaccaaggacaatgtgtttgttaatgttgttgcatcgattcagtaccgtgccttggctaataatgccaatgatgccttctacaaactcagtaacactaggagccagatccaagcttacgtctttgatgttatcagagcaagtgtccccaagctgattctggatgatgtctttgagcagaagaatgaaattgccaaagctgttgaagaggagctcgagaaggcaatgtctgcttacggttttgagattgtccaaactctcatcgttgacatcgagcctgacgaacatgtcaaacgagccatgaacgaaatcaacgctgctgcaaggatgaggttggctgcaaacgaaaaggcagaggctgagaaaatcctccagatcaagcgagctgaaggtgaagccgaggccaagtacctgtctggtctaggtatcgcccgccagaggcaagccattgtcgacgggctacgcgacagcgtccttggtttctctgtgaatgttcccgggacaactgctaaagatgtgatggacatggtgctcgttacgcagtacttcgacacgatgaaggagattggtgccagttccaaatcctctgctgtcttcattccccacggaccaggagctgtacgcgatgtggctactcagatcagagatgggctccttcaaggctcctttgcagaccagtcctgaaatatagataatggactgatcattatatgttctctactaagcttgctgtgtgttaagatcctatgatcttgtgctgagaaactctcatgctttaggtttctatatttccacgtatttggagtgtgcaaccaaaaaatcgtaattaatcaaataatctatatgttgacca

SEQ ID NO: 3548 - DNA, 1268 bp, Triphysaria pusilla
gtgttagtgtatatctatgtatgtatatataaaacatgctttgctttgctagatagcttgttccatctcagcccactcaaaaccctctgcctgccgttgaatcatcaattcacatattcctccgccaactaatatgggaaatttattttgctgcattcaagtcgaccaatcgacggttgcgattaaggagaggtttgggagatttgttgaagtcttagagccaggctgtcactgtctgccatggtgtctcggtagccagctcgccggccatctcactctccggctccagcaattagacgtccgttgtgagaccaagactaaggacaatgtttttgtcaatgttgttgcgtcgattcaataccgtgccattgcgaataaggcgagcgatgctttttacaaacttagcaacacgaaggggcagattcaggcctatgtctttgatgtgataagagccagtgttccaaacatgaaccttgacgatgctttcgagcagaaaaatgaaattgctaaagctgttgaagatgagctcgaaaaggctatgtctgcatatggatatgaaattgtccaaactctgattgttgacatagagccagacgagcatgtgaagagggccatgaacgaaattaacgctgctgctaggatgagggtggctgcaaatgaaaaggctgaagccgaaaagattttgcagatcaagagagctgaaggtgaagcagaggctaaatatctctcgggtttaggtatagctcgtcaacgtcaagcaattgtggacgggctaagagacagtgtgctgggcttttccgttaatgtccctgggaccactgcaaaggacgttatggacatggtcctcgtcactcagtacttcgacacgatgaaggaaattggtgcttcatccaagtcatcggcagttttcatcccacacgggcctggtgctgttcgtgatgtggcatcccagattcgtgatgggcttcttcagggatccatggtttaaggcttgtttgtttggaaataaataagactttatcaacattgttattacgtcgtgttagttgttttgttttctgctttgtgggatatatatactggtattagtgtgaaaaaatgtgtatatgggctacttaagacagtacagattgtttgtgttttgctattcatttcttaagtctctttgtttgtcggtcagttatgttctgtgcatatatggtatgtggggttttttgagcttgtttttctttggcatgcgtaaaaatatatgtgctcgtctttcttct

SEQ ID NO: 3549 - DNA, 1243 bp, Flaveria ramosissima
aaacgacgtgaacaatgagttcccaaaatatcattatcattacagcaagtgcataactggtgaaatttcaatatttttcctataagtaacacctgcaaactatcttctccaccacgttatccccttgcaaccacccttcattcgtgtgatatcatgggcaatctgttgtgtttggttcaagttgatcaatccactgttgcaattaaggagacttttgggaagtttgatgatgttcttgagccagggtgccattgtgtgccgtggatattcggaagccggcttgctgggcatctcacactcagggttcagcagttagatgtcaagtgtgagaccaaaacaaaggacaatgtctttgtcaatgttgtagcttcagtacagtatcgtgctctttctgaaaaggcgaatgatgcattctacaaacttagcaacacaagggcccaaatccaggcctatgttttgatgttataagagctagtgttccaaagcttaaccttgatgatgcgtttgagcaaaagaatgaaattgctaaggctgtggaagaagaacttgaaaaggcaatgtctgcatacggttttgagattgttcaaactctgattgttgatatagaaccagatgagcatgtgaagagagcaatgaatgagatcaatgcagctgcaaggctgaggatggcagctgctgagaaagccgaggctgagaaaattctacaaatcaagagagctgagggtgaggcagagtccaagtacctctctggtttgggtattgcacgccaaagacaagccattgtggatggattacgagacagtgtcttgggtttctcagtcaatgtgcctggaaccacagctaaagacgtgatggacatggttctagtgactcagtattttgacaccatgaaggaaattggcgctgcatccaagtcatctgctgtgttcatccctcatggacctggtgctgttcgtgatgtggctactcagatacgtgatggtcttcttcaaggcagcgcggctagttgattgcctggactttgatggcctgatccaatctatgcaaccctaaggagtacagtttcgtgtttctttagtacctgtggtttatattttcaactaaaagtttgtgagtttgtgtgctaagcttctgtttaggtttatgaaattgatgtctatatacttcctgcttgagtttggttttttaagttttagtaatacctttggaacaagtgttatataatatgatatatcaatcaaaa

SEQ ID NO: 3550 - DNA, 1049 bp, Gossypium raimondii
agcaaaatccaaatgggtaatcttttctgttgtgtacaagttgaccagtctacagtagccattaaggagagatttggcaggtttgaggatgttcttgaacctggatgccattgcctaccttggtttcttggaagtcaacttgctggccacctgtcgctaagattgcagcagttggatgttcgttgtgaaaccaagactaaggacaatgtatttgttaatgttgttgcatctattcaataccgggcactggcagacaaggcaagtgatgccttttacaagctgacaaacacaaggacacaaattcaagcctatgtgtttgatgttattagagcagtgttccgaagctaaatctggatgatgtttttgaacaaaagactgaaattgctaaagctgttgaagaagaacttgagaaggctatgtctgcctatgggtatgagattgttcaaacacttattgtggacatagaacctgacgagcatgtgaagcgtgcgatgaatgaaattaatgccgctgcaaggctgagagtggcagctaatgagaaggcagaggctgagaaaattttgcaaatcaaacgagctgaaggtgaggctgagtccaaatatttgtcagggctgggtatcgctcgccaacgacaagcaattgttgatggtttgcgagatagcgtgcttggattctccgttaatgtcccggggactactgcaaaggatgttatggatatggtcctggttacccagtactttgacaccatgaaagaaattggtgctgcttctaagtcctcagctgtgtttatccctcatggtcctggagctgttcgtgatgtcgctactcagattcgtgatggactcctccaggccacacaccagtaactatatgattttcttactaagacaagacaagacagctattagttaagtttaagatactacgttagtttacgttacttgttgtgtgtagttattttactttactattagtgacgctacgtaggtagtacgtaactaattagtgggttgggtcgggactaaaacggtttaaaaccgggtttcggt

SEQ ID NO: 3551 - DNA, 1028 bp, Capsicum annuum
agagacaatggggaatctattttgctgtgtacaagttgaccaatcaacagtagctatcaaggagagatttggtaagtttgatgatgtccttgagcctggatgtcatttcttgccatggtgtattgggagccagattgctggttacctaactttaaggctccagcagcttgatgtgcgttgcgagaccaagacaaaggataatgtgtttgtaactgttgttgcttcaattcaatatcgtgctctgtctgataaagctaccgatgctttttacaagcttagtaatactcgatcccagatccaagcctatgtgtttgatgttatcagagcgagtgttccaaagataaatctggatgatgtctttgagcagaagaatcaaattgctaaagcagtggagaatgaacttgaaaaggcaatgtctgcttatggttatgagattgttcagacactcatagttgatatagagccagatgaacacgttaagcgagctatgaatgaaatcaatgcagctgcaaggttgagggtagccgccaatgagaaagcagaagctgaaaaaattgtccagattaaacgagctgaaggtgatgctgaggctaagtacctagcaggactaggagttgctagacaacgccaggccattgttgatggtttaagggacagtgttcttggtttctcggttaatgtcccaggaactactgccaaggacgtcttggacatggtcctcatcactcagtattttgacaccatgaaggaaattggtgccagctccaaatcctcggcagtctttatcccacatggacctggtgctgttggtgacattgctgggcagattcgacaaggattactccagggtgcagctgtcgagcaacaaaatcttttatagatgtattccagtaccttgtgtggttatggttatgtagtaatgtctcctgatttgtttatgatggccactattattctccacatatgtgttttgctaatgtaattacatgcagttttataagtcactattgccatctaattggcaggtt

SEQ ID NO: 3552 - DNA, 1425 bp, Aristolochia fimbriata
tgcttgcagggggaatcagtttccgcggaagtaacaaactcgcgggagaagatcagcttggacgaaactgtggagtactttcctttcgattgttaattattttcctgttaatggcgataccgtgggcgcgctgacgtctctctgcagagcaatttcgcatgatcctcggggctctgttgatctcatcctctgttactttgtatgtatagataaggaagggaaaggaggtgaagtcgccttgttgcttccgaagtgaaaaaggctcgaggagaagatatactccgaaattacaagtgagtagacactatgggtcaagttctcggttgtgttcaagtagatcaatcaacagtggctattaaagaaagatttggaaaatttgaggaggtgcttgagcctggatgccactgcctgccttggtgcttgggtagtcagctggctggacatctttcattgaggctccagcagctggatgtcaaatgtgagacaaaaacaaaggacaatgtttttgttaatgtggttgcctctatacaataccgtgccttggctgacaaggcaagcgatgcattctacaaacttagcaatacgaggagccaaatccaggcatacgtgtttgatgtaattcgagccagtgtccctaagctgaacctagatgatgctttcgagcaaaagaatgaaattgctaaagcagttgaggatgagcttgagaaggctatgtctgcatatgggttcgagatcgtccaaacactcattgtggatatcgaacccgatgagcacgtcaaacgcgccatgaatgagattaatgctgccgcacggatgagggtcgcagcgaacgagaaggccgaagccgagaaaatcctccaaatcaagcgcgcggaaggtgaggccgaatccaagtacctctccggtctgggtattgctcgtcagcgccaagcgatcgtcgacgggttgagggacagcgttctgggtttctccgtcaacgttcccgggacaactgccaaggacgtgatggacatggttctggtgacccagtacttcgataccatgaaggagatcggagccgcgtccaaatcgtcggcggtgttcatcccccacggccccggcgccgttcgcgacgtcgccactcagatccgtgaagggttgcttcaggcatcgagcgctcatgtctagcttggatgagaattgagattgagatgacccccactaccattgcctgcctggaaagtcgtgtaaagtgtttgtccgtaatgtttaaggttgttctcttcttcttctttttttcttggtatatactccgattatcgtaaaaatggtgtttttggaattgttagacggtggtcttgtaagatgggtgaacagagtgatcaattcaatactctttatcatattatagccacttagaaatagcagttttaggtggccggcgtg

SEQ ID NO: 3553 - DNA, 1082 bp, Capsicum annuum
gcacgaggcatactttctctgcagaacgaattgacctctgcaaaatagtaatcaagagacaatggggaatctattttgctgtgtacaagttgaccaatcaacagtagctatcaaggagagatttggtaagtttgatgatgtccttgagcctggatgtcatttcttgccatggtgtattgggagccagattgctggttacctaactttaaggctccagcagcttgatgtgcgttgcgagaccaagacaaaggataatgtgtttgtaactgttgttgcttcaattcaatatcgtgctctgtctgataaagctaccgatgctttttacaagcttagtaatactcgatcccagatccaagcctatgtgtttgatgttatcagagcgagtgttccaaagataaatctggatgatgtctttgagcagaagaatcaaattgctaaagcagtggagaatgaacttgaaaaggcaatgtctgcttatggttatgagattgttcagacactcatagttgatatagagccagatgaacacgttaagcgagctatgaatgaaatcaatgcagctgcaaggttgagggtagccgccaatgagaaagcagaagctgaaaaaattgtccagattaaacgagctgaaggtgatgctgaggctaagtacctagcaggactaggagttgctagacaacgccaggccattgttgatggtttaagggacagtgttcttggtttctcggttaatgtcccaggaactactgccaaggacgtcttggacatggtcctcatcactcagtattttgacaccatgaaggaaattggtgccagctccaaatcctcggcagtctttatcccacatggacctggtgctgttggtgacattgctgggcagattcgacaaggattactccagggtgcagctgtcgagcaacaaaatcttttatagatgtattccagtaccttgtgtggttatggttatgtagtaatgtctcctgatttgtttatgatggccactattattctccacatatgtgttttgctaatgtaattacatgcagttttataagtcactattgccatctaattggcaggtt

SEQ ID NO: 3554 - DNA, 1217 bp, Tripterygium wilfordii
taaattgatccgcaagtttctgattggttgtgacgagtagactttgtagtctatataaatctgttattggatttttcttactactccttgtctctgctcatacaatctgctgtttctttattatccttaaactagatgggaaatgtgtttggttgcattcaagttgaccagtcaactgttgctatcacggagcgatttggtaagtataatgaagttcttgagcctggatgtcattgcctcccttggtgttttggaagccagcttgcaggccatttgtcgctaaggttgcagcaattggatgtgcgatgtgagaccaagacaaaggataacgtatttgtcaatgtggttgcatcaattcaataccgtgccctcgcacacaaggcaaatgatgcattctacaaactgagtaatacgaggacccaaattcaggcctatgtgtttgatgtaatcagagcaagtgttccaaaacttaatctggatgatgtatttgaacaaaaaaatgaaattgctaaagccgtggaagaggaactcgagaaggctatgtctgcatatgggtttgagattgttcaaactctcattgttgatatagaaccagatgagcaagtgaaacgggcaatgaatgaaatcaatgctgctgcaagaatgagggtggcaaccaatgaaaaggcagaagctgagaaaattttgcaaatcaaacgagctgagggtgaggctgaggctaagtatctctcagggcttggcattgctcgtcagcgacaagcaattgtggatggtttaagagatagtgtgctaggcttctcagtcaatgtgccagggacaactgcaaaggatgtcatggacatggtgctggtcacacagtattttgacacaatgaaggaaattggtgctacctctaagtcctcagctgtcttcattccccatggacctggtgctgttcgtgacgttgctagtcagattcgtgatggactccttcagggctctgcctctgcacaccaatgattgttaatattttcctagtttttcaaggttgtgttgatacaggttatgtgtgcatactatgtttgtctgtcgaggttccttatcggaaagtcttgttaaatgttgatgtccatttaaaataatttctgtacaaattaccctggatgctatgttaaaacttaaaagtacaggagcgtcacagtacctccggatggtgatatttatctattgtgagcttt

SEQ ID NO: 3555 - DNA, 1084 bp, Nicotiana benthamiana
agagtatgggcaatttgttttgctgtgtacaagttgatcaatccacggttgcaattacggagcagtttggcaagtatcaagatgtgcttcagcctggttgccactgtctgccttggttctttggatttcagctggctggccatctctccctcagggtgcagcaactggatgttcgctgtgagacaaagacaaaggataatgtatttgtcaatgtagtggcatcaattcagtaccgtgctcttgcagacaaagcaaatgatgctttctatagactaagcaacactaagggtcaaattcaagcctatgttttcgatgtcataagagcaagtgttccaaaactcaatcttgatgatgtttttgagcagaaaaatgaaattgccaaggctgttgaggatgaacttgagaaggctatgtcggcttatggatatgaaattgttcagacacttattgttgatatagaaccagatgagcatgttaagagagctatgaatgaaatcaatgctgctgctcggatgaggttggctgctaatgagaaggcagaggctgagaagattttacaaattaaaagggctgaaggagaggcagagtcaaagtatctctcaggattgggtattgcacgacagcgtcaagcaattgtggatggtttaagagacagtgtgcttggcttctcagtgaatgtacctggaacctcggcgaaggatgtcatggacatggtccttttaactcagtactttgacaccatgaaagaaattggtgcttccagcaaatcatctgccgttttccttcctcatgggcctggtgctgtaagggatgtggcaagccagattcgcgacgggctccttcaagcttctacggagcattaaatgttctctctcagaaatgtcagtgtgtttcccttgaagcagccagctattttcccttttctctttattattttgtcaagtgtggaaatatgtggtgagattgactttgaagttgtgaatatactactatcctatgtacagaagcatgtaagtttttgaagatcttcagaccctttttgaagaattatgatttgctatctgatatttggcagcctagcctt

SEQ ID NO: 3556 - DNA, 1097 bp, Arabidopsis lyrata
aacttagctcttaagcaaatctaatcggagaacggagaaatttcggttgtgaagagaagaaaagatgggaaatttgttatgttgtgttcaagtggatcaatcaacggtagcgataaaagaaacattcgggaaattcgaagaagttcttgagcctggttgccattttcttccatggtgtcttggtagtcaagttgctggttacctctctctaagggttcagcaactagacgtccgttgcgagaccaagactaaggacaatgtgtttgttaatgttgttgcatcgattcagtaccgtgccctagctaataaggccaatgatgcctactacaaactcagcaacacaaggagtcagattcaagcttatgtgtttgatgtcattagagcaagtgtcccaaagttgcttcttgatgatgtctttgagcagaagaatgatattgcaaaagctgttgaagaggagctcgagaaggcaatgtcggcttacggttatgagattgtgcaaactctcattgttgatatcgagcctgatgaacatgttaaacgggccatgaacgaaatcaacgctgctgcaaggatgagattggctgcaaacgagaaggcagaggctgagaaaattctgcagattaagcgagctgaaggtgaagctgagtccaagtacctctcgggtctgggtatcgcccgtcagagacaagcgattgtagatggattacgcgacagtgttttgggtttcgctgtgaatgtgcctgggacaactgctaaagatgtgatggacatggtgcttgttacacagtactttgacacaatgaaggagattggtgctagctccaagtcttctgctgtgttcataccgcatggaccaggagctgttcgcgatgttgctactcagatcagagatggccttcttcaaggctcgtccgcaaacctttcttgaagtggattgactgattatgttctcttctctttgactatggtgtgatgtgattatcatctcttctttcttttggattatgttcgaactctttttttctttttttttccttttttatttctatttagtattgtagtacatgaattatggtggtataatcaaactcgtgaac

SEQ ID NO: 3557 - DNA, 1275 bp, Arnica chamissonis
acctttcattctgtaaaccttctcaccatctatcttctgatttcaattttggatatctagggcttccgtgatcttcttatctcatagtgctataaaattctttctcctaatttgggttactcaaagctatcaattacgtcttctgcaaaatcaattttctgttgtgtgtaatatcatgggcaacctactctgtttggttcaagtagatcaatctactgttgctattaaggagacttttgggaagtttgatgatgttcttgagccaggttgtcattgtgtgccttggatattcggaagtcagcttgctggacatctcactctcagggttcagcagttggatgtcaagtgtgagaccaaaaccaaggacaatgtcttcgtcaatgttgtagcttcgatacaatatcgtgctatggctgataaggcgagtgatgcattctacaaactcagcaacacaagggaacaaatccaggcctatgtttttgatgttataagagctagtgttccaaagctcttacttgatgatgtgtttgagcaaaagaatgatattgcaaaggctgtggaagaagaacttgaaaaggcaatgtctgcatacgggtatgagattgttcaaacattgattgttgatatagaaccggatgagcatgtgaagagagcaatgaatgagatcaatgcagctgcaaggctaaggatggcagctactgagaaagcagaggctgaaaaaattctacaaatcaagagagccgaaggtgaggccgagtccaagtacctctctggtttgggtattgcacgccaaagacaagccattgtggatggtttaagagacagcgtgttgggtttctccgtcaatgtgcctggaaccacggctaaagacgtgatggacatggttctagtgactcagtattttgacaccatgaaggagattggtgcttcatccaagtcatctgccgtgttcatccctcatggacctggtgctgttcgtgatgtggctactcagatacgcgatggtcttcttcaaggcaatgctgctagttgattgttcaacttttatggacagatctttttaatgcaacactaagagtacagtttcatatttctttagtaactgtggtttatattttcagtttcgtgaaaacttgtgagcttgtgtgtgctgtgtgtgtggatataggtttttgaaattgatgactatatatttcctgcttgaatttgggttttagatgtatggttattagaagggttgtgttcacgggtctaacccagcatgaacccgaaatt

SEQ ID NO: 3558 - DNA, 1236 bp, Citrus clementina
aatgaagctaatccaattggtctctttgacttttgtgcatctagcaatataattggcttatcttgttccttcttacctacgctagcatcttgtcccattgcttcattgtgaagaatatacgagtaagactagagaaaaatggggaatgcattctgttgtgtacaagttgatcagtctacggttgctataagggagagatttggcaagtttgacgaagttcttgatccgggatgccattgcgtgccctggcttctaggatgtcagattgctggtgatctctcactcaggctgcagcagttggacgtgcgctgtgagaccaagacgaaggataatgtgtttgtcaacgtagtggcatccgtccagtaccgtgccctggccaaaaaggcgagtgatgctttctacaaacttagcaacaccagaactcagattcaagcctatgtttttgatgtgatcagggcaagtgttccaaagctagatttggatgatgtttttgagcagaagaatgatattgcaaaagctgttgaagaagagctcgaaaaggcaatgtctgcttatgggtatgagattgtccagacactcattgtagatatcgaaccagatgtgcacgtcaaacgggcaatgaacgagatcaatgctgctgcaaggctgagggtagcagctaatgagaaagcagaagcagagaagattgtacagataaagcgagcagaaggtgaagctgagtccaagtacctagcgggagttggtattgccaggcagcgccaggcaattgttgatggcctgagagacagcgtgcttggcttctcagaaaatgtaccaggaactactgccaaggatattttagacatggtacttatcactcagtatttcgacaccatgaaggaaattggcgcttcctccaagagctcatcagtctttattccacatggacctggagctgttcaggatattgcaacacagattcgaaatggattgcttcaggcatcctcacactagcagctataagccgtcttcactgtcaccatgtatgcagctgcttctgtaagtgaccgattggttaccgcgtgtgtctacataatacttgctatgtcaaacctgttatgtgcaaatgtcatgtcatgcgtgctacttcttgaaaaccaaaccagaaattgtgcaagtatgcactttatacgtttttggagtaggtgatgaattagataaaatcgattggaagatgatgattactgcaggcaacaa

SEQ ID NO: 3559 - DNA, 1300 bp, Citrus clementina
ggacttcccttaatttgctgttaacttaactaaaaaacgcatagaaagtttggagaagtttcctaggccaagcttttgtttctatttaagtcccttgatttagttgtttgtttctatcactatatatcttcctacagcggcatttgcattcaccattttgtttctgcattgatttagtgtaaagaagatggggaatctgttctgttgcgtacaagttgaccaatcaacagtggctattaaggagagatttggcaagtttgaggatgtccttgaacctggatgccatttcctcccatggatccttggacatcagctagctggtcaccttacactcaggctgcagcagttagatgttcgttgtgaaaccaagactaaggacaatgtatttgtcaatgttgttgcatctgttcaataccgtgccctggcacataaggcagatgatgctttctataaactcagcaacacaaggactcaaattcaggcctatgtctttgatgtgattagggcaggtattccaaagttaaatctagatgacgcatttgagcaaaaaaatgaaattgccaaagctgtggaggaggagctcgaaaaggctatgtctgcttatggctatgagattgttcaaacacttattgtcgatatagaacctgatgagcatgtcaagcgggcaatgaatgaaattaatgctgctgcaagactgagggtggcagctaacgagaaggcagaggcagagaaaattttacagatcaaacgagctgaaggcgaggctgagtctaaatatctgtcagggcttggtattgctcggcagcgacaggcaattgtggatggcttgagagacagtgtgctgggtttttctatcaacgttccaggaaccacggcaaaggatgtgatggacatggtcctggtcacccaatacttcgacaccatgaaggaaattggagctgcttctaaatcatctgctgtctttattccccatggacctggtgccgttagagatgtagcgacacagatccgtgatggacttcttcaggcgtctcaacaccagtgaatcgttaattgataaggcttatctagttttggtatcaagacaagttttcattttgatctattccgaagtttccatgtgctctgttttattcttggcaaattgtggtccttaatttgttttattgcaacaaacttaccgagcttaagactttccagtggttgttgaaagatctgtcaattggccgactactttcgcttctttgtcccacaaattatgcgtggttatagtaatcataattcctcaacagcttttgca

SEQ ID NO: 3560 - DNA, 1222 bp, Flaveria ramosissima
caatgacttgccaaaatatcattatcattacagcaactgtgtaactggtgaaatttcaacatttttcctataagtaacacctgcaaactatcttctccaccacgttatccgctgcaacaatccttcattcgtgtgatatcatgggcaatttactgtgtttggctcaagtagatcaatccactgttgcaattaaggagacttttgggaagtttgatgatgttcttgagccagggtgtcattgtgtgccttggatattcggaagccggcttgcggggcatctcacactcagggttcagcagttagatgtcaagtgtgagaccaaaacaaaggacaatgtctttgtcaatgttgtagcttcagtgcagtatcgtgctctttctgaaaaggcgagtgatgcattctacaaactcagcaacacgagggcccaaatccaggcctatgtttttgatgttataagagctagtgttccgaagcttaaccttgatgatgcctttgagcagaagaatgaaattgctaaggctgtggaagaagaacttgaaaaggcaatgtctgcatacggttttgagattgttcaaactctgattgttgatatagaaccagatgagcatgtgaagagagcaatgaatgagatcaatgcagctgcaaggctgaggatggcagctgctgagaaagccgaggctgagaaaattctacaaatcaagagagctgagggtgaggcagagtccaagtacctctctggtttgggtattgcacgccaaagacaagccattgtggacggattacgagacagtgtgttgggtttctcggtcaatgtgcctggaaccacggctaaagacgtgatggacatggttctagtgactcaatattttgacaccatgaaggaaattggcgctgcatccaaatcttctgctgtgttcatccctcatggacctggtgctgttcgtgatgtggctactcagatacgcgatggtcttcttcaaggcagtgcggctagttgattgtctggactttgatggcctgatccgttctatgcaaccgtaacgagtacagtttcttgtttcttcagtacgtatggttatattttcaactacgtgatgtttgtgagtttgtgtgttaagcgtgcgtttaggcttataaacttgatgtctatatacttcctgtttgaatttggttttctaagttctattaatatccctttgaaacaagtgttatataatatgat

SEQ ID NO: 3561 - DNA, 1192 bp, Flaveria ramosissima
cataactggtgaaatttcaatatttttcctataagtaacacctgcaaactatcttctccaccacgttatccccttgcaaccacccttcattcgtgtgatatcatgggcaatctgttgtgtttggttcaagttgatcaatccactgttgcaattaaggagacttttgggaagtttgatgatgttcttgagccagggtgccattgtgtgccgtggatattcggaagccggcttgctgggcatctcacactcagggttcagcagttagatgtcaagtgtgagaccaaaacaaaggacaatgtctttgtcaatgttgtagcttcagtacagtatcgtgctctttctgaaaaggcgaatgatgcattctacaaacttagcaacacaagggcccaaatccaggcctatgtttttgatgttataagagctagtgttccaaagcttaaccttgatgattcgtttgagcaaaagaatgaaattgctaaggctgtggaagaagaacttgaaaaggcaatgtctgcatacggttttgagattgttcaaactctgattgttgatatagaaccagatgagcatgtgaagagagcaatgaatgagatcaatgcagctgcaaggctgaggatggcagctgctgagaaagccgaggctgagaaaattctacaaatcaagagagctgagggtgaggcagagtccaagtacctctctggtttgggtattgcacgccaaagacaagccattgtggacggattacgagacagtgtgttgggtttctcggtcaatgtgcctggaaccacggctaaagacgtgatggacatggttctagtgactcagtattttgacaccatgaaggaaattggctcaacatccaaatcatctgctgtgttcatccctcatggacctggtgctgttcgtgatgtggctactcagatacgcgatggtcttcttcaaggcagtgcggctagttgattgtctggactttgatggcctgatctgttctatgcaaccgtaaagagtacagtttcgtgtttctttaatacgtgtggtttatattttcaactacgttaaggttctgagtttgtgtgctaagcgtgtgtttagttttatgaaattgatgtctatatacttcctgtttgaatttggttttctaagttttagtaatacctttggaacaagtgttatataatatgatttatcaatc

SEQ ID NO: 3562 - DNA, 1090 bp, Flaveria ramosissima
ttgggggacttttctttctcctttctcatcgacgactccactcgtatttggcttccacgtctccttcctgatcatgggaaacctatgttgtttgtatcaagtggatcaatctactgtggctattaaggagtcttttgggaaatttgatgatgttttggagcctggatgtcactgtgttccatggatatttggtaaacagcttgctggttatctttctctcagagttcagcagttggatgtcaagtgtgagactaaaactaaggataatgtctttgtgaatgttgttgcttcaatacaataccgcgctttggctgataaagcaaatgacgctttctataaactcagcaacacaaggtcccaaatccaggcctatgtgtttgatgttataagagcttttgttccaaagctgaatctagatgatgcttttgagcaaaagaatgaaattgcaaaggccgttgaacaagaacttgaaaaggctatgtctgcatacgggtacgagatagttcagacactgattgttgatatagaaccagatgagcatgtaaagagagcaatgaatgagatcaatgctgctgcaaggttgaggatggcggctgctgagaaagcagaagctgagaaaattctgcaaatcaagagagccgagggggaagccgagtccaaatacctgtcaggtttgggtatagcccgccaacggcaagccattgtggacggtttgagggacagtgtgttgggattctcagtcaatgtccctggaaccactgcaaaagatgtaatggacatggttctagtgactcagtattttgacaccatgaaggaaatcggtgcgtcttccaagtcgtcagccgtgtttctccctcatggacctggtgcggtccgtgatgtagcctcccagattcgtgatggactccttcaaggttctgctgccacttgatttgcagcttaatatgctcctcatgattggaatgaagttgcttaagtatatcactgtttgtgttttacttttgagttttgtaggagctaaacttgttttgttttgtaacctttctttgtgtctttaagtgtatattcatttcaaacttgaatattaagg

SEQ ID NO: 3563 - DNA, 970 bp, Flaveria ramosissima
tttctcatcgacgactttactcgtatttggcttccacgtctcctccctggatcatgggaaacctcttttgtttgtatcaagtggatcaatcgactgttgctattaaggagtcttttgggaaatttgatgatgttttggagcctggatgccactgtgttccatggatatttggtaaacagcttgctggttatctttctctcagagttcagcagttggatgtcaagtgtgagactaaaacaaaggataatgtctttgtgaatgttgtggcttcaatacaataccgcgctttggctgataaagcaaatgacgcattttataaactcagcaacacaaggtcccaaatccaggcctatgtgtttgatgttattagagcttttgttccaaagctgaatctggatgacacttttgagcaaaagaatgaaattgcgaaggcagttgaacaagaacttgaaaaggctatgtctgcatatgggtacgagatagttcagacattgattgttgatatagaaccagatgagcatgtaaagagagcaatgaatgagatcaatgctgctgcaaggttgagaatggcggctgctgagaaagcagaagctgagaaaattctgcaaatcaagagagccgagggggaagccgagtccaagtacctgtcgggtttgggtatagcccgccaacggcaagccattgtggacggtttgagggacagtgtgttgggattctcagtcaatgttcctggaaccactgcaaaagatgtaatggacatggttctagtgactcagtattttgacaccatgaaggaaatcggtgcgtcttccaagtcctcagctgtgtttctccctcatggacctggtgctgttcgtgatgtggcctcccagatacgtgatggactccttcaaggttctgctgccacttgatttgcagctcaatttgctcctcatgattggaatgaagttccttaagtatatctgtttgt

SEQ ID NO: 3564 - DNA, 1104 bp, Ipomoea nil
gagttgaatttagttattctctccagcttgacgccatttgcggttgcttcatcgttttctttcctcggagaagatgggaaatctgttctgctgtgtccaagttgatcaatccactgttgcaattaaggaacgttttggcaagtatcaagatgtgctagagccaggatgccactgtgtgccttggtgccttggaagtcaactggctggtcatctcaccctccggctgcagcaactggatgtgcgctgtgagaccaagacaaaggacaatgtgttcgtcaatgttgttgcttcaattcagtaccgtgccctggctgacaaggcaaatgatgctttttacaaactaagcaacactaagggtcaaattcaggcatatgtttttgatgtaatcagagctagtgttccgaaactcaaccttgacgatgtttttgagcaaaaaaccgaaattgccaaggctgttgaggatgaacttgagaaggctatgtctgcctacggctatgaaattgttcagacactcattgttgatatagaaccagatgagcatgttaagaaagctatgaatgaaatcaatgctgctgctaggctaagggttgctgctaacgagaaggccgaggctgagaagattttgcagattaagagggctgagggtgaggcggaggcgaagtacctctcagggttaggtattgcccgccaacgccaagccatcgtggacgggcttagggacagcgttattggattctcagtgaacgtgccaggaaccacagccaaagatgtgatggacatggttctcgtgactcagtactttgatacgatgaaggaaattggcgctgccaacaaatcatccactgtcttcatcccccatggccctggggcggttcgcgatgtggcttcccagatccgtgatggccttcttcaggcttcccagtctgaccatcctcactaaatactctcaaaactcttcagacttttttcaggcttgtataaacgcgtttttaccatttccgattgtgtgtttactttactaggtgtggagattgtgaaatgtcaatactattatcaacttatattggtgtggaagaagattgtgaatgttagttaacaagaaga

SEQ ID NO: 3565 - DNA, 1196 bp, Quercus alba
cttggccagatgggttggggcacttttatgggaaaagccgccggcttgtgatttgtgaacccagagtttgagattacttgaaaagaaaattcctgatataataacacagtatacagaagatgggtaatctgctttgttttgtacaagttgaccaatccactgtggctatcaaggagaaatttggtaagtttgaggaagttcttgagccaggatgccatttcttgccttggtgccttggaagtcagctttctggtcatctcactcttcggttacagcaattggacgtgcgatgtgagactaagacaaaggacaatgtatttgtcaatgtcgttgcctctattcaataccgtgccctggcagacaaggcaagcgatgccttttacaaactcagcaacacaagaagccaaatccaggcctatgtgtttgatgtaatcagagcaagtgtcccaaagctcaccttggatgatgcctttgtacagaaaaatgacattgccaaagctgtagaagatgaacttgaaaaggctatgtctgcttatgggtatgaaattgtacaaacactcattgttgatatagaacctgacgagcatgtcaagcgagcaatgaatgaaatcaatgcagctgcaagaatgagggtggcagccaatgagaaggcagaggctgagaaaatcttgcaaattaagcaagctgagggtgaggctgagtcgaagtatttgtctgggctgggtattgcccgccaacgacaagcaattgttgatggattgagagatagtgtgttgggcttctctgttaatgtgccggggaccacgccaaaggatgtcatggacatggttcttgttacccagtattttgacacaatgaaggaaattggtgctgcctcaaaatcctctgctgtgttcatccctcacggacctggtgctgttcgtgatgtagcatctcaaattcgtgatggacttcttcagggttctgttcaacattagggttacttttccagtttttccccctttgtgtattgaaacgaggtctatgcatgttgatgtttctctgcaagtttttcagcgtgttatgtaatctatcttgatgcaactgtcatgtctgtttgtgaattatgataattattgtaaataggagacttaaagatgtctcgtatgtacagatcttcaagcttgaatatgacacagctaaaattgcttctagtt

SEQ ID NO: 3566 - DNA, 1236 bp, Citrus sinensis
aatgaagctaatccaattggtctctttgacttttgtgcatctagcaatataattggcttatcttgttccttcttacctacgctagcatcttgtcccattgcttcattgtgaagaatatacgagtaagactagagaaaaatggggaatgcattctgttgtgtacaagttgatcagtctacggttgctataagggagagatttggcaagtttgacgaagttcttgatccgggatgccattgcgtgccctggcttctaggatgtcagattgctggtgatctctcactcaggctgcagcagttggacgtgcgctgtgagaccaagacgaaggataatgtgtttgtcaacgtagtggcatccgtccagtaccgtgccctggccaaaaaggcgagtgatgctttctacaaacttagcaacaccagaactcagattcaagcctatgtttttgatgtgatcagggcaagtgttccaaagctagatttggatgatgtttttgagcagaagaatgatattgcaaaagctgttgaagaagagctcgaaaaggcaatgtctgcttatgggtatgagattgtccagacactcattgtagatatcgaaccagatgtgcacgtcaaacgggcaatgaacgagatcaatgctgctgcaaggctgagggtagcagctaatgagaaagcagaagcagagaagattgtacagataaagcgagcagaaggtgaagctgagtccaagtacctagcgggagttggtattgccaggcagcgccaggcaattgttgatggcctgagagacagcgtgcttggcttctcagaaaatgtaccaggaactactgccaaggatattttagacatggtacttatcactcagtatttcgacaccatgaaggaaattggcgcttcctccaagagctcatcagtctttattccacatggacctggagctgttcaggatattgcaacacagattcgaaatggattgcttcaggcatcctcacactagcagctataagccgtcttcactgtcaccatgtatgcagctggttctgtaagtgaccgattggttaccgcgtgtgtctacataatacttgctatgtcaaacctgttatgtgcaaatgtcatgtcatgcgtgctacttcttgaaaaccaaaccagaaattgtgcaagtatgcactttatacgtttttggagtaggtgatgaattagataaaatcgattggaagatgatgattactgcaggcaacaa

SEQ ID NO: 3567 - DNA, 1063 bp, Helianthus annuus
gtgtgatattatggggaacttgctctgtttggttcaagtagatcaatctactgttgctataaaggagacttttgggaagtttgatgatgttcttgagccgggttgtcattgcgtgccttggatattcggaagtcggcttgctggtcatcttactctcagggttcagcagttggatgtcaagtgtgagaccaaaacaaaggacaatgtctttgtcaatgttgtagcttcgatacaatatcgtgctttgtctgataaggcgagcgatgcttactacaaactcagcaatacaagggcccaaatccaggcctatgtttttgatgttataagagctagtgttccaaagcttaatcttgatgatgtgtttgagcaaaagaatgatattgctaagactgtggaagaagaacttgaaaaggcaatgtcggcttacggttttgagattgttcaaacattgattgttgatatcgaacccgatgtgcatgtgaagagagcaatgaatgagatcaacgcagctgcaaggctaagggtggcggctactgagaaagctgaggctgaaaaaattctacaaatcaagagagccgagggtgaggctgagtcgaaatacctgtctggtttgggtattgcgcgccaacgacaagcgattgtggatgggttaagagacagcgtgttgggtttctcggtcaatgtgcccgggaccacagctaaagacgtgatggacatggttctagtgactcagtattttgacaccatgaaggaaattggggctgcatccaaatcgtctgctgtgtttattcctcatggacctggtgctgttcgtgatgtggctactcagatacgtgatggtcttcttcaaggcagtgctgctgctagttgattttcggagtttgatggcaatgcaatcataagagtagagtttcatgttttcttaagtaatcgtggtgtatgtttttaacttcgtgtgaagcttatgtgcggacgctatgtttgtgtatatagggttatgaaatgatgtctatatggatatttcctgcttgaatacggttttctaaatagaagccctgttgta

SEQ ID NO: 3568 - DNA, 1127 bp, Eutrema halophilum
ctcttacttgcaaacattctcagaaatctgaaagcaaacaggataaatttcgggtgtgaagaagatgggaaatctattttgttgtgtacaagtggaccaatcaacggtagcgataaaagaaacgttcgggaaattcgaagatgttcttgagcctggttgccattttcttccatggtgtcttggtagccaagttgctggttacctctctttgaggcttcaacaattggatgttcgttgcgagacaaagacaaaggacaatgtgtttgttaatgttgttgcatcgattcaataccgtgctattgccaatcaggccaatgatgctttctacaaactcagtaacactaaaggccaaattcaagcttacgtgtttgatgtcattagagcaagtgtccccaagctgcttctggatgatgtctttgagcagaaggatgaaattgcaaaagctgttgaagaagagctcgagaaggcaatgtcggcttacggttttgagattgtccaaactctcattgttgatatcgagcctgacgaacatgtcaaacgtgccatgaacgaaatcaacgctgctgcaaggatgagactggctgcaaatgaaaaggcagaggctgagaaaatcttgcagataaagcgagctgaaggtgaagctgaggccaagtacctctcgggtctaggtattgctcgtcagagacaagcgattgtagatggactacgagacagtgtcttgggtttctctgtgaacgtcccagggacaactgctaaagatgtgatggacatggtgcttgttacacaatactttgacacaatgaaggagattggtgcaagttccaaatcttctgctgtgttcattccgcacggaccaggagctgttcgcgatgtggctactcagatcagagacggtctccttcaaggctctttcgcagaccagtcttgaagtggatggactttctatgttctctttcttttactcagcttatggtgtgtgattaagatcttatgatggttttttttcattctctattcgattacagtgaatcttgttttgcttttttttgctttttttttggattttttccccttgctgtatagacatatttgggtttacaaccaaaatcgtaagtagcatcaaataa

SEQ ID NO: 3569 - DNA, 1713 bp, Cicer arietinum
ttttttttttttttttgaagtttgtttgtagtgcaaatgcatgatcagaatttccgcgaatcaattatccaatttgcctaaatttattaaatatatatatatatatatatatattccactttccattgttcggttgatgaattaaacaaagggaatttctaggttgctgttctgactataaatatataattgtttatgtatatgtcaatggaatatgccattaaaatataggttataattaatagtggcgatgaatatcaagaatacaatggttttttcttctcttagcattggtgagctactaaggttataatttcaagctaagtggagaagaactcttccaagtcaactttgcttttcaattcatatctttaatttgagttaaaacaatggggaatcttttttgttgtgtgcaagttgaccaatctacagtggctatgaaagaaggatttggacgatttgaagaagtgcttcagccgggatgccattgcatgccatgggttcttggaaaacgaattgccggccatctctctcttcggcttcaacaattggatattcgatgtgagaccaagacaaaggataatgtctttgtaaacgttgttgcttcgattcagtatcgtgccttggtaaacaaggcaaatgatgcattttacaaacttagcaacacaagaagccaaattcaagcttatgtttttgatgtaattaggggaactgttccaaaactcaacttggatgatgcttttgagcagaaaaatgaaattgcaaaagctgtggaagatgaacttgagaaggctatgtcggcttatggatatgaaattgttcaaacactgattgttgatatagagccagatgagcatgtgaagcgcgctatgaatgaaatcaatgctgctgcaagattgaggatggcagctaaagacaaggcggaggcagagaagatcttgcaaattaagcgagccgagggtgaggctgagtctaaatatctctctgggctgggtattgctcgccaacgtcaagccattgtggatggtttgagagatagcgtgcttggattttcagttaatgtaccggggacgactgcgaaagatgttatggatatggtccttgtcactcaatactttgatactatgaaagaaattggtgctgcctccaaggcttctgctgtgttcattccacatggacctggtgctgttcgcgatgtagctagccaaattcgtgatggacttctccagggttcttatcattagcttctatttctcctacatggtatctgatttgtatggaagtgtggttattttataatgcttaggttgtatctctgcagtatatatgtgatatgattttatatcagagtaagcttctgctgtgatcaaccaaatgttatggcatcactatatcagtcttgcaaagatatttttgtcattaagttaatccttcaatgatttaaaaccgtgtcacatttactcttaaggaaaatggtgacacaataccaatttgctaattgttttgtatctttgtgggattgatttggtgatgaaacctttggaggatgatttaaaggaattactcttgttttatactttttgtttgtaattctcattatatatatattaattttctacattataatgtatgcataactagactatcaactatcccttatatactggttttctacaatacattgtgaaagttgcattaaagaatttgtttata

SEQ ID NO: 3570 - DNA, 1287 bp, Solanum lycopersicum
gaatataattttgtttatgctattatagtttgtgtaaattatatattttcactctcctaagcacattaacccatatttaacccccacacctcgtgtctctctccgctgatatctgcaaaataataatcaaaagagacaatggggaatctgttctgctgtgtacaagttgaccaatccacagtagctattaaggagagatttggcaagtttgatgatgtgcttgagcctggatgtcatttcttgccatggtgtattgggagccaggtagctggttacctaactttaaggctgcagcagcttgatgtacgctgtgaaaccaagtcaaaggacaatgtatttttaactgttgttgcttctatacaataccgtgctctggctgataaagctactgatgctttttacaagcttagtaatactcgatcccagatccaagcctatgtgttcgatgtaatcagggcgagtgttccaaagctaaatctggatgatgtgtttgagcagaagaatcaaattgctaaagcagtggaggatgaacttgaaaaggcaatgtctgcttacgggtatgagattgttcagacacttatagttgatatagagccagatgaacatgttaagcgagctatgaatgaaatcaatgcagctgcaaggttgagagtagccgccaatgagaaagcagaagctgacaaaattgtccagataaaacgagctgaaggtgatgctgaggcaaagtacctggcaggactaggggttgctagacaacgccaggccattgttgatggtttaagggacagtgttcttggattttcggtaaatgtacctggaactactgccaaggacgtcgtggacatggtcctcattactcagtattttgacaccatgaaggaaattggtgccagctccaaatcctcagcagtctttatcccacatggacctggtgctgtgagtgacattgcagggcagattcgacaaggattactccagggttcagctgtcgagcaacaaaatcttttataaatttgtttcacagtctgtcgtgtgattctgttttgtaagtaatatttcttgatttgattatgatggccactattgttctctacatatatgttagttgctaatgtgatcacatgcaactatataagtcgaaggtttgtcgtcttatagtcggttctatgtattgtttcattgacatattactacatgccataaaaagtgatttttcactctagtgagcatcttgtgtaagctacaaacttgcgcctcctttggctataatacatatgcaagctccta

SEQ ID NO: 3571 - DNA, 1084 bp, Allium cepa
gataatgggtaacttgatatgctgcgtgcaagtagatcaatctacagtagctgttaaggaacagtttggaaagttcgatgaggttcttgatccaggatgccattgcatgccgtggttccttggcaagagagttgcaggtcatctttcccttcgtgtgcaacaactagatgtcaaatgcgagactaagactaaggacaatgtgtttgtcaatgttgttgcatccattcagtatcgtgctctagctgacaaggcaagtgatgcattctataagctgagcaacacaagatcgcaaatccaagcttacgtatttgatgtaattagagcgactgtcccaaagcttatactggatgatgtttttgaacaaaagaacgacattgcaaaagcggttgaagatgaactggagaaagcaatgtctgcctatggatacgaaatcgtgcagaccctcattgttgatattgaacctgatgtcaacgtgaagaaggcaatgaatgaaatcaatgctgctgcaaggctaagattggcagcaaatgataaggcggaagcggagaaaatcctacaaataaaaagagcagaaggagaagcagaatcgaagtacctttcaggacttggaattgctaggcagcgccaggctatagtagacggactaagggacagcgtccttggcttttcagtaaacgttcctggcaccactgctaaagatgtgatggacatggtcctggttactcagtatttcgatacaatgaaggagatcggtgctgcttctaagtcatctgctgtgttcattcctcatggtcctggtgctgtcagagatgtggctactcagataagggatggactgcttcaagcaaacgttggtcattaattaagtacattgctgcattgcttttatgtttgcttttagtattgtcttttttaccttgaacgtggcttgtgatttgtgaggatatatgcttgctatgcttttttactactttttacttggttggttgttgaaaatgccagtttgtacaaagacaagtgttagattgacgatcgtcgtttgacaggtttcatcgtgtaattatatatattggtttcttattgg

SEQ ID NO: 3572 - DNA, 1180 bp, Flaveria ramosissima
cgttatccccctgcaacaatccttcattcgtgtgatatcatgggcaatttactgtgtttggttcaagtagatcaatccactgttgcaattaaggagacttttgggaagtttgatgatgttcttgagccagggtgtcattgtgtgccttggattttcggaagccggcttgccgggcatctcacactcagggttcagcagttagatgtcaagtgtgagaccaaaacaaaggacaatgtctttgtcaatgttgtagcttcggtgcagtattgtgctctttctgaaaaggcgagtgatgcattctacaaactcagcaacacgagggcccaaatccaggcctatgtttttgatgttataagagctagtgttccaaagcttaaccttgatgatgcctttgagcagaagaatgaaattgccaaggctgtggaagaagaacttgaaaaggcaatgtctgcatacggttatgagattgttcaaactctgattgttgatatagaaccagatgagcatgtgaagagagcaatgaatgagatcaatgcagctgcaaggctgaggatggcagctgctgagaaagccgaggctgagaaaattctacaaatcaagagagctgagggtgaggcagagtccaagtacctctctggtttgggtattgcacgccaaagacaagccattgtggatggattacgagacagtgtcttgggtttctcagtcaatgtgcctggaaccacagctaaagacgtgatggacatggttctagtgactcagtattttgacaccatgaaggaaattggcgctgcatccaagtcatctgctgtgttcatccctcatggacctggtgctgttcgtgatgtggctactcagatacgtgatggtcttcttcaaggcagcgcggctagttgattgcctggactttgatggcctgatccgaatctatggcaccctaaggcgtacagtttcgtgtttctttagtacctgtggtttatagttttcaactaaaagtttgtgtgtttagtgtgctagcttctgtttaaggtttagtgtaattgtatgtctatatacttcctgtcttgtacggttttggttttttaagttttagttaattaccgtttaggtaacgaagttgttactattaatatgtattatatactaatacaaaacctagtatttacaaataaactaataa

SEQ ID NO: 3573 - DNA, 1079 bp, Flaveria ramosissima
aatttattgtgcttggttcaagtagatcaatccactgttgcaattaaggagacttttgggaagtttgatgatgttcttgagcctgggtgccattgtgtgccgtggatattcggaagccggcttgcggggcatctcacactcagggttcagcagttggatgtcaagtgtgagaccaaaacaaaggacaatgtctttgtcaatgttgtagcttcggtacagtatcgtgctctttctgaaaaggcgagtgatgcattctacaaactcagcaacacgagggcccaaatccaggcctatgtttttgatgttataagagctagtgttccaaagcttaaccttgatgatgcctttgagcagaagaatgaaattgccaaggctgtggaagaagaacttgaaaaggcaatgtctgcatacggttttgagattgttcaaactctgattgttgatatagaaccagatgagcatgtgaagagagcaatgaatgagatcaatgcagctgcaaggctgaggatggcagctgctgagaaagccgaggctgagaaaattctacaaatcaagagggctgagggtgaggcagagtccaagtacctctctggtttgggtattgcacgccaaaggcaagccattgtggatggattacgagacagtgtgttgggtttctcggtcaatgtgcctggaaccacggctaaagacgtgatggacatggttctagtgactcagtattttgacaccatgaaggaaattggcgccgcatccaaatcatctgctgtgttcatccctcatggacctggtgctgttcgtgatgtggctactcagatacgcgatggtcttcttcaaggcagtgcggctagttgatcgtctggactttgatggcctgatccgttctatgcaaccgtaacgagtacagtttcttgtttcttcagtacgtatggtttatattttcaactacgtgatgtttgtgagtttgtgtgttaagcgtgcgtttaggtttataaacttgatgtctatatacttcctgtttgaatttggatttctaagttctattaatacccctttgaaacaagtgttatataatatgatat

SEQ ID NO: 3574 - DNA, 1100 bp, Linum usitatissimum
ccacgcgtccgagaattctcacactacaactcaacatcgacactagaccgtctccaaaagaaaatatgggtaatctattttgctgtgtacaagtcgatcaatccactgtagcgataagggaacaattcgggaagtttgatgaagttctcgagcctggatgccactgtctgccatggtttcttgggagccaactagctggccatctgtctctgagagttcagcaactggatgttcgttgtgagaccaagacaaaggacaatgtttttgttactgttgttgcttctgttcagtatcgtgccctggcagagagggcaaacgatgctttctacaagctcagcaacactaggggccaaatccaagcttatgtgtttgatgttattagagcaagtgtcccaaaactcaatttggatgatacttttgagcagaaaaatgacatcgcgaaagctgtagaagatgaacttgaaaaggctatgtctcactacggctatgagattgtgcaaacgcttattgtcgacatagaaccggatgagcgtgtaaagaaggcaatgaatgaaattaatgctgctgcaagaatgagggtggcagctaatgagaaggcagaggctgaaaagattctgcaaatcaagcgggctgagggtgaggctgagtcgaagtacctttcagggttgggtattgctcgccagaggcaagcgattgttgacggtttaagggacagtgtgcttggcttttcttttaatgtacctgggacatctgcaaaagatgtcatggacatggtcttggttacacagtacttcgacacgatgaaggaaatcggtgctgcctctaaatcctctgctgtctttattccccatggtcctggtgcagttcgtgacgttgctgctcagattcgggatggacttctccagagttttgttgcataatgtgactcttcgagcttaataaatgattcccccgttgtttcaaacaagtgtgctaggtatgcaaatagtcgtctatagtgtggggtgttttctaaacgaattgaagtatgctttttttttatagaattgaagtacgcttttgttaccttgagatacagaaatgaaagttgcgtttgagat

SEQ ID NO: 3575 - DNA, 1145 bp, Orobanche aegyptiaca
catatcttcgcctaaacacacagttgaaaacccatccttttctccattgcccctgaatcaattatcatacccaccgaacagaacttttggttttaggatatgggaaatttattttgctgcattcaagtggaccaatccacagttgctattaaggaaagatttgggaaatttgaggatgtccttgagccaggttgtcactgtttgccgtggtgttttgggagccagctggccggacttctcactctccggctgcagcaattagatgttcgttgtgagaccaagaccaaggacaatgtgtttgtcaatgttgttgcatcaattcagtatcgtgcaattgcggataaggcaagtgatgctttttacaaactcagcaacacaagaagtcagattcaggcctatgtctttgatgtgataagagctagtgttccaaaaatgaatcttgatgatgcttttgagcagaaaaaccatattgctaaagcagttgaagaggaacttgaaaaggcaatgtcagcctatgggtatgaaattgttcaaactctaattgttgacatagaaccagatgagcacgtgaaaagggcgatgaatgaaattaatgcagctgctaggcttagggctgcggctaatgaaaaagccgaagccgaaaagattttacagatcaagaaagccgaaggtgaagccgaagccaagtatctctcgggcttgggtatagcccgccagcgtcaggctattgtggatggattaagagacagtgtcctcggcttttccattaatgtccctggaaccactgcgaaggatgtaatggatatggtcctcgtcacgcagtacttcgacaccatgaaagagatcggggctagttctaaatcctcggctgttttcattcctcacgggcctggtgctgttcgtgatgtggcttctcagattcgtaacggacttcttcaggcttctcacgattcttaagtggttaatgttggaaatatttataaataaactgaatcttgatttcatggggttaaattagactcgtttttcttgtctttagctttatggatatattggtgtgagtgttatattttggtttggccttcgcttgaagaaatgtaaatggaatattattgatgaattgtttgggcagtaaagatttgttt

SEQ ID NO: 3576 - DNA, 1479 bp, Arachis hypogaea
atccctttgaagttttcatctccaagtgcctatacttttctaggttgtgacaacatgatagctaacttagccggatttgtttgtcattttagttagctataaaattttattcatagacagtgttactaatttgttttttatatgtattccaatagaataatatatggttagaaaacaaattttgccatagttaatgaacatgaatatcaagaataggattaggatgtaatgtaattgtcgattcgcttgtaatttaagttaactgtacatgaaattctctctttcccaaatcccaattaagtagttagcaaagagaaagagccttctcagttctttcatcaaatcagcttttcaaagcctatctatagttttgagttaagagcaaatggggaatcttttctgttgtgtggtagttgaacaatcaacggtggttataaaagaaagatttggaaagtttgaagaagttctcgagccagggtgccattgcataccatgggtgaccggagaccggcttgccggtcatctctctctccgcctgcagcagttggatgttcgctgtgagactaagacaaaggataatgtatttgtcaatgttgttgcttctattcaatatcgagccctggcagacaaagccagtgatgctttttacaaacttagcaataccaagagccaaattcaagcctatgtttttgatgtgattagggcgagtgttccaaaactcaacttagatgatacttttgagcagaaaaatgatattgccagagctgtggaacaagaacttgagaaggctatgtcagcttatggttatgaaattgttcaaacattgattgttgatatagagccagatgagcatgtgaagagagctatgaacgaaatcaatgctgctgcaagattgagggtggccgcgactgagaaagctgaggcagagaagatcttgcaaattaagcgagccgagggcgaggcagagtctaaatacctctccgggctgggtattgcgcgccaacgccaagccattgtggatggtttgagagacagtgttcttggattctcagttaatgtaccggggacaactgcgaaagatgtcatggatatggtccttgtcacccaatattttgatacgatgagagaaattggtgctgcctccaagtcctctgctgtgttcattccacacggacctggtgcggttcgtgatgtagctacacagattcgcgatggacttcttcaggcttctcatcatcagacacatgagtagtttgcatgggaatatggtgatgcaatatatatacctatgattttcttttatgtgcagtgtgcaatgtgatatagtttcatactcagtaacaactaacaaggttctgattggtgttcaaccagaatgtaactaaatatatataaaatgatgatataaggaatgatgcactatctagtatccataaaattaggctaattgttgaatttagtagtatgctacttcacaat

SEQ ID NO: 3577 - DNA, 1769 bp, Cajanus cajan
gaggtttctcgcgttctcagtgaaaattggttttgaagtcgtcttttgttgacctgcactttgtaaatccagttatccgaaattttgaactgtacagttcttgggttgttttggagggtcaattgatcgattgagcaaaactgaattgtaggttgtatcagcatgacaactatgatagctagaatttccttgaatgtgataggtttgtcaagccagttaccttgcaatttctgagtttctaacaggcaatatataaattgtattttgtatgcctatggctatagaatatatatggttaaaacaaatacatcatgattaatggtggtggtgaatatatcaaggatagctcttatttgtctactctctgactcagtgttcaagagccacttgcttataatttaagcaagagctcccccaagtcagctttactttcgaagcctctatctttgagttaaaagaaaatggggaatcttttttgttgtgtgcaagttgatcaatctacggtggctataaaagaaagatttggacgatttgagaaggtgcttcagccaggatgccattgcatgccatggttccttggaaaacaacttgcaggtcatctgtctcttcggttacagcaattggatcttcgatgtgagaccaagacaaaggataatgtctttgtcaatgttgttgcttcgattcaatatcgtgccctggcagagaaggccaatgatgctttttacaaacttagcaatactaagacccaaattcaagcctatgtttttgatgtaattagggcaagtgttccaaaactcaacttggatgatgcttttgagcagaaaaatgaaattgccagagctgtggaagaagaacttgagaaggctatgtcagcttatgggtatgaaattgttcaaacactgattgttgatatagatccagatgagcatgtgaagcgggctatgaatgaaatcaacgctgctgcaagattgagggtggcagctaatgaaaaggcagaggctgagaagatcttgctaattaaacgagccgagggtgaggctgagtctaagtatctctctgggctgggtattgctcgccaacgtcaagcaattgtggacggattgagagacagtgtgcttggattctcaattaatgtacctgggacgactgcaaaagatgtcatggacatggtccttgtcactcagtattttgacactatgaaagaaattggtgctgcctccaagtcttctgctgtgttcattccacatggacctggtgctgttcgcgatgtagctacccaaattcgtgatggacttcttcaggcttctcatgggtagcctctactccacctagatcttgtatttggtttgtatgggggtatggtaaagctatagcgcctgtggttgtatatctgtatttctgtacagtgtgttttgtgattttgtttcagaataaactgcaaaaccggtcctccaaaaattatggcatcaccacattaatcttataaagatatttgttatcagactagtcccacaaatatctaaaatgttaccacatctgttcttatagaggactaaaatggtaagaagaaataatttagtgtttgatttgttagccaaaatctttggagggccagtttgattgatactttcaggcagtcaattattactgtgtattctgttgtcaatattgtgaaccatgcataactaaactattaagtatccatgtacatacaagttttctagattgtgaaagttgcatataagaaatttcttatatatcgttagaga

SEQ ID NO: 3578 - DNA, 1329 bp, Solanum tuberosum
gtcccaacgtacggtgtgagatgacgatgggaacaagttgccaatgaaattaactttgaaatttccgaagtatcttctcctaataattaactccattacaatttccacatactttcttcctcatcaagtctctttcctccatagccatatccccaaatatataaactcacccatcttagctatcgaaatactcatttcgattcttcactcctttgctagctttgttgcttccctttagtatgggcaatttgttgtgctgtgtacaagttgatcaatccaccgttgcaattaaggaacagtttggcaagtatcaagatgtgcttcagccaggttgccactttctgccttggtgcttcggattccagttagctggccatctctccctcagactgcaacaattggatgttcgctgcgagacaaagacaaaggataatgtgtttgtcaatgttgtggcatcaattcagtaccgtgccctggcagacaaagcaaatgatgctttctacaaactaagcaacactaagggtcaaattcaggcctatgtttttgatgtcattagagcaagtgttccaaaactcaatcttgatgatgttttcgagcagaaaaatgaaattgccaaggctgtcgaggatgaacttgagaaggctatgtcggcttatggatatgaaattgttcaaacacttatagttgatatagaaccagatgagcatgtgaagagagctatgaatgaaatcaatgctgctgctcggatgagggtggctgctaatgagaaagcagaggcggagaagattttgcaaattaaaagggctgaaggagaggcagaatcaaagtatctctcagggttaggtattgcacgacagcgtcaagcgattgtggatggtttgagagacagcgtgctcggattctcagtgaatgtgcctggaacctcagcaaaggatgtaatggacatggtcctcttaacccagtactttgacaccatgaaagaaattggcgcttccagcaaatcatctgccgtcttccttcctcatgggcctggtgctgtaagagatgtggcaagccagattcgcgatggactcctccaagcttctgtggaccattaaatgttctactatatcagaaatgtcaaatgattttcacttgaagctacctttttcattttgtgtttactttctgtaagtgtgtatatgtttggtgagtttgactttgtatttgtgaatgcctctagtacctgtatattgaaaaaaaaatactagtatctccagacctttgaagaattgtgaagtatatgctattaatagattgatgtgatatttctcctcgttaaaaaaaaaa

SEQ ID NO: 3579 - DNA, 1101 bp, Secale cereale
gatcagtctaccgtggccatcagagagcagtttgggaagtttgacagtgtgcttcagccagatcgtcaccctgcttgccttgggtcttagggaaacgtgtagttggccatctcacactcaggttgcagcagctggatgtgcgctgcgaaactaagacaaaggacaatgtgtttgtcactgttgttgcatcaattcagtaccgtcctctggctggcaaagaaagtgacgcatactacaaactgaccaacacaagatcccagattcaagcctatgtttttgatgtgatcagggcaagtgttccaaagctcaacctggatgatgctttcgtgcagaagaacgatatagcaaaggctgtggaagatgaacttgaaaaggctatgtcggcatatggctttgagatcgtgcagaccctcattgtcgacatcgagccagatgcgcacgtcaagcaggcaatgaatgagatcaatgcagctgcaaggatgagggtggctgcaaacgagaaggcggaggctgagaagatcgtccagatcaagcgtgccgagggtgaagcagaggccaagtacctgtccggcctcggtattgcccgccagcgccaggccattgtggatggcctgagggacagcgtcctgggcttctcagtcaatgtgcctggcaccactgcaaaggacgtgatggacatggtgctgatcacccagtacttcgatactatgaaagagattggcgcgtcctccaagtcctcggccgtcttcatcccccatggccctggtgcggttcgtgacatcgccacgcagatccgcgacggtcttcttcagggccagtctgcctctgacaactagtttgcttcgccggcatgaactttgaagctggtggtggtttgtggttgtgctagctattgcctacagtactgtctaatatgatgcatgccgtattattatgacttgtatggaaccatatgtggatcgtggcttaggtcgatgtgcggtatcaaaacctttaacctattgggaatgcaggatgatataagtgtgttatgaaatgctggtgatgaacttgaataaactaaaaaaaaaaaaaaaaaaaaaaaaaaaaaaaaaaaaaaaa

SEQ ID NO: 3580 - DNA, 1309 bp, Solanum phureja
gtgtgagatgacgatgggaacaagttgccaatgaaattaactttgaaatttccgaagtatcttctcctaataattaactccattacaatttccacatactttcttcctcatcaagtctctttcctccattagccatatccccaaatatataaactcacccatcttagctatcgaaatacgcatttcgattcttcactcctttgctagctttgttgcttccctttagtatgggcaatttgttgtgctgtgtacaagttgatcaatccaccgtcgcaattaaggaacagtttggcaagtatcaagatgtgcttcagccaggttgccactttctgccttggtgcttcggattccagttagctggccatctctccctcagactgcaacaattggatgttcgctgcgagacaaagacaaaggataatgtgtttgtcaatgttgtggcatcaattcagtaccgtgccctggcagacaaagcaaatgatgctttctacaaactaagcaacactaagggtcaaattcaggcctatgtttttgatgtcattagagcaagtgttccaaaactcaatcttgatgatgttttcgagcagaaaaatgaaattgccaaggctgtcgaggatgaacttgagaaggctatgtcggcttatggatatgaaattgttcaaacacttatagttgatatagaaccagatgaacatgtgaagagagctatgaatgaaatcaatgctgctgctcggatgagggtggctgctaatgagaaagcagaggcggagaagattttgcaaattaaaagggctgaaggagaggcagaatcaaagtatctctcagggttaggtattgcacgacagcgtcaagcgattgtggatggtttgagagacagcgtgctcggattctcagtgaatgtgcctggaacctcagcaaaggatgtaatggacatggtcctcttaacccagtactttgacaccatgaaagaaattggcgcttccagcaaatcatctgccgtcttccttcctcatgggcctggtgctgtaagagatgtggcaagccagattcgcgatggactcctccaagcttctgtggaccattaaatgttctactatatcagaaatatcaaatgattttcacttgaagctgcctttttcattttgtgtttactttctgtaagtgtggatatgtttggtgagtttgactttgtatttgtgaatgcctctagtacctgtatattgaaaaaaaaatactagtatctccagacctttgaagaattgtgaagtatatgctattaatagattgatgtgatatttctcctcgttaa

SEQ ID NO: 3581 - DNA, 1078 bp, Triphysaria pusilla
gggtatatctataaaaacatggctgattgtcagctaactcactatcatctgcccttgcatcaattctcaaattcctcggccaacggaaatgggaaatttattttgctgcattcaagtcgaccaatcgacagttgcgattaaggagaagtttgggaaattcaatgatgtcctagagccaggctgtcactgtctgccttggtgtttcggtagccagcttgctggccatctcactctccgactgcagcagttagacgtccgttgtgagaccaagactaaggacaatgtgtttgtcaatgttgttgcttcggttcaataccgtgccattgcggctaaggcgagcgatgctttttacaaactcagcaacacaaagggtcagattcaggcttatgtctttgatgtgataagagccagtgttccgaatatgaaccttgacgatgcttttgtgcagaaaaatgacattgccaaagctgttgaagatgagctcgaaaaggctatgtctgcctatgggtatgaaatcgtccaaactctgattgttgacatagagccggacgtgcatgttaaaagggccatgaacgaaattaatgctgctgctaggctgagggtggctgcaaacgaaaaggccgaagctgaaaagattttgcagatcaagagagcagaaggcgaagcagaagctaaatatctgtcgggtttgggtatagctcgtcaacgtcaggcgattgtagacggtctgagagacagtgtgttgggcttttctgttaacgtccccgggaccacagcaaaggatgtgatggacatggtccttgtcactcagtacttcgatacgttgaaggaaattggggcttcgtccaagtcgtcgactgttttcatcccacatggccccggcgcggttagtgatgtggcggcccagattcgtgatgggcttcttcagggttccgtggtttaagacttgtttggttaaaaataaataagactttatcgacattgtgattgcatcgtatttgtgtgatatatgttggtatgagtggagaaatgattatgtgggctatttaagaagtattagtaaaagattgtttatgtt

SEQ ID NO: 3582 - DNA, 1325 bp, Populus trichocarpa
gacatccgaatcaggctaagaaacaagtgctatagaaatagaataacaagaacagacgtcgctcgtcaacagctctgtttcggcttcctttccctttgcttaaagccagagaagatgggtaatctgtgttgttgcgtacaagttgatcagtcctcagtagctataaaggagacatttggaaagtttgaagcagttcttgatcctggatgtcattgccttccttggttccttggaagccagctcgcaggccatctgtctctgaggttgcagcagttggatgtccgatgtgagaccaagacgaaggacaacgtttttgtcaatgttgttgcatctattcaatatcgtgccctggcagacaaggcaagtgatgctttctacaaactaaccaacacaaggactcaaatccaggcttatgtttttgatgtaataagggccagtgtcccaaaacttaatctcgatgatgtgtttgagcagaagaatgagatagccaaagctgtggaagatgaacttggaaaggctatgtctgcttatggatatgagattgtgcaaacgctcattgttgatatagaaccagatgagcatgtgaagcgggcaatgaatgagatcaatgcagctgcaagactgagagtggcggctaatgagaaggcagaggctgagaagattctacaaatcaagagagctgagggtgaggctgaatcaaagtatctctctggactgggtattgctcgccagcgacaagcaattgtggatggcttgagagatagcgtgttgggcttctctgagaatgtgccagggacctctgcaaaggatgtcatggacatggtcctggtcacccagtacttcgacacaatgaaggaaatcggtgctgcctcgaaatcctctgctgtgtttattcctcatggacctggtgctattcgtgatgttgctactcagattcgagatggacttcttcaggcttcggcccacaagtaattgtgcagattttcaaagcttttacagggtttgtgtttgagaggagcttatgcttgctatatatttctgtaaaggtttcgcatgttgaattctgggttttggtgatttttgttttgttttccatgtgagagttgcatgaatctgatattctctcaattttgggagtttgtgaatgataattgaatgatgctttatactgtgcaagtggatacagtagaaggcaaacattaaatagtacatataaaaaagtgctgctgtggttaaattagtaatatttttttccccaacgatgattgctagtattcctcattttctacttgcagagtttagctcgctacatgtctctgtcactt

SEQ ID NO: 3583 - DNA, 1290 bp, Nicotiana benthamiana
gtctgcatcattgttaatatttctccaagagtatattccgtctattctccatttccacgaacttccttacaagtctctccccctccgaaaccccccaacacacacacacacaaccaaacagctcatataaaaagacactccctccagctagcgaagcccaattcaaaaatcatcagacctttttgctgttcctgcgctttgttgcttgtttcgtaagtcagtatgggcaatttgttttgctgtgtacaagttgatcaatccacggttgcaattacggagcagtttggcaagtatcaagatgtgcttcagcctggttgccactgtctgccttggttctttggatttcagctggctggccatctctccctcagggtgcagcaactggatgttcgctgtgagacaaagacaaaggataatgtatttgtcaatgtagtggcatcaattcagtaccgtgctcttgcagacaaagcaaatgatgctttctacagactaaccaacactaagggtcaaattcaagcctatgttttcgatgtcataagagcaagtgttccaaaactcaatcttgatgatgtttttgagcagaaaaatgatattgccagggctgttgaggatgaacttgagaaggctatgtcggcttatgggtatgaaattgttcagacacttatagttgatatagaaccagatgagcatgtgaagagagctatgaatgaaatcaatgctgctgctcggatgaggttggctgctaatgagaaggcagaggctgagaagattttacaaattaaaagggctgaaggagaggcagagtcaaagtatctctcaggattaggtattgcacgacagcgtcaagcaattgtggatggtttaagagacagtgtgcttggcttctcagtgaatgtacctggaacctcggcgaaggatgttatggacatggtccttttaactcagtactttgacaccatgaaagaaattggcgcttccagcaaatcatctgccgttttccttcctcatgggcctggtgctgtaagagatgtggcaagccagattcgcgacggactccttcaagcttctacggagcattaaatgttctctctcagaaatgttaatgtctttcccttgaaacagctattttccctgtctttattttgtcaagtgtggaaatatgtagtgagattgactttgaagttgtgaatatactattataccatgtacagaagcatgtaagtttttgaagatcttcagaccctttttgaagaattctgaattgctatctgatatttggcagcttacctt

SEQ ID NO: 3584 - DNA, 1109 bp, Eschscholzia californica
aagtttgtatttttcttgttgagcctgttactagcatgggaaatctactttgttgtgtacaagtcgaccaatcgacagttgctatcagggaaaggttcggaaaattcgatgaagtacttaccccaggatgtcattgcctaccatggttccttgggagtcagttagccggggaactctcacttagggttcaacagctcgatgtgaaatgtgagaccaagacaaaggacaatgtcttcgtgaacgttgttgcatctattcaatatcgtgctttagcagataaggcaagcgatgctttctataagctttcaaacactcggggccaaatccaggcctatgtttttgatgtgattagagcaagtgttccaaagctacttttggatgatgtttttgagcaaaagaacgaaattgctaaagctgtagaagaagaacttgaaaaggccatgtcagcttatggatatgagattgtgcaaaccctcattgttgatatagagccagatgagcatgtgaagcgggcaatgaatgaaatcaatgcagctgcaaggatgaggttggcagcaaatgaaaaggcagaagctgagaaaattctacagattaagcgagcagaaggtgaggccgagtcgaaatatctatccggattgggaattgcccgacaacgtcaagcgattgtagacgggctaagagacagtgtgttagggttttctgtgaacgtgccagggactactgcgaaagacgtcatggatatggtacttgtgacacagtacttcgatacaatgaaagaaattggagcgtcttctaaatcatctgctgtgttcatccctcacggacctggagctgttcgtgatgttgctacccagatccgtgatggactacttcaggctaataatggtcagctcaactaagcaaagttctttatcgtagttcatccatgtttgttttgaaataggcatctagtaaattcattagcagtattttgatttcttaatatgcaaattacttctcttttttttggacttgcaatacgaagttgtgtatatccacatttgctttttcttggttatgttttgtgacttcattcgatacctataaataaatgtttgggatttgttttt

SEQ ID NO: 3585 - DNA, 1418 bp, Musa acuminata
aacagccaaaacgtccatctctctggtgcagtttctgcgcattttccagcgtcaaactcgataattccatgatagttttctttgaagaacttgcatacagctcatcatcctctatccaatatcacatccaggttgacttgactttagtgctctaacaattgattcaaaattgctacttgcatccgctcttgcaatcctctcatctatatatctctctgtgtttgtacgtctcccttgtcaactggcgttctctttgttcggttgtcatctccttgtcgatcgaagctgctgggggataagccatgggtcaaatgctttgctgcgttcaagtagagcaatctaccgttgcaatcaaggaatcatttgggaagtatgacgatgtgcttcaaccaggatgccactgcttgccatgggttttcggaaagagaattgccggccggctgtcactccggatgaaacagctggatgtgaagtgtgagacgaagacaaaggacaatgtgttcgtcaatgtggttgcttccatccaataccgtgctctgcctgacaaagcaaatgatgccttttacaagcttagcaacacccagtctcagatccaagcttatgtgttcgatgtgatcagagccagcgtgccgaagctcaacctggacgacgctttcgagcagaagaacgagatagcccgagccgtggaagaggagctcgagaaggccatgtctgcctacggtttcgaaatcgttcagactctcatcgtcgacatggagccagacgaacatgtgaaacgagccatgaacgagatcaacgcagctgcgaggttgagggtggcggcgaacgagaaggccgaagccgagaagatcgtgcagatcaagagggcggaaggggaggcggaagccaagtacttgtcgggggtaggtatcgcccggcagcgccaggcgatcgtggacgggctgagagacagcgtgctgggcttctcggtgaacgtgccggggacgactccgaaggatgtgttggacatggtgctcatcacgcagtacttcgacaccatgaaggagatcggcgccagctccaagtcttcgtctgtgttcatcccccacgggccgggtgctgtgcgtgacatcgccgcgcaggtccgagatgggctgctgcaagcagctcctctccagtgagctaccgctgcctgcttgatcctttgtgatgtgtcgataagtacgtgagagatggaggaatagtgttcagctcgtcttttatcgccgtgctgtgtgtgtgcgttgttctttcagaacgagcgatgaactcaaataatttggaaataatttcagaacaagcgatgtattagaaattgatggcataaatgtcgtgataaatatgtcttatcaaaataaattatgcctacatacactataattaacaagggtaacttttca

SEQ ID NO: 3586 - DNA, 1191 bp, Nicotiana benthamiana
tcttgatatctgttgtttatgctgtctttgcagaatatgggaaatttgttctgttgtgttcaagttgatcaatccacagttgcaattaaggagcaatttggcaagtatcaggatgtgcttgagccaggttgccactgtgtgccttggttccttggaagccagttggctggtcatctctccctcagagtgcagcaactagatgtgcgctgcgaaaccaagacaaaggacaatgtatttgtcaatgttgtcgcatcaattcagtatcgtgccctggcggacaaagcaaatgatgctttctacaaactaagtaacactaagggtcaaattcaggcttatgtttttgatgtcataagagcaagtgttccaaaactcaatctggataatgtctttgagcaaaaaaatgaaattgctaaggctgttgaagaggaacttgagaaagctatgtcagcttatggatatgaaattgttcagacacttatagttgatatagtaccagatgagcatgtgaagagggctatgaatgaaatcaacgctgctgctaggttgagggtggctgctaatgagaaggcagaagctgagaagattttgcaaattaagagggctgaaggggaggccgagtctaagtatctcgcaggcttaggtattgcacgacaacgtcaagcaattgtggatggtctgagagagagtgtgctaggattttcagtcaatgtgcctggaactagtgcaaaggatgttatggacatggtcctcgtaacccagtactttgacacaatgaaagaaattggtgcttccagcaaatcatctgctgtcttcatcccccacgggcctggtgctgtaagagatgtggcacagcagatccgtgatggacttcttcaggcttctgttgagcattaaataattattgctcatgaatgtaaaacgggtttcacatcaagcaagcttttgtcatttttagtcttttctttcttaaatatggaaatatgtggtgactttgactttgttagaaattggtgaatcccaacactatctatgtttataatcggattgtgaggttttgaatatttacagaagaaatttttaaagaattttcaagttgttctacagcatcacatatacttttgcagctacaatgatcccatactctcttcggcagaagtaactcattttctatctatgctgctcggaaaagtt

SEQ ID NO: 3587 - DNA, 1099 bp, Capsicum annuum
actcctttgctagctcttcccctctgctttagtatgggcaatttgttgtgctgtgtacaagttgatcaatccaccgtcgcaattacggagcagtttggcaagtatcaagatgtgctccagccagggtgccactgtttgccttggttcctcgggtaccagttagctggcaatctttccctcagggtgcagcaacttgatgttcgctgtgaaacaaagacaaaggataatgtgtttgtcaatgttgtggcatcaattcagtatcgtgccctggcagagaaagcaaatgatgctttttacaaactaagcaacactaagggtcaaattcaggcttatgtttttgatgtcataagagcaagtgttccaaaactcaatcttgatgatgtttttgagcagaaaaatgaaattgccagggctgtcgaggaggagcttgagaaggctatgtcggcttatggatttgaaattgttcagacacttatagttgatatagaaccagatgagcatgtgaagagagctatgaatgaaattaatgctgctgctcggatgagggtggctgctaacgagaaggcagaggcggaaaagatcttacaaattaaaagggctgaaggagaggcggagtcaaagtatctctcagggttaggtattgcacgacagcgtcaagcaattgtggatggtctaagagacagtgtgctcggattctcagtgaatgtccctggaacctcagcaaaggatgttatggacatggtcctcttgacccagtattttgacaccatgaaagaaattggcgcttccagcaaatcatctgccgtcttccttcctcatgggcctggtgctgtaagagatgtggcaagccagattcgcgatggactccttcaagcttctgtggaccattaaatgttctctccctcagaaatgtcaaatgagtttcactctaatcagccttttcctttttgtgtttactttctgaagtgtggatatgtttggtgagtttggctttatatttgtgaatgccactagtacctatgtatattgtaaaaatgttaagatctcccagacctttgaagaattgtcaagtactattaatagattgatatgatattgt

SEQ ID NO: 3588 - DNA, 1094 bp, Arabidopsis thaliana
aacttagctcataagcatatctaatcggagctcggagaaatttcggttgtgaagagaagaaagatggggaatttgttttgttgtgtgcaagtggatcaatcaacggtagcgataaaggaaacattcgggaaattcgaagatgttcttgagcctggttgccattttcttccatggtgtcttggtagtcaagttgctggttacctctctctaagggttcagcaattggacgttcgttgcgagacaaagactaaggacaatgtgtttgttaatgttgttgcatcgattcagtaccgtgctttagctaataaggcaaatgatgcgtactacaagctcagtaacacaaggggtcagattcaagcttatgtgtttgatgttattagagcgagtgtcccgaagttgcttcttgatgatgtctttgagcagaagaatgatattgcgaaagctgttgaagaggagctcgagaaggcaatgtcggcttacggttatgagattgtgcaaactctcattgttgatatcgagcctgatgaacatgtcaaacgggccatgaacgaaatcaacgctgctgcaaggatgagattggctgcaaacgaaaaggcagaggcagagaaaatcctacagattaagagagctgaaggtgaagctgagtccaagtacctctctggtcttggtatcgcccgtcagaggcaggcgattgtcgatggattacgcgacagtgttttgggtttcgctgtgaatgtccctgggacaactgctaaagatgtgatggacatggtgctagttacacagtactttgacacaatgaaggagattggtgctagctccaagtcgtctgccgtgttcatacctcatggaccaggagcggttcgtgatgtggcttctcagattagagatggccttcttcaaggctcgtccgcaaacctgtgaagtgaattcactgattatgtcctcttttcttttgactatggtgtgattatcatcttcttctttcttttggattatgttcgaactcttttgttttggttttcttatttctatttgtatagacttattgggggtttataattcatatagaatattaaaacgtgtttagtact

SEQ ID NO: 3589 - DNA, 1137 bp, Musa acuminata
ggagatagcatacctctcatcatcttctggcatctcgatttgatctcgtgtcatatttatctcgtatttccaggttttattttgtccttcacaggtgtcctcaggcgataaacgatgggtcaagcactttgctgtgtgaaagtagatcaatcttctgtcgcaattaaggaatcattcggaaagtttgaggatgttcttctgccaggatgccattgtatgccttggttccttgggaaaaaagtttctgggcggctctcactaaggttgcaacagctggatgttaaatgtgaaacaaaaacaaaggataatgtttttgtgaatgttgtcgcatctgtacagtatcatgctctggctgagaaagcaagtgatgcattttacaagctgagcaacacaagatctcaaatacaagcctatgtgtttgacgtaatcagagcgagcgtcccaaaactgaacctggatgatgcttttgagcagaagaatgacattgcaaaggcagtggaagacgaacttgagaaggctatgtcagcttatggttatgaaatcgtgcagacactcattgttgatattgaaccagacgtacatgtcaaacgagcaatgaatgaaattaatgcagctgcaaggttaagggtggcagcgaatgagaaagctgaggctgagaagatcatccaaatcaagcgagcagagggcgaggcagaagccaagtatctgtcaggtctaggtattgcccgtcaacgccaagccatcgtagatggcctgagggacagtgtgctcggcttctcggtcaacgtaccaggcaccacagcaaaggatgtgatggacatggtcctaatcacacaatacttcgacaccatgaaggagatcggtgcacagtccaaatcttcggctgttttcatacctcatgggcctggctctgtccgtgatgttgcagaccagatccgtgatggactgcttcaagcatccactcacaactgaattcctcgtatataggtgccgtacggttctatcatcagttactaaattgcatgtttgatgtgtgatactatggcctatgcttttctgtactttcgattgtgatgtcgagggaccagagactcgctagaaatggctttatgatacataatacatgtgtggatgtgg

SEQ ID NO: 3590 - DNA, 1793 bp, Eucalyptus grandis
ttttttttttccttatctctaagcaatttcattgcatctcattccttaaaataaaagtatcaataagaatctttaggctgatgtcaatctcaaacatacctgatataaaagacgaagattgattttaatatattttcgcagatcttgaattttctaagtacaatcttatcccacgaatctctcatcaacacttcattccctcagatgcaaagtatcaaaatccccttcaaattcacccagtaagtatcattccgattaggtcgtggatgggcagtcaatctcggattcgttcaactccgctgtcaacccacagaatctctccttttccgcactcccactccatccctccccttcaaatccggggccacggcgtcgcccccagccacgcccagtctcactgagcacggattatttactaccttttcgcgccacccttcttcgccaggacgcccggacaggcacgaaggaacgacgagggaggtctcgaagaagtctcacgatcctatcttcctccaagtcattctgtgccgagccctctgacgctttggtactagaaaatttgaaagacatataagatgggtaacctgctctgctgctgcgttcaagttgaccagtccacagtagctattaaggaaagatttggtaagtttcaagaagtaatggaaccagggtgccactgtcttccttggtttctcggaagtcagctcgctggccatctctcactccgattgcagcagttggatgtgaaatgtgaaaccaagaccaaggacaatgtttttgtcaatgttgttgcatctgtgcaataccgagcccttgcaggcaaagcaagtgatgccttttacaagctcaccaacacaaggagtcagatccaggcctacgtgtttgatgtgatcagagctagtgttccaaagctaaacttggatgatgcttttgaacagaagaatgaaattgccaaagctgttgaagatgaacttgaaaaggctatgtctgcctatggatatgagattgtgcaaactctgatcgttgacattgaaccggatgaacgtgttaagcgagctatgaatgaaattaatgctgctgcaagactgagggttgcagcaaacgagaaggctgaagcggagaaaattctgcaaatcaagaaagctgaaggcgaggctgagtccaagtaccttgctggtctgggtattgctcgccagcgtcaggccattgtggatggtttaagagatagtgtgcttggcttctcagagaaagttccgggaacaaccgcaaaagatgtcatggacatggttcttgtgacgcaatactttgacaccatgaaggaaatcggtgcatcatcaaaatcttctgccgtgttcattccccatggtcctggggcaatccgtgatgtgaccacccagatccgtgatggtcttcttcaagcgtcaacacaccagtaaatgtgctagtataagtctggtatggcctctaaataattgagatatgaactattctgtcttagctaatgtagatatttgcttcaaagtgctagaaactacaatgtttatagggtgattaatgctttcatattcggttctcatatcagacgatttagtaatgtaaatatgcatcttgatgaatgatctacttaagaagttagttcttcaatttcccttttttttgtccagtcagtagcataatatcttaaaccttacacagtcatctgttgctttgtaatatgctccaacagatacggtccatttgttgtgcaaagccaatatatgcaatgctattgtcagaaaataatttgtaatcaa
